United States Patent 7,745,391 (HUMAN THROMBOSPONDIN POLYPEPTIDE) - sequence listing, part 293

SEQ ID NO: 965247 - protein, 339 aa, Homo sapiens
LRLGFMPPGGHLSPRSGDLLRPWVCRSRFQQAEGLPFVLSWDIWLLPRDKWRYICSLTQYQYTGLCVFCSEDRQTVCPKTRTGRTSKYQRVVSCSVLSCCFLGKSLNVDNAPRLWVLRAHTFVRKHRGRESGLWECLEWHSVGCGSGTSATWVNGSMGSRAEQHDSVISSYFLSVGLRLVVSTKPVDALDLLADRTSHYRYCQKKFVLSGQSLHAEMLLQPLIGGRTSLDLGGTRLLLNVSWRVVGLTAYMNFLQSITVMLHILWAAGIARVLKYGYVVFSWCTPVWIWPLACVVAGASAATGVLAGRKSPILESSGPAFRSGTGRGPLPPKGGAPGRS

SEQ ID NO: 965248 - protein, 179 aa, Homo sapiens
KYPRLIMLRKKKEEGVIDSSDNRNRCVKQKYWDVKADGPSVFITRHGLFCNGRRLREQIKKYEAPISVLMLCTRDETRQQAPTGLPLLYYRFYGARLLSSKATLGSAHDFKPCKLLDRIAQHYSMKGRIVRIVTTLLYEGTRSCMQYWVRHKMALLKNTMCSEKEPWPKGDFVKAVTML

SEQ ID NO: 965249 - protein, 67 aa, Homo sapiens
MWGGTATTQENKRRSENRWVGRAAKKLAKTTWRGHNRSVVWRRHRKIIQRERHSTDPGKKKTIRKRG

SEQ ID NO: 965250 - protein, 403 aa, Homo sapiens
MARQGGCGHQRRSCGPPEECLVVSFSVGGPPVRHTLSVSPVVPLSTPRLSPEKLVPLLSPLWPLMCDQVCLSNISPLFSLYLCATLSSHLSPCVDALFLSLFPSVCLSPCLLFSPAACISQTGPIMCGVKFNKTSTTVEERPIYHIRGKHLPTGGNIICSFPHISLLKEHLPFITRFIKQLRISGGQKRLPVMIKYVAGHKQLVLYHISCTNGCCLPPPCFNSPPLFWRRGVANSISGPWLSRLVSRQCGRIDLFSKCGWPPPRQSGGHSKISHRLILRGGGEPTPFRARHNRAQHRRIIGWMRETDPIMYEGGGPTRRTLRHIWDASALPPEGKILRTSWCCYHADALPPVTRALPHMQWSLTWSVFSHRGGVPSILSHVLFIVHITLPISGNMPVECAKDS

SEQ ID NO: 965251 - protein, 171 aa, Homo sapiens
MSGFPPHPVPNASSTVRCLPPDSKVSQCNAPRPLSFTEGQPCSCHKQGCRRSSWKGQQSSSGFSKHSWGPGILHALKGTCPESDSQSVTGASGLPAICVYSRTGLGGFLRPESAELALPLQGFRAIGGSPSGYVVRSLRCEKGPPHGRSVPRVAGRGFSTTVGTHPGPFGP

SEQ ID NO: 965252 - protein, 788 aa, Homo sapiens
GGKHIRLWDRRSVFVSGPPTGDDDDDDDDDDDDDDDDDDDDDDDDDDDDYRRRRRTYVRTHDARLLLAASCSCCSGRGGVGRYLSGRSYRRRRSSDDRSASTERNERSMRSIVPRDRAKVRLDVEFERSRSSLVVSSLVDDSDYYFLPCLMRAMLFLAAVVIVAGRLLIVVDLLLLIECCWLVGCLIDDEIGGSMVVEGWVSDRIVGGWRGEIQDSNSKDATVLDEVSSLRFYLTLNSTLQIASFRFSSLSLVMVLVYLRYSHPFLSIAIFACHWLGDDLHTVYYTFTYHMLWLFTMPCYLNCTGSTSHACEWQGNPCWRRHGSVADGEDGAPAGVGQGAGGEARGRGYGRVSQYAPRQHSTYSPAHGRGQDSGRCQQRPETGAEDGTVQDLHEARAASRTRTDTDSSRNSPPDRAATRRLVRYEYDTVPDTLDSDSNRTVRMGQSREGDRTSIHHDSHEEVETRATGRRKKEIRARSESDRYARVRIALKIRQATGREDQTAQRPVRTVSTVCITPARPARSIPKHAVGSTASLTLSLLCRFVRFNCSCDSSVASLSCACRSFAAPSLIDHNGEMCETSCTLLSVLLCVWCVRRWSDIIEQTTCGRADLSESREIDSGRLERELQQHDGCSTMTRDSPTELDAPGPWMPDCRLHPNGRLSVPGSSGRTSRLADDANRKDTRHSRQKTEGPGTLRRRRPSDAAAPHVMRPDDVTSPTAETENSDTREGTANGQSATRERQKFEGGDIELHSQTREDPPTANGSPAHDREVSPRPLNLERLTPAPGPCI

SEQ ID NO: 965253 - protein, 732 aa, Homo sapiens
WAQDTEGPVRLQQQQQQQQQQQQQQQQQQQQQQQQQQQQQQQQQQQQQQQQQQQQQQQQQQQQQQQQQQQPLYTGGAVSTQQEEADGTEGGGGGRARQYVRSVGAGGGDRRKSDEEEKSEVQERRSDVVGRQQEDGRTHLATRDKPLRSPRPPPGSYILLTSLPEQEREKRVHPSLPRLPPSVRPAACMRAGAPSMSYPRLRPPRTSISNRLQLAALPDLPTYLTKRQLTYYARNGRLPQLRIPRYARRRHAPTHLANRCKHVALPRSLDWIDGGEEGRKERRQAQGEPVPPGDRATEKRDVAGPRAERRGKERWAGEAAPSEAGKERSSARPQQPATKKRHERREEDEREEERQAERGDQADDAGRPAEQAEAPPARSQARRAQARQEVSQIPGKRPDRRPPAVPARTARRRQPGTRTDSLPSASSRPTTPPSGGHGAGTLRPPPTETSEQSDRTAQRLSATARGESRERQAGSPAQLASDEAAAQSQHNTVSQYSSNGRARTPNDRTTRERVQEKEGHHDTNDDTHKSPKARRGEDGQTDPPTNRTTGMRQKKNADQTDETRREEKRDSDERERRAATGGTSARERTRTTTEKRGRRITRRAAQWQHVESRQGGGATANVASSEGAARDVQAAEGPTSERRVRQERQTSHSGKEQRERRKEQQGARQDGGRREREAGERAEEKSCRGGREKSEQAVEQAAETERSSEKQREERDSCSPSQRSALSPHAEE

SEQ ID NO: 965254 - protein, 269 aa, Homo sapiens
MAMDQAGVSGRGQNVQIAGGLAEGFVRALAELHSQNTLPSRHVAAQPVNGAGMVAPVVGLGGRRQRQRWLQRQSCTELSRRVYANPLATSTPGALSSWLAVRPPYWQRPCHGLFPLATLVMQLAAVAGSWAQQMPVQHPRVMLALKGGASVQCPEYAAGRRLARTHVPRDQTNVESPQSGSKAERKRHDGTSIALLHGVSVCRKLEENRPGLVGEKSGETPFESLEENRSEAVAGSHQDAEIKLASTGGENPGVWGPQGRLNNGGKGPS

SEQ ID NO: 965255 - protein, 274 aa, Homo sapiens
MGKVKVGVNGFGSYGRLVTRLLITLVQWILLPSMTPSLTSKLHGLHVTKYDSTHGKFHGSVKADNGKLVINGNPITIFQERDPSKINVEAMLALSTSLVVPLAVLHHHGEGWGSFSKGGAKRVYSSSAPSADAPMFVMGVNSEKYDNSFKIISNGSWQQELLSYPGARSVHDNLGIVEGLMTTSPCHHWQPEDCGIAPLRVKLWRDGRGALPELIIPLSSDLGGWPRQCDQGLPLSLGTGISLALALPCTHCQRVTRWTELAFRKPGNMRLHKV

SEQ ID NO: 965256 - protein, 429 aa, Homo sapiens
SPAAYLVGSAARKAMPDSGFLGAAVPTSCVTQLLSAVLCCADVPNEIMKRGTGCAVHCIIVTPAVCACDGMTMFLGQTVLATCDAARTLCGSVCLYVPSTLKPLLLSVVNTMCSQSAHTQCALHAQCNGSTAEKCPQEEPSASNVAVYLPDARAPPRIQGGYLDARYHVTSVPEPGTMQSIFPPQRLRYATSGIPAARDDGTAAFQLFRVRPPAAKVYTASPTRALRPPHTRTHSRPFPVTLGPRPVIHPRLGAAPNVGRSNILTVRIKREHTAAPFLGDAPQPSPVRYTICCGLRDYAIMLLMGPHPHRPWMRRPTTGLRILGLDAHTSIVGSSPHPQMRAVAHPYLYGSDTISPSSIQRQIDALPPILHTYHTHTLSRGRQKMAATHTWSAMVPSTIITDYSYGSHFWLCGASPPRHWIGNSTCAPL

SEQ ID NO: 965257 - protein, 636 aa, Homo sapiens
MNHTCPNHSSLLSTAGQPPNDEMLKEEHEVAVLGAPHNPAHPERSNVIHIQQTRPPLHDTVSVWSLIQPPITITEPPCLHWRIYTTPFRPSSDENAPAPTHNALSPHKQMQETAHTSIKAMPHIHHHHMTLEQSLYNYDPRKDTKNTDYQTRTNYTRNDQHMQQTPHQHPTNHTPPAHTATPHHRTHTHHATTPDARAYAHTRLDRTEPQTTTHEQHIPATPTAKQTPQMSTNPRLHPTHHDTRTPTSKRTSMQRHQLQLAADPPTHPTTLRRHPLAPTTEHQHDSRTNPTLTLLYTPKTRDNKHHTHHDRNQKTQQHSIKNHDLKSTHIQLHHQGRHAHAAKRYKRTNTNNKKHDDRQQPTPTQNNTANTKLTPSEPPTTQLHEHTHTYRDDTREREQTTRQHKDERLRASDTKRTPRQANTNNSSMKRANDEDSSARDARTDRRAPTFTHKPRIARERIQTHINNREIHAERITAQRTTTREAHPKRAARATISHGMISDDTSTMKQDNTRSTDTTTHHALRTPDTHLHARSSVATEHATTRTSNDDERTYTTTARRTKDRYEHSEARLRRDQSTRCPSTERCYRTSKRNRYVQTEQAPTKRDSYSHQTRTSRRHSTGRMITRELDTQTHPSTR

SEQ ID NO: 965258 - protein, 141 aa, Homo sapiens
TPGTRGLWVCTVMFVVEGHSCCYSECVSMDVWAIGSRSLGRSMSVLWGEGVLTYWEDAPVCIRDAACHASLSHCMRSTLLEVVWCSSEVVYRGGVALPRISDRCLLHNQFVGSGVRRGVGGMCSALGERVILFHRRRKRMV

SEQ ID NO: 965259 - protein, 173 aa, Homo sapiens
PTLIAWVLSYGLTMDEMCVLLGERLGSSCRLSVRSHPLGSEFAPLSLWVLDQDQTKRPGFTVPGAKGPSLVRAFLLNSAGQGLVTVKCVQCCECKCNLTEEVLLQARQTATANERLLTECFGTKCAWAALRVISPSDLVRRARSKVFHLNCFTCMMCNKQLSTWRGTLDHRRE

SEQ ID NO: 965260 - protein, 200 aa, Homo sapiens
EIELPVKRRAKHRQDEKTLWSFDILMQIQYLMLPDAALKISVGATSDARTQPPSSDMLESSSVKANYYTQLIQELDQRNRVILGKQRIVLILESDINNRVNELDVWIQDIPMCARALIKRFVVFKRVKVLRDLSSDRSNPGRFLSTSNSLPVRRGQEKMKAYLQQSAFPREMIHLNLVLYPHPAKNRVVKMAEPGNRIRT

SEQ ID NO: 965261 - protein, 239 aa, Homo sapiens
GALRSVRARVHWPICAPPPAVCADAWCASRAGLLPVSVRTERGPAVRGSTPSAVAPGFAASRRPTRRDRAGAAGWRGLCVNASAVSRLRAYLLPGPPGPGNAKESEEERAPASVESPSVSSTHRVCDPKFPAPPFKEIIIKKGHAKRRARCYKVDYESQMHMIPRNSPPESSGKTEVWSLPERHGRTRDYLKFLNVLSPGLVPFQVGALQGSQKNRVPQGERLAVWNMALRNPMKESRP

SEQ ID NO: 965262 - protein, 200 aa, Homo sapiens
MGGVVDNYTHNAAAHTLDAPPCRTYSAETKHATLSADNVEAAQNIIQHAGLPAGYRGSLRYTAHTPPSRRHAHRPPQTTTSSKYAGPPNLAAGDLNGVSPQAGANSGGETQRTTQSECGYRGATQQRRGDFNAPTHRHPTLYTKTGNNTTTNTHPKISRPGSPIRPYRQHTTTYYPAVREHTRTHTQYEDPPANATTTEP

SEQ ID NO: 965263 - protein, 106 aa, Homo sapiens
KPSRSLLEGGDIACVLVSIRGLDGARMGDKGGFVNSSKSLQLIYYFFFFFFFLETESHSGWPGAGSAAGVISGSLANLRLPSSGDWSWPQVPKWAGDYRAPTIMPS

SEQ ID NO: 965264 - protein, 169 aa, Homo sapiens
MSGDTPAAGDRRVSTRPVSLTRILASVAFSGAALHKCPHGAGLNILAPVRKGDRVLVRESVTQVPEGKEAALRRAANDFHPRVTVRLEEHRIGTRGIYRSPRSLWWGDLSVGKTCLINRFCKDTFDKNYKATIGVDFEMERFEVLGIPFSLQLWDTLGRKRFNALLTTI

SEQ ID NO: 965265 - protein, 72 aa, Homo sapiens
VFCFQAKENKSKTQKAVLNPGPGMQGFAWERQPVLIAPLGFRISPGVHFPAMVDSVTARICPTACERWDVEA

SEQ ID NO: 965266 - protein, 403 aa, Homo sapiens
MLCDDQGAAEYDKDGNLRPWWKNSSVEAFKLSDPDVHWYEVTYQVKLQAVKREAELNRDGITLGGEHSARPTVGLKDALYSACLPYTSGGSKNGGCSPLDSTTLGLNTNHSRFFITVGFALGLVLRTGRPEQLTDAYGLQIDRIAHNKAHSSLYPASSAFTLFQNSLRERYSRIHFTCLGQHLGTARTNEIPSHQQTLAESLLGVKVIRNVRQQVKPYKESAPRERARKREVCSATVEIPPNSRTLPRGAQFLSSNMAPVFGDRFPWGGPPGAFSLSNGRGWRDCITAREKPEMPQLGCYGASSIDGLEPGNLLGVPPWFKRRPGNMFPEGRAIGFVWWPHTFSSHSGNCSEVWHWARCGVQITEGRGAPPRPCEQETRRRNTVATQCSHLCRSPVGCFHRSM

SEQ ID NO: 965267 - protein, 248 aa, Homo sapiens
WRLWNQNTGIVGSITGSKYYVRILSTIGSGAVKAQRLSGPPKHSNALVDVLPPEADRSIMMLTSEQKPDVMYADYRRHGGIQKQEVREARGAPAQRIVELYKQIGIEVPPEAVLMYGSHGGVWEDQCGKGGGDITQKLHAIRVVGFGAVYRSIWVRAPDDGSGMCSAVARMNASCHHRSEMEIDAVATKRFDAQTGADEGGSEDPAWSCWITMDGFDPNVNVAVIMAQKEQRPWIRPWFGQDGVDGRD

SEQ ID NO: 965268 - protein, 210 aa, Homo sapiens
MWVTTHTSLCGRREVDLHVSPAQTVCVSFTHIFLASFSLPVVWRGAPSLFSVCACVRTVRRRFSTQRERECERIFSRADKCRPRSVFHRALLCARRLLGSAHPAVVIHTALWTISHALMCPAAIRRHTNDVLHHNTTPLLRLSTTISYTTSSAAAMINDVFVPPCCLRRTKTTSVLTQAPLILILLCYLLVVACSTNNTTSSLLGRQYII

SEQ ID NO: 965269 - protein, 320 aa, Homo sapiens
GFLVNEGPHCPQLERRDGSSIRQNTLVYYKLEGGRRVTPPKGRSPPGVELTPSAWPLPGRMKTDRSLIKLKTQTFHGMYFLEACALRGSGKPGPFEITGVYSLQGQPVEGPACCAAWRKLLQAAPPNISLHRIVDKMHDSNTGIRSRPQHGAGKHAMRIDASVGSSAGGLASSPTSFSGPAVCEAVDPLPPGLMECERSSGLMGSPKAVGSQFASGGSGSSSVLDDSHQPCYTFAESYRKHDKAQRKNLSPEALVDVHVATVADTKAYRGQSQGAQRRDNSGTVDEHMAPTARIPADRPYMITLPRHRETAQSAGNNTHR

SEQ ID NO: 965270 - protein, 360 aa, Homo sapiens
MFGNDISPGDMAEKVRTLVLALVNSTSDQIDGSSTCKAPMKPQTFPLRPFVIPFLKAKLPLLQRELLHQRYGLAQADPIPDTWLRHEHLLLNSKHCIALLTSYRARSMAGAHGNLAHSRPKVPAAGTQHAAISLRISSTTNCLPAGHPCHNEKLMYQITPCLPPVAPRPCLFNPDAPSLISTEGPTFHSLTPSNLFTATLHPLPPDYSATLSSTLLFRATPTNDCLRKHFAPQSRSLHTSIHPFGILTIALRYVPALQARLTSTPPAPTTGQRRAAPPLATPQPPHPMTPCKSHNPTCPPLRQEGKHTHRAAPRTGARIPRRPHPYPTPQTPEPSSDATPHQSTQENDKHADHNSDTHTH

SEQ ID NO: 965271 - protein, 221 aa, Homo sapiens
LGVKQVMSVLTKWIPLRPPYSQRRYEEIVNGSQTLHIKKIGYYPSTVAFCAKFTGWNGDNMTGAKCYAYALVQGDGTVTRKDGNAMWNQRCIESSGTASYHQLVPTDKDPCACLSRMSTKLVVLVLFLLARLETGVLKGRVWWITFAPDHIVDNREMLQICRRIVTMNALSEALPGDQVWCFNVKNVSVKDVRRGNVAEWLAKMTHTNGTHAGFTRSGDYP

SEQ ID NO: 965272 - protein, 267 aa, Homo sapiens
TRSAQTRLAMKPGFSPRGGGFGGRGGFGDRGGRGVPRGLWLGCRGRGGGFSKCLWDDGGGGRLAGWLVDAEDGKRVGGGFHSGGNLGVVVAGQGKNTGWGKNPRSGGAHTDSSLTGLDASNLRPIGRGGFGFPFSKPSLGTDRDNRNRMHIGSNRKGRTPIWGGLSPPPFSEDGGKTTFPEAGATYSTFGGATAKWNKPHTEWVSITAGNFLLGDSDGIGRTNTSHRSPQQRPHFGGKTPPPFFPPGPFSRIPGHAFNGSPQVAPHG

SEQ ID NO: 965273 - protein, 241 aa, Homo sapiens
CCSSAVLSELRTKIDPTIVPGCQNGGGKYLVQSELYLRYSPNRKFPTILLRRLQRVRTEGDKTQQQRFTSCLRMIVLMAEAIGSLINTAGELAAVKADFGYKLVLDQLQLCTRRVRETQIALKPTELSTHHWRFYLRLGVTIQRGSDNHSLTVPDACTDKQLTQSQDLIHHFCALAHSSRQPLREFPSVYTHTQMAASVSLHHCTVILRCNYALSIKLFRYTHLRFRVPHGLTRFTLPLLL

SEQ ID NO: 965274 - protein, 277 aa, Homo sapiens
KEEQPPVPSSPTEEEEEEEEEEEEAEEEEEEEDSRGAVGMLPKDGPTCHCHPLQPGQPLLSEDNNACPTTEQTAVPSSEMLPEEALQQSSEECRAGLLEVTMERVPSCEPWMQGRFSLLHFWPPNWESTDLRCSRPDAYDAITHTTELLIYTRSCHHINAMSSAGQPETRGSIIRTQHLAQPWGLTGLGALTTDRVTDAIATYAGHRHRDCLARGPYNAYDQALARPCDGERRPSVIMQPTEAETTEKVPSCTLDDDPAGLAREANRHEAHQRKTNQ

SEQ ID NO: 965275 - protein, 229 aa, Homo sapiens
YAVNCQRDHMAEDYAATLIFLHLDISGGWAMKALLIRSYGLCWTISITWELTRALLHASPPQFLPSAGADQVILDSPVVHMARGIMAWALARLAGFNSRCRTYHWASFKDIHTTTGQASRELLCSFTPCQLAPTAPDWLRPTKSFSLPDDARLECTLSPCTHPWQARLTSDIDPFLSSGKSHYSICASPKPQLIPLTRLRTRYAHFLLSTWTAHFTSLSHHQLQHLRYA

SEQ ID NO: 965276 - protein, 59 aa, Homo sapiens
MASTRNPHLEMPRVDRRLCAPGHVQLVEHLPRNRLGDIPPQSSAQSYLATAHTDRLWDP

SEQ ID NO: 965277 - protein, 153 aa, Homo sapiens
MCALLAHVHENMEARRAMDTSRDKRPTSRHGHRQDSDQDRTTMTEEPQHAHRQTSGPAGKPTHPRTAQAPRHATTVTPPEERGTQKTYLTGHPTKKRKKQQQQENIGSHDVAQGRKRSAARTTESAGDERECPGDERHKRDGAERDDPRAPQR

SEQ ID NO: 965278 - protein, 437 aa, Homo sapiens
MARGPMKILKRVAAPKHWMLDKLDRLMVCSSSIQRSPQAGESCLPLIIFLRNRLKYALTGDEVTEDSPCTRFIKIDGKVLNRYNLPCWIHRIVISIDHDEEMNFRLIYDTKGTLCLYIVITPELRPRYKFAATRARQDLSQAQDRNPVTLGDFMMTRTIRIPDPFHSWLAPDTISHCTLASTRHRYTENISYNVPDTTLTLSVIGRTCEVALTLVHSTFDCESTNQTIRHTLESHDHRNTTDDTTLDQIAYTMPLAPHKEPNPTTCPATLAHSRPTKPTVLSLTFPGVTCGNQRANQSSVMNTSHISLCRPHDRPLCIKVWILVLPCTTYRTILTHTYEPEIKTDRKVTARRPGRHSMPEHRRRRLNTRPCVMPPGAAASSDRGPTITEPDDAADSRVFHILSYARSESEYASMRGPHSCPSDAIRRPLSHQPSHHT

SEQ ID NO: 965279 - protein, 142 aa, Homo sapiens
MGHALWCSTRHAGVPTNELAGGPFCPGCEKRRGPFLLKNPMWVVGAHKKTIYEVCANLTGSLPPGTSGKRPLYLTLWWEAGRQGENKNCAKKTKGPPRWWSPQEVSEGARTHICNEGACDTVWGTQTKRGGGSLWSGGAGTT

SEQ ID NO: 965280 - protein, 159 aa, Homo sapiens
MDILGYSGTITGCTWEYISTQTHSLHLKIQKGLYHILLKSTEECLIPTLDWAVTVGMWAPGPRAGAQQPCGETGEGGGNQLHTQRQTRSTGEEAQEASQDLQMHKQYPAVAHGGINGTPGLTKRWNDAHDIGETIPHTKDEIGRPHTRSTGHRGWRNIH

SEQ ID NO: 965281 - protein, 509 aa, Homo sapiens
TPKSQNGKVKRLISDIVCSSDTLDSRQVHHYMAIWTSTTSARAIDTTEPVDETFENESAAADWRTRAAFTATALGSLGLTPETRLMQVNRLAESRNIRLLIAMHATHVPEHPEHTLYPTWMTLRQSHLPPKAPSTARTNSQSRHHTHSQPPRAATTSSSALAPCRPAPPARPPPPPARASPGAESTRTTPAPTPPPNATTRATSVTPRHTRPLTPHSPLAARLTHPTLARLPDHTPTHPQHSRPPTLCLPPRTHTRRHSPPTSEHRDPPRIPAPTGTHTAPTLAPAPHLPPQHRAPPAKSHTAQPPYHPDPPTPRAATPTPPPPPPPHTTAPSHPAPHTAPPTPAPNIAHAPTPPGPGAPPHTPRPPHTRPRQRLPTHTHTQPRPPPPRPHPTTPPPPPARAHPHAPATDPQPPPPTAPHPPTPHPTTLAPAQHEPPTHHTPPPPPPPHAHGRPPTTHTPEPPQLPPHPSHHPAPPPHPRPPTPPPHPPTAPPPPTPPHNTPRRHPSPH

SEQ ID NO: 965282 - protein, 243 aa, Homo sapiens
EKIMLYTVLAVLEDTSRDIREALHELLCCTNCFNQKKGFILASVELREQIYSQVALLDRDIHMEVLEVSGKVGHATLVLPLVPELLSSHPFLDTGEPDMEIQLILQYLVLIFNAAKTCPSNASIVSHDHTRSGSYAYLRDSLSTIWLPGLEVYQVEELVSSAVYSQDHTSMRILPSSSCRRALKECIVFSTLDPQGAQELLEFTIRGICKRLGELQSEWAGVADFSGSYLRCQLLLIKGLAGK

SEQ ID NO: 965283 - protein, 188 aa, Homo sapiens
WVEHGVLYGGYMTRCGSLGPSPLQGVYLATVRRGNPGWGGTDCGRDSPAVRVSLFLWVLCAGAGGPGVSTPGRPLWAMRLHHPCGCTPNRWLIPGNELDNSGQIEGKCQPQRQPVEDVGVAVRSQQEHHRAAQVVRHRMPLRGAHPDAGFTTYVDSHHYSGRLPKNRQVRSTSEPVWHAGDPRKRHGQ

SEQ ID NO: 965284 - protein, 309 aa, Homo sapiens
IIKIHDMNENEPIFTMEVYTGTVPEMSDVGTNLVVQVTAEDADDPTYGNGAKVVYSDSTGYSRYFFTVNQKQVLIKDSLLNMDRDNREQYHLVIQADTDMGGQMGGLLLGPATVNIDTELDVNEILPDLPQSTYQFTTPESSPTGTCNWQKSQASDADVGRTMLKLSTASQTVRGWILWMSSATRTPQGRAITCQKALGSANTHRNAYTPYKRQASRAHRRRHDLDWALPKTPPHVRTAATGCPLTPRCPHTPASLSHYRDTAHYPTTPPHTPHPTRATTPATTLRPPRSPPSPCPHRPPPPGPTRRPP

SEQ ID NO: 965285 - protein, 134 aa, Homo sapiens
LCTAMAWNDEVWIRCELPPSRSIRPEKGFLHQRSKGEQALLFPHKPPFAGNFLTTRRNWRQAQSSPPTYAESYFDQARHRRPPPQIVNLLVRGPYAGIAAAIINHLAPQTGGIPLRHVRPPNNKLGFSSFPPPY

SEQ ID NO: 965286 - protein, 122 aa, Homo sapiens
MAKLGPRSSCSLCPFKAETDEVESSAVIDSVQVATDVMSDEEIERIKEIAENYKLARATVRDPKSRSPHCRQSQRVSKSSWLEEDDDAVVAGVNRRMQDMTGLTVKTVEWLQVANYGVGGKY

SEQ ID NO: 965287 - protein, 282 aa, Homo sapiens
CAAMLQFVLGRWRGPGFGLPCSQWPDVLLCCERCACCCADLRTLDAVCAMLMGLPVSPVLLQMSDAPWYPLICRPVQACGQSPCWGFEQELLWAWPDLHPDVFATCAQAGHTCTSVAIVCTQELQDELAIANDQELMMPEVRGLCGLEALAAEMCTWAVARHGSILLSALARTEVLPMAPGGPTKLLLHAAHEGAGAGSQSGTDLSSLAQDELHIMDSLELPRRPQYLTELVHLPPLGGLRTPRGLNTRGRCQRSIVEATLALKTFKLIRVVAYMVHGIVRR

SEQ ID NO: 965288 - protein, 198 aa, Homo sapiens
MTSYADLSELELKAYEKLDERDSRRLRERVGRRLEGAGSFAGTLQQPPDGDPGSGLQLERRIENQKQSAEQGSRNRWQGGQRRHRKEPSLWLSKPCSSPEVPFRLTRTDGDDICHGKWYSFDLLISQSDTKSVEENLNLWEWKDPSRERGVGHTSGCRGMANGARCGSWHEIGANPRAGGTGGEGSPVGGTTRPPAQG

SEQ ID NO: 965289 - protein, 361 aa, Homo sapiens
MSHSGGERVTYSHNMCVCPQEELCVLLSQRAVGDSPQGHCWKTNPSEMVLHLYVDTKEDVCPSKEVINTRRLFYKRCARILKSSPDNKSYREKTCADKLCSPQGKPPRSPFFHEEPPQKRLFGGGTNKRVSIPEGGYTPAGVKKPPTHGGRTQRGGGARRRGRSCGRPTRKGATLWWASPTKGEQSNILLVGGCPQTRSGEGERSIPPNSEAPPPRSAPRQPGGRRPKGGSTFVGGAHRRLVIQQQTGPKSKKQQHGHKRTRSERRKGPQNLPHFQRRWGQTIQLIRHRVVAIVVNAHTHGGAQKEGPPIIEASKGQRTTQAMYTPPAAGRGGVPTANNDHNYSLVGSPTVVTAGWYTRHK

SEQ ID NO: 965290 - protein, 234 aa, Homo sapiens
CSSSASLFAAAASAARSSAGADSGSFIAMSPETLRFLLNPLHRITGVPTPSVETAARETTSSEITTKDLKEKTGKLLDSTADIHGKETPLHNGQCSPCMGTQWGQAQAPASLATTLCQRKAPPQAQRRATAQAVARARAQPRQGSAQHTTASHACRRDQWQTPDHLGGGKRTNFREHTGKPLFGNLVAKHTRRPIREYGAFPNRHPYSTPLGQATQQRSRWRHNGPLGHNGQVG

SEQ ID NO: 965291 - protein, 186 aa, Homo sapiens
RHNIERMKEEKDFTSTFTRNSRYNRRRSAHVQAGGGGNGWAAVQQSWLEGYIGAETENNDCTTSHLTAKDFILQKLSTFEETNRTLRELLREQHCKEDSERLMEQQGALLKRLAEADSRKPPAVTAADKDKEVEELLQEIQCEKAQAKTASELSKSMESMRGHQAQLRSKEAENSRLCMRLESGRT

SEQ ID NO: 965292 - protein, 576 aa, Homo sapiens
WVLSRSGGGWDGGDLEQHLEDTMKNPSIVGSPCAQHSPRHFTSGLPAGTRVKHAAMLAVIICSQPQQADISSTIGTPTGIFLCVCLRHPASMGNNSCIPANHDRHPQDAPSATTHEPLCMRPSSVSYTTRPRSLRTTENSLPLLITYNLTTTTTYNVATIRYDEPHYTLLIGDNYTSNLYTPCLYVLYHRPVPTLTRHYSYTLTYIVRRPGRHTYTRTNSQINRQHAYCTGYKQTQALTPRSHVIHPINGTTYLRHTLAGTSSTFSHQSQQSVGSWRKETQKPQQTSEHTQQKRTDHNESNTTHDDTRSEAPHKQTTDTAVAATNHERGHKHTGEPTSKHRHQNPENTPTATHDSKKKKKKTAGTQNHTNAPSEHKHHKERQKRADKQSQQDTNHNQNNQKHKKTPEERDRIGKRHNNTKREKKAPKNTKKERNRTQRQTTKTKHRRDNKKPNTHETQTTNRETRREKRRKTTRETQGKTPRERQGHSESTRKAEQAAQHKSRAQTNCEPRQESDEKRETRSQTKAQKKNDRGRRKKAEDNDDAQRGEQKRDGDEGDHKTEETAEIEPERQGQKAE

SEQ ID NO: 965293 - protein, 133 aa, Homo sapiens
MLLFPPKSLRKGRQQLGRDDDVRNFTLVTKKYKASSRESGKSKRKQIMQYSQRASFISSRCSSSKGDRRRPKQFGGHGGKGKEQDHNVVAPDGVIYRHQLNGPHGQVPSKPRRSGLLVGPSGKSRIGLDWATI

SEQ ID NO: 965294 - protein, 137 aa, Homo sapiens
QFGVPQALFGVRRMLPLIWSKEPGVGKPCLMPTVNSTSTPKGTLPEPMAQVFDSESLSAASGCLGWDHSGVYEEMSLCSYVARRSELNTSSDPAAVVSRATENGRLLSSGALFLCHASWHDGTRKARSVGSNLDTIW

SEQ ID NO: 965295 - protein, 311 aa, Homo sapiens
HSVPLLLRLSKEETVLATVQCSADSIPPVPCSADLSEHLLEGDLHVTIVALPVMNSVGAVYLQVYEEVHIVNTNKQLYLVVLAHLTTCIHCASIVVVHLMPIPINVQGIHVSIPSIALHTAASYPRRQAQHTIRDVPSSLQQPLSQTCWAPHSQALQWLHLFCPFTFPAIPRKAALAPQDYRLEIIDTAPSATLVAFRMALLHLANTTIPQFANTHVAVQCHISGHRQVSRVQTRFYTHTSPEQLVEFIRPYLCHLITQADPLPFGHTPYRNEWTRNCCMVLKREQPLQGGKHPHFTVPYNDTYTLGFYVG

SEQ ID NO: 965296 - protein, 159 aa, Homo sapiens
EERRDVGRDAPGRPRVSGVVTAEREALENEPGLKDAVWGREPQGGAGCRARTFPVLPAQENPVSPLKGYALPPVRDSRRGGPGGGMDVEQQEEEDNDEEAARAAEPALVLPACLQDSQQLDGLERACVWRLGPQCECRSPGAWRAGKPGPKPISFPKGS

SEQ ID NO: 965297 - protein, 119 aa, Homo sapiens
CSCLLLLTSEIDLALMKKAGITQEDEKSLWSFRVYASAKAVILKQNADRLPNTYARASHINKCSGYVGRTRTQEDQPIRRQIACLKSFSHGPIRNPSIVSSPIESQCETRITNRSDRIH

SEQ ID NO: 965298 - protein, 214 aa, Homo sapiens
GRPVGDISCVLDRWTGWGQWWLAGLRVAVSVKSPVGSSVPECPWLLLVPCPAPLHPLLGTEAALRILACYLLRLECIMDLIKENCISGPVKCYMSSLECPKRVLVTQQIPCQNPLPVTYVAMAQRVIVSFKFFPAAFLMQAQKLVSSHKPVQNQKQKQSAGNQCTSSCLQALNNTQKSKQPLRSGPETNPEEEPGITKETCTNQTKMPVGFGRL

SEQ ID NO: 965299 - protein, 90 aa, Homo sapiens
CGGEKDPRAVRHKSITPRGDLSTQFTWWEHGRVLMQTTGPRNLKKKLEGQHMLENHRRILTLELGHGGGTRRGQIRSKGKPGDSSAAERS

SEQ ID NO: 965300 - protein, 80 aa, Homo sapiens
MRTTTPSVARQKQLSWQHIDSNTQRTESQAPNAGGRLRDGTLNNRHRPQTTTKSETNEETATTHNISTTHTPTSPIQIPQ

SEQ ID NO: 965301 - protein, 121 aa, Homo sapiens
REAVPLRYWFLAPTRELATSRKQRLQLTSHKSCQWLGFYGGTPYGGQFERLRNGIDILFWNTRSYLKTTYRMVKLRSQPKLEAIVCPRMTVDPDVGYRVICIVSKLENEIYTVCAYQRNTF

SEQ ID NO: 965302 - protein, 255 aa, Homo sapiens
MSDAVFTYEDSPPTGILATDGSWHSKATEADGALLEANFVQIGNTDVRPSRLTTGNTSHTDRWHIEAYRHMALILRVPAQRTVPGNVAWRSPYNRTRGSLAALLCLSSLRTTNCSQYLAPLYRAPWPILRTTFTGRHKRLGHERGPWELITTDGTLERSYQISLTRNGHTSFIGPTESKNTAALRLLKLAKTIGGHKHHERARPGLAISKESNSTFHTYHLQARRNKLRQIDQKTPYVNIHTGRTALNDPIHTVP

SEQ ID NO: 965303 - protein, 138 aa, Homo sapiens
MSLDLLSVEAFIHNYFWGQYRPTKGLWGRMGLDGVYSYNISGAPRVVPTNAFITNDHCVCVLNHPRHKIAAPFAAVEDKRRRKRLGGGPPRRSNDCCVITPLGISAVVCRAGGSYKTIQLFPPRGGVRDDSSVIHTLL

SEQ ID NO: 965304 - protein, 75 aa, Homo sapiens
MQSLNDRLASYLDRCELSVETENRRLESKILGALGEEVDPSVRDWSHYFKIIDGPEWLMIFCKIRVDKCPASYLA

SEQ ID NO: 965305 - protein, 507 aa, Homo sapiens
GHEGYLTAVCLHSVKNAPSEPQLWPKLDSSESEEETLHKIDQQTADVSPSFPCTDAMSLECRVHTGSNASQQFLPTISSNTPMTAETGAHPKKTAQLPIGNTGKPPLPKTLEAQDSHGPHHIQGTRSFPCFVDMQRTTLTYTPRDGHIMPLAILLTICMGQRNVLHLPIIICPKVLPLELRTHASNESLRAIQQKLNAHIARHNFTNPERLFPYTQPLGYPFLPTTTPTHARTTPPLPFGTSKPLATSGHQKRHTRSPKQRIISIDPLSPSTPPYTREHQHQEAAPSDTTNNHTTAHKRKQETTAHSRYTNKPKERAHRTNNTPPACHSPVPTDKTPIPRGYTNLEHPHHIHTQTQKPQPQTPKTTPPHTPATRPGKLPDKSHNPRPTNHTPQRDETPQDQHSDRRPPTAPQYQKHETTNNKFTRADKPLPTPTRQNQNRPPPPPPQTTNREKHITHQTHHPDTHNASTPPHHSITPPATHTHQPHTPAPPTKPTNPTPNAHPHRRP

SEQ ID NO: 965306 - protein, 258 aa, Homo sapiens
VKRDIKYFCLQNSGVHFSWPGTVPKAVCSSLRPSCTSDEGGAGQGKAKPWGPEASLDHRGQGNVNVAWPRKSPHLHPILALGQINGSKWSGLPGLGLEEMRWGHLPTGSKRGTRSSRQRGRLGHQGSWDIALTWEPLGGLGPRDKRGCVPRGRACRWRGEVVGCAKVACDCYVALEWTPGLPGVGTGGALKTQPCNRGLLGEVHLKGAAAIWSKPTAPLAREKPDVSSVALRTRIPSEWPFDPRELQTLTGEAPEKAV

SEQ ID NO: 965307 - protein, 245 aa, Homo sapiens
MAGGPGLISVFSSSQELGPGRYAQWWPSAQHADWQLVPAPVSRSVVGLGASSRCQPGATLRVALRASSLALLDAVGFCDERLVPFRSRREHGTGLYLERIFSPDCRSQKCQVITINPELPVEEAAGGYAKKAESRHSKGIHPGLRPADPGGVAPMVTPVSHLPRQPLLQGAGEDVVTFSDFTEGKRTAWLTLMLPVPECRTNCNLMWQLDECKEAVWGALLEGQEEQPMPDELFSAERGKGSMFI

SEQ ID NO: 965308 - protein, 233 aa, Homo sapiens
MVIASVEGLVTLLGWRGLPNIVICGPLRAFGVAPVLSLGCGLQLGAGVSVLLELDCLFSRIYTYKRMHACYNSCSLLSGASASLTTSGTKLLAGRQPGPHRLQPASVTMLDFVLCLDTCGPGGSSLHLHVSKACLGSGTLKPLPSCWELETGCARHQLPLSVLVLHGWHKLDQLAADVLDWEHERFDIRRFPAFTLSTLESTLLTASATRIMDVLVPVDSKDLTVKEESLQMA

SEQ ID NO: 965309 - protein, 183 aa, Homo sapiens
MHDRIPPHLWTARVSLPQCPPEASVEAAHQEGGGYSYRKAPPKWKARVALQFSTPSPFPSLAAMTILRDQTGPKTDAPELFMAQLPHFLQEQPVASLPWAAPHGGFRGLSPEVKRGSLNSNAEPRLKCGAPGLPYLRQEGQEGEPAAWGGVGLTRRASPAWPAQICAPCLSAWAAGCQGQSGL

SEQ ID NO: 965310 - protein, 410 aa, Homo sapiens
PPRNTDEKISGLESTGWVEPSDPAEQQQQQTHVQRFFFFFFFFFFFFFFFFYRGRHTPRGKEGGGGGRTEERAQRGETRGEHHTRGGGRAGETRGAKGETRGGGVGEGPRAGGVGHTHCCETGEEHGGVDTHTGGARAENDAEQREYTMCETHTHTPGAHTHTPQRTSPHQRAEPAGGRTPGEGHQTRETGGRTHSRSTTHTLTTVGGGQAHSERDAPPSRTEQRSESTEETQRRGAAEGPERHSHGCEKRARTEGTTQPPKERRRARIHPAVGGGTKNNDKNNRSSGEPPARDDNQHNTQRGGVLAGAHTTNGSGRATHPNEGREANHAASPPQKQTKRETKRDSKERQTKQARGARSGSARTNKNNSRGGHPRPPKPQHSPRTKPAGGTNSHTRERARAPQTEPEGTT

SEQ ID NO: 965311 - protein, 514 aa, Homo sapiens
MDPACGEAAEKDIHCAWCNSHLRERLGTQIDEHRRRTSEDVTEAHACCCECSSQCELLMSQAQKRRPSMSSAPQISQQSNTGTWPFHQPRQQDVKTRMSHREPAQQIRGIGHMLAQHCTTRRDCILRTNPSLATYATSNGTIIRWHSSTSQNTNRQTAPRLHCLGRSTTANEHAPHIPTTLLHTHPRHLPTINCMRNGMRPSPPYSWVATPEYPTQHTTPGTRRHCNLDTHRETQPSDGHTGNCTPPAYHPETHIRKTAATTHGTARATAQQHDNPKTEQNNHPPKKDIDLSDTFGPRNTEHNTRNQQQPYGAPTNTETLTHHNPPPTVHLDTATPRVGTHRAQYLTTKRAHNTPRGTDPPTDNLGSGPTHKGKNEKNHEHTTFAQKESKRETHRPHKPRRNDTHSTEQQPSKLRTEPTPNKKKHGPTDRHTPGNAPPDKPERTHNDSPSGSGTNKPTRAEHTVKPKPNMTIDKRHTSKQPVTAKITRDNTLTNKHTTRPTGCDETPPPETPTQ

SEQ ID NO: 965312 - protein, 113 aa, Homo sapiens
KKFTSCNGTYNRSNGVVDQEPYQCKQNGRIHIASTVLGAFFPPPASLAAGPPITPAPARRTRAHYSRDGMRLTPWQAELLYQTLRTKHQSSSFGNNTHSFPPPLFPTGLPGSP

SEQ ID NO: 965313 - protein, 238 aa, Homo sapiens
ARGLTRHASTMCCGDPCPGFPVVYRAAAAPRRRPGPGGLDPEDLLSPCVAAGTAGYAAKQFARYGAAPGWSPVRYGRRRSSCRELEAEEREWYPSLADHAGVCLRVKQAGEEQKLSGRGSMHIAECIGQDATDDCELAAAVAWRTGRMAQADTVRGGAPTAVLEAQELLGYQCGPKELPASSELLQDLKKKERKLPQGGKTETEGRRRELCIGLQLLAQDPDRLWGHPCYMRLFSLSQ

SEQ ID NO: 965314 - protein, 354 aa, Homo sapiens
RATREAMDIMVVMEVLDDYAGYNNYGYADMMALTDRLTAWKRYWRRTLATGCEHGDCTVQRFFMAASLLATLCTQRLRPLFAATLQHMTLASHILSHRLTSRYRAFTTSPTSRSLTEHRATTRTTRHDCYARFCLTTSVSALPTLRLAQCSYTALDNTTPSCHNHSANNYFDSLLYLAHSLASHGKGPGYLRPLGARGLPERHLRARDITAYHTDLAHLSTKSTQARDLPAKSKHTSEQENRRANLSAPHHPTLLNPKASANRRIYIGSHNFLCLHTSALSKGALAILICRAPACGLGLAERRHHLSHATFTLNCRRPQPTPGSTRSRLPPRLAPIVPRFAPTCFTLATPTPNT

SEQ ID NO: 965315 - protein, 102 aa, Homo sapiens
MATGIRSQSKELGNLSGGHMGQNPAEAESQDMINEVDADGNGNSIDFTHRNFMSYEWLERMKDADSEEEIRVGYSESWTRDGNGYISAAELRHVMTNLRRKT

SEQ ID NO: 965316 - protein, 85 aa, Homo sapiens
GSSSRELHQSTHKIFLLRLWRCCLSCSSAIREQLAHDFLAFLAMKLFLDETCGLTHRFPISFLPKTMFICLSLTSRTYSREYCRS

SEQ ID NO: 965317 - protein, 400 aa, Homo sapiens
LSTVLPPLINSGVAGIRDNIHLVLLSFLGSTTVTSPAPRSLTRYHCLRLTPTANCSAPHTHEPAKRPNRLRELLTQPLNHTMAPCHGTNTQPNWPRHHPEPLNAHFYARHSFQTSLSTQTPAHSTLLSYQSSSPTPLLLTHCCTSAVCAILPHYQRRPLTPVPPLLSGPLATAVSHGTYTPTPDAQPAKAHTPIALSRPLRLRASTYLPQPQGSNPTPQNRRMPQPPPEHATPATTHNPPRPRPPPRLPQHNMQPLPRHQRAATAPARDLHHPDSQTTTTPTQHTAENPHNDRTQNQRHPNDQNPLPNPTHPHSTWLSTANTPPPKPAPHSTPKRGHNTHSTTPPPTHRHRRHTPPRTQPRDTYKPSVRMARTHLNPQRHNKQASRRGPTNPGHPHPQTP

SEQ ID NO: 965318 - protein, 125 aa, Homo sapiens
MMGGRSHPPSTITNSRVGGREEEGRQSNTTSQGGTKPSRAAGKEGLYHPAGERQLYSPKQDGAPHKKMQGGAREQPHKHKHEKTNILPSIEKKTPHNKKRRRANKQHTSTERGGARQSRTHHTLR

SEQ ID NO: 965319 - protein, 197 aa, Homo sapiens
MSTSAVLRTSSGHQGSGLTKTWRPNDEHHTGVRCGLYIPISRHPCTGLTGQQGSSSGGTQYNAAWRLRRISWNPLVELCTSELNAFTHGMYSLWVGSANATADLTHSNCLSHTDNHQHLLAELPLKHTPLSCCPLGSLGHSSLSIHGPGQPLNLCYPYGALPEPYPGPLAVTSSTAHDQRLVNAAILLNLATSPRRP

SEQ ID NO: 965320 - protein, 32 aa, Homo sapiens
VCWVERCQATAGTIPLCHEGQPAQTTTHTPQQ

SEQ ID NO: 965321 - protein, 393 aa, Homo sapiens
MSLEFYLVEFLLRGLQIGMPGPWQPRSHLVPQTETLQDRWERLTVDMSLFIIINIIMETPSITPVHGAHPYLPHISTELESLNRGLCCDQAHHACTTHGHCTVSVHDRHVNKNRHTQGSGMHRRMHTACVTSCHSCIADSSGQERCTSAHLYLKVTGPSISAFRALETTVVHNRTTPGHKGVLAATDGASRENATPHGQLRANDPITNTWSHITPSTTQAPRPTIVDVLHMVEIPGGKHTAASSPRGWGHGYNMSTTEDRTNTTTPPQEQHDTQGGTTGDRQKSPTIRGGDTERGAHKTHPRTRGPRAGSDDGAHTSETDRTTPWGARTPWHRPCHTTSSTQTAELSRPPPTREKRKRPPLQESRQLHTPHQSGEELQKNNTATTQNTDEQTT

SEQ ID NO: 965322 - protein, 382 aa, Homo sapiens
MADGDGVRQSWRDPEPVPEATVLRPTELRDACLQVGMQHGGPFLHYMVLVRWTCLFPASGLRGFPNVLKKVLVDQLVASPLLGVWYFYGPWLPGAVTTRWAATLPGAAGRSLWDLLQAQTGAVVAMPLAASSSTLSLSRSPTQIHRVHHHIANENCTPARLRHHGTHLIHNYGSHRAAPRTLCTTTKGTADTAHGNHPDAALAPCHASLANPTNIAPTMDIPLRRDTTNPLREPTQGGHWDIHDSATASAPHWTPKVPYDHHFHAFPQTPTFGRPTNTSTHYPTSTYQLSCETIKPLTTSKDTREHNRPACEPHSDLAINPHPESPMSPHKGETQYYCNTGYNPPTVCPIYFTAQASRPLRRDNGTTTDTTHHTEGETRTRG

SEQ ID NO: 965323 - protein, 209 aa, Homo sapiens
SKGGDCAGNMCHGSADSIRQPDPRQAELRIIVEEIEDLVGSALDELGGRVSPVLTEWTGNKSVICGCHLRSYMDHVVTEPSISDGVIMCHPSLMIVLIFSERRTLSPSPDSLQRGLMQACCALAINLRTHSASCGMCLEGSASDTHEQAILRLQVTQCCWSRACVNSGLNCVRNWNDGVGDRCCFRLEPLVPPRTDIRCNPRVGDVPVN

SEQ ID NO: 965324 - protein, 130 aa, Homo sapiens
MTVKCLYGPLSCHSSHRTICQKYLASTRGRLTTANYTTSPYRGQTKKRIRIATIKDAGKIDTALALDKKPLIEVVNPTGQPIGTTPNVCVAVLTLTTKQIARRTASSRHHNERATYATHVAIMNNRTVSI

SEQ ID NO: 965325 - protein, 325 aa, Homo sapiens
PSPPGVFGQKTPKEREPPPPLTRGAPQGWGGGGRPQPLSVCAPCVVEKNIYSLSSQTLDGGAPGETGWESSPATRETHKNGGAGARRARLGESRPLRDQGARVWPERAVAAVGARGHTPARALSVWKHARRAHTHTLSPHRDGGGGAQEEERHHTHTTHRSAERDTPTLSARAYVRARIHTSLSCERVSTQRARRSCRTRTLSRAARDHNLNLDAEHALIGEEEDMLERSDVHSLPLLFSSSSYHRSSSYTRSSRRLSVLLLLLVPEPLPLLPFLFISSPHQTEDTYLAVEDGWHIIYPTHPLLLINNTTTTMHKTKYTSVDSRR

SEQ ID NO: 965326 - protein, 252 aa, Homo sapiens
MIGSRILASHEGHVEVSAATIRDSVLERRLQLCGHAKPEFLQKVMIRFLPNVCVSLRTFVQNWTGSTMTSLSDKSSYIQWLFPLREPGLNWHAKPLTLREVEVFKMLPGDPGCWHCPGPIELMLGFYWDPVGVTDVHRVTVGPSTRTTRMRFLEPCTGAVLGQRSGVITRFFKSVGELVSRSTSRLPAGPVLPWGTTLCGGSCAWFWTFALGLLHVSPFAAARAPVGGFAWSFRPVRFFGGQKVGVTPFLPV

SEQ ID NO: 965327 - protein, 255 aa, Homo sapiens
MPKFKAALWGGGSWKNMRPCDDQILAWECVCCVRGCPGRMLAGGRGDMENAGEKSIVGAPGLMPDWINACNARGSNMDVNSDGLMHGDLGTMPCGCLLGTAPLLARGPKDMPSSDAIQALTAGTEEVVPNALERNVLDTNGQAKRRHTIHEGALCGPHEGTERLWPNTTSGPIETHKTRPHLAKRRQHHCALPNFAPLRTNQLAALAENGRTDGRDLAEHWFQWVTAGAWYGGLIPVYSAHTDLGHPAWAEPYEG

SEQ ID NO: 965328 - protein, 182 aa, Homo sapiens
SPGERRCRVEILREGDRIRWRGSPLLCIGLKNDKPTSAMKDPSQQSTSPSIINEDVIINGHSHEDDNPFAEYMWMEDSARKRFKREIEEAVMGKKRIYCTLFPRNAGRGTKSDEVVYSERRDLREEYGPNPKTSLMTLSSVMALLWKILWSTSNLNPNANGVCSWGEVRKVFEYDGALFWWM

SEQ ID NO: 965329 - protein, 120 aa, Homo sapiens
YRSRSATPANRALRAYRRCRDRYISTPWIATSYPDADAGTTPTARMSRSYEASKTASNGTTHFRVAPYPSDADQNALSPSTPDTLSLPPEYLEEQQKEGLTRHVWQTPGALRPGPTARTR

SEQ ID NO: 965330 - protein, 361 aa, Homo sapiens
YIPRFWTFETGCTVCDEGLRSLKGIGDEALPTVLVAVFIEQPTAVSSPCSSSWLLLVHYPQKHMRLFIHNHDAATTRLRWTTFLCTAMFRTYQLCERCWALQVRMRECRLPGTMVRTTCAGTDRSCTYYLQLCDCCRGPDRAQQTCGLLHPTATRMSLPRCMTRPGRLWSNFCPRSQLHMCYYAQSRGHTVEPLSQGAHDVGLSWHMCPNLSTQSTLESLAHVPLLWLTLARPSATALTHTTTQPSAHPEPWRIPGANKIQASRHVRHRHLKQPGSTRWRIMDTRRTGNAHNQPAQTDPRQKGDKQPPRDGPPRTTHHRNPRHGPATQHRRHSRPGGTRATIITADAHHRSDHAHSPATCA

SEQ ID NO: 965331 - protein, 73 aa, Homo sapiens
SQREQALREAEPVPLLASLAFPKRAVSGVVLFPDSPACMSSPVGDRAFWCSFPMMFRRRTYSSRWDLPIHTFA

SEQ ID NO: 965332 - protein, 110 aa, Homo sapiens
MGLVGTVSKGAHLRCHRSNKRRVTRGHPWWSITVLEEVKWLILLVHCNMTIEIRTPEEIPLIYLIGMILSDTPSANHKTEIINPVWTSLDFTWNPDKHNAGTDRNCIWNK

SEQ ID NO: 965333 - protein, 290 aa, Homo sapiens
KPDQKQRDNILARRAREGVYIFTYLHSYLTYINAINGQSSCNDEHGQRSADGLCCSSSQRMTAMRSPRTQDLIRLYDIILQNLGGICSSFLVIEEDKAFQNEIVPQALCVFKAYSVEHQHLLSPHVLVTHSWHAHTPLSCMTELLNYAPDVHSDCWPYQATRLKELPAAVAELITTTCGQHYTHSLPLHMDPPAHPIALAHCTSTHNTNNSNHQAPSIPYHSQCNTKHSCAKQLGLRTTNCLGTETHTPHGHTHDPTKKRCYDHHSPTQTHHQAPHPPCGPRVMTPESRV

SEQ ID NO: 965334 - protein, 133 aa, Homo sapiens
SSCCISIVGHSNERCDGGIYIGSIMKGGVVAADGRIEPGDMLLQVNEINFENMSNDDAVRVLREIVHKPGPITLTVAKCWDPSPRGCFTLPRSEPIRPIDPAAWVSHTAAMTGTFPAYGMSPSLSTILSLCLG

SEQ ID NO: 965335 - protein, 98 aa, Homo sapiens
MEFEISLDGRERNAWQVRGQELTCTARDSRLLVKLPFTVCFSWVEQRGSWRTPLVRVWVRAPGFPNLEGKGVIKTFALLGLQGVNPTYCTGWDALDLG

SEQ ID NO: 965336 - protein, 251 aa, Homo sapiens
QACLLPEPLQEPYYQAPYTLVWSSPASSCILSGRWPLAGGYKKRPGIEILFHQLAPLYEIVIFYDRVTGYDCCFQLIDEMWTPYGFISYRLFLGRHKIHGMDTMFKDISCLNRDPASSSSCGTAEKESLFRLQALVDGVALRPWDGNSDDRVLSDLSAFLKTIALNGVEDVEAVLEHYALEDDPDCRLYKQRVKPAESQEVAAESPWSELSKSQQAVTSFLGSLTSPLLARLHTALNSWGSSNSVLGPGPQ

SEQ ID NO: 965337 - protein, 94 aa, Homo sapiens
MCSVDPGVAETPGHKDDKGGTTISHLCYLGQRVSTNFVEAYFNGRHKNECMGSPGKLQVSLIYIRDIIIGVLLYNYALNSTFVFMNTSVCLPKK

SEQ ID NO: 965338 - protein, 497 aa, Homo sapiens
GQEQGAHTRRLVEKGAKKKVVDPFSKKDGYDVKAPAMFNTKKYLARRSSPWTQGTINGILMGLNGVGVFEGELLRDSADTWMDTLASLGTYFRALQLTSHMHVPVLYQRLAMNLSFPSGNRQSVSPSTNEDVDNPSGLHKQEWGQQRNVVWRASERSRSVLQVALPASGVLAYWPFAGTWVFLDEYGDISKLREHTTVRPRVLGIAENREPSVNVAFKATPQSGLTTRNSRKGNDCNREESLSPGGNVFGRKRKLASFGTHGKGLWITNLTDLVDVYPTNHKGKLGGKHNAYVTKEHQRGDYVAKDPLNLVMAPSICSNLVKLGRPSFRVDRGTTEGLHNIVGLRENGENDPTKRSMRRIVGLDNTELPWRHASIVDRGIAKREASTYMRTWRPKTQGAQLRRGWYEESNRHSTTSNNRALQHTPRRWHWVQLTKRSAANPQGRAKQESALRRSNNQMMRAHQSSRNDNKWGDGKIQTQTNRENHAGNGKEATAKRQ

SEQ ID NO: 965339 - protein, 217 aa, Homo sapiens
MAPWGHTHPRALPVRRAWLPPHIRRRHEGGAGAKTHHTAPHGGVLPTRGSEPRSEEYSYALCFAAVGGVVSPQRSTTTAHECAAPTRLYYTRAVTKRNVCGAAVSTQHQTPGQVVDGTRWAGPPNYQVGATGGWAALVWRGGARHKTSRAGGRYLRRQQHPTGPAATTPTGAHTPPKPGGETTTTHRVEGREPHPPKIQPARGTRTPRRATPNTTNA

SEQ ID NO: 965340 - protein, 109 aa, Homo sapiens
GEEIVVVLVCTGFVWAAHNKDVLRRMKKRYPTMCVYDVVMLVLQRILLISMFRRSHGSSVLWAFTLSFCCRCLSMHRVRLRNLKNNSWRIKLEGIRLQRTPMGIVLDAL

SEQ ID NO: 965341 - protein, 54 aa, Homo sapiens
MHCDVESSRVPALDRQDERSKVGKADPNAQQQLQNRAPTEQHTDTRALTEQQKE

SEQ ID NO: 965342 - protein, 83 aa, Homo sapiens
DTGSRWRHMLKTGGTLAGSSSMGFCLRRMTAVHLAHIQATPQPASPLLSPGRRQYEVMICRGRPYPVMPAWEAPLLLPILTLC

SEQ ID NO: 965343 - protein, 77 aa, Homo sapiens
RCRAKLPLKANNGEREKTHINIVVIGHVSIRRKSTTTGHLDLYNACWPLTKRTIEKFCRSEAAEMGTGSFNVCLGLG

SEQ ID NO: 965344 - protein, 90 aa, Homo sapiens
RRLFLGPSATFFVPLSRDRSLLSRYFVPRCPASRSVFSLSVVSVVCASHFVIVALFFESLGVLFRSGLGASSGLIPVLIQVTRPYRAGAW

SEQ ID NO: 965345 - protein, 269 aa, Homo sapiens
MWETHNQQNINKTRGAWVTTFSQDNSGGDHGKALLTRGDKGAPVRTQFSHNIYEKEANGGAHLREGYHPLGVWGGPPWGAGDKTRIGTLIKEKPKHTKYLWGASTEHNSANVFHPTGCFGGAPPKPPTVRHGEKNTLGGLLTISICGGLGETHFHPDWRYFGGAQGNDPGGATTLFGCKQPNKIQNEDELVRKVKIEQDIDNKGAHKGQTSQETYSWACGRDPYIFGKDSEAQKKVRTNNCVVEQLLVVGNEGDGATRLGLRTPTISEL

SEQ ID NO: 965346 - protein, 63 aa, Homo sapiens
FPHSRLNGLNSICLTLLVLVWIQAEARYDSGVISNNNCHICITFFHFYTILKESSYILVTPIL

SEQ ID NO: 965347 - protein, 310 aa, Homo sapiens
LACINDEYYVCPIWWIRGQLEGASLTAVCQIKVFDDAYRKVLVSSLDRVGCPLQAQGKFGEDHQRDLTLTIKATKGLVGRGPVQEYLLQVGSRWSEVISCVLYDQSLGSLGAVILKGSEEVQNVGPEDNPRARDELVEAACALTCDWRRADPESGPSGFHRIESQPASLLQQHLISARSATCPCAEGHGALLHEDEHAPRERSSKPKNGKRSQRVAAHKKPERLASPPGDLEARNCGPCPLATVDEREASSVSGELLAPIVANKLAGLLALVGSGWHSGSLTTGARWSISSANSQSIKRIRGPKDSSRVA

SEQ ID NO: 965348 - protein, 83 aa, Homo sapiens
MLVAGHEDSNGCTTYNAFVMAYPARGDGPMWAELVRMVLNGWATFPISPESVPFPCVNLRTLAQSFPSASLSPPLSPLVSSLV

SEQ ID NO: 965349 - protein, 202 aa, Homo sapiens
MRELGVATVGPKSALKRSGAQGGGTTSAWGSRGHVWRQSPPKNPGATARWKGENLFKGIFPPRETGVRMNPSLMWRGPPKNTFGGAPVWAQYLLSERAFGEKKRTFGCTTGEGQISGGARPFENASGKAAMFRQGKYSTGTTQGALGGEPTIGGMGTPVWKDKSPKITRRDSLGNVGCEKHFRRKGPPQKTPVGDQGEVLSG

SEQ ID NO: 965350 - protein, 125 aa, Homo sapiens
MVVPPRWQPRGDNNTFGGGPRKKSALPHRGVTHQEERRWAHEKPSGGERPTRKKKSARSVGGWRYTPPHPTKKRMWRQEENAREVVQPHRFVSRTNRDDENEISETTKPNTSKCQVRPDVMRRGR

SEQ ID NO: 965351 - protein, 100 aa, Homo sapiens
LCVRFLLLLLFNDVFLLFSLRRVVFYFPPVRDVSLLVGCILARVLCFPRVLYYCGCGSFTLFYQLAVFLSVLCMLLRSWCSLLRSCLLFCLFIWCGVCFC

SEQ ID NO: 965352 - protein, 426 aa, Homo sapiens
RERERERERERWRRRTWISPGVDGNCKNPKPPKLNEGPLITPLSSPYKKMGVSLKDEKGTNSLLGNPLFLWGEVERARVSSNLQCWLLAEGRNQRAGEQLFFCWHHAGEVVRVDQDTKAEHAAGEYTQGGKKRCVAVEEDHLKNTREGTLRGVFLLGCCSSQSYIGPLGGGCVDDATTTISHTISSQSVVVLVLLTRRIFIQQSRDVAPVAPLMVCWETLTMLLAVQAGIRGMGVVGQCQPGGGDNNNTNAHVVTRVLYSWVSWHRCTLSDPGVPDRPLLFYKRPQQGVGRVCKGHSAPGPGLVPEEAWSLGVRGQVREYAGLHIMAKDTSAQTPDQVSSTSVVLFPQGLCVQEQQGQLYPEGGDRRPLTIRPHTYRVIEGEYSSGYQQFYKNRETLIYRMCGEQGKKAGMDDTQAEPRSHREESA

SEQ ID NO: 965353 - protein, 104 aa, Homo sapiens
GPPGRTVVHDLFGFVSSVRPRFRVVPSAKPTGPEHKLPEYGLRDSTRNFEYKFAISGKKDHGDTQCRNKCHLPFPQGISIESRMNAQSRRYSLMKAVRRHIWHL

SEQ ID NO: 965354 - protein, 193 aa, Homo sapiens
YEEIGIFVEKAQDDPSTVRVPGPDWAVLPGALSLRTWRDLYSRYKKLQQELEFLEVQEEYIQRGGKHEPLKNGSFSSAQGRSVDRKSKGISAWFTREQVSLARAGGITTYPGSIGWGFLPNEGRPRSVISVWLPASFPLEGQSPIPDSRGKGLGLPRRPAKSGPFHVLVPPSPRKRADNGEEFGSLGVGDPVS

SEQ ID NO: 965355 - protein, 103 aa, Homo sapiens
MEISFVMYPCVFSLSLVSTGLWPVVSLAGQGLVRPVICSSISLTNHGHGWLSSKPSRHRAKLIWAPTTLRTALLADVVLHHCFLRIDEHECDLTDFGQLVPFP

SEQ ID NO: 965356 - protein, 561 aa, Homo sapiens
RQRHSEVGIWHSEVGSVQRGRQAAQRGRQLAAEVWQLAAMVCAAVLRCLLLFRWTSEVHVRPLANDWQTSGLRLRKRACFRSSASTETKQSAIRMHRAAGQVAICRPRNCFRRPNCGPLAGEGHPLLCLLGLISFTGFITGVFSGNRDPTFRTRDSQMPPLQGAHSQHAEGEFRFRTQGRQREHVVRFRADAGSCPKVPRRRQNVRTTRRLNAPTPYFTCYKYLQKGYPFTRMGSVHPAGESNYPHGGVPRVREETFTPSAFITDASYIGASNHPERTHGTGTGLSGAFCFRPRQLPPRAPGCGAAYRLFMASPYGRVSNPLTPLYGSISRYPQKFCPHNLDRPYVPTYICGCHGAAHTPDERLGYCVGRGKVGPPPILQRVGNNARFCGAHIINAEGGDPNDDHIERYIGSSARACVVAHNYYPTAAVVRAVHNGYLPLRTRLSIATIIAAYRPTVTDSAPPLRREGHHHVVFAFNIYARQPLIGSRWRYMLWARTIRHRGRLWHYCNNPLCLSHTLINHERAFLLQPRLCNVPTGQIHYTRATPCSSYSTGCALRRPMY

SEQ ID NO: 965357 - protein, 52 aa, Homo sapiens
PTRDNEMYKMKRRDDGALRETQGRRMKRAIMQLGTTLLSLYHILSRSIGVCY

SEQ ID NO: 965358 - protein, 420 aa, Homo sapiens
MCVPLCSRVVPREGAKGTIGSSGPKKRGCGSPVGREKLCGRQVVSDKQKGCDNSGEKEGGCVGPPTDPKFSRQGGGAPKSEAAHKSVAPKTTTQMVAAAAANNHLFRLATLISLPTTLLWLFPRVKCTPAVVGGNNNDERGATALCCRQGADKMCAPQRGSHKGGHRAPPFGNDLTAGDITRGEESATNKKVGAAGVEIFPPRLLFFFPSVHKGQRDITHQPQFFGKRGTKGRVCTLVCPPDVKNSETFPSDGPHSEGCSTHDEGGAPPPTCQNKLRTGEGMVGKDSHNKTELLQNDPNTRVRTVAVWRNTVWGDRRPHLSVGRSATLIHCYHRRNLLSVSRQLPREKRRHLERRSGSPPVVSGYSWTGRETAGGKKKESHQSSIKTLFVLCPPQPKIRAGGRHQHTHTEEVKVRGQRER

SEQ ID NO: 965359 - protein, 69 aa, Homo sapiens
TQINDDDIIYWGKALCEVVPYVSVSFRYREEFEVDMTPSLDYSGLNSDHVGLYSWNKRTFNSGCTIGMS

SEQ ID NO: 965360 - protein, 421 aa, Homo sapiens
WEPVAFIHAPLTKCREKQGPVSENNSRGLWTSVGSPYVQTLSPVCKPKVCIKGAWVVCDHPLWGRSKGAKSPEGPVEERARAIRRWPPKKRRGKGRARCQPTSRGLRKTKSAARVAKEGAPVYTYGKPSSKPGESPLRGEGRGEYVYKRGALTFSCYPLFLHRRRCGHVLRNTGALCGKLLPDRKSAGKSPPFSEAPCGSPVAGNPVVRRPTAPPEVVVRKILSKRQPLPAEESPLSLVGHNVECCKNTLNEGHQPQKGATCGNRRGSVPKYVFPRGALSPFKKPRNRGAPPWRSSTSLCGQKTLFITWRLITVPHYGATQRDPLIIKFPHKPKVTIELAANGLEGSPTKRSINHPSVEDPRLSHEQTACPQRAGARRRGQRWHKSAPMTDYKQREASRENEHKGRRDLAPKEPSRSTTKY

SEQ ID NO: 965361 - protein, 136 aa, Homo sapiens
MFLSVHLRVHCYRPTARGLVLLKKIASVDYNNALFPFSSVHHTRLSTTICSVPSRITCAVGSVPAAAVSERLQGNNQGGSDSLTSISTSFLGGNHFSRTVNDGSTANRDGVSETLGTYGSGSYMTWLCVVVLFNTP

SEQ ID NO: 965362 - protein, 103 aa, Homo sapiens
MSCKILGGTLCAQCVYRALLEHFFKPKDYRLNVSLFSSGPGILTPELGAFPCYPVPYSIGVPPRDSVLAGFAAVSAPRCPWFRGRCTCHCLPVACRWATRFRS

SEQ ID NO: 965363 - protein, 424 aa, Homo sapiens
RKEPGRRTAGMSYDRAITDLLDPTDTSSNVDVRARTAVKNGLDRGLDVRRNDDHLIVSMDVDERQSRVPTPGQSMQQHTSSGASTHCAYMRMHPHRSCQWHIYAQSTSTSTAMPHGIRSIKTTGHPENEHAAQERHKHQDLAHDSAENAQRITLSETAHQFKHPSINQYRATQGDHWDKKSTTNRLTPKPHNHPHQTHANNIGGGPAPKQGSNQPHINEEERPLNHTNTVSYTQITTRQLHTVDRRRSTKQTKQIKDTKRKEDKTTQPKQEQRTTHNTNPQQTTSRQHTPTQIHEKRDTTLKHNNNQEKGHTGCGTTERRPPTPTTHTRHKRITQDQPSPKQGLARHTEHPHRRQHIPPNGTREHPPRKANSTSHPLCGTQTQTTATHNNTKNHTRRRNPRDTPRTTPTQASEHTKPTHAHSLD

SEQ ID NO: 965364 - protein, 60 aa, Homo sapiens
LEDPINNRFTTVDVLIMDIPHSAAAIKGSFVQLIKVLRDLSSDRSNPSRFLSTSNSSLFD

SEQ ID NO: 965365 - protein, 456 aa, Homo sapiens
MWANEQALAYGLILITVGHRGHQMGASPSGTIGAYSIVAGLCFVVPAVSTPVGKRQDRAPTMDAVVDQKHMTAEVEASSWPFYQDITIVSRPHHASNLNTQDDHRPWTYLGLEQHTLLRNTGAMTHEDTWPDSGTIVTPITMAAQGAHRRTKHTQRHEPKHTRTATKDTQAQTDHATKQERANNPTPEDRTTGHEPDEGTEGDQQRQQTRQAHQHRTEHAATQTTTAGTGETEKQHPQATQARTRGTRGRQKQHTTRGRSGTQERHSESRQTNNTPQQTRRRRRKRRTEHARHPEPTTKAGNNTQTQRTNRREDSRDKQERHTRAESGEEEKTEGTKVKARRTRPERGEGGAHKARMRRTEEETEERPEEDGRKTNGQEKRDEKTEKEADRKGHRDESGHKKKEKGRKKNDDEESRKEKKKGPQAANMDKKREKENEENSEQKENEGQAATETENE

SEQ ID NO: 965366 - protein, 259 aa, Homo sapiens
PDLLPLQKRPCSSCLHLAGSTATEFAAVPAQKREFPAQGHRRASQLECGQRQTLGLQGSGPQGVNEEGILQAPDIAMRVAVINPKPSSIIHSLLHLFILLSQELGYNRKETGHRQTGKAIPGSERRRELCELEMMRKRGEGRGRFRKAAGDVLFEEVTLSLEPSQELGKSMSGPENCRCKGPEAGPQQDPSRCRCRCKGPKAGPEQVQVQRPWGRTEQIAGAKALRRDLSRYGCKGPEAGPEQACLRGQRTPVCLEQRV

SEQ ID NO: 965367 - protein, 74 aa, Homo sapiens
PDETRWESLLETMKAYGKLYRYYYNPHRERHGTLGETGKVLSHSAPLRTSSVPMGPSPRQDMPHQRFIVYTTIC

SEQ ID NO: 965368 - protein, 249 aa, Homo sapiens
MVPRLECSGVISVTTNYTSQPLPWLPKCRDCSLCPAAPRLGSEECLCLAPIVWDVRSPSAGCPVWKVRSVSTRPPSHLGSEERLFPAPSHLGSEERLCLAAISEMWGAPLPGAHLGCEERLCPAAARLRSEEPLRPAAAPSDHVRSLSARQPTHLGTVTAVPISDDRNTFALLEIRVSLCHPGCALPVAVILRLPARIHISCIHVILLHQLPYYAGTYHSCPSYFLYSLHRSVHHTSPMCLQLPCLTHS

SEQ ID NO: 965369 - protein, 188 aa, Homo sapiens
MAFLMLTERKILGYIQLRKGPNVVGPIRVYYNPFADAIKLFTKEPLKPAHLPSPSRSTALELSSHHRLHTYETPPRPHTPKAALVRSLRTLVRLHMYVILDQRSRPETRFISNPSVSVDDDIRDVKTYVGRDSETLRASTPQQSRYDRFTPSPSLLSYTNIDVISGSFNSSRALINEHKNSSDYSCHS

SEQ ID NO: 965370 - protein, 200 aa, Homo sapiens
MCHVRARDPEELLCESLVVSPTLLRQAESLCPHNPTDDPQCVPTSVERGQSCDTPFLLSRCWGCVPKNTYNTELWPHRGLITRGPPEKSGGEGVSITKQTARARRRGSRPPITKWRHVRAAPSAGSRRNQRRPAGAAGGSTHKPGGAGLLAAPRRTGGGGPPTHGEEGGALPPNDYHKRGGARHHQWGGTHPNNTTHAAE

SEQ ID NO: 965371 - protein, 180 aa, Homo sapiens
HRGSCLQSQHFRRPRRVDHEVRRSRPSWPTRRNPVSTKDTKNKLARRGGGRLQSQPLGRPRQENGVNPGGGAAVSRCATALQPGQQSETPSQKKKKGKKIGSMPSWFLQEEELRGRGKTQTQGPELHMREVKDKICLLLFQTRNHGDAGGGLRQAFIRGKTATLGRRQGSGGTRLLGPES

SEQ ID NO: 965372 - protein, 113 aa, Homo sapiens
FVDTNNGRPPQPGCGVDLDKRQGLQRRHPWPWINFLGQIVQRPFLAVPAVPGGLASTHCHHAPRNSQNDTCDTVPHTADAPLERFLWARLLCLSRQPVTLVVPFFFDVRVPQL

SEQ ID NO: 965373 - protein, 172 aa, Homo sapiens
MFKLLNCKEKVLQFFSQRVVTNPCATSQQCDFSRQGTAARNSTPLTINTWYVECDGHRVKQGQFPVQTSEPARGEKPPCERTPGEKAVGESPDCVWWTPGCLHLCLGCHSQPGTRWPRALEKPAARGALVTRWALQLAPTWAQKRSGEIVRRLRTLAPEHTWVRREKGSPGV

SEQ ID NO: 965374 - protein, 69 aa, Homo sapiens
RRRTTAQNKTLEGPLILSLLSFPFSILSPRSPHLTSELLCPLDPHISLADFLVLLIPNSASHVFVISCF

SEQ ID NO: 965375 - protein, 283 aa, Homo sapiens
LCCFPMVYPMKITGTVLCWHLYYIWLHSLIGCLPPLFGWSSVEFDEFNMDVCGCLGPGDLATRPSGRSGVPFFPFHGHAGVLWLHLPLLGKGSKAQQGALWLLVRHRGGGCSEDREEELQSSSTSLFEAEQEEVPFRLWSISANQCKALITILVVLGAFMVTWGPYMVVIASEALWGKSSSHPRVLEILGMMVCPLLSDVWQPLIYGVWNKISSHENYVGMCLGDRYYREAFVQVTVDFQGFSISNMIHRPVSVELNGGMGRWKALGPGQDGCLVQVSRIRAD

SEQ ID NO: 965376 - protein, 75 aa, Homo sapiens
FVEEQRHLSSEPLSRKKLYALYTKSPLQISVNYNYSQPRERNPWFYYRSDNHYFIPYLGYHHADEATSPERLNAG

SEQ ID NO: 965377 - protein, 91 aa, Homo sapiens
MIDAGDDKRRHTGGLNPHKTHGRVTHTSADSPQEEQKRRSHKQREYLTSTRSQPTRRTSTNIALTDNSSDRASTNRQVATCVGIHTPSTES

SEQ ID NO: 965378 - protein, 150 aa, Homo sapiens
QAMQNSGIVLERAAGEEGALEPAPAAGSSPQPLAVACPCMLACVLVKLHACCETHGGQRWPQLVPMDPPMSSCCLEESLTCMPNPVKCPQDGATPGPEACSALRCQLLANGPFPPRAPLNPWPFSKAKSPIPKRQGLPTVAVEAWPAFPF

SEQ ID NO: 965379 - protein, 80 aa, Homo sapiens
AITRVSPGEEQRHDSQTAHPEILQIIDSHICTVSCEGAEGIFFTVAANLNILYNTDSCVYVILILLCFYSFGAWETPQKG

SEQ ID NO: 965380 - protein, 90 aa, Homo sapiens
NVIVRMAAARSSKPLRGRFSNVVTGKPLGGEVEDVLLWVLRVPGAAGAAGRSAYNLSRKVVQGRGAFFQALALAGLRHHLAGAAAVVLRR

SEQ ID NO: 965381 - protein, 140 aa, Homo sapiens
RITVLRSRIRFIHEVTGCVLGSSGKVLPKMGLGAVGSYLHPIPEQKTLNSIWNVEAHINPKLPNISLDVLQTQIYLRSCMESHMVMIRGNSGHQTQGQCVQVQTLALAISNYQGTMTYQGSNDKDLHEIYMNWKTGGYGG

SEQ ID NO: 965382 - protein, 154 aa, Homo sapiens
MDVWEEGRKNKYFYMCARGRQFQGCGVQECGLRFQKTNSGDTGKLDQGTLGSRVCSMVWVSQALFRGRIWVQQFFSEHTFGARRPKEWLSVTVRSKLRCRVSECTVPGWKHGQRGINTDECGTRGCQEARGPWAYGASEDTGRVTACARYGLNI

SEQ ID NO: 965383 - protein, 98 aa, Homo sapiens
VRYTSIAENESKEQSRFNLMEKMLQPCGPPADKPEENETLPYHRSAGHHLTSVSSGFANSILSIPCLHKDRFLHALLAPRCFSADRSGGYLYQSHLQR

SEQ ID NO: 965384 - protein, 248 aa, Homo sapiens
MATQRRDRVAWLLCTHTGVNMRLPSQELDWPGLHFWSLCHPETHDAAPSQRYRSAYYEDLWPALLQPSDSISANVNFTLTHLMANKDPTTGLTAIQRLTLSCMSWFLSSLFYRPLSSHQLTSLLLHATHFLQYVSQLMEAIIKCHGSSLPRELPGTLPSPLQRALGAAHRSPGATRPLDPVRTNQHEATSPPDNEINTHSTATRTNDTRLRRHPRHNETGMTDQQAPPGPYPNHPTTPTIPAQSARQQ

SEQ ID NO: 965385 - protein, 37 aa, Homo sapiens
MLVYKIRTGKGTDSGETGKCPAVIQYDHVVDELYHSM

SEQ ID NO: 965386 - protein, 74 aa, Homo sapiens
WVATHEHEGKPYCQPPLTTQTMFVGLNGFGRGGAESHTFQCKPWLVETPSLGCLQWPHVQANARPLSPDAQGIP

SEQ ID NO: 965387 - protein, 43 aa, Homo sapiens
MSSTIVYVIEFDKYNASQATYGKKKDESYGLSSTSSSIISYIA

SEQ ID NO: 965388 - protein, 349 aa, Homo sapiens
MNGKASSQANRRLQRYSWTQQHTTLPGCFSSTPVLHNTRNPPDRSAQASPSAATRAAGDRPAPCPAHGSLCLKLLHPAFPPYAQPNAALCSERNHGLPAQAHTHTNWHTFLTQDSYYATRPKATTYVTGSPHTLDTAHAPSIRDIPMGELTFRRNPQALRWAPPYPYGQAFLLPPPPLHAWAYSLSSVYPLNAAPWSTYLPRRPWGLVFVPPSGAFPLVPPDFSFQCTPFSPLFSLYTLPRFGLSFKVGFWPPPGTGGSYTLSGHPCAPPTGRLSPSTPMVASPGFLRLLLQLKLPSAALTLRPALRPLPTSLTLPLDLSRSAPAAYLPHFTSRIRPAHLWPAVPLPAP

SEQ ID NO: 965389 - protein, 46 aa, Homo sapiens
NLISGSRIYFPVASIHYFPRSLGQSVLAGDDEFSWLSCLLREINAL

SEQ ID NO: 965390 - protein, 34 aa, Homo sapiens
NESHTFRHFYSRDDIGIILINQYIAQMCGMPWTP

SEQ ID NO: 965391 - protein, 84 aa, Homo sapiens
DLTNQPPFRLLVRSIMHILLVSRRCQAVENRSRELALEVDQAWRLAVKEVEGAFRVQEPYPPQADGLHPLHGAHIKDVHAKPCV

SEQ ID NO: 965392 - protein, 122 aa, Homo sapiens
LLAGLAGSVAHLAVWGCSHSVRYCSSVVQVVVQLSTLSLVFPLRRTNAGLTQPCVSPRASWMTPGHGHQWSTHLLLRWCRTVQIADWRRPLWRGGKVDLQVAHGFDNGHDGLDGVAVDNRPV

SEQ ID NO: 965393 - protein, 82 aa, Homo sapiens
VRERMMHDSAEEWSQLLTWSALEAVLATKNVEPYDAVGNGERDDSQATLEARSEGKHRRPRYKLYISSCLNLFGFRLVFYLV

SEQ ID NO: 965394 - protein, 55 aa, Homo sapiens
GREVICYSRASSVGSPPTGNFAVLHQARKRDLFRSFSKVWTDVEVIETCRLVLTE

SEQ ID NO: 965395 - protein, 63 aa, Homo sapiens
YSQLVYQAFAGAGEILREGRDMAIQDWCFWVHGVFSKDQRWSEDEVFEMVYYELLCKSRTWRR

SEQ ID NO: 965396 - protein, 72 aa, Homo sapiens
MDTRDADFNGTKASESATFYSFAPRQENQKPKQTNKKNPTTTQNKAKPSRLYLALSKSILKFQISQTPLILP

SEQ ID NO: 965397 - protein, 66 aa, Homo sapiens
MIPCTADLSILRGGGQIIPTARRCLYRQCADRPATPHVSPSTLEEIQCPEQAEISGIYGDIEQESG

SEQ ID NO: 965398 - protein, 85 aa, Homo sapiens
QFAGSRRACLFISIPVHVIGLSHRFHYWCHGMVMDLGSPENKGREDSLVVNKMLTTAFSWEIRDRPCSSFFVFLYESERGDRNMN

SEQ ID NO: 965399 - protein, 54 aa, Homo sapiens
MVLHFYHVKSSLAQPQMMVVSDVADMFVPLLDGFLVNVNESRAFSPAYWIRFQK

SEQ ID NO: 965400 - protein, 120 aa, Homo sapiens
MCVLEQDQRIDSAAPSTVGFRTPVTKPVHGQAASMRVHLIFKNNSIFQCELTPLKPGLKHFPFSKGNKLLPKRCRLGPRAAPIWGGAVWTPWGRPGGAQWPFPGRPFRNAALATDRVSAA

SEQ ID NO: 965401 - protein, 76 aa, Homo sapiens
FSRRDPSYAMALSHMRPPMECRYHLLNRFSSTPGSSILHLKVIRLSHKASHCMDFTDGSDFPIYKPFIDRLYISFH

SEQ ID NO: 965402 - protein, 69 aa, Homo sapiens
DMIRLDLGTTTVALWTNYLQNEFSHILQGVNSELKTWHIDDICKISVQYAFSDAIMRCEVKALPLSSHM

SEQ ID NO: 965403 - protein, 54 aa, Homo sapiens
MIESSSVPKWCLGNLSKVNQCPSATYAIFGHTFFFLQFGKLPGKAVFTKYPLVS

SEQ ID NO: 965404 - protein, 41 aa, Homo sapiens
LLAYWRGSHENSKRPLSIMKEMPQDFSTSKKLVGIMAHSEV

SEQ ID NO: 965405 - protein, 71 aa, Homo sapiens
LSGLQEDVGNILGLRVLYSYKKDHRCSATTASNNELVRTTDLVKTCIVLIDSTTYRQWYESHYALTLGRTK

SEQ ID NO: 965406 - protein, 55 aa, Homo sapiens
IIPDIKRPQWVNTCFSQFWRGSHENSKRPVGIRLEMPQYSPLSRTLVEIWTHGGG

SEQ ID NO: 965407 - protein, 46 aa, Homo sapiens
PEELDDSDYEKEDRCQKQDERQTEDDQLIAGQSAGRSWLSFPRDRE

SEQ ID NO: 965408 - protein, 119 aa, Homo sapiens
LGSYTDEYIVGSYLIAHGFFSVYACVWTRCYILKYEEDLERNDGSAERPYFMSSTLKKLLKQEQHEGSGVLKAPMTTPPLKESHAAGCSVTRSVPPAPWAHLKSYHCRSAPPHEPDPNS

SEQ ID NO: 965409 - protein, 76 aa, Homo sapiens
LSRAEEGAGKGTSNEETPVFEQEFNTVTTLGENKKAQTDGDCTRRWIPSELVVLYACHCVVKLGVPLLHYQGKGKT

SEQ ID NO: 965410 - protein, 106 aa, Homo sapiens
LEIVLGSSPGASAWGSAIYGSYILLLTIHMDMEMDVVQDQGPDEAQDQLQVPVHDGLAVDETTSLMLSRSRNSSATDTFSSCIRRKVGRWYCLRSIFFWLSTSNKR

SEQ ID NO: 965411 - protein, 54 aa, Homo sapiens
CEDDSDIIHALKMDVVDIYHLTGYKERQRRTNIIRDHGLINLRQLQLMERRNPK

SEQ ID NO: 965412 - protein, 50 aa, Homo sapiens
RLLDPLWGHRDVAYIVVCPENEALSEGSQTVSSGDYDVPVYDDCVGYGHA

SEQ ID NO: 965413 - protein, 58 aa, Homo sapiens
GACGSVGYDLLKDGGVRPRIKSLSSLKPLVIFCHSAKNEDACFRFSMSRTWNLSNKRL

SEQ ID NO: 965414 - protein, 73 aa, Homo sapiens
MNPEDIRKHLLVHAPEDKKEILASFISVPLQFLQRTCTSPYLDDQSHLVTWVCLCGMGARVPVPNKRLGVPEA

SEQ ID NO: 965415 - protein, 65 aa, Homo sapiens
MDTSFLFTVVGMTGHCISKLITRHRTTRHVLRCRPTSTNVLYNRTLYIAINTAASYHWISPNSSG

SEQ ID NO: 965416 - protein, 132 aa, Homo sapiens
ILLALVTTTGSKIALARVRPDIAETEAAYLKILESSQTLLSVLKREAGNLTKATAPDQKSSGGRDSCPDHGQALPSVCPSAQPQQVCAQSIFVLHGSRYLPSLSQVPRGAGCQASTGISDECPAGYRAPNRT

SEQ ID NO: 965417 - protein, 118 aa, Homo sapiens
TALSSTDFYLSRLEINMLAFIPSSNRKNKPLVPQKLAIKYFLHASHRIHYSSNSYSLPPYSLRTMDPNQYYPSILLLNSPYGYSNKTKNRPLSLLNPRGYPREPSDLRAASSHLTSGP

SEQ ID NO: 965418 - protein, 49 aa, Homo sapiens
MVKELRDHADSNIVIMLVGTKSDLRHLRAVLQMKQELLQKRMVCHSSNL

SEQ ID NO: 965419 - protein, 75 aa, Homo sapiens
GDSTGSYGHSSQRYARYDFYLSRPRNKHASFYSSSNQKNNPRSTEAAIEYFPHASNRIHNSSNKLYLFNNITSPE

SEQ ID NO: 965420 - protein, 141 aa, Homo sapiens
SSCCNLSKEGGRFPTKKVAVAHQPKKAAVTPGKRQQQHLARRQLHQPKQFTTPCQEGSHTKGKALVGNSWEERVLPIPAKGAKNGKNATEDRGDEEEDDDSEEDEEDDEDEDEDDDEIEPAAMKAAAACPDSEDEDDEDDE

SEQ ID NO: 965421 - protein, 33 aa, Homo sapiens
REDIRMPSRAEGLHQDGGRFREDPEVSRCDECP

SEQ ID NO: 965422 - protein, 129 aa, Homo sapiens
VDTQIKAEGAATQQEGGRFPNKKRLQLPHQPRKQLLLQGKRQQQHLPRRQLHQPKAVTTPIKKGATPGKALLATPGKKGAAIPAKAAKNGKNAKKEDSDEEEDDDSEEDEEDDEDEDEDEDEIEPAVMK

SEQ ID NO: 965423 - protein, 55 aa, Homo sapiens
MVLIVTSDSINMCASHVHPYETQLGSSPMSPFEYLILFPVFIRIHWGMGRFGFCF

SEQ ID NO: 965424 - protein, 90 aa, Homo sapiens
MRYIDTILLELTTVRTRKTPALDITFCLPNEHTLCWFTSSSIKVRAVSLKVLVFQDMQQQATRKAFQQANFKHTKSSHLTGTDFVFNMYL

SEQ ID NO: 965425 - protein, 85 aa, Homo sapiens
MEKIWHTPSTTSCAWPEKEHPDAADRGPLNPKANREKMTHDLMFETFNTPAMYVAIHGCAIPVRLWPYHWHRDRNSGDGVTQQLC

SEQ ID NO: 965426 - protein, 39 aa, Homo sapiens
VDLRIPLALVITAIIVVHQISATEFIYFEIIAIKLTSAQ

SEQ ID NO: 965427 - protein, 34 aa, Homo sapiens
EEENSSIGHNRSASLMRHLFAVYFLLYNSAGCVL

SEQ ID NO: 965428 - protein, 49 aa, Homo sapiens
DRHLKSGSLAANTFTLQCMLRQAADRMLPALTAWWDSLTSLRRLAEALP

SEQ ID NO: 965429 - protein, 39 aa, Homo sapiens
LGLSVWEGLADADHVKPDSASFCTSRPRSPRADLQVRCS

SEQ ID NO: 965430 - protein, 79 aa, Homo sapiens
SCPSCASPSDRRCGSKLSKIRVVRTTFAVFSQYYQTQKKPQEIYEGKMYTRLDLRAKKTRAMRRRVNKHEENLKTNKRL

SEQ ID NO: 965431 - protein, 40 aa, Homo sapiens
RCALELIYRAGGIQQFESASFLSFSSAEMSRFTVHTELYQ

SEQ ID NO: 965432 - protein, 93 aa, Homo sapiens
GELLMVMNLSSEGGVHRAFSLDARSHSHLDTVSGGPRQRTVQYHAATQVEGDAKHRQHRSGAGAADGGVPAHGRSGKLGPSATLKFCSSNKRL

SEQ ID NO: 965433 - protein, 75 aa, Homo sapiens
GLPGAVGGRRVPYVSFGPHAGKLVAIVDFMIRTGLWSMDLDTEVRREAMPFKCMQLTDFILKYPDSAHQKYVRHA

SEQ ID NO: 965434 - protein, 88 aa, Homo sapiens
TIYALWEMQTSQAGHWLCQGVDAWHKMRQLFHFCGACCQLLNFFMVGLLQAFIIHDDLVSDEGEAKDSKSTVPCNDNFWYCTHANKRL

SEQ ID NO: 965435 - protein, 152 aa, Homo sapiens
REMLRDVIMCSRLRQLRDKKKPCSTLIRYVIKEPIIKRKTSLKELGFCVHVKHPHKIIVMYLQVLECERNQHLVQTSWVASEGEVTKTSPLLSKRFGAGTAASSANPVQALHRRLALDWWYAHSIAMADSCCGSLTIVLLVNPLSFFGNRID

SEQ ID NO: 965436 - protein, 52 aa, Homo sapiens
MITLGWILLKMKQLSLRTVSSVAGAKDELHIVEAEAMNDEGSPIKVTLGNFE

SEQ ID NO: 965437 - protein, 51 aa, Homo sapiens
RANLLRQDLMRRQEELRRMEELHNQMQKRKEMQLRQEEERRRREEEMMIRH

SEQ ID NO: 965438 - protein, 79 aa, Homo sapiens
MEPLYPTYYCKNETFMNAFLVGIRPRIIGIEHHDESESEKDEDVEEEQMRTAEGKDDRKWRRTEIQQVTKTLNGNSAFA

SEQ ID NO: 965439 - protein, 92 aa, Homo sapiens
QAVPLLSKIKAVLSPLTEAAEEESDDEIADKDSEVGDLFPVYTSAFIILILCKNETFMNAFLVGISTEDTWDEDEEASASEKDEDVEKGKWR

SEQ ID NO: 965440 - protein, 124 aa, Homo sapiens
MPKQSCRCDFQAQHAGPKIDEKLVSLKYIIKSPDGHIVGKGRPAPTVSPLPAKTCNGCRYEFAIIEPSRTRTQTGMSQKVEGPIEQGLRMVSPRWGRGGDDVCTRTQLQLIEPSQCRGLYNNPN

SEQ ID NO: 965441 - protein, 74 aa, Homo sapiens
YKILFSERHIIWSNLQVSRNDTIPEDFQEFQTQKFRPLRLLNQGSNLVTSFIGTLKTIYIFNYQLFFHLPTHNI

SEQ ID NO: 965442 - protein, 41 aa, Homo sapiens
MRQDRQPKQLILINRPMISPALTGLKLLSFLVLLPDTSKEH

SEQ ID NO: 965443 - protein, 44 aa, Homo sapiens
IPNLLIPNSKYLINNRLNHHSKQRLTQTKPTKQMIHHYTTAKRT

SEQ ID NO: 965444 - protein, 37 aa, Homo sapiens
YQVSRKKGELQIHEGTGRIADQVIYKPDCRGDWVMFC

SEQ ID NO: 965445 - protein, 109 aa, Homo sapiens
VSQTYESLKGGGPQRFLMNMRFAQKHNKKGLKKMHANNAQVHECTCRGYQGPRIAQGGYSPRSRRVSAVKLDRLAYLAHPKLGKRARARIAKGLRLCRPEAYAQAKAKA

SEQ ID NO: 965446 - protein, 36 aa, Homo sapiens
EPAPDEENDYEGVIMKGDELFYDSASRSTRRYFPYH

SEQ ID NO: 965447 - protein, 54 aa, Homo sapiens
TGRRGWRKNKGLQVTLQIRGPPESPVAGVLLVWPSGGAEHAGVVQRVIELTGDL

SEQ ID NO: 965448 - protein, 77 aa, Homo sapiens
DHTLLSLLSSGDTCVILLFLRTLVQGEGVYYYIMFVSSATPHRAKGPAEYTMLKPETSSDSPSARSKGVRLVSAIPF

SEQ ID NO: 965449 - protein, 40 aa, Homo sapiens
ITRNTSSVCADTVLGYTVHHRGLLQCALERRGPEAGKVGW

SEQ ID NO: 965450 - protein, 101 aa, Homo sapiens
IDTSVMWRSSGDILGCSNLDKYDVPGYLLSASPSILAALGLTLGLHNFLPLFLLCFFYQELGPLGLLLGHLFGFYSSCVLSAKAQLCDGHIIQDEAEIPGL

SEQ ID NO: 965451 - protein, 39 aa, Homo sapiens
VVHGCQPSANPEVQVPRCGSSSRVEPVLIVWSKLFVLGQ

SEQ ID NO: 965452 - protein, 127 aa, Homo sapiens
MRSSQWSFSTIRRCTQTLITSICMQLRPNTRIDLKKKRRVVLDSFLLVLLELGELALRVGVKRGPVGGSALLLYRLCLPLDTEPRSILRRQLAAIITAPILSGEVHRGLVSLGTQSRKSHIAKIPGL

SEQ ID NO: 965453 - protein, 175 aa, Homo sapiens
PEFGSRDDSPHKVSLPAVQSAAHNLNSVTFLRVSTSNTCDRTGHGGSHTCEDTWGAKSPSEFDSGSGLRRSDVVHSAGSSDGQAQDFHNICDLLAGSDRRSIMMSLLVFLEIWSKALMLQKAHIVERVWEAVADRDPLACVFRLKQVVPTQPDLAIPGEEGGGCMRREKMGKGMD

SEQ ID NO: 965454 - protein, 110 aa, Homo sapiens
TATHRALYNMSRSEVIKAFRPDKDSSHDLMLLRLLQSTAKITDVVKVLGLPNQEPALGTTCYAIRLGQHQTRGVSLQCVSLHLLSNDMLCKSYYSEKVTEFMLCAALLDK

SEQ ID NO: 965455 - protein, 64 aa, Homo sapiens
HRQGVITCQQCSSAIGASVVSICHKSKNLHTQIWFVTVFSNYSLHDVFDMVSYDQMNQKQNEPC

SEQ ID NO: 965456 - protein, 37 aa, Homo sapiens
VVRTHALSMSHAPLRWCFCNVYTAKNPRITTKYLVCY

SEQ ID NO: 965457 - protein, 40 aa, Homo sapiens
LPDTPVSAHKAASCVAYGTAPRSEEFGGSCRVLWVGFVCR

SEQ ID NO: 965458 - protein, 99 aa, Homo sapiens
GLTDLTVKHAVTPPWMSQPQCLSVILSGEHTLPEGLRSPRSAESKESPSNWWAFSKTWLLHWESFYSVRLLAPVLPAGLPRRRVLNRVHSSCAPGLTIT

SEQ ID NO: 965459 - protein, 73 aa, Homo sapiens
RIYNQIQALYGTKGAIRSVFLLGRDLTTPAECMWLPQHPAPEAPGGQQLPLAPSSPQKLRRRHSASTEAPLWE

SEQ ID NO: 965460 - protein, 72 aa, Homo sapiens
LYQNRHYTEERRLRSVVLVGRDSDYMPGGSACGFPSTQLLKHQAVQQLPLAPSSPQKLRRRHSASTEAPLRE

SEQ ID NO: 965461 - protein, 112 aa, Homo sapiens
MATILLHASVGDVMRALGQNPSNAEVLKVLGKNNRDEMNVKVLDFEHFLPMLQTVAKNKDQGTYEDYVEGLRVFDKEGNGTVMGAEIRHVLVTLGEKMTEEEVEMLVAGHED

SEQ ID NO: 965462 - protein, 117 aa, Homo sapiens
TQDQILVWCCLCTSIHHEFLDIQVNKVTVFCTVGKVVTWKTPGDSCWDFIMLLTVWFVWFCLLLIFSLLLPAWLCQTNPPVPGARKCLGRVWNTHLGSTPAPGLRARWGSWWSPRRC

SEQ ID NO: 965463 - protein, 90 aa, Homo sapiens
RRPSSVLLSLGCVTAALRRHNSVQPCPRKTGKIGYTRDSSIFNFVMNGSLITFRQDKIQHRPELFWLVIGLRSWGTACGNTCCALGTVAR

SEQ ID NO: 965464 - protein, 124 aa, Homo sapiens
TVGPIPTISYNMVDDYVSTRRAETCLTRVYHKGISGTGTEVASRSKSSRIKNDSREKIQSKYAEAYEVLSDAKKRDIYHKYGKKDSHGGGGGGSHVDSPFEFGFTFRNPDNVFGEIPRWMGPPH

SEQ ID NO: 965465 - protein, 57 aa, Homo sapiens
YVGPSVIRVLTQVSPSMVSATPLPDARRARDEGCLECCEENKIRQVRQARGVAWDRR

SEQ ID NO: 965466 - protein, 43 aa, Homo sapiens
GRSRGSQRRAILDNSSLLSEVKPILEKLTQEQDVDVKYLPQEA

SEQ ID NO: 965467 - protein, 43 aa, Homo sapiens
VLLLLLPSSLHPYAMFPPWYAMLGRLAHEVGWKYQAVTAAGGG

SEQ ID NO: 965468 - protein, 81 aa, Homo sapiens
MCAHPSRKAVNNYSCMAANVVGPSSKKPTSLPSTRRLTRDEGVMGNESINWDKLGFDYIKTDKRFLQTWKNGEWQAGMGPT

SEQ ID NO: 965469 - protein, 53 aa, Homo sapiens
MTSRDGRPAVCCAPESIGYTNFIIVEKNFVINVVYRLGAIAKDPKSETGPRSR

SEQ ID NO: 965470 - protein, 44 aa, Homo sapiens
MVWVGLVNSGITGLGWVVLLVQKVVLAGEQDDTDVPGEWDQLLG

SEQ ID NO: 965471 - protein, 85 aa, Homo sapiens
APYPGPDAEGPHEDNSEHLKNPVNSTEDPEADGCGSACHFGDDLFIPPFPSPSCEQEDAGTAATPHGAHRGRPGAQKASSLYICP

SEQ ID NO: 965472 - protein, 137 aa, Homo sapiens
NKFTYKTIWAYIQTYRSDIIWMTQLSRTDKIETAVTINPICFWAVQQAFLIFSIRELALILRIITPTPSSNFTAAQGATTSTKESNHDLDAFSSGGGSKPSYEAIYVKAQLPQASPPHQRPAQENLPHLATELWHLL

SEQ ID NO: 965473 - protein, 46 aa, Homo sapiens
MYKSTPDVIMVLGFRTHFGGGKTTGLGMKALDMKSPFRKGGEHSTM

SEQ ID NO: 965474 - protein, 94 aa, Homo sapiens
VIACSRKSDYIRVHFLLEEAAGQLAVPMVERDPARVKLADHYKALHILVHELQDFAAAEDYCLLMLLGPISITIASNSFIICCLPSTCVLALLP

SEQ ID NO: 965475 - protein, 30 aa, Homo sapiens
MASLLFFGLEEEHPMVCHSGKVCLGLQALA

SEQ ID NO: 965476 - protein, 73 aa, Homo sapiens
MSSPFMPYWWNIDLAADILNSYAGLACVEEPKYMITREYTWMWLKEEIIDDDDDDITLTVEASCHDGHESAGQ

SEQ ID NO: 965477 - protein, 132 aa, Homo sapiens
MKLTASSSSLDTGSSSQLSCSLNSDSCLLQENGSQSPDHCEEPMSCDSDLGTANAEDSDRSLQEVLLEFSTAHVNSVPSNGLSPETEIPIAQGSLSLHGLNTSTYLHCEAPAEPLTCQGDSGTQDGVHRAGA

SEQ ID NO: 965478 - protein, 35 aa, Homo sapiens
TYGTPRNCSTCFHEVPTCMAWDLPRSLAMGGTWAQ

SEQ ID NO: 965479 - protein, 47 aa, Homo sapiens
RGPFMSGFMPSEESQETGSGCAPQLQVSVAVPCSGTAGSGAYALHCC

SEQ ID NO: 965480 - protein, 90 aa, Homo sapiens
HVQRFHAGWEEGRLKDDVLHGSGCHEIMIECFIPNANHYYSKPTNKLHSLSIPHAFHMRHNHNQLYLLYVKPTWHEGTRYEMSSAFMPYN

SEQ ID NO: 965481 - protein, 35 aa, Homo sapiens
MLCTVAQSCLVLSKELLEGLKMVSTGPGESWRMIG

SEQ ID NO: 965482 - protein, 71 aa, Homo sapiens
PGPSLTATVKAMRDPSFVCDLHHSSRQRQNLNPLSEARDRTHILMDPSWVREPLSRDGNSQDKHLSEVQGR

SEQ ID NO: 965483 - protein, 65 aa, Homo sapiens
RSLLDPLLPSLAGYGWDTRAMCKLGFFMPNQPTPRWRKTFGVGFKLRRPPAKQQCPRSQRHSRPP

SEQ ID NO: 965484 - protein, 74 aa, Homo sapiens
MSLLGDVKKLITDEFVKQKYLDYARVPNSNPPGNEFFWGLRSYYETSKMKVLKLACRVPQKDPKEWAAQYREGP

SEQ ID NO: 965485 - protein, 56 aa, Homo sapiens
VRGDLRIPLYLSMQEILCLKKFRRPRQHYTASPGDAQGTGLQKINLQIPHNTGPIL

SEQ ID NO: 965486 - protein, 74 aa, Homo sapiens
FISSAFMRQQVAKPESKSNRIKDDHQEKEFETVYATPNSDPRFTRDLEECIVASYFSQSQCLSRPRGFSNPKAT

SEQ ID NO: 965487 - protein, 57 aa, Homo sapiens
YRRHDQGCSCRPMSQPQIHQIQAESSTYTTAHGNTEILNPLSEGRDRACNLMVHGNT

SEQ ID NO: 965488 - protein, 87 aa, Homo sapiens
FISGFIPHFQSDYTSAKWHESARHDFMSSPFMPAHTPKNLELMQLNTSHGAVPTEPSIGPHPLRKPFPNNSYTSSLGMKGLDMTGTE

SEQ ID NO: 965489 - protein, 71 aa, Homo sapiens
GYRRQRGILNPLSKGRDRSRNLMVPSRIREPLRHDGNSTLVIFKSGGLKKSSQFIIKCVALTLFPYPILYQ

SEQ ID NO: 965490 - protein, 77 aa, Homo sapiens
CCWGALEDPSCQGFHPPNHPPDPPGCAQPFEAFEECLRQNEAAVGNCAELLRRFLQCAEQVQPPRSTATVEAQATSW

SEQ ID NO: 965491 - protein, 58 aa, Homo sapiens
HVSASCVYHLKLLFPAGFIELAWPLYTFWGEESFEREEGDFRRGMKMSPGRHEGPRHE

SEQ ID NO: 965492 - protein, 36 aa, Homo sapiens
MSSAFIPPSYLSSQSTACSGVRLADVGATGGTWGLR

SEQ ID NO: 965493 - protein, 106 aa, Homo sapiens
TASILSYDQDEHLTQNTHSSGPYEQQPGQFEDEETLAITVVSGLLDTCYINSIHPNHNTRAHLNNLYILTPSHNMIYLNPSRNQTEPRSTLQKESQNLYQALTYGN

SEQ ID NO: 965494 - protein, 108 aa, Homo sapiens
HIEGFMPWFRLYYKATVTKTIWYWHKDRHIDQWNRIESPEFNPCTYSKLTMAEEAEYLSGTKPKAVCNGFREEVIRSQYVSGSKLSNRCSLPSLSKQLMLSGMKALDM

SEQ ID NO: 965495 - protein, 40 aa, Homo sapiens
QAFMPPVFIVLTTSAGIMDHEEARRKHTGSKTFYFWHDKL

SEQ ID NO: 965496 - protein, 63 aa, Homo sapiens
MGRIEAVATSLHHSHSNAGSEPRLQRYTTAHGNARILNPLGKSRDQTCVLMDASQVSYPLSHD

SEQ ID NO: 965497 - protein, 81 aa, Homo sapiens
MKQKKASFEEASNQLINHIEQFLDTNETPYFMKSIDCIRAFREEAIKFSEEQRFNNFLKALQEKVEIKQLNHFWEIVVQDG

SEQ ID NO: 965498 - protein, 71 aa, Homo sapiens
MPTLSRRHISFSTIASMLKKGLTSVSCVGSASADPPTSLNTTNSILKRRPLSAVTPEKPPVRTFSTSLAFS

SEQ ID NO: 965499 - protein, 42 aa, Homo sapiens
RYLHARLTQFNVTLLPLQNCWRQKCDIELSATSVWLVLESRQ

SEQ ID NO: 965500 - protein, 106 aa, Homo sapiens
VDSQECSCKDSKFNCHLRCASISTKQTALVRRLLAMENLPVLGTDTDIPMDIDNNDINRDSSSGFGLTQKSHHPQKIQMFFLDPSDLDVDGDEEAVCTLSPSISDN

SEQ ID NO: 965501 - protein, 34 aa, Homo sapiens
MLKCVQAITHYHHPDQSGDADICQLLPRVALAVT

SEQ ID NO: 965502 - protein, 68 aa, Homo sapiens
EVLPGECRALRKQQARATVEASCMRSVTEGGPYSLLLVPWAPYYVHACSLCAARSTQDGRTPLAEFVP

SEQ ID NO: 965503 - protein, 39 aa, Homo sapiens
GSALTSFSLFQLSSSMDHTGGAASWQYKNGYVTVSEINS

SEQ ID NO: 965504 - protein, 51 aa, Homo sapiens
WKVCRHDRLYSYCHFFRGPESQTPLFVHLVTEGSPVRIAFQQHAAPQVLRS

SEQ ID NO: 965505 - protein, 85 aa, Homo sapiens
VLTHEDIQNGVHAAVGNGNGSGQGHTQAEDGARHGSVMELQEVERMVGAPAEEEGDNDGHDDLEGLLGLGQAVAPQLIDDSEVAG

SEQ ID NO: 965506 - protein, 59 aa, Homo sapiens
LRHMDVPRLGVQSELELRAYTRTTATQNPSHICNLHHSSRQCWILNPLSKASDQTHNLM

SEQ ID NO: 965507 - protein, 69 aa, Homo sapiens
KATIQMQSRNKKWAQVLTALQKDSREMEKGSPSLRTLMAAAENSHSCTNSEPHCRVPSLIVSELTPGAA

SEQ ID NO: 965508 - protein, 43 aa, Homo sapiens
MPDPSRICNLHHSSWQCQILNPLSEARDRTCNLMAPSWICFHC

SEQ ID NO: 965509 - protein, 74 aa, Homo sapiens
ITNHIPELVRFLNDTLSTLDTQRKPSRSSLSSGHRKPTPFRRLSGAYSKRLGNDKYLKSFIYSSRMQNIQAILT

SEQ ID NO: 965510 - protein, 75 aa, Homo sapiens
PALLLEADEGSSLVDQIDQLAQDLLSLPISSCLQASLPDHVACELLDQLPLRLLQIQFLHRDHELGLLSHQAVFL

SEQ ID NO: 965511 - protein, 87 aa, Homo sapiens
GQLFDPAPACCEPILDHNPYPKLVSKYAPSWAQTPETGWAAYGGSRNWNVPLAHLSLLSLWVPTHPLCCEECSVPETVGALTLADWG

SEQ ID NO: 965512 - protein, 57 aa, Homo sapiens
PYCCTSGHRIAYQDLLCDLLWSDPSRDVQDWGANDRDVSFTFGAEVVATYLHKHDLD

SEQ ID NO: 965513 - protein, 88 aa, Homo sapiens
ISRASPIEVFPLHICYSLDGIHSKSQPSVVNNIEPHFGAQRGCRCLNQGFGVLYVNKDAIADLVQVFISNASSLLIAIGYSDRVNASV

SEQ ID NO: 965514 - protein, 111 aa, Homo sapiens
MSQCMLGLYFGFLLVIFAIDMLRHSGDIPTRHEVIKEVQEVFKDTYHRLKTKDEPQRETLKCHPLCVELLWLGWGRDHCLSQIICPKKDRYSKPFTAESPVLSANQKRVFD

SEQ ID NO: 965515 - protein, 35 aa, Homo sapiens
PSSVIPLHICYSEDGIHSKSQPSVGNELVDLVWSP

SEQ ID NO: 965516 - protein, 114 aa, Homo sapiens
MTCSEASTRQKWKKEIHVSDASPSSYVNRPEPSQSCHLLLLLHVMASRHKWALLEHCIKLFTYRWSEELQTDEEGAQEDDDEAHNARGIPPLGLIALEGLTQLSRCPAELANGG

SEQ ID NO: 965517 - protein, 71 aa, Homo sapiens
LNLAKQNSNRGCKPVDDYENDCAGKASGGYEDENGCNYEGYVADVKQYAHERILEICLYVRQIELVIINAS

SEQ ID NO: 965518 - protein, 32 aa, Homo sapiens
MVHRLSVISMCHLYPVACWPVNAMIRCSRAFK

SEQ ID NO: 965519 - protein, 35 aa, Homo sapiens
RLAGLQSGHSCTDRWLRYAVNAVLTVADMERKDRR

SEQ ID NO: 965520 - protein, 42 aa, Homo sapiens
MRNLLMLMTSLRPYSLESTGFTSITVALIRDSSLEVSTLTLT

SEQ ID NO: 965521 - protein, 46 aa, Homo sapiens
AAPCVVAIAVPVVVSSGLEPRVGGSSYSYGSGLGVEEVGYTVPDSE

SEQ ID NO: 965522 - protein, 62 aa, Homo sapiens
YDFILNFNCNLSFHGILIHKNGTLDLDSVLNIITGTPVTAASRTSVPTMRNTTTIKKLLAHH

SEQ ID NO: 965523 - protein, 105 aa, Homo sapiens
RTFVIRCESDSWLYHWLIHVDCTYTELIFVGQAAGPWTLKEVLLDVVVPFHVLLAESQISMLEDCTALPPSYEEPYQDRVSEELRMSEAQGVPAGGSGLSTTVRL

SEQ ID NO: 965524 - protein, 72 aa, Homo sapiens
STIVAPTPAGQVTGQCCEEWLCDEDGAKDPMDDRDGLPGKALAFDASEVELTRNNELIAFGKGGSLKRLPGK

SEQ ID NO: 965525 - protein, 81 aa, Homo sapiens
RSAGLPSLSITVLVQDGSRAIDAAQENLGNITWTLSLKSHTLTWDAISQSFTGTHYIPNAQSGDPVSSKIWQFVYETVQNI

SEQ ID NO: 965526 - protein, 84 aa, Homo sapiens
RYRIHTTYVSTIIRFSHPTRRNKSEIPAVRNEQNEFPSWLSGYRAQLVSTRMRVRFLDSLSGLRMDVAVSYGIGQQLQLLFNPQ

SEQ ID NO: 965527 - protein, 38 aa, Homo sapiens
TEVYFDTQVLMLFPGLKCEHKTEQHQFRGILTIGSSSS

SEQ ID NO: 965528 - protein, 94 aa, Homo sapiens
TDEVSWRNNSQDALDIDDALFVCSQNSHVTHERGVEAIQSQVEQTAVDGILSRNSVRVPKFYFFFHRILYQYMVFRKTSLIGGTKKSTHIFIII

SEQ ID NO: 965529 - protein, 117 aa, Homo sapiens
PAVYERNRDRHRDRERDRERDLDKDRERDRDRARDRDGDRKRDMDRERDRDRDREGAFRRSESFPERGADRKGNTLYVYGEDMTPTLLRGAFFPFGNIIDLSMDPPRNCAFDTYEKM

SEQ ID NO: 965530 - protein, 121 aa, Homo sapiens
PAVYEHSRSQGCIPWPALGSTQTYQTGPAHHLPRDHICLGSRSLKSFIRLIQPCRFFKELTYDSLAIYWESLLLESMNPDPQREFQKHHKRRKAVLFPVGFAVGTPWHSHGGRWNWRVLLQ

SEQ ID NO: 965531 - protein, 81 aa, Homo sapiens
PNERIECGKSFRRNSNLVIHERSDTGEEPYERTQCGEPFSQSQQLDAHKRTHTGERPYESNESRKAFNRSSKLSRQTRIET

SEQ ID NO: 965532 - protein, 84 aa, Homo sapiens
TPRLSEAEAPCQPLTHNEHTARLPDQHSDCPAVARLGLPGEPRPAPTLYLGSLTGADSLAPPSMDTALLLIVTLEERRGLVSSS

SEQ ID NO: 965533 - protein, 62 aa, Homo sapiens
PAGYEEMIFHGNVDKDAPVLSELSKPVVARLIRMYPLTWNGNLCKRLEVLGCSEAHVYSYYE

SEQ ID NO: 965534 - protein, 49 aa, Homo sapiens
MHAFFKAILFICSGSIIHSLNDEQDIRQIGGLYKAIPFTTTPPISPSSP

SEQ ID NO: 965535 - protein, 91 aa, Homo sapiens
MSRISTIHDILHSQGTNSAVRETATEVGRGCDFHNFTVIHKTDESSPRVISQGKPSSPQSWHFFTFTIFYADSYLTRQQHSRSYTMTMNAE

SEQ ID NO: 965536 - protein, 125 aa, Homo sapiens
PVLLLLLSRLCLDYETATIYYILTLTDEQVLEQDQLPETPVSTLRAESRQTARRLLTHYGKRQSLVISQMLRKSMETRDWLSTLEPRNVRAAMKRMVKDTTVIDVQMWLLYEECVRKAQSSDSSK

SEQ ID NO: 965537 - protein, 54 aa, Homo sapiens
ILNPLSKGRYRTRNLLVPGWICEPLSHGGNSLVLLFLSIFILIINDISCYTFVM

SEQ ID NO: 965538 - protein, 81 aa, Homo sapiens
SPNGLYFVCIFDRMLKKQICEFTGFLGQPFDFCFQPFILFFELSDSLQALCFLLAFQPALFHSHVVPLSAVRYSSLFRSMG

SEQ ID NO: 965539 - protein, 44 aa, Homo sapiens
LNRYLVQDQFPVTPVSTLCAEASGNGAAQLVTHYDEGAGPVVIS

SEQ ID NO: 965540 - protein, 110 aa, Homo sapiens
MPVMGSEYAHEGWKLLSPTIKSPLSLMKTDMWYRHTEVGGNRFHSAYLQTSARLALLLSHQCTSPDAHDQPSAILSDESTGFTSITAGLHSRLVVVGLHFDPDSEYERSE

SEQ ID NO: 965541 - protein, 40 aa, Homo sapiens
SKSCRTATTSLSDNVLVEDGSCRYAAQENLEYNVEPQEIS

SEQ ID NO: 965542 - protein, 45 aa, Homo sapiens
SIRSYNAERAHMCHWKPAVRRDCYTGTQADSLKSHWFPDHYPSMC

SEQ ID NO: 965543 - protein, 72 aa, Homo sapiens
VTTMNRVQTGSNTRSDFYLHIKYHPDDEQDKRNKAYFTKRLPPIHNIISNISIIPTTLPIELEESISDVDLQ

SEQ ID NO: 965544 - protein, 34 aa, Homo sapiens
FIAKAKEDFLTKMGKSRIRTQTTLDQFERIKTHR

SEQ ID NO: 965545 - protein, 118 aa, Homo sapiens
GVDCSWWLSLLQQPMMAVDKKISRIANRTDTFHRPPYLMAETREHVKLIKEFENYIQGINLVQAKKLVESLPQEIKAKFPKAEAEQIKAALVAVGGTVGPGSSLQLGGLVFRGPGPIG

SEQ ID NO: 965546 - protein, 69 aa, Homo sapiens
TRMGVYVCISAPLLQLKSQNTTDHVHLCSLHCSCSLLWFTLLPFTVNDDVLCWAGRAHHPSALHAEWVL

SEQ ID NO: 965547 - protein, 76 aa, Homo sapiens
CCCRSSRDPPRPESSMTSTVYHAPVFLIDHLHQQQLYLPLQSPVTNPLFPRAGQAQAAVLGPVGTYFKPLNSTHRR

SEQ ID NO: 965548 - protein, 32 aa, Homo sapiens
MALRGDSWWLPVSSFMPFVFSLCKVSTVPLGV

SEQ ID NO: 965549 - protein, 38 aa, Homo sapiens
AGRTLAAIPHHADGYGVALPEAAATSQYTFWSQPSRYR

SEQ ID NO: 965550 - protein, 45 aa, Homo sapiens
MHIIYGGRRLVKYALFLLSFRTGEEFEVSLKPTWITPALNLTITV

SEQ ID NO: 965551 - protein, 71 aa, Homo sapiens
KHTHKNDSTKPTSINTSNMKLMIGQTMDIQMYEERNHHRHHGACHSDAPLKSQTSARYKCGDRPREHRSGR

SEQ ID NO: 965552 - protein, 37 aa, Homo sapiens
PSIHVPSVRQMKASSPGIYGSPVKAATCSADPTLQDR

SEQ ID NO: 965553 - protein, 43 aa, Homo sapiens
LLLVVSSPGADSGIEAQLVMCELIDELANQEYQRLMDINVAAG

SEQ ID NO: 965554 - protein, 33 aa, Homo sapiens
MGRPDPCDTVLVETSACRDGTFQNVGGCGGAFW

SEQ ID NO: 965555 - protein, 36 aa, Homo sapiens
VSLIHYLYHLNHTLYNVQEMGTNSHGILSGFNNDGS

SEQ ID NO: 965556 - protein, 35 aa, Homo sapiens
VYERLGCTIGSWYEMMQALLVSESPLTLHRNESLE

SEQ ID NO: 965557 - protein, 62 aa, Homo sapiens
SSCHCSIDIPSGAGIRRMGRGEGKCWRDQPDLLISLTAPKKSATQFTGRYRYLGGRFVPPAL

SEQ ID NO: 965558 - protein, 86 aa, Homo sapiens
LHGWYTPLVTVHDLPQFQVLPVCSSHLLLSSRFSSCVCLYHCIQVLLPVLGAGPLIGPVHMGWAPMAGNTLGVGPGTGKCPCAPNE

SEQ ID NO: 965559 - protein, 56 aa, Homo sapiens
SLLDQSLPLSARRPSSTVTQCEGMDEMESPRLRANNDLVSEYQQYQDATEEEEEDV

SEQ ID NO: 965560 - protein, 47 aa, Homo sapiens
GGILHLAGKGYWHTVHVGITPASGYTRLNWTKTCKNDPRTESQISPS

SEQ ID NO: 965561 - protein, 38 aa, Homo sapiens
WWLTPPNLKSVNELLYKRGYGKINRKRIALTDNCFDIA

SEQ ID NO: 965562 - protein, 43 aa, Homo sapiens
LTSTPQSNHRPKQHAPQGQPGCPCPGHCDRRHQEARPVAGDPP

SEQ ID NO: 965563 - protein, 59 aa, Homo sapiens
NIILVIPVVTYLNFPSWSKLKLQELVAELALCPRSTADKSHSPWLPKDNLSLNFQEQAA

SEQ ID NO: 965564 - protein, 43 aa, Homo sapiens
PRLGYTVMYVSSGPGICPGISGKQWPSGGESITKSLATQPGII

SEQ ID NO: 965565 - protein, 68 aa, Homo sapiens
SIRYPGGASGEEQRYTCHVQHEGLSEPLTLRWEPSSQPTIPYLWASVAGLAVLAVLAVLGAVVAVVMC

SEQ ID NO: 965566 - protein, 36 aa, Homo sapiens
CYSSSNELTAGQRMNPEDASSSPVGSPQFRQISRLH

SEQ ID NO: 965567 - protein, 60 aa, Homo sapiens
IEDPVSKSATSPDGKTAARTYLPVDPGPHLQWCLMLIMNFNEDEETMQKLTRETWTYKLG

SEQ ID NO: 965568 - protein, 38 aa, Homo sapiens
MCATIPNHNYYFKDRIFSITQEVETADESIITPLKRYR

SEQ ID NO: 965569 - protein, 122 aa, Homo sapiens
VGSRMLYTYITVFLAPMRHRADSNGVLMGSSNVEGGSMGSSDDLSCGEMYDSNIDDWIPVPELRTNRCNAGVCALNGKLYIVGGSDPYGQKGLKNCDVFDPVTKLWTSCAPLNIRRHQSAVC

SEQ ID NO: 965570 - protein, 43 aa, Homo sapiens
SSLHSSHKNMVWCPSQSSGELSPISVTVRTAMQELQEPQTHHA

SEQ ID NO: 965571 - protein, 50 aa, Homo sapiens
MTVLHRRTYYYTYTVITSFMVLILGIRGKLQFYSSDDENNFPKQVCQGRR

SEQ ID NO: 965572 - protein, 34 aa, Homo sapiens
TVYSVAKELRRLQLELTKVREEFKELKARNTKEE

SEQ ID NO: 965573 - protein, 46 aa, Homo sapiens
MSTGKMLLNGLSRCVALLQWVIENRNVPLANAHTLHAEPHENWNKA

SEQ ID NO: 965574 - protein, 43 aa, Homo sapiens
LLCVILLAGGTRMSTGTFPINDHLLPVEILYSGVVFVHKVVLD

SEQ ID NO: 965575 - protein, 53 aa, Homo sapiens
ALVILLSVTFPPRYQKCRHLHWQQHGIQELFKRISEQFTAMFRAQAPSCKWYT

SEQ ID NO: 965576 - protein, 63 aa, Homo sapiens
CWYFLGQLSLLLGNTFSVTSVVEQCDHAAREAPPSLLLHQCPQDLQPPELQELLLAIRGSGAE

SEQ ID NO: 965577 - protein, 56 aa, Homo sapiens
NHYCHLIYKVRWHRQRTIEKFEKEGAEMGKGSFQYAWVLVNLKAERERGITIDYFL

SEQ ID NO: 965578 - protein, 54 aa, Homo sapiens
MVSIPSFGVLRTVNVEPVRPHRGGSMGPALVIVTSNFLSMDLTVELSLKQLWLR

SEQ ID NO: 965579 - protein, 58 aa, Homo sapiens
PLVDPFQTQFLISDRGQSCEEVKAPALVVATLIFCYIIGIIDAGLPSANNDLGKSNPC

SEQ ID NO: 965580 - protein, 37 aa, Homo sapiens
VLQTDTVAPPVHVGILGFPHAHVEGDDSDTYVLSCFP

SEQ ID NO: 965581 - protein, 153 aa, Homo sapiens
MERTAHTTLLLKEDDYLPSKLTGCTCLSSRGVTQGSWFSLVFEVGLSLYHKRGHPFFPVISGTVLNTRVSSPNLLPSVNVISKAAFTDSLGIAYYNCRIAGNFFCTLDGFFHQCLNRTNLADKTCNTRKSVSDVQKQHLSIPSRVSVRGTQLE

SEQ ID NO: 965582 - protein, 41 aa, Homo sapiens
SFDLRAVLIWLSYLIVVHILRWFLFMQQGIGTGYILKLGVY

SEQ ID NO: 965583 - protein, 66 aa, Homo sapiens
SSLEYPATARANNMVIRDDNQTIRLQEALNLFNEHLDTTERVRTISADPCSSTQQDSARLSKVPCL

SEQ ID NO: 965584 - protein, 79 aa, Homo sapiens
RSIPAQHALNKRLKQKYSTRILSSSMVSISAEIGVNALDLVAMQHMLMSDYAPVSYTFFSFIHCFLLESMADIVVEDER

SEQ ID NO: 965585 - protein, 61 aa, Homo sapiens
LNQDAQDGLSLAMLNVCCYTSQDGQLGVSDVRDESGYRALVHGRGCDAEMLATFLWSEVCS

SEQ ID NO: 965586 - protein, 57 aa, Homo sapiens
MTWKRTMKSETAISIWVCLVEPTLPSTLSRTFIFFGSNTGLKTLSKYQLLSNLSIKV

SEQ ID NO: 965587 - protein, 62 aa, Homo sapiens
MAKLGGGISPIPPYHYTTLITTLIPPYHHTTIPPYHSHQPIYPIFLYKEMMMDIGSLHRWYS

SEQ ID NO: 965588 - protein, 71 aa, Homo sapiens
MWIIAPAKFLYNSYCATFDRPVTITIMSHDPLHSNNHIRSHLVDHKPCRHCDALHVSIAESQVASVLKPTM

SEQ ID NO: 965589 - protein, 72 aa, Homo sapiens
IPRRHPDLFSTGRPSCCSAGGISAVRKGIAFMCCICKNGCLNFLTSYWQVIDKNWWEFHDMWTSLEIASQMS

SEQ ID NO: 965590 - protein, 33 aa, Homo sapiens
TEPGCQIYSWPRVLLLLLRQGPGFGCSADSDEG

SEQ ID NO: 965591 - protein, 93 aa, Homo sapiens
RAAALVTVTATVPGDGSLRLGEVGALCDRASESGLRPALARAVTRTVSGGRDSRRVHQQEEDPEEDRTPRDRIAWGRQQRDPSLRRARTVCGV

SEQ ID NO: 965592 - protein, 125 aa, Homo sapiens
EKSRYLNNKNTAQHGTALKSQTLSFSMTIPYTPQKVSHRSSFTNCIHSECLLPHSPPNSQVMPWHSAMHLSTVQAQCHFLDTHSIITTFINHYIINITHICHHPHKSSNIAVITPSTQDFQHQHH

SEQ ID NO: 965593 - protein, 34 aa, Homo sapiens
PSVTPKLIAYKESLQPRLCSTKAAVLYVLGGAVT

SEQ ID NO: 965594 - protein, 75 aa, Homo sapiens
ATSTRGSPCSRTIPSWGQRGIPLGGHSNGFPGPQGPYYCGARADRAYGRDIEKAYYRACLYADVKIAGTNAEVMP

SEQ ID NO: 965595 - protein, 333 aa, Homo sapiens
IYGSALTDSPYRGHRDAKIATCDFRLTMLIPGGTFQAAATAGPLHLKNAAIPRIQGAIAVHTRTFSYRDSHTLLPVTTLIPAIRSDKALVMDLTPLRNSFQVIYISLNPGVTSDPYGYIANSGLHLVTPLYLTRTPYYCCIHAHEQPLHLRPYQATSAVHWILLDHQQHFMAPRLRLATPLYWLLTHTLTLTPTETYATQTKYPQRPHRNGLRHFPTHHFPAKLAPLDYMDDTVHQPTGPLVFSPNKPRPISTLLTSHSLGPKADTYAHFGPTLGAFRHTVSPLHPAGHTRTLSSLAPVPSFTPRARVHPDTTAPPRHTRVHTYPTSSDQPPN

SEQ ID NO: 965596 - protein, 84 aa, Homo sapiens
SLEHRSQHPDTTAARSLHDRKPHFSHLHSSTSFPKRHEVCTKEEHEVAMLLRGTQPKITIPYTRYQPYNTKIPQEENTPMHRSM

SEQ ID NO: 965597 - protein, 235 aa, Homo sapiens
MQNPQIQRARLSFVYRCYIRRGNIGSSTLYSSLLAELVIQTTSFQMIRGEGLSCWISDIWAVATGHRSHCLTQQGHSVTNYHPSSSQLHAVPNIVSPHAQYPYPANLHPDPDHHGSHPSRTRSGSAPPRPQPPTHAHELESQPPPAQKNKNRTWKKRLYNPEQQQIHATGALAPQAPITPVNTDLPPRPTHKCAHDTTIDSQPESSTRDQQTPEPHTTSVPPTPVHLLTHTQSQT

SEQ ID NO: 965598 - protein, 337 aa, Homo sapiens
VGYVKEYFNYNGMVCFSPLKFDEALDMYYIIMAGKYYNEEQYYYIKPINKKFVKSTNTFGLFIKNNTYRNVSSSVYISQSVCDCLKKFNSKPLLKMIYEHRKLKTTDPIKDSTNILPIKLIACHTVTTVSLQHNHNHKTTLHHTHPRPQHHKTPTHPNPNMSKIRIHRRKINTDLKKRVYKETRRVSIKEIENSTHNTDTPVINKIIKKNPTEQNQKKHKTTKQNREYKPHNKHSYARRRHKTQTTPNKQNPIKMTQDAHGTDRGKNKKKTKMKHAKSRQHAREDTAEQNNQASQAALAPRARKARQGEDRDERAYDARRRRRRRETEIQRSTDKRS

SEQ ID NO: 965599 - protein, 97 aa, Homo sapiens
LSGCGRVDDLQTAVGFSTQNPGVGATQNRISSPSHFLYIGFCEKPYHPNTMASNVTNKRDPTLPGGSRVYIGNLNTLVVKKSDVEAIDSESMAQIVG

SEQ ID NO: 965600 - protein, 108 aa, Homo sapiens
MLLSRKWMAVNVPVKLRSVNSFMLSNVVVTAYRTRITADSTVQVTWQRKFVLLSAPTEKKAVSDELTTEKAQKMLVLSAVSDYRILIDRHIVHRERNIRTTQFTHNTY

SEQ ID NO: 965601 - protein, 219 aa, Homo sapiens
MGHCVQPAIEPDIAALKPPPRTLPVPHPNTTRPTHSAPLQQPPPTTIIVPTHGHDKSDNRLSLVNTRNPPQNTRDKKRPLYTAAGNSSPRTQTLTPAHESGNKTRITQPMDPSTESHDHNHHRIVPHHQQATPTNSRHSPTHRTKQAHHGQPKQQHTSRIHKSQQPRPPITTLHHGLAPPPPQPRQQPLDERQHSKVQHDYAQNTKYHPPSNSLTTNTQ

SEQ ID NO: 965602 - protein, 338 aa, Homo sapiens
RSTTTGHLIYKCGGIANRTIEKFRERRLLTMAKGSFKLCLGSMETPDKPDAVTLASHPLTIVACWQISAALEHTYLSSTDPFDSHLCTTSTHYIYNKPCTLQRHHFLTRPAPAAMPPCTPASTCPGLLTTSTLLDTPPRSLLTQAQLRHPRHHTETARHTCPTLYPSAHPHPIISSAPGLDTTHTPQHSGSRDLIPTHNTTPCATLVPSIDTPPSSAPLKASPDHTYARQRMSFDNAAPLPRGTLTTDATKHFQQPSSFPNPNLMQPRHTHPLAAAHYPTTILHRQTKSRHQHTNYFQHATRHLHIPWRAYNAATNSSLGTKHITLCPSSSTHHTLPS

SEQ ID NO: 965603 - protein, 469 aa, Homo sapiens
NAGCLRSPDSLQCPLNSLQGQQPTSKQLQHGKQAVRDQAINPSPWAHYTTPGKRQRPTDTGLNGPEPNVHPTHTTTTTVQNRQQRIRVIPKSTQTGKPTRLQTNQTTPVKQQQRPNEGNDEATPTNDNQKDNNDTKREHTPHTKEKEKKQNKQTTTTASPNHTRNTPEEITGAPSNTHSERKKKAPPKPDPHTIDTTTSHERQALEHQYETQQTYIHTDQQPDTNRSEHTRNQPHSTSTPPPTDPTKQPTQDQTTSHHTITKTIGAHTSTSSHKQTTTQENKKKQRNIANAAHTKMTHKHGKQRRHRHNEDSYKQQRTQEQNKTSNQKRQQTATKQRIQEERSTTTDNHKREQAEAQRRPTHPPHHTTANSEIETNSNDEQTRQNAKESPETTQPRHTYGSRHHNDTIRTNSATNKATQHNTAEGLRTASSQPQIDLDITSHETQSTTHTILNNTSNKQLTQTQNYYIN

SEQ ID NO: 965604 - protein, 250 aa, Homo sapiens
MIIYREPHQNTDEMFSDIYKIREHRWTRLCLEVDGDDGQRDRSVPLDDSASLVRHASAEGPDRRNVIRVAHVNHCVLTYTSMNQSPAGTTCSHHYTIAFQARYILRRLYTGQTQLHTVNTFCTPPRTTNPRNTTANQPYILDTEGDLTNNTIQGTTSLRPTYYRHTTNPTFITHSGIDTRDDIPNDCDHSDIGLPLSVPYTEQTLRLAAPPDNFYFSYPYKRALCYSSKPLAHPDCNNHNLNGPPRITRT

SEQ ID NO: 965605 - protein, 162 aa, Homo sapiens
MNNDKEKQVPLEDTSQDEHNDKCNRKTKYYQNQRYTNGQRMNTNEDFTTQRPNQPKRTHQARKQNKPNKNNHNTKTTGTKSRRPHRITRGTNDDENTKKKSKSHKDTNKQEHRRKTKEDEQPDATGTTNKKQERRKKENPKLKTQKQTKPNTTPHHTAPQKH

SEQ ID NO: 965606 - protein, 108 aa, Homo sapiens
MLMLIMWDRELSQREGSKTLSVYTERYASKRVPPVQKHDKIVTAIREVTGSTSTLLLSTEGCKLCQNRYRTPRITSSLTIPLCEYSTSRYEQPIAIIFRYQPKTRLTH

SEQ ID NO: 965607 - protein, 101 aa, Homo sapiens
APTKFDSQGSSRPIEVAKLVMPFKYSPPYDSICIYSRLLEVDKRIVIDMVSAQEPIRLSRNPPRKTTPRSAYGDNGTCYLITFAYALTSHCAKRKFHSRPR

SEQ ID NO: 965608 - protein, 168 aa, Homo sapiens
QTKFETLQAQLASLDLDCVIAEVKSQIMSAMASCGRAEELNPGTTTKFETLQAHCVRSMGDDLRNTRKEIIQEMKPGSTDGCAAEICQQSMNHACNRLGGRTRRGQRARAVGSRSKTAPSQRDRGASKARPGRRAPSRDLRTGTLACTYPVHLHDDLTPGPGTSTPIA

SEQ ID NO: 965609 - protein, 119 aa, Homo sapiens
MSKSKYTIKKNNSKIKADARASPKQNSPADTHPEEEPQADTTRHEQNEAHNRERTITEQRASEVTAGAKRETPMETAGADETRKVHEKKKMSRGRGRLKLEEERGQNQREQRRRSSEYP

SEQ ID NO: 965610 - protein, 322 aa, Homo sapiens
LAQLTTAVRLWDCETVKAAGPYSSTNSASPDLRLYDYWGQASSMFSSGPSQTGATKVHFVTLHKTLRRSRCQHMTKQVETLHSKIHIWQLELLIHPPRCYSSGDAHERRSCSHTPGPMQTCAAASKPSYSVAQKLIGRSARNALHTRSKRNHLTRDHDSTRTNPRLNPQGNPVDRAMGYMGGHLLGFTHVVASIERCRQAILSGMFPTITLLYCKTYFLVTRTHVTHGTEKKPYAVRADAISQRRGPHRQMRTSSKPSNDIAYIACRLPHETHECYGHTHDDTCPPITRTTGSTSRPQTHTIHKLHARTSATHTPLTDKSYA

SEQ ID NO: 965611 - protein, 106 aa, Homo sapiens
MRLKLPISMHDTGRHFGRLLRLHVVDWDQWCETLLQFYAFNRVNWDAHLIVGGHDQVIGATGNALGSFDFARTIRTYSYRKLYGYPVVRLRTLTNQNKDFFVRENN

SEQ ID NO: 965612 - protein, 119 aa, Homo sapiens
MPGVHDSSTACHCDRGRSVDRRAYSQHIQDILDKTPWSARRFDTLANAHSARPPNNFKPAHNVARSTQGDRWTSTNATARRSNGTIPRWIFNTQLWSKTTDTITANQREDNDPTTQAAR

SEQ ID NO: 965613 - protein, 416 aa, Homo sapiens
KAIQCFQSTGSNTSNNPKRKPAVMGNFRSYTESILSSTNPACIPTAGTCTGSIPTKWKWSNNSNNFINRTITVASASSAIRDYTPKSTMTLTSLKITATAAPSSAHSFAKHPMGHVAPGMLQQSKVGNTFNIHFMWMSSQQEEAAPQEHSDGKTEGVNSTDRSTSTLQEYLERIHLPGNTTQPPHRLHWVTENLNTDFTTDYNTERVSYNRTNSYLNKPRLTRRPATNPLIEQKHWKASNIFKGQPETQWNHGRHQNPIGATRQIQRKTIGPRVELHRPKGPPGRDTATSPGTSQRHGTRRLRNTRKRGIARDTNERKITGAQSTRKSGPSKCQLRIEQKAQEIHKDNENEDAQREDARPWPAPEKNQDRETDNELGRVQRTKTTTKTKGKAIVMTHTRLKRKEAKKGESAAAKEE

SEQ ID NO: 965614 - protein, 533 aa, Homo sapiens
GWTDCRPSNKLPTTVAGAPGIFISAQPQHAAEFIVETCSNMHRSSFAGSITMHSCIKPFQIMHHLRQHDGKQSCALTHQHNCMQAKPYAQPDHYHNPHAHTAHYFPDASFSPEGSMSGYVHRYGPITHAADWHANNKSNLVHCHWNNLWSTFVPWWAFFFNKVPSSNIINGSTHLHYQYIMIIYGHRTISGGKFISQLTLQTLTRSDIFAQDLNTSNQSFSYQRASPIGILLLPLSHFHRHTFPQLQTLFETTPNRHPPNSKHQETKQQHTPTRVATDTDGEITAAQLNEENNEKKRESEDKQRTTTSRFGAHRTQRTPNNMRETLKHTAEDTTKTTTERIHDRRSNHVTPNNKRRCECDTYTTTHEKRDRDSRRDKSKMMRKSGRKHTQKRGTRKEATHRAPNTKRTTTAQYQDTRSRKRSTREREDDEENGRRRRGTHGSKRSTKRREQREREEQRRITEETHGESEDGRQAGRRRDRAHESEQAAQADHAEPETQAEPREGDGQRRTEGTGRTTKNAYRMRQSRREAKTS

SEQ ID NO: 965615 - protein, 108 aa, Homo sapiens
IFNVSLHRPPITQQQAHKGKSYTPLHHVPQHTHRMCSLYCMLSTSMSIHHNNINTQHSISRSTYIKLYSRFHRSTMPFITTQMQSLHHHAIICQNSAVCSSTHSNCTS

SEQ ID NO: 965616 - protein, 318 aa, Homo sapiens
MKSPLQTNTQTDLGDMLHSLLLSEIGIIAGKRIHKTQAVPYICNLPPNISSSVNQANVRVEAIVYPIHSWCTLLQDRKTASEVLLNRMHIRRPGLPKHYETCYNQNRCKNNHSHDMTHCSGGTSKPGPTIHLLQILKTHIPAGARGKGNTSSWPGFQTSTNRRVEHSACDLSLRHLQFGRPRPVTSAETWCLVDSFPYYTVEIRVPNTLYHMRTADQPDKRETEEGRSHPENTHQRQREPRASDDRPARGRGKAAENQRTIAAGSSEGTTKEEVRPPARYQPRKGTTTRKRTPQPEPRGGERGDESGGRTTNATDQEQ

SEQ ID NO: 965617 - protein, 558 aa, Homo sapiens
VLWTTMYLSLLGVCMGCRPGPCQPQWHSKFAPHHGTLLQRSSTMEHSKSHQKHIPATIHPQSHGNTLCQLASQHTSSPCSSQQQQHDKPRLCNIIIVHIGESYSAYLFMEHTCLHHPHGEPLQATQHSTNTSHSFEYCPSKHHERTLCSVGYFHFTPHFAHTQGMQHSLQGVGYTTSHPCHALCATAKVHRHSLVAHILGYGPPTSHQWHFTFSIHAQLQIYVHPQFFLGLAPIPQDRHTVARTGHKAPPPHTYRGCRTWRFHESNICDPLGHFNFKNNLGELVGHASRIRQGTPPVQSPVSTLTNIPTGYQDHISSPRCKHPDVNTKSPPHTNIHHQYNLPAQYRSVVPFNYNKLRYILYSTDTTMAIVPFRRMSVTQLSTHDNLHTLCANQPTLVSSLHSLKQYDLHNTLHNTQYPPDHPNSCPYDIQTRLIPLAFQYYSKQLTSTRQTAYRQTMSHRTHEAWKRRSHDAYTTNEQRETRARENKSACSLPLTTVKQRKATQTTQQQQLKGALRRTILPCTPRQLTSCNDRQAERRSRGTETEAAEDSADGERRAR

SEQ ID NO: 965618 - protein, 357 aa, Homo sapiens
KTLWSASSGAIAASVALAGDPEPKSYRQNVVAKIRIEIFPSRMAQTIMKARLKGAQTGRNLLKKKSDALTLRFRQILNRSINQRLNTCSMGASALAEAAFITSCKPKVQQPGALRATTVIQNVHNAQVTRFERKTDNVSKVLLCQYLTITMKELNSYELDWFTQTVGNSWLNYTTALCQSQWNYWMELRFSADLLRSLWMHANKESHNRAMVHCPLQPLSSIPPGFSPLLLAFYSFKQLQQRQPKQSLTKRNTRPDKIKRTTGPGQQHANTVKSSGTTKLQDGRKGQRNASAHKHGTGHNSTTTGHDRQRGRTRTHNAALAATTKIASSDHHYTDHTAKKRLARRISDLPRYLGRPH

SEQ ID NO: 965619 - protein, 434 aa, Homo sapiens
LNAFNAQSIFNIIILYNSTFISNIKHQSSWRYWEVNNSQPYTHLRKAQIFTSYTHHYHFLCTAACSDTLTNYLHTLAFSTQSVTHITHLSYYHHLTNGQHYTNSISYQTQQQHTSLVRYPIYHIILSLHLTSLHPFTNDLTANAATLAHTSILQRNHTATVTDTDNRIHVRSSVILSSNAARTYTGATSPQYSSQTARLQRTRTRSHTLTSYSDITTCAFLTCYTTLPEGSTLNPHQLTKLYCTFNHAPSHCHSRTIISPYTLHTALLHRTHILISHLTPFAHTNTRHNTGQAPLPRNLTLTNSSSPRANSSRQNHDITQHTQATTTHPAEQTTTLKERRPKQEHQAEGNKNNIQQQEEPGPRQGNTDHNPAPTAQKPARKRGTTPPHHPSTTANATELRKKKGEEVSILFRRRKQETNQRGHTDTPNNPHQST

SEQ ID NO: 965620 - protein, 136 aa, Homo sapiens
MYIDLYVHDVINQLIDSCGLVRTLNTVRPYMNLGMCSRTSWACSLAPPCKIEKVQGPLHVTREHITILTSLLPVSTDFIRIRMERPGCKRSTVVDRHVHRPLHPLRKGESGPFTDHTVGTDPLETETYEANVIVRC

SEQ ID NO: 965621 - protein, 408 aa, Homo sapiens
MCTAQHYFIHASCIPSCHHLIDKCVSAQQQRLGHKSTMDLFLWLCMHRSVPHGITLTHACQIMKPQVPFHLGCSSDHTCIGSHSGRHILQCTGHITIVQTKNMHRLVGAISTQQQVHSKVGQHSHNQDFHLRTSKRLHFKIAGHINFVPTPCTFTISIHHETRSTHCSPIATIINTIVVHPSRFITSSNSPINTPKNNIPGNPNCKLHVCTDSHNPIHQIIEGPRTPVAFFKDHSEATWALLDGDSQEWQFNCFPGFSDCKFYDNQLNTVRHVFQATTMAFTPHTWMIQRPIHVTTQASTFDTSIAPFTRLRATDGSSHRRIDPQQQNIGVNYDADSFDQPVTDGNGHWGPLTINLVTGINQSLDTHGDQMSLTDIHVHTLERRTTMGYTLATNNTTMNTPPPTSDAT

SEQ ID NO: 965622 - protein, 506 aa, Homo sapiens
RPSQKLSSTHSVWLRECPSQVKCNMVISCIPKRASMVMHSVLRILHQSKNALGGKPRRLHEQTPRCEFLTRHIPGLYSTRSPRRASTINNYAPTPVKHTIETTTRKTRGRATSERREEETGTEEKEKGGPERVNDTGGERETASAHGKRGRASDGQRRAEPTTEHGAGRTGKASARQEQNGHERGRSRKAPKQRRDKQGQNRKSDRKKDRREEGGEGEEQEESNTSGQEKKKRRDADRGGEGKKEEKRERQQKGKERKRAGQEQDRGEDKKKAEKRRKSRRAEKQSREGRDEKGRRSKQGEEREKRGRSGGERGRRREKKEEGERREKKRMTSTKPTRRGEREKETARQGNGDRKSTREQTREGTDEKSKRKRERRAQRSERRRAGRERGEEDGERETEASAAKERGERGTGGIERRQATRRRENRREERERGEAPQTDGAKTEGERGEPARRGERVRDEARGSAKEEERGAGGAGRSGGTRRIAAGRGRREGGGAERAQAGRRRP

SEQ ID NO: 965623 - protein, 147 aa, Homo sapiens
MVNLTECRKIYDSNGLITYEFRAMISERYLKVCLKLESHTIMFDIDNGDKTIATHGLLTGSAVILIRYPLSGSKCLMHRHSAQDVLDRYRRIIQDDSWSRKASVSNVTPEITNHVILITSEVESCTAIERIMSNSDSFEIFRLHSSE

SEQ ID NO: 965624 - protein, 372 aa, Homo sapiens
MYRGSEDGRRESADHRVGSMSPDYRAPGDGEQCQPWYLGATLGVVGAKIVDNAATSVYLSTSCYAILTARQDEDCELNAQVQAIEVRRETPVEGSPVFGPCENSEGRAPSGWRFALARMRFSEHRWAIAVNAGRLPEYRSCMGGLDRRIRLRVNGERMKLPLIWSEMERLSNVGEQYMCYIGNSDGYKYRMIGRIVFIFSHMHMICREIMISMRCAWPERDISPMDGGFVERITVTKHEGNTVQRETTMHGSRGILLLMRGDLPMGNLRSSVVLNVASQAVGNQDIPVGSRSNAGRMLLQTSLVSAEMATWGGTHTRGGPILSLGKVEWPQKGLVGGAPMPWRRGLVVWLRPVVKNRLWGYNTRANPRAHTP

SEQ ID NO: 965625 - protein, 315 aa, Homo sapiens
MTNKNKHSKKHNTNAYETQTGSDTTKRHNNHTQNTMNNKTTRNTNNTNQRKPKTEQANSTTPTNTHERQRRAHNNTNRKHHPRHERKKERHEQPNQPRKTEHNTKKDKDTTKVAKQDHDKNRNETTHKTTNEQETERQHKTHTQTRKGDSKETERTNKASRGDESKKRREAEEEQKKERRERSEDEEEGHRQKSRTRETRNRDREHTEHETTRAAQTETTAKHRHDTKQKEETNTNTRGTAEQHETNRGNRTDETRLRTEDTKIGRKKKKNKTNGNENTKQNEKEEEQQKKNRRKRQTQMKQIKIVSLFCLRPHT

SEQ ID NO: 965626 - protein, 124 aa, Homo sapiens
MLMKAFKASSTSSTLIKDAKAYEAELLTPNLDPVYSTLIMNERKLFSNYKSNLMKIRYLPSDIMPRRENLKNYLENWTILTGPIDSTNSKLNEVIILPVNCQTPNKRGHGSLSEKGFPQTVPRH

SEQ ID NO: 965627 - protein, 371 aa, Homo sapiens
RFKGPAALAPPRPGHAAIQCRCWLGLLGLVVAEACRRTSRSQFLERRRVEFPLDRIQRHKSDYWAKYRSQFRQDSTERGEKIRVLQYKPGCTLVYALSASFEPFSEAKARRWGVQFTVKHEAEHRLWGRLCEGCILIVWTRQSMHGDSEVQHHVRSRASVALAARRFMSSSIYKGKNVRINEDIRREDDEFEWPCTQLMVRRERAYEVKIEERQVESGRGKTTGNYLPAKKLRIRMRQKRKDRTERGKNRESQEITPEDGKGPGNPEPYARSPRMGLEKWGQRGPPGVDTSVSKGACGNPRSINTIKEGEMYQNCTQDYTDRDIDENSAAAQSRSRTEVRTQNTSSAEGARRNTCEKISSEVDHGRRSLLS

SEQ ID NO: 965628 - protein, 95 aa, Homo sapiens
MGTHTALEKRHSAHKKLRGHLHSTQRRTTNTQPSHAAEKRRRHKTAQTTEGTARANNSAETPERTQGARAPGAPEPSTGEDYYNADHEPRPKHTK

SEQ ID NO: 965629 - protein, 148 aa, Homo sapiens
YSSLGDRVSETLSPKKKKKKKRSIIRGGPSEVLASGQGGLCAGSSLPSWWRSSVPFLFLEWFSLRVVEPTVSLARSGPIWCWGWNLWSPQTNGPQGWKPINPQGHLGYGNLVVVVRDTDGFTNRWIKVNNGGHMGRGPNFNLWIGGPG

SEQ ID NO: 965630 - protein, 139 aa, Homo sapiens
MYIERHAVCGYLPHSTIEEESSIIPHFLSEYSPCSIHYVRRVYMQYDEEGLCAFVAHPRAVGAECCGGTDSGECGLHKEGPVALRQPLAGEQCGGHQLSSVGAVRRGGVSLRFGGKKKVFGRGAAVGDQTREGGGRRVL

SEQ ID NO: 965631 - protein, 339 aa, Homo sapiens
MVTDGWGDAASVKAKGVGCKAENHVYVQASTVLAIIKLQSISCGVVINGELTLMVEWDGTDNNDSTDLGANVTLLVDVSLGRRCNGEGQHESGTDPVVIDTHVDYGEHEEASRDVESLGMLQAPAIANSEGVVLVIDGYMILDKQECNALSRGGAVSLFRGFRATQCAQVSHRGQSVEVHRGTNVRLEQGWRLWEDVKRWFGCTSFVVQHSFALGAGETKAIRLRLALGAMIAVVWMRCPESLVVMGPVAWSSGLASSCDSGAAAPGVAARSLQAFPGPVWALAGLGAGNQPREGPLVYLPINKFVGGATRYLARHTLLAGRAGVVPKHLGGAASRGVA

SEQ ID NO: 965632 - protein, 262 aa, Homo sapiens
QVTDKYRKPEGGSPEAVGQISVGIPLPQQKQGEEGGPLQPFYVGRFRAPLVLTLWCARNLLEGEGPNSFPVGTVGIARLNPSLCQVPPSPFFPQKEELFLWGEGDRVAQDTTDAQCDEMRHICAALWYTPGTPMCTGMCSEQHVDHNVVTQRNTNNKTVCHTGTTLWVENERGEHIVWDPQEHLCGGAQSGIETAHERAAGCGRTRRPRGCERLPLEIIVGCAPTSVDAKRGGDKWCAETSGGREHAKKDRGVYGGNGNASK

SEQ ID NO: 965633 - protein, 281 aa, Homo sapiens
MRAISLHGAEKNAGALGAPSAPYFTSFAPPEGYVREAVQEVNWAVIQLNYSNTDALIVEPDSNIKLRFQTQTRPGTHGQGFQTPRKRREQTRRRKREKNRTIPVPVASGAQAWRVLTKERGEKQMCGGKIYISPPALFRGHHTQGAPDANLWPTTTHAEPPHVWFLLLWEAHRFLQLFAPRGVENLPWCPHLPISSGIAERAIMYQDDPINQRGHRSKLRRELVGSNPIPTHSGAATGRKNRVDHSEFLTYQTGGATNTSVQETTHNHNTEPDYQRKQYDG

SEQ ID NO: 965634 - protein, 292 aa, Homo sapiens
MTEAPLKPKGNREKMTQIMFETLRTRPRACTWPSRRVLVPSTPSGRTDWHCHGLWRRGRPTTAGPSLQGHMRLPPTPILRSGPVSGRVPERSTSMKILLLRRGLQLSSTTAEREIVARHSKEKSVLPFCPGYLRRRDDGHRPHHFLFVLGTKSYELDRWAGHSPVGNERAPGVREALYQALPSVGMEIVAASTDEHHAKSIMKCDCVSIRNRTLYADHGACRAATTMFPGFARGMQRRSSAWWPSTGKDRDPRTPRSASTPVWLRGGPLGAPGPFHAELVSQRVQQIGPSFL

SEQ ID NO: 965635 - protein, 520 aa, Homo sapiens
MWLRFRGPLWSTSCCDRISMRGEGATPFRCGTCGESKSPCVTPQALCHMCATGRFFSPQQERGFSCWGEGEISGGRKTHRRGAHVRRYEHIVRRARGDSTARRHMCTRHVSSEEKWHTMCDNKNKTHIHTECVSQRGDMCVCVHTRATHKCVHTTEKTLWRGPRGLEKNPREESGADIAGREAARRTRRVLKSLLPACVVTVVGGSRPNFRETAEEGGDNMGALKVVVARKHAPQKCHEGGLTGGEQNQAPNKRPQASLSGVWWRGRPPRGVSLMEGPLKTSWGDQHQRRSRRGEVPSHNYPTPREIYIAVIPKRIPPKGRENGGQWAGVFVGSPNLAVNKQAEFWARVFTAPFPWGFPLLKAPKGGGFVPTLYSPGALQRALLRRNRASMLGRPPCLVDQHHTVWASGGKHTGRGAQKAPPSHMWGQHLCRGLQRRARRQYTEVRTHKQTRTRADTQLKDEGEATLTAATLSSNPHEHSQAKRRGAAPHKDREESPPTQEGSEQTTAECEVRNCTYNQA

SEQ ID NO: 965636 - protein, 134 aa, Homo sapiens
VSAWGARYRRPSPGGTAGGSGGDGSRVLMAERGTIWRTRRDAFISGCLDSIEPRLYDEFHRTANPRRWNASRRVRASNRRRSVLCTVLPERAVRTKVLLVSMHAVVPRPDGLSQEEEWNREEEAWTVRAVREVY

SEQ ID NO: 965637 - protein, 131 aa, Homo sapiens
MHPPPSAVEGDFNALSLGTNTSQQRTCEIICNMDPLVAEPAVNGSARQAYFNPPSLFAHAGERIRGRGDFGTHMDPLEPRKGSHSHIQDDLIDVYGQVHTLNCKPLWVSLTNRFPTAKLGALNPRVSGRAW

SEQ ID NO: 965638 - protein, 272 aa, Homo sapiens
MSKDGTREKIAIPNTDDTFQRKAAFVVRHFPSLMSYRLSGRRSEYGSAYYTLDESLEPNWRRRIPGPWEPPNIYPILLVTGVRDKKSSESPRCILTIIGEPMGTSEHEKARLFIALGMLKFPRTETVLAQHKDGTIVMQVVVQITVTQGTSSPGGPLRMIWECAQGVLLLLTPTASVMWVSLGHKNRLPLEVDTRAVTINRYPSANVGSRPQGEPLLAWLPGGRPRDRLGHGGPLWCGFQAPGASHDFPGPRLGSLSARVEGGVVSARTASF

SEQ ID NO: 965639 - protein, 40 aa, Homo sapiens
MGRVLHHYIRHTTIPPFHPSRHTVHNLTTIIARDSNVCLG

SEQ ID NO: 965640 - protein, 231 aa, Homo sapiens
MLSSCSVLKFISVLKKENKTERKKIYRTTITRLQQTKVRRGDIDKSLSLGLLIPNWTNSMTLVEGNFNLVTPSLYTTRMTPLLPSVLQPWRPSCGKPVGPPAGMTLAAKEGHQSHREAGPPYSGHQTGPPPGAFEQAPIRGNGSKPPAQKRSIRGTPIPAPVYPSVYNALATSRHYRTGFKGVPHPLHQTTAAQQQPTSNPKHLTSTDVTDPPRPRYLALARLHISQNRRY

SEQ ID NO: 965641 - protein, 89 aa, Homo sapiens
MRYAAIIITISLIISEQQRHDDDESSRAETQTHILTQHVMNILRSRSCRSRGERREKKYNIVVVDRSRYSSSRIIMILLTDSYPYSTCR

SEQ ID NO: 965642 - protein, 541 aa, Homo sapiens
MSRLVYNYVKASKRCRAPTGYYNPFADAIKLFTRGSPVKHRHDLPSAPLHRSDADLWVIVTSRRASTDELHHAEVARKRRQMRSQPINTTYGKLTQLRHIIRTTPAYDTSDRKQETKGIKKSRRYQTNRKTIKQPTSTTRTSAQDQHGRKHNETATRTQNTYQECQSTTKKHASKQNISLKSQNRKPSHIKEQKRHRNRQNITKNKARQKHKNNRTQATHEDNKHQTTTKMQPHNRDSKKKMKDNETQNHKDTKAPTQHAKRHERAHHKNRTTNSNQHKRTTATGTTKKTSRDQHKKHHSRQQRTRHRAPQTPTPKQQHKQDTHQTQTGTTLKNNYTTTNQHKHNNIHTPTPTEATKHRRKDINNTPPHDPLTTHNNKKATEHSHTTARQHHHHHGQRYTAHVTATNNRHTHTKQAGTKHTTNASIHHDQHLARSKTEETHKQDQTATERTTRQQHETHEQRSLTAQQMNSTTTHKARDHRRKSDHTQQEPREDAAEDKQRREDTRHSTVRTRAHNNQPEQPDTTKQPQKHKQREDTKRKE

SEQ ID NO: 965643 - protein, 383 aa, Homo sapiens
MQRASNVTYQAHHVSRNKRGQVVGTRGGFRGCTVQGNRLVWSGKDYCEHGLGGSTWLVMVIPMLTTLGMVTTSFVQGSPITHILALVLQDQQHSSNVRTRSQHSLANTLFCKALLGFSCAIHHSFHHPPFTLPGIATHMRQAQNSIAQVQRLTLSIIGQVIWLDGFLMTSARGAPTQGHCQTADIVRTQQAPGARGGHIFINGVLELGRTSTLLGTSLKQGPKKEAALPALGCLEKTWTSTGSRGPMDLVYRATVRRTPFLIHGNRGTPRRTLGRPRTIFIMTATTGQLLLGATTTSTQPSTRGTTPDMGDTTATTTGKSTPSGRKHRGSQRRAPTGRATHSSPGRQHTNTRTRAPDPKKQGTKENGGKTDPSHQTPQSTHQA

SEQ ID NO: 965644 - protein, 106 aa, Homo sapiens
MLLSPEEQKTLTVGPLLRQSEGLSAPQENVTKPGNPPGNLGSYIILVASENERGLGGDRLFPLPGEFLGTVFAEFQGDSAIIVEKATLLEHSEIAQRFVVSGPPLR

SEQ ID NO: 965645 - protein, 82 aa, Homo sapiens
LGERERKAPAGMAAARRYGAHANTSERHFIEDNLWEKAEKPFAQGHREQAKAARNGYPRDFLKPLFSAILTSIIFNQKIQCG

SEQ ID NO: 965646 - protein, 321 aa, Homo sapiens
SRWWRCKRAEGGARARRFQAEQLGRERLRRRAGRIESPAPCWEEEPRGWRSPRRPTSSTACTTGLRPAGAEVTGLPRRVARSRDRGVGSPAQAPRSDPACNKPPSSAGAPKEPSCGAKQKVAESMGALNRLLLGPMFEKHCRGDRYQLPAERTARSGAGRARRETGMPEEPGHQGARGGPREGRQAEGGYDGHKEEGGGKWLTGGRGGAREKSPGPRGKGQGGPTESRGKKAPTGDDVGTPDCGSGQWGKTALGGLKTQRGVKTPPPRVRGTKRGPRPKGGEHQDHLAPRGDAAVSTHGRERAEKEQQEQTHEDRRQTILC

SEQ ID NO: 965647 - protein, 348 aa, Homo sapiens
TEPQRLTAAQRLPSGVAAACLAVRFLLLTGYRCDRRLGGSALCFPSETGNSTLPASAWGVVRIGSERQWRTCNSRFEATAGREPRENLVTLLARKFMLLAWQENAAWGCQETSNTTWGNPRSCPRSLEGPIQPFRPKPFQALSEDCGEPWPICNYYQRTGANNPPYLSNINPTSHRDFTRLKNARGRSHGSNRLSWLAALGHTAISLVNRPPFWPPGRTKQRAHIKGLGEHFGELWAPRVFGTYYSPFQSMARPSVSEEIFPPVWGHTMCTEERITKAGLSILTYFYPTVKRQTADPRVCPLTRRMLFGTRIPLSNKQVFHTLASLTQTISAQKARKKRAVTPSYHSD

SEQ ID NO: 965648 - protein, 122 aa, Homo sapiens
MFWVMETAKPPVSEDSFRCQKVGVEDRGYSSTLAPVPQSICPSVHTPPDARTDCWEPDCPCETASLFSTHSGTKPPALTSVSSSPSYCKYVKKEKMQTLESGLELLPPAATFNYCTNVQRKL

SEQ ID NO: 965649 - protein, 264 aa, Homo sapiens
MPVIYTNQKLHIISCTTKLLKYMMKNLLLQQRHTLYYNTCKTCVNHITLAGANSTHTPHTRGKAQSRHPTRGRNPSHTPSILKRGYTQRRDQKDKTGGKKNRSSRRVAQRQLPGRTKTVEHNRFLDATNTSYNHTREASQHDRIKNPDDKHETSETTTTQHDTTKRAKRRATNKPNARSADKHQRESLRQRICSTHNDRSATERTAETTGVTEARELTNTEQYHTLRKHHNTYRDSESIHRTATERHWQSGSASSSIRRRRGDN

SEQ ID NO: 965650 - protein, 162 aa, Homo sapiens
MIGNVQNHVQFQYRRTVTGSRGPEFLSGMYIRISPIPASRNPSATISSLLVHLLIYNNADLLENYIPAKLTPAQPQNHSRTSALWLNLLHYPGENAPKPQPGHAGPPLKRHKTTTARTHTHIHTAPTPPPPAPHTELTDHILTRATPTSRQPHTHIYTQHIT

SEQ ID NO: 965651 - protein, 34 aa, Homo sapiens
MIMYTRVTLSPPISHQHHHTHTGRITNPTLHPKE

SEQ ID NO: 965652 - protein, 255 aa, Homo sapiens
MGNGEGRTLNAIWSYSGCHGHQGMLTNSGKRGLLSPSMTPIIDLNIHGLHCTNMIPPTGNIPWHQSRLRTGKLVINGNPITIFQEQRSPPKSSGAMLALQYARESPLALFNTMRERLEAHICREGAKRVIISAPSADAHMFVMGVNHSPTYDNSLKIIQQCLLHHQLLSNHWTNVIHDNFSESVERNHDHMFMPITVTKNDCGWTLRAHLCACMASWRYTINIIPCNLHEECKSMMKKGHTLDLELVKLIDMDIT

SEQ ID NO: 965653 - protein, 125 aa, Homo sapiens
MNTWTLTPEDLTPKGKSVRTVIFTTRKTSLNQMDFGTEEKTIHQSSKLEIPKGSHMSKWAGLDFVEHQIETVPKMEDTKKADQMNGKEHDVANEPVIIKEKLPKNPFGPTWGFNPKRPLITFKKE

SEQ ID NO: 965654 - protein, 387 aa, Homo sapiens
MRETEAEENHEKQEHEQRFRNHKTHNRRKRKQQNRTTRTKTDHKTQTKHTKKIPPQRGKYDSQEPRHAREENESLKKKPKEKTDGTGEERTTSGAREATKADSCTPPARETETTQHRDKQARTTHPKKQRSARPIKTKTECTGPKRTPEHSDSAALRREKKHEDKRTEIGDESTTGEQPPARKRGTDHTDTATTTSPRRTRRQKYTYDDAKKKHSAKTQARNRTADKTESEERHGHESKNNTNTMKHRYKTELTSNDKLTDTTQRDERQRKRKRELHEHNTGAADTNQRGERELTVAARERQEAKRAIRAERAKEQAEIEDIAERSERAEYNQTQDRGKQSDRTRQEHRERQLVPTAVTESCAACRQHEREHGNSRRRPEAGTGLRY

SEQ ID NO: 965655 - protein, 515 aa, Homo sapiens
QHFVVAECSVDYLSASEIETMCVPTWQKPCLDEQYRKYLGMVAHACNPSYSWSAQAGESLEPKNVDVFDAVANDWYYLQLQRLVYNRTTSLPSNTHKQTNTTTCHFTTHLHSYTDSDPSVILKVKKLAPEQHLSPKAQALHTLNFVHDVNIIAFIAENINQYETYRTTHMHHLTFHTIHPIHCALPCAHTYQPRVISPTTCKHLRAIVHTLHSSHQTANNVQMNSETLNFKPPIFISYSSHVGIVVPPRMIRRTASLTWDPITHYPFSILIIELERELRTCEDNRECKIRYTSVNEVTERHPCINWSKLGPYTLARGKVEQVQQRKLPPPALRSHLQEQHGQLLGHNRQNRQAQRVITLVTVTFSICYTTINAFQTIQTQEKKGDQQRNDRSPRNNTAENSAKAQVDTESRQEKRAKQRDRGTGAAGNSKDKTGQQARDREATPTRRTGNKRNNYEEQAQHEKQEREQRDHITSSRENTQGDTSKTRTHREQKTERERRSEQTPSSTRQERQQTN

SEQ ID NO: 965656 - protein, 438 aa, Homo sapiens
MREQNSRLNRLRFLSERACRRGPGDRVPAVLIHGIHSPAHDALCRLHPCTHLPLSCARNIAYVPDTMPYQYPAHDPRSSTQELSDIAHRNRGTMATGILAAELSPLGAIAKRTADHEGNRRTPTDGQNRQPTHRPACEHEQRDDPQIKPTMTIRRRRSTQTFPDEDKIKPKDKAETDMKQLHNHRQRSRKVHTARVQRSDNSPAQHQTGAEGHPSETDEQTNRTRYNTRPRGTRQEAFDQTEARSPIHHRHGTWKHEIFRTKVVKHGECVNTTYGKNYKHTQTRADATHHNRNKMRKSNRNENTSNKTQPIMNKQPHGHMRTRDQGRTQTAPPTDKSRHRHRKAEHTKDTRPQQKSDYGTQANPTLPEVRKRTAAHEQREHQRTRRQRGTTTGESRRGNVTESTERPSGAQHPNTGPEASTQRRKQKKGENRREDGAA

SEQ ID NO: 965657 - protein, 385 aa, Homo sapiens
MPPGVCCGPFSFGYCIYFDSQKDEVTPNFTEQASQQRQKETEACQGESWAFQDYLHLQQMLKLFSKSSYASKITSYWLQPVKSAQQVAIIAAQGCHNIMHHTCHIGIVVSRPADSEFDFASVFTSRTLYRNQRKCLQDAYTRLKLPTTFSQSNMYSAQSLRLQRMHVRHARHPTLSHINSTPLHLTTYSHTQLLANVRSSPSGGHYTGTLLLTVMEPTTLDSFNKSSLFHLRCTDSQYGLTHPHTRTPVTTCLSARAILHLYSTLNEFTTAYGRCRRPGDRRVRPYTRATCPSWQVQTNHRAPIGRPPRPKDGAQRRQPPRQGTALSRRQDADDGTKTAQGARHDTGTRHSGTPRRGRTPSTRARRPQRRKNETPTTAQRERDPT

SEQ ID NO: 965658 - protein, 85 aa, Homo sapiens
WGLMRAGLAGVASGRVVVSDIEKSDYYRERMETSTVQGILPGYHEEKEQAHGRHGIKSSAHTKKCDPLRDLTIEFLIYRSIGVAC

SEQ ID NO: 965659 - protein, 195 aa, Homo sapiens
MYEARTLSCLEHVISLLPCGPVTTEKIITRGPHRRLEGVPGKHGQDSRKAVESFSREHTGPDEPGSSSKVKLLFEPREGGPGVRISQADDAAQKVVSPCSSWHLISGERLIWKAQRGSEPWEHLARRACTRDVNFAILPDGVGGIMGATTDFLERSYLADYGSQPLLERVPFTRRGESLLLTGARRITQRGPHTP

SEQ ID NO: 965660 - protein, 149 aa, Homo sapiens
MGGSRGLWKLPGGAPGRQVKPRKRWQGKILAVGISAFGLNQALKGVRGSPGNSIEIPSSLTGSIGSANSYILPQFSPIGGVRLGECSNNGSKQTLGQTHVEQQDLRSKNPRKQKKTFLENLFGKGQKAIKGGSKRAITVAANPPLFPHS

SEQ ID NO: 965661 - protein, 273 aa, Homo sapiens
DAPVGGATQVHHCPEREEQRGSRRDSRTPGTLTWRAGARPLICPEVAGDPRALPCHAGRYPLQSRWCCDRPAVPAEGSVLLSTSYISSLSVRHVRESRLVHVGPVVTYGFFLGDGPSHSREPGTMASLEPGDERTYGDPGLKARGRPSRPRILSSGSCIHQRLISRSSPGETVSQVKSQHQRRQFQLEVAVPGFRTEQMGPFQSKATDLCARLHKTLARDTTFPGQLGANPISLNSAVPMRTVGSENSDGTEMNCLTVRSTVAFRWPQMEIPV

SEQ ID NO: 965662 - protein, 202 aa, Homo sapiens
APRPARRPPPSRCPTPKPQALKLRYPGRGRVAQRLSAHKNSMEQGAEPRTVRVSCAPKSTPERLHGWTTLSIQAVDNPGHPSIMIDWLRGGRRRQSYRSVKHLFDPSFEDRNGGLTRRQAGAPSTEASSPDNHEGGDTPCEHKPRMTGDSRDGARGPDASGENCRTPTRQQAAEAPDANDSYAEKTPERRTRPRGRYKRKTY

SEQ ID NO: 965663 - protein, 135 aa, Homo sapiens
MAHDTTTSEYCFLCGPAPITPSTIPGVVSSSLDFNPRPQNRCAWTFVLTVDYWSLRKRGRSRTAKTVVLRTTRPQNRTARTGTEEGPHTYKRSRHRPGMKGHRSETRRECPVVPPARPPDKCVCPRRPADGTGTS

SEQ ID NO: 965664 - protein, 44 aa, Homo sapiens
MHERNARQHTNQPPPRNTHLAQRALPRPKNPHNGKPEPGQHTAL

SEQ ID NO: 965665 - protein, 202 aa, Homo sapiens
KNAEYKRYLEMLLEYLQDYTDRVKASPRSEELFGKIQAEFEKKWENGTFPGWPKETSECPDHDAGAHLDLSAILASMGGVGFIWVWSRLKIVLSLACRLEMWRVRLEERAAETDSSYQRKVPGVDCDTSWLAKNPKSKGSQCETPEKEQRDCFSRSPGSMKYVEILGEQRDLTHEGVYSASKPGQEKSEKNEEEEQISESDE

SEQ ID NO: 965666 - protein, 262 aa, Homo sapiens
MPHLMDPDDDLHYRNPILQAFIMMTTSVTHIPMITYGGPTMNMMEHPTSLHSVTHEDPRHPTGWTAPWETDNDLDIRHEKGLYTSLVLHNRMQDNVLQHDRTKQGSRRSVNGPDDSTQHLNGSLNAARDAPVAWVMFTHRTHMGITMKSISRAIRTHHHEPDPTSIWHVAETESIIPTYAKGSDKEITWADPSSTGETRHNHMGALRCLGWNMHRTHSKLPYMTPGHRITDTGPTTEGTGKGLNGTRLDKDKATITRCTRQA

SEQ ID NO: 965667 - protein, 553 aa, Homo sapiens
MKDSRACYEEYKVVGSHALPTRHNADERSPSSSRNGRSAVLAAHTVTVRFGQKSPGSWVALVLLQVTMNDEECLYSGEEFVGNVVACSDASRCQSRHLGVGERHLRGILGMRLLKSPEAVIRYSDGYAGGNKRSEPWQTTLQGQAGAHTELAYTEENALRVSHMWYTRRAPRRPLTDAEYRRIPLENGLGEEKKFGRGTQGHMAWRHAPEERTARLYESNIAHGYSRNEEHIPTKDIPRKSYPPGHWRTANAGGDSHWQDTGRSQGAQTKNGQLKQRQLLPKGRNTQEVKGGATHRRQATVCAINQLKEEYDNVVNRTLRGHPGEAWLGATKDNLHKASEGRKNLARVNGGLQITRYHVHTLTKGQQTTSDTEKTATRGTTPPRPREGRYNRATTHSRGSDTPHNRGLGAATRKNRHQAAVTLSRVRKPNMQRFNPGHPGVDDMSGYQATSGQPERNYTEAAHELHLGRSTHCPNVEQLDLQPSGSQLNLTEGAHIAELKRAEQHPHRTLSSERGERNNHNGGGYAQAQPDTRQQQQLDKARQQAEDKHTDTQ

SEQ ID NO: 965668 - protein, 115 aa, Homo sapiens
LPGAGAAARHRLGREVAIAESAGVADGGPGRLACEVGLPVGCRTCTVASSEWRTARVIERADWPPKRGGDKLPGAAMGLRLGILVLASWAPCGCSARATERSSPGDSGTEVLLPG

SEQ ID NO: 965669 - protein, 135 aa, Homo sapiens
MTISYYRTQGDIRITMSAPSRLIENRTRNQIIAGTGHYNFGLGLYCTLLSSRQSTSSTPFSHFRRHRTAQTLICSHRLPRDLHVISGQVSSLSASSATNISLYIQTSVWLRSRRLILTADVEDYFCMSPSMMRVL

SEQ ID NO: 965670 - protein, 357 aa, Homo sapiens
PFYFFIGQKLRSRYSFFGRGLTMWKGSPNFVKRKTHVVTDHQEPGQTTDGGGRGSVRPNGPPRTAWRVHRTIGAIAPKNKLTSDEQTTNKCRRNSLHTQNNDTENMQPTQEKYTTHSGNTPTKRKHRSPRHPSSALITQETESTRTPVLEQYQRNHHSTQPQRRRAPTTRRRRHNNGEEQQEEEKDSVASHENKRRSRPRRDTQESRGSRKKTNTYKEEVAQQKEQQKHRQTEDTERGRQRQSENNTTTKSKKTGDRDGVSHTTRRHKETPHITPYTQPNTPDVTQTRRRQSRETDQKDHNQRDKQLEDSTSRTHAHKIDVLTIHRQPEEDVENTPEQGEAHTTAEHDREEDHPRQT

SEQ ID NO: 965671 - protein, 570 aa, Homo sapiens
VSEARQDICLLRQRCSSCNTTGWYTRNSPLAHLHSSTSAYCRLHATNQATTLWQGNGHRTQLRHDTAPHAPCLSSPHAQPTAPLTPYLYTRTSQLPTDYPILIYTRATRTLPPSPRASLSLLSSPLARAHNARALQPLHPLRPSRTHPGAQTTQLANASGLAAAQLHACHTLCAHSPHHTISHHPHTPAHSSLLSPPSNTQTPTLPTAHHNSPLRKPPPTLLLSQRTLSLSLQSATPIYPPTTGLPPCLSPPPHFLLRTSFFPPRGTPTTYSAAPHHLVSDPPGTLPPRAPSTHRAPRPPFYRACRPPPSPTLPPPGVHLPAPPTCALTHTSLGATSITRPAGLLSPPHALLATRLASAHAPAPDPASPSTSSPRATLLAPFGFPSPPWHTRGLHLVLSTLSHAPHIPSYTLDRTLCALPRSLRVPTALAAFAPFSAADLLPPRLPAPTPGPARHRAPSRLANLLLHAALDLTNDRPRTLDLAIPLLAHHLAAHLNAPRVPPPLSPLIPTGLSYHSNGLLLLMRSTSATAPPSTHPAIASCQRRHHPVLPRDAPPSLRPAVLSPPSQSQP

SEQ ID NO: 965672 - protein, 275 aa, Homo sapiens
MGDFDGELVSELQSTRHTCCHEPVYLLPEQTISTHGRSIASPFADNYRATPRGHQQPLLALSIPAHRINLYRSTPLGTCHTPNSSYTRHNPHDTLPTHWHNRKAATTEQPPQHSDPAAPREMYPTDILDSTTARHCLTARHGMATDSSALCRPNMGTTTLAANISESAAQTARIPQQLAATFSHNANRTSISRARNSTGGFRWQKTVARPEAQLQLSPFPPATILHSIDPAGAQNPDNLGATGTLGTTIHNKRTLDSRTHTPLSEVLPTAFEAPQ

SEQ ID NO: 965673 - protein, 175 aa, Homo sapiens
MFEARLVQGLHPQEGVAGTTRTLIQRGLAGILAPDGRTPDRDMDSYHVSLVAASHLTSLRAIRQLPDEIATMAMGVKPHTVCPTNTTNAHVQQNASHYNYTGQNDYTAGIPILRALRYSTNGNNNTQTQTYITAPNRTAPAEATLRHVDTKHGTLPDTEENTTLGGYATASPFME

SEQ ID NO: 965674 - protein, 455 aa, Homo sapiens
FENKAVMGVIQEKNNNNNNNNKKKKKKKKKQQQKKNTDQHNKQHTKNRKHKERENRHDNTTTQRKQRHEAPRETRSEQRRQKKKPAPQTRHAQHADTTDRKKEKRNHTTERRERSRPGGDKRREKARETKAKRGAEPTASTTDEEEKKKERRERRDRTSGRAEEGRDKNAQAKQRHRARTEDRKTTTGGTKRNPRTRETGTRSEEETRREEHRREQKREEKKEKRGRGEERQEAGRRRAERAEETEAQHPAGTKREAESKREAQSTRTQQDSCSGEAHPERGARREEEGKKGQRRRGARGGERQQKSAEKTRKRSGAGGGQGKSDTTGGTERRRQESDEHRSERQRRGRERGRDNSTTQRKGREQGASERGTARNSGRKRRVDEGERAARDDQEKRGRGRRQRQPSAHSEHGGGGAEESDDTRETEDGQKGRDAHGAHNTHAKQHTNEGETENRA

SEQ ID NO: 965675 - protein, 465 aa, Homo sapiens
MNIFDRKINFDERFIKFFSYNPSQRSSTWKKVYASYCTYSMYVGGMQGPMSIWSLTFISGWPALSALWASHASLHAFRPASATHHPSAHAHTSNEHTQHCGTILCLGISAISHSPSAGMALGGHMTPCDSYMATMAECKPTKDHTTITPPSLYYIGRHERDRNTNTNTGPYTTPMQTDTVHTGPREGPATTTNTDIKHMRNAVNHTHRAHKTHNAPTQRNSPTKQVPLTPHGTRTHTRSNHNNTETIPPKRREQTHTQAATQQHREYNRQPATSRSTYPSNSTQRQPDDRPPRHHTLPPPRSRIRTGRGHVNTLVPPIPPDKHQLPAAHRANTDHYASRSRPPHSEATATLQPQQPTNQRTHRGHTITLIHTRPQQHTHPDRHEKHVPRQTHTPHEAHERTRSETHHAQRTADRDVSSPDAPPRLTQQQRTDTAGTQTQTNQNTTPLRHATKHHRPTDRTDRTTT

SEQ ID NO: 965676 - protein, 242 aa, Homo sapiens
TPDSGPRAFSSASAAASSQKPLRALDSARPAAAANPRVHQHVPLQDPWHADGGGNPRSTAPGTEQQQPATSPGIPSSSAAAQAGNAGTQAQKAGRQRRQRRHKTGNKPVVTYREATRAPSTGTHSTNRPFRQQGLSQPIATRPSLTHIAQATKPAPIPNHIRPTTRGTQRVLRTAPPPSPRYGNATSGTQRALPESATLPPSHTVHTSSRHHTTRENLRTPCVTPPTPFHPTRHNPAGAIAP

SEQ ID NO: 965677 - protein, 299 aa, Homo sapiens
MAGSGLCPRGPGGTHISGNDSFVDDRYKISHGDAVARKGSNVLTSHLGLGNRLRVWGPRNARTMKRGPCPQGCEFAMSGRVRKPALGWDTGGPESHFRLPAWGRRPQGQDEALNTTQLGVPIPPAGTGTQNATCNSHTAGALWSSGTGSRGNTFDVTKGQAIWWGNRRQALGALGRQNRMYSYGGKFPLSYTPCEIYKERTAHHVGIPRLRRGNIGVAYGPGGTNNPGGDTSEGGNDTVSHQEEGGHRRKLKSPVNSCVDTPEKPRERERGSKEEEAQEAHTDHTSTQKTRRGEETASG

SEQ ID NO: 965678 - protein, 145 aa, Homo sapiens
MRERNTEEHPNSSGTLAINPNSSIHSEGSNHQRGTARESHQYVSLPQQDTSAAKRTRGRAPNDKRWAGAQTPEDTQGECPRTPKGAVTLITHGRDEQPNNTYPPMKEGGLSTINQDTTGGLQQPHGITIHGPTGDIPPGNPPTKG

SEQ ID NO: 965679 - protein, 43 aa, Homo sapiens
MVSPLKAIGLSDKFHLNKLNFENRGQFAGKKSLSEKYNQTRFA

SEQ ID NO: 965680 - protein, 267 aa, Homo sapiens
GRVGQRKTRLRNGKENEINQQFMRQSLRELWHHQVTVPEVNRREKSLLTLQMRRDLLQEGVQPEECVAIAGYACHQIETRAQFCEEEKKFLSCMTRTICRSARLGGDACGLLWVHSGKPCVGSTWHAVTDPGGTSWPRGMTRVLQRSYGILETPLGGSFGKTKRDEQLIYQQCLSCRIKNPCPDNKSVLDVALVRTGIIESLLCSSNARPERVYGVGRPSEMAPATRGWLVLRSGFADFFTCPAAGWAVVLPGWGRGGLVDGAGRRL

SEQ ID NO: 965681 - protein, 104 aa, Homo sapiens
MVIGVNPEEYQETYWALDVIWSWVIIMSSIYEPLILLRRWHYARMSAAKHSNYKTAMRDQGRFNKRPRKYFVARIWAGRRGADKFEVFSTHSSLKQTELRGRGV

SEQ ID NO: 965682 - protein, 131 aa, Homo sapiens
MPCARPLISVYSEQGVNAHLPENCHLAYLLFKAPKYGPSYGLNTWVHTHNSLSAKIHNQDHALMAEYIVEITGRLHSELTELEAPVGGNWARKFCRASEFSPKKSSRKGMAYGGHLSTLDILGAPRLNVPI

SEQ ID NO: 965683 - protein, 356 aa, Homo sapiens
GDHVRGQQLQPDPKPGPSPPLAGVVLGDGVQHPAPGTTAQTPAVQRSFSNHPGRVPGIILLTGNIPDAHVSELTYVTKNNPPRESAQPFRGLTKAPFPVMKPRLWKRHAQEAHLAPHKPPEEHYREPATWFDTTSTRLCTHCAHCTPATQANPLLHAHYPKGAPPSSAPFPLAAREQFPQAKAPWRPSHCEPLNSTTLGSPRPLSSRFAPLQQKNPETPPYISPPHHNFKGAHPTLPPPSPHTLPHQKTTHNATEIYLTHHFDRPITNIRIIPMHTPLPHHPTKGLRPRIGNPPHVAPTTHTPPLSTTPNTRDATEADTRRGDQPRVHAKRRPPVDRIYPGQQVGHSRAIIVSPRT

SEQ ID NO: 965684 - protein, 268 aa, Homo sapiens
MAPSREWHGLEAPLPQGLQRRVAQWFNQPARKIRRVRARQAKARRIAPAPALGSPSGPSVPLPNGFRVPTPKVRRRAEVSRPWKERSGVAGHSQRRVAPDTIGISLWIQEGGGQGPTGIPLETKRAERVESEVTGSKFNLFPQEKPSAPKEGGTTRSVAEDVEMWATPMFDRDRFMPRFRNVYNGGRNVESSLDGRRRLHRPAKSRMAGQRPVLRHRTKRARSPRLVFEKKINGLPGTGHRGSNNTQRGAIESQRPIRIPFAGALRDV

SEQ ID NO: 965685 - protein, 196 aa, Homo sapiens
GRTGSRLGSQMVRDYLRTKPEPECAQNRRRTDEDAAEIDAGSRQQADPRSFEIEMCANLAGETRDKQLERSIERSGSVIARHGNIGRPFNRFTDGLFAPCVGERVALARKDYLIVRSIQAAGGPWRGKASTGCETDLLGGTLEEYTSTVARIGKGGSRVQVSQQLRQRVGYKKVGSTAGSTHGVTSATGVTLEKPN

SEQ ID NO: 965686 - protein, 161 aa, Homo sapiens
GGGGTARPSSDPRSASRRREEVPTRSRSAPADRLVPVVLISVRNHRGPTSRGRKDADLSDKGKRRRWLLVERARNIKKLNFQAFAELCRKRGMEVVQLEALAGRSRSRAPLGPFIRIPEAKRPWNLWKQVPISLFCATARQTTEALEYTPRSPAAQLVHRF

SEQ ID NO: 965687 - protein, 113 aa, Homo sapiens
MLLFRSDGGCVAQMERALRRSQVVRRCEIPLGSGKFDRALVGHVLPFGTRRSGCAQYWACQWPLNRWTHAFTRWGFHSNQTLVAFYYQDSTHMTYRLGGAKLNSATLGRYLVQ

SEQ ID NO: 965688 - protein, 487 aa, Homo sapiens
MGRRPRPLLPVFVRNKPWHDKSRFCLSVSRALTIDSHCCDRVELEIRPQQLDARFRLWPRWCRDDIIAARLVLVTARWRRCPEILVPISSHDWLRKLCEENSIELPIILVLQRSQPVTHVYPAYNNRMFVPSALGLDKSVPRTSDHCSRCLCAKAHPGTLVRPGVQHMVNGLSMSRSATRSLARNKGRHCEFRGPVGQGAKVTRLSWTAHEDPTISTDSGVLQPKLTHADLKYCTSPWLSWTNAAQYPALDLVGGSHASHTPSYAGTTPGTTLERDPLALPTKGGIPRWKIGPPSINKVNPTKIPNTSLRKNTTTQKRQGQRDRRTTPHEEEHQKHPDDTQHHQDQREDTNRGAEAVKYKHKTQHASRTVITPSSAEAGDKREDHGGHMSDTATQHPSAGYERLYDPSDHKTTCTNDRPSQTLTTDEQMKTNRTDKDDTTTHISKTQTEPTRPSRKHEEPPESPDKAGTHIIDQSTAKNHEAKPALA

SEQ ID NO: 965689 - protein, 158 aa, Homo sapiens
SVGSITPSAASRPRLSRRAPCSELPVPYQAYRQLHLAVITYILQPDHVYRMLGARQSTPLLRRRIVYDLSPTVVHPIARTWRRSPKSTAYLGNSSPFAVVRATFLETKHEQTAAILGVAHPTARNSAACTTEDLPGRHQPLPSSTSHGCFFPLATTEY

SEQ ID NO: 965690 - protein, 308 aa, Homo sapiens
TYPENWRAFKALIAAQYSGGQVRCALRSTSTSIWGNSNRTPEFLRKFPAGKVPVHWRVMMDSVCSRATAHCLTYVSNEELRGSTPEAKAAQVVHGWCDASLIPDIVPPASTWCVPPPWGIMRTTMKAWPLRMLDARTCDVPNSGRLLDAYIEQTEGLFWLGERVTNWLTSHVVCALLWLYKQVLEPSFRQAFPNQPLVSSPAFNSGPGSRAVLGGRCNSCCEDGGRLMLKVAKSPSLKGAPRKRNGPGENRKPRLCGRGDTRGCPRPRREGLNLFTRRVLATGPDPLFTAQNLLGDERGPRNQRRHFT

SEQ ID NO: 965691 - protein, 360 aa, Homo sapiens
GKRRKVDEELVVPEQSLRKTMVIRADSVAGAPCDDGTAPIILEAVLQADSGARIADRFLLYAMDSYWHRRCLKVLLLPGAELGDSLGTSVLHRESGMIRFRNDYIRLFAHNSRCYAALARQMDSCRVNIRHEERKAHARIIFTRCWYMLYLDGISLVPGDRIHYINRQLKYIGEHDSDLQLFINGHANSVQSTSHYCQTRRSAKRSEECRMRDFISDLSSRRVDPEVSSRTTRSLRKIANKRKLHAIDSIMRTKLTLPDVIGGSNCLEYEHLRAHQKNRDQREQPGTPQEQRTTTPEENTRDSGRSDQGGEQEERQQRKERKRKNRATTGPKTTDGEGDSKAAVDTQHDREEHREERGAH

SEQ ID NO: 965692 - protein, 450 aa, Homo sapiens
MGKMQTIHSQAIHHQPQDITPSYHSCHQCTLHSAQSHSLPTAAAHKLTDPPQHPARSLPSQQRRLTTATPHTPLLIARQHIRLCEPHLFIRVSMCLHKPSPERLASHSRLGLLPHHITTLPLPLSTPFTHYPHPTKPTPILHTSPPMPPHSHPHALTLTTHRTLPPPPPLRAQPYSATPPPHLISSHTLTTTLSHPPPPLRLTPPQHPHAQPQVPPTRPSPTLNPPPPSPSPPIPNNNLTNLENIPTQPQHMPPQYPHQSHTSKIKTYNVHALTYNHSPTTYTTPAIQPYTLTTYKNTRHPPTSHPPPTPRPTPNNNAHQTPNPRERHKQRPGPTRHAHKNDTRPRPRPPPGRHRHHRTPKHHPDTTSTHSTRDPRRTSSPAHIPRTGPQPPSPNTATRSTDPRNHRHDTHNPQPGQGRNTASRETQATTQTTPHTRATRDTHNHKPQTK

SEQ ID NO: 965693 - protein, 231 aa, Homo sapiens
LSRRLARLVSLPTMEGVAVVTAGSVGAAKPRELQPCRSASAPVYPDRLTLHRRGERDRASVLRRGQPGCHTASRRTPELETERADRAGIRETGYRRTEGQRKPHRRRRAEEEEGTRSTEEDQRRTQFAAEREDGRAQKETTEARRASGMASTTSGRMDPQNTMRIPVRRKETQQDCQLTNHHKLNYKRKDERGHRQEREQLTGHQTAPKRHIETHTDDHPRTNTHAGPTAP

SEQ ID NO: 965694 - protein, 33 aa, Homo sapiens
SEEGWFLSFAIPVSRFWSSQPAVVAMIPPAGAG

SEQ ID NO: 965695 - protein, 125 aa, Homo sapiens
MGQTSRALPFLALHNLGCAPIKLNLSVLTENGVPAEPAYSRRRSAGNLCNGSHARYISRKNWWYQPRTELAICVPKFSWLGNWCQTMLEAEVSNIAFGFPTGMGKSQPVKGLPLPVGNPGLDGGA

SEQ ID NO: 965696 - protein, 395 aa, Homo sapiens
MPSVRHPGSSHMIHAPVYSAATWAEPHPMGAPRRIPHARVPAASPEHQQRALSAWRCNRLPRLPTVNQNVPSGGPSAIATAPTGKTTRSGGETQPGSRDSCRQAPIGMPSTACKRNRAAIKASRLSNRWRGEEGLTSCHGMPPSTISHTEAQDARQCRPRQQPTTYGQPLTSIHPSQIAVATKNVRDPTTSILPHPRRAPECTTETYAPRWTIHGPFAPTEYGILDPTQTPKQETDTDITFHTHHHAITKQMNCWDDESHPLVSGGRDIWRHHIGLSSHLLHDSAQTQGQPFIKQEAMTRPQTCNNSTWAHEHFDSHGVQLTPLHGLSVRKQTVSPRTIHPVSPGNDKTKTATPPSTATTNQANTQQHRDTITTTTAVTAGQNTQRQTPSSAPTP

SEQ ID NO: 965697 - protein, 181 aa, Homo sapiens
VKFDLDESMPEDIPKQSWSSRIATDDSKAVCRLTVKFGATLRISRLLLERAKERKVVDAVGVSYPCKETRLYRVLETFVQAISDARCVIYDMGTERRISACICLILPVALPGSLRDCDNRYHFEEITGVNRAQRRTNTFRQTRGNVRIIAEPGRYYVASAFTLLQLTIIAKKIVLKEQTGS

SEQ ID NO: 965698 - protein, 484 aa, Homo sapiens
AWCSVGWPGGPGVPCVMVEPLVAFLRRFRQCASCGPGVCWHCGLVCRGLRPAGALRECNGRRDQGSGCPVNHRLGQHMSQGTMQASMSPVAGSIYRRSRRATFKGIISSIHLHFLTMEWPSSPRHAEVIGTAFMPQLPAKPAHPLTLAPDCHPGVPQAHSAPPSSRGPYQQEANRSGTLGVRQRLHTQTGRAGHPRGTTTGGRAQFDFAGTQRRTSHISSHTSRPPSTRAYPERGKHMEFGGNRPPLHTLVPLILAKRVGPHEPRIDSDFLAGIGYRAYHIHHWTTRKEGDTSGHLRNRLPGHTRRGQAPDTRKRPGPSHGTCGPVGHLPDTGNVATKQHPSSDTTEGDYARLAPPTLGANTVRDPEAPRAFDRAPHTLKDNMIRGITRGATAPRQQCWDTRRTASGQYCTAKCTPVNHRDRLQRGAHRLGARHPLDTQSPAGKREHTAVMACVRSNLNGKPDTKTRTRKTARTATQRSARDHT

SEQ ID NO: 965699 - protein, 184 aa, Homo sapiens
MVSREIPFSRYWPPIESQRLFGKILTTVFSPVYPSNKPVYEDATPEGITPCNTWTQTGTTGLSHDPSKPFEIRAIEVLEVLPLQWGDRALGGTPLCVFVGLPPGRCSQCPPRASIITLLAGCYPEGGPYLWSAHRRASPLIPPLAGVAAVPELARDLPVRPIALSQPWLPQWAPGHDTRLRRSF

SEQ ID NO: 965700 - protein, 406 aa, Homo sapiens
IHISAPVLRAVLPFRCPAHATMTEQAISIQPKTSWPGGIAAAISKTACGSDQSAVHSCCLPGPSHAEHSSISRRTKPVTHRAISWHLAISPAIHPKAARGDDMVHIVRQVAPPLCHNDHITDITLPPSIKGPHRNISDTLQSDSRIHTQGVPLTMRAGARIGQQTRPHNTPRNNHSRTAINATNGKRANKHIGAPITVDGDIEQRTQGHDRQTQFPPYHDKSYSGMNNTTHKTQLGDTLTLASATPTGTTPPTGSQMETTTSPGTPAEKRNHNDSTQRANPQSSARPAPRYHPTTTGTNARSNDNTLDHTWAARTKGNIPTPTDNQVHSRKHASTANPPYGGTHPMNINPQQGGQRYHRRTSELQSPRKSANQRGPRAPNVRTTTINPTEVARLHTSHQQVTANGQ

SEQ ID NO: 965701 - protein, 110 aa, Homo sapiens
MVMGPLMKTASIQARTVARFSIPKTMAAHHECMHAMVWAICATIGSIRQSVGSLRTARHSASNNIHTSIAQHAIGSCYMLKSSSQGTGYVAVTTATRIVNNMHGPVYMTH

SEQ ID NO: 965702 - protein, 274 aa, Homo sapiens
MSRAPVTGYRDCLLGICLIRRSVRPGCLLSGPRSHFPRTSDGEIHRMKYVYVFIYNSTHNTMPKKGSPLARPNRHYISHTAFSLLLLAMRSMGCFVVFSMPWWCGYQTSQCSTLLGVDACASRLARPIRSVIYSGKPIESLSRGPVPATVSLGGSHPLLRWCNGYAFVGGSSSSGCRRLGSALGERLVFPVPPCASLRATFLRDDLWNPPKVLNTWRRMVPPGNAPCSESSHRGVALIGLACSDRASRHVGGSPVGYDAGACSLVEGCYARGGP

SEQ ID NO: 965703 - protein, 313 aa, Homo sapiens
MEKQCCSHPVICSLSTMYTFLLGAIFIALSSSRIFTSASHSAQCKQNKSCIIFQLLCTCVLQNWCKLSLLCACVILCYHKQRSSKSAQFEICFLARQFSDFMKWSIPWLAYIVLDKLMGLLCPVPIFKQTMAVIFSNNSNYNNRSSIQDSAEEGSYLGSSGASPPGLHNSLMVALTWRGLKNYYKEQFGQGRGYHITAGPYSEPSPVHGRSYISTGKGTQTKERWITATGTVHTVPEDKRGNHNRPRENTETNSDWYAGQEPDIRTQETTPARRTHHLSKNTDHESTTCSTPTTNDHHDENTQRHAGQHNSDD

SEQ ID NO: 965704 - protein, 160 aa, Homo sapiens
MDLMTKTKLYCTLLCAIGHKRSTVAQLVKRLTDADAMKVPPLWCQAKARECSPHLQYWIRIIWCAMGGAFEEDNGQHCSLIYDDVIKQVGYPAKGLGSGGPRRRRHRDGLLNPGAGKRQRQRVGGALKRGDKPAGGCANRKGRRGASREGNSAQRGSAGR

SEQ ID NO: 965705 - protein, 188 aa, Homo sapiens
MVRVQGPQDVPPTATVNVSVGLAQLSCIAYLIIFPLDTAKVRLQIHLRNVRGQCGAIVSAQYRGVTGHHSDHGAVLRGPRRLYNGLVPAADARMQLVPLSASGLSDFCRIRFFHPMALMHSPGLGSWLLRRHAPPGVPWVWLWAPPGVQGPGPRHAGLGARRSTGPPRRGPLPLHGSGREGPPCFALS

SEQ ID NO: 965706 - protein, 109 aa, Homo sapiens
MSDLCDRYVYSLQGHLSPSKPAKSLHTQKNRQFFNEPEENFWMVMVCRNPIIEKPDKDGKPVIEYQEEELWDKVYSSVLRQCYSIVQAFNWYMSESMEDGGVKLLKEQD

SEQ ID NO: 965707 - protein, 153 aa, Homo sapiens
MEQYGSRKNDVNYHELRWRKCNEKLNIVTEVDVNDRVCMEKACDSERGKQLRCPLAVMICFGLAKKCQIDLRMGPSSEIIVVQYKVYDRVDSDGRVRNAGKESQKHVFLKETIGVRNARSQYGSYEKVKWVLQIIVPSTWNAMCNTVFACQVE

SEQ ID NO: 965708 - protein, 367 aa, Homo sapiens
MKRRRRAQSRREGPDRLLTGAGGSSRRVRRVRLTPGRLPSIRSRDLSIGGSQEEKLQPKYHQSEDHGRAQGRSNWSRKEKRERGQRPKREGAWTRGEAVQEQWIQVSLQSLEAGPSPKCMQAHTGEPGAFTNTGIVSSTSGTFLEYLIKSQNKETEERQDRTETLTPDLGVWVEKGSDCHRMTPGLGRERDSGKLLALLQIGRSRDSSSRDGRLTRACKNVEKPAWLNRWDGCDPREQGTWEVRNNLVGQRVHRGKPPSIDGRQSPPHERASITKGRPGKDCRSIHERQVSRGAETVKEAETNPREETPGCRAHLRKEPPPWGEETTRQGGLTAPSKHTGRRRRAPVVLHTGTDTSIESEKYVALCG

SEQ ID NO: 965709 - protein, 147 aa, Homo sapiens
RIRVADHVRPSPTFCIAGFEAAIPPRHLTDRGAGRIVRGSDGGVGRILCILATCGSKMSDIGGLDYRSIPAITRYWFDATVADALGRPNSSLISPAYLFLWTRSLPIIAFRFGGQSLPPFIIPVGPGTGLPLLWSINTYLISVFYAT

SEQ ID NO: 965710 - protein, 94 aa, Homo sapiens
SGSGSRTAVRSPEARMSTGLRQSASALDLSLDSLITVEQRSETESVERAGPDSDVIHHGGPGFFYWGTVLDTNFWVLVEMGFRHVAHAGLDLLT

SEQ ID NO: 965711 - protein, 189 aa, Homo sapiens
LALKQQQQLQKQLLFAEFQKQHDHLDKGSMRSSCRSTSSSSRRCWQPSSSRRCVAAKRRAGAWSSSGSGSSSGRKSWRSRRLEQQLLILRNKEKSKESAIASTEVKLRLQEFLVVEVKGAHTRRLNIPSPRPQMLRSPPCFFVDQEFPLHRGGPPWDASLLERCLGRGPYDSREDIPPSEKTAFVNPNL

SEQ ID NO: 965712 - protein, 385 aa, Homo sapiens
GTEPCGGRAELGGHAVVPVAYGYVQPVVTGERSFCEDAAAARGSVTLDGLKGLSLLSWLLGWRYDDGRREALGRTEPESMNARQNGILVSGPRGATIQTRGGVEEPEGERLTDALGNERNPESKQTQFCTHESLTATMTEPRSTGAGVELRRESRNGNNYIAPVGKNLLNPCGRVNSENFPIRENNTINDQFATRTDTNTEWFQGHTQKQRQQPNAWEQIWYNLSYCQGAHKFGMTKKTVVKRKQGKRFEQRHKRDEHNQTMKSVSPFPTLHCWKLATIEINASQKRLKTNQAARDKFTRAVFRQNEGHQLHLDRKANTQVVNRQLTITISEPHHEGREILTRRGDHRTHPLQDHITIGHTQHSDINTRSNTLGTKIQPQFATRY

SEQ ID NO: 965713 - protein, 263 aa, Homo sapiens
SAAGAPGVGAAVLLVLLLGGCSGRIHRLSLRGEASGIQLNSFGFYTKWLSGVWQLSVLRAGPSVEGQNEHSPMLVGRTDLTPEFGSGRASAPSYNAGDIQWLPSSKKRTVSTFILSPVFSRSSTHRIMPGSSVREAYWQSTKTDSCTLFPGSSFPVKDTPSKTRVIPRSPNTAHKFPPDKDDIGRSGPLWQHRTKPQRSNHTLQSDHKWILDGDTRHRDPALVAALQPLCNQLLRKSSVSPVVDRRSQGGNNGQVHSLNFQQP

SEQ ID NO: 965714 - protein, 94 aa, Homo sapiens
SEDIPGRVNLPALGGGSKRPWTIAEQSFARWKSVDVHGAKPLSVAGGHCTPGLRARFREHAGVHSGAFQQGYLMKGLLGETVKRRNPGKEPKKR

SEQ ID NO: 965715 - protein, 233 aa, Homo sapiens
EVLSPTVKGKLSLELNLHGHILPNQSCDSGRGQRSQSHLYFAKSCMHLCLAVLRSYCSATKSKDQSTTHLPPPPPSPIHFQPAQLHVILALQQPINQCQRNLISATASLENNSTVLHLAGMHSASTFTSKRSWQVFLPMTGSNPSFSLSFIMPSAGPTLVGSPPTTCIGSIHLQQLGQTCAQARLAQHRILEPSLFRRHHSIRPHMSTHTLKVAQPSTHMQSGFSSDKQPGVR

SEQ ID NO: 965716 - protein, 52 aa, Homo sapiens
VSRGPERTRGELLESGGLCAEDEADAEGVLRVLRACEQEAGGQNRVGMCARD

SEQ ID NO: 965717 - protein, 146 aa, Homo sapiens
MTQTHKHTTHTNQTGLDAHTRRSADRTHEDERDQGGPTRKTHKPEQKDQENREKKQETNNAGGPQQTTKADEQADTQRHDKIKNTRERQTEQKRKRSDEATHRQYKNSRQTTSLDQHADCDEATTHARQRKLQRQISDQKHDPKLT

SEQ ID NO: 965718 - protein, 327 aa, Homo sapiens
MEPILEILQQKFCSSPSPLDVLIIDQLGCLVIIGDQYIYQEVWKLFQWDQCDAPAPYVLLRPPKIDEDHGYRALLPVSDKLPWSNIAAQYPRRVTWCHELLMNLLELFVQLGLEEDASQREGKRKGPALKASRQCSVTWQYSFLYIAVLTRRLSSIKEALASVTGSSFETSGCIPSDWDSAVTGLRSLDRQWYEGRQEIGPKSPCAPIPPKVDQLWADLPVLTSAHDRMSLWSPRVSCGNPSIRIIKLGGPRSEGVGVTNKELQVHQTRLLSQHGARGRYHTQADKAGTQTTKSEAGEHARKHREVRTNKREHCGHTGGVSEDDDGR

SEQ ID NO: 965719 - protein, 470 aa, Homo sapiens
KERYRLYCHLFQLHLSVCRHVEHGTKANGGSGDSAVNAQLQIDGLCGTQTDNQTLSRKKDKGNVKLFKELLIGSGCRKIGLKLPTAFLSLSTQRMMLTFDESPNIRWNMMREPCAHGTPLDSFLHVGPGYQVPTIPKWLNALTPGGDSLGNFSKSQTFTKPWPFETNPVCNSTLVIPIKDRSWPKRSLYNYRAAITSTVGLLIKRWTCRQRCATPAHPRTFYPSLRRDFDNNTPKILHPFWKATNWFWQTNSAPHSGITCHKQCHTLLDITTCPKQWWTPTVHNRNKLDTWFCQHIQHFEIWAPTPCDNARQHSIVRRQQISQQDVRSRRNKKELDNTNKGAPKRIRDVQTPRQHQHTMEEETLTACDPTHDPRATDKDAEQTDHRRQPSTAEQYKKETRREGEKKPPPHQREEKQMPKTIIKHTKELPSRESASPECEDREKRSVTSRGGGGRQQSKSAQRSKDSRNAT

SEQ ID NO: 965720 - protein, 131 aa, Homo sapiens
GRSPGNMELLNPSAQEHVLLLSLQVYKVTSGHAALSIEALCVTRLGRAGLLSVHYAPLPKTFVAESAKVVCWPRTRGHVLKGTRHGFKGSGSEPCGAHHGWGPFNTWQPCEPCLPEALNGSTQSMSSSPTY

SEQ ID NO: 965721 - protein, 383 aa, Homo sapiens
MVFLDVLESGNWPLMVVSNLEIEFPGTRDLGDVIEFEFMQFQVSLHDAVHTREATKIFAPVESPRRPFNYGGVAVDACLTNTRNAMQNANTGVSPLNYRMTRQVCRSTRVRTDPLALQRDCLSSAYGSEFESTHTNSVNRTVGSDDRLLSVLPTCSTSNQIYMSSSGSYANDYNVGTSVHLRYISLTATSYKYCYGPVPIQEDENFTTSTNRSHHMHRYQQASSLVAYSSEVHHTRSRLTQRRAYLVTLRHRGTRAPRTDVSPRRFSYYYRTGDLAASSLDGRLIVSSYGQALTYTSRKRSIIGDKSSLNTTHGNTDIPNLQQPGHTQGRKSLQHTRSITNSLQFSFSLQQQFPANGTQSLRTVASLLTTLFPSDSPQTHFQS

SEQ ID NO: 965722 - protein, 169 aa, Homo sapiens
MHECHIACFNKPPTDLTRTPASLLLLRHTIPTPAFPAILTCCPPSLTPPLRPAGATPLRSLPCFLLTPPLCATRPPRTAAASPCAGSPQRPPQHPTCPCTPTSGPTNPRLPPYPYHQPSAHTTPAQTYTPASPAPYATPQNTSQRSAKRTPHPSSRPLRNAPRRHHPPP

SEQ ID NO: 965723 - protein, 231 aa, Homo sapiens
MALLRHRGKNPPGCQLPTYTTLPSEPHIYNRSERRTMSGYRLLSQKRSWRSYPKRPKKPPNMVPLLPVPLFRSQQRDTMTKHRHPPPSPPHLLHIILFQAPPHSIYIQLKNYSYPPTYIHTTPYIYFFPPPLLSLHHKTRSNKYYLLTLYYHPPPPSLYIHPVLPSHTITTPTLLNTPPGAPTTHNPPTPTTTIRLTPPQQPLRTHHLSPTLSHLITPPPNLTSYLPHTRH

SEQ ID NO: 965724 - protein, 183 aa, Homo sapiens
MVVQLKPSFIADVETTWFTWYPKDVPIADGMRIGPSLPTLRGIGGHPSYAKEARPGLTRPGHLLGTGDNDTHDPQHCRESIRQGTSLCVRSITITLPAESMRPRQWASTYQHKQRTWLIDRVKGWTTERQERCSIEGPLPRKPLSQGATSLGCKMGAHTVQETDSTHRGTSAPRCEKCLGTPH

SEQ ID NO: 965725 - protein, 87 aa, Homo sapiens
MNPFNSAFQFVPRGSYANNYFSYCLSHFCANNDYPQKNTTNGRRTFALIHTSTSAFNPPSVQPPHDKQQQRTLPPNKQPPSHTQPSS

SEQ ID NO: 965726 - protein, 66 aa, Homo sapiens
LLLFSETSQCRLSDDKKKKDAGKVGQRKTKSQLNYSGGKAIERRSGPQAKFGTSSINLVLFDKSYL

SEQ ID NO: 965727 - protein, 366 aa, Homo sapiens
MRCSGPARTRGHGPADDSPPEVIRAAQKDEILPRWAAETRQGGALHSLRGCEEVAGVEEGGESCISDVAYFGLTTLAGYQTLGEEYVSIIQVDPYADTCALHRCASGDAGDACMPSVPYLTGQEPMLTHWSRSMQADPDSGQTIDTGSLGARWAWLLRGAALRCDTTHRTPLHLETTPGGAQQRGGHTEPSRQGLDLTSKRLHVAWYNINGGTYPRCATEGLHGDQETTEYRSPARNRTKEDRVKQREKKPHNTGDTMGRDHRGKQTEETKTPQEPSTRRQKNSEREKKNPQRAQTKRKTRPPRPGAEHDKTTRRSPSPTETTEREAPGDAPAGPKKQHRQGHETPRTRERAPHARNTNSNGDTPN

SEQ ID NO: 965728 - protein, 308 aa, Homo sapiens
MGNPRGKSREFDQSSWTNSYVTETLRPQEGKPYNVGEKPCELEDGQERQAHVGVMTSEYTEGRGLTEVRESRGLRGSRYAYEEFGAFQKDTGTHLLSLHRFEILVDFPVPLWNLTRETLGGQGPPPWVLRQPDEAETPKADRKDPDWRQGHWNLSRQSRPRNLGRPWNQPQGSGSSDKHPRQTAQHNDPARRLAQDRDHPEHLANTKGETYKSNGDRHRTDVEPPAARGYTNEPKQGRNIHQRVPHREQGEEGQRRTSNERQREEDTKSEVTTKGNTRPEKHQQKGTHQEEQDTKKGRTHRRRTSATV

SEQ ID NO: 965729 - protein, 217 aa, Homo sapiens
MTTQTSQRTTHTKPGDLSSTKHKRLHPNQVKHARHPQPYNAGERHAHHTTHHSHRTTKKEDPANHHTSRKPRHHPPNNRAKPPHTPHTPPLTTKHRSPPLPRQQQTTKQTTGHHEQTPRNTRQAMQHVPTHTPARSTHAHRPTTQHTTQRHQPSPTNTEQRQHNTPDTATTPPPNAPHSDQDTDTTPQQHTENAHAHQNRPTHTTPANRPTTANRNT

SEQ ID NO: 965730 - protein, 455 aa, Homo sapiens
AVQISKKRKFVADEPSSTADTAMSFLLGSLAAQHGSLVAVAGAQLTTDTRTRHIHSSLSPPATTSNVSLRAAQGQAGIERNLHLPAQLPRTPRLSALFPRSGQLVSTLLISYAQQVVPTTARSRRSPIGPQGQELILTLYKNLHIRDSAHAGAGSGHMHYCAADKPGLPTPLATQLRRPKQACRQGIRRGRSWDAQASQQGTSRGNKATHCHRPRHGNGPLALNSHTRRAENHKGTNHNHTALAPPWAQVAAHRKLRPRKEPERKTAQKSQIQTALHTEHPLDTAPPEAYRQTTWATATPGRTINRQRPPGPHRTPRPLTAPPRIEHTPDHQRTSPEHQPRPPQDGEHATRTIVPEATHHGNKRVLRGTQRPPTEAGPPVALHVTPPPERTYTARSTERSSYTPTGGSLRLQRDQAPRLHYTHAHDALPRKPDTPRRHITKTTTGTDHTHHAQGH

SEQ ID NO: 965731 - protein, 367 aa, Homo sapiens
SSPGREDGTGSAVSGGLGGLVLCGAHTQCGGGPGVLGPLRGCPGSTEHVEQPTHGLSQIQPDPWGGRVTACGPSCGDAGLEGPGGRRPQPGSYEIRHYGPAKWVSTSVESMDWDSAIQTGFTKLNSYIQGNNAERDEHITDDSSSDKLRGALVQVLIVSLHITMSLYFPSEQQFDPPRPLAVRLSSLTDRGEMTVCVRSIRWITSAQKNQDQLMTLARISRDDGTRRHEKGYYTARLQHDLTTCLTRNTCTAGGSPHLTPTTAHRPTNTPARRAPAGHTGTSGLKYQTQGDHITTHAHTQTNTGGRTTHTRAQQHHNNRRQKPKHRRTNRATQAHSAQLEMNQRTSTHDIKTESHIANAKPTRHDNA

SEQ ID NO: 965732 - protein, 391 aa, Homo sapiens
SQCRRPSSDTCTFFYCGKKYKAAHVMCVAGAGHKQLCRSSPLPGVCRGMWLQGKRVCRGESPRVNPPSGGQQREREAVKEAAGPRAEPLLWNASGGTRCYLCSPLSFSRGGSYEEVSPKGGVAGGKKVVPVGYLISRYTQISLYEANHTPFDPVALWEKPSYPLFLSQKQGGAYPNCEKPKPRAHNYSVSCVVNTLFKKSFVRHRTSVGLPTTSLSPPAGGPMWCGDTGSEQKSQDRKNPVGDNWVWRSGAIDNHKVLPLPLCNCFPICEALCVSPKPLLCGENSNKVFPRVKKLLLPAKKRILLPEKAHHFIRGARLKQLLLFHLLWCVFWAPLIFIPNYRWEIVWIPAHGLWPPRESGQYSPQKIKAVTQTVEGTPSQKIHSLIPNSSL

SEQ ID NO: 965733 - protein, 410 aa, Homo sapiens
MKTTPKSQKWERKQTHINIVVIGHVRFGQVHHYWPSDLIQCGGIDKRTIETFEKAGCCSMGNRAPSQYAWALGSNCKAAAERGITIAYLLVATFADQTSTTVNYHCLPQDNRDTLSNNMIYREHLKAELDAVLNCCMLVIEVELEAGISKEWADPRACPSGFTNWVCKQLNWSVVKQKWIAIMKPTRTDQKAEYEDTSSHASSATLHSNAKLGHTNPGQPEAVGAQNQGMNSEHTHGMLTPKAAQTNAIAAHRELTTVNPEKEMDNATGTHTPDKTRTMDRTHTKTAPHEHAHGRTPHTTDTTHGRNRTTNRMHPQRKTQNQKKEKKGQNNQNTETHADNNGATTKKTQNTNPEDRTEQRKTQTNRAHDNRHKNRRRQHTKRRTQKTTYNNKKNKQTHNGHKRYQQNTEE

SEQ ID NO: 965734 - protein, 136 aa, Homo sapiens
MCNFPPVMWATGHKQHPNQKPTSSFYLSRITLQCICERDMHCHSTLQHHLHCNHSSLTHWITTCSTAPVVHMCLGFRVTRLVITTCDILLYISKISHAMYTIYMVVYYTKMSPGCNHTEHTRQIRPHISSSVMGIA

SEQ ID NO: 965735 - protein, 305 aa, Homo sapiens
TRIHDKLEGLQGSHRCYSTAGAQVRVLVRDHPTSIVAKPTAPLNFSGNISLPGHRSQPSAGCMHGILCVCSSTRHCLTHVSNAGSCGASTPEAAAQVVQLGELADSDIVPPASTWVFPTLGIITHNHTPGPLQHMPTGRHSAGAILGLPGMLYLKHEALPCVGERVTSADITIVCTLSWLYKQVLEPSFRQAFPNYNRWFSPALTDPVRAVLGEVKLCETMAHVDAQHVRQRPTPHNGPHPRTSTKGTQSNRSHTPQVNRTQDHTGGMHLESRRKKTDQSATTARNEDKAKDPRYLPKNNKGSIK

SEQ ID NO: 965736 - protein, 298 aa, Homo sapiens
QDRLALRNSMFGAADLLVVPTKVKLGDLGGAGSMIRDPQILSGKRRVAVGGRDLFGMEPNDSTSTAVEEPDRLGGVVKTSDISNSYTYIVGAQMNVKEFKEHIAAICTAIPSEKTTDHNQGRVLQDDKKLQDLTNSREGTGSSNMDGNRGSTIRLNSTSWRALYCDGVMPQPHINGGRRYHTPGTQGSLEDQPDTMNRTCPNKQMYMGGHQQNLHPRVTGSSRRTDTIKKGKQGPEIQEEKPQGNGEDDGSETRNRAINRKIRNHGGADKRETHGDTDDRPERHRRNQETDTEHQHKQ

SEQ ID NO: 965737 - protein, 437 aa, Homo sapiens
EDSSCADPHRQFDPTPQAGISSSQALQAHHTHTLWLACTLSQPFTASNRHTVIIRHTHSNQQSYSCSCEHRHTAHMLALAAATAIIMAQCNVHKQQQSPTATISTAHVQAPKHRYNIHRTHSESTTVGTIAADTITPTLMNGHYLASGISLLPHPYFFVAVVRPNRYNAAKDLVQPRTRTMSRTHNSQLVTTPRTGGAPPHRHDNAESTHIGWTTGLVAVVHTPTTRSHTHHTWPSTGSITTYERGLHSTHIHPPAPPLTHACPTEGPPPPLPPPADTRPRTSPPPWRQHNTAPAHDLPSNKPPTAHHMAASKDRDPIDNTRGYKNIAVMPAITGNSHPPNTSQRHHEVTLISPLKEHAPPNRSTDNEIGTSATWTGPQPEGTGPGQRPNTTTRTNKSLATPNTTSAPYTHRDRENDGRTTPTHHSKKTTQRLATTS

SEQ ID NO: 965738 - protein, 398 aa, Homo sapiens
MNSSAACIACGAHVIRAILVITACEYGTTVSTEHWRRIGKLASKAKCGMKRWLDVKIGQRLPEGMAVLREMRPPRKGVNRHCRLPHVNEANKKGDVRVSFRVAFRALTRSLALSHRCGATSHFHIQTLVLVYNTYGYLYQAQSNLGSGGAVGSQVFNTQEKEDPNMGVRSTGGVSNLYPDRIPIEGHEVKPQMGSTVLVVSSPSRWYSAPHAMCAAYKAPWKLRARTSGRYPSKKRNTDSSETAWQKTTGRPDGGTQDRLLRCANQPQESRISATGPAIQRTISRLCKPSTLGWKRPARHNVAHPAKWGNNRDGDDVWLDTQRKSRVKITRRGSQRGETVPGPHSNVGRDRVGGSPRGRKRQIETTSSMGGTSTSGLRAGTTERAGQATGLQQPCAVE

SEQ ID NO: 965739 - protein, 312 aa, Homo sapiens
MPSVPSVITGPQECGGSPKQSACGAGAQKSGKWGRLGGHKRGGGVRAHQGAPLAQGKGGPRGGGSPLHTAATGGITHNHGPNVGVVRGGVSIKEIPGEKAEQTGPERRYHHRLGEGGPPNSIIKAPDNPQSAFSLGVHHTRVGPPNIEENAAGDYINEHSNREVRDAVLQHHAPPANSCATNPGAVPLWGTPRVGKRKPLHSRLRVWATIWGDTIPPQTRINTGLQGTIYTHSPALLPVWDPPHYLDAAHNVSDDSNYTTYMYACNCTGSEHAERDRRERASSTASCTATIASDTQTDMQRSTTIRMHTSSA

SEQ ID NO: 965740 - protein, 388 aa, Homo sapiens
MEDYTTGDNNPYTNTHHRGVSPKDQNITTHETLPTALRGGKKSRHDGRTHTNQKRARTPRDTNSQARLHPGGPYKEYLTVHNIIKPQRLKQRTPGRGHHKEGRIHIDIEEDTNRGSIEDSVHKSLTRWRTPFDTGIGQITKHRYEAHTEGRHTPHKNRRGLSRGESTTQSGIGIDKHTSPGRAPRRSCTRKDDKLDERVGTNDNNVNYAKDKYDDEPTYWEEHETHCNGAQTHKLNEPRMANMRTQQERVSDDKLYVASKQTQRAPGMAYNDKRRTHMGEDNTPTGQRTQGINTLNRQVARHRSKQREHGNSIHIPRHDEISQHTQLRHCAPSNLTSRDEDNIIRKKKISDKSRIRKILDHTQIRKRRRAKQGRLSTNKYDRQEHKHT

SEQ ID NO: 965741 - protein, 416 aa, Homo sapiens
MSSEAETQQSGDVRTERAGYEVRWDPQSHGNTSYQRDRPYARRTEAGTKNYTQPPTHTKGNQAHDRPRPNTNKRQDSSPHRPTTTRRTAPAARNATQTRRNDAAHSGPPSQQGHPTPPTTTGRYARTNTPGATTKPPTTRPIPARQHPTTATAHPFNRQQPPTTNNTPDAPPTNQSARTTRPNDYPEHQATHKTERTDNSTNTNENATTDPSLQIQQRTHKAVTDTASTAKKRQPRAEPEARSQGKTPTPHHTQTHKHAQTSPTTQQPAQHKPTEAPQDNRASTTVPIDRYDRQSARNQRPSTDETERQKTERASAPSPAKDKTRDEGKRGGRGPTTDEENARRRTGQERPGGDPTKAPTPHEQWPKENTDSSKREREKKNGRRVTSGSDHASRGKAEEQSERESRHAVQDEPKKS

SEQ ID NO: 965742 - protein, 355 aa, Homo sapiens
GPGPQLGSQGLETMLATYSYGCKRGAWLSLDDLLQLIAPQSSAIFHLPPQEDTYVEVDLEHAWTITQTTCPSPMAHWTPFEGQKVKGTDPHVWSCEGRLPISDGQVLVPPGAMDRMYAKWTQRVLYLQAPTPQHPATREMTTTPERPQTMASQGFLMAASICRPESIEPSDPGLPAEEPQEKSYSEAVTEPELMGHHAWHMLTSTNSTEQGISQNLRTHGLLNRRNSTLVESYRWANFLVVSRLPRAQSDSMSLWHNTLVYGARRTEHDHPTGQGRAQRKKRNGTDVRCEPRPGDEPRHDRTQDGEGSPRTETEDRTPPATAQHNDNAAEEGRHGSKEEPTKHSEDKQPEGTNHP

SEQ ID NO: 965743 - protein, 214 aa, Homo sapiens
CSSSSMEINPEMLKQSAVPGWEGARQWSFVDVLGVEEESLGSVTAPVCALLLLFPLTVHDENFRRKQIEELKGQEVSPVKCIRIMKLSIGKFCVVRMDLFTHVVRVIKKNLGFEDGSRCETVIFLKADKMSPEDRAKCFERNEGITGSHDAVGQEGQCRVDDKDEFPSNYCVTSVECASSMNLMDEVPFPVNHGASSEDILLNDAAGLREVHES

SEQ ID NO: 965744 - protein, 164 aa, Homo sapiens
MHKEKETVIGKNCGTSGKTEVLDKYKNRYWVVGTIDTIPNIIRRMTKSQGKDLKKLSRQMGPHIDPQGELGKRGTTGGTTEGNAHRQCTQPVGQNRGGHITRTRDRFKGTNNRGRHIWEANNCKPRVRTMIYPCNGSSIKNTQHDTGAGDKKGTTGDVRPTQRG

SEQ ID NO: 965745 - protein, 355 aa, Homo sapiens
MPLALLATKHPATHAARRCNLLRYPPHLHYSSLCCAPTFSHAPTANAYLLLTLPPLCTAPSDHTHAPLTPNNTALYNGHTLQRLHPCCLLPALCSACPGLLRACTLLHTAWPTRPKQLRCTTLQQPLAPICDLHHLRLVHNPTNSLGCFETNTLGTSTLRPTPYQLTHTHHYCRHTLAKTRNLQAHLYDSTPHTLWAYQPPRTTGYATFCWPNSSCLRAHCVTQHCPGRPTLPKTLPFGPQGDIATVQRRYRIRHMPNGQTTASPVTPHPDMAAPLPTPHFGPTPWTRAPWPAQANPHGRLTTPTGGHHSGTDPQVSPPSRKTKRLATTPSKQQPSPLCAPRTSAITAQQKHTSR

SEQ ID NO: 965746 - protein, 113 aa, Homo sapiens
MHLEQTGSRCHKSMDGVRNDVQILTFYPILVLFSQGPPQSGAQAGLDRGGIITRLDATSGCLVSSLLRHPPKVVAPAGVPPGVVAGVVLLCGANVCHCARCAPPALVALSWAV

SEQ ID NO: 965747 - protein, 141 aa, Homo sapiens
MTAASQTLLQNTELEADDPYPGASHYEGAQYIRLEVYPMMQLSLTPANYPAEIDSVFQLSTEDYMTHAITRENTLTRRGNRRSQNVMRIICQQADDFMASERSILHSIMSSLMMEWYGYITTVLDWRHGYIATLHASVRTL

SEQ ID NO: 965748 - protein, 288 aa, Homo sapiens
MPTSGKVPRKENLWVQREWGSCSFVCSTMETVLGACLLSICISTCMALGDGVQGRGQRRMTHVEETAILLTSGQGMWLWFSGQFCRDLIRPCLLPLLPQLELQTVGAAGLARARLTLAPAFLRLSSRRNVIPDIPASFPVSVAATVENSFDNPDGGFIGVWIAHYVCAVNSEAVGKDNPGGAVWLAKAVAAASRTGSKVREHLRKHIPGESGRLPSTVGGNVLASKYKVLKTHNPRQILMWSQPKKVQGLNWFQQFGPGDGHGGAIGEPVSLLALVLIGVAPLDTWVE

SEQ ID NO: 965749 - protein, 215 aa, Homo sapiens
MCGFAYDRIAVQGSRLVLPYPSAQELVSRLSSGEVTSMIAQWPLARAPWHKTTPRSGTTSLACPQIDPAAKLLRAYTVISANEDATIRHESTSREQMFCVAHTETGCPGMHAPGFHGVTKCAPNGERSTCVPSPAAKHLGLQVHLCSNRPLRFFIPRAFTGGNATRALTTRPPGVLTPYADIPLESRPVAICIDPRRTLGRTNHVAEGPSLNVHA

SEQ ID NO: 965750 - protein, 457 aa, Homo sapiens
YSNNFISLARSKKVDRLPGDFSTPGPSSRSWCGLPVSWEITSVFPLWQVPWLWVHPQWFGPVGLPGENVGPSPVGVGNMWVREEAPGLCALGDHVVVASGLGARAHLSQVGVWANLRAQRVCEGSVLSRSGRKSLSREEVKLSPPNLSKYPTILLRKTEEVNEGEHPKKSLRKDHEGAVGKAVAYNEAKIRGGTIIRRRKEGEGNTAKELTPRKEGRQETGGGRGTVEQEGTTARKNPEIKGGGEKLQRKPPRKEPHQVSAIHRGAPPKHLGGSWATTRGERFIKGCPREIPRGTLKPWKGDGEIPEGKKPEGHTAWRTKGALNQGPTKGRRKGKRTTEGRDVRRGVRHTENSGEEEGGAPKTGVMPPHCSPAYAKWALQKGPRGKTQYRGGLPHPPLIESHEKGLPNRGSKKPGVTGEDEATKKGEGPPDEVETSGRATVADLRQKAGSKHNHTRG

SEQ ID NO: 965751 - protein, 98 aa, Homo sapiens
FHREDLLEWLRLSVLMTPVAVRSRFTCCRLGAIICTCTEEDSRAPRVLQQVKPFSDSPPWSPNETSVDDSVTFDEFEENRYMSYSWNVRGNLDLRDEA

SEQ ID NO: 965752 - protein, 107 aa, Homo sapiens
WEVFISYVVISFIIKKKKFKNSKKNVSVAEGPRIKTNEETFSRNSRGRGEEAWCGLSLSLKRRRCGRGCGEERERETQRLSVCHTERDLLITDIITPHPTTPPHPSL

SEQ ID NO: 965753 - protein, 66 aa, Homo sapiens
RELAPLIAMLRVISPVFWQQLFDHLFGQVVSLQNGGATMGYEPSSAAYKLEKCGRKCGAHALVNPT

SEQ ID NO: 965754 - protein, 122 aa, Homo sapiens
HPFPYTKINSRWIKYLNVKPKTIKSLEENLGNTIQDIGMGEDFMMKTPKAIATKAKIDKWDLIKLKSFCTAKETIIRVNRQPTEEENIFAIYPIDKGLILVYEELKQIYKKKTNPIKKWART

SEQ ID NO: 965755 - protein, 317 aa, Homo sapiens
GGRKKNGGGEKGGRGGGPPPGPPVGGAPGGVATGRARVYTHQPATQRNRTPSRSQKNNHIIHAGGVQAPARPQTTRLTQEERAREDNELGCTNGGANSDAQKERGAPPTTPPSGGGNRRRRLPPYYKKKTSRGRRPQQGERHHRDQYTHPTRSSEEGSHQHCGCSGGDLHTTPRRAHQSGVAEPPRLPVVKKDRQTNNYERTQELWWRDHATPDVTSHASGAAQVETRRQLPTRRERGTPRSGEQRNKMLRASNKPSRGEAETGGRAPSSYKDQTHKRGAGAAPQRHSRRGGTTTKTKRTYFVNRGPSTEEERLNTA

SEQ ID NO: 965756 - protein, 139 aa, Homo sapiens
MACARPLMNRCTPTEGESSGQKGHLACSYARAPIRARYCELGATPSSARMTDSPMLSDELPRSSSTSAEVSGVLAEPVARMSQEIRWWWDLHPDRGQQGCYEGKHVFVVGRMFAPDKIWPPIGPRTDETANSKYTHTRI

SEQ ID NO: 965757 - protein, 326 aa, Homo sapiens
MVTMTGHVVYSRLASDSMLIASGSAGQVPAGPMAVSFDASMSSKAGNPQDICSQCGREAAILQTPIADSVRTITPQGRQASAGCTIGSSRARQLEGGRGAQKHEVTRDSSTSKAKQQPRRQPIVSEQPPSAPGPKQQQKAQQQGTEANKHRGNKVRHSIQSLRFHMTHIYLPARPPDNTAHCGFSKAHWRVKRHTRTLTTNRTKTQARQWDTHQGPEPKPEEPTRNNKHNPTTQLEAVDRALIQEQQPEGVWEEQAPALDTTGPKGPSSGQAHGQRKLRTTQRHTAREDTQKAKHTRQQYQRNHTKETSGENETQRTGMHRSPHLA

SEQ ID NO: 965758 - protein, 367 aa, Homo sapiens
NYPIKDQHMATAKQYSYQHCRHWTRRFGQVHHYWPSASTKCGWHSTKATIAKTLTKRGCCNWAQGLHFTRTKLTLESSMRLTPCNRPEAVATRWILHPLALLLPSDGEHYLTDTRTHDYLSDETITPCLATCHPPRETNKHGPLKTPHNTSSMELQPTRGTQHPSKASHDTLAWPKNSPLDLQRPDPRNRSGSSGDQNTSRNRTEEITHTPNAQQAKPSHTPERTTKVDPLTVRTINTNQHWRPCRKKSNTDTTSNPEHASTTPHNQRNSPTLETPTPTINTAPKNRTNHLKRNTPAPPPATHNTTNPIRLNSQNTIRDTPNPPRNHRDQHHHSAPRTQQGAQRHRDCNTNTQPQNPPTTSKDTKPK

SEQ ID NO: 965759 - protein, 374 aa, Homo sapiens
MDNLEQESPSLSVKTTKQDPTETKLQRGQDSQTSEHANDTHDDDHFYDLFDYNTQHDTTHWDDDDDATTCRRGQPGRTPSTTRTTRVREKTQTQAERDRDRQTRTQRALTNAAGKGSKATGITARDTHWQDYELPRDHEELESVEAQCETGSRDERRKAALRRGSSRAQGKEAGKRTSKRRRRQKCRLAEEQKTMEHQALAIHRTPRADESDPGSRRGTRTRTPWTPRSYSHCNSHTLDAQNTGNNTYDEQQGEAATRTIMRMTETRYTPRDTGTQNTEVTHAPLSDNHMDTTGSVTEVDRVTHRTKMSNQASEEAHEKGTKSEGERATKRGEHERQEHNVDKKCDNRRHVNTTGESQPPAKEDHSREETTHTG

SEQ ID NO: 965760 - protein, 150 aa, Homo sapiens
MRPPPLTRLPRGPPPTIPPPERRHPPSGPPHPPRQARAPPPTGARNPVISTPGAPDGPPTGAAFPMRRTQPKDPLPHLSSPPPTPPTRPGHPTSFTGRRRSIPPNALNASPPFQRNIGVPSRATTKPPPYATIPPLWRFPNGGISRPCRH

SEQ ID NO: 965761 - protein, 76 aa, Homo sapiens
RENYPYKSKMRKEKTHINIVVFGHVDSGKSITTGHLIYKCGGIDNRTIDKFDKEAAEMGKGSFKVMPGSWYKSLKC

SEQ ID NO: 965762 - protein, 425 aa, Homo sapiens
RIPGNMMVAGAEVRMSICGPLAVLLWYVLTPASRAENVDGQNQGLSGGTKRRSERYIPHIRLSSLAHVMAWPVMRPGTPRHGVGSALMGPGQGNSIDDHRGDPSPGVDLPTPAHSPPVSQPNLVHTGRKLPGRIPANTPYAHPWARRHPYLLATTLASSYDNSYPPFPHSHPHIAAPGSPAPNSAPRASRSHSRNKPYATIRLPPPATALQHHRETEKTGHSTIITRHTAYAPSRRHHTTPLGYARKTTRRHTGGPGGPPLHPPAPRPLSLGAHSPLRATLVTACTRRRPAVPPRNAATRVRHPPLGPNNDGPGTLCNRSVGCPPGMAHTSVRMESSPRPIAPWSPTTPIGNRRIPAIGATHTKASHHRGRYWHDYKPHRLLPTTPVSNTTLSHYTSGSCYPGITHLDNVTTSYSPTPYSRPPLW

SEQ ID NO: 965763 - protein, 68 aa, Homo sapiens
MGGRSCPGAGRHHDYSWQRRHEAKGTTKERLVQPRLRQTQTEGPNPKAAPPHHTTPQTLDGVTQGQAH

SEQ ID NO: 965764 - protein, 520 aa, Homo sapiens
RIGRGNEEGGGNRVSCYCRYYSTKSCVAGWILELTKEMDNIMGLIDSVCLLLLCEHLEIVCYVLTRYTGTHDTYRQLGRRDLVGLVAFDLFTTFANASTTDLVYPIKPDGRTVMPTAFRTTVVSLTLYEKDDTDNGDTNYNTTTGERYNLTNLKGLLDNHWTWLNLRLPQGITAWGSTGHEGSDNVAPRVPTKNPTRTLGKALNAGRQLQTRLTPRHHLAELYHGPGGPRQGVHTLKPWRPNTDATQCDTAPYHYQRDKDSNNPTVPFSTDAHAYTEVDTGPKSPLVLGFGLHRPLKNLIRLEDNPRRRHGRELDWAYFVCNCPPKLGKLVTYRDRCSDHYYSARTPNERRNSLRQGLERQRVPGPARTTQSVTNISEPGAMSRQETNLVRKTTGGDNHFETHKGSPAQFTTSTQWRRGEQIDERRHMRAPGQELDANAEGRRAHHTTTRRDDIQIDDEDSHDREHGDSVRRTQWSSPTVLRRQAAHSECNTRDNVHSKTSIARRNRGRSYETAHNWRTS

SEQ ID NO: 965765 - protein, 359 aa, Homo sapiens
MECHRVAESSSAIKVFPAMPLLEFWHLVGGSANDCEDPSPPDWSVASQCGVGLNLHHRLWPGAASGQWSDPWNSITSGALTGGCAGCPTDGPLAMVELSNDGGHPVMALIEGVGILLTSLTQTQKFRNAPPFLEDPSQTDPYGWNPGPRLTQLSAVPTEEDNDTMRSYINRYPHTMVLPTKGRAGYPVRPGTIQRGYYSELPKFQRVESEDHQCPDNSGAPKTTTRDTEPKKQNVEGITPDSYVRTRHKITGRSDCQDRRQEGARTEHRTRAKRRKPRNVDQRATKSHKKPGQGQGNQPPRTPRQTDGQRPGGGRGQTQKKEERHEQHDDRRTRGEATTGEATAKRDDTHEATDTNAAK

SEQ ID NO: 965766 - protein, 218 aa, Homo sapiens
LPYFLLVITPINRQLLPVMPEPSKSDPCPEERLQEGRDKGPDEGRRRSASAAAQESYSVYVYKVLKQVHHRNRYLDAKVHGASMTLLTINDIFETHRLERLPAWRINNKRSTITSREIQTDVRPDADRGELAQARGVRRDTKADSKYTSTKKRHKKIHRAALTQAHGLQTAQDKATIKSQQPSLQHAHIIMGKHMQCRKAESRSLTINHGHSTAFAKL

SEQ ID NO: 965767 - protein, 424 aa, Homo sapiens
WTRECGGAGGGGRPELGSCWLCAMSCEHGLSSSTSVMINQILCCLCWAARPTRRSNCCSACPLAVRDSPQRHFSMETNIPYSHHHHQMMCTPANTPATTPTSSLTALTMILPIIKAIRELPQTVCSSAAPEWHSDIAKDKHTGTTDSPPNAAETRETLAALTDWTPIVARHVKPTGGAQQGNQACHATRPRELEGQKATDNTSRRNKQGHKPTSDHHEKGNTVEKATRGAKTITMDRTKESYGRHSHNAHHEPDAARDNDQEEKGEHRGRKDNEGATHMKREETGRQHADDKHERHRGQEGDKERQRGNGRRTQRTQRRGQSGASEGTSSEGQERQAEQREEGAETPTPERPRADRHHSTKERAAGGSEEETRTGLPEKNTQKALARQEREGEAHATRRKRIAKSERNKGSTGRRRKAEKGGHD

SEQ ID NO: 965768 - protein, 208 aa, Homo sapiens
MYMQHLHSLTNTNKGLTPHFPCHTSQRTRGPPRTATAQTRTDKAETRHTTRKTTETQWKTRQQHTAPTARQTEKKRKHRGSNNQTEHKQNRDNTPNNTTQAITTTPSPGKKAATAANHQQEPGNGDQNTSRKQSERETHTGGGKGSTQGTTERRERKSKRRKQNERRPTDKQGDPRRKRGGNRRRNTKKQKNTEGNDRRLHQNDGKQK

SEQ ID NO: 965769 - protein, 284 aa, Homo sapiens
MPTPESTNSTTLGGHLHTIDPSLAHNLATDTQLTIGRRKFRSSNKGDTKYIPASRVNWVTTNFATAHSTPDTPIKITITFQGRSPLGLARTDIVWAIYTPNFITTAIKTRLSSDHTLPTYCTSGWPFMTSIIKNTLGAPTWEPPALTHNPHAQRPNKRRSRANTSHRARRHPQPTYATHAKRPTLDNWYDIKRNPKRTSHQHRERNPQKHTAGLADTTGTSYHNQPQPQTEQTHTYKSPNLTTQNQQTRPSNRASEQRENTPYNTPEQPYHGTATHTTRNEQTR

SEQ ID NO: 965770 - protein, 420 aa, Homo sapiens
SKALRELGTPPASDPAVSRPASPAAQRSHGDHGSVTGPGQHGTAPARRIRHEVLQSSYVSRECSNHFKAVLTPTESLYLMQFCCAVRRDPEETHWHSLRIPSEEVWRKEEAKQIRRILHSKARATQYQTLRCRIADVLARSHPHPSWLTRYGMATVVADYRRLTVLQRRDYVCGSPYVRNTDYTEKDLSTNKCARLLSQTRHLTKNVLSCHDSGCINEERVHDLLMPCLQVSFYRQAADLLSPAQGDFARGINVLSVDSDFKGAGRHCPNAETPLKVWANLSWFAADPGRAEPYREEKLVFAEPTREPTRMRPRPPRAQGPTETPWSQTFAGAGSQPGTSRTRRESPMGESPPGETPNDRYRGGNPSENALPSTTPLVATPVATHPAPALLRPPTPALARHRRPPLPATRLPHTQAPADP

SEQ ID NO: 965771 - protein, 137 aa, Homo sapiens
MALALFVHDLRANIGTRTRLNDNRGLCRWHHNDVTKSHLHIAQHNVCVNAWWVCSKGASRTNTLRDKLNTRGHSEPNTTNTCTLGLNKLGEHWDTARLIDLAARKGRFSLYRLLAIGREDLQGAHCACFAKLVPSSR

SEQ ID NO: 965772 - protein, 342 aa, Homo sapiens
WGAPEGESHQRYLRNKELSFLEVKFVHISVSKTFDSVPVVKVSVIFSSHCQAVSGYSDQVVHQRRSATSSLRRCLLTELPSFSVCGQSTSYRSAIGFLLHMTRSAEYETASTDTDRRELAAKQCLLNGAPELAADWLNRRSQFFPEPAGGLWQHPTLRTGWYYIQDSRTRRAYITDRWKLSALDVLLTRTPVSQGYGYPIYYQMHHGRIDQLEGLHGKQEDIPTSRLAAHHSPIRAEQRPPPWIAEDPHNRHRTLSEQPSAIPPTPNHRHGTTGPPPAPTALAKQTSAHYTHTGPAAPRPPPHREATTAGHKPQRDNAPRGPQQSRQTKTPANTHKQTTQTT

SEQ ID NO: 965773 - protein, 414 aa, Homo sapiens
MTDRYAHKSAETPIRGSTRHKDRAQNTTETKLQKTNTQETTAPPTDRPHDNRTQRRQGKPYQKDTTHTTSPPHQQEQHRNKTNDNTTTETKHPKSPKEQKANTTSKERGPDKNRTGKTTADRDSAQTTTGGEAINISQHTDRRNKQRNKTKKGANRRTDRTKERQDTPNPPRPQQTNPERAKEAHDKRKDRDTERPQNKRSEQHKTSQGTQKQKTMTKHPVHNKTPKEKTKTNHHQNKKTEEAQTHTGTRTTGRKQGRRQTTKEHNKQRGPNTKNTGAKRKQPRNTHRDSKSDQRNKKTTPSPTTTSQTREPNQETKQRTKHPLKQRAKTTEKRQRARREQATNRQQQLKTRHEAPENRKQQSKKRPRARGTANQQEPKSNIIDHTTNSETKSTLTTQQQAKDRNRESDKKREQ

SEQ ID NO: 965774 - protein, 301 aa, Homo sapiens
MDDDIAALVVAQRLLACCKAGFAGRRCPPRPVFPSIRGGAPAHQRPLMRGAWRSEATSLMWPDERPAASRRPSLTPARYPHRRLGHRSPNLETHMARKICAPTTFLPMQPAAAGLPQRRTTAACLHPQATPLQPPYTAPTRRPPHCTSTTHCSRTTLSTPTPKPTAHAQPSSKRPAASIPVPTAHLRTIPHCATPAAPRDLLSAAPRRSQPTTRVAHLLTHARELAASSTLANPVDQITCDTPGPIVPPRGNPWQHRDRSPAHLHTVSPRPRPIAPARAPTARPTSNNANTVYPLNVLVTY

SEQ ID NO: 965775 - protein, 208 aa, Homo sapiens
MCDNEHETPYRKSQNKRRWRVEIRACKTCLSTGPLYYCPTRSLIYCNSGKNGYALSAHLIQATGKDKFTAGKSIERQRHNVSTSGNLHAMGQAPPATNEQKHADTQQDHMELKTETVYTVKQNYHLNHEDTSSNSRSSVTLNTQERPPDDPGTTHGRDLEHGSAHTLTLSREPTPQDTITDRYLHQPSHDSSNRSTCHDSSDVTPFQG

SEQ ID NO: 965776 - protein, 254 aa, Homo sapiens
MADEGGRTWRKERPPLTRGGGGRKQEGATTPPHKRRIYNKPPSGEKINTTYQALQPAGNQQPPGESCCAAAERRNGLALPEGGNYFLDTTLFYHRGGSSLTLTPEKRETNEKNNQRKRREAQEEGKAESRGKQKREGSRAREMRATQRKTKKHTTRKTSNTTKKTTEKQRRKGQRGKTSAERSKQKQNKQSKRSRQRRGTGSEGEPQGPDDAGRGQPGQWDARPQRRRQDERGAEEPSRRRAERERPHESTRTE

SEQ ID NO: 965777 - protein, 466 aa, Homo sapiens
PAHHAVKDHGLQAPRADLHPVQAVQRALQRPLSQLAGHMLDPSGGGRPSLSRDDAPQPTSPPCCSGDPRHLIQRYWLTRLLLPGVRQRPCRPARLARYAAQASTPAAVPTTPSCGIRSSAGARTARLPCSSLSSALSPSPEPLGCTPPHMPRPSRALAARRHPPCARYEAPPLAPPLTPSSFLARPPSVFPPSPSPSPLRSPPPHPTPQRALPFPHQHAAHRRQRPTHPLLRPLYAAHDFAPPRTSPTRPTPRPPPSPGLSPPFPYSRTPLPPPTSAPPHPLPSAPLRAPGSSSLPLLPPSVRATPPAVPPRRRSAAPAHPPSTRHVLTAHRSCDSMFIPPATRFPFRCVGVVESRAHGSRPRLLVSRIVGSTLPADTPPLLLTAACSGGPHDPSLTLAPVPPTGSTYNTPRLPPLAPRGTEPPLRPRRAQPHDSPPPAVGPPPVGSEPRIDALGGRSRSAHQPRR

SEQ ID NO: 965778 - protein, 291 aa, Homo sapiens
MNGASCEGSYQFSSHLPCVLVTTVFLRIIAGGLGVAHNRYISEQEGDAMEANSWVSFHLVRFVKETWYKSERLSTMTSGFPTNGPWKRGFDRGNEGWTRSERHPGGQMWTRFSKGPSMVITYEYPREVQSAFQGKTWRGGTYNGEDHVQEAEDTWVSFNSTKWKRDFHRGSAIIKIIPNRWIAIGYTVWVDRYLLFAMGFPPQGEARSALVPPSLGTRENLCPIFRRVAQDRWACGGVTGVCGSVDHCYVLRGERRTCAPTQAQVVRETQSCIMLNRGEERTFSWQQRAEN

SEQ ID NO: 965779 - protein, 156 aa, Homo sapiens
MGNEQDIFNEEDLDDQQDCAFFNKKELLKLYSRFYEAGPQARAQMDYRKSPDASKRCPLKRHQYNPDARASRAENPVANRTERCVRRAAVFRRTGERRTLNISHRIFVDMYTRDHAEIVTPTMQLQETILIALQVSMNFKLHVHSFNLARGKDLET

SEQ ID NO: 965780 - protein, 134 aa, Homo sapiens
MLGRRNSAMCSGLLELLLPIWLSWTLGTRGSEPRSVNDPGNMSFVKETVDKLLKGYDIRLRPDFGGPPVCVGMNIDIASIDMVSEVNMRFWLQERGTKTVVCAFQGCLCGFSKAAFLDWETRARHRQSLSEVLT

SEQ ID NO: 965781 - protein, 310 aa, Homo sapiens
ILKYQTEIVYAKTSPHQKLIMWKAAKDRVHIVGVTGDGVNDSPDFEESRHGVAMGIAGSDVSKPICMTMFCVDDNLPQIVLELEEGRLIFDNLKKSTLIYTFNQNSPGYHSPCHDIYYANIPINTGDLSTNPLHDLGTVTCFLPFSLAYEAVLMHDDIMTETAQKSQIQTKTCEIERLISHGYGADWYLIQALGGFFTYFCDSGENGFSLLTVGLRVDWDDAINDVAKGTSSWGRMTRDSRGVHCNSSQKIGGHGHWNRKRESGPAEQKDRIGCNTGSPSQGADQPGGPPANARLGNPLTPHVPPRVLRA

SEQ ID NO: 965782 - protein, 153 aa, Homo sapiens
MFVSTWDGVGIIPGKWSRTLGGSAHGVGLNHTWGGGGRQNGRPVHPNMKYHRVANTIARTKQMMSTCVVAGGGALVEFYENWGRLHAQRNLFGDPNECIRVVVDTMNGGPRWDKGGEGPWSAKDNVPRLRWTPWKPGGGGRGLNPTGGNALEL

SEQ ID NO: 965783 - protein, 238 aa, Homo sapiens
NFPCHNTHAAISPQRHVTTKRVAPWHPYVASATIKTWTTLGTISDRPTVAYITWRGLFLVVTGGSIAGDQHVGCVLRFVCVRCVPCGGDLGRASVVPWCRGIVTRVVCGVSFSPVVCTRRGRGSRSPHNKRKNPWLGEPQRAFSFILSNASVGHKEYSWPTGGTEPGAEYNIFLWGVTHTLYHQRVGSDVGNPPISPSLCALCVGDPNLQPVGGVGGRFGALFIAAPRKFPRRDVQSP

SEQ ID NO: 965784 - protein, 138 aa, Homo sapiens
MDKKSKEYSCKAAATIRRENTYSRATQNKHTERTKNRQKEKKKQKKKTKAKRPQKNTNKSDAQRANTKKQATELNRRNANNTGSREQNTKDRRNKARNNKREHRNEEQKNERNPTNKTKPHTKQGTNDIANEIQDQIT

SEQ ID NO: 965785 - protein, 206 aa, Homo sapiens
AAHRTEARALAEAPSPKPEPEPAPVGRAPQALAGSLRLWEPHRWGTNIDDKELTKREHRAEEVPGLWMILKRSEAAPMTEAQACHVEDGLPDNTITRHVCRVMTQQQSPGGSWPGMGLTARHATGLHTHRVGPRFSRQTLTGGASSNHMLMDRWPILMTSMDPTDIQGRAPKERPHLGLTTLIPGDIQMLSEPVGINPLAASSIAT

SEQ ID NO: 965786 - protein, 267 aa, Homo sapiens
MRGRTASAHNATDARGTHKEDHAATPNARSGQPPPNKENVTNKTSDQQQTVPKQVAKSTPHAPTHPPPGDTAATTAAPPHERTYMASAARATKNRHTTEAASPRTTETHQGAPDTRGGEGTGGSTGGRGRGGGGEGTEKGGERGTEGAGRGRGERKRRRRGRQEKQSRRGGGAREGGGRGERESRGGRGRNGGGEQGGREGEEAEGRGETAGADGRERRTRRAGGGGERRESGGRERETGERAGTEEQGRERGGGEREGRRGGEGRG

SEQ ID NO: 965787 - protein, 530 aa, Homo sapiens
KYSLNRLKNKSHTYVILLVTSAVFCLICSSLGIINPFHHQPLKGKGSIFTASIPRAAFPTTSSKSTTPSVQHESSTFPVTSQCITYSQGHIIRHSFWTNPPHHNIKLSTPASTGIMRIPTHTVAFTVQVVSGHCITLWTLSNTAQATIHLFCRPTPIHIGHLQLILPHNTTRHGAHHGSNTKHRRTKQPQISRDNALALGIPHIVIQVTIQLITRGTCTLLLGSLQFTSEHSTHVEDYTAAITNDTDWTLWLIAHHISLHVNTSGEADTHIHTVHSNNTTTTTRNYITLLHSILHTRQTIDRKRREIGSTTTTRNTIKRQDMTPTQSSAPCDTHTKKRGRGHMAAHQWRPQTKFTTIDTQIPTHTINIAKNGGDNNENATHPDTKTYTHNHHPHTDGKRVPPSSTGNTTSRTPHRVLQQVHKMTRLRKPHRSLTRKQATDAATPPNEQHTTTTEYTEENTTGTQINTVKEQNTDPGENTSPQTTDKHCRSCDTEAHTSSNQHRKHTTQQRMDTTKMRALLTAHKERQPLP

SEQ ID NO: 965788 - protein, 136 aa, Homo sapiens
MARAVGGTQSHSISSVVLQETEPIRSPARGGAQEPAPPWGRRASRSSCAVHDLIFWSRCEEEWGNVLGHHADHAAFPGSFQLSSVWLSYLILALLSVTIRLQDLQVRHPSLTEVRRRHPFKAYLDVTLRLSSEAFP

SEQ ID NO: 965789 - protein, 437 aa, Homo sapiens
LGAGEKQALLVLCAAHTFVLAVGGIHFETPLPRLHDPGGDTGRVDTTDGCNVVDLRADMGRCRSSVRLAERRLLEFRGTYHPFKSFRILRATSLVSRRSVPCPHVQVSTCGDHSTPLPLSPLDFPDILPGSSFTSDRSVTLQLDPILIICMIPDFFLPRQKGWWTTGRWISFYTLTHNLNTAQSRRFGQVARSFSNLVRHSKPGIYDLAPSTFTLLHNKTPLQKSLNNGPLSISDGNYSAKDQVKLFTKDQVEGTWLDAQELWPWVNARDSNAPRGRQCIRPIPRAEPSYNGQGRQHRGTAHHEPHIQGMTARQRRTTGTLPHGGTGQRPTSNVATTEQKGDTPYVAKERQRTSWYSEPRQGQMTGASTRTTRARRADMKGKATKPMTQTGDQQGRRATTENSTNQQALALHQLVKSKQQAVVRLVVVVLRCSTART

SEQ ID NO: 965790 - protein, 199 aa, Homo sapiens
RPRVGSLERLGGWASPLRPRCGVPRGCSWPSPCTQRCRCPRACGLLLCWCAGPAGPADVPHFLAAAAGLRLRMCSDAGAPAGPGMLLHTATLRHLQCSSASTSVYTGAMCYLPEFNLRHELELSAQPLTPGCSSDTTLRAYFPDCPATWCCYLGDFCWTRCGLRVQYNTTILPTVTLDKDLQAWNGHYFILTDQKGRCI

SEQ ID NO: 965791 - protein, 142 aa, Homo sapiens
FQSSQEHQVLILLTSPPTSYHSTVNQSPVNDAHTGLQEIVHACQTPPVGLLRAPITRRHLVPRSLHPILAVEISTQDHAGQILCYVHTGNSLTPEVPPIQLLADHPQMEPETRATMGPETHPCKVVLGTHQPTPDTAMALGN

SEQ ID NO: 965792 - protein, 180 aa, Homo sapiens
MGMRSTTPCELTPRCAFWNESVCLMPRHIAAEQERNRHASQMVVTGENLIEKMKTQNINQPEHRSRDANSMQLCKFSFRGSGKNPWKYMPQASTVRVMRELGSNVYVDANKFKPVTYTDMRQDRLLPISADIKREQDEARGPNEDCPAQTGAPREDSAELWKRKGKLYIIWKRQQVDQEE

SEQ ID NO: 965793 - protein, 194 aa, Homo sapiens
MWWWQLWHFVVEKQPSNNHDKYPLSSLQSSAPGAMSQGKECPVCRRGECEPVQRDLRSLGPLRSISTVEVLSTYCCVEVDIATNSYAKRIRYSTYCWWTNKSDGVLSGEHNFPYISITPNLRCAGEELHSILSARAIISVGGDPTRGGAHARDQRRGRVRHERGGPRRAGGAGASLPPAGGRTAWGGAPLGTFS

SEQ ID NO: 965794 - protein, 359 aa, Homo sapiens
VSSRRRGAADTGRLRGLARPSIEVSASESCGAHGDLPRTLYPRGFLGLALDDAFAFLLPRIRRHAHPIVVVHGGGSRSHLQGIWKERVHQGMVKSRTPMGIRQSYRAGRERRWMPQRELYDRPGRRSRRSTQVVGLSGTKIGEVEMDASIMDGKRLSAGAVSEVQCIANPIKTLTRIVMEKTPHSFLTGQGARTDMEAAMGVQKILETKLVTQRTHKRLAHEPPAHRCSHTDWSQTLGTRGMMMPSDWHGHDGLRKHSPRGTRQQQCRTRRGPHETYETGRELPPQGTSVNTDHTTRECGTAPKRANPCTNAPWATKQRTVQHRRHTRDTSQRHTKETHREQTPREEYTATSDHDNKRP

SEQ ID NO: 965795 - protein, 75 aa, Homo sapiens
GLVMAEKVNGLTRVLYSVHGSDPGEGGRTTFADWVFVIIDREEVQVDFYSWSELIEGWGRRRNSTTGTETGCHTA

SEQ ID NO: 965796 - protein, 224 aa, Homo sapiens
MTQARVLVAAVVGLVAVLLYASIHKIEEGHLAVYYRGGALLTSPSGPGYHIMLPFITTIQICADNTTNDEVNPVPRWNKLVRVIIYIDRIEVVNMSAPYAVFDIAAENYTADHDKTLIFNKIHHELNQFCSAHTLQEVYIATRPEAAARIAPSGTQFAFHAHPLMAPATLTQRIPETRQMLHFLAREKAKADADYHAAHNLCTSNKHKLTRQYLEPQKVPGRCF

SEQ ID NO: 965797 - protein, 210 aa, Homo sapiens
GSRWEIGPRGAVVAVWAMARRPRAPASSGEEFSFVSPMVKYLLFFFNMLFWVISMVMVAVGVYARLMKHAEAALACLAVDPAILLIVVGVLMFLLTFCGCIGSLRENICLLHDFSLCLTAVFLLQLAAGILGFVFSDKAPGKVSEIINNAIVHYRDDLDLQNLIDPGQKNVSCCARAFLHRTWSQNMYSNCSDRPPQSRALLCALLLLLA

SEQ ID NO: 965798 - protein, 343 aa, Homo sapiens
RPARPRTEAGGRDPPPPTTTTTTRVRPGHRRGVMAWGKGAKGSIFAQDKRRGLTMTTRKGRGPISRGHEVGGEEGTSSPYSAPFLHTLALEEGRGHRLPATEGRQGLWGGTPTGFQGDQESECGETPLPRPIPGPMLPPPGLPITREERTPQVSPGGPRDYPSGRLQPGLISRVGQLEESYYIIYLPKFEIVCRVGGRRWMLAPSLHRCGQNPELQGRRAPKYTQQIGLGQSSTSEHMNCTLVATDHLKASQHWDGAPGGAITNRAVKKTAAKPKRGEGTDQHSTAARKDPTGSQAEAPRKRKRKEGQATGGAKHPLREQAGEEELAGQNRETRTQEQQTDDN

SEQ ID NO: 965799 - protein, 177 aa, Homo sapiens
DHGVAHAYRPTSSCTVVFNYFRMGGEGASGHHYLISTTIFAVPISEYLKLNLNRYPENQIPYLALHSYRSLILLELRIIIIQPPPPSLPTDVANIKKVTDRYSSQVNWNTRLDERLWKSISTVIYLTVMQQAYSEPYQETHSYQTHASIQGQPFCDDADSIISPQVAVDVLAHVAYV

SEQ ID NO: 965800 - protein, 69 aa, Homo sapiens
RWDGTLAPWLPVLRGKKLEILGQRGDKLSLKSSLGVSLFKSTFTFVYWLCDFLCTHVYDAEYTMNTQKL

SEQ ID NO: 965801 - protein, 336 aa, Homo sapiens
EGSGHVCEMVRQMYDGMTFLNQNASEIELAAEKPVKLSIITSGGATRDRALEDLDTCMTLCCTSMTLNPKGKSIHSRMLRPVILGLMKLELSILDKAHGKRYQIHMKEQELPIRSRQEKRKHGINQYEDRHSTKKEKKAGTPKTNVTSRTKDRNKKDNTSPTTIRPVHCTQPIQPDRVTRHGSNTRERTARGPHSPKHNNNAEQHAQPSNRQHQQPRHTRPQKHTNTHTKMKANGKQCDDYKKSKYSAKSTDHTRMPKERQHNHRGKKHTADHNNDERRQEKEDEDKHDRTMHSQQQNDKTQTRREPRARDTKRRNDECKTQSVTRTEQSRTHDYV

SEQ ID NO: 965802 - protein, 131 aa, Homo sapiens
FPSSSGAPVEDHSPEVQVVKNWLQVLVHASPQNPTQHHPVKTKRHAKRQASTKQRIQYKQQLGRRTEHNAAPPRAHKDRKPGARTQAPPCSQAHRNHDRPPSRNGVERLASADADHHIRQAKHTREPAPTR

SEQ ID NO: 965803 - protein, 446 aa, Homo sapiens
MPACAKHHIVTHGGHRCVPYVRLGPRSQKAIHDTIRYRVIPTRSIHYILCLLYKETPTIHLAIRSDIEYIHGGTPNVLLISTYPNNMRAKGNAYSVALHITKKARTPKLASRMECGLSSSIILLGLGPKATDALFRFCKDRAKERQQDKTFGGQQTRALFYPRHDPGDTGTSAFNKREILPFMGDLYLAPPNRHPCLLTLGRYTRCRIPYWTLLHPSGGSRPLPPFKFWFSHNSLGFGNILRFRLELLDIHHWSHTKTWTRYTISWHIFWGAMKRSPLEQGHSSYVNNAEPAVRVLWGGHTLLFPPLGVADITLITPKIATHQGVQGVSPHWVTLRQGKEGREAGEHTGWALTHHAEKETAPKGTTTPGDSLGSPLIWRSHPRGDRHSNTQNPQELYNKQTTHEELRPADNPQHVVAEPVSRPPALRALGGQQTYGRWRPHYTQSR

SEQ ID NO: 965804 - protein, 131 aa, Homo sapiens
MKDRTRPKSTTRHKKTLQCEERPHARRGQQERRQGEQARSTTTKTKHNETGERASSERPRSRRDADGARGAEKAKRDAGTRRLAKPSTASYRPGLSVAARVRRLDEPIILDRASAARTPELAPYLTESRGG

SEQ ID NO: 965805 - protein, 76 aa, Homo sapiens
HHLSIVTFENHSCTGKHTTYPSIFILYTRESISSLGIIQDKLNFQEILYIILIICAQDDTYEDDFGSNSFILDFHN

SEQ ID NO: 965806 - protein, 105 aa, Homo sapiens
MTRIISLQTADARLSTDGQAQIPARCLRTLRSPHAHGRLTLLGPATYRMPAEEVTRILANTPGPPSTTTIDGGARTQTSCYKSDHQPTSPSRRLLRAAPLIASAQ

SEQ ID NO: 965807 - protein, 86 aa, Homo sapiens
MTSTSILLDSRESNDNNSSTPQNSSATRDPQAVCHHHLRLNLVRDHDIDQVGQRWLSDSWTLVLPRSPAPKRVGIHSAIPPALGQV

SEQ ID NO: 965808 - protein, 254 aa, Homo sapiens
TVAVRTGLPSETKKTGKRIGSSELLWNEIPHFRMSRQQSHLDLKVWSCHTLRNELLRHRSVNLSNVLKSNGGKMENHAADPEPADGEQRQRKSTGGELTIFLDGPTCDLGNVPNGSALTDEITAAFERLQWNRVSSENGTAPSTKPGKEEDPGRTRPYGCLSQNNPRSGEQSPGARSRHRSRQELTPQWVQAMAQWMRNPTALNRRTSREGESHWTLEDRSNDSPPHTGRRPPTQPETRHSEKTGAHHRPNGAS

SEQ ID NO: 965809 - protein, 96 aa, Homo sapiens
EKAVWTIDTSVKKRRHGTRIRDIHQESSQAPLLRSCPKTPHHTVYIRMHNRYTRKTHLSPEQQQIIEQTQHNLQHRWALHSIIRYQPQVQQHDNTL

SEQ ID NO: 965810 - protein, 107 aa, Homo sapiens
MFTQHQAIQLVWIWIMYRRPMTYTVMLPATDNFAAPHRYRVWKRVTLRLADQCVTLILYSELSPTWHLCCMSIRTHLIYTLRPPPQLYIVLQINEYPPISRSNPAPE

SEQ ID NO: 965811 - protein, 169 aa, Homo sapiens
DSYQSIVRHMRSRTYSRQRYHASYHATNLESINMSVWHLTQQNHIEQRILDAEEHVRVLHGCAKRARFKVLPGFYESEYLKRHESVQTLVVSHFEYLLSGQFREPGTCTTVTIIDAPGHQRLYRNNDDYKGISLEHDFSWSVIVAAVCSRCNFEAVYRRKNGARLRMEH

SEQ ID NO: 965812 - protein, 338 aa, Homo sapiens
GTQELDSLLAITADPAGGPVRGSGERGPDDIMKGPGEEMLLSIRRVVMPMSILQCFGRGFRERGPAGLGLMLRSEFGAPVVLSLCRKLAGFHLADPQRSVARILACMEDGSPAGAAAALVSSLRSRTMLSCTHPRVLCKPARCAVGILIGRLIAQVLNFLDASVEIPSLQATSTAFSTARTTVYAMLELRVQVCGASAGMLQGGASGEALVHDLLSDIYPAVLMRLSCVPAGEPDVSLEDWEDYGPAETHHAESWGEGYWGRNKRQPVKGAMANGGTRENVIRRQAIQKAPSRSPPMLVAPASSGSTHNTNTLEQRSYPGHGCINGVYRMSVPRRTTT

SEQ ID NO: 965813 - protein, 428 aa, Homo sapiens
QKYRLRSNCKDAVQCALLRTWSAPFLGGPDWSPEMLWSSSFIAATGNFHASQPLHLHNSTGTAADVLIILDSSVILVSCITSVASLHSNTWDVSFKSFGAWSLPCVTWSCRHMFQASTAHMVTVPLSRLSHRVHVPLSTLRTPCHHIVTRRLVRCKGQHCINTPIPRQGTIHPVSTARHQCSTISLEHVSPRYEMAIATMQAGYDGPGSHCPLWVPHEASIRIGTQGCPPIQGLPNKHTPAQRRQLLGPSGHQTPPVAHSHIPSGNNTPRLAREQTQNRQSTERHYFTTGLVRTIKTLEDVTPHSRATTMGITVMIATPSSHLPLAVRTQKQRNAGVDKQTPYPQLGHTPGHTPTSPIHNQPEQHTGSPAAWQLTNTPSTRHQHTTARPAAPQDTNRTTVGPTTVRHTPTNRIPHQWASPHRRGRHND

SEQ ID NO: 965814 - protein, 466 aa, Homo sapiens
RFVVLYSTKPYQCHTSSLQRHTLYAAAMTRADRPYRGTLQGATTASALNPSTTLTNPPPASHATIAYHSYRTSSEAIQTKYHTIASDKPSTPAALHDPTYMRTLTPTQPQLGPTLPAQSYQHNTTTPTTASTPRTAEERTPHLPIPQPLGAPQDNTRPTPCHFQNGPIHLAAPPCRKHHHIRPTTITMGGSTLPIPIPQPRRRHHSTRRQTPATGGANLSLGLGRRSPNLQPPRTAGTLGLAPFATHYDRTPPVSFLIPPIFRLHTPQTPTGAPTANLLGSSHSHMDHKLLITSTRRTFTPSSPLHIYYKCVPYIVWPHHYKAAPLGGGLWAWRFGPTSSSLSATPLWGVPPQAVNLGDTARDPNEHIPNTTRPRPAPRALTMAVHTASHACHPYPRRPPHAPTSPPRPHPAHPHNHVPPPTPPLHHSPTTAPRGPPNRTNQPPNPDHQAHDFTTTRGNHTHWRAT

SEQ ID NO: 965815 - protein, 301 aa, Homo sapiens
MAAFNFIQCQTSHLNQTPPGPHNYRTPAIQHTFQVGAHLVQQATPSLRSQSPCSSTSTQIHKRTLTHHSNLHPNQLSTNRQHSSPVKASHQRPIHHSSAGPIIQPPQRYSSTVRIVGIQAPSAHRVARTRVISNKRLRLPRYTTPQYHNAPIHRLQSLHVFHANLSTLKSPRGPGYIATYIHLDTDSYPQYPPWLKQDKRDTKEANKLKRGHNISPQNKRPGHSFTPAGEKPGTYFPRSFDRTYSRPPSHYTPHQASHSPNKEKPRGASIEETEKAAANAKRGAARPRTTTNEDDITPGER

SEQ ID NO: 965816 - protein, 446 aa, Homo sapiens
LISTPLALTDESHNPRVPHGSANCSARLVPSSRFRPTFERHLLTTGRTVARCERDRKHGLLNYRSMRRLTFNVTSGKQYPFSHTIHSAHVACMHSNISLPITPRDSMIRDSESSKSVVVTSTVHVQPLDSSKLAARQDFRSVIKSIQVHYQPRTHGRQHILGASKTQRTLATHAATKHTLISSLCQRARPPPEQLSKAQQENFKPLHSGATSPLSPLTRRRPTATSRAHRALPCIAYSFYKLTCVNNTALHLLGEIRTTNLASSGNTQLTQTHPSAPPLTHKPHIHVLPHNTTIAHQTRTNTPTTPPRNPPIGANLASHNSHDNTHRNNPNQAGSNGHPNDRQLTSYSRGGNPSRLDKPEHQQRQYGPAHANQRRPNPQLKSKHQHHQQTPMPPQGYHNQNVKPPTARTTRDNTKCKNLREPPRRQQHNTKHYRAVAPHRRKRNPP

SEQ ID NO: 965817 - protein, 453 aa, Homo sapiens
LARCWINDEPAVSCVLLLAVCCLMCACANAVMNCLNAAWTLDCVAVLCVHVAACLLCVPWCCCCVDAWAVLCVLCACGVHALCAGCVLPLVIPPFVPIELEVRLTQFSPQFTTGVLFPYTYVNSTMDFQRIRRACKRGGPHYHPQNNQVANQTKRDDHHLLRVPPPPAPGPTRFSIPHLVAPLVNEHPGPDDSTPELTRPTLPPYGNDLARPHPEVDSDHPRQHQRPPNMRSPTRGTTTRTQHLTKNPPRAPLNTRHAGKTHDQEMAAIPNIDRIPPSRFPAARKQPQHIPGRTRPTARKGQKARCAHSTERPQNRRTSLVPHHTTHSPQCTGTTQSVASTGKKAAHFGHNTEDPTRSAPPIKIVNTQQQRKPNSLTKLLRSVAGAEPKHYHQSSPPNIRKLPLDTTSKITVAHNGRPHTKTNFAEHQQKPPEPNNKPLTRQLFLIANKHPTT

SEQ ID NO: 965818 - protein, 515 aa, Homo sapiens
MAQKQKNELEEMPGTLQETYTAYLIDNKAQLEHTDWSELLLTDITMAADIAEVGACSRSYLFTLNSYHILVVATSDQTKLGRIEYRHYNYYWLHNIGYQHIMLRRVRTGNLRLSRTKPYILLCTGTSGLSTNYPKSYGLHTTTPNPYINSMTSHTPTPAHTRYNTAKRARTCLNLAHNLGAYHDSPAHGPGTFPRRPHHTAALTPLAPPTFPRKLDNTEAPMVPKTQALSAPLHPVSKPSINYACTCKPVGHGTVASTSLQTKYNSPYTPTVSPGRALRQHTNGPRQVPSTPYPKLARRPNIPFDSGDNHIGGARNTHVGRPPAHRLQPKPLAKQQSERPKDPTHNRHKPPAETTMAATAHHWDTPRCNAKDRQVAHHNFTTNYGGHMPRTTQPTHTDTSNNADPGNQNHDTARTTSEHPDTQTHTRTSPHLRPRATSAIRHTHKPHTDYEPHNDTQSRNHRPHHIGQDATQAKVFTKPKETRSTAYHRQRIRDATATDKAQKPQPHTHTSDTQT

SEQ ID NO: 965819 - protein, 184 aa, Homo sapiens
MSDAAVDTSSEITTKDLKEKKEVVEEAENGRDAPANGNANEENGEQEADNEVDEEEDTTRRGANDGRDATDRTVTGDGTRMDDDRLPRHAESATGKRAADKMMQDDDVDTKKQKTDERDDYTAHKEQVTLTTQKAAVTYPPSTSRLRIYTWTPNELERADPPTEGNATPDDTRTHTPNQNTEKR

SEQ ID NO: 965820 - protein, 356 aa, Homo sapiens
MCSVITQIRCNSHHQNDSIPQKSRIVQCGLAQVGAPVRHTSMTETCTDDPDDVNVAHRRCNEILVVTTGSDDERRGTDWAAIEHGRRHSERKRDTMQPEFTCPCDLTCPNDQWQERRNTGLGRTCMQDNESIERGEFDDLHECYQEMRSYGQNAEFGKIVVRLTVGAPFGKDRIRRDVLKDPVSTHAPKEPSKQFTELPTRGWYASCSAVWLGTTCGFRDMVHVPKRPWVNPSKSRAQRFKHRIGVPQIVCDPSLGVSSGVTGTLCHSPILAGGPNAEGGAVEPKGPRGQQAGMHQDRPAEKKRPHSRRPKVTHTEGTHGENIDRETRTTKRYREGKEPQSHKWSDKTEGEQRREE

SEQ ID NO: 965821 - protein, 190 aa, Homo sapiens
MCNRSPVGSEQIGGGHLCIQQAWELCIDPGPGGKIGQLSGASPMLGPRVGPRNKRRHRSMVQVTAGPGEKSPGGIGWYQDPWSGTSIQGPKEPGRRQPPAAGVTRKKPDVREPFGKKKVHRVLPKNPGTIKKGPNKKRLTCGAQYEPKSLVLKHTGILSEHTTNRGLHIQPAHEIRQLKQNTRQQRRSDD

SEQ ID NO: 965822 - protein, 75 aa, Homo sapiens
RLMAAAGSDSSELRFEAVPDSFLPLPYPTMLCKSSLPTCTTITLKDYSIAELLRDEGMTCVQRKQFGSISYRNYT

SEQ ID NO: 965823 - protein, 237 aa, Homo sapiens
SRMRNTRAGRVVCGKDLVFIESCTRSMRVLCILWEALTTLSSLLCLLERRCPPKVRVGKDTQPVDLRSEDAAGTDLTQEQPSLARHSSRAFPDPCDLAPMRAAGPSFCGPCPRPVRLHLPRDGTSVLCLQQAVFHLRLSHHLNTWRLHVTFWIFRVTAYTSGCAGPTWRSCAPRPRRQGIASPQPQSKPSEGGQRTHATPVRGKDLFPSSFHPRRSAWGPRLSLEPHWRARHGLPLA

SEQ ID NO: 965824 - protein, 298 aa, Homo sapiens
MAETNICATQRRVKQPARKVCPLPKHPSPLIEERDLMRKAAQQHHAGCNTNQREEGGVQTTRGARNSLLREQQKAGAKEGADHQTKLFLLAHNLGCGDEKSAPQHDFYNQTDETVCRLPHRGVGGNPPSRLLLCRYYPNAGPPRGSYLTPRAGLSPNPPDDLARRVRAPPPPENRKSAYVDAANSMYRKQELSPQKRRPPLEFVSPPQTCYYVVGARQRTHLRELLRERNTRTTEKKNGACGARTATSPTYRRGERTPTEGPTIMSARRKNTRTHHEEHPHRGGHTTRRTNSTGKNTA

SEQ ID NO: 965825 - protein, 317 aa, Homo sapiens
MAIGRSRGTNTKSHAHKGNTEVGPLGQTYLSRNFARTERGSDRTIQIVPFCPQRNTGRVPAVKNNYRHFAKEKRGLFRGTTQVSILGIRYRALGSEILQFLRYPYFPNRIAFGKPIGRKNSVSDTYCAWKKALPSERFFGRVCADKGLPMGARRPPHRVEQRAPTQDYHGESTNPTFGADDLTQGDPIKKACTRTHGIVASLFKTVHDPTQILVVQQAATTAQILLGGNNNTNMRQLGGHADPKHRLHRGGARHDKIAFHPEGTQANRGPPDIVSQVATPMGRLIPNARAAYNAPSSTQHLRMVALPNVIIVTEQHI

SEQ ID NO: 965826 - protein, 90 aa, Homo sapiens
MADDQLVNAEDRQHTCLSNPRGTKSLGFWTLQTRDNSVSPKSKDTCEIGSDQVMNPRRLELKSFGECSRFEGTGVNRFPLETAGLHGKGL

SEQ ID NO: 965827 - protein, 85 aa, Homo sapiens
PAEYTAKMLSVLRMLRAWSAPFLVSGRTGLQKCYGFIFHCCEELSMPLTISSSEELATADDVLYSGESVFLELIPLSILKKLGVS

SEQ ID NO: 965828 - protein, 165 aa, Homo sapiens
SGQGRCGSRGARGVRADAVARRAGSIHSGRIAAVHIVPAERAHPGRCLSVLDPRQRLRRAVVCTRNPWRTQSSCCPPSMSSGSKGPREVTTSTPLGAAIRYAVYQQLQRETSPAKLVQSTLSDLRVYLGAFQTRLAVAASLAPAASFKSPEDTPGLQQAGPCTKG

SEQ ID NO: 965829 - protein, 98 aa, Homo sapiens
MTQALPFVPGSWEPGCSRIQLRDKAASNDGWVAGRQRTTVGETAELGAKQPAGSKGLTAINTNTRMNAPGGHPSLATAGGPRDRHQTCDREGNVTRRT

SEQ ID NO: 965830 - protein, 295 aa, Homo sapiens
GVAQTLNRCNYLFYVVVAYLVQEMSDYSVAGDPERTAEPSSDPAVLGSNNSRRRAVLAVDNRSFVLGTVCLSETPIGRAARTPSQYCVELCDSLPMVCLVLMLAERWGVNAKRLAVRAFAQEPSYQNVLNRADEAEACMTAMRCTRVSTHAERGILCLYCSRERIASHKRELQVPGGSRPKRQIAQETARNPEWRQERPSNTEAPEEVLAKLALRGTIIDYWSIDALPVTHSVRNIETPVLKQLKQRLVTRNRDMCSRRESGTDNHWVSEVCDTRRHGDLEEFRGLQKTVVLLNI

SEQ ID NO: 965831 - protein, 226 aa, Homo sapiens
DFCVRTLLLLTHRCSLIAEEQCRSWKPARNSHGFLRIPEKHPMEPDGRQFTDIRTHPNQAAHVQTPLDTGVCLTFDNDGAHTDPELSTAEHGPAIELPYQRTSDALTYPTTTNSLAWSTGLPKRNRSAHSAISPGTAATIAPNDGASTSPLLTLRITLLGRNFGLQRQRINTTPPITNALFGLAPLGTVSDCVQKRYNPNIGRAFGLFDVFKPYFHLTSDSPGPQP

SEQ ID NO: 965832 - protein, 303 aa, Homo sapiens
SLPPKKGGLAPEKGGGPFSFVGFFPPFWFIFITLISHNVQKRAWGEADEWGTLGHPRGVWGCVYEGEPALCTSKNKKMKGGPSFHEKPVTRVSPAEFPRPRRKKKHEGITYYLAGDTEGRGSESGAHPNIRGDTAYPPGENMGRTYGEDPKPQKGHGAPPLHNPAITLWSEHQGVVYAPVGIKGDKRYERGITSQTRWYNPPSDRTAQPAGLITPPPRVMWRKIYTTIGIKKDKPLRNHNTRTDQTQPTRDGDARHKTRHDEQATDKMSADDDKYGKRGPQQGGDINKRNKRRLNNSRRKEKE

SEQ ID NO: 965833 - protein, 117 aa, Homo sapiens
VSGPDGRRRLRWRRRECGGGGGGKMAAPVLLRVSVPLAGSGWPGMQCALPESCSPSTHYHVRAERMELWTPEAPGGTIMDETIGGPMVDGKCSSTALSPRRIERIRGIMGPIIGDSN

SEQ ID NO: 965834 - protein, 107 aa, Homo sapiens
MHTYWHTLATTKWYWIDIGPWFSAHNRIHTPHSLNRAQRQHSSVHKQGTRKTPFGWDQIVHDLASTAHALHRGSSGQVCKCPLEYNGLPKAEGNTGVPNFGLPNRPP

SEQ ID NO: 965835 - protein, 181 aa, Homo sapiens
MDCPWAALVMHSVAIHNRRMRSMTLDVIATSTSKTAVKHCSSSIRMQPPQYDYGMNASIFTSAMESHTLACTRIHCRRWAAQCSTSFVCHLVPMLSLDNTSRERACVVPICILRAVHRMSCILFSRTYSRGRIHYGGDITTPTHDHLFYTRDVELKGRPCVYLRCAYVVSPSSRWWKVRPR

SEQ ID NO: 965836 - protein, 277 aa, Homo sapiens
VAENIYSKTGIEKICTEVSAAENGAPWPSAIPPGTWLGPPFGGAPVNNAHAMLHSQSNVVLSRWECRQKNSAQVGWGEKNAWAPVNPRGPPSSDLPQGIAVRPENALEEYGESAVIDHPPSGCGATIAELSCGHASLCVCPRHESMRKDRAPCALWVLARQGFKTSCGPKKNVRPTVLQKKRTPSHVESGTGSGHSRGVPSHNATSWGGGYNRGPFSGRPRGLETLSPFVRSARIRGAHNAATPPLSTRVAIPEPIARHLPCGSPPSEDVGPLIEYG

SEQ ID NO: 965837 - protein, 271 aa, Homo sapiens
MEQPPAPKSKLKKLSCRHVRPKQPETQFFCCIREACEKGLMDVSLTRTTQGIRSSSLAIQHQYLLCISIFSEIIKAHFHNAATVTAHMLVPYYGSYLNEYRPLDSLMEYCGAGSALTHNSDYEHKTIHYARCTLHHSYIYIERHSPLRTSLQPPYTRRLSTAATSPPPYRPDHATSRRTPATGWVTSPCLPGPNVAYRSSAHFPPRLAPEAESPPTSGPLTRVCHHPPATLALTSISTIALQHRPPMPAYSLTLPRTLTDLLQDHPPKLAS

SEQ ID NO: 965838 - protein, 466 aa, Homo sapiens
MCVRRGEVTGAELARMCFLAQTVTLLDIYTHWQQTSSSLVVQAASAAGQIAALPSSSKNRVSSTPSSDLGRARQEAGKHSQTACTHRHKPTPTALSIYQTPQVHGGGTMPIHSMTRNKPQASSTEHSWQHWDIPMRTTLTTREGTCAHNLSLLGEVSTVKSARALSQILTLVSSKLAGRAGPASQALRQARSQRHGHQGVTSRAQGTKAYKRKDQPPSSTELQNHTLAGVTTCQLATQQYYTRIQPDDDHQAPKTPTGTPLDGPRRLTPQTHPPGDNCQREQQRQYQHHKAPGAKDTRGTNRQSETRESASSGPQLDRRPTARPPRTAQEDATTGQPTPRRTARTAQQQQTARAATHAAEHEMTQQPPRHRTAHGEQRRAERTPTHGRTQDRRKRRQQRTANTPEQHEGPADARDAGTHTPPPRDKTSRKARDGRRKDGGAAHNAHDSETENHDLKTTERRKRARR

SEQ ID NO: 965839 - protein, 374 aa, Homo sapiens
MRRGCHPTRRAAHPTTKMLEAAARTQDGGPTQSTIRRTDDGATTHNDADALPQNKKNSHRSRGEPQQHNKKQQTQPTIVRQGRLHKQHKHTKENIIQTTPRTHSAQQGAPPSYSRRTHTAGRRILILERYHTTKANQHNRRHKLHTSEVINTNPQRHKNNHGENTKGTQQHNVTHAHNNSAPNTPHLTSEPPQQLSQRRDNRMNKHHTRVAHTDQTNKTQKNKKEINITKSRHPLNKRPGIHNNEHRRARINTIYLNNTRHRLTARRNTNKRWRRNHTRHMTAANHTHPSANHESSSGKKARQRDTPKRDHHAIPHPVGTTHHHTQNAPTTHTQTNMSLHTQHHHTAPTQHATHTHNTPNEAPTDHTTRTKHSK

SEQ ID NO: 965840 - protein, 73 aa, Homo sapiens
CAATVSSPEVVNGVLCSELETEDDEEEEEGSVGRRPKTEQVRLHVWRGKQGSCRAPIEKDERQYNIVFGKVSF

SEQ ID NO: 965841 - protein, 251 aa, Homo sapiens
MYWGAVVTEGLRFKLWLQVDIGMPSDDPCQSDLRLAWFSDVPGMSSCTHGQEFACAPVNGLRNGKRCSSDWKSRIYQSFQVAEIRSQESSVGDAGAEYCRGDPLAFVHSPWRRLGLMLQGGARRVIDLLLLLCCCPPMFVMGVNHEKYEERPQDHRALPPAPATAYELVAKVIQMTNVGIVKGLMITGPWHRLSPRSTGDWPSGNMWRDGRRGSHITSSLSSIVAAKADGQGQYLKLNGKLTGMAFRSHAK

SEQ ID NO: 965842 - protein, 172 aa, Homo sapiens
MWGPPVHLTPLLSVSPYSPTEYYDPRAVGTCEVEQGKAPTKCRLSNQWRGHFPTGGTWCKGTQSVAERSPGLYYGDHGKRAQHVSGTNASTLHGWGDNRSPCGGEGHREDKSNRGHIMLLLRSLGKQTCITKGTPKRLTGHIHAGHDSNRSATTLRGNNRTEKMQPDVNDGT

SEQ ID NO: 965843 - protein, 135 aa, Homo sapiens
SLCKHARKAGLVIPPENIGTVPYIWPVQLGIFACLCSSMRVMHAYPSLSKEGLIAETLTRNAQHSTMAIHHSVQSRQASHTALMHAHTFNTYTGNFPLETQAHRHHLYHWQQLDAICLTSHTPSNQLDRALSDNP

SEQ ID NO: 965844 - protein, 82 aa, Homo sapiens
KGAKTNVVDPFSKKALVMHVHTATCSCSTSSQHTSLAQARSVTQAPKATQHIAICMVSKGRDVCTVQSCCICQHMHAQLPFQ

SEQ ID NO: 965845 - protein, 204 aa, Homo sapiens
MLALADGLPVVGLLSVPAPCGALPRGLVWRGSGDRRLPPPPVTRSLYLDVTPTESRSAALVAVLKADVVPKTAENFRALCTGEKGFGYKRLHPSTGLNPFPFIVANAGDLRPNHKLAQAGNVQSNVKPVSLTRTFHTWKHCWGQGVPAPIGYGWFPKQPKTGSPVAFNLAPYKTRTWLADRAKAIGRCCGSTCTQSALDVVTDT

SEQ ID NO: 965846 - protein, 131 aa, Homo sapiens
MFENPIKHRKPGTPGYGGAASRCANRRATPTKREQRASHHTESNKRQPPVCETRVHNEATYKHHRPQSHTTEPDLALYRNNHTTSRSHPQHKHPRPKTETKTPLPTLVKQRDKITKVEMDDQHDDRPKDTP

SEQ ID NO: 965847 - protein, 88 aa, Homo sapiens
VYTDSPGGLLCTFNSDTHSSTFERLGLAIVLNEHFVKAHFLVMTSEFGYQQQGGGPHGPHGLQGVRPLDHQPQSYEHEVGARETLIAG

SEQ ID NO: 965848 - protein, 267 aa, Homo sapiens
ETRVIGTSETPIIIVGNKRDLQRGRVIPRWNVSRTWYARPGSAVYVDCSANVQTWLHRCVLFSERASSASAAPVAMHVHAALRFQGALRRDRCAFMCRLGAPRVARLADAEGWCRYCADLARAARREMTCDCPRAEGPCSQAASRVDEALSARGRPSEMAQALPLGPAVAPWGTGRLPAAVLGCSVPGAGPAGVCPTTPYGGEGGFERGMERWGLAQLPALCRAPPVVLLPDVGSGLGRGLPFAVFGPTHSVGGAFLVSPTSEPLAV

SEQ ID NO: 965849 - protein, 178 aa, Homo sapiens
MAGPRITYDVQRTLHHRRTKNGDAVRLSVRRTRNALHQQSARSNNSSAAGCPEKDQTLTVCTRHPKKNTDMQARYTHPEEMKSHLLSKPTPWLSEKREYIGGASLVVNQGNPQNAYKDHWNKPTAATLNNSSRLHTRHPRKPTAPAWAIPTTKKTNRAKGTPDNRHPSEDNKGAQYSK

SEQ ID NO: 965850 - protein, 110 aa, Homo sapiens
PGPWSGAMSGCDAREGDCCSRRCGAQDKEHPRYLIPELMQTVLPFGWVTGTGGGISLTHGDEIYIAPSGVHERNEFSLTTCCMWYHMKRTYSGPYAIEEANTKPVYSSFT

SEQ ID NO: 965851 - protein, 252 aa, Homo sapiens
RGEDGGLLRDGCNAMSIAQASGTADGIGSIHNCIIPGVNLITQLASSGRQVHSNFIGCSNTRHSGHYHWLLIRSYPSFIPASAFMHTLVHKHRHAGHRPQHTGKHTNHIQQLGCVQLHATQMAQMHTQIMHSRHRGILLPKLGDPAWVLVWRSNQPGAEVNRGHEAMGDGKKPQLTGAFDMQHRGKRRYFMEQYHLIQWQPNRGVYIAKRDYERMRFLTPTGQRGPITSSGTHISGLTSEPNGIHGKSPGPI

SEQ ID NO: 965852 - protein, 419 aa, Homo sapiens
KVQPLLTSSTKSPEPPGALASHGQGCTWLHGEGKASRRALEPDCKRQKTELERKKGKRERRCNNRETDNKREEPQHTKTRRANHRPRTTNHTEKSKKGNKTENKEQHRKKNKNKPATEQTHAQNNEKEKKKEKQIAEENNHRSKRQATHEKREEATKEPKERREKGEKRKEERTTTEQKKTTKRRKKEDSETNEQKEENNTKRDEEAEEQRNRSEREQQTKGTEKDTEAKRSNENKRPEKPTQKEANTQQRKEEQSTRRNEQESKEKRTQHTGQQQTTKQAQDTQKHPKTVERPRKTKQKPQETHKEQRETHKHKSQNTRQNKRKGEDHQDKTTEGQKSHRATHHKSTETNKEGRQRNTEKDTTEEQNKRRTAGHQNTNKTNESSKREDEGDNKGEETKTQQEKTHTDTATHNHTHQKK

SEQ ID NO: 965853 - protein, 151 aa, Homo sapiens
MFCGNSRACPPKREQHAILSTNEQRRGVTHTRASRAETRASRATLCGRRRKTQLYAWWGGEQHNLRGRHHTPPRRESISYAPPPGGHNTYQHHSHQVDSRRGYQQTAAQRQLATRCDDTTKLPPQRGVYTTIDMKTLFLLTRGTSPSHISG

SEQ ID NO: 965854 - protein, 125 aa, Homo sapiens
SYFISVRLLSYLSAADTRWKIRVDMDMSPTEAPELSYRVCALTGRQSIITYKVDNDENEHQLSLRTVSFRGWLQRHEYAHCLTAAGNAMYAQAVHIKVTLATSTNVLYSTTGLPVGGPYDNNTTQ

SEQ ID NO: 965855 - protein, 497 aa, Homo sapiens
HLRDLRRHPHTRPPPPPHAAYTPAPHLHAPLLCTHAPSLHLHPPAHPPPSAARPPPLSLPRLRPTSLTRPPYLRLSPARTPPPPPLPPTPHARTAPHGPHLLLTPALPLLPHRAASHLHLASHLSPLHTTPSHHSSAPHPSRRTHHPRPPPTFSCPPPSTSALSPLPTAHAPLATPLTHLLYHQHAPLTSTPPPPSVRSPSYALTPPTPFRHAKTFGPSYAQQLNTAHALALHWPPYAHAPYPLRARPLPCLTRPLAYSARAPPIPAARCPDGAATHTPWHDTAHTSPHHSTPLRAYPPLRPSLLLSASNLPLTPRTQYPGFAPQTTEHFKRTASLAYLGICKRRDPTQLLYTPRWALSHVPPTHSYCTPTFPKTGLKLGQPPPELTVLLALLPSPTKLALFLQWLASGKPLTTTKASLAREPPTFRRLPPWLPPTRATEAFEPPWDAGATPAPRLPPHFPRLCYAAPPPAPAPFRPPPPSRAPPPLHPPVPLPPAL

SEQ ID NO: 965856 - protein, 118 aa, Homo sapiens
NLKLSVLSSGGPGGTDDEADAVKDAGCVMPGDKDKEHGCCLERWINMLQDELGDAVERLGVRIDTSLYRPAAGANLLKCRFCSYYNVPMTFRLPQALSNIILLSQQLLCNNLDMGHTP

SEQ ID NO: 965857 - protein, 100 aa, Homo sapiens
LLSSVTMVHGRDAYVSPSGYLLQLVNTEWNLLAERGTVSARKINYGRRGEYVYQMTILTVDKEFRFEVGLKRADQREKITTSLMLQRKDYMYQVPRSTTE

SEQ ID NO: 965858 - protein, 158 aa, Homo sapiens
MSTRKVSLDHPPMMLDAEDHRLEAGATGMKKSPSVNLTLVLEPVHSASGHIVLGRHQGKGPGGTMRSQVRRSCPRDVKGRGSKTPRGREKRSPRRLHGTGLNRKEMGWRAKVEIPWYRTLRFLSRNKIPPLGHGGNPVCCPRKENNQLAFANCENQGK

SEQ ID NO: 965859 - protein, 125 aa, Homo sapiens
MSSDGLGSRDFSKRWRPRRIVTWSSAQVKVEEPRDHQVWQTLCLTGTLSYMAVYSRHQSLEERITEPYRGWAHFLFACTGEIMETFVYFSGTLQEALATRRYAVTDANPVKQGRINPGNTQIRGP

SEQ ID NO: 965860 - protein, 127 aa, Homo sapiens
PCSVTVKALQGRSAVCSVPEDELVSQLKRWLQKLKSSVPEGVVKAGLGWERVSDYSIVAKSKLNLVVKPLEKVLRRRRRGPEAGDSPPREVWQLISKVFVPPLQCRADASRVLEQLPEGLREVPEVA

SEQ ID NO: 965861 - protein, 309 aa, Homo sapiens
YLHPGSARRRLGRPGAILHTSAMAADLRAGERPGYSYATYGLHIVYLADRWAPDPGLERTLTECLLRDVQALTLHYDRYTTSRRLDPIPQLNCVGRHQLVCAFFITPNSPSQMSSTPPGWAWVMHVTVGTCQARHFSIIAITTHFWHNDLWVAAVAQAHAGPLASTSHDTQQVLCGLWQSHIPAFIARNIEPARQPAREFLEPASTRDLCAPIRPDLITPSRRDPSGRDYTVVTTGRCALDMTQSNGYVHRGYSARLDTSSAAVMALGDPAPGIPFHPTDDILKYPSQSSHTRTQKQSPSFSRNAQSTR

SEQ ID NO: 965862 - protein, 193 aa, Homo sapiens
MLHKYLAPGGTRLEMPRMTGYPGGTLTVESGGNIHAEETAEVTRGALEPYDGHEGPTTTNARALKVVPLPEATRKDLSPEFPKKRTTGVYPNLTYKLVHVTVRGPQTNASSDKTKEQSARSRRRTRNHLPEEGVRKFPCHHRGQSHTCALRKSKTRDNPNIAKSKEQPTNDHCEQTGGKRTYSEDDKTSTKNW

SEQ ID NO: 965863 - protein, 400 aa, Homo sapiens
VRAVMAALRQPQVAGAAGLRPWLSLPGMEFVWPDAQSMACVMLPVACVNLICGNTLDYNQWPGAAYVLCELMTVLVGRPRKDGLVSLLTTSEGADEPQRLQFPMHHKHQRSHGDLGLHRWANYVKASDSVLPKLPPSLASVAVVVSDQVPTEERRWTVHGSGSLGKWTRYNLPTDTLQSRARSTNRLARDPGDVTRQDRNTTQHSTRECPDEQFHGPTSILLTGTGHSATRIDQYDVMRSLADTQLGDGKHTEKPPDAMGPDEPSKKRDEVVAHNTHEPPRERSPCDERRPTEEGQVHRAELHSEKPTGKEQGGTRNRPARQTQECANEGMPRGTRAHVGGRNRAREPNSDIRDAARPRKSTNSAPRPKQPPTNKSQPTQTTRHKAPERPRKCKHAQQDQ

SEQ ID NO: 965864 - protein, 247 aa, Homo sapiens
MDLACGAVATVVQPCLALSDPQTVMCPGNANGCSLRSATGCPSSQRSTSCAPLCSSCTQRILCNHTECVLLPCASVHSCHVSDAQVVWPGNFTTTGVGPRTICAISWWITTDVLEHMSNWRSTCNVANWLHAVLERQYQPPKHHRSSPVNAPRHPQEREDQFMRDQTLKPGTPKRDLDRVTALSVNVYNDRRPRSRSLTEDRDKNLTAFARSPYGPCNARIYGIRAKRRQRKAAHTRCCNATLTPSW

SEQ ID NO: 965865 - protein, 529 aa, Homo sapiens
MRIEESVIISVRGPSILDTGMMFVRNDFKDVQTFANLNCHKNFKQEAQSSQMLVWTKAFLETHAGKRRLHVDYLHFDTFEHNRTTHLNPIHNYHSEKLMDIQTYFDCLTDRNARLTRHSQTPTERRPTGLTNCYYTDNHGPLTRKRTLHTTDLRRKHGFHRTYLTHRRGSIVPQQALATSIITDDPQSYGKGQHGANTQDWNTDAKHELPAMFNTVQAMVENMWHELTPFERQQSFVVIRQFRTSNYVISTSVYHRVTPIYGEITSGQTLGGNNFSIQIYHATRSSGSSVLQRCKQRRSLKKGTTSYVTAGTIVPQIPYAFNSTSRTYFSGGMCPTKSGLILHSVIEHIIYSTWELDMGEPLTGLKLRTATRKIPYYCNQLYFDKASNFVAGPDHTQCAMSKPPNHGNDNLATPHARHTSANIETSTPAGPKHNHARTDRTASPPSPHDLSADNDKQRLPNIVTLAKPTHPSRPPDNRHTNTFSTRHTNTDTTKQKNTEQEQDNTSTTPQRIRIRIQTQKYSTNPQPQH

SEQ ID NO: 965866 - protein, 114 aa, Homo sapiens
MDYTPTKSYINTASPRHTKNSPHISANTTIAVHYYDTPGAIKSTVDDLHTHPLLHLRKQIKYEQNNKVYIPTDKPDLAMNQDNTPKRANTIIYTTTIQKHTHPHRQPITTRRTY

SEQ ID NO: 965867 - protein, 414 aa, Homo sapiens
MGAAILPGEREVKAGVSPVGSRPLTQELAGPGPVRGSTSCPTLAHAPYRTLARWTDAIAYHPLVIGAEGRKRGASNQGIGSTGMRADAGRGSTMTITERVPQWSVGQGPSGLQIAEQGPSTPCTGHAEQRRTAGPNELHTARGAPTPYPEAATALSELEPLTLQLDDMAPWHPDSGLHLAGSPFERGTSQSGDPSLVTTTLELTHRGHTTALKAFILTLDSAAPWSHPTRDTSTYLELPVAYPSNLADSQLELETRHNHKGRIDKSHATERIHPNHLTQPPPPRPRLSTQQRLCTIDITHSIQETTLNRPLLRSHSSPIPGTTDTDDSGRSHTASAPSPPTQPPWSRKYYDQHEDDAMIAQPGADVDRASQLKLSQAIPELTHDTIAPPERRHPASARDATTPQEPLQTATCIA

SEQ ID NO: 965868 - protein, 96 aa, Homo sapiens
HSDVIDSQNLSKVQTVNYHSHEFHSHEDMLACRPRKVKEEDKPPCTIIVFSHAIQHSCHPLCSVNLNQAAQTHHTVSLYLYRDYQTQDSTTNCVSQ

SEQ ID NO: 965869 - protein, 75 aa, Homo sapiens
WKGIDDVIVKHGRCIVDTLDSGKYTTTWPSDHINAAWQRTRENQIDRNLETGGCSSMRTEGSFKYAWVLDETRNA

SEQ ID NO: 965870 - protein, 526 aa, Homo sapiens
ARGPWMALGWGTADGFRGGFGSGILGPGVAGLWTWAVGLRPAELRGVQWPEDKEWMPSTPSWAALDQGTMKHHSPLDRQISSSYHPVPYIRQSSSIHCIYFHGRAIISKLLQSYTHSIHCPDCSTASTPEHVPKLHPVLPKCHTSSSIIRESTHEWAQRSENLGVRYKLHPDMERVVHKHRQISLMRGTIQYPGDQRRPSQSVHTRMLAMHGLNHGGGNHKNFRRKMDTQQTNLVHPYWTKRVAPWGTRHRQTATLVSHMEINRHATNNTRWRQPTQGGEPHRSTTTGTLTRVNLWLGRPHTDNGSGPYQLDNDAVEELFQHLETWRKTTHYKEPPGGALRHDYRDQNTHLVSGPHLLTDTTSEGTTHLNGNCDQVIPSKEKAVNTGVKRLKTPPPGPNQWDNRKEPRFFHRNSVLSRINPTGKDLRRETHTVLTKTNPKQHYERVTPEQQTGKHTRRTPEDARRNNNETEGSNYPKTNDNDGDINGYNNKTQQRTGTHPQETNKRTQAENDPKRYRQQGDSSNGR

SEQ ID NO: 965871 - protein, 176 aa, Homo sapiens
SAWTEPGARSPPRADAIARPPITSSPHPRNDPRTTDEAPAPSRHQQRAAIIHESAATLTERRSTISRCDQKLHTKDIREHEHHTDRLKTRSISRHPTVVPDTMSLHTFEQQMMWLQKNFAQITNTITNSHMKRGNMLTTLTDPAEPKRWTNLSFRISRNQTVMTGESGLTCNGLVP

SEQ ID NO: 965872 - protein, 281 aa, Homo sapiens
MWMRLGLVWDLWHAYQGVPQCGPQEPSPLLDRAIVVPLLPRPFLGLWWMNAVLCCKHYANGSYRFVVLCRALLGDYSATHAACSMRKEHIPSSHTIMVSFSKYLDGEMATETLDTIQISSDLLPPVGPGMVECWHSVDIQSLFSQTVLLQLEPSERILTRGNVGQGSDPHRTMTRAQKPSRIISGEAPYDLTYTTVNPPANHTDRLQGTKLMKDRRTKAARLNNHRNPEETHGYGPRGQTLQADALRYNSKHHLGACLDRWEHKRGKPEESRTGDKEARHQ

SEQ ID NO: 965873 - protein, 237 aa, Homo sapiens
MQLHVRRARKAGSSENGASLNNSFNSCSDMTARASKKQGHKTKKESQGTRNRSDTRGKTTHSRQRNKKKKKHKQQQTAKKNETQKRKNKNQKKKTQKKEEKTKQKKKAKTKKKRKKTTARKSKRRKKRGKQTKKEKEHKREGHNRITRQHNKEHKKNRRQRKQEQHKKNKRQPQEQKEKTRKARTQHTKKKDTQKRRRTNKNNKHEHDKQTEIDTQHTTERHKKRTERNKHEQQRKR

SEQ ID NO: 965874 - protein, 93 aa, Homo sapiens
GRSRSCRCRSQSLMHRNHEQRGRDPAADQLANSRYGSDMIRRETQLLGLFRVRGLVKCIRFSSSLAPVPSPLQGESLFTVSRTQGSDRIAIPI

SEQ ID NO: 965875 - protein, 324 aa, Homo sapiens
MDAKTGHAPWRYEVWSQVGRSQCTRPAREKRERPGRRRWGPADRRESVAGEEEREVTAVEMGAGPEKSSQICVGGVFLPSPSEAGSSSGNPQGVWYNSWGSQGSPPGRCYRNRAEDPPLRSEVAGGRRSRPPASVGSDKSAILAAPTRRCPGIRAHGKCGKNEADNPREGRDAAKSKEVGRPNGGSAAPGLFRGWYHVGEATQPKAPIGPNPSETGGHAGVLTFQVFLTAILTTGPSGASARGDVFNRLRPRVGAHNLWLGNLAPQIKIKTVPGGSMFVGSEHVPELLPRNGVNSHTRRARRIPLGGPQHSVGCHMMCARRPQV

SEQ ID NO: 965876 - protein, 322 aa, Homo sapiens
MSRSGNGRGKGKCRGVWFPLSPCPDRPNPRCVCLCLSVAPLSHHHSSQWWPRRKAQEAAQGVENNEPSLPVGACVRTRGRTNVAHETAGGPHVIRAMTRSPISHPMRWPSSGPIVRESASEQQNGEWVQGSYAAEEQASERQQEGHCGWARVGCMAAPLVRGCFTAQRTSRTACQKSSSSNRFMSPANRTGNKETTQHRTSQERTRSDTTQPQRQREGPRKKPATEAETPTREDAKTDSTAGKESRAQSTRREQHEHPGTHHAPVSINRREPAGTHEATEETPEKRNHKKQRSRETSGDHTAEASAQRRKKQDSAVKADNRT

SEQ ID NO: 965877 - protein, 170 aa, Homo sapiens
TPAAPIASPPSTSSPHPRTAPRPPPASSAAQQRAAPLSLVAASDDRGPTSQVRQKYHQDSEAAINRQINLELLRLPKFYLSYVLLLLTRDDVVLKNFCQNIVCFTNLMRRGNIAEKLSEAAEPTRWPNLPSGYQETRCDDWESGLNAMECAITFGTNCVNQSLTGTAIMP

SEQ ID NO: 965878 - protein, 539 aa, Homo sapiens
YQTTLTKAIYPNKVLGDEKLKPGATRYSTARERLTHYTPRHNTSKDYTPTTFCHQCNSTQHNNYVQGAAKAKPPPHNQHAATISNSINTQHHPVILLSHTHQRGTRIHTQRTARLNTHTNQQPYGCIKHGYSTQNAISTRSQYPTLFTIYSTNTDTPLHQDSRTYCYNTLKTICLQAFTNTHENTTPYYTRTHHQTHKHPYASRHARRTTQTKYHTTRPPTVRLKATPIKNQRPKAPTPTTIHNTHNNGTPDQQGNSKEPDTTKPLTRRYTTQTRSTHNNTQRYVHNPGKHHNPTKQPPQHKRGHTKRHYLNPPPLPTNATPTRRQPQTTPPAHHHSTTHNIASPHHAHTPATRQIEEKDNRPRQGQPQHNQQTDAPTNNSEPHSHTTHTKLNHTKTTQHLDEHHQPTGNSPKHHTGTKHTPPPATPTNNDTTPAHTTHPNNNRTTHNNSHSAHTRRQHQTQRETKVQQEHRNHHTEAPRQQKQERTNTQQTHKISTQKIARRRHTTRKIKARKKRQTNTTTAKKRHNKKQKHNDTAHT

SEQ ID NO: 965879 - protein, 587 aa, Homo sapiens
PPIVLPSDGFQSGLGSQLPGQTASTSTCSTIRHLSVWDLLETEPDHRTDPCAGHGQIGAIPDHDVNPEEYDTTVVSIDSGKPVMGPTERLCPPWASPGEPLVTQEDPGGRLGHHVKTLNLLTPFSSGGVAHPPVGAHNEDHTPHLVNTRQTPGEPDREQRLPPRGSWRTHNPRTNRDTYRSTIDTFGLQQTHTHKTKQHKLRGPPWTRPWEGKPPRERGGPRTVPGDGDPPYDSHTHNDRMPPKAGTGHSTRKPGEHVQEQHTIPRGETRAKQIPRRKKRQNNIHAKAPHMQEQREVTPPIPQRHTGEHKDTRKPIHKDNRKEERITLATHDHKQTGDGESTVDTGKARTTQRQERGTWEPPRNTQKEEHDKQQDNPNGNGNTRETPNQKITKETAGETTEQNKNSTENAETTDKRRRDTENNNEDEETENNTVEKENRTRDTSNAHHTEGEQPAYITALDRSTRRRQHGNTGRTVTRAKHHNSSEATRDRRSHTRNEWRHQHAQAHENSDSRKSTPLTQQTEQAESRPDHKDARDTPQQQRSIQRCNVTAARHTDEQTNDQKQTQSRHTQQRQHRQTTRRDRKHEQ

SEQ ID NO: 965880 - protein, 370 aa, Homo sapiens
EGDLREGASAVVAVEATVIQSPLTPFPSHSVPVPNDLLSLDNQGASDLDFQGRISSEDTVNLLLPAPCPYRISEPLNPGAEEGAVCTSAHRHRGTLAGASWLQMSPHGEHCQAAAVHWHREHQRRTGASTCQLLLTADDLREPHAMGVSSIFHETLYQKADDGRPFPHVIESTERCTWASRYDKGRGSTLAGHHMERLPPNRVGCDWLKRMGPKYNDGTRRLTSAHWPIVRLTDSGTHTPLTPSTLIAHMPMYWPPTPRYDHAHCASPPTTRHLTPHPDARPQTETGTQTWATENSQPDGTEHRHVSSTRNRTREPTVRQAETGNHGPRSETQRKPRNEQHRSPASTTHQIPPTDVNPTDGRPPTRRNSR

SEQ ID NO: 965881 - protein, 444 aa, Homo sapiens
LDDTNAARAAERSPRKGSPGQAGNTNARTLFSCHSCFPLRLLPNALRDRPCDAFPWRNISSLRTERYTTHHRPPLRYAPHGSCASPASPPLDYSSPPHCPPPALRAHPAPCPLHAPLPLRARALHATRPAPLSRRLPAPTRTSPPPPAPLPHAHLPPCPTRTPHAALSPPPPPPPTHLLPPYPLALAFARFHLFSAPSQPPLSLSWRWYNWGATAHLANQPLLALSPPCPPPATPPPPTAPTAAHAPRTHARPTTHLRLPPRAPPPAPPPPTPNALPPALPPPTPTPQPTHTHPASPWPLRRTAAPAPHPPPPPRPLCPPTPPRGPPPSSAPSPPQPPYLPWVVQATFPLDLPRCTPNPNLAASALGEALSSDPPSLGGPPPPALAPPPPSSSHPRRHASPPLPPLHAPPPSLATSVPLAPRLRRTASPPWCPPPTPRGFQPLA

SEQ ID NO: 965882 - protein, 213 aa, Homo sapiens
CPPRLLDVGVRHVHPPAASHGTSGHQSCRLGDSWSVKSLVVPVPAGTGLGLVRPWGLRLVFLCLRFAYLLALLVETPRPVHPAKTPQAACGSRHSAPISPMSPAGAGAHPKPAGLRPPLGQALAQPAEWGVVGQSPRSWAPAQAHRSRPTQRPPAQPPVGCCLMPGAGNQLHVGVVCVVFQEMIQMCVWLWDIYCNCQVYTSWTPFHFYTQLW

SEQ ID NO: 965883 - protein, 264 aa, Homo sapiens
SLSSVFSPPVSVRPVHAMLALRWAPAGLGCSPSRLRAVASRAGLREGLRDRLFAPPRGTRYDVPGRGRQREARIGRVVLELKADVVPKTVENFRSPVHGEKGFGFTNGSTFHRVIPSFIVPGRGDFTNHNGTGGKSIYGSRFPDENFTLKQWGQVSLSMANAVLNTNGPSFFICTIKTGLLWMASMLCSVDVKEGMDVVNENRTLCGSTEWEDIPRKTCHHQNCGAVELNLCGPGCWSLVGRLQCSLAHSVPLGLFTKVLKRTW

SEQ ID NO: 965884 - protein, 513 aa, Homo sapiens
TKPFTQIKYSAIESGNLAQSAYQYQHRESMQTHYNHSHQSSAKALTPHTIHASMHIQLSTINVCQGSSPTATAPPANQHAAHHKQPAHNSSHTTSYVSQQSDLGKHIHQRQQCSTTTITRSLACITLALSHHTHSAILQYTTLLTHCARQATPSKHPPFVNILHLSQSPHAGNQTRYVHHVSATHNHVDRSKSHTDMFNDPHQVSAHQTQPSTSTQFRAHSCLPSFLSTTRSLRQHPQRTIHQTDNSPRHSTTFVTPNVIQALISKANYIVTRSLNGHTHVKTTSSHPDITAMRSRQSHTHVEHVDTTEPSHDPAITLTESHKPKQKVPLHTNHLNWVKHPNNRSTAPPEAHTRYTRHSHTGTLATTSVTPRGSTTKHIYSSKESAQGIRTGTRLVHKQTHHVVTQHQRKTPTRVHGITNPGYVKSMTEHSEPNGDTVTTQNNDDTTQNKGDGQNKSNSRHKQTKNKTDETGTESETHDSNKQNGPSLTDATATASSPLEQQARKTQARTKKE

SEQ ID NO: 965885 - protein, 218 aa, Homo sapiens
MEGHCLVRVVRSGALRMYASYPNTSSFHHGCIQQHFPFSSGTAVVVGPSQPAAKGHQHTPVIGHNEPLLALMHATASFRHKTKLPNGPYEAILLDRQSAIRRCTRTMWDPGSGKCPKPFHANHYGHTFATERVVGATSCRCRTHVSAFDTLLTTVTVPAHITQATLYPVVRQYKGTSQTERLLKDMYVEDETKFKTLSRFGQERYRVQYDEEKFNITL

SEQ ID NO: 965886 - protein, 48 aa, Homo sapiens
MPVARRQDPLPGQLHPGFQGPYGLLIGGLPNGPRTASGVVHGASKGSV

SEQ ID NO: 965887 - protein, 209 aa, Homo sapiens
LNVMRLPFMRKLILKNLSLAKSYLFFWDKVERCYFFFECFWLGTTGPRTKGSLEGLGRWLAVFGYNEPCKIDGWAQIGDYCFGLILVWKNNWCLSLKKMLSLNLYTTEAPEEMNDILNHKMREFCIRLRNLVTQWSNRKEKSRTHRTSLMEEIFRVVCICLGNPPETFTWEYRDKDQNYQKIGPITPLEFYREHVKPLFNMEDKICLVN

SEQ ID NO: 965888 - protein, 217 aa, Homo sapiens
MTMTRTNNGPKRASWVSGVPGAQWRPGVRVTNRFELINIDDLEDDPVVNGQQVLAVRSQTLWPQGTKARGQRGNTESKTDGDDTETVPSEHVSCKWQTPEERKNKAEETRKAAREKHRKTGLEDIDRILERIEDSTGLKRPGPDPLISRNARLYVEHRHLNPDTELEQVFRCPGNPWGTQRPRRRQPLCTPSAHWVNTLKSRWPRYSKPGPALRSLD

SEQ ID NO: 965889 - protein, 123 aa, Homo sapiens
IPRVARALLACLLASTLLSLLVFPRGVARCRDQRGLGLSASRLPRYHPGEDAGRVCRFVTHVSDCGTLWPHISTLEAVRGGPSPTSSRSETWPPERGQRVPYYLPEPAAALREQPAGESICYT

SEQ ID NO: 965890 - protein, 76 aa, Homo sapiens
FLKGRASRKPLVLCGDLKVCSMKKDLRNPKGNKKNAGFTAYKSAKVFGELLQAVPLADIFRAPLPNDPMRYTFGLI

SEQ ID NO: 965891 - protein, 132 aa, Homo sapiens
RCDAVDVGGSGERIVVRRVLSRERRGSSWDPPPPDVGSKNAGMGPGRNSAHTQWFRGSERIEAINKSDEEESYPPYYHSSPVVVILERYRYMIGITISNCHLRVIFPKQRERVSNVDSLESNIRKGPLKEDH

SEQ ID NO: 965892 - protein, 205 aa, Homo sapiens
MLPSPEVPVAMILRIDYQHYHLTMPHVPWQYHKVPEIELSARPQHPSEKTERTSCDWSAPSSGMYTTPPIDPAPALDTSRHRLDQVAHLNEGASLARAAQYSDISDRFSAPGPDRELKCPTVTAEPIGDRRDALADQHVSKMGSPARSSPVKQDPTCETRSKHADHSEFRTPTHTDKTGHPTQTDRTQPTVCRGRTRKSNKPAHT

SEQ ID NO: 965893 - protein, 97 aa, Homo sapiens
MDTGGEISPVGTKKVLRYKKRECSHEEVAWSLKKRRGPEWVRQGSCLGKEGISKQQVAQQTEGGFLPEKRLGGENTSLSSRATFTINSCRETNHDYD

SEQ ID NO: 965894 - protein, 248 aa, Homo sapiens
PLFLFYNQKCCYIDKIGCHKYIIYRERGDMNKSKILYSAQKPSRDVLLKRWLHQGYPMRGQSPDAASREEHRTPVPLRGLSPGYWYESGLEVNEVPDALFAVNLGKIVLGFMEVLDGSLQSFCFSWDDRRKLLKPPGHWATEEHGDDLVSRIAPSAKMGSIGHVEKTEGLSGIPRMSWAKAKFSTGVRGKYCNRNSWGGGAKPEELGKRDGTGTKIGSKVWPDSWAWSHSGSPRSDMGPIWGKLCALH

SEQ ID NO: 965895 - protein, 362 aa, Homo sapiens
EECLMTDIVWKQKEWRDMMLSQYPITSQARALKRVQADFIRLAGPPHHCTPSRCLDQGYSAHPEQVRFSVSFSRSDPSREMEPRHVLMPTLVVDPRWAPDQHQSPDQGHVHIHVLVQHQATAEKSLSPGVSRDSSTSYTETKDPSSGQEVATPPVPQLQVCEPKERTSTSSSSVQARRLSQPESAEKHVTQRLQLSGGAQRSVKLKRQEQQWPHSPNSGDQNSHLAESERIHHTVRKKEEVTWPQVTTGLKMMSRSYKSMETHQDDDGEDAKMRQEKSEPNIRDTRANTRTPLDNVHKVPTFETPCDTRTSEKHEATHLRDTHNLERENKDDPQDKADTTTTRRRCNIILFILLFFLLPSMW

SEQ ID NO: 965896 - protein, 85 aa, Homo sapiens
IFAEHGHHSAKLSTDPLPELGAINKDASFDSSANQKDKASLPEIAARIIVFLHASKRIHNHILIASFFNNIRLPEYRMNAINTNT

SEQ ID NO: 965897 - protein, 105 aa, Homo sapiens
MFRLLSWSLGRGFLLGRGAVVPGLLRAPAPGGWQAGPVARGAGAAIPESRRTAGAPGLLPLLASASTWFSRPAAAEEEEQQVAEGGSLPEAGGGTKGLGRDHPSC

SEQ ID NO: 965898 - protein, 232 aa, Homo sapiens
GGVIPATEAKGDAGVPLRYTGAQWCLWVLEKRAPCAMPGPEKGGPGPGEAAPVAHAWALRRVALDLGLLSQEGEGGTQHVAAGGHRAVRVPLLGCRLPYEPHEPLLQAADELMSLVSRTSRRRPLVATKAYLPVVDVGGRGLSVPAGSTVIASTGGWCGGSSRGQTRGLTHCCGAAVPGSPFTPPRELLDTLGTAKGVRNNPSQYLRGWASESEDEDLLEQSWNLQTGTGSR

SEQ ID NO: 965899 - protein, 240 aa, Homo sapiens
SGRPCPPRPRGAPRKAPVGVPGAWEAAEREWRGTGRTLRGTGRASMAAANKGNKPRVLEYRFAAGHDAHGSHSHVHFDEKLHDSVVMVTQESDSSFLGQGLASRRSCTGYEITFSLPPCAQGLSKGLSGEGTLPQALNLQSVLQAVVPGSREGLYGVKVLRYSRAQRKGVLQRGDTWLSLRKGGTGHLLCDVTVQARVMDRQQGTPMLLDGVKCVGAELEYDSEHSDWHGLTEARGPACP

SEQ ID NO: 965900 - protein, 250 aa, Homo sapiens
ASCGRCCCGAAVLRLYAAGAGAGGRAGRKDQFCVLGGPQPEMAAPKARNPSRESLRARTTVQATLDAPMHKEGSPCTRLSASTESVQGSISKHEFQAENERSLWTLSARSLLAQKRGGVIYGSCSPMASDALGKTWVTNLVSDGPSTCHEIGDSLLQTNAGEKATITIQDTGIGMTKEELVSNLGDDLPDSGSKAFLDALRNQAEASRQDHRVEVGIYSGSWRADRVEVYSRLGTPGNLGYPVVPDGLEC

SEQ ID NO: 965901 - protein, 307 aa, Homo sapiens
VWTRVNKFGIKRLPFLQKRPKREQITPPSQCSEHTSETCRCRWSPRGCAPSNEVPVGGGRSSLTRAGAAESPGSSRDPVTRLGNPSSWLDLRPLASVARSFAPGPRDRLAGGGLVPLRVLLGDLHLRAAPCVVFERPALTGRGSPVRQISWGPSVPRRADVAALAAPWNWPPGLPGGYRRPLEGYASAPGCWGASGLLGGRQHPGLPAELGHPAHASCQWCSKGARTFSGSPASESQSVAVFPPSCRPFAPGPVLRPIFFGQRRPGVSGIKAGEPSYALEDFRAGETHARHPGVGVRAGARGPAGGR

SEQ ID NO: 965902 - protein, 443 aa, Homo sapiens
QCPHAPRWMALRTSCASPAHRLSCARDVPPMTPDSWTSPVPASGLKLCCALEAGPGRDCWPGVDNNLRGAGVQRGGVREGGASPCCGSQAARDGDQVEEAAEEASSGPCLAPRSRECAGGSYEPPRWRLPKKLLGRRFGGALRGPGRKVGQGPWRPALSAPPGYVQALGGGDGRKIPSPRGTGGQNYSKEGEEYKAKSWQWIDPPLVTTQGPRDTPFDCDYTQEVLGSIHNRLGNPVGNNKRLGHNHFLYGALVPFLKEKPMHKAAPSKRACVGGTHRPGRRGIPPKGGRVKGKNAKEGPEKGRDLQGRKRLGEKTRGMVNISEPPQRARKKFGAPKQRQRKAVKQDAQKEPPERKSWGSAPNPLFDGNETGGDLETPPDREREGGGRPAAPTKRGRCSSQPTRQEENDHKDGEGETKKPTEEDKKQDTGDSETNEADRSSTQ

SEQ ID NO: 965903 - protein, 513 aa, Homo sapiens
WVPGSASRSPLHWAIAPVPRASASNTNALQLRHRTQLQPPGNHQLPAKHLLCTHYSPPDTLLLRHPQRSTALQRTALFCAPPNLRQRTSAAPAPKLHCATTAHSLPHARTLTRSHANSQAAPNASHCTSDTPSRPREPHGHCNTQRLCGRNCENPSKFQRYDLLRLPRAHAAAHIGLGSLGYGRGTATLIPVAGRPTGRKHLAIRLRKCKMAVCVGSFPQDLRPFLNLPGRNERVSPHILGRQSEAKLQASDTSRHDQNRTSGLHNNAVHTSTLLRTLLNVLPPKSAFLVKHNDSVKTLPNPNALGNLNLVKHLDRVCRKAQCFPTVPRHAQSRLIPPIRLLTPDINLQKNNRPPKSFPAPLIPPDLAWTDFPNTYPPSMIERRPFLDRTTRTTLFHGAPPCRGPHIWPIGPPPNAPNTWRRLTPEGHSSRHTRPHTANNRRPGPPGADTTPAHRTTHTPRTPHTLYITTAPATRAADYVVLATTTTTHRPKCRRTINLATRQTTYRSPLSES

SEQ ID NO: 965904 - protein, 549 aa, Homo sapiens
ENAPSEGLKNATALRTLEGYSLSCFIHNTLFYSCLLLSRHWGASAAHTALTQATDHVNAAKPCPRSAPAPIPISLAQPGPDRPTLTLRTRSPLNHPKRHCHHNPEGPSPPAPTLRTHPPTHAPTRTRHLPKHPSLPRTRTHQHLPLYPLPTQTSTQLGLNRPPNAPRRTQSPPTPERTVSWCVNHCHTEKEDSNPIRNMDGEWGGNNGTKKKTTYKCPKEPRPENQPLTANRAFNPIKLNPTPAQNNPLSLIRPLDNNATHYSHLTTTPPLYKKRPHVLHTGRTLHPNSHSLGKPPLTYHISPLTMADTYIPKLPQTIYPLGTRAQLSAQQPLSSNPTSQQTQRPGPPTIHSGDTHEPVRPFDNPLVRQRRHKQRTTFHPHYGRGDPAAPPQQTGLSPISARQTPHGQHTHTHLSPPTHTSPTRATARALPNPPRDGPPHIGAQRARNRNPNKHYTTRTPHASRASRTHAHTTPKPTSYHHTPALAANTTRGTTTHHTHRHHPHRTGTPYPPPPRAPHRAPQHQPGAHHTHTTPQSTLQHPHPPRAPSP

SEQ ID NO: 965905 - protein, 118 aa, Homo sapiens
RGDWPDLVCSSARAPWSWTDGRLESFKKQSFVLNQGLSTDKFFGYEMAANNQTSGSVMKMTNVELCRRESSLTRERPVCAVHQHESVKRETTLLDESTSKMKDDHRGGVNDDETDRRM

SEQ ID NO: 965906 - protein, 174 aa, Homo sapiens
VHVSENWRASRLSSHAQYSGAQVRVLLRTNPTSNYGHNNLHPMNFSANFLPARSQHYEGDDGFCVFESNAIAYYVSNEELRGSTPEDSSQVVQWVRLADSDIVPQTEPGCEPSLGIMHHNKQATENAKEERDGELLGIAWMLTCRRGHFLVGRRVTMADTHRCLHPDCGSTNRF

SEQ ID NO: 965907 - protein, 408 aa, Homo sapiens
MYINQFFDSQYPIINRAGIMANMHLRYPTNQVGCPQHMDVSAAHTRHIQHIIAHLYTHTHLLTPSVAIVHIRRTDREQQNTDIATDTYTSPIGKGTIDRQTHERHIRTDPYDHSIHPLTHIDTDDLLRTHLGDHSHSHQHTNYIPSTSKPHLEHKTKSTNTATLLDALESRTIHSHTQSLPILTYSHTTGYLKLARANPLKAKRKRGTGTRYNNNKPEHNRSPQTRRKEQDRTHAIDTETQTTPNEQEIQDGTTLGRDTSQHKHPNTGHTDHNKPSPTHRAHHTLHTDNEQTKTHAQSTRGIAADQRHNKQAHNRHNTRSNTLRSKQQHRTQQSKHKGNNEYTTDAEKQQKPQPDHTDSKRTEDNRDRKTSAKRKHQRNHITSGPLQLNTTHEQEIRKQKNTNIQRSS

SEQ ID NO: 965908 - protein, 123 aa, Homo sapiens
AQVRIGGKGTARRKKQGGSSEPDTASMHHNNIFSSPFKAQLGVKPIISGHCKQVNHVSHTPKATVIHIEQTRKDSGIIWQRTHFTITGHAETKQLTEMLPSILNPRLVTDTSDLRLRRLERTL

SEQ ID NO: 965909 - protein, 224 aa, Homo sapiens
MVTLVLEEAHFLPGRGQVCAHPADSCCVLRCIILSYTPGPGSFSLPYPPVPSLVWNKEHQGVPEGTQYVLSLWNKAGPGHWRRVGVSHLHKNSAPLTHRTGKTLTRHMTKRDGHETPANCHLPLWNIAEKSTNLTCELRRSGGASETHLAIQMPTKEGSCARRNKTQQQPHTSLNREGERSKRTSAAPSTESPQAERLTETDEPPKRQGDNTRTQDTQAQAAKN

SEQ ID NO: 965910 - protein, 364 aa, Homo sapiens
MPIHIQEVQCGHLAVPPTGRPPSTCSIQGTMYAYGPTSQVPQDLQTQMHWMPTETTNMMTAPHECQGPTDNTGDLPRTTSDTNTSDIKPRTYQGHSHNIQQHIPRGTHPLDTITGPMHRATHGIPTQLAKHHHRCGQPKRTHPRPGVEPMTYKRAPPHNIQALLRTGVASQSPRGSSTHRARPNHHQPPAKQRSANSRQTGPPQWQSIDRHQGTRELTAPLHTPDEQYGQYQQWSNPQQVMDNRDTKLTATSASKHQRSVSQVTAGTQSNKPDHQSRHEQGPYEDNKTNSETGTDETATKSTSQVTPQLDTNNKQPEQKRKPDTTNNMHKTQEQKQDTNRPSYSRTAEPGSEERHEQKGEKVSK

SEQ ID NO: 965911 - protein, 489 aa, Homo sapiens
MTYGQPINGYVTMGGNAQGTAAYPQLQHRRANIAAFGTHIIARGDPSSQMSASITLPKPGSAGNWVITSMARTQAIIVLNAGRMGPKASHRIGTHSPCGNRNSSQSAQQNRGPSTFGGQAQAQQAICGTPGYAQPRSGHASRIRMTEQSQGNSTKRHKRWRKHATETTQSQKGKEKTGKRNHIPIGAHTRHTRIARDASHRAHYSENTEGHHTIQIGERNHHKAVKDTTNSHSHEHSIETCTQDTRYTTGHTYTPGQGNIDNEVNTPPNTEANCNVHYRRRGTDTSHTYTVGTHGTMAHEAGATAAPSRHRPNELQVTKMLLICGTPIDAHTQENTARNKRATDTSYTARTIHTTRGESTHETTQTSGHDHQWHNTTTTGHRLTPKPRRATRRNTPRSTAPHVSDTHRATKTGGTERYTRTRNPPSTAQERQRRHTGEMNSTKDDIEHTEEQTAHREHDDTDRLRHTRTEQHTTNRTAYRTPRQTNSNS

SEQ ID NO: 965912 - protein, 591 aa, Homo sapiens
QFGRLRLVDHLRLGSLQHQPGSTMVQTIIAHSHTHPSTHSAWHDSNAAPTISSTQHTHTQHNNTTTHTHTTSNKHRKQKVQKETRQREREGDTRARFTDRTHKTHNKNNTNNQTPQNTHTNKNEHHYNTQQTRHPQERRAGERQESKTKERGSDRNKPHTPDTRKQIRKKKKRNGERRKTRSDKNMTTTNKKTREDDRRRTHKTNTKARGQQARATTAQTRLRERVEHRQGECTQHRDNAKGAKATRLHNKSAGSSRNDQQSTHRAQDRSEEAQKQTREQEEKRNTNKTKDHRPDDEQDLQPTQGAENKQTEDNDTQHKNQARQAGGRLTRETTYRQAHDITLQGERKRQSQTARNNTAPRIKNRETREQESQHTGKANTDAQDKKHRRKQERKDNSKITNTENKEDRSINEKSGDSKGRREAEETQEEPGEIQQTETNERERTADLMQAREGRRRQGARASGEAHQGQRKRHKKKEAGKRAGKTRQHSGSESTTSRTQAQTPDTTRTARRRHRNGDPKGENKERVTGAYRDKDEIAREQAEHEERRQTKEEGHTETKQTGSSGRKKQADESNRHEPAEERRESRATERKR

SEQ ID NO: 965913 - protein, 359 aa, Homo sapiens
MSSSVISWGFQQKPESLTEGTAETIVGIQHVMDIENQRHLVFTTRKKYLQGRFPFLFRGSPGSMNPLREWHCPKPASGSTRSKQCRLHTGGAHGTAAVRAVQRQHSMQDAMLAMHSHSSVVVPRLDSHPITPMRGRRLGLIWTRVPVNRHSRVFIYTSNGPTGRIKRRMSRRVGRLAGHATWGLDVTADKKEEDKPPTIPCKALSREKMESGFHRIRANINCSILVAYTRLPLHSPEPEHWVLDNRAVYLHIQYDYSRTHSPSCQGTLQIRQTSTDTQAQRKDGHNREEHTERLPIYRITQTTNKKEITQTTRNPATNHQKRTNKSRQNREDKQEKQTRTTREREQEWHHKVKEQRKQR

SEQ ID NO: 965914 - protein, 401 aa, Homo sapiens
QAEPASLTAYPWLHSLTPPGTLLLPAGGTWPAAPAWLASAAISSCEVTPDGQTHVPGNLRMGQLQGPRDRASDSPHASQAAGSSWHSTPRKTCEHQDHAGSTPAMYNVWDHRRGSSQRDRTKCRRQADARALTCIKFMRSRNSDKVAKTPGHQRTPGLTGAPPHGRHSLPRAQRTSRPHISTHRGQSLLTGNIRDPACTDGTCATVSQRSASAGCEGQTMACTVLAKRCRTSSTSRGMRDEISTAAHHIADPPYGAKMTAWTLESEVAFTSGPEMYKHTANQPGRSIRGQSTKSTEGTSDAAREPVKDNSGNTELLLKGTEMAAGHNGRGPTTRRPDAQQRENRCTGPSNDSPGKRHDDDGARPREHHTRNTTKHHGTTRHDTYIDAPQDDKRQRNPRGTH

SEQ ID NO: 965915 - protein, 116 aa, Homo sapiens
MKTTMRRTAARQRYKVPYRAHHKKGRNYNTKRTQKKEKKRAKATPRHTIPNRKREHSEAHSKPSESQGTTGGREEYTTKGPWTTVDEEPLKRKRTHPTFDGEHNIKTYLSEFIVTH

SEQ ID NO: 965916 - protein, 299 aa, Homo sapiens
MRTSLGLISNDSELTSVAAATPRCRRHGGNAYVTSGDQGLPVWLHQLGPALPSFSNLWISLKHACKPSSPQIMGLDVSGCWLSLLQGGSHRRVFWAFGQWMSPSMVRCVPGVGIYFGTLYSLKQHYFELDSPPNWPWMSESHAWEVGPQHQEQRDMALYHISWTTQRPSQTLANLHQNVSRTHVGNHRNDTACPRGHTNGNGTRTPKRKGHEARRTIRGVDHRSRGSRGACNVVRTTGRRNEVSRDTRSSDAEERAGEEEERTIGGVRRRGHLRDGVAPVLGMRRHSEAGRVAPEKEDE

SEQ ID NO: 965917 - protein, 220 aa, Homo sapiens
TRTGGRVVIRPERVQSGLPFSAKRAGELDVPRAHEDGKRFGAVLEALEKGQPVDLSAMPPDLEDLKPQQASSGSHSTSVIPPAVERVQQLMALTSQTTPVAIQSHRQCWMPAERLNKYRRRDIQAGVVGTSARSGCMSALPSEYQRCYSSTASKDGKSHLADIAWFPPGLPPILAWIPLWVWTEDAVGEDIWRWQKKMASAEDSDRLLTTRTRVAPSKAT

SEQ ID NO: 965918 - protein, 113 aa, Homo sapiens
PLEPLASRRPFPPAAFSRTRALRGDHEEKESYRCPYPELISTLADASTGDDVLPAGTEHNIQYKNSPEKRQEDPYYLSTGIADDHDKKNIVKASTQKVACTWYCNGSIRNMEK

SEQ ID NO: 965919 - protein, 333 aa, Homo sapiens
SPPLRQQSSVCGMWIFYPRGGLLAHNGVCFPMCRVRFFFATLDTCWPPQRILWGFVPQNPVPPISMFSHLLCLSLPLETLEVAVVSHTVTLGHQTTEDGAWEAAEESHRGVRNEKVRKTGRKEQNKQQRKPPKLLGGRITKHRNTTGAQRTKKRQKETKETKRETKENKNKEEETEYSAEQKKIEQRKESGKTNTSKTKNIPHNEKRKKERNTTHRRSPKDKRKREKPKARKNSTKRGQRSGSTTSPKPPTESKGSTNTNKRDKQEKENTQRPGCHTIRRKDDNYTNNQPRTTGRRRQRHKHREARTPPRARPIQKQNREKEKETRPLDKTTG

SEQ ID NO: 965920 - protein, 228 aa, Homo sapiens
ASASDSRLGEVYLGHVVLSTLSSNGMSRTSLRAKPLQAGTSSGHRHNESAQSVHGAGRWMREPEGRTEPLHYTLDASGKIVIHHFPARYRISYDAKTAGETDEQSAYHLVLGTRVVPYVTIESWSPPVCVSPTFMYPSETEHRRGSWNPNIWLGSGNIGYRSQSNEGSDFENPEAKAPARNPEVCGRSELRTEFLACRPPRKKNLRNSLTRVVELRRMKILFSPFVDW

SEQ ID NO: 965921 - protein, 431 aa, Homo sapiens
LEENNSDKNSGPQGSPKNSHNATGGGSREEAPWSPAGTHNEDNHKGSWLKEIFAEAYTEVEPQADDANEVACQLFYPKTECKKSILVHILDDSEAPWSLKKKGGNRNTKTRSQTQSTLMGNHMTRALNTSGFHAANCTTGLKGKALRYTGSKNQRVPSAIQRTPRIERKPRRTYIQEESLQSQDLGGRSKQRYTGGHTGSKVARTHQEEQPRETLPDTWHQKIPALQRQTNPRESTEDKTITMKSVGKETQAKPVASAYNLTRKHPNHFEQERLKEETSNGRAHRTPPTSGRPQGCDHENPRTNQTEHRRAHTTQAPFLNLTGKQTLNRRRPTRRQKPEPSKREPYAGESRDSTKAHTNKKTEHTRTPLHNTQPTLSGTRALEATSENHCHQPAADRGEGDSTETTPTENDGNRAHRKNQRRHPDSERTTY

SEQ ID NO: 965922 - protein, 76 aa, Homo sapiens
HIVRTQYQGALTGVLIWTLVMTSGDLAMLIFNIRISHNCGLNTYGHTNQSITNAIDSRMDGADVTLTKATTTTTDH

SEQ ID NO: 965923 - protein, 103 aa, Homo sapiens
MRPHQSWVQGHSRVRIPKHLQQLRQWHHPNIVWKPRINVPEVAVTRECQASTHKARQRRHRPQPRCTPSNKKSGSLTAGERNSPGPQGGANESRRDEEKSDKT

SEQ ID NO: 965924 - protein, 209 aa, Homo sapiens
YGCDLGPDGRLLRGHDQLAYDGKDYIALNEDLRSWTAADTAVQITQRKWEAAVRQEQLRAYLEGTVRAVAPARYLENGKETLQRAETPKDTVTHHPVSDHEGTLRCWPPWVSYPAEYHTDPGRGEWRWTQTQDTELVETSASREDGTLPEVAQLWCVPSGRRSRRYTVAMCSTRGAAGAPHPEMCEPFFPAQTIPIVGLVAGLVVLGCP

SEQ ID NO: 965925 - protein, 181 aa, Homo sapiens
CRGLSHARPPGHHERRRRSSSGGGEGCAQVRVRQAGWGRPSLCQRGAVPASSGIKGPGGLTLGKLAATRTGGRQGRDERLRWNKPAEGWGTGSGPNGTLEDSDGGSVLDSSGTPGTRTFRASRGPLGKPPGGATIFPFQEGTRVIQKNAFQGEGTGHFVDPETPFAKRERNAHWFEKRANG

SEQ ID NO: 965926 - protein, 245 aa, Homo sapiens
INKQTGQHAVIDSSMPSQVYEGVAEFFTDLLNHIATVLQGQSTASGTPQGTMARAEATASFWPSRRDDRGGAADMQRQPRLLREDDGPGRARGRLRADRGGASGQSLRTRDSGLQSRGWSPKLPGSQLCGLRWAPKGLPSTDTPKGAGDPMRGQRRGDRSNNPGGPKGGSHKGRLAYKHKKVRKVDRGSVPGEQILQGGNCGEGHGMKHEGEEGARMRSTRNPGVAHPDEKKGGPAGRALNGWRP

SEQ ID NO: 965927 - protein, 397 aa, Homo sapiens
MALGLTVASDMVQPTFAIILQPLSDPVSEVTLKTVHERQHGHRRIHGRIQLYQSAILLPRKPKPKGNRTVPNQSELLMLPWLEDIINLEEVNDETEVCRENALNGIISSDSQYKDLTRIPLTRLASGNLLHARRYALNHVISQISMKSPQPDLGAIWPASPECTAAAIKAISTTWTESEPRSGRDANSGTHSPSNQSSPANMLVHLDKQSTINGQRLFTARFAPSSLHKLVEFPRLPLRGTPYRLFAEADYAIQGGFNIVGRNLDSVTSASVHTNKALGMHRPMRPEHTLPDSPGIMAANPHAVVDHSGTILFDSQLFRKYFVTPTCIKSTVSCIVDTHQQGTTDSVKYLPKHNEYGEDDFIKQLRGATRPSRSSTNSNHRLPVPQQHNYNDRNYMK

SEQ ID NO: 965928 - protein, 123 aa, Homo sapiens
QRGGRGPWLALGWGNRGGFRGGFGSGILVAGVAAVDGSGPRRCSSRREAGIGVDARQQFGRLYEDMKYQVPGGDLSLLPAIKESEIIDFFLGASLKEMQVEKIIASCRRKNCAGKRTRYNGNC

SEQ ID NO: 965929 - protein, 293 aa, Homo sapiens
PFLPHLAWPRASVSRPYSRLSLMWGTWRRYRPGDSKPSGARARLGYGPGRRRLVVSAPVPLSEQRTGEAGAGELGSVQSSGRGPCPCAPAGRRHGLRECGRVPAAGGPPGPVCLQYFAEPMMLDCRPEHLCARASPVLGAPVETNVSCPQMPGRTFPQKATCGPTGYLAERDPTGKSKLRQTEQACRGPGGEMGLFGKKETGEPLKAVTAEEDQDAPFGVCVRTGPGEHRATVVLAVRRRPVEGFNGHFRAARAIYQEWRFQRNFGPVGHCEGTLSLPMEGTMCGSTSFPKAI

SEQ ID NO: 965930 - protein, 127 aa, Homo sapiens
GGLPGDQACGCTACCADSEVFCHRNAAPRRRPEPAAASLSYPELPSSGAAAPGDGLKLLQARALPVYSPSPSPAERCWGDFQRPGSPYNCSCSSFTSGQLFSPKGNSPGAHTFSNEGISLMTDLVEE

SEQ ID NO: 965931 - protein, 69 aa, Homo sapiens
ARRGQSALARIFGGVEDGPEAEAAGHTYDRSIVVDGDEASLMVYDIWEQDGGRCVARPTAWACGDAYVD

SEQ ID NO: 965932 - protein, 193 aa, Homo sapiens
LIAELAAACAPCGSNCTRPRDSQRLRGGTTETVDGGRFIVDGQAMPVSEGLVDRYVPPAKMPAVLRAGSASLPGFFGPGAGLVEAPSPGACGQGNGTEGPVALTMERPFRLLCVAGPGTNDGAARVGNLWEPNGRTAPPRGGRHYSLGNLFSNTGGQQNLGKQARKSPPGGQGNSGKANGFSIGLTPNGNPGG

SEQ ID NO: 965933 - protein, 229 aa, Homo sapiens
SFTNRNYDLEYDSVQPYFYCDEEENFVPSSKRAKSELQPPAPSEDIWKKFELLPTPRPMSPSPPAPGFCFARPTSRVTPFSLRGRQLTAVDGRFSDGRTSLELEVTELLGGDLVNQSFICDPVDETFILKSSSLQDCMWRRFSCRRQVRLREAGVLAGLAREDSGSPNPDQDQRSLIELQICYCRDLSAAGSQVRRPSGYFPYPLKTGGRQFLGSKNSGPSSGRIFEPL

SEQ ID NO: 965934 - protein, 271 aa, Homo sapiens
QNTSTAPHAGWASDPRPPGVAQAKASPWERSTVVDPAQRSRLEHTRQRTDSRHEESMILQALQLDCVLPVVPTEETGQTWRGRLCGRPPGHTEDRELPPGLALYCCRCSLGGPTEPPAPESLAVQVLRGVAAVRAKRVPGTETTWLTCRTGTLRKCLEQWVRMKQLRESDGAKVTQLSLCGRKQDVRLCTPQGLEPVAGCSGPGQGQQSQAGPCRMLPEWPLWRVWENRVSGQWRSFSRLADDVTRLMWLWGVAVPNGNLVGPGGPLLRRP

SEQ ID NO: 965935 - protein, 571 aa, Homo sapiens
NYTLVHPLNTLPSHQPELIFRYFALHMSLRIRSLAQPYAHARSLCHPPSPPSLATSPPLTSATLTTSPIITIITYYLATPPHPTHPPYPYSLRHPPYTPHTITHSPPAPTHYPPANTTIHPTHHTPPSTNSTATRTHTPNPQHTLTPPSLNPPTPLSPTTPLTPTPPPPLYIPLSTHTHTFPINLPQTTYTPKTITYLSPHKPLAQYNPNTTHTYQNNLPPPLNTTHHYNTTHNHNTNHTTTNTTNTTPLSPPHHTYAHTHTSHFLPLTAPPYAPAPILCSFRSLTSPNFNQYICRYLSGSSLHPYHPAPSQQPVADTQHAIEVSSILIHPLSDKTPHHAPACSRSTTHRTLAAPRSHAARHLYRSSHLHSNPLQLAATSHSLPTPRPPSSIADDSPVHSSQLKTHHRDQPRRPSATQNNHGRLLTTPSTHAHHTTLMIPATSHTHSPDHPPHIPTTLTPTTIKHNNTTTQHPHHHTTTTTPTLPPPPPPSTHPHTHPPPPRQTHTQHHPTPSPPPAHHYPNHNPTHPTPLTQPPTPVPHPNNHLPPTPTHLLHPDPGRTNHIKPRNDQPT

SEQ ID NO: 965936 - protein, 399 aa, Homo sapiens
AVAGASHHCLLPGCRVVYIAPPELPVPGELLMWTRFFNGLLVKILECGSEDTDMVSVDALTDSAVMQMMLFYELKLAKTLCCVTRRNLLSIGPRPHVRACPAYRILRRTLDYWLHTKNRGRALNTGPSLTPRTTHATSTIYSASRPQLSGHTVPGLPRALSANQPLHTDLLIAGSKPHAARTRLETSYLPHELAPSTQTGEPCHHTHLPTAARLHLPHRLPRKLLLILPGNLPWTTYERPLGGNTHRTSGATWRHTSCEHRVQPLAPNATPPTTLPATSNALLTPATQKATQAVKPPGYRDTRPPARSPLTVPAPSHSAPGGQASPTSSRQGGIQSRRITVRDNRTECKQLLPPRAKRATPLHNTAPPTPAPGAQPRTRHTHNAALGSPRSPIHSHKDY

SEQ ID NO: 965937 - protein, 234 aa, Homo sapiens
YPYILLRDPVGSRLPQPAWGLHAALSRGPRDGTESIMGSYCPAAPSSVLLLLLLLARAEQPCVGRAHLRDCRTTAKHVSSTRQVEHGREVLPGITRSSLEATTTVDCICRGPPGEQHLQRNEASSSDSFTYRADKSQGVYQLSLQLMQFSTFSHKTVYFDFQRGADEPPILPDHGRTGSQSLTQYGRHACVTIHDGSDTVIDSQTALSGCGTAHEPGPERQHLNTQSSLTGSAW

SEQ ID NO: 965938 - protein, 200 aa, Homo sapiens
DGRGGEEGGSVRSGGWCPDSDPRGRFEPPSWSPMAPAASPRPVAAPSLHPWPLPLHAAALMLSPWCSASWPSCVRRGHVRSSLCVLCGQRVTHPLHSTRPTGSPRLACATALWCAGSCHGTGLGWVACPPCPQTEQLWLASFAQLQRNPAGSYSPMVALALIQPVSELLLLRAAIFRQPPIHPPTAHRRAFSVGPTYRST

SEQ ID NO: 965939 - protein, 219 aa, Homo sapiens
PKRDFFLIQVTANRKQKGDPRVGTTMGYPSQKKRGEGWALNPLRVIWAPLWHTRGCGHSLGAGPHLSRGEGGRLGAPSSCRCPSPFFPKKESSGEEGTRGTKTGGQVRNDLLGAWLAQASEGVSKKGTWNKKHPHVWFQRIAWGQPRRKRWNQQPWGGQVATRRGVGNRHRVDLCVNWCAPSEGGEMCVMWRKQVGFGRAQPEPTSGLGQQGWGLHWNQ

SEQ ID NO: 965940 - protein, 176 aa, Homo sapiens
MPSLLTVSLNLEKRCCKDDVNYAARMYTHVKILMPAMRYLQKAFCALVALKTIHLAGPDDALQVFVHENPPAGIAHKGKSPLQDQATKRVLTWYEAARESTSILLPNLTDSCMDQPGAGYNVITDRAPAIQEELDLIQAVGCLGELWGKRSCLCSAMVPDRISLIKAVYCQSRNGI

SEQ ID NO: 965941 - protein, 72 aa, Homo sapiens
QCKSNTFPQGRHYEKQVFSALEAEDVLSIEKTAWQREWPSFTQSDRFCIGLGSVWHQQAGARHQEQEWRNEW

SEQ ID NO: 965942 - protein, 122 aa, Homo sapiens
MVEAWVTPGQGWFLLPPVTLPLPWVGMSWRQSSLWLRCGWEGATGSSAFSSKVVSPSKRAVGGRPGSLWVTSHSRGTLLVPCRIFRLGNWQCPLDGETRVCVSLKVECGEEVFPNTGPEMCV

SEQ ID NO: 965943 - protein, 216 aa, Homo sapiens
QRRSRAPTTTHPPAPSIASYSGSQVRATDRRPSAMRHPPQPCPPGPVSSSSYRRMFGGRGTAEPAELQIRSYVTTSTRTYSLGSALRPKHPCRSLVAPRTPGRPLYATQLLLPCCSAGATRARGGRHPAKALGGPPSLGRPAIEQRQFPEKHPRHPNRQNSASTLARAPVDMKPANRANLTFGAHGLPPSRRPQPRHYRLPGGPSSIRRSLTGPTA

SEQ ID NO: 965944 - protein, 420 aa, Homo sapiens
MDQHNTSDWSKPPNSALTQAHPEPSHCRPNVHAIRTWHSLTQRDEEQLTRRISNIKKAKDPNQQHHSQKLTTLDSHPTRPLHKERKQKSTQPLIQNTHHPPPRHTPKPQHPAATHTPSPPTPHYDQPPTTSTTHPHPQAPHHNTRHPTPTQRTNQNNNPENDHKSEHTTTKQLQTSDTVPNLTTNQPEGAHKHVPSHTPPDHTRHEQPKPDYPNPHAENNRTTTDTIATHAHITATRPASSHNNTPGTNRLTNPRTRNAKDNKQTRPPQHSQHDNNAPNTANQPTPEPHTTNSTQTTRHHSKHNTENTQGLDARTSDHVTLTIKNDDAKATRSIAKGTHGSIRKKLTQQRPATKRELRTPRSNRNTQPRGRDRHQTASRNAKTSTTTAAADDSLRAASPARQTRNPQQQARPHPKRGPTH

SEQ ID NO: 965945 - protein, 321 aa, Homo sapiens
MVAILWRSWSACKPGDVNGAGAWKARLDVERMLEHQNERDVYKTPCSTRCVSGICSDCHWQARFHVTTMELLLPTFGHPFKVPPTSTPHEEAWCLAKEQRVETVLTFKEVPCKTIVDNSKRDQEDQAISKTSLKDVQLCLYNFRDSSLAGIYTWDPICSFAALQAWSGPGLIMAVTCVRVQGGCATELEQPLQKLHTSVATLSDYRNHRATNARKGTQRHKPGEDTKTKPRTRAQPRLRKDGRAQPGQVQHSAHIITDPTRERKSKAQDTQAAAHTAPKRGPPTRPTTPVPTQGGHPTTNRSHDTTKHIQQQGAHTHPQPP

SEQ ID NO: 965946 - protein, 683 aa, Homo sapiens
RGGRRSSHHCSGSRHHSRSLVIRSCQTHLRPPQAPTNAARTRETAGPRADGVQASMTRTCSHPAHQGHEKDHGTKYYHSVDTSFHSGQGTQHPGTDRNTRGYQRIPKISNEEEDTQTVNRKESETHTAGHGQEQHTTGTPDRVTQHMKTHGEQQTATSGDRQMDLGEQEQSENDNTDTDTRESNRRPHEQKGTTTKKVAQRTHSEQHRLHRAKREPAHEHHHDLDHDRAKETTKHNKRCGHIMSGTNLLTTTRERRHTTEKRGKHHPTKWRTQEQTQRHTYTTHHASDTRAHTKREERNNDGEDNKTYTASMTHTTGDENIDQETKEHGKESEYTRDRTTLVEINATTGKETHEEHSSSTIDTNINSRTSKETTQMQTQNHKKKNNSHIRQETANRTSELVTEADEGSEEKQQTTEQKKKRRTPERGITDERQQYEIDEAQQTTRTAKDKQHTSIESKEVADSRTPAISETSRTIKNTSHHDAEQDAGMHEPRDELTETQTSDTQRPEAESTREALIMDSRHTQRQQHDAEATHRTLIDEANLQRTGESAPEDERNGRTTDQQRISHMTHMATADSPLTQRSGATDEERDATRAEQSARRRAAHERGKAQDRSGETNDTRATKQQRETDRLRNRARETGHAPPAAKRDSERESTRRLRAEHTRRAKATLSKHRDRQTQQNQRK

SEQ ID NO: 965947 - protein, 363 aa, Homo sapiens
MHIFHATAVQNTRHTHLTHGLESLNEQKLHDYQILMHVASQEQHLNQVQENRPDRGPVHTTRLVTAQTYNSRLHSIVALSHLGNFYPNNDGSTSAYRLNSPLHQPLTIFLKRTLTTLYLGTSTLIDIPRGQKPPNGTSPVKCPSSQGGPRTAFFYPIHRLYIYPASTTIIHTRPPTNNDLQIQHTPWGTNHTTNKEEHPHNHPIHSAARRTTTEPHNTRAANNTTARYGALRTHTNTNPWYTYAHTPRHKPYRAAQDKPILYQPTADITTYMPDQLHGTIPPSSEHTPTLTTNKADLLTTTPQETRLTNTSPPRRAAPPATTEYYDSQASNSSATAVSHQHAGQRPTMHTQPRGALTQTAPDD

SEQ ID NO: 965948 - protein, 118 aa, Homo sapiens
MKHSCCGAKRVLPGLASCRVRIWAPETRRGEPWEPAQQGAHPEPGAELPRDQCTGEAILQAPFAHTFPYSKLADLAANLSLRAPLGNCVVRHRHARLGASRWPVKQPATFQHSGCFDR

SEQ ID NO: 965949 - protein, 164 aa, Homo sapiens
APGGSDAARGGPPAAGLPGCPGLAQDAEGAVEPGGTKEKHEDGVKVETCWSTRCPYFAPAYRAPSRRSAFFYEGRPVRLSVAAEEVASINGRMDHEYTTKEVYRKNFFNDWRKEMAVEEEGSHQEPGQVWFTEIHRYFVDKAWSRKVLSREEKQKLKEEAEKIQ

SEQ ID NO: 965950 - protein, 231 aa, Homo sapiens
ERRGPDARAWREPDLECEQIRLQCIRKEGFFTCASGTQDRARDTQTDETCRTDTTVRDGPRRTDGIPIQQLAGEILLLLRLRSSEHSVELKEGVGHWSISWDGTVSGLATSEICTPSGGSGSACAAGVRAQYLTGLIIHGPEVQLAHDDKGGEDGIGWPARVQYSMTQVVISVRALTAEGTQQHHIDLAVAVWPTVGQALPDSDHNVTPLWEPWNCGSSACADAERTPAIS

SEQ ID NO: 965951 - protein, 186 aa, Homo sapiens
MRAAALFIFFGLISAHLSTYIHTVTHKTTVYGYLQKQKKNKKTKTKHNTQNKQTTKTKNTHQTHKPTKTTAQGPGTTNTHPRGADNTDTDTHHHEESNQAAATTQKRTQNKQRTEKQRRHAHKPRAHDHSGGRHTPQPDRGISTAKNKTKTETQSRAQEEKTRETDNKNKHKQHRTTTTKHKLQTN

SEQ ID NO: 965952 - protein, 57 aa, Homo sapiens
MAGYSSDSKHETGGASKQGRWNLVKGNYPSQVRVAMNLAASGYMVNCVQNEGTTGRD

SEQ ID NO: 965953 - protein, 296 aa, Homo sapiens
MAGGRCLSVAQPVVWTWGLPRMGPEGECSGASAEGARDAEALLRLSEGEAVWSAGGLTPGPDDLNWGAFDPEVHLDKLRRECPLAQSDGQCDWTWCGRNPGSRQRMQTLVYENYNKFISATDTIRQMKHDFRTPGGWDVTGLANKCSDHRLRLALHQRHAAGPHERITKLAGVHCAAAEAASPLGAALEPHKCVHLCAYGQAVRIPGSRAQGTWCKYDQTAAIVPEPIQGGVPGSYKRPRGQKLGEQLKDGRTQAPGRRKVRESSRRPWGAWSSCQTTGTQGRWEELELGGAHPDQ

SEQ ID NO: 965954 - protein, 168 aa, Homo sapiens
CLMMKTRTHPNIETLPVSSAGGIMARVERMETVLRRRRRNWYQGGVPRVHRRKGAECQRKLEWSCEVAEWRQRHELEAPACRVHWLAASRSERELGTQRACQENAQARMTDACPWNVDTLSKRTGSSGPEEANGVKSSRKPDEGTGSEESSAGSGGEQKQKTFVEELP

SEQ ID NO: 965955 - protein, 117 aa, Homo sapiens
MQQHLWAWSSSHVVWPGGAEVSESAPGEPIASTQFPEGEVWGSGCLLSRGVSPRQTSPGQVLCDAGRTSQTGGVQSGRVWTTSRRPRPSGRVWRPARPGGKQMDTKKRAHSLTTRQT

SEQ ID NO: 965956 - protein, 360 aa, Homo sapiens
SLYEQQDAGLCTAGWVLCSTVFKHIKASLFTAASPKMQHFSTARTQQGHTHCIHSCSGTTLGENQSIKTSHITHHHPHTSPGMHQIRLCTNTSSIIHFVQHMRIIATSSAEWASCISLAPASCHHAHCHNIMVVAQSLDRSTNISCMHSHHLVTVASPSVAAARLYLQSELRANGAQHAIFMAKSPTDEGKASPHGIAEQINRNRLGTHAHLAIGITRPRIATYTTLGLHKGGMRQALMAHRHTLTANFRAHTTAERFTGRWPPLNKGGRLGRELWTWLLVPSYHHTNRMTPADSVLHPPWGLHWQILRQHAKRVHYFVTWAHGTRINSIGGKGKGSNIGERQQNWVWDTTYNTSWAPWE

SEQ ID NO: 965957 - protein, 389 aa, Homo sapiens
WEHENIHPAVRDSVNWELSHLTSLSLMANSYEHSIHARVYPQHNSSGSQHCSKSKSSEGPCMHSPSTHHCDVDSVSAQTAPSVSIELQPSITGWPSMYHRLSEESRLVMHTTFRQTNTGCWPDLHYQQGRQSCISCCNSMLPATLLQSTASSSSQHIMLQFQHAPVQHISQCRQQLPTHSSGALRYTWLSNLQQALPALSRRELIDQNYGPRLTKWDGRCSLLTASPRSHTRRSHVTDKLPSGYTPAVSRWCIIIYLPIHLHLATSYQLTNDETTALRSDDCDNNKRNQTKDNNKHTRDEADSMEQSNRAPDWRRPNGDYRPPWLGPDKPSESAQNTTRRAGVHQARSNTACKTTRGGKDREEERPTPRPTLTQGEEDHKEDNTRDTGT

SEQ ID NO: 965958 - protein, 113 aa, Homo sapiens
MQSSPYKEAAVRESRFLQRSGGASSHRIECGVCDNGGCGRKSIVAAAERKSYATVATVSRRGVSGENQCKSYEIEMPINSGECTSTNNRSEDMGLFTDRHCDLYTDSSPEYGT

SEQ ID NO: 965959 - protein, 82 aa, Homo sapiens
MNTPKRQGERTTTQRKSEEDNETRRTRGNQKTRSQKPRDTTQRNTKQKTTPDDETERQKNEPEVTTQEEPASQTNNKSRPSS

SEQ ID NO: 965960 - protein, 367 aa, Homo sapiens
MSFLGKLGGTLARKRMGARGEVTCRKKARYAITFTDVPRPVADVHPEDTQLEENEERTMIAPTFHRKPQVQGTGQGPPRLELMTCWWQAEDHCEAAGGKTCMHGQGACSKLLEKLAVVQAECGLEVTQIRNRAGNTKLQTVLEAVHDLLRPEAGRSGGAVDSNSREDTCCTSSTCMDISGHAPTGPPTDYPEHVTVHRWRASARHRARPAAIPATHLAKSGTNTYSKTDGLGRNRPNAYSRTAYLRQAPKKHNQETNCNLDVQKGRHRKTSNACCNGDTGQQHADGHHTAHPHPTSPPSDTTSQHDRGGQTQRPPAPVKQRQKLGNSHDETQTTQPATAPRTRRGPTRAATHRAQTARDTKKDDATT

SEQ ID NO: 965961 - protein, 175 aa, Homo sapiens
MGKSRVGGVKRDKHVAYQYRHVHMTNRRIEMILWTQYYRDIQRVIRTHRNRDKISAAQDSLSTVARNSMPHTCAPRHTPPRHASNTDNAHAPPTTQCATQTAEEKARQNRTPKRQQRYKEQETNNKQKQRPKASGQATRQAQQYEKAQQREKEKHTQQEADNKTTPPTVYQLPTQ

SEQ ID NO: 965962 - protein, 72 aa, Homo sapiens
KVSIEGSPSKVGRGTPREESRCRSLLPRRRWEEPRVPHALAKGGCACGGSRGACAQEVTVPRRSKPGHPLAF

SEQ ID NO: 965963 - protein, 107 aa, Homo sapiens
MLLAKSMKRESTWKFITSLLPTMKSTTCIWYQAGRQMRREEEEEEEKALELPRGDKHHTTSKQQYNNTFSQESIQTFDSYTHITSKYKRSLSGSYWSKLISISFYLR

SEQ ID NO: 965964 - protein, 221 aa, Homo sapiens
MQSVSHSRDLWRLSRFLDSLILKHTYYKLSLSGSIYSREKIIQKKKNKRHKQHPNKKTKQHQQQPNKGAGRGRAHEKNHHPRGGRPQRLAHPPATFVTPRGGPIRGKRVETKTHERGPSGAQDNNTAPLARREDNRQHVRTLLWREPPPTPAAGGATTHAGHTTPSTEKIYAQTGDKQTPTRAHSAAATPTRRNKSSHAEQHGNQKSTQTTIQTAHQKQHR

SEQ ID NO: 965965 - protein, 195 aa, Homo sapiens
TTWFPIWMMKKEKEKKMMHACMQAGMAACKHAGKPESSSLGQAGPAAQHACRHARMSHHPQHSQHSTARRHALSTANNTGKQFTHVKTHNTQQCRLLNLYQHSPTFPGPPDNRHTRGSPLRVHHERPGPGHATRLCDRLRTTHRAASMNQRDARPPQHKATDPPRSQCSHPLRQTPGRAGHHHGTPTQLSPKGHR

SEQ ID NO: 965966 - protein, 331 aa, Homo sapiens
LGKLRLECADLLETREEWCSVHPTLFSFLWVVSISHVFLPKEAKSTEQLAIWPKQPIYLLPYPVHIPSPVPLSPTQGPVSPTTDALRFTTIGHMQNQAGWFQIRNSTTCQSCQAVVIIAAPTIEHNRQACAKIALTIMLPGLSAFIGSTHPPLAGNCHSAGTEQELEYCTCSPWTSSTDTSEACSIRHIHPTRPYRGHQCTPHCKPNYTRDSHDPITLNETPDTALDSLHTRRYSQKPTTRTSQIWHEQEALTFETPLALASAGKGLTAKTSKRDRTMDYPRSPIKHKNYHQLLHTSSKQHNAFYHCHEIQTKTYYHTTKKTQYTNNKVFT

SEQ ID NO: 965967 - protein, 340 aa, Homo sapiens
MADDAVCSGGGPWGPVWPWCWGTAVCFRGGFGTWQSGGRGRGRGPGPGPSAAELAGVQGRRITELECPVTQSWAALGSRDFDGSSSRGGRSSRLLPCPFKGTQEESLCFPSVGAIFSGHEVFEDLCQCRSRPVPASRTRFKGIGGYRGTTIGHVGLGCYGAPRRVATAIREGQSSLAKLLPSSPCARGYWREQDRQAPTVPLQTVTGRCGRCAGTPSIPCSQGALASSPTPVPKKAAHDRLVIQMTATPSARGLHLPPLGNFGKAPLNANSKTYSYRVSRGTLGTEHWYFTKVSQYRELHWTTLWVKNTTPRKICWRGEPRAPQWGLTTTGVIFSNNTVP

SEQ ID NO: 965968 - protein, 188 aa, Homo sapiens
MPVMPTPLRKHGDPYTPWLPCTRQAGGQAQADGSGSCHSFPTLLRFEHCVCLLLWCSVACARETCDPFLTSKQAEVALRRPTGYCRLDSCRLSRRRFTMLCQNLRVTLVDCSRYTFAQGGSLKETYRRELWPERLNTHRRRHLRTLGNQHLSEAPEAPIGQQAPSGTPGIGVLAFKPDYCFIPPSEPH

SEQ ID NO: 965969 - protein, 94 aa, Homo sapiens
CAETPGSGGRRLGGREKPLWPALRKACEGGWCPLPSSVSDAQCRRQPEAVKDVSRGQLMDAVREDYAKRDDMRNIFNDTITKKNQIEFWSGLET

SEQ ID NO: 965970 - protein, 97 aa, Homo sapiens
RFVVRPLLQVVQAWDLDARRLGPGAEAGTPVKVVFTFRIGVGTRKRAPGKQPRTGPPILKGPKCPGSNEEKTTRSRKSDIPALPKQLGKSSGAFRSR

SEQ ID NO: 965971 - protein, 232 aa, Homo sapiens
MRPRPPSQVRQKVPPGLRGRHQGRQINLGASTPPTFTCPCLTYFDREMNVPLKDLAKLVSSPNLMRRGNHAEQSDERCRNQGGLPAIFLPGLIQTKPSNCDDPGRSGLEMPHGRVPYILATPHCDFSHYCNLHNAGPLDKKMTPIVCDFIVETTFSLTLSSVEMAINRHLAVTMVDPICRQRWEPPKSGLGGKYPLLTQHTLGEPVINDTLKARANFPNKRGGDLPGSPKAA

SEQ ID NO: 965972 - protein, 289 aa, Homo sapiens
SLPSAAQLFTPEIMAAEDVVADMAPTQAIWRAAGCCSEIFTSPLNLLLLASDIFAASTSIVRGEPDRRHSGDRRRPTSRPHLTPPQASATSTPARAAGRFDRRPRTRAYSWPIKRQGWSMCPKRAGTNSYEAHERPSNGGSSGPRSHHAIPGLPLPHIVGPWNSREATLERRLADTDMTPSPGTLQLACPHAETQTLLRLALGKLLRAHTCHTAATRSHRVWRATTPWPCQRTRGHNGMHPRMYAYPHTYLTRERKPPSRDLETQWAHRANTTSWLNTGHIPPSPRLYS

SEQ ID NO: 965973 - protein, 227 aa, Homo sapiens
PAWQSLTHRRDAQGTRHGRPGSPTTSLRSSKLLWMIIRKLFIVGADNVGSKQMQQIRMSLSREGVWCCMGKNTMMRKAIRGPPGKQAQLCEKLLPHIRGTCGLAVHQGRTSLQHQGTCRWPIRCQLLPVPGAIGPCEVTVPAQNTGLGPEKTSFFQALGIEHVKSPGATIENSYVMCKLLSDWQTQWEPAKAKHAEHAQTSSPFSFGAGSSSHVIDNGQTSNNPESA

SEQ ID NO: 965974 - protein, 341 aa, Homo sapiens
MPPYDEQTQCLHRMLPSEALQQVRGGLERSLKDMEESIRKPGSRRFLYGLWTLTGKFCLPVQPVLRSSAATNTSSRLCPFRAMSRRKRQTRWALPHSLGTWGLMDWPRPGQVQCHERMSKGTGLLAVAPTCSNTVLPPCAGKRDHWLTSEQREPSTLASYLMGADDGSASLPGSQPALESNQPEDDQWRSSSLEWAPKSCPERQIERPRIGQIPQTKDEAESPFGKSAPQCAILINPRYTKFTINNETETYEAEKYTPPLGAHDYRRSTEIQHHGNCQETSYTYREDTHTRASYKRPQEHAVSRACSTTSMLQHIMKQRVVYIRSCRVATTNLTLVAHASV

SEQ ID NO: 965975 - protein, 154 aa, Homo sapiens
MIEGGYGCNSGVANLQTDTGNMADTLQEGECRVSSGDITHFRVVDAAMVEHLRDDQPKGERGRCRACSAAWLRGLPLGLQSVISGTSLRISRGPRGDSGVIPKAVEKGRSSSGPRPSCPGAWHSDFHMGQGEPARAAAWHPYGQQMSRISGGPW

SEQ ID NO: 965976 - protein, 125 aa, Homo sapiens
MDHGSCRLGIRSDRDLSTGLEASPLRKRLCRSELSLVKFDYDDIVRTVLQSIIVSVEDVNRFSRGETFQRETGGLKWCEIKGLLYEVKGLLCNYSIKEGCQIRSTSVGETTYVMKWTVFFVQDLE

SEQ ID NO: 965977 - protein, 159 aa, Homo sapiens
MATPRSFRVHAEPPDAAFKGRTEVEPGTETTGKREAANHQHCQQTSSSCALVFENDLKVLIPPRETMDLAPRHNTWCAQESKAHIKKLDKKRGKRNKPSTKLENWEREQRFLKWRLEQLQGPQEMERIRMDSIGSTISFQKFRIPGISRSEEGALQVDV

SEQ ID NO: 965978 - protein, 112 aa, Homo sapiens
DGIGVMLPQVLKGMTSESDSIGLTPGEKSELALSALGGCVFYLKKWLYFGITELLSMANFEEYIPLDSDTVSTTRSGAIFTKAYQRMVLDAVTILKKNQKLGDFSEWNKWFY

SEQ ID NO: 965979 - protein, 305 aa, Homo sapiens
ERTPESPEQPTAALASYHHTPGGRRSCRAGPVTITVTMSSEAETQVPARGAAPRRYRERQRRGRIRKSRRTDALQMHPSSSGWSPRLYVTLAGSLACRRGNPKGRGATEKPVEHAYNGHTCTRHGALLPHCNPVRVGRPNSETRGIWVPNPMYGCRLAGTNLSPHGASVPLSDTYRRGYFGTTTRGGVVGTPARKKEGRNQGVCRTVGKTIAHQRRRAQECPPPDTGRISKHVSQQEPVKPSILDRLSSQRPSKAGSVRNDPNDTGTGFSPEHTSTRCGAQRHGRGTGRTGSRKAPGVTKNAPAR

SEQ ID NO: 965980 - protein, 116 aa, Homo sapiens
CVNASAVRRCRYLLPGCQLQEMLVSRRKTERRSVESPSVSSRHRGVCSQVPPPPFKRYLIIKKGRAKDSQCYKVDLRVSEHRYPEFSSESKRETEYGPCRREIGRHIESPEVPSMC

SEQ ID NO: 965981 - protein, 297 aa, Homo sapiens
MATFRKPRTLMSAARTAWGSTGHSQKPTSPMATPGTLAARSTHGTQVPGRDRAKSPKANGTGGQLRKSRNRHARRALKYHNVNAATLAHAAQWKFAKLEHTESREPSYATRPSTWFDKLQHHLGLYSSRNHNTRGTNHLVSHPPKAHSLPPDSLPRTHVRCETPCHECTHIVPQRIRNTHKVNGVWHCLRLPPHPRQHPRGTKAPTQQRTKHEEQGRPSTKGEHRQPPRHSPLRANQPLPKQRRLQATRSQPLKPTRPTTPPGDRVTTRAPAHMWGEPHRSTSDKPYRENPRHPQQP

SEQ ID NO: 965982 - protein, 46 aa, Homo sapiens
MRQEAQAKADKIKLALEKQKEAPVKTHVSYVVSRKYIILRFLQLGV

SEQ ID NO: 965983 - protein, 255 aa, Homo sapiens
TPVQRGGPGALVARGMGNRGGFRGGFRQVAFRGLVVAAVDGAGAEAAELAGRQGRGYGVYARLASWAALVTGIIEDQVPGGDLSSSRLAQLEEIERLIVIFLPGGASLKDEVWKIMPVQKQTRAGQRTRFKACVANRGLQWATSGLGVKCSKECWPPASVGAIILAKLSHRPRAQRLLGEPRSAKPQSGSLARVTGPLRDLCLVRLIPVPRGTWNSSSHLVAKKLFNDGWYRMSVHSAGAEWPTWEFAKGHFDAF

SEQ ID NO: 965984 - protein, 87 aa, Homo sapiens
WATTLYNPYKSLTTTLITDYYDTYERPSTWGQVPARSTALAYFQLRISHDLDGQTHYYHPALPRYVHEDVHDTTCSMRGVSENVSGP

SEQ ID NO: 965985 - protein, 54 aa, Homo sapiens
DWMSYTKGLCGHRVSRESLCTRPRRTLREWCHTLPVCGQAAELLAVCVRAIYVW

SEQ ID NO: 965986 - protein, 119 aa, Homo sapiens
RSEAVLAGHSVAWEPSAAHLRMGYCPQSDAIFELLTGAEHLELIGRCAVSLEAQVAQTVVRAWASGTLMVRRPVLQAPTAEGTNCKLRAALVLFVGPSRGVPGASRPQAWTPARGASFG

SEQ ID NO: 965987 - protein, 125 aa, Homo sapiens
MNCTRLCGHNEGKEHECVGSRVEDFQRAKKLLCRSSRVSVCETFPSCETWQALVQKGELLGGKAHYSQFGTISVTVRQGVGRLGAHQRQAISVVRAPGLGKGAKTLSLRGHWSPSDIERAGLVSA

SEQ ID NO: 965988 - protein, 85 aa, Homo sapiens
DSTRIPPEKLRRPTAQSPYTPVHVGLFLPICKKHFTSASNLSHQKSLSTCSNIFFPPANRHDHLGMLPAKTSLRHAVVPSAFLST

SEQ ID NO: 965989 - protein, 38 aa, Homo sapiens
RIPPREADHYEVPNNDDHMIPTRVLITTRPLTTIRVQD

SEQ ID NO: 965990 - protein, 362 aa, Homo sapiens
MMWSREVDKFVGEKGLTGSLHCEKGNCIEKSSTNARQNSGDMAQTAGAARIPRAQNPEKEHTFPFRGSLSGAGTVGASQGRPREVTLAQGHYGAAQSVSGTAGTTCRCALQFGNAQELTSSKGGIPLCFKNPVALKKPLGPGQPGCRGIPKLKGPRKSLSQRGKYTSLQKSPIIISGDLVFGPFATPGGAIGGHKLCGSPSFSGNAFVHAGTRTPMAPCAPASGTKTPFPGWRYHNFLHTGGQFEHAIGPHQGTGEVYINRAGTPFPPIFYNGTTKGALIGNGRGPNHLWSQQQFEGCGNCPLFFAHGGLLLFRHRQTRPHPQQHKGGQGAGTSKKKYNSPWEGGATPRGIKSAGITPEFCG

SEQ ID NO: 965991 - protein, 140 aa, Homo sapiens
FLLVVSQDPPREADPCSPLMAPCVGPCLWPAWDTLTITGTHWTDTSMTPDCTPACASQERPRDSGSDLGVVHWPNTRAGRHTVIARTLNGTLCSAAVATYPSRITPFLRVSPGLCSETPSADTMGTLPFAYDSIPHAFSG

SEQ ID NO: 965992 - protein, 260 aa, Homo sapiens
MRSTLACGRAWARLGAFCWALLPWVGDEQPGPPRCCFGEGTGPGARAQRARSIGARPAIRLWPELHTSGHWGNSRCPDKHSSARLRPRHNCPLRSWVPGQDSDSWVGLELRIRNANGAPDVRINTGVKLDGHWCSPWPGLRAPWVVMAQLPLAAYRRGPNSTCSNQSLNGWAPCRKFGMAFIAPYMQSPKGEDQRETKTGGGNGDAACYRDDRRQPGAPSGMSCELPWAKVREKPAGQTQRSAPRIQGDTTRKRNREWPV

SEQ ID NO: 965993 - protein, 74 aa, Homo sapiens
LEDPAREAELPRWSLPECQRHRISEMLGDPQGRMTGPMKEINPYSLTAHSVVVSETYAWPPTYESECLCSLRTL

SEQ ID NO: 965994 - protein, 319 aa, Homo sapiens
ACVFCRSRYRRVTSAICAPGDRRTCCECERIAEYGNLRSGAPDWCRRRRYRSWNGKTEARVFEAIRSSHIVRHNCDGRELWIDVISGFEDRARIYVSVGLIIYGSGIGLQREQGDCDMGFGSEMKGVWQKMVASHRLGGLQASRRRHTGSMYSQGERVPRNHACKHGGSLPWALTIPCRSMSVRDGMSRICSKDHLVIVNPAWSMRGRTDASMQEEWWSESVSGMPNRFSREKGLEAQGGWLVEPSETCPGSSLEPKKKRRSVRTRLLRALRTVVGAIGESEAPPRLRPPKKPRGFPRAIRGGWALYPAGLENPGDHLD

SEQ ID NO: 965995 - protein, 72 aa, Homo sapiens
MCIALVLHVPVVLPEPFGSHTHHLVHRSISSSWSRFRDFNVVFYRQEIGHKLVPYLIHHATNHGLRRHLQCS

SEQ ID NO: 965996 - protein, 291 aa, Homo sapiens
TRLTALDSLGSTRGSLDKPDSFMEETNSQDQRAPSGVQKPVPSGAAPGCPNTGLVFKNPLGQHPTSMQAGPAQCLSTPRSGPRAGDYTYREGLEHKCKRDILLGGSGASEDQTWKRIRPRPNKSSFVGLLRTCAKDSDLTSRTCKYGGYNCTFRLPFRREIDVWTEERKGTLKRELSSTRWGVPSAGGLNHRPKLLEGTTRASSTFHLGRIWVVTSKPRDHHGTGPQDSPSVCPNLVCKQQFLQQQVPGDIVRSTSLRYPDRQSGALHVEWRLRWAGAAEKCHCKFRTGWC

SEQ ID NO: 965997 - protein, 88 aa, Homo sapiens
ADPVSPMAPARPLPWPAWETHNYDRNTRGLIQNEARHTHACASLMSDPQEQLGLDRWCLQLARNIRAVSHTVNAQDTIRRRSYCRPGP

SEQ ID NO: 965998 - protein, 68 aa, Homo sapiens
AFSKLSLSVTEYTMTYASPMAMQWPGSQLAPILANTDTHKYTQESSCPSYKAVTPCSPYPNPALALSL

SEQ ID NO: 965999 - protein, 217 aa, Homo sapiens
PASTVLGRNPDARSPPRTDDHSQPSVTSSPHHSDCTQGHHNDASSAEQTTDGRTTSSSLDRRHDDRGPPSERCAKKVTHQRPQECRTIQPATIQTLELLTHSYGYTFVTMVIYLHFLDPAEIDRWSIQDEATLLAPKVTYIIQTHIRSIEGDRWRDTFGLARKTHGIETDIDKTNHKPDVLPPANTVSPLCPAAIITKGKQHARHNWIDIRNVGRKQ

SEQ ID NO: 966000 - protein, 70 aa, Homo sapiens
AVCSCWWALCGTLCGPEDGGTCGGFQREGYLEQWTSCEAGGRRPVELVCLGPRGAARRLGVERKDQRITE

SEQ ID NO: 966001 - protein, 78 aa, Homo sapiens
AARYTEKEIYKDRDSQITANEKTFEDAQKSISQHYSKPRVTPVEGSCLIIPRNKRCEIKSMMLRDESMTQNPEPQETR

SEQ ID NO: 966002 - protein, 71 aa, Homo sapiens
MTCAHTMAPCEAPTHGLPGETRTYDRNTLDMIQNEANTPMPDDLPSSDPMDRWGRTEGVYTCADNTGLDAH

SEQ ID NO: 966003 - protein, 304 aa, Homo sapiens
LQQMLGRNPGARSPPRTGAHSQTLRHLFTAPSDCPKAPTPSSAAQPPARRRRLSLVAAMHDRVHLAQGGAQNYPHRTQEAGHQPPGSTLELYASLRYTVSMSELLKHRDECGAIDRTLPTIQLLLCTNTHAGEGPHAAEHVTDKACETPTRVWPPSYPSGYQEHPGLVMNCRHAGAECTLDVCLPILGNTTCASQSHTVSNDNTNWANGQKVKPPNLDDGLQLQNTLNLQLTAGETDHHKNLGGPRMQPHLTHSMGRRQNSGLGGKFLYGQSKPPGQPCNTKGYAYRANITNTGGELSCVTQDR

SEQ ID NO: 966004 - protein, 111 aa, Homo sapiens
MLRADKAKVKDEPTEKIREVALLNLLLRKPEPKPKKAPVKQGRARYPKGTKGNADAGKEEGITHAEQWSIAKTDQATDKLHRCCEMPSESVLPLQDNWCTIMVTVQLEPTY

SEQ ID NO: 966005 - protein, 121 aa, Homo sapiens
MSGFQINLNPLKAGHSAFIKVLEWIASIFAYCTCGGFKGQTEIQVNEVLLQITENKTVTATYGYPFRLNEASFQPHSRCKNDVMYHGKRLRPHRRLLFYCTITMKPIADFVYLYSIADLSA

SEQ ID NO: 966006 - protein, 49 aa, Homo sapiens
GSPPKMLTLENQQTPRTGLNDLIGTLSKKTTVTGLERPGSSLHALAEPY

SEQ ID NO: 966007 - protein, 134 aa, Homo sapiens
MDAPRQVVNLWAWSRQAAALSVLEIQQELLDYKGVGISVLEMSPRSSDFDKMINNTENLVRELLAVPDTYKVIYTARRVEVRTVQCCPLKPHWLKAGNGVLDYVVTGAWSAKAAERKPRSRDYKYRTPLNLGRL

SEQ ID NO: 966008 - protein, 74 aa, Homo sapiens
MRLTCRFPQLVPAGPRREEAKLWLPGKHSKKSSPMDQKHVTSIGYADRGTTWSVKKSRLKSKLKAQDTLQRVNQ

SEQ ID NO: 966009 - protein, 145 aa, Homo sapiens
MSKPHSECRDCLQFRPSSVQRSHGMTSIPWTHNVLALVHLHSPTPVTAPGNTWRSILYLLVPDFPNQLADVEPDDWLNDSLGNDMLGLGSCTPLTSVDVAHRPVNAYHKLPPEGNPKFQHGTLARRANKGAQPRHRGPYLARSRG

SEQ ID NO: 966010 - protein, 103 aa, Homo sapiens
FSASLSDKGYVIRLYHEATTDTYKAITYSVVLSEKSTVFHQNDVKVPNSTHVFTTFYAKTKSLLVNPALFPNPKDYDHLMGYDKPFTFDMEEDSEKKQLKEDK

SEQ ID NO: 966011 - protein, 82 aa, Homo sapiens
RNAFQLKEDLIYGPVCATAELGKDLSQDKLCHAAKEPGITRRQLSLDKLVFQPLEDIDEPQAAGFRRLKLKRGPRRSKPLKP

SEQ ID NO: 966012 - protein, 44 aa, Homo sapiens
RRSPSLSSPSDPARPRPAMEKLSMIQKGKLAEQAERYDDMATCM

SEQ ID NO: 966013 - protein, 134 aa, Homo sapiens
MALMCSRKVDAHKCAHALITQTPGEVLDSSWEHVQARTERRGFQEDLWQKGTKCMTVTRPVLSSRLWCDASTGANAIKGPRIREVASDVWTRGPGRWVTGERGDQEGPERSKGGEQEGEETPGKGKGRTKKVKQ

SEQ ID NO: 966014 - protein, 210 aa, Homo sapiens
MSDIDWHRKAFWGCLHRLCLGLGLLSCTIRMCMVLLTVCSPEVPGRCRVLDSQPWSLPLPVLTLRTDSVREGKCLNGLSPGSHSYEDAGGAYSVILPCRISVSGDAFPFLDLQWGLPSGDHSVFLLPSEGSDLKGFCIENCGPGTTLRGDLPQKVALSAENLYAPEVSDVGDMLGVLRAWGPAGAPNAGWQPGVAPGDAGFWEKPTLPGV

SEQ ID NO: 966015 - protein, 197 aa, Homo sapiens
QVLGDQTVSDNELQEMSNQGSKYVNKEIQNAVNGVKQIKHSHQKTTRIDMELPQTNCFEHNRSKKPKTDRTAGCPEMQTRESRDKAERSSPGVCNGDHAWPFMAKKLLRPPWPLGNTKNPLPIESSTHSVCRSGSGLVGRQLEEFLNQSSPFYFWMNGDRIDSLLENDRQQTTMLDVMQDHFSRASSIIDRALPGQV

SEQ ID NO: 966016 - protein, 209 aa, Homo sapiens
VSENWRAFKALIAAQYSGAQVRVLSDTSPLPFGTKPTVTPEFLRKFPVGKVPAFEGDDGFCVFERQAPIAYYVEQCRSCRGSYQMAASPAWLQLRCSFCWIPDDSCPPARYRGCSLTLVHHCTTTKLGHCRMHKEEVRRILAAAGCLLEDEDFSGGRTSDIGDITVVCTLLWLYKQVLEPSFRQAFPNTNAGSSPALISPQFRAVLGEV

SEQ ID NO: 966017 - protein, 45 aa, Homo sapiens
FKYHTIHYNLIGVVNPANGIQRKYKNATFYCPVLISREGGFYFTH

SEQ ID NO: 966018 - protein, 174 aa, Homo sapiens
VPVVDPQEEERRRAGGGAERSRGRERSGQVRQSPRGLALSILLDLNDENSNQSFHSGRFPAKGHRAQSWGHPPAQPPCVTLPGPPEGVPEEAQAPRLGPRERSRGHNCWQAPTNPQLLTKGRKPCFPRTLLGNAGGPPKLYPGFEPGANLFPLKASPRVDHRGPRRVAPRLKRI

SEQ ID NO: 966019 - protein, 46 aa, Homo sapiens
PLVVTQYSCQSDRVVQPAKGIQVKYKNATFYWYLSDLLGKEGSTLH

SEQ ID NO: 966020 - protein, 67 aa, Homo sapiens
STQQHLKKVYASFGLCMFVAAAGAYDPYVVSLIVIAGWRCCRALRRPLILMSLAEWRTPSIADGNCN

SEQ ID NO: 966021 - protein, 66 aa, Homo sapiens
MSHYYGPHLYELLYSSKRQSGGPRLHLQQRFEHIIKEDPSFLARRKRTAAIVLYCRIAAEFSLLIT

SEQ ID NO: 966022 - protein, 111 aa, Homo sapiens
PNRALIQTSIMISGYPCDHSSTPYRSSYSGLVSNSTNHIPMMADVTEKAHTKDTNTTVQKGLRYGIILFITSEVFDLRRIESEPFNTSSSSTYPANEEGTGPKRHQPAKSP

SEQ ID NO: 966023 - protein, 221 aa, Homo sapiens
ALVSRTGRHSERTVSAGKGMRHLQLEEDAPQQQAGPLRLSAQAWRCTMSSIGRGLASESTSCDMIPPRVQSPQFSHVEICAMPGPRGKTGSLSPPTWPPGLEGPTAPASAGLREDTVARTHRASTGHAAEARPQFLAAKFHQRLVRAGAASIGRPRIIAGGPFPWAFFLSLFAFSLPRPAETVDLGGWFCSVAPCPAPAGTRGGQPGPPVMRMGRQRPGLL

SEQ ID NO: 966024 - protein, 215 aa, Homo sapiens
ADPSAGGGDCSGASTGCSGRGPWRESHVRAAAAGRKSSDLYRDTWVRYLGYANEVGEAFRFLCQRTVAVAELWRGQLLRAWRMPLTTGQEGWRGAQPLKARPAAARGWTVRCACDTLCSGRLQRLWPSRAFTINPRVCCPSLYVRGHVPTLVAPGLFRKWTTTALGLVDHRPSLSRPHWNRSGGIALLGLPALAQARNPEQWGEGPRFTPDQYSW

SEQ ID NO: 966025 - protein, 54 aa, Homo sapiens
FNASYSFPPKDLKVKSKHMLYNNVCSAVKTPLNSNGKHPYQLWLKAGHCGQPSN

SEQ ID NO: 966026 - protein, 451 aa, Homo sapiens
QAEASARWVPVRGTSFQSCMSDGAITRSVNPRSWVKRYMRATREWARDTRLICAPSQCAVNTQEIPPVESSIMDTMHGISCVNLSSVYVMCARYPSRKVAWVMSGTLVTLHGGCTLFRTLHIVACIHGAPSSAFHMRIANARKHLYASHLVRMDTAYVLPSSIHARVPINPKPTANARMLSLSHVDLQLNFVHPPQEKPPYTPTRAHSLELPSLANAAQVPFPVPLSCTGPRLLSRTCPLVPPLTSDLSHASLYAARGVPFYAPFQPLPRTRARQRTLFSHFPPPGPHCTTRVSPNASPPGSQHPFSLRLPKRKMFLVPQSNARNFHTVGTLWVPSRGVGGHPRSPLLRHPPLLSFHTHRGCASPLLVTRLGPSLTPPLLSAASHRPSAAQHLCPQHFSGSRRTPPSPVLRHPTPSFCALPRLGPTPHLRLPPLFPPLTHPRCAPHAACSH

SEQ ID NO: 966027 - protein, 44 aa, Homo sapiens
MEPVQDTYRPPLEYVKGVPLIKYFAEALGPLESFQAWPDDVLIS

SEQ ID NO: 966028 - protein, 150 aa, Homo sapiens
MWGRVPRISGSFELFEKFKGKVLGKFQGDHLGTGEQTKRHLLYAGFLEQQTLRLEVCDETSFLNSSFRDIFTGGCDGAMPTFWRPHSNFKGVGGNLKAPPFSPFKEEFDILVEESFTQRKLPLKRARPFRTRPGRKPHISFNFREGGPDF

SEQ ID NO: 966029 - protein, 64 aa, Homo sapiens
MDRAHSLSVTIPFSAQVRDKFLLKGVWACRLNTWERHEIRVNRGGSRKSLTLTLEKGDSSQSIR

SEQ ID NO: 966030 - protein, 80 aa, Homo sapiens
TDFVEGVVQEDGLLGPVGCLMMHFRGLPGVKSFQALNGQVVHRVNLVVVRRVSEGQRQQALSLQVGLVDPGLKLVGDDGP

SEQ ID NO: 966031 - protein, 244 aa, Homo sapiens
MGRCHVRRLEEVRELEGKNGFSSDQDRAAPSGIYGMLSGDQPTIAHRRTSSMCPDLELNPIRSKIVRAFFDNRNLRKGPSGLADEISFEDFLTIMSLLPGPSDYSPWTEEQVELCPVMEEAEYFCIHMYDSEQTTVASLWTEYRTVVEELLSGNPHIEQGVRSLHRRRGMIGGGSCVHGADEKPDQVCDGISFEDFLKICQGIDLEDNDAVGSLNMETMAFGTDPRTSGRNWLCMGAAPGSEEQ

SEQ ID NO: 966032 - protein, 232 aa, Homo sapiens
MPVSCEVRSRPKKGSNKAVTKARKKDEKKRKRQPSSEELLSDSTVYTGAARRSILDIPGIISVINELNGNSVNSLRSTSILRIGSRRVMGFLYLAGSYRTMQLERSTLRGRIQHWSVRRGSEPEGRFGRYGTARVRTGTKVRQQSTIQVRKVERMLKDGDFSRVCSLSVTLSKAYLSIGKRNLAFGLPAFIYWRKMKNVTAMRYLMDLLAEGLRLAFMDSHADSKENSFPDA

SEQ ID NO: 966033 - protein, 149 aa, Homo sapiens
MPRKDANQVHSIYQEEEQTVRLSVLYEPKKAGPLVEVGGQGAGNIQEDWSQCTLASLPDSSLATSAPAVLLASATSGCRDTHFVQCPSVPSHKFCLPLLQTIASHHAGQLVAQVYGPSGDTCPSCGPPMSPGAFYARGTLPPSLLPDVP

SEQ ID NO: 966034 - protein, 341 aa, Homo sapiens
SDYRKKLLEHKEIDGRLNGVTEEQLKELTTAVLQQSETLICRPYRVLGSIVGDSASTQLTEDKTSLVKRYPTGPKDYVVGLSSDRLTNNVHADRHGTNDVALGILTTATLLTDDYFSPETTVDSNCVYYTTVLTDGPLGTLFSYFLTHFAQGSSSNQNPGAHSTQPGASAIHLLYDNLRRFHYTALSGTSHNHPTHRACIRVLLGPHPGTGDTNTSMATEAGCVAQPGPATFLHKGWYLSSYMSDPSLHLGDHAATVRPTADNQFTFIDQHDSTQTMAITLPLRLHTSTANSERTHRSLLMTRNPSTLDTTEELPTENALTLAGYPWKYKWEWDLGVTPAV

SEQ ID NO: 966035 - protein, 132 aa, Homo sapiens
VQDDDLKNVSQLERNIQTIINTFAPILCDELGHPDTLNQGNSIELVRNDLQNFALKNEEQYPNEKVIEHIMEDLDINADKQLVFEEFIYAAWSRRNLGCSLASKMLEAVTRALVTTISQVSGRAPPKSTSGQ

SEQ ID NO: 966036 - protein, 78 aa, Homo sapiens
MFPEGSQALGLRQIHRTVDPGQLREMLKAFGLTASAVHILQVDSTRTVGHRILKNGLGELLQNLSLYVAVVMFRLRSG

SEQ ID NO: 966037 - protein, 114 aa, Homo sapiens
HAYKKYIKDYMKSINGKTSSNMRPERVKPFMTGAAVQIKHILATIQKLPVLYCVTNMNPDGMVALLDDREDGVTTIYDLLFKDGLEMVNSETNVAIILALSPVIITGFCSYSKQ

SEQ ID NO: 966038 - protein, 278 aa, Homo sapiens
MTNGVEDCLSPVHLKPALDNVMKPFLYQKIKIQTKKECVKNLAAGRWVVCGAVLVPSRGVGTGRGGVKRGMKFKPPNGRFQTPVPMVDTSSGLSNSTLVHSPQTLGDMNKKDKITLEHSPIKEHNTQSDRTSLSHHRVSPPTPFYTISFTHKISACIYPLFSLFICHSVPLFWLPHSIISNRPQEIKTKYPPLFDDNLPLHTQTQYHTTLYNTQPFSNIQIPHLPKKKTPLFSYHESLSSQQYSSMSTKQHLPHLLNPLCSPPQNISHSHKPPITNTL

SEQ ID NO: 966039 - protein, 338 aa, Homo sapiens
YLRANTIGDKAGEAGGRKQGSAAAPAYCELCSLPLALNHYATCTLLRAHYLHACACCGRLHCHYLLCTRPRSLPLPPPSSYCTPHAPLCTHPAQPHASGASLASSLPRLSLPSPLCCPTLAHLYYNAHSRPPPTHTLTHASPTKRPAHPPTPLQTKKCLSSFSYAPPEAMHHKKGCGTFYTPSPPPHHPSASPPARTPTPLHRTTPLRRPLPLRLATRHSFLPSTPTPPPPLTQHPLLTPAPLPAPSLPSPPHLCTLLLSHPPLLWRCASPHPSPAHFLLENEAFEAPEYPTVDAPEIFVRDEKPPSCTGPQCPFPVDPLDPPPSPLPSALLTLPLTL

SEQ ID NO: 966040 - protein, 200 aa, Homo sapiens
GCQSQGPVAAISWILKTNWPSTLGVETCLPYVSEDMLSRSKRYIWQLFLEKAHWVSFITFLSFWVFIISCLRKQSGCMAQAAVWWPPITVHRHPQSPRPKNPPTLFAGHYSSQNHRAKIHHQVETDYLCSPGRVTGSGAQDVVPRWTQFPKGQGTSWNLGPLRCCPTAGHIPLKESLSQLVHCRRSLHLQMNVLERSLHS

SEQ ID NO: 966041 - protein, 257 aa, Homo sapiens
SGAALDNTHTCVFQDMNQPLAHYFISSSHNTYLTDSQIGGPSSTEAYVRAFAQGMPLRCELVLLETGPARREPSHLSLAIPITIQAFSFRGRASNAAALTTAVHDMSPLPLYIRIRWHEPTCAALELARAGHEPRPPYCDRVLAANMAGCTQRAWHSAKLPQAAAYPLEPRCNGPGSWLTGNSNVAPLPRTPRHGRGSVGSATTEEEDDRGGQTRTARGCRAPGGRPPRSPRSLSALAASATPPPADLHLPPRPPPA

SEQ ID NO: 966042 - protein, 67 aa, Homo sapiens
MLMISDQSDTIANRLFNEQCDSVKVNFHPEFSTSASPLLAVDYEEFVRGCQLWQSSPPTMSLGGYTP

SEQ ID NO: 966043 - protein, 112 aa, Homo sapiens
MSYAAGQPTRARFRLVGAEAQAAWSKPHSYIFHILLLITASHFTKNYTKTMNNRSPPPTPPTPLPLSPLTILTLLLSSSPPPLRLTLNISLLLYHLTLYISTPRTNSLPHLS

SEQ ID NO: 966044 - protein, 35 aa, Homo sapiens
GFANGGIFEQEHEGSIYYPHCKFIAINIRIKKCIH

SEQ ID NO: 966045 - protein, 447 aa, Homo sapiens
MHRFELVPKTILKRIHLVASLHINWAHISYMVHIYLRRTMWPPLWVNVDLKAVVSRRGRCIHCNSSPVFLGARSWTPSCKLRGTSVEGRPYHMITTAFSGWGAIPTRGNGHISGRIEMRVVQLTGKLVRDKFLASNGEGTGLRPHTGTVALGVRTWALEPASECTRAPNVGCRPFADSFELLGWKGPPHSRCRSLFKHRGCHNQIGQAELIGRALLCGKRLGLIIGHNISAGPMCWATSWPCGQENGSHFRAFGHGHLALYICREQGFRGPCLILSIPRYGVVGNVSPGCPLARAVGQENLRSPRTLGRLVGPTGALFRFADKQGLEAEPSPPCTCRPGKALGQCVNGPPVGPVGQIGCSHTTHSFSPYLATGDCLVYLISETQRLVLLRGHKAPSIAGCVPVVRCTTIALPGRHTSAPLQQDLLFPGSRHNSDDTVVDDPAVRRQL

SEQ ID NO: 966046 - protein, 34 aa, Homo sapiens
ENQGVFGNGQTNKMVCVVYRGGKGVHSCGELVQG

SEQ ID NO: 966047 - protein, 37 aa, Homo sapiens
MIGLKSVLWDLRPQVHIMAAKAVANTNENITCDQMGL

SEQ ID NO: 966048 - protein, 42 aa, Homo sapiens
MRALARRSACCGHLSRVGNPTVGPYVTEATRVQLVLPLLVAE

SEQ ID NO: 966049 - protein, 282 aa, Homo sapiens
LSFERPGCTKWSLKSSAQITGVSTAERRLVMIIRVPARHGGDADPGACGPLLLGRTGANRRARPSPGAAGSRMPPRSLAANYAMGAHFPVPTRRYLGRLLLAELVPWYRAPCAWAAASSGLVAHGAALGPFREAPEVKSVLSRRVLGFGKAAGTVFRISGFTYWDPLAKVIGEVLALGGNLGHKRNTHPGRPPWWRRWPCALVGSRGNRSVGNRGMSGLLSLFPVPAGPRARGIRLGARAWERPQGGFGRGSWSLAERPRVGFARRGANRAVCFPLAPVAQG

SEQ ID NO: 966050 - protein, 70 aa, Homo sapiens
MNAPPQMILWKNTREVERNNSQQENDKQQYDDEEGEENNTDWMTRACYHTTERYDEPNRHNANEAVVHKQ

SEQ ID NO: 966051 - protein, 44 aa, Homo sapiens
RWDPCCIIRPSPEQTVGTSMSAGCKHIHLALHTVCIVQERRLLH

SEQ ID NO: 966052 - protein, 284 aa, Homo sapiens
MGVTRDTVEVRRSVLSFQEGREVWVECAGQTRCGVEISHSGLSCVALRLLRNILLSHIICGRVSEQTSIPMCAWVCPLCGQIIAPVIFLTGSIVGNDIGLSLRVTQGGVAYVSVEREASLCGAKHGGTTTRGYNYGLAIRETPYIIYLLQCEALWHAEGGARCVIRQSAAVSALSDKEIMKKNPLMCCVEEQRTRGGSPHLQEGGAIKVVLVSIVGESDEYGFFSTLRGYSCGVRAAMLSLVAQLYIKGPHNDGTGAPPLFSSAVGGPTLGRVHKSAAEERYKP

SEQ ID NO: 966053 - protein, 40 aa, Homo sapiens
ALRGIWYGPKNKMVCVCMGSERGANAVVELVKWECGQTSV

SEQ ID NO: 966054 - protein, 38 aa, Homo sapiens
WDTDVKRVAAVLVVLCSESVPRFIKYTGYGNAVAFWLP

SEQ ID NO: 966055 - protein, 285 aa, Homo sapiens
MWGHPRDGGDVSRPPRGTCGRVGVTRDQENQEPGVGCGQGGLSEPLEGANSTEGPTEKEFSLWETSRSRHTERREPPMRDGGISHTRHTQRERETLWGVHREKSAMRYTSARAYSPTKKSARVHEERGGKKMCALWRTSVVCLCVCPLTRCTHCVCVKNLCVCETPMWRARPHKSPWWEPQHSRERGEEKSREEIRERKTERTKHNKYFHSPWEEEQRWSPQRRNHRRGSLQRNTPTRGVVAPNAGGPVGISPEEGDQHQTAGVAKSRAEHIRPPKTRRVSSTKR

SEQ ID NO: 966056 - protein, 301 aa, Homo sapiens
MIFVGENILEQSENLHNADQALRVRGCILISGGTNGGRIYQNNAESTDASAPKRYVEHLKDEAQVCAIIAMRVQRYLEEKGNYRGGLPASTCLRILAHLHTSVIHRPYQRQLTPPEGSSKSEHDQAEDVGLRTGLCLMEETVQVLFYSQGPQETGSAHVPSSAISTTDGLHSRWYQGPGPHGHEPLAGQHSACRPAVQILYRAYPGCRWASVASVKGCTMTLDYACGHPVEWLGEEFCAKAVWAAEEAQEWEVAADGPSLGELGRGVVPGWRLGPIGPIGARCRSPCGGNSGPSACPEAPR

SEQ ID NO: 966057 - protein, 407 aa, Homo sapiens
WRLPELLELLGVPVCVLAVLAAGWSECMAGVPLCVLPPCDLVLLALCPVSLNSAVCVCCCALLLAPDPCGPFLPAAMALACYVPSSAEGCCCWSSMVACRNEPVSRDSCVTLVDDGDLYNWEVAIIGPPNTYYEGGYFNGAPQVPHTTTPYYSTSLSRSLTKMWHPNIYETGDVCISILHPAGGRPPERGAASERWQPSRTSGPFSLSCDLPPERAQHLLARKRGRLRDVQERATRCNGERIREYTRHHAAHILLAEHGGLRDATALTVPTSPGRLLALLIIAPSAPTSDSRTSFLRPTLLTQAPVIVNLRHRRLTSSPSNQRHTWHERRLLSACDMYKYRSLNSRSCWIPVALLEVQVTAPEGNSVLTEHSLRDMDGLSYVPRMVDSTLMTTEGGPPTIQLRFTTS

SEQ ID NO: 966058 - protein, 512 aa, Homo sapiens
MHLSSVGRVDSGKSIHYWPCVSSNIDGGIRTNENPCDEYLYDTDVLHEYGQTRARFNVCPVRVLCIHMRDTGMHAGESSRSSTRCAYRRVCWESSEELKHYVLHVTYHCDAPLGRDKRKLLINTDRMACDRGNQFIDVTRSLLGLGPVVLSLWTWTRVRLVLVQFYDMPGIIIQSNVVHRTTEESSCSLVMAVINKLGAVDIAKRIAWFRVAYSIELGSLPPFEAQPPTNAPGKGQIMARGTYFAFHRDTLHVHHLTAVKTDTYSVGLSKGRLEQGYVQILGGARNLGVGVWGPRGWQQNRLSRGSPKGGVETIEPFGRCIRGAIRGKRRFHRTGLNTGQLGPYSGLRKVWENPEGALTLSSKEELFLGATIADFPLNTTIPKGFRGSNNLVIETKSPPLVDETIVGLPFHHTGQTGVTQPRQRGALRANLGGRPWDFPCICCTRMIVVQNRVVCTFFHHKKPGCSSDVRKFTTHWVRSHSNAHRFANHVDKRLRTVWVAMIDATTCHQSLR

SEQ ID NO: 966059 - protein, 274 aa, Homo sapiens
MPSVQTLVDPNACPLLCPAFLVLLVHCLLLVLCAVPMCCHLHGSCHVPSDDCFLPLLTCTDACAYTCLCAIDASEMPLLHNTPNSLASELIALQDTRQEPKVRHRGRGGPGGPSGDPEVLEILKHVFLWTPVIDGGLRPAMLACAMAGCGCSSTAGSRRLWTLPLRGPCPCRLRSVTVGAACWEALLDESRPLFERYRAMFCPVQRRECEEAALCAGRGSALWERPLPARGRLRPGTAAHEAVVPQLLAACADFTENPMVRPDCAEGLGAIAGC

SEQ ID NO: 966060 - protein, 139 aa, Homo sapiens
PGSRPTAVEGLALGSSCIIVVRATEIIINPADRRWSRSWPCTEDGALTAGAAVVQLLSAGAGTGRPGPKQVRFRASVHWADPKSQQSTQHPGPTSLAAGGACPGKEAPHARHTMAVHLGTYRASPPGTDRPPCPTLPPK

SEQ ID NO: 966061 - protein, 60 aa, Homo sapiens
GGGTQDDRRPAPEAKSSMQFTAEASREASLSLLAEDGALAYLASNFISTSVSPIQMGPNL

SEQ ID NO: 966062 - protein, 126 aa, Homo sapiens
MGDLWRQWTKMQQGEDAEQLLAEKHLLRTSKRCLKGTQGDRSGTTRWSEMRGSPMGPRAEAKARPTGHCQAPTQVRSNLRLWPPKGSGRTPQGRRVSERPDNLAMNHRRRRVERNSTVPSGNRLKS

SEQ ID NO: 966063 - protein, 246 aa, Homo sapiens
ALARLQEDAAFATSGGRGRTQAGPHAPSTRRSRLTRSAHLIGRAARARASQRIIFHLLLREGKDDVSRARESSPSSYGTPMLMRKGQALSKLGPRGEACPRMQAIQVDVPGHYARWSCEKYREETTDAHAAKSPYWSNFAWTEPEGVTQKNHTRCLAEESSRRNHREQTPSATVKLTGGHDSLDIQLGKTGRESREGGIISMGGPSCRQWTQDEPQCPEPDRDYRSLAYVRQQLPLPCGRGPAFSF

SEQ ID NO: 966064 - protein, 151 aa, Homo sapiens
GALCDRASESGLRPALAGSYQDGLRRPGFAEGPPAGRNPRRKKPQTDRRGGSAGSQPQACADGVRVSLPKSGALVMSRTGLPVCPWAAVSPVARSRGDQNPAASGAAWGWVFPAVCLCPLWVCVCVCVCVSVCLRVCARARARVGACLCAH

SEQ ID NO: 966065 - protein, 245 aa, Homo sapiens
TSPGRGPAFPAASRRSVPAPRGRRLLLPGACCLLVPVMDCASHCPLPAPVSLRPGLLLLHLEGALCVLLGSVAWVGRMASTEPAWLRMVEPPVDACAAALRWLASCWNALAPLMLLRALALVPRPECVPMNVLPWAWPSAGLWLEGDPGLGCPELCPSSEARSPEPPANRLQDFDTLVTVGKQLEAICVKVTSGETKWSGMTNVPTGHSPAPICKTEPAARGNSLPGGTPSHQAQLVRGTAPREN

SEQ ID NO: 966066 - protein, 74 aa, Homo sapiens
GKNVDEWKISENVSNLVIEDTELKAGGLHIQVCQHDIAISRAKVNSITVDNLCKQSLSLDIRMTWWSIVEIINR

SEQ ID NO: 966067 - protein, 171 aa, Homo sapiens
MCRRKLTALDLTIEPARAYILQTNEQQEVYNTFIDLRLDTHQNEIRHYKIEDRGNLDETSTVERSWPNVALKRYLRDVKCPFIDSRSIKNAIGLACLVFSCIDYEYGGLMLMNRGFEYLIIQKLLTMQLRNAEPLDPIRHVHISPELPTAGVMALANLLQIQRHDDYLVSA

SEQ ID NO: 966068 - protein, 235 aa, Homo sapiens
RLYQHEDEDEEGSSGAAYLFLKGKEIRSSFCAEESAKFPLEREWMSEDDGTSERFRKECNEVSWDTGSTFFRIPTQKEEVRDNKSALAFIGFLKKGQSPPEDEDKKGRREKKSGVTRAKNEVERAGNYQGAWYEEEEENEGGAVVNRGSRGGDAGYVNGEGQENVCARGTDIRHGVVIKKRRMRMVQAERRRRELIGDCPEMELVQVLVQMGSGRRTWETGVIVKIKFNIDRLSL

SEQ ID NO: 966069 - protein, 284 aa, Homo sapiens
HQGRAKRTRVFKSMDLKELLIFKKQLKCLLGSREILDRVGRWHGDSAALLRRGDGMLGDRAGSSKQQSSLLLLAWGTSTALVPRVLWFKGLQNEPKHGIGSWAKRPIQEFADERVVSTRQEKLEWLTEAATDDIRTARARREQASGRRVHGRPTPCHKLVSAPCVAWWNVASGLQARMKHHYHRHAEILDISGQRVSRGTTDRKSHKAYDVKKAPRARNVAQGHGPEHRVSHSIRQPNNRYGGRTDEVQKDGGKFKGSLKSELCLRTSVQDVIRLHQEPSVSSA

SEQ ID NO: 966070 - protein, 85 aa, Homo sapiens
LERFEEGLCIMAGDLEFSVTHEEDWTRWVQTRSQGLFGPGSSCCGPKLTGPLVRHFAGNVAGSRLGQDARRQAPWVAPFSPVAPL

SEQ ID NO: 966071 - protein, 240 aa, Homo sapiens
MRFELTEQPPSWQFNKIKEIAVTVKKADEVEQRKLLEISVPVIALSLQADLPARKLSWLMMVVAMQMMMLDDLLQLKMIVIKMVQVGASEDSQLKLVLLQDDLSLSWVEMQPNKYHNPKIVFECRLSWKWEDQLNRIPMENSGHGEAMKGHPMTRVEKTRSSRGTKKFCCKLPMGGFGAKTLGQGTISRRGRYQSDDCDQDVGSTAARRIFNVGTGRVTDGMRRRWPHRYCATNSETLTG

SEQ ID NO: 966072 - protein, 44 aa, Homo sapiens
SLGGVEKELTLLQQALELNKRKAVEAASWRGPKVHLAPCTPAPA

SEQ ID NO: 966073 - protein, 275 aa, Homo sapiens
MEIQELDKDDDEPAEYTTEGPAGGRAGKVSSKTAKRSSIRRMSDMDLDPLEVMQSIWPPRTPTCEPEIAERGRLLAAACPTKARRLCCLRGQAVVGVHVSKRESSFSRGLTRCSISCPGHDSHISVTITVSEGRQAVQEFVARLDLQWYGQLSGASRGRRQSRSFPCSAPGGEVTGRTQWGSLSGGPRGATLNKTIQDCPIYTSNARNKDAEQRGSLGEDWGDLQPNANGKGGGKGDIGVPQALRRPGTQGLEHGNGNGNRAAPGGLCFSRGTHG

SEQ ID NO: 966074 - protein, 124 aa, Homo sapiens
VETRWRPLLSSQRNCTIAVHIVHIQLRKRYVLGSICLLTHRYRSPCNRYIPLTSPEGEPCGLSFKRGPRLSSVNLGDAPEVVEGTASRELVVCKEQSRRMSLDLTSTRKNSQDSRCPWTTRWLS

SEQ ID NO: 966075 - protein, 60 aa, Homo sapiens
CEVSVPQVCGKVGTTAGQQNSSWQREVCPQRDEDICFSFMPKNELTSCCCKLNIGLIGQG

SEQ ID NO: 966076 - protein, 164 aa, Homo sapiens
MKRHLGEQRTHHNPLASRDCDFFTIRTLTPHGIRSASYPGNNTYTLPPKLIKNRALASAPPNVGTQNGENTGTLQRRTQSTETKPNETTKPTHTGKALAKRPQNSGKRDGPADTMHRQRRAPKTTATNRSGNRDQHPDRTHRDTRHAQPVICQHIKDADRTKQQ

SEQ ID NO: 966077 - protein, 77 aa, Homo sapiens
RVRVCCNVGEQPDAICGIMSHTQQGCMAASPRATSAVILQSSSTVGSAATAALVYTWLSGSLEAEGSQRQSATMTST

SEQ ID NO: 966078 - protein, 47 aa, Homo sapiens
YGRRSTHCILSGKSVEVGSCQSDRNSSSGDGMLLWLRLRSFTTRTGS

SEQ ID NO: 966079 - protein, 93 aa, Homo sapiens
CVYLHCCSSRAAAEYLAEYACLCGVDSCSKAAPRKEQQAEAPADVERGTHLPLLPGGHQRIVEVLNDVVGRPGQPALFTIGPANRKHHPRQDH

SEQ ID NO: 966080 - protein, 49 aa, Homo sapiens
SPGFYQWVAVVLTCSCWQQQSAQQNTWRSTACLCGVDSCSKASPPPKEQ

SEQ ID NO: 966081 - protein, 40 aa, Homo sapiens
GRGPTSVMALSADGYYARSEDYVDIVQARRVGVWNVPYIS

SEQ ID NO: 966082 - protein, 40 aa, Homo sapiens
RGALDRWTSATPGTWVSGAQSGTPPTGLYGHSAVYHGHPC

SEQ ID NO: 966083 - protein, 66 aa, Homo sapiens
AEEERSLALKNFCLWWLNSDLDLEIMAMATQKGGYWSKRASVIQVPCEDAHDPRVKAIEMGSVHLI

SEQ ID NO: 966084 - protein, 48 aa, Homo sapiens
HTVSGASVSLRALSDNFLHPSHQLTETPALAWNTELMCQQRTVIYQGS

SEQ ID NO: 966085 - protein, 41 aa, Homo sapiens
SVHKENNRWGLLKRAKSAFYLVRLSGVFKSNGGSPMFSMNH

SEQ ID NO: 966086 - protein, 137 aa, Homo sapiens
PISRSSTGLGICLREHADILHPSTVKRHTLAGHDGMCQSECHLHGSVHIAAGRFGLCAGSPQVSGRPGSQLGSPHQCRLPFMALRSSCTSYSTVGVIIPTITCSKLPLSSDFKVVYQVPADGALVGWPDLLALGGVA

SEQ ID NO: 966087 - protein, 100 aa, Homo sapiens
MSAYYTIARLALHEYCGYYYGPSDRRVDMGFRGVIIGARKEVSLLYTLLCKLVIPKLVIPKLVIPKLVIPKLVIPKLVIPSSSYRSSYIPKLVIPKLVIP

SEQ ID NO: 966088 - protein, 68 aa, Homo sapiens
KATMGVNSYSLYKVLSYVSKELFLLWTQQLNLQGDLTGLQWANLEVELRFYLWTHPAITMARISFVAY

SEQ ID NO: 966089 - protein, 95 aa, Homo sapiens
MLTILRSWVWFNPPQLPAMMATIERVQEQGFTFNEGRDLVIMIEMGAQFLSCEQATGLDVSKGALGNLWDSEVKGGYSSVFIAIAIMILHDEYVI

SEQ ID NO: 966090 - protein, 61 aa, Homo sapiens
MDGTTCTLLSDITEEDLEELGVQDPAHKRLRSGQPCSVSKYTREAPRTLLNVRGPLLWIPK

SEQ ID NO: 966091 - protein, 37 aa, Homo sapiens
VSLTSAGRSGLLLLGRGCFAATVHPAQTSLTPPSILL

SEQ ID NO: 966092 - protein, 83 aa, Homo sapiens
KHKGYMKCRCAAEEQYSPKEDKYRKKSSILTEYTQERQRPCAELAAKSVAKLEKTIDDLEDKLKCTKEEHLCTQRMLDQTPLK

SEQ ID NO: 966093 - protein, 64 aa, Homo sapiens
QGRKDCVEAAEKRIQEIIEDLEAQVTLECAIPQEIPSSLSWCPKRFQQSRQITQGFHVFKIKLP

SEQ ID NO: 966094 - protein, 117 aa, Homo sapiens
MGPRQSNEESLFRGASMGAVPLAAVTLAAILRQIFKLQDWALVAFGGVAAFQEVEGVVVVENIGARAAGKVATATEVEVILWSPFFTFLDPVSPTSRQLYFRTDGTVGSGCRPLSQL

SEQ ID NO: 966095 - protein, 52 aa, Homo sapiens
RPRSYILITILPSILKLRPHSQSRHTPLSRTIKHLLPLLALLLTSSKPRLNS

SEQ ID NO: 966096 - protein, 125 aa, Homo sapiens
GFQQPFWSDYTPAYQTTSRLFLVIRVLSIGGDLMFHMQSAEVSSLTEHARFYAAQKICIALDFLSRRGGIIYRDLKLVTTSSCMRTGTSSSQDYGMCNERSGSMPDTYEQVSVEALIPSYPAPGL

SEQ ID NO: 966097 - protein, 93 aa, Homo sapiens
MALLDQLGQVLLHYTPFRRRDSTSSMTRILSSAEHRTTSRSPERSSYMESLIYLPLCVGTHGQVPAPHYTDYYHRALEVLHTIHLLDDRCGNI

SEQ ID NO: 966098 - protein, 59 aa, Homo sapiens
SRGFSGVMPVGGHSHAAGKARVLSICDHLSGPVTGVTWLAKNERIYSMLGRMFSHNRCR

SEQ ID NO: 966099 - protein, 73 aa, Homo sapiens
MLAQFVSRNVLRLKMSPPALVPPIKCWVLQRMTPPMPGPDKLYNTHKLSSVPNSLVTKTNHTYSMKENNLLFI

SEQ ID NO: 966100 - protein, 56 aa, Homo sapiens
MIAKDGDKCGFDEDITYDYSVAECSHYGDMQGDTYREVEFYSVNVQLERSHVRISR

SEQ ID NO: 966101 - protein, 56 aa, Homo sapiens
QLGLSSASSTTYAKIHFTIIFIGRKSKLSSHNTILEPIRQCPERHLDRAILLGRRP

SEQ ID NO: 966102 - protein, 60 aa, Homo sapiens
MSAFPRYHNHAIPTGVKVFSCLATLHGSREYGSREYGSREYGSREYGSREYGSREYGSRE

SEQ ID NO: 966103 - protein, 33 aa, Homo sapiens
VIRTISFMKELMQWYKDQKKLHRKCATRFWYRS

SEQ ID NO: 966104 - protein, 77 aa, Homo sapiens
IPRLWPPLTAACAQRCPEAMICVIANPVDSTIPITAEVCKNHGVYQPDKIFGVTILQNLVGANTFVAELKGLDPARC

SEQ ID NO: 966105 - protein, 131 aa, Homo sapiens
LEHSDMRYKNRVGCSISGTEGCQEALTCRRKCGVMVYIITQLFGVMISEDMGRDELQEIRNGMTNEAPESTRWPAVVAGRQICVTCGKCRKKNCTYTQVQTRSSDEPMTTFVVCNECGNLLEVLLTPRVDV

SEQ ID NO: 966106 - protein, 38 aa, Homo sapiens
RTCAECTPTHACMSMPRISSGSGDPGETKMLITKQADW

SEQ ID NO: 966107 - protein, 65 aa, Homo sapiens
MALNDQSTQIRPGEELDASLIDPYLKAHISGLSGTVKISQDLVLGTDHSVFVENTFDCIKLKKLA

SEQ ID NO: 966108 - protein, 38 aa, Homo sapiens
GHGDVILFSPCDLSSAVTLKNTIHIYLKGDFNSVGPHE

SEQ ID NO: 966109 - protein, 33 aa, Homo sapiens
MLRLTGVPIEEIMVIFRLSEFLGHLDTVVTAYR

SEQ ID NO: 966110 - protein, 50 aa, Homo sapiens
MRAVMSFLPLLRPCVIMELVTALHNSDQLRLLRKREAAIPLLHGEEGTWN

SEQ ID NO: 966111 - protein, 100 aa, Homo sapiens
ELSLVTAGGAYGIILTYDVKLPLRSWLKLSDRISGLTDTYSKDCLFTIVRNKVDLTEEGAFAGQEKEECSPNMDAGDRVSPRAPKQVQPGGCGRPSIKMI

SEQ ID NO: 966112 - protein, 122 aa, Homo sapiens
VVDSCVSPVCCPTPTHIPAGPCQAFDHPGRPRRVARPGGPLESCEVNSLGAVQQRTVVMVSEQSPQRLSGLMQVSDGRDSVHEGHHIRRVVEVNDMDVEDEHGRARDLVSSSILPIGEVRGD

SEQ ID NO: 966113 - protein, 91 aa, Homo sapiens
VDERIDESATVNMPPMTGAHTCTGSGLKDLSFSVSFTSHGTRAHSRTKTPEKALLAHTAALATILMSGHTRTAFVLTYHLQSGLHSTTVGT

SEQ ID NO: 966114 - protein, 43 aa, Homo sapiens
EESTAIGSPIARMRNGIESSSEDYYLKKLLGAAILYYDCIYVK

SEQ ID NO: 966115 - protein, 65 aa, Homo sapiens
VANTSSSYQWNPDCLIKQSIAKAVWVLTRCDFLPSALEWSTVKKFNEAAGKRREELIDSLKGSQN

SEQ ID NO: 966116 - protein, 55 aa, Homo sapiens
MSLDHLTAHDMNSLLPSMCNSFVVQLEETCYPDRNSWLVQHDVHDGIIAINTQLN

SEQ ID NO: 966117 - protein, 49 aa, Homo sapiens
NGLIHRKTVGVEPEPLEGVVVVIKRRSGQWNAATSYVRTPINKNARATL

SEQ ID NO: 966118 - protein, 67 aa, Homo sapiens
RRHICRLPDSCRCPVPGHAQQVTYSNKDFQEEMDIETKESGSPIYDKSTIQSNRQASTKLFKHATLY

SEQ ID NO: 966119 - protein, 53 aa, Homo sapiens
LAGVLYSPSSIPPEDVRPHSITNTYSDYSANLQVEYSYSTRRRNNLPYCYLLL

SEQ ID NO: 966120 - protein, 55 aa, Homo sapiens
MRNCLIYTVNLSRIRRTQRLLGEVSRIDHTGARRYERTQTQNPDLDALTPIQPMR

SEQ ID NO: 966121 - protein, 68 aa, Homo sapiens
TLEDLANLSLSRDKKTPEANKRAQTNRKSAPPQAWTTTKSCSPRSGVKAKAVPGLAKGQAGIDSKPHT

SEQ ID NO: 966122 - protein, 338 aa, Homo sapiens
SLQAPPPGFAPFSCLSLPSSWDYRHAPPRPANFVFLVGTGFHRVGQADLKLLTSNNPPTSASQSAGITGVSHHAQPSFLLWLNNISLYGWTTFGLSIHPLVDIWVVSTFWRLNKLFGTFGYKYLFKDLFSVLLGIHLGVELLGHTVTMLNFLRNCQTIFLNNCTILHSHSNNEEFQFLHVLILIFEVFNSCKHFTHVLVLLLSWCLNLCVATGYAWCRSRGSKMATGGPERRTKPAGEPQRWELACRVRRSLGLSQTISEPSTPGSLGRPMIHQPRTTPRKSNDDTQRTPSAQSSDETTTSAETPHRANNAQTNTQEPHLQNSPARASDSRSTHRREE

SEQ ID NO: 966123 - protein, 60 aa, Homo sapiens
MEAKRSMCGDHIIKMTAENGRRYTHMDEFGHSFARGVELRGGPQEAIIHNNGLGFSNIES

SEQ ID NO: 966124 - protein, 391 aa, Homo sapiens
MVEWSEINGLWSYWAPGSPGAAFNIWLKLDIAVPSECTPFIDLNVHGFYMFQILIRTRWAKFQWHRSTRLENREAYRSNRHNPYHRSILGDPTIPSNKSKVGADVRRRRRMLQSCESHVALFHQPDGSIGVWALIVLSGGHAERQLVDLIVFAPLVLVMPSLCCVLWRVELMKNVIEKRGLIGLHRAIGLRGASLTVVQHPLRHRSIQCTIFRESSEGNSIDHMSYAIYLCTQIDCVMAPPGNCGVMAAGALQNIIPAFYWRCKVVGKSSLELNGKLTGIGLSVSHCNVSVVDLNWPFEKNLPNFDDSRNGVETSRLRAPQGLRALIEPPGGVPVFTGEPISPFSTGAMAPKPCDASWLHTCCRHRGVCVSARCDWSRPTRKKSCGCLPLT

SEQ ID NO: 966125 - protein, 138 aa, Homo sapiens
GTLGWVAPAERPKRPDAYPGPALQKPEIDAPCAAAAKSQQAFPWMDASVPGDLRLENYPIPDPGPNEVLLRDAFYVGNLVCSACPRTGKYGRIGNYYCENSPWCWDMKLREQCEKSGIIGKAPKILGDRVAIEPGAPR

SEQ ID NO: 966126 - protein, 130 aa, Homo sapiens
MDPESTDSGSKLLQMPPGSLGFVANVASTEPQENVGPRVICWSYDMVRASLAGSFGACCNCFLTVQDCQNRKYGEARTVGPFELTKHLYSLYLTPSPSGDSPDSNGHVHTPTFLFPHRRRVPSGMLALLV

SEQ ID NO: 966127 - protein, 200 aa, Homo sapiens
GEVYRNGGDRVSRTQSGAYSYLAAMLRSCSLNQPKFSNQKVNPEIENQVYLYDRRDVGSRQDSLGSSGPGIRQQWSAVISSDQQDPRPDVIGLHLALVLGLPKDEASCDMQTSMVVTYHAGYDAKVDLKIMSYKCEVWFQSKCNGEVFQGGFKLQPECGKPGRLGTLHSGNAPTSTPSRIMPLDASKQPGLNWSTWFHPF

SEQ ID NO: 966128 - protein, 137 aa, Homo sapiens
MTLVVLQESTYSILRVKLREGKVQAPEVGPQPLTLSSSHPTGTLTRNLNDLIRCLYPPPHRCEPGDCSAVTLGVSASLTWRRAISREKAWTFRELSHSSRLGVWVHEEDQDARQAQEAPVSCPNDLVDVEGPRKQAW

SEQ ID NO: 966129 - protein, 33 aa, Homo sapiens
MHDRMPTSPYGSQKRGTHKHSKSTHLAGIPSLP

SEQ ID NO: 966130 - protein, 225 aa, Homo sapiens
MWRAKAYIIPHRNPTGGVGGARDWCVCNRVWRQGRGPATQVWASGMPWRPVGFWLTTSSHSSGEHWGPPGHPSLVPKVNLRRGKGKACRSTGGSPMWEPCTLSVCGIIPSCMAKNSEGKTAITIYGRKRVRGIQAPGEINCIIRRPILPQCAENPNPHKSYGAVSHKRENPTDGRQHSGGTRDDRLWLAKTRNKEGFLPLSSRVPPPLARPSSYTTTERENSTKE

SEQ ID NO: 966131 - protein, 223 aa, Homo sapiens
MGPPQPWGHLTSTSMLAPMILAISQVTQGHGRAISETDWTMGWCQHRTGDGENRSKVEFLFPSSAWEVEVGWMRRRAVNARYEGHYEACDIPVARAVNLSVEISPQAGICAYLFGQQPHSMARTQVFRIVTGNSTQRWQVGGQPSWLREGPGRGPWEETELRVCLSLMETGWYDNLCILDSRRNADANGRDAGVQAVIDDWKEAADNDLRILEQEDEEDQARN

SEQ ID NO: 966132 - protein, 270 aa, Homo sapiens
AIPVRTVVMPRKTGRPGKSNYFLKIIQLLDDYPKVFHCVEHDNVGYQSRCNQIRYVPCGKAVVLMGKNTMMRKAYPRATWNRSTQSLEKSADLISGGSVGFVFTKEDLTEIRDMLLANKVPAAARAGAIAAMRSHLCQPRTLGLGPEKDLLFPGFRVSPLIISRGTIEILSDVQLINALVDINVGASRRPRVLKHVSRSAPSRLWAWSSSSVFDNGSIYKPEVLDITEEMSAFSLPGGVRDVASVCLQIGTDCCISNPILSSRVQTSSGL

SEQ ID NO: 966133 - protein, 343 aa, Homo sapiens
LQNLIVRDIGKQEKGMFLIKRSPYLRMYEVHTAIPGNDRSTWIRVIQLRACAQCPSREDFPLIDDQRMRLTCGRIKMELQSLGPGYWLELLLSRRSGLFAEMTLFPWLDRMRMVCAVGMALPTLAQGLFRSARPLSPLVASGWLEDAISEVEGLKDTAWWGPVSGRRASLTPLSSPALSPWNPGPSVLLDESWRSPVDLGDGQNRSVAPLNFCIADSDSSQEGWNVDIRLRSPPEECVHAMGPLSMGRSTVGYWRLWASGHSVGKPLPEGLTAEKYVPGSSRVGPWRVWLPVGLVNRGRPGSLGDASVRGWPRCCGRPWLSRVLAVLERRVYPAAFAGCPGSL

SEQ ID NO: 966134 - protein, 90 aa, Homo sapiens
NILSELIQVLEQRSKLPKGYQRYPILESISNNTVYDLDVGITDIPSGAAAIEVFVQFNELRVLRDLSSDRTNPGRSLSTSHSSLYYRTRS

SEQ ID NO: 966135 - protein, 258 aa, Homo sapiens
RGEFGRRAYKGDESHGSMFTESVYVLANEPSVAWTRLHEHVRRSLPEAGPQHKADMQRWEEQSQGAIYTVEYACSDLKNLVDSIVYFRSVVGSAQYRPSAIRDHMYCPRAQATGSLLGPLRPPLPLPAARIRLSAALGTAASRLLENCLFPFVLVSGDLLLSCGIYTPDVHVTEVTVGPASLLCAWSLGLGTGDIGSDREQTGSTRRHTINQVNMADKSMSDAAVKNTAGPPSGGMSYMRQRTIQGQDWSSMWGSGEG

SEQ ID NO: 966136 - protein, 52 aa, Homo sapiens
RHCIKQAVNHKLRVDKAAAAAAGDYKRQSDEKACGCSARMPVCSVMKCEQNV

SEQ ID NO: 966137 - protein, 208 aa, Homo sapiens
MGRNQSRKAENSKNQSTSSPPKDRSSLPATEQSWTENDFDELTEVGFRRSAITNFSELKEHVLTRRKEAKNLEKRLDEWLTRINSVEKTLNDLMELKTMAQELRDARTSFNSCFNQVDKRISVIEDSNDEIKSVIASYFNDKTGQQHLPECPPILSKAITGRQEVSGVTLLELVKVTSSGMGLGTSLREAKPKDGYGGANGSRKRLPT

SEQ ID NO: 966138 - protein, 280 aa, Homo sapiens
YNAEEPQDFSSPVVPLVLNCAPEDGQTRSDARLALTLPPWLHLDDPSARRSYGKVNQWTTQIPSTLSFNMSDKVIPFKIRNSLKLKNVIQVTLNCPRNSRYEQLREKKMAFQSSTGDPLPEISKDNSCKENCTCTSCLLRAPTISDLLNDQDLQHVIRHKAGSVSANGDRLAELLRANGGMSYDELCFLEEEATDAPPWKFYDFRNSQRTVGHAEWSSEGSTTRADVEDGYAHGGVDEEWPSGSVTKTIQALLEASILLHFTWPLGNVKQPRVTEGNVTQ

SEQ ID NO: 966139 - protein, 239 aa, Homo sapiens
MRTGEQQRRLNTHQISTEEEADDADDEMIDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKRSKKTVAAKKGKPSSDTVPKPKRAPKEKKVVEAVNSDSDSEFGIPKKTTTPKGKGRGAKKRTASGSENDGDYNPGRKTSKKKQEPKKTLCSGSDVESSLRFRVSTYLQTG

SEQ ID NO: 966140 - protein, 281 aa, Homo sapiens
MVSMPDAGALRRGRGEVAVRKPQSHSGSVLALPLRSRKIRKQRAKVLYPAWQLREDAERCLAITRRNRGVESTGLTIWGIALTRGAAVAVVSGLSAGEILTVTWGPQELLEASPAGVSLAQYPDLGCLVSVSVSARAPGVRCPPPPVRSVCETSGSCLCTRATVKLASSRPGPLRSCVWGRRWTNTGVGRRSGDSLLPGVLGLSCSAFPHQDRAASGPGLFEWLIAPMRANQFYRATYEERQRVLVRWEDQTEYRGIFTVTDSFCAKGDGRHIAPAYVREE

SEQ ID NO: 966141 - protein, 107 aa, Homo sapiens
RPAPCKLGAPKNAKDDKTMGEEMTLNTFFSETGAGKHVAPRAVLRLEPTVLTDSPGTGTYRQLFHPEQLITGKEDAANNYARGHYTIGKEIIDLVWTEFALGGWNQV

SEQ ID NO: 966142 - protein, 199 aa, Homo sapiens
MLYVSQGSAKVQPVTWCVCVCVCVCVCVCVCVRVSLSKEWFKACIGLKKKKNPKKSVGPQNKSPLTKIVWAPPRTVLAGKPESVSSDDTRRGSSPPGVGCCKGEDESSVVTERPPPAGGTKKFRAISLHDVRWGSKGVCTNTDSHTYHEGVHHHTKKIQRMTPGDGGGLQRPKVSIGTCPTSCGGRQQLLLKQIRSLDC

SEQ ID NO: 966143 - protein, 525 aa, Homo sapiens
GPPGTLISVVYIVRSATTTRPLAPAVNPEREGDLRANKGETEKSSHSVEWSKLPGFSHHAWQLLQVGQHENDSRSVTIKCELLTGCCKEIGIKATSHLRLPRTTSTESERLTEGYSYSLLNWQTSYLLHVGYPYVHAYPSEKLARTHTIPVEATERQVHSDLPYSAIRSTTRDLRAHCALCTYGTPNALRRNTIVALARDVPSQYMQPLMYHSTHFGLTCHKRAHLTCRANRSNDKRRTTEQIVREFLHSEKAHTGHAEQWIRDARQGIRHTKATAGANRNRQMEPKDHIPSIAKPKLPQPRCNPKHIAPALTKLHAGPLSSIGALVNAQGLITLNTGGLAIQLSHGARACCLTPLGPLQGTFRYDIWRNKTQRPSSVDFSPTPLRPGAHTQAFTSQNTLVRDTLQRYTWLTHSNREMYHKNPHTRGHHNNTHRTDTKTKGHNLTETPAGAKQQHIGREARKRKPPPRNNQRHAHKSTTTNSTHARNTRPPTPQHRQHQATTEVASTLPPAHNKHHRHTAHQATR

SEQ ID NO: 966144 - protein, 178 aa, Homo sapiens
MPTVKKARKEGGSGPVVSEKKQEAKKSGESPVGEKAKNEGIGQDIQSNKRPHPLVKWPRYIRLHACRVAFLYKRLKVPPAINSVHARPWTANSYSAALMLAQQVQSHETSAKRRMHETVVPGPRRRAAGQIGDVPTKRPPVLRAGVNIVNTLCGEQESSAGGDCNTTVDPIELVVFLY

SEQ ID NO: 966145 - protein, 135 aa, Homo sapiens
MAEIEKFDKSKLREDRDAREKIHCLPKKGLNRRSKQANRNEACAAYMLLYSSTRALPFLFYFCLAVELCKDAKEVGSSLNDVCCPFHIKELRDNERPRHAFPICLSYLGLAGNAKELANVGCKEEVRVRRTVGWD

SEQ ID NO: 966146 - protein, 425 aa, Homo sapiens
MKKYVAIKRGDDYMACPPSIAHIRREPVYIKSRRKRKGIEPHQSWYVKPSPMRLHDFDQKRAKKRKKQTHTKKQNNPTKNKRRRRGAAKEQPRVYCRTLRPRRTQKTNTLNPTRKHRGHPTARHTTSNPKTPHKRETPRHKHQSEKQPTGKPPDNITDETRQQKSREHNRRQKNEETKQSRDTQNQKKHNTDKTGQHAKENTKKPRETKRTQKNKRKKDKQQQQTAQNTGDNKPTAAETPHEKQKKRRKTAKKKNEKKRKRTTKRNPENKGRKKQRRKKTKQTKEQKKEKTRTEGPQGHQTRTQDKNQNKKKKEATNDDHNERNAPQQGHKQKQKQTEKDDRDKQTETEEHKNETNHEATRQQRDKGGERERERGRKREKDEEKKGKRERQRTRGDSKTGRGNKANTKTGRQRQARNKRKGAKRR

SEQ ID NO: 966147 - protein, 274 aa, Homo sapiens
VTASPQAGEKEVSEAADEVFKDIMESSPVLLSRTDQTSVEVTVACSGSPKKVKGQCLGTLLQLSQCHHSKAGSGAQGAQKGPARVQVRRHKHSSESPGGTGEIVQVKPAPPPHSSLCREGWRKALRRARARRRRGGSPGRTRHKATSLVDAVNSDAAKTSQTGEGLKKRVLPSTPKHRPPSRRGPNQASTTLPPKLHSRIIGPGERPPYFQLTYIASHITRVSLWKPASITADSSGAITNVNGHAHHRTRRAPNHTTSDTNDSSVIAEGRHNYK

SEQ ID NO: 966148 - protein, 332 aa, Homo sapiens
LAVRVNGRGDTGCAVVAERNVECYGGIIGILHHGIRARPASSEAMILSLSRTLAEARGVLMALTSSPGVTFTIEDESEGLLGTEGPLQVKKRMDEELIGDGMERDYRDHPRDWTPMRPRDWALDDEDVEELTARAEGSTESGAMRQGDREAGRGLGPHAPGAPDMTSMTRGRASALRRQAPARRSGPRSDSEEDHAHDETISNLADLDQDHSDGRVARGMEGAPGVAGSHIESHYTYPGAVTIGTAKGPQWPEQGQAPQAETDAREETEPQPRRRTESANSRSHKPAHQAGLSPSLQHPGTPLSRTTARGGPGARDRARTPAGRHKTHTVPL

SEQ ID NO: 966149 - protein, 68 aa, Homo sapiens
EKNGLMVIEVPCGFLLGTQEQQQQQQQQQQQQQQQQQQQQQQQQQQQQQQQQQQQQQQQHADRQQKYQ

SEQ ID NO: 966150 - protein, 143 aa, Homo sapiens
MQVTGPARSFHRLRTADKDPRGSVHDSGVLDGCGLGSSGASRCARPDPVSDSASQAPKGRERSPPWRGSADDRARAAWTLSRGSHLASRVLRGHGGGSRGSSKSGHFRFRSLAEARTEGGRVGGGGGLGRWSTQRGMRWFGPR

SEQ ID NO: 966151 - protein, 195 aa, Homo sapiens
MQICLGITAASNVPSGFLAPVFAPVGYALFDVAPYQESKWRQISGSAVHATNRDICMLYGWDCSFSTSGSYIWYGSRYSGLYVRSVATIAILCQVHQVLCIPQLDGRRFFVLDYFEPDLRLLQNPPGKPESGWEPGLERQRQLRMELLYRAADVLVQLPRGATGTRGGIDTGMAVLLRQDKVTKAAELSSGPSYF

SEQ ID NO: 966152 - protein, 140 aa, Homo sapiens
NGEGSDFAFLPVTRFIPELLRWSLQVTNGEGLVTSAGRVTGNQRITSAGILGVFSAGDSPGEAPSALLPRGNPCVSLKPLSCQGQNGLDQAVSVRDEALWLMEGSLFLQDVLRRSGQSPMKPFNSIIEHLSVVFPVLRQH

SEQ ID NO: 966153 - protein, 262 aa, Homo sapiens
VVIGEDCCHPGGEALQMWKMAKFMTPVIQENPSGWGPCAGSRVRFRDMPYPGVQQRRSGRKGCRLDREPDTKIRGTQISTPLSGWWKVRYAELSTEEDESSFQLVDTCALQQKTGYQLDIELRFAPEEPPQRAKIVGDMWQFNLQILPKSANTERERTHCDVQKKFREDEFGVQAEIGIRISSEYPVDSSVEVRSDWEVKEENGFSSVMKMRYLEVSEPQDMSVWGPEYYDKAFDRITTRSEKPLRSIRRIFHTVTTTDDLS

SEQ ID NO: 966154 - protein, 220 aa, Homo sapiens
MHSASNTVPSENAPGGSEGEFWGLLDALLEDEDFDWWANEVIHWPDITVVLRPVVVVYTAGSKVASFLTGLTQSTNRLVPHLYEPASVPVVSCREVKLCEKMASLMLMKFGRDPIEKGHRHGMRGSREEKRRPAEGLGEQGGGLDPERRGDVSSAGGGHGSTLVHAEYLVVIRGYTRPRAAIPACRGPAQGLKPHTAQSRRKTSPLHLGSAVRAGKPAHS

SEQ ID NO: 966155 - protein, 307 aa, Homo sapiens
HNCYARGLRFYIGTEDLHGPCGTACSLDAWSCGACCVREIRKELKLNGGCYENLLLCATTDLVCLHACVPLEMLLLLCVLLLLPASTCCTMQLHVMLHCPLWCFPDPVLATQLMAPQSPVCCGVPQPASVPTKPEPLWLVPVTNAQFVPVCWPDTVLTRHVGVLCMDTIESRNLIMPTCAGQLKGGPGQWLGLLAQGTKATELFCHVTTVRNANDLDHSIPATCEAPALGAALHSGLVVNALEEPYGQWRPAYSNNTQNVAHVPLDHLGRDFCWRRHGWTYTETQGLAVATQLFTRMIGKATAGMGP

SEQ ID NO: 966156 - protein, 251 aa, Homo sapiens
MCDAAINARPHKVDGRVVAPQRAVSSSKILNRSGAHLTVIKDIFALALHKTLKNITYEIILCQYGPIDVIELMNVTEACGLEKGLCLCDLLTTMTPEIMIVIQNISYCELATSVNVRKQPVTARDGLDASTPDQRGRTRGFLVDFADGRRESVRAQMTAYGPCEGNSRRIDRWAPGGHRDSWCDLGARGDVISICDAWLHMDGETKKFGFTQSAQIWPYCEFAQLAFHGTFTPTSLAPHIWANTPWETKNA

SEQ ID NO: 966157 - protein, 98 aa, Homo sapiens
QENMVQKLTNQKHKLLKGIELGSLMDNEVDLPIEDINQNVLLMTPPDSDSGSQDGYSPYSIDSEPGSPLLNDAKVKDEPDSPPVALGMVDRSRILLCV

SEQ ID NO: 966158 - protein, 297 aa, Homo sapiens
APPRMGSPVSALPSLSGALQGASRRDHARPVSSRLVLLALGPLAWWPSGRDVVSLRACRVGEDSCLIHRLYPRRCGTTWCLVGVTFIAWNIDEAHGRCPSFVVFSHEHVETCNAMPRLEQHVRHQRCAQGSLLESNLCVSVIHQDSPKRRNRAERDQPNPPYPKGSLGGRVDARPSPVASISMERIQAKLDVSNRMSRVSDYTGLQGYWLGNFHPLTFTNDISVRRLERGEGKRIRSPEERKGTLSVNVSLASSFFHRQEGTDTCQYERPPVKDESGRFTLSTREFRGIRTSAFPFL

SEQ ID NO: 966159 - protein, 116 aa, Homo sapiens
MCKDYLSSKAFKMWPSATNSLCSDVGANEDLNLELTFKQEAEPKSWEILQPSQVVKKKTIFSKEFKQAVEQPLADICILKGIQVVISNDKWGKGLKGISETYGAAPPVIGPEAKED

SEQ ID NO: 966160 - protein, 239 aa, Homo sapiens
MARQAQRSTTHHPHLLGLPRRHLAAPRHAPPSGPAPPSCLPGRPPRLSRTPHGFSPPPCSLPSLHSTGPWNAAPCATHLTWPPPDQPLWPSPRGHPRVTPLPHAFSPLPAARPWGTHRVAWAPGPGPNSVRAHSPRRCRPCSPLPQSPNGIVYRTTKQPPAPTLLPLNIPPPHTLLKPPLSNLTITNLPTTTLHPLPSPTHEPHKHLNHSHRPPPPTSPPPTPHHIPLTLPRHPHPSPP

SEQ ID NO: 966161 - protein, 53 aa, Homo sapiens
MSAGVSSMTLGRNKDERKQGPGGAIISLAYEHIWYPNMGTPGNMKDRKAQLLA

SEQ ID NO: 966162 - protein, 268 aa, Homo sapiens
YCGRERGVGKSRDFGFVPPGAISPPFYFAGQNTVMGRTKKKQLKPWCWYCNRDLDEEKILIQHQKAKHFKCFICHKKLYTGPGLAIHCDAWYIRETIDAVPNALPGRTDIELAIYGMEGIPEKDMDEQTRLLEQTTQESHTKRSNKMILMTYDDDRLREPQALISATDLFNLSKVIFLPSGHSRTSTSTRSTRNASRHTSIKCQVVPPLMPRNATSYARLATWTCIIQRKYTQIIGGETHIDGDGWNDCTLDGKYRSDCLTFHSIHQR

SEQ ID NO: 966163 - protein, 66 aa, Homo sapiens
MTRRRLLLHAVDVPGIRQLNTFCHPSSVVDPHSTLPRHGTTEDTGACTINTTHERDASLTYVYVVH

SEQ ID NO: 966164 - protein, 302 aa, Homo sapiens
VIHLHEPSLDFLLGFSAGTEYMDLHGMDLGQTALHLAAILGETSTVEKLYAAGAGLCVAERRGHTALHLACRVGAHACARALLQPHDPGPLGEGPPYHLTSAQDPKRSTRKQTYTLSGLSNPDSDKKKEEKESEEDLEKTCKAERLKTLQVGAKTESDVGHNRIKRLWRWSGGSEDAGADLDKIESPTDASGTPYIWQRRTQAADVTGASPEGRRNPADRIVLESYNVTARANRQKAHESQTAIIVAAPPEQDEEPRESARSEGTKKILGPFNKVVRVKADRENKSVSQSRRYRATQWRGKE

SEQ ID NO: 966165 - protein, 313 aa, Homo sapiens
WRRDRGPRGWVLSDEAQTASEWGWLATRSCHHAAASSGPSSRHELGRAFLAICPCKCSSSPFCTLLDSLPDITKRLPPLTGGLHHLVVVDPIVTPAAVACRSFQRWEISCSGILASRYKTPPSSQGLELGGSITGLKFNPLNTNQILRLLNGREQLCCKTLKATFYEFYASSDTINIWFSSLDVSASSRMVVTGDNVGNVILLNMDGKELWNLRMHNEDSDACGSLNPCCDWFLATASVRSDQCKFGTLRQSLEGKGSFLYRRLPQQASCPNAACFSPDGAGPDHGPKSETELLCFQRELPWADPDLNVFRLK

SEQ ID NO: 966166 - protein, 103 aa, Homo sapiens
MEKNRNSREEIKQKTIEKQGTNSRTARRGQKRHTAQVQEKNQHRKPHMIPRKNGTATSAKGKKTRTEKWEHGENKTRDKKDTRKRDETQETTGNITGKQKRII

SEQ ID NO: 966167 - protein, 303 aa, Homo sapiens
MCAAMHTENCAAECVLRTVHCWAWLKAGSSVDEDWYKQLWMCILCMGLGDHGLQTPYPVLHQQLPQLFQDEINLCCLKEWTGGMCWVIIVAAPSSCYVDYLGQLVLCLEHGQPPIERKVIELPNIQNGRSVPSRTAACPGTMIWANLTLYRLQTYLDSIGLVLSTARERFLGGAPVKTLGFGPRNSEGSLGEGCMTAHITGYSNAALENWAVDHHGSSRKTRWHLAQMHSVVNATHTCRNTIRNSKVNKAFVANHMGNKEYHETRPLRCSGNVHQTQRNCVQKVNIVEVKIVSRWMKGENEGD

SEQ ID NO: 966168 - protein, 58 aa, Homo sapiens
MLGRTIMPPDLIRCSPNVDFPQEQVTASLGGIQEGAMEWSRLKPEQALHTLHGGNAGA

SEQ ID NO: 966169 - protein, 41 aa, Homo sapiens
MGAKTGGTSNITSRIVDSRGGPIPKEVVSGQPTRGPEGIPC

SEQ ID NO: 966170 - protein, 80 aa, Homo sapiens
GETAGWLKWTDGIAERAALEELVKLQAKRVRGLKQQKASELMRGGGNLNEASGSDESNRNLCSNPKAKRLCPRRWIARRC

SEQ ID NO: 966171 - protein, 75 aa, Homo sapiens
NGSLQKVNVGVLGPQRRGHFPPGPPNEGLGLRGSRASSSRQRELPLLSQALFWRLTLVPGECAPTTSLQTALITP

SEQ ID NO: 966172 - protein, 138 aa, Homo sapiens
MIPKVEWSGVPGGGDNLRLIQVLKGPVEGYEENEEFLRTMHHLLLECEKRAITCFPGTPASRTEASSAQHLYTSPARMVEVIAGHPAVPGILDVCSPSAAGIPKQCLLSEEETEQLIVPVRQYILVMTVYRSVDLYPM

SEQ ID NO: 966173 - protein, 65 aa, Homo sapiens
MEGANLVKTSGNKNGETTDPGDGPIKPGGHTEPQQLKKARRATRQTTETLRDSKSTKQQPPNKGK

SEQ ID NO: 966174 - protein, 323 aa, Homo sapiens
VQTGWWNCPGERSVYNAFDSWVTPDQACGQHCLLSSRVSCFFVSSEGGPSGIGSSVGAWAPLTSIDRAWTLALHLIHRPFPGPKLGHDRVAWPLGSLLCNCKWFLNPQSQLSCQTGQTGVRETGPWPCGVVAGCETHCPRHDTSLSSMEWSLTEAGASSSLNFNPFKSFTRNLVGANPQQKGVKERQIHDLLVGWLPVGADACVTPGDTGPRPCEDSGPGLRSDLPALGDGNGGGRKAPPQPGAGNWKCRKWPPKRERPALNPGNPTYPARRGPTREVGNTAKPEKPIPMPGGGLAPPVDHEGVAVGREKNAEPNSTVTDTTE

SEQ ID NO: 966175 - protein, 273 aa, Homo sapiens
METLNEGLAPAGPEALTFQKCVMSVTQNRKLDMTNYCMDDLTGETEYILARLLSSIPWVVPINTDLCLTDVFELQQRGGGAPKNPTSSAGTMSQTPVYRYVLNHEGRPQDHPKGRHTWADAVVALQGDGPLPAELEELRNRVRAGPKKESWVVVKETHEVLDIAVPKVLEQDCSDAGWKTEKHQLHACLHCRGHMAPVSRTEGLVSSPRREAQSQCMNLEQDPLGHRQRQWHRQLHLSLRAPEQDWPVPHRTSCNPCNCPVHMRPATGHRTFT

SEQ ID NO: 966176 - protein, 49 aa, Homo sapiens
PEEGAQQQEPKSNRIGKREGGDKKFQKAPVTAISNPNLQEEAIVKLVAP

SEQ ID NO: 966177 - protein, 250 aa, Homo sapiens
MTQAWSSSCSPGHTPRCCCLLLPGGHACCPSSLAFQAWALAGEGWKRALPGVPLGLGLAIRVRACVVVSGLARPVCVWGGVKHAAAPSPRGAEPPGGRLPDGVPPAFQLQARVPGNGPAWRLLRRGMFVQQLLSRGYGFDERAFGGVIFQKTALDPAVGWALGFMLNVTNCSPPTAGLGKAQLQLLVVSAVFARACWLSCCGSSSPVQTTWPGRRQYKGRTKSTTQQNSLPGRPKKRRRNTIEHERDSSA

SEQ ID NO: 966178 - protein, 512 aa, Homo sapiens
PEHSSWIEARGVLYSRPTDDDDDDDDDDDDDDDDDDDADDDDDDCDDDDDDDDDDDDDDDDDDDEDRDETDDESEDDDRGGAGGSEGGRRQAGSQERPGVLGPESETGARSCARRRPARPPGAPRPGRPLHAEPAQLTWLKCVTCADVTERTPPPLPFTKPQVFESDCILTRPIPYLYSLPPHALATTRCAITAIPMPCSCPICRAVATRRDARGPIYTNKPAHHHYIYVLDPSPPPLNSPSNRIALLSAIRHRTNATGNSYMFCYSDLYMNLQTYNLVIYVSLSTEHRTRTEIHNLISYTLPPPFSVYPQRSGSGSVRSQLWFGLRLARSGQYAFRFGSVRFRSDRKRIWIAYACFRYLSHVPVSTLPIPFPSRSVPFLCIPFALESDSRSARPPRLMSYAVVCREQARRMSGHGKGRGKRCVRLGLVSARLKILVGSAVARMFAPPRCRDCYLFSRFCLFRDAQRRAMASGSGDSIGRCPYLCTRCCIRLSYTSHHSLPLVVLPRCPHPP

SEQ ID NO: 966179 - protein, 317 aa, Homo sapiens
MTGNSCTLQAGSVLAHHASSDQAFMATADQLTEHGIEPTGTYHGDSDPALLAPPSLLLLQLNATSVAKYASLVPSLAAISKPAAPTGPLLQLRLHLCATTPLSTTTHSCYSCVSHARARLTTCGPNGTLHHDGSPKPGLTYCTLELCAYGNGRAAAEPRELSMQGTYPACTTHPLCAGGATAHLRNCGTSRSITQRLRRKELPCILHHCNTIQVLVAIHTNKCSEQPTEHQTPPYQMPQTLIPSQSRKARRNIPELQHPTQHLHQRKATPTLTHSYAYSKHLTQHCPNTESLPTPTLRDTHNPCDSYRPTHSTVALD

SEQ ID NO: 966180 - protein, 84 aa, Homo sapiens
PNHDAAAIEGTDTQLRWEKLLPHIRVWAGTKEDLTEDSGTWLANKVPAAARACHAPCEVTVPARTLGSPGVPRDRPPFSRLYGI

SEQ ID NO: 966181 - protein, 463 aa, Homo sapiens
GPTRVYLSFPRSKSSEPAKRGRTALGRDGTEGLLRYEKEKGFNESSYKEFYQDDELGKKLVHSMGNTVGSGMELYAGTRMDSVMWTLDDVAEDDPELAGLKFGENCQGYVEAHMAECAYKRLRASDTRRGKLDKEEMSWTYYIDGNRANCLEGSGDRDPGDGSESSRRTRVALLELDAQDLMVVIYQGLRRRETRPRGESGHSAGAWTPVEERLVNLCVASRSSPWFFLERSKPQGMRWMGALYSFVEHSGGVQENHNSRVPDLPQLLHCLRDHGGTKAQCRLAQKPNRRPRERSGLGIHGLNHRGASQQSLQNSPGRTARHGQEALARVKCRLCGRKNPSGRHTRGRRQTSGGHTTGEVGPKAVRKETALEGSPGGYFTWAKRPGGKPGENPAQGWKHDGSTTGETMTLDTHSSVFKETTEYDRQTSGGRKQHESKEYPHRQEQKTHSRHNGEEERGETEKD

SEQ ID NO: 966182 - protein, 48 aa, Homo sapiens
GEGMMHLGKRPNPVEDLAWRSQMLSERSVSHSGITDCWHSRYNILLIS

SEQ ID NO: 966183 - protein, 257 aa, Homo sapiens
MARRIRDAVSCVTWRLCGGPCALVDVPGHSLSSWHAYSPPCYALPCVPVLARMCWRCARCPSSDVVPDRCVDVRAAGGTLARVMMLDLRGCNSPALGGPLRKAGDAGCVFVLMSLCPCALGILQIECRIAQSVGWLGRTDVVDTNSNQVNKPVACECAIDRCQLTLGVKQSHSWVSSGNEDSTLGLLEAPGQPLESGGCFPGVRFPAPAAYFSIGATIGCRFIRGELLFTTAFGLRGPNMHLCSPRSLGTHSFDSVD

SEQ ID NO: 966184 - protein, 40 aa, Homo sapiens
SQFLYQLLMILLRVPTDTEGHGALSISPHQQKSRFPCRLS

SEQ ID NO: 966185 - protein, 99 aa, Homo sapiens
TTNCNRIRAPAVNTPRPDGDDDDDDDDDDDDDDDDDDDDDDDDDDDDDDDDDDDDDDDDDDDYDYDYDDDDDVRVSHQRSCIVRCCCCVVSVFVSVMHD

SEQ ID NO: 966186 - protein, 293 aa, Homo sapiens
HEGRLYCRATDASDNNRDRGDAYYDATDYRHSYEYQRENSSYRSQRSSRRKHRRSEEAQNVTLYADSSYDEIVSTLGEGTFGRVVQCVDHSQGMRGLELALKIIKECGEVQGIMLDYEIKRAREISMRIDPDKQEASGVQMFDWFDYHGHMCIILIELTWALAALPSFLKRPSKPTPDRILASPPRCATSGLPAVPGCQGSSSDNKLTHTRPQWLKSILLCELHDYELTYNLEKKRDERSVKSNRCAGGETWAVPTWTMSSHSTHCLRLGDYRAPEVILGVGLLTGFGHEVEY

SEQ ID NO: 966187 - protein, 111 aa, Homo sapiens
SNTWSTVRVPLRYLRSVTRYLMQYITWPADQYNVGASIYRCSVSNEVSLTLSCCYLHKYRLREQITVEADKESDYESKMPISRRIYVMLEIRHSNGQGVIQVITPRIPCVA

SEQ ID NO: 966188 - protein, 457 aa, Homo sapiens
QPPLTNGTRTHALPRRQTARPHTQPHADLLLPPCTRPARASTRSTTTRLSPCAPSTRTPQHHPTHLSTPPRASACSATHALCSYLHASAHPTPPAPPLLPPPLPPGTALPAHTHLHSLSPCAPAQNTPNTHRASPAPLLRAHPTTPCTALLPARLTRTAPTPHTPLHTRVLLQHCPPACTPGPGAPRPRTPAHFPSSGPPRPAPKRQLPSTLFFRSPQAPCAPRCATLPPPHTRLCLAAPPCFPMAPLSQTPSLRPQVSARTQAAAIPAPHFSPAPNGTPPKRKPTLTNQATTHAQKPPLTPPRPLPNRAARGKAFQKAAAPRNGPPYPWAPRPCTGPTTHPTLTRPLGTSLSVLLQFNTPTHSPLPLHPTPPTNPAPPRRITTPPRNAPHHNRHSTDLPDTNPRRRSPAHVGPPPVAPTTQGSRMVPPAPLPPPPPARPTPPDPPHPTYANPDYSH

SEQ ID NO: 966189 - protein, 78 aa, Homo sapiens
IHLSTPRIPVSLSPRKKLENDVSPLQSEVEEVSKNHAMQNEKAKKAITDAATMADELKKEQDTSAHLERIKKNLEQTV

SEQ ID NO: 966190 - protein, 143 aa, Homo sapiens
NVEEITDFLSNFDELDTLRSGYRRPDLCWKLSVRDVTKTLAAMKEQNGDVKEAASIVQELLGGKPTSQGNRKSVLACTVGANEDLSSDCERITMRRAQIDQLDNLSPRIGPESKIQSKLESTYYHSSEFCWHDMRDPICLLGR

SEQ ID NO: 966191 - protein, 285 aa, Homo sapiens
VVLVAQCCSICWVPQSSWRVFKPAQLCLCDSSGPCVPPNASCEGNTCPWDVALASASVMDGNGCPHLACWLPGGRHLGPHLLPTALKRQQQQNWIPGQWSWDSLQREGLSPVGRRGGGVAALQLPRAYNHYSQGSDLALLQASTSHTEPKSNRVLTMEPKPWTQYDVSHVWDAMPCMVGPTWVMRDSSVPPRDDLHRSWRSRSGQLRAAPDGHQYEIRTARQLLSKVGSIVTGAATRIAAIAHAGSKNLLLPRDRALGAHGDTPVVNLPIDGIGGGVPYPMIALQ

SEQ ID NO: 966192 - protein, 151 aa, Homo sapiens
MPACLAIGAGREGTCSLALAAEQGANPRTSCAMASQCASPRTSRLIASAHAVGVPCAHALMSHFAARAFQCPLRSCPTGVGLHDMPPGGDECKYATSLLVQSARLEARHTVPCALRVSIIAPVSLLGSSPNTGCISLRRVPCSRCALILGE

SEQ ID NO: 966193 - protein, 130 aa, Homo sapiens
MRTAGNTRGDRGPGKPLVEKKRALRINESLKELGMLLAGPRGAGPKLENSRKCLDLERGERAPGCWLRGQGRAKRKQLQAKTKGNASMPGNTQCMSRGGPRSVSPCQATEATECEVPEAIGPNQAVVRGA

SEQ ID NO: 966194 - protein, 77 aa, Homo sapiens
SSVPCKLGLDWQYESLDVKAGPREPSDLMGNTQEVSRKVTYTVIDRLCAAKRAVATSAYRSFGVGSSYHCEAEFTKL

SEQ ID NO: 966195 - protein, 272 aa, Homo sapiens
RPLLALAGGLLRCLLLLLANGGGVRWGSRAQDAAAASADGPPAADGEDGLRTRTASTCSTGLTCFTHRDPLAPRHFRYMFFAPMVVVTSVQSAVKPNFGNDLRRTKYNSHCARCPRVYGGIKRWTCQRHVRACVRTEAGCSRIAPTLKSFARASGQVELLKLPGVLWDFQNTWKHWIAAEHCNVGAQCHQSPEGGTDPVPPRLKQWACMSSQASNFELHVVQGDHVYQVLRSVLVVTSKSSWFQAVEQLDLVPVNIPKAVNDWASVDCTQHY

SEQ ID NO: 966196 - protein, 39 aa, Homo sapiens
MHTWLLCCREETRLVCMCLGVSLPCPRVSAVRMTSVDGH

SEQ ID NO: 966197 - protein, 266 aa, Homo sapiens
MEEEIAALVIDNGSGMCKVGFAGDDAPRAVFTFHRRAASAYYSGRPWWAWCLEGLPSVGDEAQYVEAVDILTPEVSPLESWHRRSTGTDMEKIWLHKLLQLRLRVVLRSEQPQVLLTEAPRGTPKDQTREKMTQDYFRDLQLAPGACTIEVIQAVSCPYYCRRGGGTTVAIVMELWYDRWSSLTMVPIYEGYALLYSDSGSGAGWRELSDQLMKILTERELELHHLWASGKSVRDMDAHGVLRSAWMFEAGDGQRRIRAHSLEEEL

SEQ ID NO: 966198 - protein, 97 aa, Homo sapiens
MTIDYERVCQERTVTDQDITRFRNSLKELQLQKQKVEGELNRLKRTASEDSCKRKKLEEELEGMRRSLKEQAIKITNLTQQLEQASIVKKRSEDDLR

SEQ ID NO: 966199 - protein, 524 aa, Homo sapiens
LSRRSRASSTVLRRGWREGPLTEIANGRLTRQPGPVIYDETARNHGMDAQTDRTARTRMTTTEEGHYRPGGHDTENTRHHPHVHNEQAGKGLLRAHGRSRCYTPYMTHREESPHSTPHANTMQTRHSYTHPKGQHIANASKHMRTQRPTTDQQADAADTQKRESIGQQTMEYEPDENRSDTRRNTQRIRPTTEPRHTQAEATRTPPTATQTNHEQTRTYTYKGPSTPAQRRTKKHHHRRDTGLHPPNDDHKRDTTQPPHCQHKPTTPTHAEPHTAMHATDRRVAGEPPTTETPHNHTKNTHRHVPTTHTRQLRTRPRKRTRGRSARTQAPHDQPPYTQHKPEDTNCHTPDRHHDRHPPPTAQLARPRPPKRPHRTTPPPHPTPRHNSDPSTKSTDTRRARHHTTPTDDTNRRTTPRTQPTTNTPALPTAPTPPTHRPDERSTRPNTRRRHNHNRRPSQRATASHDQTQRELEGAQHHPDDKNEATHKQHSASRNHTYNHITTQQHPNAKHKDGPNQTITDKQKI

SEQ ID NO: 966200 - protein, 76 aa, Homo sapiens
MAFNSNNEQRTALWKAGFKGKSKPNLLKQETSSLACGLRILFRMYMDESRVSAWEEVQQRLLNVCSEALSYFLTLT

SEQ ID NO: 966201 - protein, 339 aa, Homo sapiens
MPSDQDHVVEGDDSFTTFFCETGAGKHVPRAVFVDLEPTVIDEILKWPIQTSSSTQSMLITVERGCLLNNYARGQPIIHLVIWRSIDPVAGIGILSSMSDRECHSDIRAAIHGLFPQTLSEWALGSWLHPHVLMERLLSDYGKKSKPGEFSILPMLPQVIYRPAGQMARSKRLVLTTHTTNPCAVSQNVCRSLGWDRRSIVYDIVRARDRLMTSSAQGYKRMLKSGSISQNLSSSDPRDFSCAFDGALNVDLTRKFQTNWCPYPSHHVPSWANYAPSRSLAGKGIHVAAVGGRDHQWPVLKPCNQRLNVIPGTGSLGLLLCPGNWGHVEAAWRIKRDSL

SEQ ID NO: 966202 - protein, 66 aa, Homo sapiens
ILLNPDYVRDLGYVVEGYMALYETEDGVPDNMKGKDKIVFGNIHQINRAGTETLNKVELEKCLEDP

SEQ ID NO: 966203 - protein, 131 aa, Homo sapiens
MMDSVLFDEQRHCLTMLSNEELRGKYSYRHAEPSVVSVGDAFADTGVLCAPQHYVPEMFPIRWAIMQPAKQTATGPNPWKEHWHIGGTAHDRMGLEFSSVRIGIGHLPLTYGYATKGQRIFLRLRDGKAGS

SEQ ID NO: 966204 - protein, 222 aa, Homo sapiens
MAAAVGVRGRYELLGLAPGQVWLLSSFRLAVVWRHEGPSGDYATGDRHGGRRKSEQLVDSPIELATHPHDLVILLRQEAAVNLPQRIREAIRLLKKFSIEENEGRGETWTGDRDSNHRTTQTAVKGKVPVSGTWIYTDGTYITLETQRHQSVNDYIDTESPVPPDPEQPDGTKNSRTSSIVYMRCQHLRGVQERVNLAAPTGTLTEDPIFNIFHRKRVGKES

SEQ ID NO: 966205 - protein, 110 aa, Homo sapiens
VSVISKEESSCWTVSGTPCREFRSRFREEKEPVVVDTVEQKKEPILVVSTFTKPEHTHTPEDLQSRMESYVKEVFGSSLPSNWQDISLEDSRLKFNLLAHLADDLGHVVP

SEQ ID NO: 966206 - protein, 376 aa, Homo sapiens
DSRSGSELQTLGQAAADHPRRARDTTSPRMDPPIRPETPELLLPEADAQPGAPKDSRLPGVTCILIRLGPGTPVSLPGGGSQGGTSRSKRFRPVQFEVSSGFPMMPDYNSQSHDSCCECAEDWPPRGPQKPDGATRAHPMCQPPDRGPPQWKKTQGKIGRCVGHEIVVIAKGTSMWSAKGSRIGEETMRVNGSDKGHSGTKTEVDRGYWSSIKVNPTEQVIARPTMKARGGQRECATSITWLHAKGWYAPPGRPKYTGAGEAKQLKNGIPNEEQTPKQEDKIEHKETKTAIQKTTRPVSNEASRLHMCKAIQPGRTPRARGAITQKVRAIDSRTGDPDTKVIERTSHAGGDYGQSGACWLQCRKRKHGSHMGHSGG

SEQ ID NO: 966207 - protein, 111 aa, Homo sapiens
RRDDINLYLVRGTASADFPLTLGKPVARNRMVHSKVIVDGICVNFEAELPSLIHRRGIEKIPWTLEVGDYILTPEMCVERKSISDLIGSLNNGRLYSQCISMSRYYKRPVL

SEQ ID NO: 966208 - protein, 471 aa, Homo sapiens
SGAVGALLLALRKRGVLSVRRAECWAVTWRVLMAVLCPSALMCDSAVMLDACCAVLCNDPLPHSVMCCAVCCDVLLLWMLCVLPAPCVHCVAIVQLCDLCACLTAPVCASCAPSCAYCPCCKPLSTVLHVCALPECVDAVPMTTKCDDVIVNLCCAAIVTCIALVLTCCALNSFAPSIVNQLMLAMLAAVLMHCRLPSACFGCDDLHCAQASHGVLPDGQTTRKTFHVTNICCALSPFLELQLVCLVTGLLDFVRNLIACCATPAQVTDPPHVEHDEAQLGPPVRTFNPEYGHDIHTLTRTDIDTALPVGLPFMGQPSWISLPLALGTALLFRKSFEAARRPPKTRLRQSRGVLGGTTQNLLQAFVSREALGQVHPARQGAKRAKRHTHYLQHHQATTTTTEQKTNTTSRQRTTQPSHPRNERAKRHGRSTHDTHEKKTAQEYDAPHETITTGPTQTGKKTNEQGADEARH

SEQ ID NO: 966209 - protein, 204 aa, Homo sapiens
CSLWTDPTEDDEKLIEEIQKEAEEEQTRKNGENTFKATCDSSDCEKACGEGARGVEALPRIRIPAVDLTSSQQMLTLCLSRHPSSFRSLILRRWRLCDFNIEFSHLLNDGGTVIRRASVNVVAALLSTDDGRGCRTKLTSLGFPNAQKYEPLVDDSYLVCTIDHYMRNHAEIRPGEYEHFLELVTTSESTPPLWKLVEQNRTKG

SEQ ID NO: 966210 - protein, 33 aa, Homo sapiens
MKAHALRDNSIHGSILWRTKAPEIDPYQPIVQT

SEQ ID NO: 966211 - protein, 47 aa, Homo sapiens
RTRSLADFERGSDRLPVQSSGMTQSSAHTWSSCMITSLEQNLIQVAC

SEQ ID NO: 966212 - protein, 297 aa, Homo sapiens
MATWQHYVQEGRIYAKTQQASLNSPHSTPVPNPEAESSSKEGELDARDLEMSKTSQAFLQRGWRPWALHLSSTQAARSCIWHSRWLLGAEDLYGVSPVVCSKLTEVPQDTCKCLRPRSDSPWKSRQQPRKQNTVENEEQCKHILENRSCAEWAWGHELASEKLLSKLEMSRADLRGRRGERHHGQASHQTGHGNKATYHMREKDTYRDHLTTGYAHRKKEQAKTLADHATPGRAYRPTRPRKLGENKTETEGTHHKRRHKHRRTRQRKNTEEKCEDRLHKQASNNGTQKVAGESRTT

SEQ ID NO: 966213 - protein, 72 aa, Homo sapiens
PTLDGPDLENPCEHRHPTDVTNRLRQNELTYYCCKKDLLFTLTNPLEQWWDILITENSSSAGDSISGNSLEP

SEQ ID NO: 966214 - protein, 298 aa, Homo sapiens
EPFAEERRTSVGMAPSGGASWSDKQELEELARHGLWIGALAEGCIVEDLTGVHFLGGGELCPILRLFPSLVPSVLLEQAYAGAYGLHICVDGMHVETERCPSWSKLFPRTINNRYDIYLLSHLGDDRTKQVSEKRALARTVFLGRESVRLDVSNAKRQMDHQTLIIVMRESNEQSLRSFGGAGLGRTRAVHRDVLSVLSEDQPKLDRSSLIIAVEGLDLGMAKRLGALRSPNALADSDSSRDGTEAIFDQASANERMSYVAKEHPCDPMNIRGLSLKRVLDQHEGVCGWQELGGNSGC

SEQ ID NO: 966215 - protein, 158 aa, Homo sapiens
MCILHGKLESGPLIQILKLAGGQISRVGYLGDYEMIYFRGQRGEKILLRAGVTAGTCLHQKVAFVNGNARSCGNKGERSCGRQGYELRTVARRPWKSKTASKENLTKEALQERAQLLYEDPPVSENLTQMVETMRTLKICSLRMWMGFEPGISDMHED

SEQ ID NO: 966216 - protein, 46 aa, Homo sapiens
PTNHNTYRYRMGSPPPAVSNNVVLRLQSVSNIVMPAARTVRDRRSK

SEQ ID NO: 966217 - protein, 46 aa, Homo sapiens
TAVHLDILIVCSRVLPGVSLSATRMDSKLIRKISATLWTWSSVSVE

SEQ ID NO: 966218 - protein, 324 aa, Homo sapiens
MGHRSWTRKLMLSPEDARSSYESSVGGGEGSQRTSFLKFALYCGFWYSRRQARQSSVQACLETNEVSEDGVLVVLVKLSPYVAPAVFTHCEQVLGEGALDRGTYYWEVEIIEGWDQQMGVMAEDFSHTRSPTTASGWAAMTRVLHAMLGGKWTQIRPSGFMGWRLPCPSPFSPTGGVCLEYADRGLAFYAVRDGKMSLLRRLKGSRARRRCASPDCPIEAHSRGRLGKSSLEGLFRPEDSRAALLPVRVMEAQLGESGANHEKSGNIPVLRRQGIPRGTGQGRGRSGLWLQLKGRTNGGHSHTEEKGATLETEQPGHKVVKGTA

SEQ ID NO: 966219 - protein, 53 aa, Homo sapiens
YPPGASLAWENSTPPRSCSGQGVPLSLSKEIHKHFLPLISHHHHRELLSGNIA

SEQ ID NO: 966220 - protein, 301 aa, Homo sapiens
CPVGTPVSGGMSFTTRSTFSTESTGPWALSRRPVYGARLGQQRGSRLCRRWVALVARYLLVSRSTSFSGRRVEVRGLVCHRSIVRGVLAGMGGISELRKETMHKPERPVLARLNLDRVRSLETEIRRLDESYNRCGASLCRRTGALMIRRRGSPYTSKSHRRDLRDSNLSQDTCGPMPVSVLQIDNARLAADDFRSQSMMTEPGHVDHSCGVTTVHGAPTKVIDDTRYHNDQLETEIEALKEELLFMKKNHERGSKKAYKPRFASSGVDRGGRMPPKSQDSPKIMADIGPNMMSGRKTERS

SEQ ID NO: 966221 - protein, 65 aa, Homo sapiens
WGEAVLSRKVLLDGVQNPRADDLVWKSLYVSATVILHSCSDMVQAERSGIPICRPLPDQIHFTNA

SEQ ID NO: 966222 - protein, 321 aa, Homo sapiens
PRTDQSPRAAASRVSTYVPAAVAAATMPKTTTAERGLLTGRLTRNTVNGRTTDEDPRGCLLNLLLQSQSPSLNKAPANRTGEKVPKRATNGKTLMLARQGNNPAENWQHAKTDQAQKAEGAGDAKLNAVCTSPTTLCYSLADCTASNNTYPIITAPIHTTASNFSLLNPSLHSLFSHHAIAASQRHTTAHHHSTVTASPRGAKRARNTSTHHTQPTSAPPTAAQPLRKARAHTPPLTTPILRTTAARTSPINRAPHPRRGRRRRTIPPVEPYHDPTAKLGPPPLNRATTSTPPPKESTTTHRKHTPHKPLRPTQSRNTNRM

SEQ ID NO: 966223 - protein, 252 aa, Homo sapiens
MPVARSWVCLENLCEPRGEPSRNLVLETMQLRLYGEYGLRKKREVWRVNIYPGQDPQGRPGTADCVACREDPTVQSDSEKSILPVQQAGMGPAVWGCMDDRQTMNDLDYNRFVALTNGGIALYEYGLLGTQDLHSWALTQASDPTYASRRCIPSRRQLLTGSHSQVVEQSSAHCTIGPLVAFTQEANDLDFFILTATSTKGEWSDRADVKMDEWHRNGGQGWVLVAWPTTDARRHNMSNHVTSLAAAGTLSA

SEQ ID NO: 966224 - protein, 379 aa, Homo sapiens
YLSSAAPEHIKQTGKEESDMAQSHPELLLADNHDGARVSPAIWHCTECGTGTVLLISQHSSQVRHVLGSVRPGEANWRPQQQVDVHLPWCQIQLSKCMDAQSFKPKGGYVQVAEFPLHLVLECHLGTIAPDVFRTAYPAPQALASGRNSRPREAGPKPQGPRDTTCAASRAQRGSACLQRELVSHPNHWTPNLHAPLSTLSVDDQRREPKKRNGRRAIHPEDTSGTRKADRHTRLPPPQHLRNGAKAPDNEIAIHNTAPSHTPDPNKHDHDCMPHNNNKPNADHIHTSPPHLGQTPGGTPEMGQEQATATPTGPTRTHDDNRTERHSAHTQDRDHAPKGPPTSTHAYTPRASNKQQPTHETEPQPPEKVHSTRDQTHER

SEQ ID NO: 966225 - protein, 115 aa, Homo sapiens
STEREDGQVEEERGFARGRYPEASGTAAREVGLSPRPRARSRVQGRKKEGEEKERRRKESKKREKKEREREKEERKEGEKKEEMKDNRIDEREERRKKEGERKEEEEEGGEKEKR

SEQ ID NO: 966226 - protein, 131 aa, Homo sapiens
MLRCFCGAITYQPADSTKMCDAGAGHRVAERTRRRSGRRRPPEESQPPQSQSQVPPAVPHSTSPPFALGAGMISRYYRRAPRLGSATAGAKCWERVAVQIVRYDRFDNITKSTPQRLFLTAEELSLINGNG

SEQ ID NO: 966227 - protein, 57 aa, Homo sapiens
MLVDAILGQPLDSRRVLPTTGLPPAHDDGTYAKLKRENEEGQRAVGRAPRARVPYGR

SEQ ID NO: 966228 - protein, 242 aa, Homo sapiens
MSEEQFGCGTGPRVHAGNVPAVGGIGRAMQEGAMVAADTRGQPVCGGNSGARDRGCGNRALAGTDRSGRRRDRSVARQLDGQLTNRRRTARPFKSPPLRTPLAGHADPAPRRATTLGTTLVYIRTRLTLCAPSYQSRKRTRRTVTYLSPKHFLRCRRSASHPCPAVPRSRLTESAEVHARSVRIHTAQHAGAALALHILLYSANTLRSHVFRTSASPTSCTSNHAQEHTTYPLCHYWPQTAL

SEQ ID NO: 966229 - protein, 125 aa, Homo sapiens
IQEPYQERHEVAIQSSYYNTKLKRIQREDHKEIDITKIPVKQMETMRETHMQKQPERDKSVLTPLRGDVASCNNQVAEKPAHTAVPGITRHLTKRLPTKSSQKVEVETSGIGDSLLNVKCAAQTL

SEQ ID NO: 966230 - protein, 375 aa, Homo sapiens
RSELVTWYTMCLIAVLSFFENNCEIGCYCQAHQHLLSGSDLECSENFYSCVLMCELSDTILLCVHCCTILPVLPASYGLHVCVCEHVHCVSWYPTIPPTSELQHIRNSLPDTVQIQAWWSELALSLGQCHHLTIDYVALVHPDYGQWSTSKKFLAACAQGGKSSAHDQLACPLCSASECYLCLSPNPMDWLASIPHTINLNTPGMSLSSTSSSPTLCFRGYTCCTLHPPDSYPASLPTSPPSNLTLLSPSLCHPCTSNPPPPNLLPTRCHTLSIQHLNYTPILLTHLPIHHPVKSHFICTIPHLQTALTKFVPHRQTTSALCTPYRSKPSSPTPRSQLCNPTYITTATLPYKPPSHITAILPPNPIQTLTTPLKP

SEQ ID NO: 966231 - protein, 232 aa, Homo sapiens
LVGEPWTLSKTCSEADILTSTITVTKFEMHRMMRPRLEARVAARDRRPQSTLCHVRALTALKQALSCRVHLPDHVTGEEVELCEPGPATILVAWENKDIYAAAIRSLRLLELQNVLECRDGPVLGRAHGASLYIARMTRLLDTVLKHHSEYGAADHVVIPIHQPRVPSRSATSTCTKVAACMETDQQHRVLLGGPGRCSHQEELCKSHQVCLQPGAHPVHLPVEILRSENAD

SEQ ID NO: 966232 - protein, 224 aa, Homo sapiens
MKLVSAHNVKDDRDEEQRAPAGAHVRWSISFLPYRLVEPRIASSVSPLRLREFLVLLKSMLKHYRRGSQWRRGTMRGPLWDLGIFGILLKINMSGQTANILEIVPKGYKSSTLSVRLSKCLSGDGGRHTERVAILRKERDDHRGLHYTRCCSRLRPPPGNFSLGEPRRAGKKNLGAEGGPRTAYTMRRGGDSNIGYRYTMEAPGWVFPPHGRGFTRESRPWYGE

SEQ ID NO: 966233 - protein, 184 aa, Homo sapiens
LTHWDVPNLETLHQMLKLGRSNRGHRRHRHEPAQSFSWLSAFALGFHCLTCARRLHRALQAPQARCTWWTWRDPNAHGRQGRPGPAAGGRPRRGPGAACGRPDHKPSLLGGLRKGRVELAGNLRGGPTGPATVALPRFAVHAIVCSRRWAQAHTAVLRGCSGWVRPRGGGGGRCVRCPCVRLTA

SEQ ID NO: 966234 - protein, 39 aa, Homo sapiens
MIPGPAPEAKELHAVHQLRPRRRGQCLVDKDGLMAYSAC

SEQ ID NO: 966235 - protein, 348 aa, Homo sapiens
HTMEEEEDDDWGEDTTEEAQRRRMDEISDHAKVLTLSDDLERTIEERVNILFDFVKKKKEEGVIDSSDKEIVAEAERLDVKAMGPLVLLKFFFNEKIREQIRKWRLYFLIWFSNSSHEEIQAPFPTMFVTTTKKPNGTFFMVQECVVAMHQAQLISKIPHILKEMYDADLLEEEVIISLDRKRPLRNMSPKNCQRDRVKPEPVYKMEKEAEESTPPAPHATNDGTDENHRTWRIPTADREPQPPPLATQTAQAKTTTTLKQRKRATQATYRSRRNSTKIPPTKQAARAHLNAAHKRKMGHNTREHARVTNQKEQQTRNKQHGQHKAGHTPPQQHTEEQDNAPPRTTPA

SEQ ID NO: 966236 - protein, 307 aa, Homo sapiens
HAHCEQQAGQTTFSARTWCACVFSSLPTPAMEAVWHVWRGMASTVRTREELRSLRTPLGAAGSFQMTWAPVLGKKQLPSPVLTAEEGASFCAGFSTARLLQHFSFKVHPCVPNEKDMICMWPRSMCCADIPQFPHPFTCGWSGSTMWLPMTGFQYLCLAEECSIVNGHYGFCIPSSVDGYGTLIQHRTEHLLHSNMTSGDILLCYITEILGPYFREESLLKADDFSCAKRQRCALMMASSSPQVDDSRLSVSGPWAMCSSPKTGGIMPGSDDAHPGRSRNRQGLGTGGTVSHNRRGGARNGPPRKET

SEQ ID NO: 966237 - protein, 373 aa, Homo sapiens
ANLRARPVLAPASDTAIERAELAPSAHHADIVPTSKSGPAVCYQITISTIHAAPYGPTMATSGALERCTMDTAKQRVRAICAPMLLVHAGREQHHASPIIPKVVHGLAIHRPSTDLRAWQIHAIDHNPVNDDHQPSTQSFHPDMAQPDLHRWRTWQTAPATTHAPFGRIRANRWGARMDAAGRHPPQASPPEPNIAGSQCNPVNLVTRSRPRRVQSEPVLKSYVTFGSAPVNSRSVPTGRGYARPDASAGAPPEPPAPRKEESYTRGSRGNPGAPEPRPHTSRTDTPAQQQDNIDPRTINPAQTTGGDETQAPSTAHHKKETEELEAHPITDEPTRKDRAIREGYATIPAIGAARHARATHRNEQPHRETTPA

SEQ ID NO: 966238 - protein, 92 aa, Homo sapiens
NGSDEWSSDLHRPQLKSKMTFSIVDSDECKILSRYMPTISERHTRSREEGNKTDAYRAISGDMRGSTLLVTVEAQELALMLSTRGKECDSST

SEQ ID NO: 966239 - protein, 31 aa, Homo sapiens
HWRGKTGTQMKGPPRNPQPSKAAENKDSEEE

SEQ ID NO: 966240 - protein, 223 aa, Homo sapiens
HTGNKEKTEHTRIPEQGEYGETKKQTNRHTNGTHTTGRIAHDEGKGDTNSSRMTEERKQTKTNRRRDNQTPTQGNRTTTGRNRQRKTHGRRDRAHRNNSTKHNKSQRADNGQRRAAGDQRKPDEAEPQRDERKTERQSRTRKEETRNEARKNTHHRKSEEQTENRGHGQQENHGKETKTHPDTGRRRRKTPRRRHPATETDAHDDPPTLTPISVRGAHDKDET

SEQ ID NO: 966241 - protein, 303 aa, Homo sapiens
AGELPRQVVSLIRMRNPWGEVECDGSLEDSSSEWNNVDPYERDQLRVKMEDGEFWMSFRDFMREFTRLEICNLTPDVPQEPDIRKCEHHTLREAPGGRGSTAGGCRRLPSRTFWVNPQFKIRLDETDDPDDYGGTASQAAASCSPVMQERTDRRRAPLRTADMETIGLRRSYEVPPELVGQPAVHLKRDFFLANASRGRSEQCIKAARGQHPVPAATRGVCWWCASTSSRNKEGDFVLRLLLREECWDCGAWMNRNQGNFPDEQGLSKRGWQELQALQAWRGGLRSLRGWGNSLVFNKPGTVV

SEQ ID NO: 966242 - protein, 138 aa, Homo sapiens
MPRRYSDYPVCIHHMKHPIICRLIHFSTRSSINNVHDLRSLRFEIDLVLIVEEGLHIPGVTIWMSPHPTTHSREARIHKIYTKKGRNRTPPKLVVKTKSPWSSNDVVLKKHNENGHFGFCMLERVAHPGVLTVRPVGR

SEQ ID NO: 966243 - protein, 321 aa, Homo sapiens
MDDDIAALVVDNGSGMCKAGFAGLTMPPGSVFLLHRGGCPMHQDVMVGMGQKDSYVGDEAQSKRGILHPEVPLSEARQSSTNWLQTWMNIWHHTFYNELRVAPEEHPCAADLSAPLNPKANREKMTQIMFETFNIPAMYVAIQAVLIPVTPLCRTTGIVMDSGDGVTHTVPIYEGYALLPCRSCVWYLVWSGPVLNLMKILTERGYVSHHGEREIVRDMWREAVLRRLDFYHRWARLFSSSLGKSYELLAAPSPLDERSVLRAFQLLLGLVCGPELLLPEWWAQPSPVWWPFPSVGAPPRNAPSAALLWDPHGSRFFFSRP

SEQ ID NO: 966244 - protein, 100 aa, Homo sapiens
MVRLASHSDDWYARVYASCSSGLACEVQPKSACSSHCTRDIDAPREGVTFDIRLDFEDTQRCFWMKAFAGRLYDSIDVTRRVLTVRKVGAPGENQIRGLR

SEQ ID NO: 966245 - protein, 298 aa, Homo sapiens
CLPVGPDNHSQTPGLVTPTQQLTKHDVERLKASVDRPFTNLESAFYSIVGLSSLGAQVPWMQRRACTLRIRSNAWIPANVGFPSSTAWPGQRRPSQDVRSLFQMRPNDLFLAGVSEDSSVTQIYHAVASSKWLMAFPWHSQRMHPQCPLRARSHAKGERTGACANRGPRALGQTSIRNRVPSRRRPELSICVTEIEDLVARLDELGGVYLRVVKKDWKRTALFVVPTYRAHGSCGGTEGMRLRRIEVIPRLMESDTLSTEELLGSSFRNFKGLCELLGARINGTRASWWVCRGIGPDI

SEQ ID NO: 966246 - protein, 327 aa, Homo sapiens
QTSYYVPLVACGPGAPGLQLCRDLYSSDPELTREREREARERDLRDRLKSGFDVKPNELEPLAWGPWALGLDPFPRKWGLWRLQPGPPWPVTLSPFIRARGAPRGSRRTSERWQVVSGLRLDMSYAERLACCRGCIARHGWRPMGYLMPLARLGCVTCDSRCQQIGIALIHSHLLLHQQDAFHWGLLPRCEPSHGAPGLWVSDLAGSAYPVGTLANPAVSHPLHANGVLRPGSLVVLTGLRAPFWPDVCGSSPGGHGLGSSELRRGAGQQTWCGPQPVARCRAAGDISAEREGAWEPFNNGPVWDPPRGRHKRWAQGGRLGDEILEL

SEQ ID NO: 966247 - protein, 363 aa, Homo sapiens
ANLATEEELSEAKDLLKKGRKVVKKVPKGTSELPSLTWHFGMVASHKWLVTGSMHIMQSCMHHRNHARIFIGRQAIVQACSSQCTAQQAQQSMQHSCTYCGQLLVRCMHLVMHHTNTQHCKQQPEGPTHMISAAQLIKHHRQSTWQQQQMLYPSNGTGGEQQASLCEIRAALPFENISGNYPGRDVPCKRRISTGKAIVRRDKQIPVPKLERNSSRVTTGARGHNPSARRFRKRTTSQLGPVTGQDAYVVSRARILHTQGENNRCVSERQLTKIEEHYNRCPITNGRKSFCFLGSTHTGHTAESLSTTTGHDVMHAKSTEYIGIPDADTGALCETSDYTEDDTCAALTFGVSQAKQTVSSHND

SEQ ID NO: 966248 - protein, 81 aa, Homo sapiens
PVLLGRQRGIWKNPCQKPQRKGGPPLPRTDTSGTAGNRRHLKGGTGNRGRSDTQAIRRQFLVRNYRLPMEKTGNAESLRAR

SEQ ID NO: 966249 - protein, 401 aa, Homo sapiens
NTIFWSPQHHELSLGAPEDGVGGPEEYEGALAVCGHFRHCTVMNIAEHYMDFRRLNGILLVRYDRLPSDVLVEPIRWTTRTGMWTFQGRLLQKNNKDLRSASMLWRPRPPTLLSQEQINAILKQDLKKYSKIFEQKDRLSQSKASKELVGDRRTMMEDFRKYRNNGPGALYASRNNERRGVARRAWTLTSVRTGNVDDLGTRRPLECFVTARTHSPRGIRSDPGALCRVCSWSRGVLPGSRRDSRLVPCALCVWPVTCAWISAIATHFWTFSPWGLHAGTSGPGRLLPCQAVFWFKPADPMIRKHLSRAHGGPPPPAAQGRFTGVRLSRGRTIRETQNYHEDKRRYRKHRWAHSDPPGVCGSQVDTRPADINCLVAEAAITAHGDRLCIDCSEIQSRYHYD

SEQ ID NO: 966250 - protein, 303 aa, Homo sapiens
IDLDTLDGCPEERDTLGHREVRLYNAVVQRGSEAECSGEQLQVTPENRRKVQGKALGLIRFPVMTIEGVRCSVPAEQSTEHTLGRDREGGHALYRCTFTVRPPMTIDMEFIDRRPLPWLRGKELQASNRLPAGGESLEATAGPGDRIRCSVNKRIFVVGFEGCNGSVHGPTDYQVNIQMIATDSNSVLSHNRDWTSDLADVVRPNTFRRSMLQRRPVCECACLQTFNLSSGPVDTPAFKVLINPTYGHLEGTVTRVTHTESADTWLAKDTASTLCYAAGTNSGTFVRGQAESPKIIFITGRLP

SEQ ID NO: 966251 - protein, 236 aa, Homo sapiens
VSLREVVRYLVGAAWLCAGGRLTRGRVQGAAGGGGWLARGLSVERTLSRSCLRCPAGDMALDGRRRPAMLPALSRSKRAWRQSELLEKEEERRCMMKMKTEEDDVSEGSEVALRVTVLQVPSSTMLNWRAGTSECQGEGQGVDPLLDRTRARMKGGGQPRAPAPARCLHGSHEQGRRNSFCSHRARLPVPVLCPQANQPYLLADGTPFGCPPGRHAEAILIPSELTRDGMSLKLYY

SEQ ID NO: 966252 - protein, 218 aa, Homo sapiens
AGPWQAVEPGGPGVGAAGGPGRCLVARWSRPVCAAGRGWSLLAQLSAFTDDGGGSSRSETDQRAKCWRHVVCVLSVPNSMNGKYDTGQLFLHSIFRLPRCRPVSLAGQTAMTADVCVLQSPEKSTEVTRVWPWLQGGERLKTHTYYQDAVLDARDCPRVYRHEISEQKLGPSWLTMMYSRALYAIPGLDYVSHEDILPYTSTDQVPIQHELFERFLLL

SEQ ID NO: 966253 - protein, 116 aa, Homo sapiens
MACAQSVGRRRGRFAQGRQKFVDFGSRENKRNNWIKGLLLLCEMGMKFHWDVVVGRKQLGKSSIELEKESSPKQERRVNEQQNGLTTEMLYGIAPSNIVNKRVRLVSHYTGQSSYA

SEQ ID NO: 966254 - protein, 322 aa, Homo sapiens
SRPPRPVPVVGGGQEDLQALGFGLFHGSRGVKWTRPILQPCWHSYKSFYDAAVLLCDVTIEVVTPVQRSLALGRLLFLQYATCQQLRVPTYKSMFTGRTCTEDARQCQLLTHSHAELRPLDVPLLRSYRYRQLANSGYDEYSTVEANVQRLYAASDMLQPGICAGSLCLLLSPNVLSKTNCTAILKFADAFDHHKLRSQAQSYIAHNFKQLSRMGQIREETLTDLTLDQMLAVLRLDSLGHRQCSGLYACELCHDWTLAAKSGVPVLIKSPSDVRMDSYNLTRIRLIYTAVTQPSLQQAFVLDRLHNGPRRSAYCSHDDNGS

SEQ ID NO: 966255 - protein, 420 aa, Homo sapiens
MTKRRMKRSPNALAWSPGQVQGAQGSTTEGPCGLPAQAVTYGPEELTYILRILASSGSKFKTRRAKDECACLTSLSLEEMRKRHLLARLLQLTSFRDRRVTDCRTDAWKGRTSLRPCVNLSFQRLCRADMGRIGKWNASVLMQSGARFGEMQDEDYGGVNFSAGVCAGGATEGRMNSEEDEESLRGMTEEREEDNWLTVIWSSCLSIWQELSDSIQKLDLYEEAEPEEHVLMRSVQRRPKLHLCILFKPGDSLHDSGAVFCVPQVYGEGGVNGIYPIEVLNTEDPGFRGAEHVPVEGTRYRLFPTHFLDKLENGRPLRRYTRSRTTDDFELHVKKRPTELDNREIQRPQKTITHHQLESTHSKETSYLVRGEQRTTLALQQYERTRAQTRPANKRQITDSTEQQTNARAEHSTEAERGQE

SEQ ID NO: 966256 - protein, 44 aa, Homo sapiens
MAQIPEGGCGARAGTTRSQVQAPRAPGREASNVKNPRAPAPRAP

SEQ ID NO: 966257 - protein, 302 aa, Homo sapiens
MADCGGLPQISQPAKLAEAFKDFVQGMGYMPSASMTRADAVPHSASWIPVDHILVEWATREAAFPQPSEGTRRPSHTRRGHPLGVSHRPARGPTMDITRHNSGAAGNSAGAKSNGGLLRGGLPRHAVLRISDSRVSGRNTIRRNPFTTPRPAILLPRSVEIRKLMGQGGELWLRDTMSLITWVTLSKARIGGGPKGRKDAEVRSRNYMQEKPGRVPLSSPCLRDTKCTKEQRSRTTLHKASLAPEHRGTSGMQVQKPGRTIRATLTCRTRSREDNNQHIARGEKKSPVPEKTERARNTTAPQ

SEQ ID NO: 966258 - protein, 227 aa, Homo sapiens
GADDVVWDKAVATGKMDERAEFVAVTSTNAAKIFNLYPMKGRIAVGSDADVVIWDPDKLKTITAKSHKSAVEYNIFEGMECHGSPLVVISQAKIVFEDGNINVNKGMGRFIPRKAFPGAPVPAASKSGIRFGDCKGFPRACMTVLCTEVPGVHPRYRQPHRFLQANLRTSKQQCPPMRKLQQSKLQSYQVAMIDDNNRRRTVTIVAPPGGVQHHQARLNVDAAEELA

SEQ ID NO: 966259 - protein, 76 aa, Homo sapiens
MFTLEDTTLWLYERELQSEPSRSKDADTDENFLRPVWCLERNPGDNAHASVTRAPLATAPPVWLTITASDTATDRR

SEQ ID NO: 966260 - protein, 428 aa, Homo sapiens
DAEPGARAEPLASRCHAAPAAALKDGCRRCLRPPREHLRSAGGCCYYRASSSAPPCVEPLVRPCRMYADLLLGVLDCALEEAGKVSSWMHMTCVALPSALPGGPGKGSVCPGCAGLQAGAGPSPGLEDEIDFLCPGCLSRKESGHLNSAPTQGPIRRLPGAWHPVASRRRGQGLELGLPSTPWNPQSPRLTKSVLLWVPVCRSGHRCRAIVGPCEPPGEGNGDGASPASMLNPWRSCLLADWIRFRSRRRAIVWGCDDCNVVKIQDEIKKGLNNVTMVMGPLGRACVSQGIIALGTYGLATERGTFSLSSTRANQCEQWRRLKRPTNRDWKTNPPRKEDNVGRETNVETQCTGANRNRKESVATTRCQRTGQGHEPPKTRALDQRRGTTDRHPRRGVRPTKQHAEKQSATNSNTHTTESATTHMTSEH

SEQ ID NO: 966261 - protein, 259 aa, Homo sapiens
MIPTARVRRCEWGCSIERSAVADGGHNWMQCQTPKGPDLVGVSSQPASSHQQMTSSKRQEGAQMTAAQDKALRELWPPEHPWFHLSPSTWYSNMAGLAGLSLCVCDTQVCTCMGMCPGWGRVSNVARDCLSSTAGGYLSMDPLNTFTSLVLGWCLTYTWGSIIPLKVLGSEHATGDCPGGSQGTLSGSPYESFGGVPKLRQAAKTEEPTRGQSKKGTPSCPTGGDSASESPNKTCAWRHGRGAHPSNGGEDDNAKRHTI

SEQ ID NO: 966262 - protein, 31 aa, Homo sapiens
DTKKQAGEATLIGADGRERTRKHTREEKRHE

SEQ ID NO: 966263 - protein, 213 aa, Homo sapiens
MEAFGGRGPNLGRGVRPQDSLTEFRPLPIPSGIRRLHFTEVQSRGPKTPRVDRDLSPRRKCSRAEWVIGRKLMLGILRLLGSFPQLFSRYYAMSTTVPWLGVASGRTNRWEFPCYLERKFLRRQMGEIGGERRFLGRRWGPQSNMSSKELITFHGLDQGPMVTRRALRKYEHLFGVRNHQWVHPRGLMRWMEKKTSSLRYMCGDYGCGVCNAL

SEQ ID NO: 966264 - protein, 273 aa, Homo sapiens
MREIVHLQAVAVRHPNLATKYGDGDHVMSTASIPTGTYHGDSELQLERINVYYNEATGGKYVPRAVLLDLVDPAPCDSDDARGPSGRSSGRTIFVFGHIGAGNEIGLLRGYYTEGAELVDSDAVMSVSKMEVLEAVTVTDSGVPRLEPTFPEDGGRLESGDGYPPHSGKIRGRMYPMTKEIVTHVLSVGLAPCSGPEIRLVLEIGPGSGWDSPRKRRIGLQLALRYKGSAIPKGFRLRKETDHENRKETLNLGQFLAFKPREAYLLKSGKPNY

SEQ ID NO: 966265 - protein, 179 aa, Homo sapiens
RRLGRRCTDVPGPGSAGLRSRAITQVHRIMVMRSTAQPDLAGLEALRERERSHHGQQEDPDKIPVQLVLSRGVPPEKASDLWGTSKDRQDWTGSPSEAMFGRGAPSRHQGVSNPRGTSIHYVGLQKLLSSSSVEGLGSLGVPGIRVCLISRKVNGYTFAGAPVKSVRSCTHFHFSRSEC

SEQ ID NO: 966266 - protein, 532 aa, Homo sapiens
TVDSNGVITVKTDFTGLKGPYRIEREGEKQELWEKYLIDKCLPPLRSQCRRDGCRVKRVEVVQGIYYGRINGVSRAALVGTGLVEMNWCTSVGPSRASFRKYWQTCRVHGRKRPYRDTELESSYGRTSPFDRKLARTKFDVGSKHPVDSKAMVALRVGNEEETLATKAIGPLGPGLGTKWVASTFIAYAQLQLVDDTRFTFSFAVTGVDNSFLTANVPRAVLSHSEDFVLWLNALLVLRPVGNFFLEQEVLALLAEKGAIFMGIATSVARSLDSHSQGSPTNNSLEQGLPHRWGKNPWLGRSYVGHRVGALTCLRNSNGYSHQVRGWSMLPRGTPWQCDTLHTGNCYRGITLGEVRISHGGWQHVPCSARCFVGTLRATQVCTRYRVRPGGTHFTRRFEQLVCAAQSACALSLEESDSSSRVCTTSEYRYVGLSTPADKWDNAQGEESQYHKRGNRGQPEQHKEAQVSRARETPQGRHNRPRENTGRDINQTGGTKKRQRREYTDENTSQHSTKHWGTHNKEAGHEQQDHTN

SEQ ID NO: 966267 - protein, 149 aa, Homo sapiens
MTLRAAVFDPYGVLALPAVFGSSCRTEEALALPRGLLNDAFQKGGPEGCHYPAYERRVSHVSQWHTDSWEENCREVAPEYRLKFCLPKAFLAGKNIFDKVVFQPRKINSPPCSRSALMLRKKGFTYAILTNILAGATVLREHGLAQLTV

SEQ ID NO: 966268 - protein, 340 aa, Homo sapiens
ITGSRMRPFRLVQFIIMETRKNRWHLAQRQLHVMNNNMSEEDEDFKGQPGICGLTNLGNNVLLNSALAIASTIVPTAHLRYIPSTIACYLEELQGSDKPLGMKGEIVRGHMQTCEELERESGHHRPLCHMCSRTEVGHLASQFLGYQQNESQELLSFLLDGGCMKTLIAVKKNGVCGAVRCCWVIRISACVAHDGEWLKAQNGGTISVIVEHFPRLFKSTLMCPDRGSVSCDRSTPFVTLCSLAITHMRVLEVSFPMVRAQPSARLVPKAKPVIVGRPPTSSLKEKCWSRPSLFRFRGYVGPGFHRWQAGQTGLSGRSGLPVHPLAREEFSPRRAPRTLL

SEQ ID NO: 966269 - protein, 68 aa, Homo sapiens
HLSEDDESGDASGAGKGSLTPVVLILQNSHVPEVEVQVNTHELTASLTQPRVSVVPEAVTQHAAKYLW

SEQ ID NO: 966270 - protein, 103 aa, Homo sapiens
AALPALRFPHFNVFRGCHSPGFGRPSPAFPAPGSPAPCHASLRDRVSTTSSMSLAHRLPDNADMWAPGNMTRAPWDKGDRGNVIRWDNQETGEQIAIKQLTGE

SEQ ID NO: 966271 - protein, 115 aa, Homo sapiens
NHLLESCRYAEGRCFQESAGGRPGGATYMPLDGSGWPAGRRSGYPQYPAPRVLGTICAPSWEEAPEAELSQAPAERARAWLPGSRWDYACSQHAPKLLTVVVLVTVLCVTYIASA

SEQ ID NO: 966272 - protein, 157 aa, Homo sapiens
SGYRDLKWKRFGGRGPDLGGGVPAPRNSFIPHFRSTSRISFSVNLRASLCTLYRRSPISAAEPRNPEGVTRRPSQSPLRALSSQKGRECGVDCADKTCARGISISLSCVALRFSRHNILLCAHIIVRESLTHTHRVLTPQCALVCALSVAQTLFTAP

SEQ ID NO: 966273 - protein, 243 aa, Homo sapiens
RRSPREEEAVTHASACSHWRSSFLLGLDSFAPLPPAGATSQVPDIQACEITSSGIEGGFQLTKGGGEVEQGKYSTHGWLVGIVGYVESPQGLPDLQDVSSLSTSVDECKRRSYKNWHKSKKKDLNQVLQESGTDEDGKKQLEKDFSSNERSTCQGHPCHCPHPDEPAMLCARRRAELMEIQVNGGNVAEKLEWARERLEQQVTCDQGVRQDEMIDRHRGDPRGEGYKGSRDDGKRRKLPGMSH

SEQ ID NO: 966274 - protein, 47 aa, Homo sapiens
RSINKKAKALGQLRLANPKSLGSLQPSCSQPAMPEEKPRSQPMKGQG

SEQ ID NO: 966275 - protein, 100 aa, Homo sapiens
VQYELWARCWRSGSPGCCFVAAAVALRWSGRRTARGAVVRARQKASELWPWDEHVTGRRSASWLHENPKNLVTFRRALAYALVPLPSSWVATNAYHHGTE

SEQ ID NO: 966276 - protein, 271 aa, Homo sapiens
GSFLPHSQVFAQYCAVYGGGFSNLVPLGEAQGSRSPHVQGVCGDFSGRVPQPSLQYPICSLAGTRRVGADGARMNRAGPGGGELQRHALPHHNSQHSPMTTLKSPSLEDPEQVRGLSLWLLQCAEVTYDSMRRVEKDGITCCGSLARSDDGAPSVLALYWEDWLILVTAKFCVCLAAACVVVAVPGGAAPGSVLVALALIESGMKYGGSPSQFDNCQNRRGAMQHSSYFTYLWKYRTKQRLGRRPTHAQDRCLVCSQDLLGCRMSVTTWLD

SEQ ID NO: 966277 - protein, 267 aa, Homo sapiens
MVTMHDVLDAQWLYDNHKDESYLRELRLPFGKAVDISETGGYESIRAVNAICYGAKIMLPRVYFRYDDGLEVNQEIVVITTKGDSICMAIAINDHSGQSLPASDGIVAKDQESDPWREKSYPRKVGLRSKGQGQTEAGDHSEGLLDKHGKPTDRTRCHLEDRRYCCRTVESSKKEVVARKWVKAPTGQLAKARKTVKRKRDRVRVKCDDDSSSYASSGRSRKEEEEEYERTRRAKTGLRKAGAEAVIDGRQVYTKQRKERKHEEEKP

SEQ ID NO: 966278 - protein, 136 aa, Homo sapiens
SCVGLRRSLLKEGARGWQLRLKHIGTGDSSQELMQRQPCETELRPSGNPVLLPGSGSAHGSVEICKAYPCKVSGSREGKNSMGRYQESNRSMRSQTRRHSQGSMDPKKEAPEKGTYDPGRARIFAYPSLQLAPGSR

SEQ ID NO: 966279 - protein, 95 aa, Homo sapiens
HLLSPRSQAEEGTANLCPLTLEISFNLQSWRCRGFQWSSLRARNVRAGPVSESWCYTQIKVVKFSYMWTSRITFMLLPGRKWVKSFNRVLHLSLE

SEQ ID NO: 966280 - protein, 238 aa, Homo sapiens
RAPFPGRDFQVPDYCAEHCSRCTEERALKNDRHKTQGDGCASFPHEAEGDWATSYSRMYQYERRIGEDVHWHLQLTSVASPNAHDSNVPAAWIHGVQWMYPTLRLVSSMEMLCLRAARRHLDSRPPIGARLMNSPVLQPSLASMHCLLLLATSVEAIVCTKCKEQENQESFVCGGLQKSRSRGYCAQNSLETLVLEERWYQYMIHWYGIFLEPCNPTCFITQGYSLSIHTLHALWTWL

SEQ ID NO: 966281 - protein, 350 aa, Homo sapiens
SLNPAWQSLTHRRDAQEDRTILEDSTTSLRSSNYWMIIRNVSLWRADNVGSIAGCMSDPAMSLRREGCGADGQRTTMSAARPIRGHRGKQSPKASWSNKRACLSIRGECVGFVFTKGGPHVISGTCCLANKVPCMLPVLVPLPHGECQLVPDPSNTCDRSGPEEDTLCYYHGLFSVCKAILRILPGGTIEIPELMCSLINDLEDKCRGASEATTAEHAQYLPPSPLGCSSSTVFDQWQHLQPESGLISLMDVSAFSLPGGVRKVAGVWLQNGTHLCAFCTPILSSSGFTESGLVWGTVSLPTGERDASGGHCLGVCPCWPPVSVLWPQWRRCACLVLFPPRFGTRFKTPG

SEQ ID NO: 966282 - protein, 48 aa, Homo sapiens
MPSWENTRTLGANTCLPPSGVSPSWVPCRGAKGAPTTGAGSLGRARPV

SEQ ID NO: 966283 - protein, 83 aa, Homo sapiens
MESTGVRSRELRLQVHGLAAMLHRHLRPSSRVSNMLTANKQVQSTRRVNQRTGELSLTKITGSGRNVISYPSPKKKGRGDECT

SEQ ID NO: 966284 - protein, 70 aa, Homo sapiens
MLQPWRHNILIMATTAGPPEGGREDAFPEVVASELRVVTVTALSLPRLRPRLLPLLRLEETLTTGGGAET

SEQ ID NO: 966285 - protein, 54 aa, Homo sapiens
MKALTVLSLSKLTAIYAFYPDSSNQLFVARRILLDTLISCTRSVYYWDIVVQRV

SEQ ID NO: 966286 - protein, 70 aa, Homo sapiens
LNIETVNAMIQDNGWHSRPDQQSVDLCTERQLEDWRTLSDYDHPEQSLPCHLVAPVSEGGNADSSEKTHD

SEQ ID NO: 966287 - protein, 91 aa, Homo sapiens
SFATPIKLQLEEIAFDASLRVIPPDLRTPPLQRMLPGLQAPLRTLSGIPEKSKSDILYLFDCSPNLVGHFPISLYTYSPSMIDELNDVARN

SEQ ID NO: 966288 - protein, 159 aa, Homo sapiens
MITGQGWHSLLSQQSVDLLPESCWEDGRTLSDYNIHNDHYLAPGCAVSEVEMQIFVKTLTGKTITLEVEPSDTIENVKAKIQDKEGIPPDQQRLIFAGKQLEDGRTLSDYNIQKESTLHLVLRLRGGMQIFVKTLTGYTITLEVEPSDTIENVKAEIQD

SEQ ID NO: 966289 - protein, 87 aa, Homo sapiens
DLEDPSSNKTAEGIAIHLHSSGGWLHETHWEWSKQVFEFSNTQAVRLPIVDIAPYMTLVVLIKNFGVDVGPVCYIIKQKFYLENSKK

SEQ ID NO: 966290 - protein, 107 aa, Homo sapiens
ARSHCLSIEVLCKGYPSEYATYLEYLPFLANDDKPDYSYLRQFSGICPIARATPNDYVFDWNMLKLVSRTASTFAECGVRGMACQWEAGGRLVESYTLPKKIMKYDP

SEQ ID NO: 966291 - protein, 59 aa, Homo sapiens
MSILTSALNVKVKNSNEARYTARVTMTLLKVGKCLVIYISDAHEWMNEIPTGPYTYYTS

SEQ ID NO: 966292 - protein, 116 aa, Homo sapiens
AHFSSFREIIVSSFSCVFCGWNNTEIQCGVWIQDQGVRYTLSVRALEDMNREVVKTDSAATRIPELDFEIPAFSQKGALTTVEGLITRAISGLEQDQPARRANKDATAERIDEFIV

SEQ ID NO: 966293 - protein, 46 aa, Homo sapiens
YSLIPGASLYDQQPYPLPAVTGVTFLAARPKTDCRNSFLSHWYTCD

SEQ ID NO: 966294 - protein, 115 aa, Homo sapiens
PLLLRRLYRISGSKSFFRDLTAIYESCRLGQHRPVSRLLTDGIMRVGSTASNETYPEKVWYARTGYSTGSCMVTNEAYFLKLQAFIGTKSCKIIDPKGPPFILCFPMAIWDKLPT

SEQ ID NO: 966295 - protein, 60 aa, Homo sapiens
MGAVGTHRKTSHIPGGASELQRRRVPRKHVPACKRKRDGWLLRNCNEFGPVRTETATDTG

SEQ ID NO: 966296 - protein, 79 aa, Homo sapiens
WPACRLRERGVGVCTRHPGVLFPKNRAGSLTWWSLLSPSASLAPDSEEHSLEGQMEDIKLEDSSPRGTKGALLLPCLIN

SEQ ID NO: 966297 - protein, 95 aa, Homo sapiens
MVVVSEALSMNTRGIEAAAFLPVVDCWDGPDGKPVIYHGWTRTTKIKFDDVVQAIKDHAFVTSRSVADFWWCDLKGKAARVGYDRWTDRQTHTDN

SEQ ID NO: 966298 - protein, 73 aa, Homo sapiens
MISPEEEERAEYRPSGTSCCGKCRNWRKELTDFLQAETDKLEDEKSGLQREIEELQKQKERLELVLEAHLTTA

SEQ ID NO: 966299 - protein, 34 aa, Homo sapiens
MITFRGLSRLSVLVLSTFRTPPCPLELCQTPLTT

SEQ ID NO: 966300 - protein, 54 aa, Homo sapiens
VSVRTRLYSGGGQGGLLPQLHIVGWEEPVPGPMHTPCHQPDVNHLDSMVMMSSC

SEQ ID NO: 966301 - protein, 56 aa, Homo sapiens
VTLEDFAVSVEVPQKLQLPAYYYSLQIYALIGPMFHVDNVPSSYSGCIPQELINDG

SEQ ID NO: 966302 - protein, 75 aa, Homo sapiens
MAVVVVDGQVFQCRMLHVLPSTIKKESSGLPSAWDSSSYKKKKECQDKANSASSHSWNTLFMGPNAVADAIALTT

SEQ ID NO: 966303 - protein, 94 aa, Homo sapiens
DLRIQALSEASVVSGVILLMALQHQHVFTSKPFLEFLREGLVDLDGVQAAGAEPLLALLLLVLLHGLLDAQLGTAPHTLLEGFQLVVEALHALT

SEQ ID NO: 966304 - protein, 45 aa, Homo sapiens
LLRIPVESHDIGGYTETEEAENLEDLLKAAEKHACPAFQLIHQFS

SEQ ID NO: 966305 - protein, 64 aa, Homo sapiens
GTDSRQESEVDMRSQYEVMAEQNRKMLNACVHQRGLKKLNAGGRWHTRQQLHIKAEYASSYFVD

SEQ ID NO: 966306 - protein, 64 aa, Homo sapiens
KVKMDVNFRGAACCVLESCKRKVKSGFRKDSSLYKGTVDTCARIWPSADKVKRNGQLNLSRARL

SEQ ID NO: 966307 - protein, 58 aa, Homo sapiens
TVEEVKEEVDIVVHLPSWGQSPVEHDYRSEESSYLVAGSPQKEKLLSSAEQFHISAGS

SEQ ID NO: 966308 - protein, 33 aa, Homo sapiens
SLKAESIRPRRGSLVLASDSLVPRLSPPDPPER

SEQ ID NO: 966309 - protein, 79 aa, Homo sapiens
HKTEQLSPSHDSEQQQHSPQQIGYSPFNRPTLQPRPTRPVSALTVRVHQTTRDSPPGNSWQPPSNTTLSSRCIAVLPSR

SEQ ID NO: 966310 - protein, 49 aa, Homo sapiens
MGNAAPRACGNEENRFCMLIAIYDLCFHVFDFNRRAAVGQVSRLVMPTP

SEQ ID NO: 966311 - protein, 82 aa, Homo sapiens
MRFIQRQIASQSLSLKSGQMFAKEDLKRKKLVGSWFLKNARRRLKEVQAVFLTDILVFLQEKDQKYIFASLDQKSTVIFLKK

SEQ ID NO: 966312 - protein, 36 aa, Homo sapiens
RACTLSCTRDNEVEQEDLAQSLAMVKDVIGAVDSKV

SEQ ID NO: 966313 - protein, 101 aa, Homo sapiens
HSIRYPMRVQHLFSSSFSLGIPSSSSLYRVVDCVLNDLNPAGFVPPWRLAWTSTISGSVIPMLIRNKPFSSCATSLAISFFKEITVDFWSNDAKMYFWSFS

SEQ ID NO: 966314 - protein, 39 aa, Homo sapiens
MRAPKRNETSWIQIIQDTINTLNRDEDEGILVRMRKKRK

SEQ ID NO: 966315 - protein, 142 aa, Homo sapiens
YRTYLSARGARFISVGYVDDTQFVRFDSDAAESEDGAPGAGIEQEGPEYWDRETQISKTNTQTYREDLRTLLRYYNQSEAGSHTLQWMYGCDVGPDGRPLRGYNQFAYDGKDYIALNEDLRSWTAADTAAQITQRKWEAAGQ

SEQ ID NO: 966316 - protein, 37 aa, Homo sapiens
MTVCSPDGPGRPSASAARWALGMAGRLLQLLTSNVSA

SEQ ID NO: 966317 - protein, 33 aa, Homo sapiens
MPSSGKSSQRKETQVILLDTPGIISPGKQKTAS

SEQ ID NO: 966318 - protein, 41 aa, Homo sapiens
PASSLSSDAGRTSQKPWLMGRYPGILALPRQQNPGAGGPLA

SEQ ID NO: 966319 - protein, 46 aa, Homo sapiens
KRGHLLLQTDQPIYNPGQRVRSRVFALDQKVRPSTDTITVMVENSH

SEQ ID NO: 966320 - protein, 48 aa, Homo sapiens
VISTPDWTTVVYLMHSVKVYYSTSSPSSSRDARVSELKKLGLTQVVRS

SEQ ID NO: 966321 - protein, 56 aa, Homo sapiens
MYPISCHLTGYTLTYRVYLGTYAHFVLFMKDCQKTAMYRLNKTLRGPSHFIEYKTG

SEQ ID NO: 966322 - protein, 43 aa, Homo sapiens
MAYPNFVRCIIPNHDTNRRRAGPASRAEPACAAYGFPRVASGT

SEQ ID NO: 966323 - protein, 63 aa, Homo sapiens
VYTGLLNRRPNGLVCVKETYYIVPITEKFHVIGIEKPEVSSPSPGTFFLLGHESPWRIHSDSF

SEQ ID NO: 966324 - protein, 38 aa, Homo sapiens
ATGSLGLTTVIGAHEGDDVLDPLRHLYDSSMQIHPSDV

SEQ ID NO: 966325 - protein, 112 aa, Homo sapiens
RTVLHSSFHPWGRCTWEAWMGQQTQWDQQDPRDPHFHHCHGAPDWASGHQRCPLVTSEAHGAPCFDHGCSYFHQGGTMVHHFTPWSTWCCPIHITSMTYCCPHKCLLNAMEC

SEQ ID NO: 966326 - protein, 80 aa, Homo sapiens
TVVYDNVTFDASSGIIVVFSPGRAPSPRHGIFMITSALLGRPFDQATVLQGFVSCRILIYFIIPVWWEPHHTYVASLFCP

SEQ ID NO: 966327 - protein, 100 aa, Homo sapiens
WSSLAGSPHTPLTELCLGKLHLLTATEGYFATLLLQVFCLDHLSQWGTAVYWMSRIDRYACGPQSVLRSFTLYLMDLLNRLMSSQDAKLELKCDIKPVAN

SEQ ID NO: 966328 - protein, 59 aa, Homo sapiens
AQRNPLITSVASSGPILTTSSNSPGEELFRDSVDALEGAAPEACLPVLWFTHTVQPTRH

SEQ ID NO: 966329 - protein, 139 aa, Homo sapiens
GRPLSRGADAHGTTHYSIGGSEPNGDSRMHSHAPHVLACVRYSRRNITEVRVGRVGLRYSYYCGCHTKSKVLPKPCGPLSQLCFGDLTIGHGYTSQEMFKPLDVGKRKQQIKTVTVYYLEGEDLRDYHLGKDLYFKQIA

SEQ ID NO: 966330 - protein, 42 aa, Homo sapiens
RSHHRPTGALSVVELGSVSVEGRLGPTVVLHVLPSNSESSSR

SEQ ID NO: 966331 - protein, 110 aa, Homo sapiens
HLAALQRRHRTRWLERFWWKNVKIIVLICVIVFIIILFIVLLATGAYLLRNREPLPPALLLQGQPSINVCHEGLLSCLPTTENAATDLLTPNYPRPCCHIVSPDRGTLSE

SEQ ID NO: 966332 - protein, 74 aa, Homo sapiens
DKQCTEGLSENSAYRWTVVNTEEGRQALEPLPRVIQESLNDSSPGGSSRTLLMMEPEVILQRQNSGISSELRRH

SEQ ID NO: 966333 - protein, 77 aa, Homo sapiens
QFYTYWFEVGYRHCISIIIELLSCGYEYPSVNKFAGRLMALSNIVQPTKDLDTIVTVKPIMDHAHKDPSYGLHRGEG

SEQ ID NO: 966334 - protein, 33 aa, Homo sapiens
LRQTVLLLHALRNKMGLKFQRYRLVPYGNHSYL

SEQ ID NO: 966335 - protein, 87 aa, Homo sapiens
QFYTRLGGAAQLPLWLLAEAGPCAGGVVERLLLRRSRRGSSSARRAVGCDGELAEQVAVTAATEGLASLLIIVSLCFSVSPGLVAGL

SEQ ID NO: 966336 - protein, 37 aa, Homo sapiens
RSFTSNPSSAPQTYSQQLCGVPFIFVLILEFLHQGFD

SEQ ID NO: 966337 - protein, 35 aa, Homo sapiens
MGYIFYPEKTTIALMKLKGEGGFSSTLSVELERVP

SEQ ID NO: 966338 - protein, 55 aa, Homo sapiens
STDLILIMICHGVTYHNLPSLCDLPVNIGDISTMRVRMKKKANPSSLVLGKGDEV

SEQ ID NO: 966339 - protein, 67 aa, Homo sapiens
WGMIYWHCGGISKWDDKTLRLSQSYSAFPSYYSTIVLQGLMTVIETLHRSPSSKPFKSSFSSFPYAA

SEQ ID NO: 966340 - protein, 47 aa, Homo sapiens
MQLQFPTVIRFLQAVGTVERGIGGFPPSFGSLIRVCVCVCLCIKLNG

SEQ ID NO: 966341 - protein, 87 aa, Homo sapiens
SRGSRSISTRLQYQNSMVLVQNRDIDQWNRTVPSEIMPHIYNYLIFDKPDKNKQWRKGEVCNMTKSTVTHLELAYLVTALVPSDTAC

SEQ ID NO: 966342 - protein, 64 aa, Homo sapiens
GDYYEHSLNFKDWVFISSRGAVLYRRSSHLLLSYTRSSANPDEGYKVSASTHVKTLGLPGGTEL

SEQ ID NO: 966343 - protein, 52 aa, Homo sapiens
LYQDPPADWVAKDRHLSLPLRKAPDLHISEVKPLANYSTLFHTLLFPVSLQF

SEQ ID NO: 966344 - protein, 67 aa, Homo sapiens
MVSYGIGLSNPDRPARQNNMDSMTRPLVEIPVTLSPVHCEYQLHSISRLLCHTVLTKTTDSVFHKTR

SEQ ID NO: 966345 - protein, 44 aa, Homo sapiens
RNNSSHYYIYKLSKNANTVTLSMGSGCTSGIPSNALHSSPPSSS

SEQ ID NO: 966346 - protein, 44 aa, Homo sapiens
IPGINIRDSLWGKEWWHRPCSLVPTLPLPGFLYSITHGKQVISL

SEQ ID NO: 966347 - protein, 80 aa, Homo sapiens
RVQFYTINGNLDSTDDQKCVQPIYDRELQIEIKHILANFKNYQYFIGEKMNPAGMVALLDYREDGVTPVYDFLIRMVEEI

SEQ ID NO: 966348 - protein, 68 aa, Homo sapiens
PTHRTTAEKYTRMSMEASVMLHRCVPVISCPTTDPRLGSLMDIQMIQLHTSAKKEKVIGAEQSRFKTP

SEQ ID NO: 966349 - protein, 42 aa, Homo sapiens
MWQSFCVRVQILKTTPDWFVTGEKPFQMHGSNGCGETHFHCD

SEQ ID NO: 966350 - protein, 53 aa, Homo sapiens
MCIPDPEFPVTFDRFCGLMVQLLRKLSVRAADEPPESGRTRTWFLYSRGCGLN

SEQ ID NO: 966351 - protein, 61 aa, Homo sapiens
MKPYRPHPSHKYSRTIALRSIILILEIPQNWFESKVLIVLHPHFRSKSSAGMNESSSEVYS

SEQ ID NO: 966352 - protein, 191 aa, Homo sapiens
LPYAISRCVIIGYATLPCDAVKMVQYEENGRKEIDIEKYARVEKIPGSASLEDSMCLAVESSLTMDVTHPLYAGCYIKKPRIVLAGFFSWNTMKGESQTDIEIYTEEEDFSRILQMEEDYIQQLCEDIIQLKPDVSSLKRASQIELSNTLCGPISHDIRSSPEEKTNNRIAIACGARIVSRPEELREDDVG

SEQ ID NO: 966353 - protein, 68 aa, Homo sapiens
VSTRIPSKCYPPGHCSWVHDRRDTGLVLPLPDDVFLPLLSCSVRQEPPVLTFGVCVFAEEPRGEATIC

SEQ ID NO: 966354 - protein, 75 aa, Homo sapiens
VSLQDPLQCYPPLKILESVKRMARSAWHSASLVNSVNMTAVLFCWFSELRPSLIGTAGGIRLAPLEVKFLDRRKT

SEQ ID NO: 966355 - protein, 63 aa, Homo sapiens
RNGPIYHPIEELIVSISNMKTFSSAEAYVRLNHPTDNEQPNIYNQPTSHYYPHCQPNTGIAHK

SEQ ID NO: 966356 - protein, 85 aa, Homo sapiens
PLEGYEAPPGPLSFKLVARSVLASSFDDLTDENKQLSIAQTSNHQTWTLSYRELRYVKSTKLLARPLRATVKNSKDLAGLNIPLE

SEQ ID NO: 966357 - protein, 52 aa, Homo sapiens
RYQRLAYAPAGAPKRASVPASVSSNGSSHAQLCLQLRLNTLKGAPQVSNLGP

SEQ ID NO: 966358 - protein, 123 aa, Homo sapiens
PGARNAEWMIIVCDGFAALSITVRAEVVGSSMGACGSLLVAAFEELSRRAKDLKAFAVKIPGPDSSYSCFEIHICWKVDSEARMEPPIQTEYFLSGGAMILILMVDGARAVISLSIPRNRGTE

SEQ ID NO: 966359 - protein, 55 aa, Homo sapiens
DEVVVANQGNWSVALHLGPQALPRGWASDVEVPAGPAVTTYPSIHVVRGSCLKYV

SEQ ID NO: 966360 - protein, 49 aa, Homo sapiens
NIRIATGKEVLQNLSTKDTSDLSPYQGRQNRQMMISPFICLIFTRIVCS

SEQ ID NO: 966361 - protein, 60 aa, Homo sapiens
AYYWSLTFGCDETGGVLIKGLIGTVLVGGVHMVGEAHSGRALVLVLVVIGVHRRAGENQE

SEQ ID NO: 966362 - protein, 45 aa, Homo sapiens
ITRLTRVFYCTFSTHQSQGALEACEKDVHKDAAFLDVVVNFVSAC

SEQ ID NO: 966363 - protein, 33 aa, Homo sapiens
VEAAELEVLSRVSADSYGHDAPELNAVHLDDEK

SEQ ID NO: 966364 - protein, 59 aa, Homo sapiens
MLRYWNFCRSLRGTSLLRILTKIARVFETLDIGVAATPRSSPEEMLEENPSRAPSDEFY

SEQ ID NO: 966365 - protein, 58 aa, Homo sapiens
STLVVSPVTASHQCRYDRRKMVPYYDIFMPVTKAYVELAVQKELKLLRGKTIECISQI

SEQ ID NO: 966366 - protein, 42 aa, Homo sapiens
MIATYRMLLEREESRMSLPLPNFSSLNLRESNRDSLPLVDTH

SEQ ID NO: 966367 - protein, 68 aa, Homo sapiens
TMKNAGIVMGPISLLIIGIRGQCTSMGILVKCAQHFCRRLTKSYVDYGDTVMYGLESNPCSWLRKHAH

SEQ ID NO: 966368 - protein, 84 aa, Homo sapiens
MTFSGGFTRSNKSGTHSAIQWNSRVLFHRSAYVRSCFVIQEGNETDHQKGHQALSGVPSLGASWSYRGVRLLQLLLVEHSGTVL

SEQ ID NO: 966369 - protein, 64 aa, Homo sapiens
SYTAPTKLLVKQLNTLINWLQSTSPAAGRNRRERSRQKWTLLLVNLQFEHDIHLGTWENRGLNL

SEQ ID NO: 966370 - protein, 67 aa, Homo sapiens
NFPIFDGWKLCFSIGKLDPMKDMLILSALRQMLRAADDLLEDSPLEETGAIERALQPSILWTFMTRL

SEQ ID NO: 966371 - protein, 49 aa, Homo sapiens
SRGPPAVIIPWTTSTTGILHPSSSMYPGQQWLPMDMQQWLLVLSHGWVH

SEQ ID NO: 966372 - protein, 70 aa, Homo sapiens
AHSGGRKERLCQHLADPKAAESETPVKGQEKKPKIQEEAVKEKSPSLGKKDARQTPKKPEGQRFFNHFPS

SEQ ID NO: 966373 - protein, 139 aa, Homo sapiens
RIHECSSDLRAWSPSSSSSQISVFCPLYVFFIFFILIIFIPLVITVIVIIIVIITVILPSFYACILEWVCHGMLLCSQINARLKCLFACFLSMNDSELAELTFYHPFIISSSRHIINVLVDITEHTHAACRFIDQVRQD

SEQ ID NO: 966374 - protein, 41 aa, Homo sapiens
VSSRLNVKGTDTTPPKSVTCTPAFPGRPGPKLTTALQNEDL

SEQ ID NO: 966375 - protein, 127 aa, Homo sapiens
MIRGHGCRARYASRDSTGDSFIQIIILTVKLSQVVSLQCGLRVGMARSRLTIEGVCRMEALAKKIMMWLLLMALTDVGIGHLAEAQWCGTLPHAERLANGLVCGILAHRGGVILDAEGDSLCRYRRE

SEQ ID NO: 966376 - protein, 116 aa, Homo sapiens
MTLSPLLLLRQDHWRTKLQDESMKSLILLAILAVLAEVTWCYESHDSMGRYELNPFISRRDANTFIVPSAESGELESKRWIRERSSGLSMSSQGKPCDDYGLGERKARGDGYNAAY

SEQ ID NO: 966377 - protein, 44 aa, Homo sapiens
DVATCNSQLTSPNRVQGVLALKNLSGVECALVVPLMLERGARAP

SEQ ID NO: 966378 - protein, 94 aa, Homo sapiens
LDLEDPERSPPVSAASPMYRILQPLTITLVHAYSPLDFIAVKGPLRPKVSIATGIRIFKNLVSLRYITEIHNIRKEVTLIIPPRESPIYMWGFS

SEQ ID NO: 966379 - protein, 97 aa, Homo sapiens
FSEGTFTFFLQGNTVGSLGEYWIFGGQATYPGRRSAKICINGFGQNRWYPRKNTSSHGPGRERRTKRLPEKNASLLWDVPSPVYMSSALPYLGAVRD

SEQ ID NO: 966380 - protein, 79 aa, Homo sapiens
GVMLRRLSEDPSSRKDINEKSPDGIQSIPGTHIFIGSLDIEAHYLKHFVVPKNHLNFYEFLNFEQDYLEPGATLSCTSD

SEQ ID NO: 966381 - protein, 69 aa, Homo sapiens
MLMEESGAIPEVYKKAPMVGIWSSGVRSGWPLSTVILMVAGYITPVIKVPSYPHLLLGQEEKTNRQVRT

SEQ ID NO: 966382 - protein, 40 aa, Homo sapiens
SHLTCPPGRSPPDVAHLNVTTPRRLGSTSAHDAGKFCFSL

SEQ ID NO: 966383 - protein, 43 aa, Homo sapiens
SSGSARPPKPPLPRPIIPRPLPPIPTRPIAPRLSYPRGYPTSS

SEQ ID NO: 966384 - protein, 100 aa, Homo sapiens
LLRGMLRVGQAKADVWPRTAPKKDENRLDSSCARVWTAIGESDSSDRVPVPSWQNSFGQAIEAAFMKLDTPATSDPLSEEKGGKKRKKQKQKLLLSIPRN

SEQ ID NO: 966385 - protein, 48 aa, Homo sapiens
VTKDPLSAYNSDIAVLWIQVDAARMIRPVNYPEEIVCCPLPIQWMLYA

SEQ ID NO: 966386 - protein, 166 aa, Homo sapiens
WHAGAAPKPCNHLHLGMSLGGGCAQTPPPLMPSGFSGGSGDSSDIGWDNESKDPDKVAPLKTMSFYHSHIFQLLMCVCGKEYSLLTISTVLHSVGTIPERRLHYRYLVLYPDVQYQNDTEAQKKGILAKVTEWHMIQTDMLSVAKKDPSGHAWDDMEKIWHHTFYN

SEQ ID NO: 966387 - protein, 38 aa, Homo sapiens
MSSSMLGADVVADNSPASQAQSRLLNVLRHWAAFRIKW

SEQ ID NO: 966388 - protein, 75 aa, Homo sapiens
QDVIRNAFACFDEVSKEAPYRKITMRELLDKHGGIGLQIRRVDELYREAPIDKKGNFNYIEFTRILKHGAKDKDD

SEQ ID NO: 966389 - protein, 87 aa, Homo sapiens
MSTYSGAQVGRYENPYEHVLRVEDQTVQHGAGALDWVHQEQGPVRALHGVEPYQGGALRDHQQVAQVQLSLLLDQTILLGRGHASSL

SEQ ID NO: 966390 - protein, 52 aa, Homo sapiens
MTAVQGDMGLLMATNKCASQPVMTAYGTRSHLYDPKNHILPPRDHSTISLEM

SEQ ID NO: 966391 - protein, 54 aa, Homo sapiens
RTGRSETPGVGEGCTSVGRIQMLKSTKSLPLTFSLSSLSSSKIRAFRRDLLELP

SEQ ID NO: 966392 - protein, 80 aa, Homo sapiens
WACLSPIFPQPLGPALRVSSSCANGRCIAGRWKCDGDHDCADGSDEVGGETRRRERWHPKSWGRATGALRSDQDACFCAD

SEQ ID NO: 966393 - protein, 96 aa, Homo sapiens
MRLKHAETVEMVVIATVTGSLSLVTVVGNILVMLSIKVNRQLQTVNNYFLFSRGVRRTSIIARFLHVTSYTVLPHSTGSCASRAPWLCDPRLRLRH

SEQ ID NO: 966394 - protein, 113 aa, Homo sapiens
MAESTRIRAGGGAGPELVVWPGSFLLEAGESSLPLPFAAPVGSGLDRELGLTEPGHRVLPLEQEGWISLAAHCSHSCLPPRLQKRTLGRQISRGCPLLFWHTEGAKVGPMKGT

SEQ ID NO: 966395 - protein, 63 aa, Homo sapiens
MGMTLFEEILAQPSLRATQPVEVGQVVTHLLDKLHFLIYGSESPGSHRDGGPCGQNPGHEDPK

SEQ ID NO: 966396 - protein, 34 aa, Homo sapiens
MFLDASSTLVESKAEVSDEGQVVLFCEGAGLISG

SEQ ID NO: 966397 - protein, 34 aa, Homo sapiens
LVREKLGLPAAVLIILLPPLLIPSLQEYLINKPD

SEQ ID NO: 966398 - protein, 35 aa, Homo sapiens
LFWGLVLKVLPSCGFLTSRVGVIVEEESPLSDGEV

SEQ ID NO: 966399 - protein, 96 aa, Homo sapiens
IRNRSREYHTDAVPSTTRSSEKSNRDPQASELTLRCYQDKECHCQMLRLPANLSQDITDNIKIVLQLVHGTGYAPGVFQDSESSVYIDYTSLQMDA

SEQ ID NO: 966400 - protein, 72 aa, Homo sapiens
LEELDLLDDLDLVEDTDSFWNDMDELEDLYLMEDLETYEEDMRFPGKTWHFPAEDLDFAWNDQLTCMDRLDF

SEQ ID NO: 966401 - protein, 100 aa, Homo sapiens
RGHMAESHHVAPRIFVAIYNPSMGVSVLAPYRERVEFLRTSFTDSTIRLSRHELEDEGVYICEFATFPTDNRESQLNLTVIAKPTNWIEGTQAVRRAKKG

SEQ ID NO: 966402 - protein, 77 aa, Homo sapiens
MHRLVDERILGCDDRSGTIFIIFNASASAISVENVSPQPVISNLLVRNSDAKHAIAKLLTCSLPILVLINAPDEEID

SEQ ID NO: 966403 - protein, 144 aa, Homo sapiens
MKLLKYSLLNALNALGPPTRLTRTGYLSPLPSNATKVLSVPLSLDWVECWAPGFAARATYMLNLLIHRKNLNYLQLDYNFNLQPVKTLTTEDRKTSRFGNAFHLCREVLRLTKLVVDSHVQYRLGHVDAFQLADRLQYIFAHVG

SEQ ID NO: 966404 - protein, 97 aa, Homo sapiens
MCREKLASWPARLNGILPVYPPNHCRIAAIVFDGGFQIKITIKSADQKTADFVIEKDEGPQQQQQQQQQQQQQQQQQQSQLPQKSTYLKLPNISRTN

SEQ ID NO: 966405 - protein, 120 aa, Homo sapiens
QNMTHVPRKSLEKLVIGPDEMLEGDYKPSTIFAPERVALWMSRHDEAYEATRPTAEQLAGGCTSETRTLVFLVVLDAAGVTTSANVVKISTEALTSALNHCQGMPTDMTQGHMQPGTPDH

SEQ ID NO: 966406 - protein, 94 aa, Homo sapiens
LISGGHWTSLNVPRPSRNSPSVFAAEPLQHLPDRNVVVACLVQGFFPQEPLSVHAWRESVQGVSGGNIVPNIQDASGALYNHEQPADPAGDTVP

SEQ ID NO: 966407 - protein, 32 aa, Homo sapiens
MVGVRITVYIVVAVIGGPMGRFYHLFKVVSQT

SEQ ID NO: 966408 - protein, 112 aa, Homo sapiens
DREETATCHEHAHRLPWHLLLTLTKNAACKATEVKGQLNDRWAKGELPLLGARKVTNLKMLLPAQILNASSQQLRGLPFAISTTDSCQHRYRSQRCEQTMESTLSLAVVYIF

SEQ ID NO: 966409 - protein, 115 aa, Homo sapiens
MMNSEHVLIIQWVLFTEMVVIYVLVNLQQFIEVKTSYSLQTRDQDNSSDEIGCIKGETFAQVVRWESLWLFVVPDVVTVLEVVEGEGCTVGLAVELAVGTGVAVETEQKSVVFPT

SEQ ID NO: 966410 - protein, 33 aa, Homo sapiens
MRTESTPTTASAISYECLWSPPSNEAAKLHFDS

SEQ ID NO: 966411 - protein, 92 aa, Homo sapiens
VGGECSLRQSVRSCAGGLQGSESTAVVTRWTRRSRRAECDIYSYDPDLESDPFGEDGSLWSFNYFFYPMRLKRIVFFELPFPQWLLLYTLIG

SEQ ID NO: 966412 - protein, 120 aa, Homo sapiens
LRYMRSTLTLLINMDLKLNEPNKTWTPDLKRLIKLVYIVDPDVYECGVLEFARLNSNEDVKSVCDHDNDCAWYASGGLDENGCFYYACSLACEEYAMFRILVCMSYADGACHKLCLIGRV

SEQ ID NO: 966413 - protein, 120 aa, Homo sapiens
MTSPERDDFTAHLTNCNLGAGDVPPAGQHYRNQKPVKVETAEYPVIMLAVVNTTCFRIECKYESYCSHNSTVSDCQVGNTTDYCTYHGHSSANSQYYSYTHSTALPYYNYQDSYYIRYNK

SEQ ID NO: 966414 - protein, 87 aa, Homo sapiens
VNKAKRTWRAWWPALQHSLQPTPALAVGKPFKWEEKPKRVLQGGQQDFPESLKSLWVFEWNLEAPGGSGLMSSSCQRRLVKNNCAFA

SEQ ID NO: 966415 - protein, 192 aa, Homo sapiens
MTQYPNVTNITPIYNVNYGAGDVPSRMDHHYRNQKPVKVKQLRILFKCKRMLNTTCFWIECKDESYCSHNSTVSDLSRWGTRQTSVPYPRPIQCQHANSTAKPTVQPSPSTTSKTVTTSGTTNNTVTPTYTTCAESLPLMQPSFIGGIVLVLGVQAVIFFLYTFCTSKEEITTLCKQTHCLHKDWVMFCGYR

SEQ ID NO: 966416 - protein, 35 aa, Homo sapiens
NKAMVYYGNGNSCCGLSLQSSNNVLPSFHDSIQLS

SEQ ID NO: 966417 - protein, 130 aa, Homo sapiens
LRIRRLSRIARLRSVGAALRISSQQEELKPPERAKQDIATAAALVPRNFMSVKLLDIEIGTYRKLAEGEEEPVGLRLSWNREYLCDDSTGGSSSGGGIGLTLGGTMGSNALSFSSSAGPGLLKAYSIRTP

SEQ ID NO: 966418 - protein, 71 aa, Homo sapiens
LGGVVIGVSTVTAEGHSWRVEGLTDILHLDGKVIESPALTVQVAHHNELWLLLLLVLCQLKPKEILDLRFS

SEQ ID NO: 966419 - protein, 47 aa, Homo sapiens
KDLGGESHCEVRSVGAALRILVPSRRSWKPALSGPSRILHGSCVEYQ

SEQ ID NO: 966420 - protein, 43 aa, Homo sapiens
MESMNGKTLVHRILMTASEPIFREGISVCSFCNVCTWTWVMFG

SEQ ID NO: 966421 - protein, 46 aa, Homo sapiens
GYSKDPEVESDIGEAEERRELALKDSRAKQEELEAGLQRAKQDIGT

SEQ ID NO: 966422 - protein, 58 aa, Homo sapiens
ACRECLGDSPLWSHGILEQLGGLVSGKDEGTGQHMAIDADTWRIAILVLTQASGKVHP

SEQ ID NO: 966423 - protein, 38 aa, Homo sapiens
MTRRIRHRPRRGGISSGTAALGSSAATSSSSIPRPSLI

SEQ ID NO: 966424 - protein, 53 aa, Homo sapiens
IRRLSLDYQKISSGSRSVPMSLPLEPELSRSDPRTTLLFVLSLIALCILFRTS

SEQ ID NO: 966425 - protein, 121 aa, Homo sapiens
GSVVTCVVAALALLQVTGLDGNYRITCHTVMEVLREHKDSVMAVLEAFVYDPLLNWRLMDSESSCLRTGVCTSQRGSVGVLRVSDLSPSHPEPEALPSHLRYIFTEQLWWLEMNFASIFIN

SEQ ID NO: 966426 - protein, 111 aa, Homo sapiens
MTQSIEELWDKLQSYSVYYCHDYTVDSEYQYYKAAVKLEHSGMKILSRERIQSVKQSIDFMADLEKTRKQKDGTDTSQSGEDGGCWQREREDSGDAEAHAFKSPSKENKKK

SEQ ID NO: 966427 - protein, 48 aa, Homo sapiens
ISNTLLSSYFTELLLCSSSDFIILHLYCYVSTVPIFNIKSRIFQRAES

SEQ ID NO: 966428 - protein, 57 aa, Homo sapiens
LEGSLQIRYDQPGNSRLENLPPVAASIEQLLEEAVELKDQPIFTKNQGYSSVTFYGM

SEQ ID NO: 966429 - protein, 68 aa, Homo sapiens
DDDNTGYFRDSAQCPVLSACSDILRLINGSWLNYDYMEEHVILTEKDLLEDGFGEHPFYHCLVAKMCH

SEQ ID NO: 966430 - protein, 141 aa, Homo sapiens
DSRRIPLRRPLDLTQRGPQRCLHLPYIFSALEGFIVDQSKAPRKGDILPGKFTSWSLFRSKSSISLAISASCSFEPMVSSFWISSFSSFLLRVCLSPSLPEYLWKMATRRPMACSRGHAMAEGWAWSGREAAKCDASGRRT

SEQ ID NO: 966431 - protein, 49 aa, Homo sapiens
RNDPVPNVTTLGAHLQRNSAPVTSTPGWVTTPSTSKPGEESNTAAISWF

SEQ ID NO: 966432 - protein, 58 aa, Homo sapiens
PSLDRSLMFIFSWYYVIVAMVIAGMMYKYIETKGESVDTTWITAKTIETSSFVRASLV

SEQ ID NO: 966433 - protein, 119 aa, Homo sapiens
EAKGVPVRERVVHVLLVTHHETLMHVAGPRVGEIPFDTFWGSGNGEEGMDVDDPSSGSLNGMGGFSNVNFGRSLLMPKSPAERKQDPPVTHDLRVSLEEIYSGCTKKMKISHKRSTDGV

SEQ ID NO: 966434 - protein, 52 aa, Homo sapiens
MPLLAMIEAGESFEPGRLQIAVSSGHVIALHLGKESTRRQDTRSPTSSFLAT

SEQ ID NO: 966435 - protein, 45 aa, Homo sapiens
MACPSDQVMWLLSDIFHKYSGEEGDKHSLSKKELKELIQTGAHRL

SEQ ID NO: 966436 - protein, 83 aa, Homo sapiens
YRIYVRRPLVRRPLVTAQINWKPPVNTQERSISASDAREINQNGLRVLNLVPEIKCTMNGGYKKPLAQRLRFGEKLPSPPSGR

SEQ ID NO: 966437 - protein, 68 aa, Homo sapiens
LDVYACREVESEVMMSDKERGTIEPLQRGDRSRLWHSQQAHGSLTLNSRQSAWALGEPTGHVSNPRCS

SEQ ID NO: 966438 - protein, 33 aa, Homo sapiens
IGSPWLRGMLSDTGLVLRKFLQFYAVVSVIDPV

SEQ ID NO: 966439 - protein, 89 aa, Homo sapiens
VRSWNHCIQSGCILISCMESIQSSRCMDSTAYSRDPFITLLEYTGFNRDAFYHERSTDASVDRGPRRSGIELADEIANSSGKGALAVRG

SEQ ID NO: 966440 - protein, 99 aa, Homo sapiens
ECSRCREYSADVIEHKHWYCNDRRHDQWKMYRRILDPIYPDRCSSCIHWPSAIVSLPLLQSIIPFYLLPEPQVPVELQGLTFQNSTPGVTSSRSAFLAT

SEQ ID NO: 966441 - protein, 69 aa, Homo sapiens
AHAGVTLNQKARFPRSYPPKEPWVQEYSTCARLKDLVTFRHQSCDHLEVTEAGSCPPLVLPHYMTRNWF

SEQ ID NO: 966442 - protein, 47 aa, Homo sapiens
RTLRGGRLKGSGPVAVAGGGANGTSFSYTYPWRPYMPCYAEYFWWQK

SEQ ID NO: 966443 - protein, 44 aa, Homo sapiens
EEEYIRLGSTDEGYLPEYQLLISFLTGPGKQGVGFLFTLYSTTR

SEQ ID NO: 966444 - protein, 71 aa, Homo sapiens
VHVTLAVNVICELARCIRKKYLSLVRLFFKLMNSSTNKWVLIKIIRLASVPSGLCSSVTWRGTLGGPAVDG

SEQ ID NO: 966445 - protein, 50 aa, Homo sapiens
QNIGALFEVKKLEGCQYYVATLNPEQLVLSRVGIILSNSIGQGATDRHPP

SEQ ID NO: 966446 - protein, 48 aa, Homo sapiens
SSTAGFDSERTPEGVYIFPINFQPFEGFIVDQTQGPQEGEYSCEVTSW

SEQ ID NO: 966447 - protein, 59 aa, Homo sapiens
EDPPSVDRLLDSVCATVSSTNLKMLLEHLVTYPKVPLAGPSVTEAAGSHMDVVKKRSTD

SEQ ID NO: 966448 - protein, 74 aa, Homo sapiens
RCMRVYDNGDCTCWKSAPWDKDLCRTTIVALCRADGEELEHGGEKLYPLQRKTNRDPEAHRTGLDRLTSLYREL

SEQ ID NO: 966449 - protein, 122 aa, Homo sapiens
EDPPSTFEDVTQVSSAYSEDSTCEAVTGKTSNIRANFENLAKEKEQEDKRSNISQFIFLLNLKPCKHHESILKTLVINNSRQLKTTMSARSTLFALTMTLTPAQRLGGSTLRHGVWRSGRRT

SEQ ID NO: 966450 - protein, 84 aa, Homo sapiens
QYLPGDSVALDTLQTDPSSGSSIGGGSHSRSNLLAITDAEVASILETGTRGSLSFNLLAILSYSGANCLQCPHPWSIKLQQHHQ

SEQ ID NO: 966451 - protein, 57 aa, Homo sapiens
PPSVDRLLDSVFSTVFSTNLKMLLEESCHLSQVPLAGPSVTEAAGSHMDVVKKRTTD

SEQ ID NO: 966452 - protein, 138 aa, Homo sapiens
RIPRPSTAGFDSDRTPLWCLHLPYLFWALVGYIVDQSQGPQEGDILLEVHLLVLVPVQVFHQPCNFSILQLRANGELLLDQLLQLLLAQGVLVTLPAGVLVEDGHEEANGLIQGAAMAEGWAWSGREAAKCDASGRRT

SEQ ID NO: 966453 - protein, 65 aa, Homo sapiens
VVAEVSRGSRTCPGRLVFTLNAAHIDLGSVATDTASLHTLPGSVHSAPGLVACEVPCLCASPMVC

SEQ ID NO: 966454 - protein, 45 aa, Homo sapiens
VLLLRRRKKLAIMHRGRVAIYSPVNIAADAQCMRPSSSNSMQHHQ

SEQ ID NO: 966455 - protein, 171 aa, Homo sapiens
SRGPVQAAFRPWSLNDSSSLINSKTGSLSHGTLETGGRNGGWKQDSQLQKARDIFMETLKDIVEYYNDSNGSHVLQGRFGCEIENNRSSGAFWKYYYDGKDYIEFNKEIPAWVPFDPAAQITKQKWEAEPVYVQRGLVRVQGPALEPILIPKLRLRLADFPYLHCSNMPEV

SEQ ID NO: 966456 - protein, 49 aa, Homo sapiens
CCEKFAEEDKKLTERIDTRNELGSYAYSLKNQIGDKKSWEVNFPLKISS

SEQ ID NO: 966457 - protein, 52 aa, Homo sapiens
RIPYSRCVVEAAGAIATDSAQLPPAGSGRGSRIIQRLCQRLVGGITLRCAAE

SEQ ID NO: 966458 - protein, 85 aa, Homo sapiens
GQSSAPKFLPSWVQTFEDMIVVIPNYHCMLPSPPKIASIITKSIICHPHCHHIHHHHGCHQYATMTTEVSSTTEVVIPTETTTTT

SEQ ID NO: 966459 - protein, 81 aa, Homo sapiens
LRYAAVIINDLKFFNTTVKTGSLQPMGLWRQVEGMEDWKHGHANFSEASEDIFIGDPMKDIRGDITTDSNRVSLYSRARFV

SEQ ID NO: 966460 - protein, 45 aa, Homo sapiens
LSKLSLDRGVYFLVYQIQEIFSSLQPFRSQVYMHPSLSPASTMIL

SEQ ID NO: 966461 - protein, 43 aa, Homo sapiens
KRTCGAQRYGGGGGPDRVHRSYRELFEFFCNNTTIHGAIPPVC

SEQ ID NO: 966462 - protein, 70 aa, Homo sapiens
GPNNPRTIVVLWSDLVLARTKAARLASSLNARSLHACSLHDWDLMCTERDKERFFHTSHLGNQKRVITAM

SEQ ID NO: 966463 - protein, 52 aa, Homo sapiens
TTYFREELDPNKEGGQRGERTFCLENIRFLKGMGYSTHAAQQILLSNPQMWW

SEQ ID NO: 966464 - protein, 45 aa, Homo sapiens
MGGILGPVHTGLLQAKSAFCAKEKTLGVGFQLRRPRGKQQIVRGL

SEQ ID NO: 966465 - protein, 115 aa, Homo sapiens
MILSQDALGLRFVPTAEFPFAECSSEKRVWCRFGDRPLVGPSLACSAWVARACQKMDSSFQISLLCEGEDVWCWFQAAESISQAAVPTEPEAAQTLLGPMGSLGLGENYGKIVRG

SEQ ID NO: 966466 - protein, 92 aa, Homo sapiens
ASGVRIGGIMIVMVLVDCQQLRGGDRGGFRGARGMDRGGFGGGRRGGPGGPPGTLMEQMGGRQRRTWRTWQYMDNRRASSGTRQKSALLDAE

SEQ ID NO: 966467 - protein, 66 aa, Homo sapiens
GPYQQHKEVPRLGVESELQLPAYATATATQDLNHVCNLHHSSWQRQILNPLSKARDEPESSGILVG

SEQ ID NO: 966468 - protein, 108 aa, Homo sapiens
QYGFGINWNQVVYMGFSYKTLTFNFLENEDSSSAGCILYEETVLGNRFRVLGREHRKLGNVWSSRCDAVVNESDYGTMRLRVRSLAWLSGLRIQRCRELWCRLQTRPY

SEQ ID NO: 966469 - protein, 56 aa, Homo sapiens
MPEEDSEEDEEKEEGSEAEQAQGGSVLSAQNAGQSLHQEGEDSGWERHLKWHAEPR

SEQ ID NO: 966470 - protein, 52 aa, Homo sapiens
MKARASRGTSRFRKNFRPSKSFLCFSCASSSFLRSSSCADISPSVGNSSTSA

SEQ ID NO: 966471 - protein, 86 aa, Homo sapiens
MSHTYSRDQSEIDSGHVRFTISSDYSNGSSSGSGLGLGEGSGYSYSSGHSLGGGFSSGSGRALRSGLSSTQGSSSTIRYTTSSSSS

SEQ ID NO: 966472 - protein, 47 aa, Homo sapiens
AGCTKASASLVAFQFISPMNRCVKTVQQSYTLHIVWTCQTLEGDSDG

SEQ ID NO: 966473 - protein, 48 aa, Homo sapiens
RILGRAPAVSAEAGVGHESVEELYLYRSKSVCSVIRSSSSSSSLISLY

SEQ ID NO: 966474 - protein, 116 aa, Homo sapiens
ITADIRSISISRHHLRLTLRNRGDIILIHVVLHNRVWVGEVVSVLPHAQALLGDIVVEVGRLHGQVSGVNLMELTFILRGLMGRLTHSQEVKSKVVSVVKEELGPNSLDDNIPGIH

SEQ ID NO: 966475 - protein, 41 aa, Homo sapiens
MGPGYVIIQDFHRHSYQLGLKSRDNTLSKYSYTTGLCRASE

SEQ ID NO: 966476 - protein, 39 aa, Homo sapiens
SHFNETLKQKLGIYDAMNIGLVRPGTALDVAGSPSSYWL

SEQ ID NO: 966477 - protein, 42 aa, Homo sapiens
LVVVLERHAESGVRQQFADGAGKLEQFFLSHAASHARLKCVQ

SEQ ID NO: 966478 - protein, 67 aa, Homo sapiens
IGERYPSRYTLAEIPVMAVTHSRSELTFTLIRKVNGVRSNTKKNKILEIRKIICKHVSPLWLTEYRL

SEQ ID NO: 966479 - protein, 64 aa, Homo sapiens
MQSQPFTVKTAKPLWAGNPNMLLNAARNHQEGTYIIELSTHDPGQWLGLIGQHLPNPVSTCTPE

SEQ ID NO: 966480 - protein, 72 aa, Homo sapiens
EGTATRAHCKMVLQTTYYYIRKTHGSHCLTRLDQPSYKEASTGTLSRLSEQLLAGNRIIVTDKIHRIPQSPL

SEQ ID NO: 966481 - protein, 101 aa, Homo sapiens
PGVVIQIEIFLICFSGMYTFLLLPFRVSWLGSPGLSTGCDQSSGSKSCIMSSVTSTVGTGVPGRSASIAVRRWCWFWGRRFGCAWFCARFPFKGAWLGSRR

SEQ ID NO: 966482 - protein, 58 aa, Homo sapiens
GVVKSRWFRSRRDHVLDSAMSLPQCQDGIKSMSRSKSTPKSPEDEVTVSLKKMVMSVN

SEQ ID NO: 966483 - protein, 53 aa, Homo sapiens
LEDSVEYVNELEQLDTGEETAGSTTDPGPVFNVLRRMNVFPGDGPLCLSFPAS

SEQ ID NO: 966484 - protein, 31 aa, Homo sapiens
MIVGRTKVQVEYKGENKSFYPEEVVFYGSDK

SEQ ID NO: 966485 - protein, 42 aa, Homo sapiens
MAMPPPRSGGGCTVATINGCRTVNTKELLLESTPADAHMEYM

SEQ ID NO: 966486 - protein, 34 aa, Homo sapiens
MRTVEVVKSLQWAGTCELDLDLFLGVLKPLGRKK

SEQ ID NO: 966487 - protein, 86 aa, Homo sapiens
AVSICRDRAYAHVRHGWMLDHIFIYSGSGDSLVSCVSDSADSVLRGLVVIISLTYLPRIKEYLDQLPDFPYRMPPGLGVQLPPANV

SEQ ID NO: 966488 - protein, 153 aa, Homo sapiens
MSYAVSLLKLKFYDLDLWEWSTRATAGVQCCVSLGGVCVEFIKLPACESFLTVTSSSCPKMPDAADMMCHSIVPLLSPVIMMTLDACLPGTASRSECHLDSRSDSSMPTQPTKCQTGLIFNKVGRVLNVHFFSSQWVVMSWHTRHRSVSLPLP

SEQ ID NO: 966489 - protein, 190 aa, Homo sapiens
YQCTFFPKSGHRCPECGLSRPRRAPKRCSTVKMPKCSHAWLQEEEGPDVDVSLPKADIDVSGPKVDVDVPDVNIEGPDAKLKGPKFKMPEMSIKAPKISMPDIDLNLKGPKVKGDVDVTLPKVEGDLKGPEADIKGPKVDINSPDVDVHGPDWHLKMPKVKMTKFSMPGFRGEGPDVDVSLSKDDVDVSG

SEQ ID NO: 966490 - protein, 137 aa, Homo sapiens
NQARYPETSYDDFETAIRMYNERKDKDINPQSFYRRNPSRHFLYVECLTDKLAYYGTQSTSREGLGEDMYQVRCYLECSTIILAVIMLYSDGFCTPETLTLAASGLLALEIDLLSADDCFRRPLYVLVRRSLCWGDS

SEQ ID NO: 966491 - protein, 65 aa, Homo sapiens
DRARYRSARSQGLLRLKFSTHIEILHVLYGHHLVLNWFLPLLFLLLVFESVFCVFAGEIAFLVYS

SEQ ID NO: 966492 - protein, 113 aa, Homo sapiens
MIVGICLVYTRTRMEASLRENGEEYENQPARQVHLALSVAKPMMSRRSCGELALWFLALNDSGWRCRDVQYHFRWSRLESVHHKTEGVERPVDAPLLFETSLAYNKWVNLCIK

SEQ ID NO: 966493 - protein, 77 aa, Homo sapiens
MQVAGHEDSNGCINYEALVRHILSGVSGAHGGGARPYGAEWLMIFPVSPESVPFPCVNLVSSLKFAYAFLSQRLTDL

SEQ ID NO: 966494 - protein, 57 aa, Homo sapiens
KDDMLVAGHRTAMVVSTMKRLCGVSCRGDGPMWAELVRMVLNGVMTFPVSPDSVPFP

SEQ ID NO: 966495 - protein, 66 aa, Homo sapiens
VRTRWAQQLEVYSTYFCSDRLIAGFIEKTRADQGFCHRTGVAVCRVGYDASRVTLLLLADSPGNAY

SEQ ID NO: 966496 - protein, 116 aa, Homo sapiens
CEKRRDDLWSLKFINARQYLNKATGPKLRKAALKISVGATSEQNPSLRAVHAKTSPVKANYYTQLIQNLTNGTSYPRDNSAILVLESISTIGFTTSMLDQDIPMVQPLLKVRLFND

SEQ ID NO: 966497 - protein, 52 aa, Homo sapiens
MVHPEYRPTRPANQFVPRLSGFKIHPMAYQLQLRAARLFPSQSRCFADSLPH

SEQ ID NO: 966498 - protein, 122 aa, Homo sapiens
PFEKREMTYGVEFISARQYLTNPQVLNYQSRALKISAGATSELEPNLRAVHAKTSPSQSELLYSIDPVTGPTEQVTLGITAQSYSRVHINNRVYDLDVGSGHPDGAAAIKGSFVQRLKSYVI

SEQ ID NO: 966499 - protein, 87 aa, Homo sapiens
RYRRDEMGTLLNRKPRETLVLDTKFTQWNTARDSGVRLVNVSSAIQHHADDAPPHGARHPELDMPHKRFIVDTTIAVLMPCHQHLVS

SEQ ID NO: 966500 - protein, 70 aa, Homo sapiens
FSVPLDFLPHTYPESRTRNVTPGRSPGHSPLRTLVVVYTLYRTDSKSCHRSVLHCGPPRELGCNGAWKKS

SEQ ID NO: 966501 - protein, 81 aa, Homo sapiens
LRETTRGGISTTWGGYSGMDKRCNDTAFTDGQGIVILPVFVKSLKQKFLQMIFSLRNTITSMCLTEALCVLLRCFCALPFW

SEQ ID NO: 966502 - protein, 49 aa, Homo sapiens
VDSIIGLRVSLVVISTIGYTTSMWDQDIPSGAAAIKGSCVQRIEESYVI

SEQ ID NO: 966503 - protein, 39 aa, Homo sapiens
MRDELCLVDPIHRCGYALPPLSRGYPSYSRTDGHASHGL

SEQ ID NO: 966504 - protein, 92 aa, Homo sapiens
GGVKICDLSAYSPSPFWRFLSQSFTLLSAMPCFACESVWYRTAQEGDHGCHVYPIALLSYAFALAGYQDKRNEVLKSLNEEAVKKDNSALSG

SEQ ID NO: 966505 - protein, 89 aa, Homo sapiens
MSNDYRVYDREVKWHRHGVLKSGTFLSHVVRQMTEEGVEMLVEHGMDVTAMCCINYDAYVRHILSGCRAHGAELVRMVLTVLVPSQSPQ

SEQ ID NO: 966506 - protein, 61 aa, Homo sapiens
RDEMLVARHEDSMVDINYEELVRDGAEWVTTFLCLAQQFRALPWCEFCIYAYNVTLGFLCL

SEQ ID NO: 966507 - protein, 37 aa, Homo sapiens
PIQETIEAGEAGRQNRNEACAADMTPYIPQDIAFLLL

SEQ ID NO: 966508 - protein, 114 aa, Homo sapiens
LLLRSAPVMLFIRSAADGRLRVPNCASGPARRSRHIFVACEGSPLLPVHFDASVEDSTFGQSCENLTSLNLILSTAASSLFFPAVKEVTTVRAPIQHTHASLSGGHQKGQKDQV

SEQ ID NO: 966509 - protein, 61 aa, Homo sapiens
PYLEETRCTREETRCTCHVQHEGLLKPLTLSMGAIFHRSTIPIVGIVAGLAVLAVVVIGCC

SEQ ID NO: 966510 - protein, 66 aa, Homo sapiens
SFAHSSHALSPYCRLPVGSSVPTCASDTSPNGVDIIFVACEGSPYVPVHFDASVEDSTFGQSCVIC

SEQ ID NO: 966511 - protein, 64 aa, Homo sapiens
NEPALLKKRRDGDTSPNSRNKKDDWGGNTGQHGNSVSQLDTGVGLYSPPPTQLGYQGTQHTYQS

SEQ ID NO: 966512 - protein, 46 aa, Homo sapiens
MKAMLVECAVRIGGAASLRYACLLLLCNRVFGRQWIFLLRLVSSLV

SEQ ID NO: 966513 - protein, 102 aa, Homo sapiens
MRCTCHVQNEGLPKSPLPETGSELARYHHPHCERCLAESWHDSSGTMWSLVCCGRSCDVYEEELMCEKEGCYSHGCVQRQCPMALMCLSQLENAGDSCLVRD

SEQ ID NO: 966514 - protein, 50 aa, Homo sapiens
KDNRIYRKQMVSYISTTTTVIKKARQYEVGPIEHNRTVEGHSCDRAKRYW

SEQ ID NO: 966515 - protein, 118 aa, Homo sapiens
YERQLGKLLNVADHASPKTGKNVHVAHPMNTQYSAGTQATIKCLGQLYFPNPEYEKGFHMVLILIFTVSLDKSKLLLPRLACTGAIFAHLNLRLPGSSDSPASDSRVAGITGMCHHHL

SEQ ID NO: 966516 - protein, 50 aa, Homo sapiens
MRTSSAPCGPITPERICLANASTSRYNLQLRYSHDHAAPSISVSLCVVGR

SEQ ID NO: 966517 - protein, 148 aa, Homo sapiens
MSQRINILSRLCSQTILGSIRYPTSAKCLSIDFGFVSRKADLRNSCILEPNAKMNYCTQVEETLKICSQGSPNFHDSIYRWLQNKYNLSMVIQVRRVARITSGGNDGREISGVLVMFHILIRVVFQLACILGKSSSSCMLKMCPLYSI

SEQ ID NO: 966518 - protein, 34 aa, Homo sapiens
QLGPSLPAHFSILDILVSHAHGQVAVAAVGVEAL

SEQ ID NO: 966519 - protein, 115 aa, Homo sapiens
RKERSRELVPCFAALLQYRLQATAMGGIVQTLLSPFWAPEARRLEEGGSGTRKRLDAMAEGTLVLWTGGGIRVPPKFTCWKFNRNATVTRGETFKRLLGHEDSALMNGLIPLSGE

SEQ ID NO: 966520 - protein, 72 aa, Homo sapiens
IETCKQHHGGLTDAAFGLDEFQILRELAFNYRYAYTRVHFMHHNVGVIHDVKMDMIILYNPTKSADSMYDVI

SEQ ID NO: 966521 - protein, 46 aa, Homo sapiens
SSSAHISIAEKGLNNNLHAGTGDVVIPGIFIALLLRFDISLKKNTH

SEQ ID NO: 966522 - protein, 36 aa, Homo sapiens
SSSAPDFIDRGEGYSRENCGFGHELDRDTVFALVNY

SEQ ID NO: 966523 - protein, 40 aa, Homo sapiens
RGNIPLMSQGLVAALLLAEDVTGLHFWWGLMEPGLTMTRP

SEQ ID NO: 966524 - protein, 41 aa, Homo sapiens
MKKSFIPFSYGKRICLGEGIARAEYFLFFTTILQNFSAIEV

SEQ ID NO: 966525 - protein, 37 aa, Homo sapiens
LSGPVAAKLVRQPWLQLPGPLLVVGDNAPDKTGVGVA

SEQ ID NO: 966526 - protein, 68 aa, Homo sapiens
MDSVLRDLGITDAFELGKADFSANVPEQTCSLSKVAALVYRCEVNEEGTEAAAATAAIMMMRCARFVP

SEQ ID NO: 966527 - protein, 36 aa, Homo sapiens
SWPSLCAEVWPRRSADTGAEGLARTDSSVPAPDLNS

SEQ ID NO: 966528 - protein, 114 aa, Homo sapiens
PHLFDRTRKSSEITKSCCTLHAQRCRMEWLTLERISYTPLDICDQQIILLWNGLIRLRVADFGLARLIEDNEYTARQGAKFPIKWTAPEAALYGRFTIKSDVWSFGILLTELVT

SEQ ID NO: 966529 - protein, 66 aa, Homo sapiens
GAQRRSQRRVEVSCPFLTGHSCLRYIVRDLSKMTGCRISSCDLTYFTPFLLLNGLLGRQGVLLRDR

SEQ ID NO: 966530 - protein, 102 aa, Homo sapiens
MCGDNTIIRSVYALPTAILVDTALLTRRTPSRPRLGSRKSEGGKTSSTILGHSHSVFFLLVVPLVRRVFFSCVSVFFSLGLAENLAVRLGRGPFRDPQAGAI

SEQ ID NO: 966531 - protein, 116 aa, Homo sapiens
RSTSAAEESIAPCRQDRCRAVKEVLMESPPDYSAAFRADFGIPCCPSAPETPSYSWLVVVVLIVVMIVELLLMGLHMSQKHTEMVLEMSIGAPEAQQRLALSEHLVTTATFSAIEV

SEQ ID NO: 966532 - protein, 116 aa, Homo sapiens
HTSIAENGTRWGGGPVSENREDECASARSALVHSACLWIVYILTRGSSSHHDWGLEEDGGRKSSRILGNFTPLLLLNGLFGGRVFFSCVSVCFSLALRRIGQSDRGGVPSETHRPF

SEQ ID NO: 966533 - protein, 103 aa, Homo sapiens
TGYAFTTDKSAIPQENGMTASFVFRVAPYVIQKAVQDGRRLVFHSLVCSQTSRAQDEKYFRVLGDGVPSEAGVLGDNVGHTHGEKVSKSLNFTDDCLCVWHFG

SEQ ID NO: 966534 - protein, 35 aa, Homo sapiens
VDLEDPPARIRFTLNVTLPHHLLPLCCRRGSRPES

SEQ ID NO: 966535 - protein, 40 aa, Homo sapiens
PHCMQDARSMVDKYFRTELRTGSGSALDFFPTQRDPPSFQ

SEQ ID NO: 966536 - protein, 101 aa, Homo sapiens
MRLLNQYHRFGEVLFWKNESRSGEDVSSCKAWGRRFFLECGHLHFSSGILQRRKKVSFSDLALLTVYFALFTDSDESTARGTKTSSEVSMSQYSCKSCNML

SEQ ID NO: 966537 - protein, 35 aa, Homo sapiens
MSLGYNGNTLGLDSTQVGVFKKANQIGLTCLRQMW

SEQ ID NO: 966538 - protein, 36 aa, Homo sapiens
DYLQDSDIEEEKDGIRKAREVLMRLGLDTIWQILVS

SEQ ID NO: 966539 - protein, 52 aa, Homo sapiens
MTYPRLRPGKHHRHCNTRLPEFSELQGCFREELMYSFTSVQCAMASHELLTV

SEQ ID NO: 966540 - protein, 75 aa, Homo sapiens
ERRVSTSDCVRGGDCTAVVVCSSLTSNHVLCVSRSKKSCLLSPPSHPFCIGTTSIDRSTTSNLFVTLVETSTLLD

SEQ ID NO: 966541 - protein, 44 aa, Homo sapiens
ETWKTSSPLYNRLLSSQAAGCFREELMYSFTRCRCKASMSSSRK

SEQ ID NO: 966542 - protein, 34 aa, Homo sapiens
RGSPNKESVFIAHEPSLSAPDAIIFCSVFTLQMS

SEQ ID NO: 966543 - protein, 30 aa, Homo sapiens
MSIYEEFVQMMTAEDEDLLSTSFFPPSSKN

SEQ ID NO: 966544 - protein, 52 aa, Homo sapiens
RSTAGSVDAPEWKREPLCSLWDIEYPSLDLACGHYPLRSAVDELTRQTLNHS

SEQ ID NO: 966545 - protein, 87 aa, Homo sapiens
RLAGLQEEGDECIIMQHRYNSNKSPFNGLACRPDGDTHYACHARRLIVQISTLASLMPQIRKEVKKHCYALLAIQTHRKGIHHVYNH

SEQ ID NO: 966546 - protein, 120 aa, Homo sapiens
MKRVACTRLTPQEITDLIAWILRGLTSPICARDTGTCHLFFPRIIGGIDHSLYTGNLWYTPIRREWYYEVIIVRVEINGQDLKMDCKEVRKPRESLGTYGGRQYNVKEDSGYHVGTMRQT

SEQ ID NO: 966547 - protein, 54 aa, Homo sapiens
LLLRPASGGISSFSLSTPVILSLALGRVSTFATGRLLKVVCLRAISVRHNVCVL

SEQ ID NO: 966548 - protein, 66 aa, Homo sapiens
SDKPQKKKKHKPQDGSSGEWNERTIYLFLQTRDYRKSFTKEEEMSSDPKETADRTQYTREEEVYTQ

SEQ ID NO: 966549 - protein, 47 aa, Homo sapiens
RPHLTLCVLCAKGIIIVLSAKCKCKLWPRSPGQPSRGRLHLLITPRL

SEQ ID NO: 966550 - protein, 70 aa, Homo sapiens
EDPLRRTTTAEFTEASSCLTEQVMADPVQPVWGLDEGLGQNPTNAEMLKVLGNPKRYEMNVTVLDLEHLS

SEQ ID NO: 966551 - protein, 78 aa, Homo sapiens
MDVEKWSCHGCVTSSYLSLTSMAQSYATRIQQRLNSEEKTKSVEKVENCRNRRWMGSALNREDSKPGRNIPFSNLYQF

SEQ ID NO: 966552 - protein, 60 aa, Homo sapiens
SWKIISSAPAPPLLAALAGHPYNFGIVKDSDHVHAITATQKTVDRPSGKLWRDGRGTLQN

SEQ ID NO: 966553 - protein, 76 aa, Homo sapiens
SSRIPFRLKNNGSSNPSAILIHFGFSAAFYIYSNLTRTELSSTLNITIVELQEFWGYFGEITKHNRSYFIQLYCDQ

SEQ ID NO: 966554 - protein, 106 aa, Homo sapiens
RRRTTAGSCPPTDHRWQVGTRKAMPLSFPFSSGGYLAQRLVPLPSRGSGIMFLRQPRRPSRHSFPGGALPQSFWVALDWNWTCRVYQLLPRIPIVVPGCPLFLSHE

SEQ ID NO: 966555 - protein, 43 aa, Homo sapiens
SATVPGLYYFTYLRQLRGNLCVNLMRGRSVRQKVVTFCDFFLR

SEQ ID NO: 966556 - protein, 48 aa, Homo sapiens
SNNQRRVKEASSCLTEQVMARSCTASVADVMRALGQNPTNAEDLKAPG

SEQ ID NO: 966557 - protein, 37 aa, Homo sapiens
MLMAYRVFIEGILVTVLTLEALPVDDGGPCLIILRLA

SEQ ID NO: 966558 - protein, 37 aa, Homo sapiens
MAIYKQYTTHEEVVSALHPTMERCSDSDGLAPPQHLI

SEQ ID NO: 966559 - protein, 76 aa, Homo sapiens
PGHILTHASSTPGVNSLAPLLSALLPIATTRTVCVNGPIGPPDNHWIVRSLSDVSSHHASNCAGRLPLHNSFLQNE

SEQ ID NO: 966560 - protein, 48 aa, Homo sapiens
TSIKMNLASEPQEVLHIGSAHNQKFDVNRKIALLHVVNKYQHKTGFRG

SEQ ID NO: 966561 - protein, 92 aa, Homo sapiens
MILHLPKHLVLCRHVILLVENLLSTSSPIPLALAYWPVVFGLFSVHDYCHDVSCTVCHAWVYTDRCEDIRLCPLLLASVFFKLSERSFFWCF

SEQ ID NO: 966562 - protein, 45 aa, Homo sapiens
MSILGIWQEKWLRSVRELDDAKKVQREPLFTLVTWHTSSPHNRAL

SEQ ID NO: 966563 - protein, 49 aa, Homo sapiens
ENAIIRQKRGLSDHYEAEDGLRDNPETGLVERGPKRGQYWAVAAPLRAY

SEQ ID NO: 966564 - protein, 34 aa, Homo sapiens
RALSFRLVAKFRQSNRYGRQGTGQRELRLPGPES

SEQ ID NO: 966565 - protein, 35 aa, Homo sapiens
ISLIWRDSHRGYAVRIHKNRRLEVGSGGKICVESQ

SEQ ID NO: 966566 - protein, 61 aa, Homo sapiens
MEEQTLWWWRRIQKCNHPSLAEGNKATLAKLFGFLLEYVGDLATDDPPDLTVIDKLVVHLY

SEQ ID NO: 966567 - protein, 34 aa, Homo sapiens
MDTSHKLHCEPRHSAPMPTACGSLKGPPPHRTSQ

SEQ ID NO: 966568 - protein, 33 aa, Homo sapiens
CAKGSYEAGNLYVKISTVDILEESRHTDFHTNL

SEQ ID NO: 966569 - protein, 152 aa, Homo sapiens
ERILCTLEESTNKKGMTQHPRNRERAITLSLLSPQLHTGTSSLLHSGPPRSSSLLHSGPRIILTFTLRAPRNNPHCYTQDPPDNHHCNTQAPGESSLLHSYSRDLQMSLCPPAKYRKELQSITQQWVELQLTTLESRTSQIDQARSQAAPAP

SEQ ID NO: 966570 - protein, 49 aa, Homo sapiens
RIILPPSSFETPVDDVEEEPTCKMDTSHKLNCEPRHIRADTTGLVSLRR

SEQ ID NO: 966571 - protein, 196 aa, Homo sapiens
MSNARILQYQSLLLDQPRLTFSPTKCFNPATLLPDSDCTIPAHDCQELLETIETGRSDLKAVPLEKADAAVFTASSSFLKQEVGKASAVVTMETDVLEAQALPANTSAQKAELIALTQALLIKSKRINIYTDSKYAFATVHVHKAIYQEAGYSPQQLAVIHCKGHQKENTAVAHSNQKAAEESLEFLLAEMVHESG

SEQ ID NO: 966572 - protein, 128 aa, Homo sapiens
DGNLIVPQDLRSPEHGAVYILSGLVNIQPVALRNIIVQASKLDLSASSLEIEQPEWEKRRSINLSELIDVYSDGVELLQMVKAPDSNCSNLLITTSKAYFEDEEEDSSNVDLPYIPAENSPTRQNHKY

SEQ ID NO: 966573 - protein, 46 aa, Homo sapiens
IPGLMEVGWVARGGGMGSYKKICFPSSCFRTSSVRQLEDLKDHMRD

SEQ ID NO: 966574 - protein, 35 aa, Homo sapiens
GGPGHGLLETRAPFRQVAQMGPPMFCIQQLFIEYL

SEQ ID NO: 966575 - protein, 37 aa, Homo sapiens
ERYRLSSDGIEGGEWCGSVILTSGSMHRGTEKLIEYK

SEQ ID NO: 966576 - protein, 68 aa, Homo sapiens
RIPTTTGCEEDACVGEKNADSRRHLGQVSVQVCSTNSEFGGTIQIRLRHDRELREIAVRFPKFSEFGT

SEQ ID NO: 966577 - protein, 38 aa, Homo sapiens
IELYLLLLIPVTVTLITWRSLAEAVAVKLLCHIFLLFT

SEQ ID NO: 966578 - protein, 64 aa, Homo sapiens
EGQYGPDEGVVKRERIDLKACMDSMFMSLDDIQHAVPVQVLTLILYPENTVGHYYDLREVIFLQ

SEQ ID NO: 966579 - protein, 42 aa, Homo sapiens
VGEGVFLLFKPCTLLVAGKITGMCWRWIIQNFFICSSLQSDT

SEQ ID NO: 966580 - protein, 65 aa, Homo sapiens
GPSRDIDTAAKLLVLGQPQLVWLVQSAGIGTVLAAVIIGYARNPSLKQQLFSYAILGFAPSGHLE

SEQ ID NO: 966581 - protein, 113 aa, Homo sapiens
DDSKAYINTKINTDKNTYKKHGNTLLKHQPDLVLEKTLKQKCKQVSKKVVSLPKVEAKFINYVKNSFRMTDQEAIQDLWKRRKSLYEPRINNKKKNNPSYHITVTVDIWLSYI

SEQ ID NO: 966582 - protein, 71 aa, Homo sapiens
IFGVVQYVWGIRIGRDSVVGRKLDLLPMNMIVTMDLVRRFGLGCSLRIGDIREMKPPMMCQYSSYCIGHSG

SEQ ID NO: 966583 - protein, 85 aa, Homo sapiens
MCILHHMLTGKAARDIFTKDWFGLVKLDVKTKSCSGVEFSTSAFISIQTLVKLLVTCETTIQCGVQYWSRLFTRKVEHCITTLWN

SEQ ID NO: 966584 - protein, 35 aa, Homo sapiens
RRLNSTVNQKTARQNTTSHRLKTQRDLAVLHLPLE

SEQ ID NO: 966585 - protein, 72 aa, Homo sapiens
MIYHALNAIMCLINYWSSANQEHESSHRCNAINEVTKTKSAPLNWHQFNAGGWECRMCHLKLLTKQIIKYAA

SEQ ID NO: 966586 - protein, 41 aa, Homo sapiens
MIVKLDFCAYGIGTTGVRLRHRRNQWMNASYDGQYSSYLIG

SEQ ID NO: 966587 - protein, 177 aa, Homo sapiens
SQGEEDKTTWLQNDGSSLTVIEHMSTPESTIAVIILNSVESNLSIVYHPAFNSQLDIQKGNLGIVVLYGLHFKPRRKRKSTLNETPEYQLRILEGSNLNFLIPIILRSSKSSSIITAYTTILAKKAFCWEISLELRAVMAHFSSRFLCSNFICLLHGHSNLFDLVNCQLGGCADKLE

SEQ ID NO: 966588 - protein, 67 aa, Homo sapiens
KIHEGLPTPVLYRDPKILMWRKSHLQDGHETTSCTDEPWHSAPHPPACGSLKGPPPNRTAKFSANRS

SEQ ID NO: 966589 - protein, 118 aa, Homo sapiens
MSTNMEHLEMQQGDAPFAWSLKRILSIIADDFAAFVGLPVEEAVKGLLEPGRARLISPKRMVLGPEKAMAGGLGMFPFNKFISLIQSPAPKFPPKYPKWNQGKFKPRTGQGLMVGFPL

SEQ ID NO: 966590 - protein, 74 aa, Homo sapiens
MGGLRIPTITLSRPQVVMWRKSHLQDETQRPQDCTVNLALRRPNATGTVESLDRDPPPNRDCQSSPTDRSDGGI

SEQ ID NO: 966591 - protein, 58 aa, Homo sapiens
DLEDSGVVKSQHLSYINSCCKIKRSLQIRKRVLRFMHPLHTIYLLCYTIELKIHSKYF

SEQ ID NO: 966592 - protein, 63 aa, Homo sapiens
EADLVEQRKLLDSVPVIRSKSPMLISQHNSFLCYMTVVDASDYCSASIAAKADKVEQRKLLEK

SEQ ID NO: 966593 - protein, 36 aa, Homo sapiens
ADLEESRQPTGSTINFPSTLIIFTILILLTILEIAV

SEQ ID NO: 966594 - protein, 105 aa, Homo sapiens
VIHHILKCLAKQHQPDRERALDSNKATARSKTVLSSAAALIRRTMPRISGVWDTLQLFATDSHSSLVRRCPMTRLVRWCFHRFICMFPDHPYCPALKTHGDPVGW

SEQ ID NO: 966595 - protein, 220 aa, Homo sapiens
VQQFEDCHRAHHRPPVSTPSMYYTRVIVWDIGEIQEYGVSSDLRQQRGLFYSMVEDAGLVVSARAGISGQNCWAYMPEHREESVPLVNQASHTETKNIKTKTRVRKHIRSISHRHPVPFLELAVTSLERQRCKPTKTCTSCAWCTEIDTQPHAPRNASGFLALPTEEFWQPDFWRNRLYEKILVTKFSLLPRISPAEVCGLQVFEMLLAPITSNILVWVY

SEQ ID NO: 966596 - protein, 137 aa, Homo sapiens
MNSESSLLYVDSYRNSVTLYKSFYETPVLGKGCPSGDNIWLVGSIGLSMSLHFRILYVEPQPLIFQITPLNVTQWLMVLKISLPVILMDETLKFVARNYLKPGRDGVQAAIKSCSFSACTDGISWPIVLRIMPLVIW

SEQ ID NO: 966597 - protein, 118 aa, Homo sapiens
LRVSPPVPGLAETGAGNHVPRVVFVDWNPLLIDEVRTGTYRPLFHPETTHHRLRTMLACYYALTGSTPIGKADHLHLPVGTDSPRACLTSAPLLQGFLVFPSFSEGELVLRSPLLLME

SEQ ID NO: 966598 - protein, 44 aa, Homo sapiens
EAWEQVEEEGLRQALQEEVELAEHALQSLAPLTPGHTCTGGSYG

SEQ ID NO: 966599 - protein, 100 aa, Homo sapiens
RYPPLPGSRLTMKQVMPDLPWSKAVLSIDIAVKCESNGQPGNNYETTPPVLDSDGSFFLYSMLTVYYEQVAVGERLLMLRDDEALYNHYTQKSLSLYPGR

SEQ ID NO: 966600 - protein, 52 aa, Homo sapiens
MSEVSYNVLRVVYYDVYVREFAITMPVEATYGEQKDESYGSEHCSRSFHIAS

SEQ ID NO: 966601 - protein, 46 aa, Homo sapiens
GQHALTTPMTKLMDTDACCDQTSRRRTFQKWAAVVVPSGERAEDSH

SEQ ID NO: 966602 - protein, 68 aa, Homo sapiens
LYLLVILEDPGQHALTINTIPSIYGVRFEKKSPEVPITKPTLNRNNAYIIILARTTSTIIDMINHSLY

SEQ ID NO: 966603 - protein, 54 aa, Homo sapiens
LLTRDEMLVAGHQTAMVSINYKALGEAYPVRGDGPMEDESSYQQEVAAMARETL

SEQ ID NO: 966604 - protein, 111 aa, Homo sapiens
QIEPPAVLSGTRKMTGEETQVSMGTGVTVDTRVGCLSTSSHYANRDADTFRCFCRKRCQRLLKSQRGGVKKSCISVPHKTAVSGFSSCERHIRALGTVAGRSLRVAPSFST

SEQ ID NO: 966605 - protein, 55 aa, Homo sapiens
MRRPICTCTFHKHCHTSITHFLLYTFVSCKEVGSSLTDCAAPYHIKEILTTKAEP

SEQ ID NO: 966606 - protein, 43 aa, Homo sapiens
TPSKLDTKLHTGKGTDSWGDWKGSISHSAPMRTSSSPMGPVHP

SEQ ID NO: 966607 - protein, 83 aa, Homo sapiens
SSKNNGIGVRGALVSIDTLICLASAMVLMFRKAASRPPVHSIPDGLVHTVWAHTSTACRLTVPARPMRVESSRGPLLMMAFTR

SEQ ID NO: 966608 - protein, 146 aa, Homo sapiens
RRRSDPSLSRPLAMPTGRCGGLYSHSPAGASFRVHQSSPRLRGEYGCHAEPYQELTGMAPPGSGACRLPFDPITGNLTRPGHGTVIDRLIALSPFRAVVVCMARFLVVVVAAYVCAYSDSERYSGMLTSSATPERSASPNFLEGLV

SEQ ID NO: 966609 - protein, 43 aa, Homo sapiens
FLSKKDNINLVPRYIPQKQTEDMHAFVTEVGYKVELLQIENMV

SEQ ID NO: 966610 - protein, 31 aa, Homo sapiens
MQTPGNPVFVHAGPFANIAHGNSSIIADQIA

SEQ ID NO: 966611 - protein, 77 aa, Homo sapiens
SGSDANVKGTQIWRLLRGLPLLRGLWTCNGSTCPGPHRGPPITTKQTRGGPGVLCARLPSGVMGSGVHVLMLVTLSW

SEQ ID NO: 966612 - protein, 109 aa, Homo sapiens
MSWPDFGQRACWDGQCGIPPSSTLIPTQDPVVAKGQKCIATRYGENQVMEPAPRKEKPWNIARENTEDQRHLPTPQSGLEEYRGWWSLKPQSWGESHGARKGKTESRVQ

SEQ ID NO: 966613 - protein, 46 aa, Homo sapiens
ELVQRCGRHKIVQGMVSKKCNENDIRMMFSPFGQIEECLDPPGDLM

SEQ ID NO: 966614 - protein, 40 aa, Homo sapiens
MSTVAPDILVSPKERSMEFMAAPDSGVGELEAATGLREWL

SEQ ID NO: 966615 - protein, 54 aa, Homo sapiens
MKGSECMYHMENSIIDHVTNSATGMNIQLGRGGHEAPEDGVNATFQHDPPGGKK

SEQ ID NO: 966616 - protein, 106 aa, Homo sapiens
MRVGAAPEHIAADIPEVGVSLVSGTKAWLQTHPGSGKNMACYCRIPACIARERRYGNLYLPGKTLGIVVLSLQKKKYELKMRCESYRESLLLLSLLLNFLPSSGGG

SEQ ID NO: 966617 - protein, 103 aa, Homo sapiens
RYVRPNIIRRGATVITNCTDHASPHTLGHDLFNESEEATQYTGASLDDDACPSTSSCPSLLQRLAALTTVPILARQTGIKPSPHRKSPSRFRLENRDFPPISY

SEQ ID NO: 966618 - protein, 44 aa, Homo sapiens
ISDIPLCVAIMLYCVPAGINPLKGWLTCAETTHTLMPVLGGVVC

SEQ ID NO: 966619 - protein, 44 aa, Homo sapiens
GVCRLMHSASAAMFMVKNGNGTACIMANSSAEFSILNLLSSTYQ

SEQ ID NO: 966620 - protein, 52 aa, Homo sapiens
MVAKQKLKATDIPDGSTESSRTHDEQISKVFLMETDQVEEVTYDVAQYIKFA

SEQ ID NO: 966621 - protein, 36 aa, Homo sapiens
DCSIIPSHVRITCVDHYIGRSTNLNTGRTIIITIGF

SEQ ID NO: 966622 - protein, 138 aa, Homo sapiens
LQSRIDQACHIILELAKNRANGISRELISNSFLYGLPAIINHKAFNVYFPHVETDIFNVTLSCPPLLSAFPGDCGRMTTNGYTHRGGHGGRRTSERTEDETRWGTWHAPGMKMRLSPDQGPQQQQVAERSKSQHAAAG

SEQ ID NO: 966623 - protein, 38 aa, Homo sapiens
SVYVGGLHLLCLTTRMDHVRKQTPLLNSQFKFVEQQQQ

SEQ ID NO: 966624 - protein, 32 aa, Homo sapiens
ARYRLLGNSFSDTHNQGISASIASLMAAAAAG

SEQ ID NO: 966625 - protein, 34 aa, Homo sapiens
PSYLVESLFVSDKELGYGRGLHLIRFGGQQQQQD

SEQ ID NO: 966626 - protein, 106 aa, Homo sapiens
VEMHPLDEAEAEHHIILRFLGLHQTHLDPAHSYPEGEELGVRSRDAFKNHCRPHSPLCSLTIVLATTSSDMPQNNSQTVPSGFFGQQQEEDSSRRRTAAGGGQQQE

SEQ ID NO: 966627 - protein, 54 aa, Homo sapiens
LTACSFNRLFFTAMLFLSRRCPYSSIYRSMGELFKLCLLGATALPPPPEASMAP

SEQ ID NO: 966628 - protein, 72 aa, Homo sapiens
SNYKHTKEGSITSTRISIRHGLVLMPHNMITLTSEKESRQRTLQPFLQEQPEISVLRCCILLQDCGSKINPP

SEQ ID NO: 966629 - protein, 46 aa, Homo sapiens
VGVDCTRQASERTSVVQAEEERPSKNEGEVAGAICVSKPSWNHDDD

SEQ ID NO: 966630 - protein, 76 aa, Homo sapiens
MSWSLGGKISEYNIWAWSQINCSLNTVSNSYSLYGIHQLRVCLSVWWDKGGKIIISNDKFEYLFNFDNTFENHDDD

SEQ ID NO: 966631 - protein, 137 aa, Homo sapiens
DSRRISGFVDQLREDSRRLALAAKRDTNEQRREGEPGEQRRKLEEMKPEIKRTLNSKLLKKKEKLKVEDEPEVLTEPPSATTTNYHRYILQPGQLWEVLMGKRNYTINYNQFKEEKPGKIKLLPENFKLYFDDSTKS

SEQ ID NO: 966632 - protein, 42 aa, Homo sapiens
RFSISNSISYVKVIPSTGFWGLQGFLFSCQEGHRINRNHHDD

SEQ ID NO: 966633 - protein, 73 aa, Homo sapiens
TSCWTLSAWTLSSKLSSPQKFKVQTGRVSLDPECLAEKYQDEEVTARILALPSLLRFRQILCQIQLMRNTFQS

SEQ ID NO: 966634 - protein, 55 aa, Homo sapiens
KAPGFVDTNKLVTNGTETYEYTDYGGLILQLPTYYPPLFLEPCVIYEIHGYLSIE

SEQ ID NO: 966635 - protein, 108 aa, Homo sapiens
MLVTEHVPRTAALAAASLVGPRVPETEAPGPGPSRGKKLQPFGGVPPPQVPSISRAQDQDPWTKHLGDATPTRRSQTSAGPWRQGALLTCGMPYWSMTCQMYQSSFRD

SEQ ID NO: 966636 - protein, 50 aa, Homo sapiens
MERGYGRLGRYILQGKCLMLSFDAGNLIRLLQCRQACHLLPCLPGPLFNP

SEQ ID NO: 966637 - protein, 40 aa, Homo sapiens
KLMLVVPASQCGSLIGKGGCKIKEIRESTLCSVSRWQGDM

SEQ ID NO: 966638 - protein, 140 aa, Homo sapiens
MSNHIRVVLPTLFYKWTPMGSEATGLLSNFQRLLWGGSSFCILVKELVGWIFVAVPVASWDRVALPLGVTAAFNSTKTMMNGCVLFSSFSITKVMTITVAMTTPPTMSPMIAPLFEPTSSERTPIFDDELHILSHVGILH

SEQ ID NO: 966639 - protein, 58 aa, Homo sapiens
GRKEKGELQDANSTIYPSYEKAERKPQTLRSAGPELRRGGVLSLEGGGRLKKRGATSS

SEQ ID NO: 966640 - protein, 156 aa, Homo sapiens
RCVFYEKRMAQKLLLTLWVKNGKGYVVPNQVVRTDQYKGPQMNSRGGLDPMGRVRLLLSKVASCYRPRRTGERKRKSVRGCIVDANLSVLNLVIVKKGEKDIPGLTDTTVPRRLGPQKSYRIRKLFNLSKEDDVRQYVVRKPLNKEGKKPRTKAPE

SEQ ID NO: 966641 - protein, 92 aa, Homo sapiens
RYRTVVYRHSSLATPDINPLSEGRTCTHNHHGFPWTYGGSQAKGRIRLTKPLAHTKATATWDLSRVCDLHHSSRQHRIINPLSEGRDRTHNL

SEQ ID NO: 966642 - protein, 67 aa, Homo sapiens
RTVVYRHVRNLHHSSGQRRILNPLSKARIKPATSWFLVGFVNHCTTTRTPYTHSFLKRESPPGTDQF

SEQ ID NO: 966643 - protein, 62 aa, Homo sapiens
MLADIIFFREIEKASRIRKLFNLSKEDDVREYRSLRKISVNSLGPLGLGFSPLVVGKIGYPL

SEQ ID NO: 966644 - protein, 39 aa, Homo sapiens
MGGLLGPVHPGLLQAKSAFSTKEKTLRFGSSCGDHQASS

SEQ ID NO: 966645 - protein, 74 aa, Homo sapiens
GVRIWHCLSVSKVDYDVVPNQIKNKQTLWQESTLEPDDNHLSIVTLEEAPFVIVEDIDPLTETCVRNTVPCRKF

SEQ ID NO: 966646 - protein, 107 aa, Homo sapiens
VLSRIERKACGMYHIGIEWTGLWNVRGPRHLAARSSEPDSCTGCMWLPGIYTPSPRGLAGLSSRPFLSRPDAHMEVLQNGNHLLNAPASVPALTALPNLCFHSDTRS

SEQ ID NO: 966647 - protein, 104 aa, Homo sapiens
AQVTRRSRSPKARLEMKRLGTLRMDFTVQKILIRDDVANEAYQNDDPINGRDDIEDPGVEPVVVRGEIHTEIRDVAVHETVRFQVQRQTVIQSHPPDSVSPKTC

SEQ ID NO: 966648 - protein, 57 aa, Homo sapiens
LAGSPAYPGVDQRPASDISTIRHTLVFGRFVSNLLGSGPRHIDELLSPSGDTTGFLE

SEQ ID NO: 966649 - protein, 65 aa, Homo sapiens
MLEKMDLKEFDLACPVGLLDYLDKPLPDDLLTTLGLTTCTLFCSLLDPVMTNYMQSPPRTAVDPS

SEQ ID NO: 966650 - protein, 52 aa, Homo sapiens
GRLNPAARKKDVERFFKGYGRIQILTLKKRLWFCRIFDGSKEMLDNCCVLSF

SEQ ID NO: 966651 - protein, 119 aa, Homo sapiens
WGVCMRENGGYHCECWGKPGQGLLRGSSAAKAVPSFLGVLRMLNAIDWRRSACIVEAGAAFFWASVLLCLRPSCRSRVVMGRVKQLVAFLDSGVPGPRWGSRETRLRCCRVVMPVPSAI

SEQ ID NO: 966652 - protein, 62 aa, Homo sapiens
CNSFRLEVAVALLPVTGDEALCQGLVLDVAFFLCDPLQQPVLHPCVVSDGVFPLTAQHFTEA

SEQ ID NO: 966653 - protein, 67 aa, Homo sapiens
HDACDYTCASSYILTQDIIAHRRGTLDHGLLFDIGTFRAMAKVIIAYALFLICVSLDSHSRKHHERY

SEQ ID NO: 966654 - protein, 68 aa, Homo sapiens
IIRDVLMADSSATFTPMAPQYTILASSLHIRKRPYSNGSLSLAREILITIGYYHSLRCNILAHSTSLE

SEQ ID NO: 966655 - protein, 70 aa, Homo sapiens
CHIRDGTVTIPVVRLQSCANYINEPAARPCCENAKTYIASQGCLEATAYDFWLALRGRSNSLCSSFMTIP

SEQ ID NO: 966656 - protein, 41 aa, Homo sapiens
MVNHPLSFAPMAPNILYVCLFLQLGSMAYITNHFSYSANLE

SEQ ID NO: 966657 - protein, 102 aa, Homo sapiens
SISCRSSLAGIPCHFPGTDYQITVNGYRSQLQWNPVCCELSDWLPAGNDIAFHFNPRFEDRGYVVCTTRQNASWGDQQEGKTHIPFQKGMPFDLCFLVQSSH

SEQ ID NO: 966658 - protein, 77 aa, Homo sapiens
DVSVIGKETETVTERASENEIGHRDDASGPEVESHDWTRRDHSSFETPQVDAEPTGRCHRTRVYQGDEIKSINEKFA

SEQ ID NO: 966659 - protein, 41 aa, Homo sapiens
RVCGLLCWMTEARMAQLQSFGSYAGRLSRGGVTNVNREAAV

SEQ ID NO: 966660 - protein, 83 aa, Homo sapiens
LMLLVALEIPCIPGTVWVSEGPIWQPDPVCDIWSYSRLVGGSWLAEYEGTGPGSGAHLGVAESPALPPYFLASLCFVPPDLQG

SEQ ID NO: 966661 - protein, 83 aa, Homo sapiens
IAEVELPEKLRHLKNTTGDHQYWKVFEQLDAPFGSCFENAAGTPCDQKPNCTLHLHKQLTGHLAGPCLLVLVCDRVRSLVPRS

SEQ ID NO: 966662 - protein, 93 aa, Homo sapiens
TSLDGGGLSPGQAQKVNLTIFTARLYYFWDTDYQDGLRCPESVTGPPWRSCATKILNIVGDNFVYYDNKPFEPWTGLKYNFLSLDCMLQEILE

SEQ ID NO: 966663 - protein, 86 aa, Homo sapiens
FAEGSGDAHLGERLSAQPLQFLEGLASSLPAQPLTLPYVVVALCLRISVYSYLASCYDKYCKSVGMLQELKIAHEMYDPSWGENGV

SEQ ID NO: 966664 - protein, 131 aa, Homo sapiens
RVGEHQNGRLWFRSPRVIGLLKSTFIVPDHVVPCESIGRVLAQRCFEAGINCMVYQLTSRGRHASDSMKRLPCAMKTVVSVYGNLSRIYERMEALFVLEHFTFLLSATTAILREHLVEQPDWKFTASPVAV

SEQ ID NO: 966665 - protein, 67 aa, Homo sapiens
CSQNLAGSHIAISKVRGMKEISLTGFLSCTIDSMTDWREDNGRLGLEIGWVGQGMERKRQTTNAFHL

SEQ ID NO: 966666 - protein, 60 aa, Homo sapiens
MDPRAQNDEVIPWTVIDISACVTYSGLIQHATTVVNQDFRTSSDGIYLSEKGICSATLIN

SEQ ID NO: 966667 - protein, 50 aa, Homo sapiens
MSIPEDYTQKVPNVLRQHGIPISLPGPQSQGSQGSSLAPSSMPASHFTAK

SEQ ID NO: 966668 - protein, 69 aa, Homo sapiens
SVRLYDGLPEPGQYSLQTGFKAYLYKPVCSNLSDFRSGFSQLNTSNLHLFSVAVLTTVLAHYSTLRHSK

SEQ ID NO: 966669 - protein, 89 aa, Homo sapiens
AGGRSGVRDGARCLSRLQVYTTVYLLAYSQQAAHARLVLTTDAKSLRSQVIHCQGPIQRANSCQSASNCISPCDATRSVTPSRPLSSQR

SEQ ID NO: 966670 - protein, 128 aa, Homo sapiens
ARSDRRWDDTLPLLEHYRPRGTGTGSDQDCLKIVVILDALSSACLGPIPAWQICNLTSDTLTSDSYKKWRLSSMDRELEAGLHRGRLQDTHPNILLSCTLEYLIPLRSRSDEDQEEWGERSHRSDRGS

SEQ ID NO: 966671 - protein, 83 aa, Homo sapiens
DSSRSRAQISSTCCLVQYEQMLPYALQLRTFNPQSLHVPVIHEILTHITSVNIITARSPLTIVLHILFLHIIKQTLKKETTDR

SEQ ID NO: 966672 - protein, 66 aa, Homo sapiens
MLPTSRIFTTYYALPVAFAHWHAGLGSSTQLRLARLPPFWLPIAKPPVYLSSPYLHSLPFLLIRGS

SEQ ID NO: 966673 - protein, 69 aa, Homo sapiens
TRVSNMKTGHKPCKVWICVEHTLNGPWKNRADKNVFPDHTQYHGNEFLLTVRLFDFISIRIGSIATQTM

SEQ ID NO: 966674 - protein, 78 aa, Homo sapiens
MSHFILASRGSAVRVQSIITLDRRVCGRWDVLLCKRDGAIYAPSLSHVLTSVLVHILVGRSLIYDYNPLTATPNCGYF

SEQ ID NO: 966675 - protein, 58 aa, Homo sapiens
MPPSHLQADYGTQGSASVPSDRRVTSSGSVIPNTRARSDTLIGCLGAITSRSALHAGP

SEQ ID NO: 966676 - protein, 42 aa, Homo sapiens
LSKVFRAVQVKRSGLKCGKNELQAMCPPLVFQEPEIFVQVDP

SEQ ID NO: 966677 - protein, 63 aa, Homo sapiens
LLVDLYQDPRNSRSPESDSGAMKAGVPTDVERGCHVHMPLHIHCITPRVSASLMLPSLALDQE

SEQ ID NO: 966678 - protein, 99 aa, Homo sapiens
PYEVPVCSETASTAASLRYPLSMTTVITRALPFLSRWQRVKEFRNHPKHYIVNYIQGSKQDCPALGSPSMLFKARVGVRVSGRVRVEAGRLAGPPYPRE

SEQ ID NO: 966679 - protein, 30 aa, Homo sapiens
MTRCSGAEVLDSWVHTVLTWWTRNCGDNAI

SEQ ID NO: 966680 - protein, 91 aa, Homo sapiens
IPRVVDEVMICSQNVPRLDENTKEKSTGCKASIPAYIFSLIFIFTIYRRAAYFLAELNLSKLDFPPVSLAQVPTLAVLILFAIFPISQRDL

SEQ ID NO: 966681 - protein, 53 aa, Homo sapiens
MVTSSIWLSRTDLISLHCILFNQPHSPRSNRHSHPNPLKLHRRIRSHYLPPAY

SEQ ID NO: 966682 - protein, 74 aa, Homo sapiens
AAADARLTHDQQAVPPGQLRVGERQPLLGPPESMREHVVADSKDMKNMMTWKNCQRFIINEKMNGKVWDLFPRG

SEQ ID NO: 966683 - protein, 83 aa, Homo sapiens
LGARRFGLVHTDLAILLYKCWCASTHRTLATFEKDAAEMWKGSFKYAWVLDELNAERERGIIIDISLWKFETSEYYVTISAPL

SEQ ID NO: 966684 - protein, 67 aa, Homo sapiens
MSYVASLKALSDPHSQLIAVVDDVIASHRLTSPLPPTINLLEERSVLVTIFIPESNITLLVTGLIIL

SEQ ID NO: 966685 - protein, 126 aa, Homo sapiens
RNNWIRPRFYYCGFLGKLSAMINEEIGAGRIRIAPSISDILGPAPDGTYSDRICRCNVFINHERKSEAVDDSSVYRRHSDHHPDADRRFGGVLPLTRRASFRETKVFGFREESSYSRSSSKFRMSR

SEQ ID NO: 966686 - protein, 69 aa, Homo sapiens
MPQGHRDFIMYVITGTSQAACAVRIVAAGVGYFEAGLSMNGQTPRAVPFWRSPRGVRPLIVSVNSNGFH

SEQ ID NO: 966687 - protein, 39 aa, Homo sapiens
SRASVHAADRIPGNQVFDEARTERASDQAAFRGENWIRV

SEQ ID NO: 966688 - protein, 83 aa, Homo sapiens
RTPIFVVLALALDSRDMLATADYMTEEGLGESGLSWLQEAASFLTYDTLTRSPAAASPGTSGIKRELMCLDTLDHRPVQELSE

SEQ ID NO: 966689 - protein, 57 aa, Homo sapiens
EDKQSVRIVVEMGENDISAFTLREDTNDGAEVADAEADATLSKNEQEREAQLIHDPN

SEQ ID NO: 966690 - protein, 75 aa, Homo sapiens
FVEEQRQTRIMGGKTLALPWGVMLGEREEMWLTPAGSIRLDTAKAHRLPGREDMSACPALGLWSVGLTPFSLLPF

SEQ ID NO: 966691 - protein, 71 aa, Homo sapiens
DHDYWTSQAVHGHLQTPLTKIWSGLGQAPAGRTLSSALSLQELQAHFLIGNQDNAATLFNSPVSGARTTNI

SEQ ID NO: 966692 - protein, 41 aa, Homo sapiens
EEKQRYGSCKRMTVSMTELVKAGPRAIPGSQEAPMGFYLFL

SEQ ID NO: 966693 - protein, 78 aa, Homo sapiens
SSKNNGIYNTKTDNALSYEMNKNVFSALFLTDSKLTSFIEIVAILTVLYFSSIKVHWVPGRSRSTAAYFHIFQSIWLL

SEQ ID NO: 966694 - protein, 59 aa, Homo sapiens
RTPIFVVLAYCQVTSTDSVARQFFAIGLKVMTNSSTGCYVAKQDWSVLHRWGSVRPYAV

SEQ ID NO: 966695 - protein, 100 aa, Homo sapiens
MVNEPNWITAGAILSMEMIPSWLNPKTRGDSSVSWKSSRSWPEDDDGPSVTEPLVGARLDEEVGFELLSTAPHQLVKDVEAALVLVLADGPRLIQQVGSQ

SEQ ID NO: 966696 - protein, 103 aa, Homo sapiens
PRVRIVAERLHGSHIAESVRQLLADGFVLQLLSVQLVLEAINAFLQSRYWPLRKLSPSLSLLQLVVKDLDLFLISVFLLEYLSASAFSDFKTRVTVLNCSSSS

SEQ ID NO: 966697 - protein, 61 aa, Homo sapiens
ISYRIPFVEEQRHLQSNTDYCPQLEMKNNFFSALFLTDSKLNSFYEICGYLTVLYFSSIKV

SEQ ID NO: 966698 - protein, 36 aa, Homo sapiens
MTDYKQIIHLSLSCLAFSTFESLSYIIHSGIVTCND

SEQ ID NO: 966699 - protein, 71 aa, Homo sapiens
VALARVRARMHFPMPRGRRKVWPAKERKLGMFSPKNSFTSFNVARLLTTRTWACDCDHHFFPESMVLAVIP

SEQ ID NO: 966700 - protein, 69 aa, Homo sapiens
IHAPSDHWLSAWQIGQLDCRVFTSWSSFLCVHVGLVPLPTVEVIHLKLLVRHGLLQMTRRLCLLLFLAC

SEQ ID NO: 966701 - protein, 74 aa, Homo sapiens
PAPVLYRSCGHRTCGRYVMCRRKSSGGKGGSYSQAASSDSCPVALTVSLTADKACRQLVYVKGLENAVISITPP

SEQ ID NO: 966702 - protein, 40 aa, Homo sapiens
MERQRIFGEVGLEGADEPSHSGLNSRAEAQVEVGGGRWLG

SEQ ID NO: 966703 - protein, 44 aa, Homo sapiens
ETEIETSSPTSLDKKDDWGVKHSVSIGTVVTSGHKGWLYSPPPH

SEQ ID NO: 966704 - protein, 35 aa, Homo sapiens
PPSRGCPKLMLTASSWCIFLDGQSPVTVQSYFIVD

SEQ ID NO: 966705 - protein, 34 aa, Homo sapiens
MRSSAVALASYLLPSSYCRFATTSCIWRRLVAGG

SEQ ID NO: 966706 - protein, 42 aa, Homo sapiens
LEVVVIGAVVATVIVEEEELRWKRRELLYRLRSSDSAQGSDV

SEQ ID NO: 966707 - protein, 101 aa, Homo sapiens
KQLMSISQSYDDTKGKVKSFSFEDTEDSFCRLEGKEEELIGTIQEKYMLVDRNKMHIKWMTATIFKGRLPAQREFSKARLYERVRSSCIDCKKSKKRGKEE

SEQ ID NO: 966708 - protein, 35 aa, Homo sapiens
VSAIQLVTFPYQKVYEGLLRTQRIVAGMELLPFSP

SEQ ID NO: 966709 - protein, 38 aa, Homo sapiens
QSARPRFTYKLWSSQAVFATVMCRRNSSGGIGWELALT

SEQ ID NO: 966710 - protein, 77 aa, Homo sapiens
MCQRPIYMQKDRRPRSLLPESCKQFSLYATWEENNEAASHDLRYTNTVRTERARQSSATPMRASSLYGPNRGTRARN

SEQ ID NO: 966711 - protein, 178 aa, Homo sapiens
QLGTVNLEVVVLYSSPDCQFSWYRGWVVESCVSSCVVELPTVGRAEPLYSKVTTVQILRREVEGEEVTVAFEIRERSSPFVLSSQPRRASVLSGPSFVIFIIYRCPAMSVVYSVFRIFISILCITNTLILSCLATSAPAYLPLLRLNVSGQPAGSPFSSLAFPLAGASLPFTAYFHNS

SEQ ID NO: 966712 - protein, 64 aa, Homo sapiens
LTGTQIGAGQAMTPGQTKPHAVIHSHSYPSNKTESTKQRLPFKLLSDIRISRLMSARPLTPGCI

SEQ ID NO: 966713 - protein, 72 aa, Homo sapiens
AYARATATRDPSCVCNLHHSSWQHHVLNPMKEARDQTCIVMDPSRVLNLLSHDKEFLQRILKVSVRNLGPVT

SEQ ID NO: 966714 - protein, 122 aa, Homo sapiens
ARYQQNMTSLLSHVGRDTTLKPYSGPGYVWEPELELKLACCCLGLVRSLACGLGLRAAQAEPLGNTGTSTLPKLGVGNVGKSIELAADTLWDLGLNLLGLYEDLDSLGTCTHGLGIVGLHLL

SEQ ID NO: 966715 - protein, 71 aa, Homo sapiens
MHTMFMSLLHIGLTVLADCEVGNICMNTSVFTENDNDDDEDVQVEVAEKVQNIVFPQVTLNTQEQLMDGPD

SEQ ID NO: 966716 - protein, 93 aa, Homo sapiens
WALEDPPEHSGHAVYRKRYRGLGRTIYLFKFNGLGAGRALSRRGLRVLGGALFGKQNWRCGMNRTPGFMAPDADAHQTPEKVLVDIGGRRWLG

SEQ ID NO: 966717 - protein, 129 aa, Homo sapiens
LYVYTSWCEKLAEIIWQNRQQIRSDAPLQAAAYPGPVKEMLAEGNATIRDIISALVTGTFIIEKQPPQVLKTPDQVCSHCAPVDEREARTFTLNPPQGKGHHSSGEQQAKFSAQEREHPPSFRGTELGI

SEQ ID NO: 966718 - protein, 37 aa, Homo sapiens
MTAGVASTYPGEQVTAAETALLNDATVATTHTACGAL

SEQ ID NO: 966719 - protein, 54 aa, Homo sapiens
GVLANSTTAPGWGPQSSPLGDDLGEDDEDAPMITAFTDNVPMVIAESQADQGAC

SEQ ID NO: 966720 - protein, 134 aa, Homo sapiens
PYVDRYLLVIYHPSSARTSEGPAWPGIACSVTWGTALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTG

SEQ ID NO: 966721 - protein, 127 aa, Homo sapiens
VDRFDKTALQVMMFGMHRHSPWSCLTCTGASPYCPGHLRYQSSPDAARTGFLDTLKVLVEHGADVNVPDCTGALPIHLAVQEGHTAVVSFLAAESDLHRRDARGLTPLELALQRGAQDLVDILQGHI

SEQ ID NO: 966722 - protein, 80 aa, Homo sapiens
TIPVRRSAVLLSSICCPCLKSGDFINGCALILLPGRRQVAPVQSPGTAHTLHRYQWEERIQVWHEEHRGLLREDALLAIS

SEQ ID NO: 966723 - protein, 30 aa, Homo sapiens
MVTISGVQRLLQVEMIRNTGRVFSWPPEGS

SEQ ID NO: 966724 - protein, 85 aa, Homo sapiens
AIIVDRHRRGRSCARPLARPKHLDQQTIIAKTFNGPKGSRREKDKELLSTGQAPSRKEDGLQPASVQGGIYEATSPRAKKSKESV

SEQ ID NO: 966725 - protein, 91 aa, Homo sapiens
RLELNGMIYFRSSCKAPYIACCSGASLALLERRRRWDPLLSLLSSGRIRHILFWGASHVEFMDRPNEFTEQEAVLALEDHQPYCEADDAIQ

SEQ ID NO: 966726 - protein, 117 aa, Homo sapiens
MHCGEVTAQMFNHLPEVYSPTAWCTSSLTCNRQYSSNSILIPTQGPYCLLSHQPILVSFLMRRSRISTPGKRRKFKQPTSGPIIVISGCDVYPEYSCDELLLGDVHLTRVMAGYRAR

SEQ ID NO: 966727 - protein, 54 aa, Homo sapiens
SVPDRCHGWFPVVYSVWDQLDHLPFLSPLLVCEVSLALFFALSYSYILWLCGSS

SEQ ID NO: 966728 - protein, 94 aa, Homo sapiens
IGNRMDHHFIVEFRRTHGKNSSENKRGVRRHRTACERAKRTLSSSTQASIEIDTLYEGSDFYTCITRARFEELNADLFRDTLDPVEKALRDAKL

SEQ ID NO: 966729 - protein, 51 aa, Homo sapiens
GDDSDLRVDSKKYCTFPGRLIKASGGGGGAENNRSAGVSLVALALKNIILA

SEQ ID NO: 966730 - protein, 78 aa, Homo sapiens
NAFKSNCPRTLVPSTNSVKECNRSNSSSPVDKLNQQPRLTTLTRTCALHTAQQGNNCTSLATEHRVASGNMQACKAGL

SEQ ID NO: 966731 - protein, 44 aa, Homo sapiens
THNRYCDGDDCYTLWDFDPWGQGTLITVSSASPTSPKVFPLKMM

SEQ ID NO: 966732 - protein, 45 aa, Homo sapiens
MSYTRRQNCLPGDEVLLQVPIVVATPSSKMLLVCRAAPSRLCTVL

SEQ ID NO: 966733 - protein, 55 aa, Homo sapiens
GAAELLQAFFLRADDIIGFRPLPADDRSAQYQKPGVFLDAINDANLLEACIYRPL

SEQ ID NO: 966734 - protein, 82 aa, Homo sapiens
RGRATDSFSGRFEDVYQTAEKIVLGEGAHAPSADLASNLITSQEYAVKIIEKQPGHIRKQGFQGRWKIAVPGAQGTQGNVLA

SEQ ID NO: 966735 - protein, 105 aa, Homo sapiens
DYMDARREGWTFSKIPGRADSVVGYDHERCPSQQGEEREEHDLVGIPGSAGTRLVSTRGPVPTCESSHIKPLVTGDGNGLGLVTRAGDRSGIVVTEALGLPAARP

SEQ ID NO: 966736 - protein, 47 aa, Homo sapiens
RSAQDQGDIILKRLPESESLSSGITRQLGTSHLYDVSHPCASAPPQY

SEQ ID NO: 966737 - protein, 79 aa, Homo sapiens
PTSCKRCNGEYSSRRSTLTGLCACSCGSHSGFWLCLLGDHLHELLTQDGRGEDALEEPLALVCPPDPEEVDLQPAEDVG

SEQ ID NO: 966738 - protein, 30 aa, Homo sapiens
MILPLMTLYLSASQVFHHDVNEAVPRGPVR

SEQ ID NO: 966739 - protein, 107 aa, Homo sapiens
TSADDGGRKSGTTHISAADKGGAEKALSSWEVPRSLRRHWGEGDERRSLGQWPGVPLGPCLGFKGVPWASPYCPPHTARIPPPRRIQLDHVCVHPPLARTGDDIVCR

SEQ ID NO: 966740 - protein, 81 aa, Homo sapiens
DSRPGDISHGWNEKQVYNHKHEIHMSQRLTEVQLLTASSAQHGPWHHEELRNEDERYENKNGACDHEGQLISMSINAGQSK

SEQ ID NO: 966741 - protein, 67 aa, Homo sapiens
APPGPECVRLTVHEAAGAARRHIITHRSSSAQAWRIANSNTEVLKNMGYAAQAMKAAHDNMDIDNVA

SEQ ID NO: 966742 - protein, 46 aa, Homo sapiens
LYVSYSDVLLPLLGLLQFILLGLHLLRPCRVTVQQWLHFGENASTQ

SEQ ID NO: 966743 - protein, 45 aa, Homo sapiens
LLPVRGHEYRNFYHTVDIKLTQWTDKQLPNKAVEVAWETLQEEND

SEQ ID NO: 966744 - protein, 51 aa, Homo sapiens
VVHNLVPDADIQRYRNEFEKICRQEVKPLGLTVMRDVTISKSEYAPEEEND

SEQ ID NO: 966745 - protein, 76 aa, Homo sapiens
YTGYNSSLQTQDEELSVDRGISALDGEYQSASEVDFYIDKDKIHIADTKVARRYGDYFSRQIHKFEELTRTRKKKM

SEQ ID NO: 966746 - protein, 67 aa, Homo sapiens
MCSCYHSQFIFPFSSAYSICVNKALNDCTSPCVDGFQGLKIHLSCIIVFLERSSFKVILNHPDRRKL

SEQ ID NO: 966747 - protein, 64 aa, Homo sapiens
YTGIVSDIDNWHILPWHGGTSSGRHSDQWSVCEGAHPELPPSEIPYLDANVEWVMCGGPCNKRS

SEQ ID NO: 966748 - protein, 89 aa, Homo sapiens
EDPPHLTPPCACIGNTLDLKGGKEFVEAVVVLRKKNGPLEVAGGEVGKPPCLSGCDTCSIRKAILGEGLEFRGVWQHSRIFKMEAKDSL

SEQ ID NO: 966749 - protein, 114 aa, Homo sapiens
ADHIYTRNEASLPSILQYPPNLSNQTDLQTIHCEIPPCLGWLPRHAYTPENNTAGAQVTNVPRCNDSRAVPRYRGPTSPEPKTLTPGALLQNRPFTKTLMCSHRVTTRYHKQQR

SEQ ID NO: 966750 - protein, 46 aa, Homo sapiens
EDPTGICAQALEQLKPLLSLLKVAGREGYLIAIFHEEHSRVLQATP

SEQ ID NO: 966751 - protein, 70 aa, Homo sapiens
RGDLEDPTGICAVSSKIIHSRLSNSHEAADATLTIHLQDGMVTNTSLTSSTKYHPQSPSDLYSITSGMPK

SEQ ID NO: 966752 - protein, 101 aa, Homo sapiens
MLEKYGLDVGAERLILKCRHIVFIILCKRGVWQEMAGESQVKHYLLVPSPFQIPFSLRATFIGNEIPHIYHLQFVCETLFLLDSRPKLRVPQEWAPNPRGT

SEQ ID NO: 966753 - protein, 67 aa, Homo sapiens
VTHRGSLFACDIQTRGGPPMPRKASSPGTGNYHRGTALIAAYSCNPTAHTSSRSTAKEAPIHGHQAC

SEQ ID NO: 966754 - protein, 88 aa, Homo sapiens
LAEEGAPVTRREETRERLHLAQRLHPFQTGPDVGEVKHVSISTSCRRGKAPEPHWPRRNEETMPGAHTRQLLYENGDLRALFSSNCRA

SEQ ID NO: 966755 - protein, 84 aa, Homo sapiens
MLRNMDRYKQETEQLVSNLKEENTLLKQEKEALNHRIGQQAKEMTETMEKKLVEETKQLELDLNDERLRYQNLLNEFSRLEERY

SEQ ID NO: 966756 - protein, 34 aa, Homo sapiens
MPALWLRLRLLSLLGLLLFSFLLRLRLWLRKKKM

SEQ ID NO: 966757 - protein, 41 aa, Homo sapiens
TVQGLVISQMLRKRVETSRLAQHYWSPGTVRAVNEREWWQD

SEQ ID NO: 966758 - protein, 92 aa, Homo sapiens
MGSVPTLAHGWRLRRLSSVSFTLPCPAQVLLLSSPGLEELYRCCMLFVDDMAEPRETPEHPLTHIKVRAGVQEDKMQSLTVFSPVRTTYNTR

SEQ ID NO: 966759 - protein, 94 aa, Homo sapiens
RKGKEDRGDGKVLSHSAHADELRPMGPSPCQDMPHKRFIVATPFYIPTNRSKCSNISTSSPIIIIVHFFDYSHPGSNKTVTHYGFYLHFPVRFI

SEQ ID NO: 966760 - protein, 101 aa, Homo sapiens
MITLLDAPDEHVAPVADGYVAAALSGAGKLHGLIALEGWTRQVVSPPLLVAISHLEAALLLTNNAHTREGSQQKPKEKEKNCTAAPGREHDVCYVLYLHYQ

SEQ ID NO: 966761 - protein, 112 aa, Homo sapiens
QQLTWDSVTMSATHHGRRTNPKKTIYYHTNPTTTIPNYPLHRQRTNPILYPIRSNTSTHTNYHHTLRKPNRTTQCRTLFPILHPSRIPTTASSTSLYPKYHRLTKLPCSVYT

SEQ ID NO: 966762 - protein, 56 aa, Homo sapiens
EYFVCGYKNVMGAAALSGGSSVALSRRHLPYGNEKKIEMVRAYREKIEHELDAVCH

SEQ ID NO: 966763 - protein, 103 aa, Homo sapiens
WTPRICRAQADHHVHLLFYVWTKLQHVLLAGRFKLVRKPKILHLHQLEVRNSDGTLLVHDLLVCDRDQTLHQDPRVYLVICHIVAEVLNYGLTGSHQHGFYLN

SEQ ID NO: 966764 - protein, 72 aa, Homo sapiens
EAYDVQRQGKARVLTHYEKVQAWSYYRCCAQSVATRDWLSTLEPRNVRADMKRVVEDTNGTRRAGWGSMYEA

SEQ ID NO: 966765 - protein, 58 aa, Homo sapiens
MAQRRLEESRSCKQQSYDITEKARREARTKYPLDESYSACLIWGVTFPASQRMRETMD

SEQ ID NO: 966766 - protein, 37 aa, Homo sapiens
NDTQKQRCSPNVPKAWSLGSGSLILVCCSAQEMSKAE

SEQ ID NO: 966767 - protein, 77 aa, Homo sapiens
CLSMMNLMVRDGNEKLDLLKINILCHRIRNYLYIFRKFDLDKSYSMRAYETRMAIEQAGFKLNKKLYELIITRYSEP

SEQ ID NO: 966768 - protein, 112 aa, Homo sapiens
MREREKKDGSNPAHLLAVANDEELNQLLKGVTIASGGVLPNIHPELLAKKRGSKGQLEAIITPPPDKKAKSTSQKKPVSTKAGGKKGARKSKKQGAVSKAASAGQRAPGGTE

SEQ ID NO: 966769 - protein, 85 aa, Homo sapiens
LGICRAYHGDHRIDGECKKTTTPTKNLNPLPDESQDDGVLVAAVAEAVVAAQVCEGPHANGVRKENLPRIYPHLSRGFNPLPDTE

SEQ ID NO: 966770 - protein, 145 aa, Homo sapiens
NSDPRYSPQKQSVDMHAFVTDVAYNMRLMQIENMLLSPWTLIVAVLLQNRASMVFDALREKTLCLKGLTQAFGGFIIFGLIINLLKMMHRTRILLHSNIASTCQRRGDSVSGAPLTRKGALGFMLEHMTLLMCSAYSIQVMLYRR

SEQ ID NO: 966771 - protein, 104 aa, Homo sapiens
SLYEIPGITELGSITLLTVFVVEEVHRLKNSQSKIFSRPNGYKIDAYVAADRNPIAEVICEELFHLLSFLTRERFNNLRGLLQEVADIFKEVQIKKLHEMLEPH

SEQ ID NO: 966772 - protein, 72 aa, Homo sapiens
QVDLTQLDLTQVASDTISMKPLERVWPPSCPPMIITISSRQLDVGVPSPEIAARLSFQSMNAKAQWWYEYGP

SEQ ID NO: 966773 - protein, 84 aa, Homo sapiens
QVYAPFDHWPVCCAIGQLDCRVFTHGQLSLVHVGVGHTHIEVIHQSFCQAGRCSDSLSPPLFLQLLAFILLGLVFFLGWRDSMV

SEQ ID NO: 966774 - protein, 142 aa, Homo sapiens
MTNLNLPLQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGLPGLTRNNFARRAKAKTPETRRATWVRST

SEQ ID NO: 966775 - protein, 47 aa, Homo sapiens
MTNPVDLQVDLTQVDLTQVDLTQVENACCNLHCCWDNHLSLIQHSYI

SEQ ID NO: 966776 - protein, 58 aa, Homo sapiens
QDPMHHSDSNRKDGGSSQKLMLFIRGNGYIVELRLLADESVTKTPNHNGYYYKEDYYK

SEQ ID NO: 966777 - protein, 63 aa, Homo sapiens
MSEEEEKEDPEKGWGTLLENRKLENKNAFFENKTVPNKQRPQDRSEGACKVEKLIPVSAQKPM

SEQ ID NO: 966778 - protein, 65 aa, Homo sapiens
GSVTSLLMLAGPADSATDMKLILFSRKQIASCNCSKIEKRKYEDNQRYLEDKAQELARLEGGYWH

SEQ ID NO: 966779 - protein, 41 aa, Homo sapiens
MAYGSSQARGPIGAVATGLHFSHSNAGSEPRLQIYTTADSN

SEQ ID NO: 966780 - protein, 101 aa, Homo sapiens
SVIEVVTWKTLGDECSDRLLILDERSALRMTTSLFRDSPAGDHDYSLPMGKQKQDLLEEDDSAGGVCLHVNKDQVSVEFCSACARKASSDSKNVASSNLLF

SEQ ID NO: 966781 - protein, 75 aa, Homo sapiens
LRLTTSALRDSPAGNHDYSLPDGKQKQDLLEEDDSPGGVCLHFDNDKVSVEFCSACARKASSPSKSVGSSNLLFI

SEQ ID NO: 966782 - protein, 92 aa, Homo sapiens
MGGSLAGRLRRVAADATSLFRDSPAGDHDYALPSGKAEAGPAGKRTTRREESVSMWTKDQVSMEFCSACARKASSSLKMKSQVICSYPRLDT

SEQ ID NO: 966783 - protein, 34 aa, Homo sapiens
MGQAELTAVVFGIEEEETAIEMPAITFSIPAAFC

SEQ ID NO: 966784 - protein, 184 aa, Homo sapiens
RIRDTPANKRVFDTKCLPVCGQIMKIKLLLRKGNLEIIEPYFETNWKHRPSFPDVPGEIGWIGIGAKSPPNLNQRDGWLLFGTRNGSKSTDSPVWYTFYFTGPEHLGKYACTGFYLVNDIYEYKTIMNWMKDTDYEGTFAEANRDKTALDSHAARSLSWETFQVNSFSKEVGSRVPTLEYPGTE

SEQ ID NO: 966785 - protein, 61 aa, Homo sapiens
MQVSVIAASISRGSISSTSEVHSPPNVGLRRRENIEGVRQMHSNALMSEIATERVASRGYR

SEQ ID NO: 966786 - protein, 72 aa, Homo sapiens
PVTLRILVNTPAFDIPDVVLSYYSSNKTMAVPEPLCIMNCTFIPRKVGKGHQNSACGAVPMADFEVVRAVRT

SEQ ID NO: 966787 - protein, 41 aa, Homo sapiens
MRQFHPATGSILIRKRQKLERQRGCEWGVDAGTGCRARIRD

SEQ ID NO: 966788 - protein, 38 aa, Homo sapiens
SSELSACIILVLIALPSLRMLYITRRVLVIAIALASKS

SEQ ID NO: 966789 - protein, 51 aa, Homo sapiens
MYNMKTDFKCQLARCQTAAGAGAGAQQRCAPDDLHLTAVGLAINRAINICA

SEQ ID NO: 966790 - protein, 57 aa, Homo sapiens
VTLEEPLNSYPQCLIVMSLDCQTLLQRITRENDRGPKIGYCTGSREKFIHATRKIRL

SEQ ID NO: 966791 - protein, 54 aa, Homo sapiens
KTNDIDVMKTDFKASCPLQKLLEEGRGQNACSEIYIHGFVPWPINRVTQKLGLE

SEQ ID NO: 966792 - protein, 30 aa, Homo sapiens
MHYEGVIMNGDKLFYDRGGSVLETYLRCLC

SEQ ID NO: 966793 - protein, 91 aa, Homo sapiens
SKSTADSSPSSLIQISSPGLISSRAVTCKEDSCVLERRSLHWAHHCGCRSSEAQRGQILHSSETLQLLPTDVLVYLVNGGVKLLTDRECFN

SEQ ID NO: 966794 - protein, 49 aa, Homo sapiens
MILTEDYEKHLTVMNYDPDVVLKQVHCEEFIPEFEKHTQNFPGRTSQAE

SEQ ID NO: 966795 - protein, 43 aa, Homo sapiens
YPPKPITIIEYYNTETVKNTPKVQSDRQQGFNCIRLKINYWYK

SEQ ID NO: 966796 - protein, 142 aa, Homo sapiens
NEKEMVLATVTTPVGGDSNGRTRGGLTSQNALIFPTEDVPRKLLSHGMKTLQSARVITASQHDPRDHSDHPHCTPQGLRGWLSCKQLASGVITCDLDLWSVTRVPLPSNTPANSSLPLQPKSISAMLNSLNILLMLTLRRVP

SEQ ID NO: 966797 - protein, 66 aa, Homo sapiens
SSSRIPKATRCERYRGLAFTCIASLLHILQSKVEIAYQIYKVDRCAFYKNISLEYITLNNINLYIL

SEQ ID NO: 966798 - protein, 44 aa, Homo sapiens
SHIRAQATEELIFRGIAYWGLWHSPVYFCFTNSSVMSFFTSPKS

SEQ ID NO: 966799 - protein, 54 aa, Homo sapiens
ADAEVTSRGSLKSYPEVLHECYSHIISADAWRRRPTRPRFRENFGSHGSYCPLY

SEQ ID NO: 966800 - protein, 132 aa, Homo sapiens
HCEVQQKKMTCNKHVATFRQMQLENVSVALEFLLTCESIKLVSIDSKAICVDVNLEADTWASSVTLDPALLPYSMPIVGRGWRMSEANEADPQCRGSCGWIHEQAACSCPYTKHQPGTGMSGLGPGAPWLDS

SEQ ID NO: 966801 - protein, 73 aa, Homo sapiens
IDTIELVTRKTLTYQRASHGTTENTSIYSHIESYYWEDPLQEHIVEGMCLVNDVNGCPSSYLPYSGTSIGYEK

SEQ ID NO: 966802 - protein, 112 aa, Homo sapiens
MCVFTVLAVEQCSALRVLTRLTGSSLSDLTDVGLHRACITVTLLLVDGTLSSQQATCLHLSGEVWGASGFSMKAEADVRCAQHVTGYSQPPAAVAHIKERALVVTFDLSCDA

SEQ ID NO: 966803 - protein, 63 aa, Homo sapiens
LIRGSPSALVGGVSQKKMHRMHPVATFCEMQLENVSVALEYLGRESIKLVIDSKGIVDGNLEA

SEQ ID NO: 966804 - protein, 47 aa, Homo sapiens
TPGACMGRLSILYSQGEEGPRKVHVQVAEVEATGSYHEGIVNANKRL

SEQ ID NO: 966805 - protein, 65 aa, Homo sapiens
GACLDGAQPEEDAPQATTSGHFPAKMQLENVSVALEYLDRESIKTGCPSTSSAIVGRGTLKLDSW

SEQ ID NO: 966806 - protein, 113 aa, Homo sapiens
EAISEDFPRRLLGDVIQRFERRGFTLVGMKKLQEPESVLAEQLPGPARKPFYPALIRYMTLGYVWHGLGRVQCRPRLEAMIGTPTRMRCPGTIRGDFSVHISRNVIHANKRLG

SEQ ID NO: 966807 - protein, 41 aa, Homo sapiens
TRGSPGACWRPKSPSQDTGRAQLSTSAPVPCRSAVPAEVGD

SEQ ID NO: 966808 - protein, 36 aa, Homo sapiens
PHLYDFLETHILDEEVKLIKEMADHLTNLHRLDVPE

SEQ ID NO: 966809 - protein, 78 aa, Homo sapiens
MANGSQSASGTSYTSQPRIASGSGTQSDGNNILVARSSKVTDGSQGLQDSDSAGTGPHMAAVCTRGNQQCNLHSAHHL

SEQ ID NO: 966810 - protein, 97 aa, Homo sapiens
PSRVLSAAVMLSPFFGAELTDLEDFIGPSQERPKPVKVEKRAGSGVAKIRIEDDGSYFQINQDGGTRSVEKAKFSLNDCLACSGCITSAETVLITQQ

SEQ ID NO: 966811 - protein, 139 aa, Homo sapiens
EVGWVYYVSFGPHAGKLDAIVDVVDHNSGFGLMDLATQVRRQAMPFKCMQLTDIILKYTAQCPPEVCPPMPGRRQTSIPKGQPHDGPRRLKPETGKHKMTDLDRSKVMKAKKMRNRIIKNEVQTLKRQLSCKASPTKCL

SEQ ID NO: 966812 - protein, 119 aa, Homo sapiens
YRIYRAVGRMESSCDCARRGDRVKPGPESKLSRGTSFAWGFKNLPSIPIPETGVTVPFWPSHPTRETDTTVSGWLLIPLGQTCSLAFIPYSRTPGAESLAFSQEALPAWGATNKRLGVP

SEQ ID NO: 966813 - protein, 49 aa, Homo sapiens
QEESPALGDDILSILKAGSAQRPSSLGMPGHTVHFSTLVSWWVPRQRTV

SEQ ID NO: 966814 - protein, 91 aa, Homo sapiens
RTVLNSSSALLCRQAAEGQHPGLSHGRSGGAQFKGHRIAVLELGPCQLPESERGANWAVNALSLAVDDFLFFYDRDSNASQAPDGLQAGVT

SEQ ID NO: 966815 - protein, 69 aa, Homo sapiens
MHTALRRISSVGNSFSSNSSNINVIFMIRRRLRLEAKSPNSRRTLHKPGVTIVDAPHPNRHLKNPYASR

SEQ ID NO: 966816 - protein, 37 aa, Homo sapiens
QLECAAVLLQELQYVAGQAVSRLDLLEEELLCQSLMK

SEQ ID NO: 966817 - protein, 80 aa, Homo sapiens
MTNPTLTQHNLSLQFSQISIALFYKRKGMHLYHTGTSSYNGHNNSSHDSYQLYSIRLPNARTAGLSRRTIVQSTTEGVGH

SEQ ID NO: 966818 - protein, 104 aa, Homo sapiens
MGDTSAMNAVTAARPSVSARPSANIDLIAPSWWIGAFECNQCGRVYTQLGPLIQNQRIHIGEKLYECNQCGTAFSQSSLLIEHQRIHTKDKPYGCNECGKSFSQ

SEQ ID NO: 966819 - protein, 127 aa, Homo sapiens
MRLDKMVATSCAGRCVCGPMLTLSVVGGGIVPVGIEWMEAEVAICAWVGVMTVEYLESPKRWRKVEREWEVWSEGVMGLDEVVVVWKDVAVIGPVEEKGLLPVGEECVVKGVVSLLLVAEVVWASTG

SEQ ID NO: 966820 - protein, 65 aa, Homo sapiens
MRILARCIRDVITVFQRLRQLRDKKKPCLYYWITDYVHLQNQIIKAERRVLTAVGFLASIVKHPH

SEQ ID NO: 966821 - protein, 67 aa, Homo sapiens
THLRVLSSVGSIISLNASNHSINIHDMRSLRFDAQVLIVEEPSHKPGVTIWMPPTLPHIRRSRMHLG

SEQ ID NO: 966822 - protein, 110 aa, Homo sapiens
HRWQFSSDGADIGFGVFLKTKMGERQRAGEMTEVLPSQRYNAHMVPEDGSLTCTEAGVCKFALGGWSHLSHGLGTETGVVFRHIQPRSVPFIHTVTHSVHTLKCTFGALG

SEQ ID NO: 966823 - protein, 36 aa, Homo sapiens
ERKTELEELEQKHSQLTEEKNLLLGRQPHPHLLSLC

SEQ ID NO: 966824 - protein, 76 aa, Homo sapiens
KQLVSSTTESLSAALPEKPGDSEVSASAASLLEEQQQPSFPRLLRKLLTLIKKNLFLPSPQSATLALQHLVLLRCK

SEQ ID NO: 966825 - protein, 49 aa, Homo sapiens
MERAMDSRSVTHKRSSSTWRRYWSCSREALQAPAAIPHGLTQGPELLLH

SEQ ID NO: 966826 - protein, 84 aa, Homo sapiens
MTQGAVFGHKQPEMRLGLLPRIPHHASHGRPQREVCDCLTQVPLVSQDIPALSLPWVSPDLEPLLLHFAASSSVTNWEPTIFLK

SEQ ID NO: 966827 - protein, 70 aa, Homo sapiens
KCFGDDARIEQGESVRPEILRWCQGNLTIFYHLGNCIHSAYHSNWFCRGRLLYHLCSIVCSFLNAKINAP

SEQ ID NO: 966828 - protein, 73 aa, Homo sapiens
YYISSFHKFGRVCADISDVFTNIVDINMAILINLDEIDRGLWLLLYEMTMPDPFRTIFLGIFHLFAYQAVHNF

SEQ ID NO: 966829 - protein, 69 aa, Homo sapiens
GRSLDGSPLVPREIEDVQTAAYWLEGEAYAPKPYYFAKVALQNVCWAQQGSYVVLEMDAFRKRYSAHAQ

SEQ ID NO: 966830 - protein, 54 aa, Homo sapiens
LSRKATSKHGEEEGQPVNTASDFITKIEYPKQTQRSQVLPAGRDETTTCSRQIL

SEQ ID NO: 966831 - protein, 55 aa, Homo sapiens
RSAVSGDHIEEDHHQYSWQDEIVQGTRRGTQKDGAVGEKVVNALVCPSALLWRGD

SEQ ID NO: 966832 - protein, 88 aa, Homo sapiens
NPKSGTKTFSVSSGCYEATRATMEDDAPSVDGRDVSGSGEDFNEGGRQNFNVRPQSGANGLPKHSYWLDLWLFILFDVVVFLFVYFLP

SEQ ID NO: 966833 - protein, 61 aa, Homo sapiens
MKIKNALDHFLTRGTPTPLIPILEIIENIRLLIQPIALDSTPKRYHYCRPPNHAPNSKRVL

SEQ ID NO: 966834 - protein, 42 aa, Homo sapiens
LVREKLGPDSVPDGYQASQTFHGAPLTSCNYWPFLLLLLGLL

SEQ ID NO: 966835 - protein, 49 aa, Homo sapiens
MESRGAHAGKHYKVRLDEYDHSKPIQVQQTEAHLSEHWREAHHCPTVDV

SEQ ID NO: 966836 - protein, 33 aa, Homo sapiens
MQYGWKTCGSTSLSLYVNGISALNDCPLVSACG

SEQ ID NO: 966837 - protein, 69 aa, Homo sapiens
VVSQQDPPLVREKLAVPGPFGIFSALGSARPDPHLCDFLVDSLPRLGSAAYQEYWVTTVTNLLSAWDGP

SEQ ID NO: 966838 - protein, 95 aa, Homo sapiens
YVVVVLQDPRTSTRYNHDLYFATPFSEAWARAYWSCLSAWITHNVPSILLPLELELKRIGWYIDHESVGLKTLEYLMEDTSSSSDVSLLNPDPLC

SEQ ID NO: 966839 - protein, 43 aa, Homo sapiens
MLAEMSTALNYLMQSFSWTTPTPTEPLCCWAGWKLSPYASGYR

SEQ ID NO: 966840 - protein, 51 aa, Homo sapiens
VPGSIDRHLTLNRAPKGTISDTRVQESIRECGHSRVGNNVSHSAVGHPHKA

SEQ ID NO: 966841 - protein, 37 aa, Homo sapiens
MASLRYVVYMYASFPYHSKSLSPFMCHALIIISPYLL

SEQ ID NO: 966842 - protein, 33 aa, Homo sapiens
SCDTVSRLHLDKGTNQQTMPSLEFPTDHLEPSL

SEQ ID NO: 966843 - protein, 85 aa, Homo sapiens
MSAFTVSGVGQQLLTGQTLVSSKASYTVRSLGIGKIEKMAVHGPVRGARAEKIWEKGLQVREYELRENTFSDTGHLGWGIHDHID

SEQ ID NO: 966844 - protein, 91 aa, Homo sapiens
MIGLVRPCSHDGNGIGHVGHRLAVLAKAEQLNHSVMQRPEPQLNRTKISFVLQSELFTFTSGISVLVVLHSLQRLISYMLRAASSSILSLC

SEQ ID NO: 966845 - protein, 62 aa, Homo sapiens
MAHDGDIRNSQTTSTKCQYQAAASKPNSDCLDVKCIYEIVLDEADDAGKVDANNDVKSILSL

SEQ ID NO: 966846 - protein, 50 aa, Homo sapiens
MAILDPHISVSDEDKWDSHSPQNHHENSKDAGVSLMHGPEGSLKSQYHAT

SEQ ID NO: 966847 - protein, 93 aa, Homo sapiens
MDVTLKRQESQLGEMDHAEADTSEKDEMDSGTMVRAVGDEMGTVRVASNMTDGANTMFEHDDTLPSQLGTMVINAEDEEEEGTMKRRDETIQP

SEQ ID NO: 966848 - protein, 70 aa, Homo sapiens
VGVPERNWLPCGLFVVLLQNMIKGVTLGFRYKMSSVYAHFPINVVFQENGFSDEIRNFLWVEKFFPQGSD

SEQ ID NO: 966849 - protein, 76 aa, Homo sapiens
LSVTIEGSVDNAKALFKPPEDSQDDESDSDAEEEQTTKRRRPTLGGYQLRATTRKEHAEDGTHYYCHSSTLEVAND

SEQ ID NO: 966850 - protein, 83 aa, Homo sapiens
MATYMAGTLKVSNMIWVIFSLLALGFRGASVSRVGLLFRCYTQLIVEGVVPDLLHVIPVGDDAVFNGVFESEDPSLALSLILP

SEQ ID NO: 966851 - protein, 78 aa, Homo sapiens
LRWFWSIDREDAAGQNDKILYTKDIKPITCQPVKEGFQTYALNHNKTTRLPTSSYCKLHCISRPLRSTLRHSSQTEGN

SEQ ID NO: 966852 - protein, 53 aa, Homo sapiens
RARDTVKLVFLRTVHPYPGCHMIILEGFVVLQDLLHPTGKHRKCSHAQQVLRI

SEQ ID NO: 966853 - protein, 67 aa, Homo sapiens
LQDMPRKYAVDVQPIRIGDGTTRPFAEDGERPPSPAGYRRVQARRLAPIFRWAIPIYADHMIGIGGD

SEQ ID NO: 966854 - protein, 35 aa, Homo sapiens
SERTCVRESDECCTNAGSGMPKVLARIKLKEVDRT

SEQ ID NO: 966855 - protein, 36 aa, Homo sapiens
MLRFCVAVLGLIHTHRPYHATPTYLPTLIALSIPRN

SEQ ID NO: 966856 - protein, 133 aa, Homo sapiens
ESSPQLPGELNYSEDELTSNTCGKAKFFNYSELHCITQMGTRDGKNATSDALTSVLTKINRIDIVTLLEGPIIDYGNIAGTRSLADENNVFHDPVDVRPNVLSSIGYPSLQVERATPTGLHYTPPTPFQQDDY

SEQ ID NO: 966857 - protein, 49 aa, Homo sapiens
VRQETLYLPCTDTVTCLPQKVIHTQDGNDILEGFVVLQDLLAPHGATSV

SEQ ID NO: 966858 - protein, 77 aa, Homo sapiens
HRIITSTAIDLVGEAQSREIQLSMSRPVVVLIGQPTRQTSLKDVDNNNKKNLITTQQHMASMCNYTYHISIQSSVYT

SEQ ID NO: 966859 - protein, 61 aa, Homo sapiens
QDYKHASQKDYSSGFGGPYGVEADRVDKSAVGFDYQATRRITSHREITPKVSAANTVSHSV

SEQ ID NO: 966860 - protein, 33 aa, Homo sapiens
FRTAEIRAMLLKTVLLHGTCGPELLNAGQMGIL

SEQ ID NO: 966861 - protein, 54 aa, Homo sapiens
RRYVGTSADFVVEAIGDDVGSLGFSVERGHRRLKDRMLNDKVLNGFLLIVAPTG

SEQ ID NO: 966862 - protein, 109 aa, Homo sapiens
TRGSPRRLWTHMGHRDVAYIVVCPENECLSEGSKTFFRDLSAVYEMCRLGQHTICKVLRDGIMRVGKTVAQKLTDELVSEWFNQPWSGEENDNHSRLKLYGKFAAIKRL

SEQ ID NO: 966863 - protein, 72 aa, Homo sapiens
TDIMYSKNSISIQDRDMKRNTLVKLLHFLENLAFSSTARFDSKDKILLTLEKHEGVLVTSQTSRDTTMYAVY

SEQ ID NO: 966864 - protein, 117 aa, Homo sapiens
SQWLRHLRIANNHKVKIVLYPKTTHIIYGSNVNSTLHTEALGIYRLVYRQETPFTARGWARYTKEKSISPMGIVKLNLPSGEVTAVRQFTTLYQTFKRQSSFPAVAKNSPSGENFIK

SEQ ID NO: 966865 - protein, 131 aa, Homo sapiens
YRIPSKNGIRVYLKNIMVLSQSFGYGMIWKRTEGIIPQDIHTLCAEQTERSRKVFYKHLRCTMQGPASSYSCLLIHICCNVDREARMEPPIQTEYLRSGGAIILIFIVLGARAVISFCILSAMPGFIVMPL

SEQ ID NO: 966866 - protein, 120 aa, Homo sapiens
MINKTFCYWPFMWASQRPGIYIPLTLLDIIQRELPKLARQANISNSGNIEKRHKDTSREEQTQSHIIYQDSPKVEMKDKTCNGAARGKRSGYPQSAAVEVTWLAGFGRERKSGTKLFNIS

SEQ ID NO: 966867 - protein, 48 aa, Homo sapiens
MALVGHGSSRRSSIPPLRRRTKVQGSTPFWMLLSERVRAIFQLACLQK

SEQ ID NO: 966868 - protein, 60 aa, Homo sapiens
LRLLVRNLSPADSRVKPPSAAAAFSNSMAAMFFCSEWAVRSWSRRVDSWCILTIELQVLL

SEQ ID NO: 966869 - protein, 57 aa, Homo sapiens
CEVAHIRSPAQPGDHVVVCGPLTYGKWTCQPSRTGGRKSCPVKDSPLVYADVVHLLI

SEQ ID NO: 966870 - protein, 36 aa, Homo sapiens
MDGIYVPHSYLVGLYTSTSAESSLNKVHKSVYRVAA

SEQ ID NO: 966871 - protein, 58 aa, Homo sapiens
YSALVGMSADFVVEAIGDDVSTLGFSCGMGHRVANDRTVTDNGRRLLVIVRYLACRRL

SEQ ID NO: 966872 - protein, 51 aa, Homo sapiens
KKTIKERVAGEGQLQEQLQCPQRVLKCHQCGSLEEEKRSAADPWKSSLLLI

SEQ ID NO: 966873 - protein, 70 aa, Homo sapiens
ETAHGAALMSIWESVLPLKLIEETYKSLMQKGQRMLARCPRSAETNIDQYINYLKEKWASVETKLNEEAN

SEQ ID NO: 966874 - protein, 47 aa, Homo sapiens
KADEESIGKCSTCIPCVEHEHARHGSIASKTVDHILTGISHHSSLST

SEQ ID NO: 966875 - protein, 71 aa, Homo sapiens
MSLAGQSQDHQEAAQRDTSNAFAMFDQSQIQEFKVEAFNMIDQNRDGFIVTKEDLHDMLASLGDRTPHDEY

SEQ ID NO: 966876 - protein, 40 aa, Homo sapiens
AFENANERLLDIMSEEGNSDGGIVVEDVEILATKTLLNKQ

SEQ ID NO: 966877 - protein, 84 aa, Homo sapiens
LGQEYEMAPRLIPDSDNQVLNKKYLTSTTFQDEIRDLAKFGQCLSTCENRKLVKVWAGDVLQGHIQHTEKENIRQEISIMNCLH

SEQ ID NO: 966878 - protein, 38 aa, Homo sapiens
AVQPVTAGQFSPDQQGQQQFSQFTDGQQLYQIQQVTMP

SEQ ID NO: 966879 - protein, 46 aa, Homo sapiens
LQDPGLHALQSQKELCEFRESLVNSHLETIPRLRTLHHAEFFSSVI

SEQ ID NO: 966880 - protein, 39 aa, Homo sapiens
ARCVIHARKLQELSSRRMRPASWHAHAQGRMCLGPASRL

SEQ ID NO: 966881 - protein, 81 aa, Homo sapiens
SLAGADVIAPLITPQKKGMERQYFSPKSNSPPRSIQKQSPAIRKMTQVNVCSQLFTNSLSGTIHGEASIIESGKVNDNSVL

SEQ ID NO: 966882 - protein, 99 aa, Homo sapiens
LGVASSDLELNASEVMQQPKCPSLRRTVRVSHRTFDRCHYRVSRVDVDVRIDDGIVLWDDVYRKLKSRALSCRHSCTDGKSSDLAVRLHLDSLPLFTFL

SEQ ID NO: 966883 - protein, 56 aa, Homo sapiens
CRHDPEHPSPQDNESDSDSSAQQQMLQAQAPSLAGSHWGHPSLPPSAPPGDPIRLP

SEQ ID NO: 966884 - protein, 38 aa, Homo sapiens
TRVFSSDVNPPRKFRAGHSPWTVIQTAGRPPRLLLAGD

SEQ ID NO: 966885 - protein, 71 aa, Homo sapiens
NTVSGLQHLNLLSLYDNNAADHQQGALRPSAVHTRHSTIAQNPFVVRLHTGMWLGLTHRPSDNPTSDDNAG

SEQ ID NO: 966886 - protein, 70 aa, Homo sapiens
TTKKRHGAHIQCTSQLSDQSQIQEYKDGFQHRLTMNRDGYHCQWRTCTDMLGLCWEKNPTRLNTWQGIDR

SEQ ID NO: 966887 - protein, 53 aa, Homo sapiens
MQSPLATRNRTSVDFKDTDYKRHQLTRTISEIKPPNLFPLAPQEITHCRKKKM

SEQ ID NO: 966888 - protein, 83 aa, Homo sapiens
GGAVACSSVWIQEVVIFEHLERDPQLLQLHVLRFSFAQVIHIEDLLPELEADEGLEEDEQSLDEHGWMQMYKALMYFLYLRSN

SEQ ID NO: 966889 - protein, 67 aa, Homo sapiens
DLEDPIYTSRVAGEHHVVEVAFLIQVGASRYISYHYPTPSEGGSPNGELSSSLDGVPTWIETVRLPL

SEQ ID NO: 966890 - protein, 75 aa, Homo sapiens
DPYIFFFRVSRARLDFSSSWTFLPTSSLELSRSSISALSILLNRSSSSLTSKASSRARARHRHCDCFSLASASAL

SEQ ID NO: 966891 - protein, 69 aa, Homo sapiens
RYRTAYRRKGALRGTCWLVLLPLDAAVHVAIPSTQLLKHQADQQMTYGTSSPQKLRRRHSASTEAPLWE

SEQ ID NO: 966892 - protein, 75 aa, Homo sapiens
IPCSEIGGIAVRIHKNRQVRNKVLRDKICCVSTGESASYVVPTKIVLFRVYIIIMFVFPAIKNRATGPAAYSMLI

SEQ ID NO: 966893 - protein, 42 aa, Homo sapiens
LWCRAPYGTGWLHLALSACRYRRLVSSGAVRGYCQCPHVIVP

SEQ ID NO: 966894 - protein, 47 aa, Homo sapiens
MNNSNSTVQALNITHSLSFLIYIILVYYRFRRLNVISGTTTTYYYLA

SEQ ID NO: 966895 - protein, 35 aa, Homo sapiens
EIALVVQINNQVVQLLLKPVLGLFQIRGGEVLLRC

SEQ ID NO: 966896 - protein, 149 aa, Homo sapiens
PRWHSLIIATEIISRTTPSFPSSIASTATASQSTPIFPSSITTIETTAHKYFQQMNIYDYYNRGHLTQYVPASLLKVDHHCVHIPQIHTSFTSSITTTETTSPSTPSITSSIATTEIISHSTPSYTSSITTTETISHSTPRLDFFTHNQ

SEQ ID NO: 966897 - protein, 80 aa, Homo sapiens
LVQQQPPVHSSTAVLGSLLDVTICKILWRSSDFTGTSLSAGRDYFFIWNPSDQYHSAPICPTTNYCCHSPSNIIPHIVIW

SEQ ID NO: 966898 - protein, 112 aa, Homo sapiens
PSTCQTDTDNTLPGLGYEHPVQVEQDTFYTASAVLARADELSYFGQEGMTEVQCGKVAFQFQCSSEQHQRELGSRMGRSLSSFSMPEVPGEGCSRSASEWRGSQDANCFLTP

SEQ ID NO: 966899 - protein, 39 aa, Homo sapiens
DHRYRPAHPSLPVIEASGSLIFLGGRKSQSYFQRSQDYH

SEQ ID NO: 966900 - protein, 60 aa, Homo sapiens
MSREHTHIIVVVLSGTVKHVEPAALCPQAVAQHRRRLGSRLVLNHGDDSIPKWEGHLDFT

SEQ ID NO: 966901 - protein, 101 aa, Homo sapiens
MLLRISMMLHEGKAWALQGRMVLLELPELDKPMADRTESLAPADSGPPVVTSSHSKFLKRLGFFKLKHLTSSVQFSVLQRNDAEHKLKRRIPSYFSTSKYP

SEQ ID NO: 966902 - protein, 49 aa, Homo sapiens
WDHPRPTLMFPRRLKSCTLITADANIDSEDEMETIPTDKTVTYKRMGPT

SEQ ID NO: 966903 - protein, 77 aa, Homo sapiens
CGAIQYRISLQFDFFETEGNDVCKYDFVEVAVYSTADSQSCMASSVVLRKPRGHSTFPSTNKQLRIGPDQEPELRIR

SEQ ID NO: 966904 - protein, 84 aa, Homo sapiens
GPFSKKDQYDVKAPAMFNIRNTGKDLVARTQGTQMASDGLKGLLFEVSLADLQNDEVAFRKFKLITEDVQDKNCLTNFYGMGPT

SEQ ID NO: 966905 - protein, 83 aa, Homo sapiens
MQVTELSDADTVSSEYSDEEVVEDVDDAAYSMSTGAVVTETQMYKKRADSLTYADYAVYVGGEQHYGVPELENFRKSWVLGCF

SEQ ID NO: 966906 - protein, 55 aa, Homo sapiens
DDHVQELSIIDKPRLTYQPLSIQPIYRHLQQTRNKEQYVSTISKHIKTLRLSVKH

SEQ ID NO: 966907 - protein, 61 aa, Homo sapiens
MSAFMLVYQVGGVTAYFLRGAGQSIYQIPSTAIRIVLCMTFFIIPTSLKRYEQPCDIEVVP

SEQ ID NO: 966908 - protein, 34 aa, Homo sapiens
HINPPRRDASEYRPELEISLRNLEVLRQTRMDGH

SEQ ID NO: 966909 - protein, 126 aa, Homo sapiens
DIKTEDITRPPLEEFASKHKQEVRKNPEFRVQYTRDMQCKHIDVNPLRPTENRIMVLKCWGVGNFYYELGIQIIEVCQQLKHRNGGLIPLEELHQQVLKGKGKFAQDVSQDNLIRAIKKLQALGTG

SEQ ID NO: 966910 - protein, 45 aa, Homo sapiens
MLVDRCIATDSSVNQTKSGNVWCVRPWWHREGPRPSATCPPMSPH

SEQ ID NO: 966911 - protein, 40 aa, Homo sapiens
FYVKHGNPGLVEKELLSIIEGGIIGPAAWKYRLQEGQKHR

SEQ ID NO: 966912 - protein, 39 aa, Homo sapiens
QASMPDNTATQKVCHLMGIHVTDFTRSILTPRIKGWRVA

SEQ ID NO: 966913 - protein, 32 aa, Homo sapiens
YLRRLFHAMPGKPWRTEQTDLLFPFVTAIVTV

SEQ ID NO: 966914 - protein, 70 aa, Homo sapiens
FQRHLMDPSRVQYGNTASVWTPLVLSTSQGICNANALSCGSTDESERQQCLHAKASLVTSERIVQEMTCA

SEQ ID NO: 966915 - protein, 55 aa, Homo sapiens
ISHRKSMYRGSPTESLTKVYRQMDIQMVSSFSTTVSVLRRHQIGVLGHILGNQVT

SEQ ID NO: 966916 - protein, 101 aa, Homo sapiens
RTTSQIREHLGLGIQEHIDLGIKYDPSIGIYGHGLHIMDAEVGQDNSIQTDKKRRTGCIEAKHRISQGGGQCAGFQQKYDGIILPGKEIPDTIQKSNNKYT

SEQ ID NO: 966917 - protein, 45 aa, Homo sapiens
HLPSYSSVQLELNMDHTVVLQLAEKNGYVTSDEIKASLKWETERA

SEQ ID NO: 966918 - protein, 123 aa, Homo sapiens
CTLYTIEYAVERVPRPGAATKEQDPVHGKKQKVGMRIIESGHAYGGLDELEHTEAVMKVLPYTPRTNAALGYATDSSPETSTSITKEQHKERMCIALGGRASEALSFNEVTSGAQDDLRKVTR

SEQ ID NO: 966919 - protein, 61 aa, Homo sapiens
KLYSSHPVYYMREPRSATTYGSCTPSSDLRPPNNPTPNTNYLTPTPHNHGKPTPLIQWTVR

SEQ ID NO: 966920 - protein, 70 aa, Homo sapiens
CQNEEVANAFGLADELAACQAKGIGDFFVYAAQGCRLVLDVAQIPPRVCVQGQLCKTLDCDRHHTTPNKK

SEQ ID NO: 966921 - protein, 36 aa, Homo sapiens
TRIVDGSGEISHINSHEVGNFLSSCCHLGMERPGPV

SEQ ID NO: 966922 - protein, 61 aa, Homo sapiens
KSATIYFKIQKHDGQDEIMKNAPLKKMSERSRKFQILNDAIITILHKSLKSGDGERTPVEH

SEQ ID NO: 966923 - protein, 110 aa, Homo sapiens
GNDQQAGNSLAFLGRENNYQHVKDWISYYNKAETMMNTDEIIKNGPDEGDEQERTRRFQILNDEIITILDQYLKSDDGEDTPVVHVRCFQPPYTSPSPAADGTRCTQKLN

SEQ ID NO: 966924 - protein, 56 aa, Homo sapiens
QQAERSLCGLNSNQQLLALAARHRTLHVQELIHAISILGLLFLAARGAELLQDHSS

SEQ ID NO: 966925 - protein, 78 aa, Homo sapiens
SSYPDHKSGKPRFMGQGSNPSHSSDLSCCSDTHQILNPMPKRRTPKKADFVCFLFFRAALPLLCGTQKRKETMAEFPS

SEQ ID NO: 966926 - protein, 65 aa, Homo sapiens
SAPQPQQGYPCCILDPESWPVLLPTITRSLFIPFLPPLSPSGHLSRAFQNRLGSSHRGPVVNESD

SEQ ID NO: 966927 - protein, 36 aa, Homo sapiens
MLVVYVADLARIQRCCGSGVGWWLQLRFNPYPGVLG

SEQ ID NO: 966928 - protein, 64 aa, Homo sapiens
ALLHGVFSEADMRLYAADIILGPGSTMHHRFVIYRDLKPANILLRRAFATIRDSRHLGSLVLVH

SEQ ID NO: 966929 - protein, 168 aa, Homo sapiens
MAADERHLTYDRREWNEPQHGADDGAELCVREAEPGYSTYTTGTWSRNLCERGFLPGSVRGLQDPNKLDSPQLHPCETLRYGEKPPCSTICLMKDMTLWVPYESISGTLIYITEQHQPLSKLNRSHNHPIRCAPVLAVVITKSSEAALDVVTLEKLRPTTSMSGKARR

SEQ ID NO: 966930 - protein, 126 aa, Homo sapiens
MGRLQAPTNWILPRLQPMLDLRYGQRLRDSTICLMKDMTLWVQYLSISGKLISLTEQQQPLSTLNRSQTHPIEVCACTRSSDQKSSRSSSGVIALEKLRATTVMSGKARRALQSVMVLPRPGGPQR

SEQ ID NO: 966931 - protein, 41 aa, Homo sapiens
MSGKDRRALKTAWSCQNQEGNKTGLVSAAKCQRLVADGQVA

SEQ ID NO: 966932 - protein, 51 aa, Homo sapiens
LCPPPAAVLLLLLEKGMSLQMIGGIMWRMHQGGGQQQEEDTQQEELPLASI

SEQ ID NO: 966933 - protein, 34 aa, Homo sapiens
GLFLLLPPPAAVLLLLLKAKVVYAARRERRKHRR

SEQ ID NO: 966934 - protein, 108 aa, Homo sapiens
VVVEPPMSFIFILCLGEGEELCQQQEEYVLLLLLTGKPYSDCFVEEVLLNSRITIKPILVFKFLVILSFGTFMCFKEKIHTHTHTHTHTHTHTQRHTELLSHLNLPQL

SEQ ID NO: 966935 - protein, 132 aa, Homo sapiens
AGLVLLLLLSSCAPPPAAVLLLLLASSCCSKTCSQVLILPTSNSSFPSLVSSSSCCCPLLLLGSGFQTESQPLGIRVHCWRHELWNSASGPRLVLLLPSVALSTSPPLYDLSHFFEKLEDEERADVPIFWGA

SEQ ID NO: 966936 - protein, 48 aa, Homo sapiens
MDPSPSAAVLLLLLTLLLLLLLLLLLNITVHVYFGGHLYLFEAPKQQE

SEQ ID NO: 966937 - protein, 40 aa, Homo sapiens
TLTKNERSKPRASLIVYEGGSDLIGMGGDWSQVVTGSRLC

SEQ ID NO: 966938 - protein, 98 aa, Homo sapiens
PCRNDKILAVKLANIRVVSEDLLQDVSASIKSLQEMPYRKLSHLGADSNAEPRRLWPQEGSQGLRSPKKARGLDTLWACTNEKGECVYLLKAEQQEEY

SEQ ID NO: 966939 - protein, 36 aa, Homo sapiens
MHMHGPGMELCVTVNQSVPPPASLQNEWISQDLFIA

SEQ ID NO: 966940 - protein, 46 aa, Homo sapiens
MSTVSGTNFSHTMCYKIGSYLESPRMVFEFIRTGRLEAGSWDQHNL

SEQ ID NO: 966941 - protein, 46 aa, Homo sapiens
MTEACSRPELGWASWTLGRTAAMDTQTQKVRLRLMKTLPSWQPLGS

SEQ ID NO: 966942 - protein, 63 aa, Homo sapiens
SPGCLLTALPGSPSAPLSPHVSCWSVTPQNRLGVLWHNSDLPIALALHQAVFLVAGAVSRTIR

SEQ ID NO: 966943 - protein, 86 aa, Homo sapiens
ADPAVRLDLVTSVTFIPMRWRTFCRSWCDLAWTPWSVFLAFLQTIFPSCRTDDTTFAMDRCSSSLKTIIAMASTVSWNISSSWASW

SEQ ID NO: 966944 - protein, 87 aa, Homo sapiens
VLVVCGPFLEGERSLRLDSALQAHGLVQLVVVSAYPVRHCPLLLQDVLLAVPVLLIRAAPAPLTVPVTPPTSALERARHSSRVVDCI

SEQ ID NO: 966945 - protein, 39 aa, Homo sapiens
MSKYTQGVEGIASLGKFTVFRFLPFPPPPESSTTRTGIL

SEQ ID NO: 966946 - protein, 35 aa, Homo sapiens
IHIEGGIIGPRLEIIVFNEGKKSTDQACMPDYTAA

SEQ ID NO: 966947 - protein, 82 aa, Homo sapiens
KRLPGLSRETRGHSTSLYYMIAGAKETDEKLTCFSEGFNNYTFLSNGFVPIPRSPGMTDDVPEKPLVGHGQSWSFKRRTDAD

SEQ ID NO: 966948 - protein, 95 aa, Homo sapiens
AAHLSLITHCLPDGSLFNELHEGTNFGVDQSQAVKMALHMASGMIFLHTLEPLIPRHALNSRSVMIDEDMTARISMRDGKFSIQRHELASSQNPR

SEQ ID NO: 966949 - protein, 40 aa, Homo sapiens
MYLSRIALCPIKRVAFLPYLVHVILWSGPALDHRCEQHHQ

SEQ ID NO: 966950 - protein, 61 aa, Homo sapiens
MRTFHIFYYIIAGAKENDEKDFAFRRASTTYTCPSPTEGLRPIPVSPTDDWRVFATTAGRA

SEQ ID NO: 966951 - protein, 84 aa, Homo sapiens
SRYLSQSHQETKRHLAAGFGIIPVGGTYLIQSVPAELNMDHAGSADAGREEWLRYCLSQITAILKLGDLSVRGNVRKHQRYESI

SEQ ID NO: 966952 - protein, 42 aa, Homo sapiens
MLFLQIEEADDWLRHGNPWEKARPEFMLPVHFYGRVENDDET

SEQ ID NO: 966953 - protein, 91 aa, Homo sapiens
MDLVTIGHINSHEVVTFLSNYVICAWDSLRLVCLAFWKTIFPNCRTDNPHLQYGLLLLLAETASLPESPWFPGTYHYPVLLSMGTKSIGGY

SEQ ID NO: 966954 - protein, 69 aa, Homo sapiens
WFGNAGSLTHGARAGTEPATSWLLVRFINHCATTGTPPFLILILACGLSLFLQLQSGDDINIYLNDDDD

SEQ ID NO: 966955 - protein, 39 aa, Homo sapiens
GTRPYLWDEDSMPVPMINPPAETGAFSPAGLEKGATTTT

SEQ ID NO: 966956 - protein, 51 aa, Homo sapiens
MLGVSGMKFRHSEAYELALPVPVLKCSEFIRTGRLEEGLGDKICCVEFRVL

SEQ ID NO: 966957 - protein, 71 aa, Homo sapiens
DPATRPRLGLGLLSDGTQPVDHVDDEDLLRVTLGAHCSGAADDEDHVQGATALLTVAAPAGLPHEGHDDTL

SEQ ID NO: 966958 - protein, 74 aa, Homo sapiens
DITCNGPFTVLVKESCDWNGRREAEAGSSRHALETVVTDSRTEHNLLTIPFSARVSRRGSEPHGAGPLRRGTDL

SEQ ID NO: 966959 - protein, 93 aa, Homo sapiens
CASPEFRLLLSCLIFVVRPGPPASMAFVCFGHPPATITNHTLCWLQEITFLAAGGPLHTASSCVSRVLADGAESMERAQNAVKHGSCVTGQEA

SEQ ID NO: 966960 - protein, 40 aa, Homo sapiens
SPSVSPMLGSTLGFISTHAQEGPFHVFTEGFTTHPVHNAV

SEQ ID NO: 966961 - protein, 44 aa, Homo sapiens
LLRPEGAGHVGKAEVQQSILSQSHSRSRRVDHDSQYHCHSGPDH

SEQ ID NO: 966962 - protein, 91 aa, Homo sapiens
STGGYRPQTGSLPLSIMPLIMACRHHLQRSCPTRVLVGLGLSPRSPEHMDVIHILKSGKTGMTSTGYDYKIAREYNWNVKNKASKGYEEVT

SEQ ID NO: 966963 - protein, 36 aa, Homo sapiens
MSRFQDVQRFLLSRQSDSMFLNTVTAELRHHLRTPT

SEQ ID NO: 966964 - protein, 165 aa, Homo sapiens
MPLRVPAWSSLNCYLAECHSGTTTLDLMKTKWNHFHFINSFIKVPMMNSKKYPVAHLIEQNLESQGWGIVQLSHNLSIGDPVEPTTSNIFLYICCGLSALLFFKAIMEKLEMSKFQPTLLTLPRIKVTTSQDMLSIMEKLEFFDFSYDLNLCGLTEDPDLQVSAM

SEQ ID NO: 966965 - protein, 46 aa, Homo sapiens
MLCAYPFASILQTLWILLLLQAGDRASSNPNATSSSSQDPESLQDR

SEQ ID NO: 966966 - protein, 81 aa, Homo sapiens
AQVAAHGGSGLLWLCGHCCLAGGLRTLKPTPSVFSFGEKANVGMKRPFGHMPHPLTLSQVLMGNRRSISATAQNSLLGAAF

SEQ ID NO: 966967 - protein, 92 aa, Homo sapiens
MLTACLAFCCLASGAGAAGSLVSFPSLGVGCLAEVIHQVEEALDTDEKEMLLFLCRDVAIDVVPPNVRDLLDTFEQVKSPHSVEQLSQVPDR

SEQ ID NO: 966968 - protein, 37 aa, Homo sapiens
ARYPMHWYQNTGACQPQCSLQTSNVLGTLYESDLQCM

SEQ ID NO: 966969 - protein, 115 aa, Homo sapiens
AGPNSITLSDYTLDNKDIERGQSKFSSHRIQTSIKESTQNVTLHEGVHARSEQRVQGDHSLLCHLHTYIKPKQETDPLDPVVVQEMSVLMPNAKRSGRRTHSSTDMGTPHSIHPY

SEQ ID NO: 966970 - protein, 122 aa, Homo sapiens
ENQSKVGEARGGLLLVEDGYRLADTQEASSGTRGHDSSFSAGAHSDAAGNRYELTLSGGRVLRELELAGLIQLQGMGEPLYILEQAMTSPKDFSKVSPATEDSVDWTGRVGGQVEKALVCKW

SEQ ID NO: 966971 - protein, 99 aa, Homo sapiens
LLRAVALAAAAPGPAGQEDRTGRCITDRDSSPIGPSTKRLDGGYLIGDEAVEKLDTMRMHEGSRENDKPGQAEDPARHEHYGWSLQNLHHDRDRMTHDS

SEQ ID NO: 966972 - protein, 67 aa, Homo sapiens
KHAGVFVGSDRGLLNLGRQFRNEGIVLTHNPEFTTCEFYMAYADSSRSHGYSRRMIVSGIRRCIVQA

SEQ ID NO: 966973 - protein, 92 aa, Homo sapiens
MVRSSNGFRRWVLFSGDHSSAQCMKIGLSQCFNLTRAVSWSTPRSLLEPYDSPHQMTLAKSRFLCGQGWLADWWKVGWTKGGHVSSQHQFCN

SEQ ID NO: 966974 - protein, 92 aa, Homo sapiens
AVPHLGASTLFLLEEAVVVYLDVWNCRLQQSYEANPNGSANDGTEANSNAKNTAIGVAASSTQAYSHRRHHWNRHSHWRRRTEPKRCSLSEK

SEQ ID NO: 966975 - protein, 108 aa, Homo sapiens
CGCSPSNSRWLWRCQWMSAVALGLGGGSSYSYSSGLGVGGGFSSSSGRAIGGGLSSVGGGSSTIKYNTNSSSSRKSYSTKVRLLALGPTVLRPLSGCRALSSCCLSEK

SEQ ID NO: 966976 - protein, 77 aa, Homo sapiens
VVLSVGGGYQYPAVAEPLAGGLSYYRRRQYHHQVHHHLLLQQEELISTKVRLIALGPTVLRPLSGCRALSSCCHTEN

SEQ ID NO: 966977 - protein, 67 aa, Homo sapiens
MTEVQCGTVTVHVTVLLGQHQRHGGTRRARSLELIFYHVTSTSPERRMWAPEVHIHIHILSPACLDA

SEQ ID NO: 966978 - protein, 86 aa, Homo sapiens
QVYRQWSRSNNSSSAVPEKMKFQWIRVKRTHVPKGWIKGNANDIGMDYDYALLELKKPHKKKVHEDWGEPTRQLIDERAHPKLHEL

SEQ ID NO: 966979 - protein, 98 aa, Homo sapiens
TVGPATLADRTLGASLLFLLEEAVEVYLMVELPPPTELRTPPMALPLLELEATSKAKTTALGVTTTSNQAYTTADTTGTDIATGDGGLHHRDIAFRRT

SEQ ID NO: 966980 - protein, 45 aa, Homo sapiens
MQAGGGDAHIKRCPTCKVYIERDEGCAQMMCKNCKHAFCWYCLES

SEQ ID NO: 966981 - protein, 86 aa, Homo sapiens
VERHISVAQSILSSSGYSRCQMVSAVALGLGGEKQGTPMADGLGVGGGFSSSSGRAIEGWPQTLLEGGSSNIKVHHHTPPPDRTEL

SEQ ID NO: 966982 - protein, 82 aa, Homo sapiens
TSLYASTYPVAMGVQWFRRVAYRLGGGSSYSYSQWSCVLEVASWSTQWQSHCVVGSATVGRRQFHHPVHRSTPPPAGRAISD

SEQ ID NO: 966983 - protein, 90 aa, Homo sapiens
HLSDAKSVGSRFDECAAPFTINRTTDNVGRACLSHLSIYLAGREGKNLHVGEGRSGVDEVGWDDSEIYSKTKLAHGVLQAVMQFNQSAIY

SEQ ID NO: 966984 - protein, 50 aa, Homo sapiens
SPLVSSGYGGASGVGSGLGLGGGSSYSYVTVVLALECGFRFQQMARADWR

SEQ ID NO: 966985 - protein, 85 aa, Homo sapiens
MLIALPAGGGGGGVLNGGTADSNRAEATPNGSANDGTEANSKAKTTDIGVAASSNQAYATDDITGTAKATWRRWTAPQRYSLTEK

SEQ ID NO: 966986 - protein, 55 aa, Homo sapiens
DQEDPRSVDRIEQQDLQTVIEIYPDLSSNDMLLFIVQGHPTCPHPQDCPLCDLRC

SEQ ID NO: 966987 - protein, 47 aa, Homo sapiens
PFLSIAASTRQLALATVRTLAHARWLLMAPDNSRCTAYFDGTRGCES

SEQ ID NO: 966988 - protein, 54 aa, Homo sapiens
EGDDVWSWFPAAETTSQAEVPTETEAAQTLLVPMGSRGLGEKYGKRWDPEPSHI

SEQ ID NO: 966989 - protein, 39 aa, Homo sapiens
MVFVLLTGAASFIIGGPTKPSMLPRTRKESTKKEVSIIN

SEQ ID NO: 966990 - protein, 132 aa, Homo sapiens
QIFTKAFFRSKAKVIYIGPNPRVTMWSPSIITPRSPGSYKDPGTPDQFLRDFLKGEVQLGSCFEHIKGWLRMKGKDNFLYITYEELQQDLQGSVERICGFLGRPLGKEALGSVVAHSTFSAMKANTMSNYTL

SEQ ID NO: 966991 - protein, 41 aa, Homo sapiens
LLTDRKNSRILITGESGDREDRQHQEGSSRYFAVLAGQLGT

SEQ ID NO: 966992 - protein, 130 aa, Homo sapiens
MSDLSLQLPRRRIPALLSLRYYTPTYTLIPIRLIAMLAKARRVDCTCVWSVFLNQVEGLKNVVRLHPILGDGLNEVADVLQMVPILGRLIDLLHGAWLQLIDKLAKNDAIFEADHEVVADATACHPLEPL

SEQ ID NO: 966993 - protein, 51 aa, Homo sapiens
MAQWLTNPTRNYEVAGSIPGLAQMGERIQMLPVSYVCSVADTVSDPAVAVC

SEQ ID NO: 966994 - protein, 49 aa, Homo sapiens
YKSSRKLIDRAYKGMPINIREPDVVSPPEHRENAVEKTRKDNRIMKGKG

SEQ ID NO: 966995 - protein, 112 aa, Homo sapiens
MISDHIIHRLLLNRRPGDHRFLYVSPCRNGCSLPVFVLSMMRMSIVMTVQVLKTCVCISMADPLKLIVSDTTQPKKRDTQCSPTTSPHIVIVCHVSVKYQFFFLSLESSQLH

SEQ ID NO: 966996 - protein, 117 aa, Homo sapiens
MRPHWTLHTSYNLIVICRAAEIRQGAQRWKYKIHVSYAELTGPRLRFHGEGGKPGPQADEKIGDEVEGADAEENSSSFSRIAEVEGKPLKAEIHNAPTDHGHADISTSDTASDVCGA

SEQ ID NO: 966997 - protein, 50 aa, Homo sapiens
NPRASPNAVAYCAAPYSGCHQLETVWENRCGERYTRQTDFSLSLTLDPCE

SEQ ID NO: 966998 - protein, 49 aa, Homo sapiens
MPNELHHHRGTCPQVPAAKYHRNFLVQVSLELFMLSFSGLASTDNAAGM

SEQ ID NO: 966999 - protein, 110 aa, Homo sapiens
RASVLIARDRGYNWRLGLLVSRLLGVTSIGIRTKSRRSGQPCRWGGSPGCSILSAGDAVVHSAGIHREDTPLRYPQSHAPVSAFTGFHRKLSHHACLKDKKNSALVDIGF

SEQ ID NO: 967000 - protein, 67 aa, Homo sapiens
VCLEVPVMAQWLMNPTSTMRLQVQSLTLLSGLRIWRCHELWCTSLTQARIPHCCGSGVGWWLQLQSD

SEQ ID NO: 967001 - protein, 35 aa, Homo sapiens
ELVPIPPVCSPRYPCCHDPLSTDEIKGMFKRKAEQ

SEQ ID NO: 967002 - protein, 112 aa, Homo sapiens
MVGLAMALSVSTVRPCALAVHLLHLAMMRTAEDNRSHSAHFFEFLTKELALGQDRILIRFFPLESWPDWQDRDGHDFFMIGHGGIQDICELAASSREISWQSEGLEITSFGL

SEQ ID NO: 967003 - protein, 57 aa, Homo sapiens
SELAPIPTCVSTLHNMRFTWTSCLIFLLLPSAVRIRFFLQLGSHGCRGFQKNGAKAE

SEQ ID NO: 967004 - protein, 66 aa, Homo sapiens
RVGTVTSSVASPAEGNCLGSTECVGEACCWVFLRERGRAILWVEDREKHSSFSPLKDGDFPTPEAC

SEQ ID NO: 967005 - protein, 35 aa, Homo sapiens
VLTGSCSYVVLLSSLKFRNKLDYLSVIEFSCCGII

SEQ ID NO: 967006 - protein, 44 aa, Homo sapiens
TCVLHLLLIPTCVLQVAQEAEGALGSILERVLPGLKVPHARKTG

SEQ ID NO: 967007 - protein, 37 aa, Homo sapiens
HCVSSHLFHPTCVPISTCVLISTVCSSPPVCSPPAVC

SEQ ID NO: 967008 - protein, 124 aa, Homo sapiens
MAILMTAACGLPAALPGVLALSQLWYILEADLLRPCPWRGSCSDRGSPCSLHALSACTVKSSSFWFVSLTLLQDVIFIINSCSVTCSLSSSLSTWDVVYKSNFQNIVTAAELQNEGKGVTSLTL

SEQ ID NO: 967009 - protein, 37 aa, Homo sapiens
MSWLPFTVSPVCSVAPAGPVLLHCISSSLPAFSLTRS

SEQ ID NO: 967010 - protein, 55 aa, Homo sapiens
DSTEKEEAQPCVCCDPLFHARPVFPPQLIFLVPERWGWMSPSLSQLCAVSCNFLP

SEQ ID NO: 967011 - protein, 40 aa, Homo sapiens
DTEEVDRTEGGGDGSFTWQSTGKPSFLRQRPSPNGPRTPE

SEQ ID NO: 967012 - protein, 36 aa, Homo sapiens
EDRGMAPVVQTLPRSRPHAPGLLLLNGVRLEVLLCA

SEQ ID NO: 967013 - protein, 73 aa, Homo sapiens
LTSLDLLSWNVLLITCGIDRQTMATQASLGVTSELPHSGKWVRGAKSSHSVSFVVSLIGVPALLQVVYELSKG

SEQ ID NO: 967014 - protein, 102 aa, Homo sapiens
HTFARCHHTAYTEHMGAQRTVARAHSIQIMKVEEIADTMCRRPAVKQFHDIRRSSSRVPHRVLRRQHKPCFTTKRPNTLLPRLHGPRPGVPQINSGMPLVML

SEQ ID NO: 967015 - protein, 38 aa, Homo sapiens
GAADLMAYCEARAKVRPLLAPVRLQKTRLGRRSFSVPS

SEQ ID NO: 967016 - protein, 111 aa, Homo sapiens
MIKVVQVVCDHLRDSKVMRRRREKNISEIEYAAFLAREKAKADAECYTAMKIAEANKLKLTPEYLQLMKYKAIASNSKIYFGKDIPNMFMDSAGSVSKQFEGLADKLSFGL

SEQ ID NO: 967017 - protein, 36 aa, Homo sapiens
MAKFVIRPATAADCSDILRLDQGSWLQYELHWQSHK

SEQ ID NO: 967018 - protein, 85 aa, Homo sapiens
YLWSQHLQCIRVAQRRYAVHAATTVMEAAASIDLNGLGRLTSMLLVLTFVDWECPCAILITDSWSTFFFFFFSFKKLPVNQFLEY

SEQ ID NO: 967019 - protein, 74 aa, Homo sapiens
QVDLTVVVEPNAIHPSGYRPVPETPDPSDAHISIMRGTLLSIHVEFFRYCSGYFFIGKGERDCVDTSARWLPEV

SEQ ID NO: 967020 - protein, 55 aa, Homo sapiens
LSDYPDALHHMKHPYHHVGSFISSRQAGILIIFTRFDEAIRVSEAKKSVSSRNEP

SEQ ID NO: 967021 - protein, 65 aa, Homo sapiens
CRLTSFRGYLRLLSRPSSGLHEDWRYMAEQEVVRVDRGVSAYRYRSPSSRGYDTTGLVSVCMFER

SEQ ID NO: 967022 - protein, 63 aa, Homo sapiens
VRWMPDSSEPTTDGEDDESSVASILNLYSHLRGSLHVTRRVMLHPVAVARLLAPHGPPSSPVF

SEQ ID NO: 967023 - protein, 88 aa, Homo sapiens
MALVLGWVDAAVLAPSAQLSSSLFWNHSWISRWGPSTAVASVDDIPADVDAEVTPYGCWGGLSRVGVSNHGPRGACDIVPFPDHGHPL

SEQ ID NO: 967024 - protein, 148 aa, Homo sapiens
RTEGGRRTDRRAGLAGVYSMEGEDMRTGHGSVLATHHAVAARWLAVVDLVLGSATAQEDSFSEHKVASVSPLDQGGVAAVAPQWQCPSGGSAAWLPRYAMFTLVLSAVDDGVRVFAMPSQLPPGGHGHEAVSAGLARLAVGDDHGHPL

SEQ ID NO: 967025 - protein, 57 aa, Homo sapiens
HARYQQWVAAVDAVKAVHSVRAELPTSGGLLTSVWVSRLVTCQLNRALQGAVLGGSW

SEQ ID NO: 967026 - protein, 50 aa, Homo sapiens
GKSLEWAERLAAAFLPGSVSAQSPVPSSQWPVAVALLGSQPALSSVQART

SEQ ID NO: 967027 - protein, 93 aa, Homo sapiens
GSFCIPPRSPGEGDPCSPPCVKEVDTWRQEALCRTLAGAVIVGGGGKEAKELVRCDPSLVIRISLCSCPPVVLKPEQVSLRAWTGSSVQGEQC

SEQ ID NO: 967028 - protein, 71 aa, Homo sapiens
IELGTSRGGVIWEGYIVVLRLEGHDWTQSDSDEAAPVNHKGVTSPVHISRNVIHASDSVYVGPYERSNCGS

SEQ ID NO: 967029 - protein, 34 aa, Homo sapiens
MSSVQRALYPYQLSHLLPGDHLNESPCPAMVVAD

SEQ ID NO: 967030 - protein, 31 aa, Homo sapiens
MASTSSVSQANAELACSPRRSGENLPAPRAS

SEQ ID NO: 967031 - protein, 131 aa, Homo sapiens
MESYGAITCGPLSCSQTKLLPRNVRVLQAQEACKEDQGSLKATLMPMTEVDLYISTQRIKVLNADTQETMMDHPLSTISYIADIGNIVVLLARRRMPRSNSPGERGSVPPIPGWEKAVQDDLPRLRVDRVP

SEQ ID NO: 967032 - protein, 141 aa, Homo sapiens
ESSSVSLTMLRAKRDLVYTAIFVEAVAAMDRLLVAQSTDDRVLEGVIKGRSSRTPPVGPRPIHAAPRAWAALLLDTQDSLVILKESGVSTPTCLTEQTRYPGPCADKAPGVKSSPEGGYHELFTWRGLAGFKTCEFQKFFL

SEQ ID NO: 967033 - protein, 55 aa, Homo sapiens
MPDDDVYYITDVKIDDAGVYNCTAQNSAGSISATATLTVLGLPIGLLCVCVCVCV

SEQ ID NO: 967034 - protein, 73 aa, Homo sapiens
WHINLLQVTLTSEEEARIEEECRYTLEDPKGAAILKSSRCHIIITVYGYTQDSRVEVVACESYFIMIVCIHST

SEQ ID NO: 967035 - protein, 56 aa, Homo sapiens
MYAGGDSSRIPADLVGVDWRRPLSQVSSSAIFFVPGFLLLVPGVYHVIFIYCASVA

SEQ ID NO: 967036 - protein, 32 aa, Homo sapiens
MIPGRYVTLNDGAGEGAHLHHALLIAVVASST

SEQ ID NO: 967037 - protein, 33 aa, Homo sapiens
RYGRTNGLTGSRFPTCVTWHSEACFPRLLVLIC

SEQ ID NO: 967038 - protein, 61 aa, Homo sapiens
ATDALSIVTADFCTVFFRAVSIHVLSLVNFIVCVHSQVSSAKLRLFRDTGARNSVSHWSYA

SEQ ID NO: 967039 - protein, 34 aa, Homo sapiens
LLRDAPQDPAEEVTITALLFGEDDLEALNGHMNI

SEQ ID NO: 967040 - protein, 54 aa, Homo sapiens
MTSKGNSYVVVRLGVRAVAATDADRSRVAILVSMPESLSRYSELIQTISLHASK

SEQ ID NO: 967041 - protein, 73 aa, Homo sapiens
AHRGSSLSRLTGTHTRLYMYKIEYRMMGVTRQVIYAQTRKYFIYPNSTLKLLTDMLKLSQFGYQIRQVFLTFV

SEQ ID NO: 967042 - protein, 110 aa, Homo sapiens
GGISDTNQIFGLSTPSFLYYALFTLNLGTSYPSISSLTHLIDNNRNQSLFQDLFCVYLTLEYQTEERATVEIFVGINSYRHCMNELATCYPQLQNNHTQNYHEPRAHSLI

SEQ ID NO: 967043 - protein, 65 aa, Homo sapiens
VDSSRILLALYMISVKNYEPQKDKRFSAHRYGRKSTPRAQYSVCVLTPPPYGNEAKAAGYSPYGP

SEQ ID NO: 967044 - protein, 56 aa, Homo sapiens
KEIFKATFVLKSATISSKYEQRPRAVHSDTPQQQDSLEIDTCHRLAFCLWQLLTFY

SEQ ID NO: 967045 - protein, 106 aa, Homo sapiens
PISPHWTPLMKTMSGRLLMFVQLTTMSPSELALAPMSLLDVGNGAGWAGQQRGAGVNNGLAALSTGDGLSVHGDAVHGDLPVTLDGNRHPVQTSSVVRRVNATKDH

SEQ ID NO: 967046 - protein, 34 aa, Homo sapiens
GIPVWKDVQLPEVLSAALTDSQGNEEDNGQRNHD

SEQ ID NO: 967047 - protein, 189 aa, Homo sapiens
LLLMDMYVSCREKDPCQNTSSSGEIHPAIPLMISDYLEIFIKIDSQQHFFKQTSSSTSIIYIFMNTMFKEQTAASKSSKRRKKKSMGQNVSSMTRPCTLLDKLWHNYLSIQRKRHTKVHNGFKIAHLDFIKLGGSKFNPGMTCQPRALFPKETEALSGEKIFSPDRPARQNNGFLPASREIPEHSALTR

SEQ ID NO: 967048 - protein, 123 aa, Homo sapiens
TYYSPTLNHRVLEHSPIHSGEGGWLMPEAGYFYRFHPKEQTTVAEKNLYVDYGCHVEESIDYAWGSRYNKANTCTKPQKSDQIGAGRLNRAADIRQPLPLHHESMDMTLIDQLADDMSQARRG

SEQ ID NO: 967049 - protein, 172 aa, Homo sapiens
FSPTQESTISADLRLKMDDFILQQNGGERKFGKVFLAEFKKTNQFCAIKALKKDVVLMDDDVECTMVEKRVLSLAWEHPFLTHMFCTYQTKENLFFVMEYLNGGDLLYHIQSCHKFELSRATFYAAEIILGLQFLHSKGIVYRELKLDYILLDKDGHIKIADVGMCKENMSG

SEQ ID NO: 967050 - protein, 33 aa, Homo sapiens
EVYTWALLCLPQRRYQSGSVVIFGGIDSSYYTG

SEQ ID NO: 967051 - protein, 36 aa, Homo sapiens
LLVTLDDPLMGYIFSPENYDSPYETLMWSEVWVYLM

SEQ ID NO: 967052 - protein, 39 aa, Homo sapiens
EAEVVWEPLLETRVGTREVTGGEDEDLTAGSEATSKPSK

SEQ ID NO: 967053 - protein, 69 aa, Homo sapiens
TPSESSRWTGPRYGEGLQRSSAPGEAAQSWERPVATAVGYSSLILSFLSQIEGQSEKSGGALGLAGHMG

SEQ ID NO: 967054 - protein, 42 aa, Homo sapiens
EIASVEGEKDDPRPPNPPKPMPNPNPNHPSTSGSLTDADLAD

SEQ ID NO: 967055 - protein, 106 aa, Homo sapiens
GFSLKTADVSGSRDENISYGIPWVCAITLVRDESHSEWVSCVRFCPTAAPYIVFLWLDKLVRYENLANCKLKTNHIGHTGYLNTVTVSPDGSLCASGGKDGQAMLW

SEQ ID NO: 967056 - protein, 62 aa, Homo sapiens
MILIFIVLGASDSDLSSAYCRQCQCYMDGACQTALCMAYRSIADVHVTLHDGVEGSYVDATG

SEQ ID NO: 967057 - protein, 65 aa, Homo sapiens
SVPVYGFNRQEVTVWELISSECFTAEQWQELLCQFRTEKVTVEKVIKILITIVEEVETLLAGGGC

SEQ ID NO: 967058 - protein, 131 aa, Homo sapiens
CVEEKIDSYIKNSFADFYMFQNNLSDYIPSYGCSERCVDHRMKCWQKWEDAQITLLKKREAEAKMMVANKPDKIQQAKNEIREWEAKVQQGERDFEQISKTIRKEVGRFEKERVKDFKTVIIQYLESLVQT

SEQ ID NO: 967059 - protein, 57 aa, Homo sapiens
MARMPNPLVPDHVSSNICRMKKRDAPVSPHGLVNTVKQVPVYNPSCSEHKRLRTTIK

SEQ ID NO: 967060 - protein, 58 aa, Homo sapiens
SAQLGTSDLAADPSRVMDQHTFQDQWEDRIQVWHAEQRGMLKDNALLEYLKIAQDLEM

SEQ ID NO: 967061 - protein, 71 aa, Homo sapiens
KCQADGNGHYQTVKELPGSGEAQAQEEVGGSFIRSSLHAGNGIAPFWMLQNRYHRFHGQGLLQSRPVLDDS

SEQ ID NO: 967062 - protein, 70 aa, Homo sapiens
WRSISAHRDAGVAEAWLLGEEPYLSAERRPERELGAEKLIKRHEALDKSAATWDERSLPWKGCTTLELLE

SEQ ID NO: 967063 - protein, 53 aa, Homo sapiens
TVVRQQEKKLLLHSLIFSILLSQYSTLAYKDGGILYGANCPVGELSLWQVEAD

SEQ ID NO: 967064 - protein, 49 aa, Homo sapiens
EVILSDSSEQPHRLEVCRQSCQMNNRPHLQVVRLTWGHISRDLLALPPQ

SEQ ID NO: 967065 - protein, 53 aa, Homo sapiens
VVQFCMALSSSFLSEDTELCCRFDVYFLESLCWPETFLCGSHRYTYVGLSEHT

SEQ ID NO: 967066 - protein, 48 aa, Homo sapiens
GPVKGLSYWFEALQYCISHFSPTWGWRGQALNYCESVVTENSWLHYCS

SEQ ID NO: 967067 - protein, 80 aa, Homo sapiens
PVSKREIHTVDTTDMNSMIMDDDVAVPGDDHGIGAGIIGCYMYYYICICHHVQVQAYGVSGGVINMYLELDVMLAQLGEI

SEQ ID NO: 967068 - protein, 109 aa, Homo sapiens
MPHHPRLLSDVRGFHDLLLHWAAGPPAALNWSRMHGEEPYTPSVSSQGTQHPILSQVQQACADARTQITDSTVVAYAVNTQQAVILSKKHLGRFGSVTVLAGRLGLAGA

SEQ ID NO: 967069 - protein, 35 aa, Homo sapiens
PSAHYYDKSHYIYSHKTCICCCAELIITFQHVTRN

SEQ ID NO: 967070 - protein, 138 aa, Homo sapiens
DSRGFLHFLDDKSETPSQKKRKKKKEGAEGKGGRDILGRGGRLARMKQSRAWFPALFFASTNIGLGSPPDFLNSVLASLSWLSGGLFFLIQAMFCKFMLGFIFLCITQGIINHAKASCFATTKRGFESKYKVDIRGGL

SEQ ID NO: 967071 - protein, 100 aa, Homo sapiens
VLVACTSTLTSWTSSDEYLEVIKALKNHEDKIRVGLNMGDHIETQQLMRVYVSLMWSLGKIINTPEVVSGYIGSFWCHQLFIHDNRMLFEAEEQDLLKDI

SEQ ID NO: 967072 - protein, 44 aa, Homo sapiens
SSTACRYATHAGEDSTICGSHVASTLSDSDVLSGVTEVVVKLFD

SEQ ID NO: 967073 - protein, 102 aa, Homo sapiens
MFIRRADIWEKSWLRWSRSMSIVRLPESFLALETLTKSSAVTVLPVILSVATSILSQTCLHVCEDVRQGQHRHDLAGQCDVKLRLPCNGPFSVYTPPDGYFA

SEQ ID NO: 967074 - protein, 56 aa, Homo sapiens
MLVGSGTTSVTSNNEIITSSEDTCNRNSDSGGPFGVPDHLRQDVEEYEARHIGVPS

SEQ ID NO: 967075 - protein, 91 aa, Homo sapiens
MTSLHNSFYSKDTSLRTPLYEYPKAHVEAPIAGSLVLAAVTLKTGGDGDKYALTLNIQNPLTKHIMLPLTCYYTLSGLIITSASGDRALNI

SEQ ID NO: 967076 - protein, 31 aa, Homo sapiens
MSKVPSVHTHKICMYWWGVLSPKDQARRARH

SEQ ID NO: 967077 - protein, 52 aa, Homo sapiens
MQLHPQLQSLENKDQEQEAGGGHVEADGDEAGQSGEQVEEEQLVRVSKVVIP

SEQ ID NO: 967078 - protein, 44 aa, Homo sapiens
ILCMTSFWADLVTCQLSSFLSLFDDTTEMSVSYHEHASVPRWIV

SEQ ID NO: 967079 - protein, 99 aa, Homo sapiens
GDLQDPLEGEVGWGAFILRCGRPERAQCEVRLQFLDVGGDIFHQQCKRNELVIPRAAQTRAVYTKDDDQEAGHCSSTPEESELDLDYGNRYKNVKLVIT

SEQ ID NO: 967080 - protein, 37 aa, Homo sapiens
EYNEDVVCGDYRMSGGEASGGLDENGCYYEGYVADEE

SEQ ID NO: 967081 - protein, 115 aa, Homo sapiens
GDLQDFGMRAFWADLCDLPAPADFYVTTGLMTPTGNVCLHIHRKQCKGVPKVASLRSSQNKWAARNHINNWQHHQTSKNIGPSSSFLPERRSIFSFSSANLHATVSRGGNPSTGG

SEQ ID NO: 967082 - protein, 51 aa, Homo sapiens
MSKPHRWVNSTWRSTSYELGGLWYNYCLNTRFSNPLTKTHRPSPFLVLNPY

SEQ ID NO: 967083 - protein, 44 aa, Homo sapiens
MGYMMAKSTGDHPDHPIVETLRKKAEADKTDKAVKDLVVLLFET

SEQ ID NO: 967084 - protein, 61 aa, Homo sapiens
RSPMLIIHSAEAWHLGEGSTHCLLRGSWTTRCNKGEDGILFLPYTKAIGNPESKSHHCLPI

SEQ ID NO: 967085 - protein, 60 aa, Homo sapiens
LRPEDIPPSMTKSAQLKGFGTSPGHCTASIRDMWPFRPWESRTLNDGTQLGVPTPVFGSF

SEQ ID NO: 967086 - protein, 138 aa, Homo sapiens
GSQTTRRLCNASLPTSPVTSLLTCGPCHRVLREQSLEAVWGTGVQAPQLGGALCLLACCVLVYFCVWKGVKSTGKIVYFHCYIPLRGPGRAAGAVEVLLALGPWDGIIYYLKPDRSKLGSPQVWIRLRGPRISFLYAH

SEQ ID NO: 967087 - protein, 60 aa, Homo sapiens
DPYTTEETVTKESISSKEKEKMETCGPRRKVHYFVAPGKCSILHDDPRKKTVADYKHSIP

SEQ ID NO: 967088 - protein, 68 aa, Homo sapiens
PSSMIPSRQWRLNILYLDSILHIGRGLYYEIIIYYSRNLKTYGNYPPDLTNYRQTDYHRAIDPPDEEQ

SEQ ID NO: 967089 - protein, 111 aa, Homo sapiens
RISRNTDRIIVRLLRMNSRRKKLGKPGYRNRIVHGLLSLVYHLKEGLEHGVEVQGLVRRAGHQAADDAGLGKEEVRPPVGQAEGQVVVGILGLPGEEPVLEELVYDAGRAA

SEQ ID NO: 967090 - protein, 69 aa, Homo sapiens
MCVYASRVVRTSRRGPFRDRPTESVVGDRGNRQGVPELIFVDRESVACFPAVTKPSAIPERARTLGRPP

SEQ ID NO: 967091 - protein, 39 aa, Homo sapiens
MPVFGLTARGLSIDLLVDCQMLGCLLSVQGLNLTAGLCG

SEQ ID NO: 967092 - protein, 103 aa, Homo sapiens
LLVVSRVIPLPGCSTALIPILHMSINPLCVALSTLVTVTYDFVMPKGCVVGTTKRVLTLRKSLLVQTKRRRLEHRLTFSSLTPPPSWAMAASRPYQNRSIATG

SEQ ID NO: 967093 - protein, 95 aa, Homo sapiens
MFITLAFVIGLWLAVIILDDCCDDNLLAPNHEPDTCYDLGDNMVRLYGGSRVRASSLLTLGRLFNPVPAPASTIADASRSRIEGGTSQKLMLSLL

SEQ ID NO: 967094 - protein, 36 aa, Homo sapiens
RIVLETGRQCTADTTSYLRLLHGVDWDYDLGKDCHK

SEQ ID NO: 967095 - protein, 53 aa, Homo sapiens
CIANPLMKLGAEEQASKQQFVVKSGQESRSPCDLVKESSEEGRSANDLVVKLG

SEQ ID NO: 967096 - protein, 69 aa, Homo sapiens
SGIANLLLYLIHKLDLGTSYPREYSSNPILRVHNSTIGFTTYYLGSGHPDLCSRLLQVRLFYDLKSYVI

SEQ ID NO: 967097 - protein, 74 aa, Homo sapiens
CIAQSFILHPPFPIERATLTQQGTTYASRADRGSTGSCAIGHRAAYVLFQFVNHHGTGFEDGIGGPSRSDVSHW

SEQ ID NO: 967098 - protein, 45 aa, Homo sapiens
VSTSIHCKYMVCSHDRTLGTPIEYHTLRPVAMYPNGSFFPECYTA

SEQ ID NO: 967099 - protein, 66 aa, Homo sapiens
AQYKTPLYETETGPDQDNLLEITTTSTTLSSQTHAYVIIFFIVIPIIIGGFDDTVVDTEVERGDPL

SEQ ID NO: 967100 - protein, 76 aa, Homo sapiens
LVKGTICRMVKYRTLVARGPQLCMETTGSQAHRGLMPTSYPSTSTKAHLHRELDACVYAGSESSLLPSRAVTPDSD

SEQ ID NO: 967101 - protein, 89 aa, Homo sapiens
TQSTLTPGEYGDSPVPTTRSSSAASMAEEEASAVSTAAAQFTKLRRCMNAKEFTVQIKDEEGLKLTYQKHKKMANGVMGDGHPMYHNTT

SEQ ID NO: 967102 - protein, 39 aa, Homo sapiens
HVTRVTHPNPRKAEVEPEREPAGKLRLGVERRIVVRAQT

SEQ ID NO: 967103 - protein, 98 aa, Homo sapiens
VRTDATHMEDDSVTCRWVYKRHRRLESLHNGMDRDPDYANAQIMIKKEEERERASIRRESQQRRMREKQHQRGLSASYLEPDRYDEEEEGEKSISLAD

SEQ ID NO: 967104 - protein, 98 aa, Homo sapiens
RRPNSTFSDIPEDQNSSLSCGNRPGSAMECALHLEKKCDISHYWNCTTVATDKNTPICVTSLKTHYLIQPVKAIIELGDHVTHLREMGAPESGLAAYL

SEQ ID NO: 967105 - protein, 120 aa, Homo sapiens
GNSTPHHASENGALRPGMYALDRTYPVPLCPTNQLMSLVCCRATSMMFHDSSLLSYQLARLMPNFWAANLGPREMSDLSTAYQLWVILWAVCMLCRDIDCSLHRPLSAIPSRQDSILLRS

SEQ ID NO: 967106 - protein, 36 aa, Homo sapiens
MRTVSCVRYFAVCYGRTEYLSDVMSVGDLFTTDWVP

SEQ ID NO: 967107 - protein, 135 aa, Homo sapiens
RNCHRDIRQVHAYSCAPIYSQVGHGGSPLYFDWLSPALSGIVSQLCLTHGGHFCQWPVCAVPRSLTYSHFFPYLMLHSDCILPALPVLIVWFLDILKARFGHLVGSAASSGFELIFCILVLAFSCVHSPGYPGGS

SEQ ID NO: 967108 - protein, 78 aa, Homo sapiens
RTLLSDGGCIRIHSAAALRVLQNAHKTLLLAPEEASQRLQNQEENMQKALSFLGPSPQLEIKNLSPETPSDGHSNSPS

SEQ ID NO: 967109 - protein, 31 aa, Homo sapiens
MACGHTSTVHCCHCYIGFFWGGETHKTKPFA

SEQ ID NO: 967110 - protein, 45 aa, Homo sapiens
LDQSGPHICDGHFDTVAMLRGAMFVFKGRWFWRVRHIRVLDNYPL

SEQ ID NO: 967111 - protein, 60 aa, Homo sapiens
MARPSLWTPGDRPQATCLLCAEVKPTAPCVGEALTEEAVGGRSWRTPGVGCSSGCLELRG

SEQ ID NO: 967112 - protein, 33 aa, Homo sapiens
SFWPRLETIRGRGCKSRAGPRESDCLIKTKHRE

SEQ ID NO: 967113 - protein, 37 aa, Homo sapiens
WLGVVPGPEVVLVVEAEVVLVVVNRDCAGGSEQWLGV

SEQ ID NO: 967114 - protein, 71 aa, Homo sapiens
ASIRTLELQQRCSCLGRQLHNPQAKTRPLLPVITSFLTLELQQNCSSLGRQLHERQHQNEISSAASRQFPV

SEQ ID NO: 967115 - protein, 74 aa, Homo sapiens
AYNSEPTSPSARKWVIWMYHERCSLEECSLHREVHPASLTVSLTVSYTRNEAQIVHHTVMYFNAGMTSRSSFRE

SEQ ID NO: 967116 - protein, 49 aa, Homo sapiens
SSSVPSSSASHTYASLHNRRGQLIPPFTIKSIGTNGTEPTKTPELPCEY

SEQ ID NO: 967117 - protein, 39 aa, Homo sapiens
YREELRPQKALNPNPQNEDTDREQQKLWNCFQRACIAWT

SEQ ID NO: 967118 - protein, 56 aa, Homo sapiens
GREGAGIVDTGTFSADRPTSPIANIQSGIGASENSDGDMVVSCSAISSLPDIVVTI

SEQ ID NO: 967119 - protein, 43 aa, Homo sapiens
MGASYWGNVLSGWVDGCDFLRHSFSRPRSDRVRLKDFFLMETG

SEQ ID NO: 967120 - protein, 79 aa, Homo sapiens
MQSSLLVEQVAMPWRAIRPPVHQHPSCRENRGTEAAMSAMVLGAPLQTRQLSTIYVTQNGGGGGRSPTFYSPESNQHLV

SEQ ID NO: 967121 - protein, 74 aa, Homo sapiens
TSIIMNGEAIACPEGCQSIDLALLSGPTSPIANIQSNIVASKNSNDDMACSCSAISRLPYIVLTIKGIQYPAPP

SEQ ID NO: 967122 - protein, 71 aa, Homo sapiens
LARYRLDSDSSNSWYLRHDPALDIAFRAFFHSDSVCLYCLVLHRFHAAAASWACCVLAWVELLFFKLWYLI

SEQ ID NO: 967123 - protein, 82 aa, Homo sapiens
MSIHEFTVTIESKALTETLEANSTLRSRSLTALGNSGGYAFRFLLYSGFAHHIDPHLSCCPNVCDADSVSPIACIPSDPAHF

SEQ ID NO: 967124 - protein, 76 aa, Homo sapiens
MTLGHSVGFISTLTQSTIRTPFDLAEGESERLSGFYIYYAACPFALFFIAYYTILILTSLLGDPDAYTLAYPLYTP

SEQ ID NO: 967125 - protein, 54 aa, Homo sapiens
MISQGCTEVFVPQNALLGSRLKRTIQSTSISRRGASDLSSEEGRRVNKIDKEAL

SEQ ID NO: 967126 - protein, 95 aa, Homo sapiens
PCTYPLLSALTYNKAHLAYNKRDAQIAHCTTPSISHMPSLLTAILIQNPLKLHRRSSFFIIAHRLSSSLLFCLAHSNYERSLQSHHNPLSRRLTV

SEQ ID NO: 967127 - protein, 115 aa, Homo sapiens
TVSPSLSSSFHRWIFHHLVCEHSTFQPLVPLGDLLIIRAVTESIAQHLKPLGDELLLKTSHQAVRQTSSPLPVYSPLSNCIPVLLVVVNGSLTKTHPALAALSYRPLMLPSMLTG

SEQ ID NO: 967128 - protein, 118 aa, Homo sapiens
MWTMRRNISGQYYLVYHPHVSDCVLSSLLLYCVMVVKKLESVLHQQRYEIEPERPVSIVSLRHFVWGGTESVTQGFLGRQQHTGFHGTSVRLKLVLEEHAIQQQFVMNIVKQSRSPCD

SEQ ID NO: 967129 - protein, 111 aa, Homo sapiens
SLTGSPLKCGLSEIQRIRGHGTGLRQSLVLGSGWITYEHYLVDLIRKLQRTTTRIPLSPHSYTSASHALSPMPSGSPEEPRGTFSSSPSKDKMSQDLRVGGRGSRIEASSL

SEQ ID NO: 967130 - protein, 77 aa, Homo sapiens
VSTGIPPVVASEQEWGVLWVGGIWWTLVYREITIDWSIMTSYQLQVTVQHEYARGAGADPWIPSQSALEREGHQDLC

SEQ ID NO: 967131 - protein, 52 aa, Homo sapiens
CMLLVVSTGIPLWTQRCSAAGSANETPENTGQRGTLASGALYRILPLIWKLL

SEQ ID NO: 967132 - protein, 56 aa, Homo sapiens
CRHSYVVCEEGMQRQDRTGAGVEEGRGTLDAFPRTQEAPHRALRHPRLTLSPYRLH

SEQ ID NO: 967133 - protein, 66 aa, Homo sapiens
MASTSERSRGEHSKANKPISCLAYLSTAVGCLASNAPSAAKLLVQLCTQNLISAATGVNLTTPRRR

SEQ ID NO: 967134 - protein, 69 aa, Homo sapiens
TPGRRIYLSAAYPIELSGSPETDEEPLGEEHQHNSTSTNTLSTSTNSLSTSTNTLSTSTNSLSTSTNSL

SEQ ID NO: 967135 - protein, 40 aa, Homo sapiens
LSISTVAKNSCNSRWSIPFGGSAVTARQNSQDSSMVYPGA

SEQ ID NO: 967136 - protein, 128 aa, Homo sapiens
EVHISQLQHEKSILRGDPDEGKLEDPCPLCMLQSYAMRAMAVSYQLERCIVRAVSWWRHRINMNTHTQYQDITRSMPAAKSPSAQLMEQVAQLKSLSDTVEKLKDEVLQETVSQRPGAKYQQNSLSTR

SEQ ID NO: 967137 - protein, 69 aa, Homo sapiens
LHRCRALRKSLSECGLPWSSRRNGLEILIQGHVQAIAEVETYADVLTHAFTQKANLNKHQHNQHQHEFP

SEQ ID NO: 967138 - protein, 74 aa, Homo sapiens
HSWSQIDACIRIVERDCSAEAAALKPAAEPDERAAALWNRATWCSAPSTSTNSLSTSTNSLSTSTNSSTSTNSL

SEQ ID NO: 967139 - protein, 121 aa, Homo sapiens
MHPCNDSSESGFSLHRECNNMEIHSGHGQTKTSDYQLVSGNAARRTRSHVHAQMAENAEEGSGGGGREEDPPCRHQSCEQKDCLASTPWDISLAQPESIRSDLESSDAQSDDVPDITTRIT

SEQ ID NO: 967140 - protein, 122 aa, Homo sapiens
RNWRRQANIIRTLPDDPVCAHPMESILPGPKPPLSTTPGPLGSLHRSPPRTRVAASIIASSATTTIIPVVTPHVRATWIPHRGPSGLGALHWLHTFLQEKFIFSQVGLGHYPVTSSLLSSTA

SEQ ID NO: 967141 - protein, 75 aa, Homo sapiens
GYGITARSYAYLCSLMKDFSLCSITSSHSYTGQVLQYPEEDVGKISLHQIDLLSTKSFPPSMRQGHKALRENHHQ

SEQ ID NO: 967142 - protein, 86 aa, Homo sapiens
TPPLSPPPPLPQTRVPALSQTTGSKLGLKLRLQLSPKLRAPPRSLTTSHHLCVGLSTTDSSQPADRYRRYKITTRILPGILLKVDL

SEQ ID NO: 967143 - protein, 93 aa, Homo sapiens
RSEVLTMRDQKKLGLEIRYTSDATVKILITKVDHPIFENWITELHYGYQSIAECLSSHPNMPAWFEENASQSTVKVLIRLLKDLRIRIPGFEP

SEQ ID NO: 967144 - protein, 110 aa, Homo sapiens
RSTQHCISYALTERGVSLVLSQDPMHSFRDYETLVDFCALHAGLPVSTGSVRASLIPCQIYQRELAMHFSLSARRIIWKHAWEREELELANVCPEVLQALPISIILMTSP

SEQ ID NO: 967145 - protein, 80 aa, Homo sapiens
RSRDNKPLTSSFRTDNLYAPVAISEDDQNGPGGYAGSQLSHVLTEEVNKPMASTAYEAHHTDKIISRHLAKINHPGTADI

SEQ ID NO: 967146 - protein, 69 aa, Homo sapiens
MEEEEGTRSPTLEPPRGRSEAPDSLNGPLGPSEASIASNLQAMCTQMFQTKRCFRLAPTFSNLLLQPTT

SEQ ID NO: 967147 - protein, 32 aa, Homo sapiens
MCAGRVSLTCPAGEVFLKLGLMLYRNVNTEFI

SEQ ID NO: 967148 - protein, 49 aa, Homo sapiens
RACGRGESFATLAPPRLYNASRWSESQGSDAVAGVGAARGSVLRLSGPR

SEQ ID NO: 967149 - protein, 138 aa, Homo sapiens
MESETRDAVKIAAEECGLEEPTVAMAYGYLEKLCLKGKFNKQTRTLCAGACVLLAATMEVTSQKHEVKHLLDKLDKKYRLNRRELIAFEYPVSVAWNSASSSPSTQSLAPIQTGGPEFLGNAPEETAEGNYLLKQVNR

SEQ ID NO: 967150 - protein, 78 aa, Homo sapiens
ANEVTDEVQSEELIQVGNSSYTNHSLHLLVSEVSLALYYALSYSYIQWLCGHDSTDHFCNCFTGFIWGGDTYEIKSFA

SEQ ID NO: 967151 - protein, 126 aa, Homo sapiens
MWFVCSPPQKKPLKPLQKWNGRIVGTQPLYVALAQRKEERQAHLTNQYMQRMASVRAVPNPVINPYQPAPPYRLLHGSYPTDSDSVLRTILLAKLLKLKTKSSLDCSGCQTSSIPKYARCYPAGCS

SEQ ID NO: 967152 - protein, 46 aa, Homo sapiens
DRARDRTQTNTSLMADHGNREGEAGMTLTYDPTTVCYTERLLSFTI

SEQ ID NO: 967153 - protein, 80 aa, Homo sapiens
VPGTGYKDTFLLISRSVTVIKFDYQDKAHRDIMIDCNICAMDINVYTTILVSFFLKSNSSCSLEVVGNCFTFGTYFNPHI

SEQ ID NO: 967154 - protein, 87 aa, Homo sapiens
SSLEHLLFFPSLFIFYCQLFKERFTDLLVLLPFLHHFALMGSCSLRSPYHSRLRAARCLARLSCTRGGSAHAYLYREILLGVRPSSA

SEQ ID NO: 967155 - protein, 51 aa, Homo sapiens
VLYGGCVGPKGTRSSHHLLGRRSCCASGRRILVWLCNINGHGTYLVSILIL

SEQ ID NO: 967156 - protein, 68 aa, Homo sapiens
KQHRRYPSGSGTERARAHQTIVVKKGKMDNEDHQNVLMKMLDVEYKHGWWKKEKCAQVRIEQTACRRQ

SEQ ID NO: 967157 - protein, 60 aa, Homo sapiens
MVAVLGRHSRPYSYYRYLLLRPGSAEDSVALKCVFLLFLMNILNSFNKHLVGACCYPYIT

SEQ ID NO: 967158 - protein, 48 aa, Homo sapiens
AVATELLEGEHTANTHFMEYLLHTHTGKGVQSQPGPPVSTDNNADNYG

SEQ ID NO: 967159 - protein, 137 aa, Homo sapiens
MSLLELYTFEPDLLDRPYYRKDEDRGILPCGQRIPYWQRSFKYIKNNIVDTMNMILFGTTKQKQELIEEERKAARAEYEAEKKGLTMRINIPTGTNLPPVSFNSQTPNIPFNRGALSAMSNQQLEDLINQGREKVVE

SEQ ID NO: 967160 - protein, 68 aa, Homo sapiens
RPCRAYAEQYRIDARKLAHLFQLVSPLDLRGPHGRSSPKGTYQALWMTTWTSSSEYKAVGRAASNIHV

SEQ ID NO: 967161 - protein, 133 aa, Homo sapiens
YESNKKTPQAVLDVLECYDSNTVKQKCLSFTPPEKDGFPSGTAALKAQGPEAPAVLTEEEDDDEETAPPRYGPATGSYELSLHTVMSVKHLFLAPVGDSHVDGAAKSSDKQKKKTKMTDEEIMEKLKNYREHR

SEQ ID NO: 967162 - protein, 75 aa, Homo sapiens
MDLNLRKDHHQMDRFFQKDSSLTRITAKQKDQTGTKSKLVSATRTCQRNLQSTLKWIFLFENVYYQSSSEQYFMQ

SEQ ID NO: 967163 - protein, 46 aa, Homo sapiens
MENRDNTGCTGVMLLMYGYMYSNCYKYNPPDHDVVAMAQKSYRDGI

SEQ ID NO: 967164 - protein, 44 aa, Homo sapiens
RRASSSESEHSLSSTILVLLIYPPPLPQRSSHSYFPHWRTLKTI

SEQ ID NO: 967165 - protein, 41 aa, Homo sapiens
MLVVILLKCWVILIMVGCICLLGSISLCVIHQPVETWDHGS

SEQ ID NO: 967166 - protein, 106 aa, Homo sapiens
HEQTRSSADNCEGMEQGRPGSYEPVWAIGTWQDCNNTNRPRRVHDEAPEDGLKSTRLMMRVAQMHPVSFHGCALVTCVANLQGMLGHAKHLMLDVLHLMVWLLTLQ

SEQ ID NO: 967167 - protein, 62 aa, Homo sapiens
TTFHHGRVNRHQAQFNSDLCWIRRAGRIDIQMVQASQNHQCTRQCGTSTGTTQTDKGRRLAN

SEQ ID NO: 967168 - protein, 35 aa, Homo sapiens
MLLLLLLLLRRAVRYAAAAACAAAWLRVTARGSTT

SEQ ID NO: 967169 - protein, 66 aa, Homo sapiens
LRQMGYCSRVGHISGQLLSYTKCVASPDGMIHSEYTDTVDDLDMEVPSKTSSCLLRSCATFERAPY

SEQ ID NO: 967170 - protein, 220 aa, Homo sapiens
MAVLVGCSVHQGFAFVQCVNDETARAAVAGEDWGDCLARSTVLDINLVGDAKCATVVTMLVLKSFLQLEFVLRSVTERPSRCPLLSSSLTGSMTFDGLFMLGCTGTPACVPSSFLVLPGLSGPPTGLACCQGTLPRGGKGGSNQCGRGGDLQGRTGAGEVLRHEEALTHKPKGSPGKMREERKGEALREIKERTQNRKLTRRRKKETRKGEKKKETKTEQ

SEQ ID NO: 967171 - protein, 198 aa, Homo sapiens
MRHSPSVSGRYGATLLFLSGKKTIAQKEGREEKLERDDERRRIEGTAICPRQYPAPELRRTTASVSCHGRRVYVTPGRDRPGIPVTTGTVCLGSADSLLFCFVDSDDIAFIPCRRMMRPNLEIGEHIGKMSHVVNRNQLEAKLAVVLYDDGVVHVGLLLTDKYAMSGGHSKGKDSVKVVTGLSCDPEFDEQLPQNSYF

SEQ ID NO: 967172 - protein, 190 aa, Homo sapiens
MQYGRHPHDCCCGGEIKALPGLRTHLSIVGVAEAGGDPAREASRASDMSTVTFQEVPGRQASLQLASTLSKVLCSHLKQGLNLPKIPVKGSHARSPLHSSSPEGHSLLLWLASTGSTAWTDEALSHSTGPISESTNTPQTWMVTGTRQIPKHIRHTQMQPVRYQWGGSNQAMNYFPNMPLLTCIQRLRDT

SEQ ID NO: 967173 - protein, 105 aa, Homo sapiens
TAYSSFSNGGRFSCHKAPTSQVDPRLLCSRCHWGMKKTPAAAGPDVFTAEFYQRYKEEPVLFLLKLFQTIEKKGLLPNAFYEASIILIPKPGRDTKKKKTSSQCP

SEQ ID NO: 967174 - protein, 94 aa, Homo sapiens
MDHISYVRRTPHTHTPPPPTHPHPATTVRAPSTSPPTGWLWTTPVYPKHQEQTIYSQARPTHSPQRAPILVEPTGTAIYVATYIHERARTCTNG

SEQ ID NO: 967175 - protein, 74 aa, Homo sapiens
VSGGGYSFRGVKGSVDQSQVFRVFHSGIYKRFMKTCARRYDYRITYILPPEGRFIPNVEYAMEAIVDAGILLGN

SEQ ID NO: 967176 - protein, 132 aa, Homo sapiens
KLGSVAQESRQSTDYQNNYPDPCTNDNMISQHEHAHTTYNRHKRTKIKREQEQTDPQRPRSTGTKADKNKEKTEHTHTLGKTKPRDEIHNKYTLTAKKEHKKHNRKNKRKIKRAKKKENKQGVTTKNNTKDK

SEQ ID NO: 967177 - protein, 69 aa, Homo sapiens
AAAVGPVCSERRLPDNVSAISLGTFCHCSPQSLLLWKNELDKYIVVPGSSQAKLIQHQFLMPCTCCHPE

SEQ ID NO: 967178 - protein, 53 aa, Homo sapiens
MGTDGTREATVPKGRATTGVDKITSMYQERELGKEGPIKDKGLTQRKECNREQ

SEQ ID NO: 967179 - protein, 77 aa, Homo sapiens
VTRIRCSNPGENMRTFDLISSETRVMFDEMKRNTLAENLQLLVDLDRWSTTVFRLHYDRVYYVSEKIMKLADNISGD

SEQ ID NO: 967180 - protein, 294 aa, Homo sapiens
GAMDLPHRASIWLRNRVTDRYFRIQEVLKHASALPGQGKIACYRLAAQNLIRAFVKLHQSPIPERTKNMRTLWHQLELQLLAQATWHCQLSSATKGNPVKRHFQARLNTALPIGPAVSSAQGWLPKDPEQGDRYPGPTTQRLHDPASLHAYHSTPGGAQPGQSYTDLAIYQPQDYPNPCLALAQHETHHTDNARLPSPECGHDTTPAIPPRADAVTHAGLMTELQKANNNNKTKQTPSTAPRPPFEQRSNKPTTESNAANTATTHGVPAAPKNTCKDNAVHATRKKPHGPPQTH

SEQ ID NO: 967181 - protein, 239 aa, Homo sapiens
MTRRHPSATLRFHLLRPSRTLHRRRVLFPSFRAPTAHSTPSVYTTLVALFRLPWSVGGPPCFLLALRPLCPDNPYLRKAHLLNAYATWCAAFSPHALFHTSEPRHALLCCSANNDSLLAPLTSVDGLGAIARLGVTLEYLLHISATWVPYAMCSRTLVTQWATSQRTLYSSLALNGVCNPFGTRALSSPWHLHNAWSIGLWLGWRPVPCVSTPYNLLPPPGIIDYLIPPLHLSHVALAL

SEQ ID NO: 967182 - protein, 66 aa, Homo sapiens
MSARGGGRGMDSGSGHLLDINSTPEKLNFTIGRIIRTLNVNSISITKKVDTYMMTVKQFRDAKLVR

SEQ ID NO: 967183 - protein, 121 aa, Homo sapiens
RFGFCLWWGACSRSSHKRPQDVGTSFPCASSFTQLATPPILAPLPELPSPLGVPCGLWSFKRQGLTVSPRLEYSGVIIGSLPHSKLHRKISKRRISSLASASRVARITGMHHHAWLLCIFL

SEQ ID NO: 967184 - protein, 85 aa, Homo sapiens
RPACMRAFFVGNTCDTPTSAKMGDASVMHEVGPCRKINSDIVFSLHYGLNAWLECENLIGLHDKGDFGGVHGFDGRIVVGQPVLI

SEQ ID NO: 967185 - protein, 296 aa, Homo sapiens
MPEHVSAIPWGIAGTAGPQGLLHVERSELVDQEYDIVVLWVPRCEVSHDLSPANSFPRCPWWSMACQASNATLIVKGVAAVRPYGRSIMDLRPMYELLRGNSYSVLSFYAFGMVTFCVCYRRIVRLCSGQKTDGLHDVNLVEDVAVLRGICQLWGHARAGSNDIQGRNGGYGGHMTHGRSVSRTSTKQVSRRQRCAREKVLGCTKRSLHKGRKESSALGVKELPVGRRGRKLVGDWGCCAPWKRQEGHGFKKEVTVRAQKEQIRVAFRKPGTLIQVPGTGTATGGNRAQQQGNTKT

SEQ ID NO: 967186 - protein, 69 aa, Homo sapiens
ALYAVFWLHCMGVCRGSLAAHRSCVRPLGDMYEHLDELKQRDYKNPDRTRCNTLESRICSSSQVMEWLQ

SEQ ID NO: 967187 - protein, 76 aa, Homo sapiens
LPDVGTLWGRVLRPALSLLAFPTLGPRMRASSRGAWAGGCRPRLRGEALYLRLYPYEGYAVGLLRNYTAYSRWRTR

SEQ ID NO: 967188 - protein, 289 aa, Homo sapiens
MPTVMSPEPRERGREVRFRQRFVRRKHALVSRLMLHVCSTCNFPQSLLKYVLNKLSWVSYVAKQVMMLGVSHPQDPCLKEFRITKPHGYEGSDKDSVLHRLPAGSAEGLIKTSLDRGTRKVLYRLRRVRCRAMRANLEQACYRHAAGYPSRCGEQKDLSYRGGLPEGVPYSFSGVIRMVSWRVSPTEFLSGTTKRGHQNYIPKKTVKGTSQGMAISAMCVEPQLGWLATPRKRRGRKFRWPPGTRRSQRTHGRRGKLSQLGLTKVLTPFNKVDFPKVDTKGASRTAIRE

SEQ ID NO: 967189 - protein, 156 aa, Homo sapiens
MYILIEAEGASNCGVKISDAQAGETFTGDTTKSCGTEKIREKTIAGQWDTQAVANKGGVKYTQVTVQTKDAPSPTRPEGDPNEGLQRDVRVRHNRLGHWRESDGAQVGTTGVTAQGEQHAAPRKATGEQSYNDSKQGACRVARTNDSNNREETNKD

SEQ ID NO: 967190 - protein, 315 aa, Homo sapiens
LGGKKDFGSLWPRLDCNDVISAHGNLHLGGLSDSSCLSRGQPVAKPLLKIQKKKKNYPGGWGGGAGLPPRSHVGRAGGEEISCGTPRRAKGGGGNPKTSCAVWFASIPGGCTGEPKNPRFLQKQTTKTTTEESLTVETSGRNSGGSPAVCVLQRARGVLRTCAGADGVFSPPRVGPPKVGGGNDGGGEPRPSLGGTKRHHRFSLKNTVVLVSLCCGASLLRAQGGPGFERILLRVLAPSVVGRPEFCLFFQFPRFSPPDVFVFSGVVPPSFPRRLGRTEGGCSGTTSVFSAYTSWGRGAGSGGSPPSNTVGKFVR

SEQ ID NO: 967191 - protein, 126 aa, Homo sapiens
MCGGHPRLSSPQGQLSVCVWPYVAQPPREVSNWGGSVPVVRGGWVSVVPVVSPGGVAREKPEVLDAGGCVSSRRGAWHPSGVVEVLSRWGVIRRQAEVRFIRGDLTGGRGRKNVEKAKEGKCVSAT

SEQ ID NO: 967192 - protein, 156 aa, Homo sapiens
MALYYTPASYTHRRERRARRQDTRERNITRRVKQLRGEGQREWAGGEAPEEYGGPCGGSPTRGGDSREAKQIHLLAPIKKKYNRVNTEDRIDNPARNDIEKFRTPPLWRERGRAPQPHDQTPLFGGAPRQVLHSSHHNSVGHYSRGGQPSSGEDTL

SEQ ID NO: 967193 - protein, 272 aa, Homo sapiens
MNHKQQEQQETTRGTQDKAHTNTDRTRENPTSSTTNQPRTNSRPNPNAELRREPRPKKNHIDNKTNRKNQHSQQSENSKTTNNRRHRGTTTMTTEQTDKRNRDTNKTKDYQTKRHDKHRNKNSPHTRTTHPAKKRSDQTHKNNNQENNKRTQRERHNKEQGRHRTETENKDNTQQTKAKRTNNDIKPTNKTNTTHSTEQKRDEGKSKTDTSEDRYKQVERKHQIAEKDVKAEQQANNTKQADKRRKRHHINRPQKQDETQNRDTLNKENNPT

SEQ ID NO: 967194 - protein, 155 aa, Homo sapiens
AHRAGLAKVVPPKGVEATASYDDIDDLVIPAPIQQLSDGVSLASLHQYNIQKKAMTVRRVPARICHIDEYRTGTPRYSEFEELRAEITGHTEVCDIQSPPILLGDVNGTLYEKHVDEWNIAPAENILDLVEKERGSPLRAVKQPPITLPFGHVED

SEQ ID NO: 967195 - protein, 216 aa, Homo sapiens
LPVQLLGGARGALCGPGMGNLRWLPAECFAQWHPGAGGLLGVDGAWGLSACGARGGKDEDKECDCPSPSLGRLVKDMKINVPVEEIYLFSLPINGIRDHWFLPEGPLSQDEVLKIMPCARSIPCARPAHQGSQAILLLSGGLQLVPRQVWRVKVRPTEEWPTVYPVVANTFLVPRLSICHPCGREQLEVEPMIRRRHNTCPIAHVLTCWRCLTLVT

SEQ ID NO: 967196 - protein, 72 aa, Homo sapiens
KQEEVVADGIFKAVDLNELILLGSWREDGYVWELRCELIPSTRDRIHYLRPPEHQKVFLVLKKGPEGIDVAT

SEQ ID NO: 967197 - protein, 106 aa, Homo sapiens
MSAWLPGCLQPATQCSLRLRPFHLAAGRNEGCVISGRKLAQQIKQEVRQEVERVGGLIARTNGHTVSVILVGENPAEVTSIMSSNKDQGMLQLWESTVRQLMKPAF

SEQ ID NO: 967198 - protein, 288 aa, Homo sapiens
QRAGVTENGWQLAASRLCPVLCWWSDGEVSEWCAVPGACASCSLQEFVLCWLLTLVEPALMSSSPLSNETVCCVLGLIQMPGSNLLPCPSPVFVLNVPSCANQTEWPMNWQLKQTYDEWPLLPVQLVCCWAMSAMNACSRHPCVLVSVPAWALGCGRSANEHHPLVTVNGCYPYMTSGTAQWADLSSQFYLREDDIGPTGPRYHSPASLSSTAYVPVTPTLGPLAEDFLTGNTAGRAPQHPPGGTRCQVRSPPAAQRCPPSPPWSNTRGPHGPHTRPSHRNHIPNSRA

SEQ ID NO: 967199 - protein, 83 aa, Homo sapiens
MTNVGSLIQRNIVQQAFLAQWTIWVCRQLDTRAEETIPLSGYPTRRHATSCADTGCFHHGSSSLNFAMQALGFIHYWGTPNAP

SEQ ID NO: 967200 - protein, 198 aa, Homo sapiens
MQRRPIDSPLHRHVISPYYGPLPEQQPGYPFKRMSRPNHKRLSSHVFNPPPSAKVKPPSPIQAYTYPNRRPSQVHRAYPPRGAAPVTPAAAKSQRTPHEQIAPPERYPSFRADEDTRRQVTHATLTTAPLTSPALKDRTQQRPPHSPRKKLIQARDNEPLPTRYTTGESTRQTPPRTHNPPPIPHTRNATPSLTPARH

SEQ ID NO: 967201 - protein, 504 aa, Homo sapiens
MGRNRRRIQLGRWSSVMALTKRHGIQGISLRSTDDKSWLLPHALRTMTYDTSRDYVLPDSGLTQEPGCPTDNRSREHRCHTTRHITVEDPYRARAHPQDRIQNTSCYALLTDTSTQALSPRLLRTDMRDKQAKVQMSEASSYRHEEHHEKSDRRTGQNRPTTTKQHTKQRRIRRPHKTTRRPTQSDPRKTHRHPPHTQENNTQTNPRTTKPNQKHNTTAPSHSHTSTQTDQPTSAAPPAPYPQQNKQTERDIDRPHNNEPRGHTQASNNTRQTRTQTKELDQTQPTNSNTDTQTPDHQPRTYPRCYQERKKETITNKTSRWKHTTHRHNPRRTRTNEQADQMESSQDKTYERHSHTITQETTNTRDSHSHTTSSMSPSTPHHTTHPTTAVHQNTTTSRKQKKPRIPTNNYRSHNATTKPNTHTMQLPTGKDKQHTKNRQIEQHTPQRQTQPSTTTNVTSDKTHRPDQQHSQLCDQSYTDQNHHHDRQQDNTQTHHDMTTEHQKN

SEQ ID NO: 967202 - protein, 131 aa, Homo sapiens
MCVIEGKPKSGAQHVWSMCLDSCEKYIDVTTNMPTLHMENSMKHACIGQRRSSRCNVTNEETHLCGQDFCDATRPPSLCDRGSSCQPMSTAQMSAYRGHRSCHRILSRIRNLHYVSSGLKSGAALLSQLGP

SEQ ID NO: 967203 - protein, 151 aa, Homo sapiens
RRPRVRISRCELISFPTTGGPTRSQLCLSRLSAGLHKPAIPNPGCTWKLPQELLENVPCEPSPCTEPWWVSGGGAQAVGVYLKLPGAVRPRLRGTAPNCPGNSDCTRHSPRPSSLLPLGRLASSVGENPGGERQPYRAPLLGGLQVGQGEV

SEQ ID NO: 967204 - protein, 99 aa, Homo sapiens
MVHCVLCLLLLLLHGPGCAWVGSGECCNRACPVRGVTDEASIVPVLTNTDQRPRTNVEWGCWNWTASGARATGDDELQKMFGIWCRRLSAACRAVEALT

SEQ ID NO: 967205 - protein, 216 aa, Homo sapiens
MEQERTGFTCVGQRWSRSPDPCDSHPASRPPRVLGLQPCVLRPRPSRRPLMVGGRSQEMMQDVTQGRLSPESYGADSLALAVVLSLGLLTVPTDQSLILETFFRRSEKRKGHTLDVRRRPFVSSSFSLPTLNSFESRPASWVSMRTSVHYIPKQRELSVRRHCRARQTQSQVAIFQELPFVSDILCRWSFVPAFLWTVLPRTSARACGLAGSWVAC

SEQ ID NO: 967206 - protein, 130 aa, Homo sapiens
PAEEYETPESPGPQSKPSPASQGGEMYPGMPSRAGRSKTPGSRGVKLLRRAAELIPAMPDGTGVRNYGLKQRGPILGGRTRAALRPRQRGARQKEEARCAQAGTATQRRCESQRQDARCLKRQREGWLRR

SEQ ID NO: 967207 - protein, 184 aa, Homo sapiens
MASLALCECRRWRGIQHLGRPGPHVTPPLGPMPNSDIDLSNLERLEKYLELQTWYRRRSRACAGAVPQHWWLDLPESISGRRQDPKEKIDIGLLHPNVSLTQQLLERKQAIQELRANVDRGAGLTDSAQPVSRLDADAGTSGRGPGDTYTQDSGLALSITSDFITEEACIHWFATLLVPPRIPP

SEQ ID NO: 967208 - protein, 403 aa, Homo sapiens
MSFWQQRHIHGTQHFKKVQQLMEPHNTTTTSSHHVLAKKPNTKTLVSSSHHTVLHRHACNRHSPQHRLTRVNIHRKRTKQHANAPVNRQNTCAKHILALRLLPTRGHIIIIYEAMLKEEGTKNSGSIASNCNSARYRGEKKTKKCIWQGLAHGKQESVSSESTEKPTVTNAHTKHATKICGDGPCTGNGPPHTVTQHDTCKTMVHPTQQEQYGPPGTNPKEQRNHPQSPHDNDQHRQRTAQSTRDITRLRNTTEENIMTGKQQNNTKTYGGNIPAQAITHSGTQGKKPQKQNGFQGTTHHHQAITQPTGRNKREQPSNSGKQVKPYRHTGTTQQTKHEKHHERTTIDKQNPQTGKKRANENKTNNRRNGNNRATRTNRVTNRETTDNHTKSTENTKRQGKPRN

SEQ ID NO: 967209 - protein, 303 aa, Homo sapiens
MTARRHWLHRAIQTLHMTSCSPEDAPGVSDKHAHKTGVRPHPPWAGQQEVIAHHTCHPDFLSLLPTHPESSSRMNKRPQPPRTHDLRTPHHERMLLLHTKPTPLRPGGPASPRRATARAPPYCPKHLPDSQQRCTDTTPTITNEHPLTAPPPPSTHAANSTTGHPHSPPTTSTSNWHTSHPHTHHQAATPTTTPTAHTPPYPHTENIPPAQKTRTQPPPKPHTPPHNQKHTIDPTGTPPTHSAAKTRPNPPPHDQKQNEEEKPDTAHERQNTRQKQQKPTAGQHTTDDRETHNNAQTPDHTPQ

SEQ ID NO: 967210 - protein, 384 aa, Homo sapiens
LGPELDICAHTRCRDHNYESDTLLHSSQVLSGLLESPVTQDIICDVGMPVMHRTVRYNCTSDIPQQEDPAHSDPRWPWPTEGNYRELLLASPRWLEELAHHRGSTYCLGLIQDLTKQRNRYPSADAVLADMGHLHREVRSVRSSGTPTARTSTMAPGLALADHHQRLGQATHVLRTQPTTKRLDLVPTGHQQERRDTLWLATRNAVAHGRTACTTDGSCHDSAMNRNRLGSTDPRPLWHDRATPTHTAHTPPHTATTPPRAQIQTTSIIQTHDPTPDNTRHSPTPATHQHGSNRSVSPKEQKQEPRTRHQTDRHTRHQTGQCHHNPDTLKTDALPARHAHSLTDEDAPTTTTRTKHTNIAQHTHNHTRPQPATTPTRKNTPTAQ

SEQ ID NO: 967211 - protein, 123 aa, Homo sapiens
RPTQKTTAGSGAHRSRSRDGPGRGHPTRFVHSRRVVTRDWKLDKSHHGCHASDQCRWLSCHRTRRACGRRGMLGMHVMRSSNCTGRTRTDQSGRYGESTSAWCTRKRVAVSASGVNPNRRDAF

SEQ ID NO: 967212 - protein, 288 aa, Homo sapiens
MATLWTVHQREFLALYDRLYAAEQESLKRSKELNLVLDEIKRVVSERLALERETAIAPGAANRGPPIEAVERLTPARADTCPPSSISCHTWWPRRGSLQPAVRVGQGRTGSVVVMGIPSVRREVLSYLTDNLHSLILRAETRQGRWGRSSVIVVLIAETDSAVALRAVDREIKALFPTEINSGPGGHLTSPSCTLTFRIESRFGTHDESQGGETQEKNLDVLRPSMIVRSTCQRHYLTCSGGIAIRGKDEYESAHEELALGAPSKTGWNRQSPEGLREKQGWLTRTKS

SEQ ID NO: 967213 - protein, 202 aa, Homo sapiens
YQLEAELPEKYSQNIYIQNRNIQTDNNKKYWMFGQSKQESKRAIPGRADAGGKEQPKGVEWLWHSIVIRMYLSLIAKSVRNYTQEASLGALQNLTAGSGPMPTSVAQTVVQKDKWPAGTRKMLHVGDPSVHKDSHLAAEESVPESFSARTDNWPQETLPGFRFPIHSLTESRVLTFSLKLQPLPVTPLHNIIHNSYQNARDF

SEQ ID NO: 967214 - protein, 321 aa, Homo sapiens
MSYDIYVYMIDNLSTRYCTPLTKVDKSATLLAMTTVSANHYLLLQYCCLILPHAIIPSTTNRTASSYQPLRHKQTPHSPTHRPEPPQNNNHLTDGRHHNDTTAHHHSIHNRTNRSDSPQQRQDTTTHTTPTEYPSPPTPIPPPHPSSTVLHPPPPDSAHYPPPNTPSFPPTSAPAAPPPPAHPTSPPPRRRPVNDTTPRAGTSITRTHPPATVTPHARDRTYANLLITCYCPDHQTQTLAAHTRAAPKNRTQHARTSNPATRSATNHLGAADTQPKATHGHRITIMNHTIADIKQTNMQPHKHTTRRPSTTYRREPHTETR

SEQ ID NO: 967215 - protein, 117 aa, Homo sapiens
EPYLKSGVVRTLLLLVRDVLHVVPYKVYSIYSTLAVKLIRLHVLTRAIWCSGVAIARLDHTHGVDMELHPRHGECLSVYWWIVVGASLVTVSSETTIYDIFDAFYDIDFLKICSSSD

SEQ ID NO: 967216 - protein, 96 aa, Homo sapiens
RRTAVLFRRQYLLVLWRRMCGFISCYPCTSKKQVSNVYYLRNRHSEDIDMPSGLKTWNQWIERRSSDDSVELETLEWVYCIVDRGMDRVLRRYATS

SEQ ID NO: 967217 - protein, 232 aa, Homo sapiens
MHNFGHAEFDCHFLDEGFTAKDILDQKIILQSLLLMITDAFYVADPGRPFYHDPPLRWLKALPRVTPFYAVTCTYTHTPREDPCCYRDQALTVLARLNIQLVPGVWGVPSQQAGIHLTAHIPCYASVFLKIKYLLVTSMQFHACVTLLDSDRCVDDSWPEPHPTAQLGVADCHLMLPGQPRLTCIVGPSDPRLLGRATQQYVLRADSSSASLRLCALRVSRARPIRRARMSP

SEQ ID NO: 967218 - protein, 228 aa, Homo sapiens
MPANPSYSRQAAAGYTHLHLRRAAVHRANTRPTALHPAPPHPHPASPKPPTPPTHPPTTPPHTLLLTAPTSALPLSTLITPPPLSQPPHPTHTPQPPTLPSPPASLPLSPPLPPLSSLLPPSRPPRPPPPAPPPHPPPPPLSLPHHILSPPTPTPTPTPTPPHSPSHPPPPPLTTNTPHSPTTPLHHPLLDTTPNTTHQIYTHTPQNPPTSQPIHPPPPPPISHPHKP

SEQ ID NO: 967219 - protein, 471 aa, Homo sapiens
IEEVKSTTKTQRIASHRPRAKGWGWTRAAWPTQAASGHCGARRHARDGTVSVNSELNSKAKKHGWKSCLSKRRDLLATRPSTATGIWLICYRRHRDSNRYPLLAQSEERVTRTPQADDSTNDHESADWTTTIRQRTNSGTKRHINKDDPQGHALTCTGRQISTARIKFTLSSNTKHIPHWRTGLLRQNTRNEDPLLPTLSAHHKTPRPNAGDKPTKTTSAHNHGNRPGRHPTGHTAISARTTRNAAGLRNTSHGEDREPATKTPAPKQGHKTIAWEAAPVQETGKATPSGTNRDGATVTPDTRDHHTSAQIYATPTAHQAAMNTGKDSYGIATPQLATNQQGRKMICKKDTHTRQHKAQRVHNPKREHECTPISTSMTTLEGNMDRPLQRWRTAGHHRRGEQEHKTAQTPEESSQMSTEVCTSIQSRKARTKTQHQRITRPPNGHAEANTRTAGTNHQLIGVGRERHRITM

SEQ ID NO: 967220 - protein, 350 aa, Homo sapiens
RTHLEEKPHVCQFCMPVASEMKGSLDADTVQTTTHVRRMPFKCYKCGLWLRRARHAEPGTCCTKGRLPACESAQAVARCLRTAPRQSSTSSREDPATTVLVEFSSVVADTQEYIIEATAETIAADQMRPTEIIAGHPDRGGTSHIMKCGDSRSVHQAETPAHQYHRCTNVTMDRGDGARSPQMAGMPDRHPSPIRPTPRQPDKSSVATLDAWPRPSAQGTCCLAAQGRYKVPNEAGPTVTMMSIQSALEHPAACQRHWHIDVPAGPTIDCCITVICIDIKATRENLGQGKDKSTIGASRRRPELLPRLRPGDTRNIQRGICRARSKETVTTDIIAALNRSNYNKAINNTR

SEQ ID NO: 967221 - protein, 344 aa, Homo sapiens
MDEIMLSVVNAYLANPSPERPCSSSSPPCQDLPDDSPRQPAPGTGRAPGHSLAAWEQLHGLSLPRWSRLPLLTCTPGPRTAHDDLTGTHGPIMALPRTTAHPTPNGLPTGVLATLHYVRLFTLISLQHTSHPTTSHSPHSPPHTPHTTPPPLPPSSTFPPPNAIPTLISVAPERHISNNMSPPYTRSLNHTTRPGPHTTLPPHHPHTTTHTPPNTIPPPYSPTHHPTPPQRTPLPNLTPPPTHLHTTLRPPPPPSTHTATSPPPSSPGVTHPPPANLHQNHHLHQPPTQSRPSNHSNTHHSPPPSHPPPTPPPPPLPTPPTPPPIHHTTPPPTNPPQTPPPHPP

SEQ ID NO: 967222 - protein, 152 aa, Homo sapiens
MAYRGPASGISEEDMMVTVFILYTLQTVVIHSLSLSAPRDYSGYQRDETISRKFQARLWAKWSHGEPHEVVEEPPRANQRDAANESLRQVTQSEFIKDDCLSRHVTQWPVYRNYVTQKEFIHHIVFSLFRANLYGKGDCFRPSNALDYNRHY

SEQ ID NO: 967223 - protein, 84 aa, Homo sapiens
GGGTTASADPLRGSLPRSLGRVRGKRYTERSWYALCLRHYPAGRSVSGGNEEPGGDITAFPDREEQYGTCVLYRVTEDNQSELS

SEQ ID NO: 967224 - protein, 323 aa, Homo sapiens
MPGAVKRTISRYNHSHIDTRQRWIAHEPNGVNQNHEQEWAYKTHIRKRQSRSATATTQTQEHTGTDTMTPTQHSERAHEGLTCIKHDRPPSNSRRRYKSQAQHKWTNRQHKREPVTHCGPHSATHASSNMTTPMEPPHTHDEPLNKTKYNIHQHTTHEKYRTEAPQTSVDDEVDEISDQKNDNNNRTTDDRKVNDTEHNIIQKQYNEHIRTQPTIPQQRSRLPQRNRIDVDIRNSTELNTNWHKAVTYGRANRTHNENSELPTAPRNGRSQRSRTKRELLQLTHHVSAHNVTDYDTRTEGSTAVNAQRTTQTAHTRAPQETQS

SEQ ID NO: 967225 - protein, 306 aa, Homo sapiens
SLIDLPTPSNISAMMKLRTHSLCACHDPPQITHRTYSLAHATTHTDAINQPLFHHIAPASTRSTYNLMDRHSLTTYHITDPSGHAIQVVSIYSWTIYTLTHIQEPARPYTLSTEHSNIYYLSYPAKTTCHTSTFRAPFNFPSTVAHHDQHAFTLPSNKLGPQCTTYTRTHINIEIPHISPTSTSWQRKTTPQNHFNFPDTYYHIENEGELTTQLTQVQFNHTILHANHNQPNEQNHHFNIFLHTHGVPTQKNIFPLARKTFTQATTPFNVDRTRTTSTTRVRQRHPPAFYNGAYYEFPHQHNALCG

SEQ ID NO: 967226 - protein, 147 aa, Homo sapiens
GYKAPSTYCTPYLYVKKRMSQVNHIWSKKKKKNKKTKKRGEAAPNKISPPRRVTRDQQLRTHDHIWATKGRPHTRTRRTHTHTTDTVDPQKPTTDRETEKTTAANTTSPTTRERRTPNTHNTANARENNTTLGDHQQTTTTTKRGEN

SEQ ID NO: 967227 - protein, 265 aa, Homo sapiens
MGVPEITLTNLRKTPQSTYRRAHIGGNLGHTWGPSARRKEVSLFVQRHRSHFEAHTSSLTGAVFISKRRFLICCWDNLRRAICHDHSEGKKKHQSAGANHSRRRTPQKFGPNRARHGAGYTQRIQTSTKKRRKRPTLRATARATISRTRGRSDKTNGRSSWRQTAPPLGGNDAQKKWGQEPTTNRRTSQPSRQRKITPNRYRKQPTMNNQQRAADTDHRQTINESTAWPRKTSSGPQNGRAVHRQHTTPGRAEASTPHATTHGTH

SEQ ID NO: 967228 - protein, 117 aa, Homo sapiens
MTRLMALNRLVHTRGTTLQRLWTTALNELSYRTHLHQFLTTCSNSQPAGYCASQAQAPLANLGIPTELTGKMDLGVSSPFNNLATLDNFWVRSPKGCYLDTSHRWSPPFQYRALVDD

SEQ ID NO: 967229 - protein, 248 aa, Homo sapiens
AKDKVVQESTAHEVYAKEALASSNTKQTNSAQQAQHNSTQSIQCKQHVVLWHFAQQLHKQQQQQISINQHSSQQFHSLMCTASFVIMAQHMSIPAGISHPCSVAAHIGIASSMHMHQATTSQHKHSCKHAHTSQQPCIDRSSMHSSIGLSTASSKHRVDGEHHIRANTAWPSTQQQNHAHIHAQKHATHGSHHQHPINSQQPQHVLYNSPKAFQHGMPSSCMGPGSALVRKSARDIMEASIAKKVVIY

SEQ ID NO: 967230 - protein, 154 aa, Homo sapiens
MYHNTCQFRPLQTYTGGPKAPPGPEDTHPARATHRTATHPTKKRKNQDPRQNRTREPYNPQSTTSTSEPAEMAQAGNQERPAASMQQGNRTEAEDEKRAERERQRKEQTTRQRQHYKRRQRRLTRATEKRPAQQHKTQRNEKRESKTRDRETRR

SEQ ID NO: 967231 - protein, 81 aa, Homo sapiens
MMTAARHLGPAGRSRHFNHERADNMIVLHVDRGPQIEFDAERNDPGLTDRHAPSPQLENGVDHTGMGRYGERLRHSPAQRT

SEQ ID NO: 967232 - protein, 396 aa, Homo sapiens
MAPSRKFFVGGNWKMNWAECRRLVVELIWHSELRPTVPGRHRRWFVLPLLPISTSPVQKLDPKIAVCCAELLQSDYMGLLLEEISPVHDQRLRSHVGGPGALQQSKAMSSGAVQMQLIGQQSGPCSGRGTRSNRLHLGAKLDERDGWHTLLKVVFEQTKVIADNVKELEHGSSWPMSLAWAIGYWHDCTQPKRAQDSTPKKHTRHGSQSQHVSDAGASEHPRNPIYCARSVDLGSHNLAGEMNCTGMIDGLGYPMVDMVSYTYSHRITSNTITAKQRATINDPVHYSGDEQRQNARPENPDISQHTTICYTKGDARQRPRERNTQTAEHKNGKTQPLNVGQHTGSRPHSQIGGQTAHGAHLSNEKAVTSTPDTPRDTTQPTQRRPTRDESDEIEQQ

SEQ ID NO: 967233 - protein, 353 aa, Homo sapiens
SYEMMMQCVSQHVCDHPTAMSIINAAAMVPVMCGMVQAKSQCVLLAAPIMGKHLQQQAQGCLGILLLDESLTSWDDVVYLVRCCNLLAHFINAYLVDDSFSQALCILELIPSSVDGACSEAMLTYPYPAELGDLHGCAPHLRAASWSSPLTPQCSNPGFTDWKYLSVQWPALPRLQPCLIQPGCPSGSCFALEYPDIISTNTVSTLATVVCKLNKLGATLPARIQTQQTHQLVLQARAGLTVPILAMVSCTGCEELTGGLRPHPTSAVANPRHTIRARSGQEDERLGKDPRQSIGKIRGEPGHRGTKEPKDRAPGGPQDGSRTSEHWGRNRTPGTPPRQPAAHSGEKVKHSND

SEQ ID NO: 967234 - protein, 207 aa, Homo sapiens
MLNISATKSSLPHKCASSNTSHPINYSFDPHNTWQPARYDLPVACLPFSPCACPPIHVPSSLSSAVASPAYRHALSASLGLSADTPRPLPFPAAAPSHYTSYPRYLAVGSRNAVTSRLEPELLCGSPISVRLPVPRHISSRPIVSESNFVEQHSMTTGTTLGVRVPNTRDFRLATYTATLVDATPCAEPHNAFQLLAKRNAHAPINA

SEQ ID NO: 967235 - protein, 420 aa, Homo sapiens
LDSQHSHLTLPYYKMSGLSHGCKFWPATDWAPVSRHGITSNITQQQAFTSFTFNPFHFHATHLACKQFKCKHIKPDKQSVSSMIFIVAAANSKCPNILCQSLLMHSTSFNPINVPCSSSHRHSCDHSLAFINQHPSVHHVHPQASQRLLHNMGSILHHATANAQCTHSPFQQHAQLDHVGLPFLATFGMFAFQPAATGHSIVPNQSIATPLAQETPAWHCLWLQYLGLQKNNEHWTLTEADSFFKVLRAEDEDTQPSAHGHTYEEAPDSERKISQMVVTPGPLNKTHITRNSGEWIKRTDTLTQTMPTTRSTPINARRTYRPYRAHGITLAKYRTPQTEQTTKDAATNRNKMRATHSNPQTERGREKPRTNQHNAKSKSASDTAQAASANTPQATTHDHTTHPRRPTCTAKPPELRGARE

SEQ ID NO: 967236 - protein, 375 aa, Homo sapiens
YYKWPARCRPLRPAMLVCRAAACSVAPSVIGRSADACRSYFKWSDVWLGREMGEDFPAGSESKHKVREFVVKIPCPQVVLGKDYLLDARMGDRDKRFAGQCLGMATGFVIASLFRLSRVRSLVFECQAHRSHACRWVALTVSPGVNIPSVGPVNHSVNLMRAGETYWHVHAWVVPFHIMLLAHTEQHRNQLLHGQGRASKITTNMRIVSWVPLDQSLLGPHCATQEEEGIHESTSCKAKTEMGGTRKSGSLGLPNNRGNRVLGFVTKRALSTGPFLAQTNFMVYPSTYGTFCLLVAHGTTTNPKFVSGSPPRHFWHPKTSVPRVCRHVHRGPFPFWRHPETQCWVGTFCPCVQYPNRNASQAAGITLDGSSKEGR

SEQ ID NO: 967237 - protein, 230 aa, Homo sapiens
MARKKVRPRLIAELARRVRALREQTEQAARSQIYAVDYETLTRPFSGRRYAGPGPGPNVRRESRLLQLARPPPVLRPWAACVTRKVLGWWQQRGAGATWGASRGLRPEYTGRRTVDHGKGLGQSDLHKGRLRARAREIEHVIGTHELDGWCPSTEEEAFHRVTTPGRRERTSCGLQKSRNTDFILRGPWIYSARTRREKNWEDNKGTHEAPWPECVRRSDYGMGTHGGLP

SEQ ID NO: 967238 - protein, 148 aa, Homo sapiens
RQTAGTSAALVRKGTARTKKTVVHRTAHSSMHTKTFSFSINSTALSCWSQQSSSRSLHSRLTSCYTNTQGTPVIHLYKQHPTTLHRPIIMRQTDTHLTAQYNIESHLGYEDHKARRDHEHLTVNHNGEYICTTHTKDLLSVAAKLRLT

SEQ ID NO: 967239 - protein, 78 aa, Homo sapiens
MHYLSTLQHQAHAAPPPRGTRHRSTTDRPEHATAAPDNSDTSIQHLHMTPNPGEPNHQPQQGHTLEPHNPARRTHQRT

SEQ ID NO: 967240 - protein, 291 aa, Homo sapiens
AFLTQVDHLSTPLDDRTDQLALPSKKLRRSSGSGVWLKDGGPHYPDIGTEDETSGSRTVRATTSATTGLAYSTHGDVLAVCQGAMTQDDTVEDGREWQRLPGMQYCSHARRWGGPRVSYTWRGSSTRTRPTEAYSLQVCCGRLRDTAPTLVYMATRAGDVDAFLEPLTGHSDESQVVEIYYQVATRSGLGSKGQLNGPHCERAPVAYGEPLSNDLILSPPGEAEGSMTAGAHALDNWRAHKADNGRLGTWHFNGGAPPSRGTGDRRANHTTAHVGRTPDYFNEKHDPRGHQ

SEQ ID NO: 967241 - protein, 254 aa, Homo sapiens
MLLCYVQSFSLCLLRLAGPHLHPCLRAPARYISKPEMPAIYCEPRLCLLLPCLPPCSFYVLSCTFRCHDPLSYWLGCCVAQLSTTWLCVRLPSLLGIWPVSSPVLCGLPVSPTADAPLPSVGMAMYWLPVPWLQRFSLWPQYSVILSLARRPLRLPAPFPPALDPRPRHHPAPIVLARLPGSSRHRHAQSISPSLPAHGLLAADITLLLGASGSHVPLDSALIYGDSSLPLRVAPCCHSATFPWRTALPSLLLL

SEQ ID NO: 967242 - protein, 97 aa, Homo sapiens
TTKYNPVGASELRDLYLKTDNYTREESTYSYGWSRRYARELGGEHVPVLRATATPSTAAVPEEWPKLAYWFIPAHKVYFSPNIAAVHTIPSVTPGYI

SEQ ID NO: 967243 - protein, 66 aa, Homo sapiens
MPEQGTTNDQSTQNNTADTQTKSHAKQPTRTLTPTANTHDLTTHAHQHRNYMTAPPSHSQLYAKAP

SEQ ID NO: 967244 - protein, 179 aa, Homo sapiens
QACYHVNSVQRIVIFLFLCGGSVCVIDVYFLIPFPQALSIMRLCPPVSRSRKLVATRHRWGTWAQRRTSLPFAVFCLIVQLRNIILFFTMRKCVALYRRLIQVTCNSLQRAVSILSPSHKRSGGVEKTREGTLASALPLDSPCLPDNRAQVVNPRIVLQLRGPRLPLPQEPQTPEVVCN

SEQ ID NO: 967245 - protein, 239 aa, Homo sapiens
SAEVLGGVMACALCGRLGPWCKPWDDRCLLENVQPCCELEVTEDSSRSEDLYDYERVPWYDLVHENTYLHDNDDYWYLNVTHWLNSLTHTGTVPHLLCDHHADDERPDYIAKVLLNYMRREGYRRYVGTGTDGFLSWTDETYESRNESIYGHLNPGGPGLPSRTNWLVHVTAFQLEPRGCLGLVRYVGTLRELRGNIHTLPHQVDLSEHNARTQKSVSVGIAHWHQRGTYTSLPRQILF

SEQ ID NO: 967246 - protein, 351 aa, Homo sapiens
QDVVKRLPLKAKMGTGKDSYQHCRHWTLEIRAKSTDYWPSDHINAVASHHKEPLATQFEQGRLHENGQRGSFKAMPVVIAHHNCTQLQRATWYHHLILSLLEHLRPASYYDDLVIDDPRTTDDFYQKPGLTRGTYLPGLDLPAATMNFDIASASEMIRVDTSGHAWAYYFHTTLEVSTITPDVSPIGPPFSLGPLSTTTHGAALDCTNNHNHINAIAPELGYINEINTGEHLPNIEEHQTPNLTKPPTAKRKDTSTYHRGQQQLGITHERTQAHTGPHMSNPPFDTGTQQPLADPITKHPTHGNDTTAKRPQMRSVRTQHITHPWRHHTANPASLETKQPNSAIENEPQNA

SEQ ID NO: 967247 - protein, 82 aa, Homo sapiens
MMTMVVCCTAHQGRNCGEHRTERSDWFLRLLLPQECRPSRDSISSRVLTHPSPALLCCSLLYFPPPLVSCTMRAPSGPRLPV

SEQ ID NO: 967248 - protein, 373 aa, Homo sapiens
AVCSGGCPGCPGGPGMGNRGGFRWRFRHVASWWPVGLLACGRGRGRGRGRLAERKADGTTGAGMPCHHSWAALRQGTGTLNVPLRRDALLLLFSSLAPTHSDTHARHSTRTLPSPGGGHHRQRTDGFLNRISGQGVRKAGPRCPRPTSASLTRFSPAATSPLRPSYRARILPPCAPPLRASLPAASPRCPPTTARAWPPSRPHSPPARGPTPTSPVPPHASPPPLALPPLLSPVSSPARYSFARAHPHTALPPPPVSLHSPLLLPLLLTRARTPAAPACGARPPSPVLFPPPSRSPLALPPPPAPRPPFRLLPCPPGLLPLAPRPCPPPALPLPRLLPPSTCALPLFPPPRPPSTPAPPPMSPSPSPPPPLPP

SEQ ID NO: 967249 - protein, 506 aa, Homo sapiens
MGRPTRPPTRTAETQHGRRHARRSRRHCSATFMQLDSARAREPASSYSMTHRGNKHDLPVTDAQITMQVPANILSGYQHATWISTAQRTYLRAARPRPRMADRAHTRVRTDRLSAPLSTASDRTTCGTQGWHTSLGPTRTLIRSPESHPLQTHQNSVRGRTSPSTPGRIHDTHALAHPSPSRTPTGEPRTPGATMTAHSRRRPQYRDHWAAPPSPGRTTLSPSPDPDSPHTRTTPHIRLAHHCALAHTDTRNSRSRRTYTTVMRPHAPDHRNALIPLLTTAHTPIYSPTPPLRATPHNSHPLLLHTHNCAQSIHPPHQHTPPLPPLPTPQHTTQPPTPSLHPHTTPQNPTLYHHRPQAAGRGTTDATHTRPSSRRRVSRAGAGASSPVGPPPPPRARARPPTPTPTYDTTTYSIEPQNPISLATSHTYCHQQQHYSIKATLSQTITHNLSTTHTNHHRQYTTQTNYSRYIQHTNYITTLTQPDTSTHTKSYHPTHQDKYNNTQSTS

SEQ ID NO: 967250 - protein, 102 aa, Homo sapiens
MPPPLDLRHAAVTRIADDDTPTPVNHNTTNNLTPNPTQSPIKPLPSNIKLPSLFTTPLITQPYHLTPISPKHNTYLPITIHPHPYASHSPPPTPTIYPPLNP

SEQ ID NO: 967251 - protein, 76 aa, Homo sapiens
SRFKKLADMYWRLCDGLTGDSREAVPQTHAAGDMQKSRCWWFFTLLFPLQHDVSGDTPRDWLLMQYSIRFILSPLY

SEQ ID NO: 967252 - protein, 354 aa, Homo sapiens
AATITAPGIGGTRAGCAGGILCGRLPSQYPSSPRSSTSEVLAAPRKEARKDAELCDERDVDATKLTLKHLFHRTKMKHTGGAQHNGWAQFIRQHIEHPRSCASLRLGILARVRKSSPFLGGQASIAPGPTTCSVLQCRVNLCALPVTTPSQDTHMRFAALGTHIICDKSSDDIDRGNSKATLNANDIVVLLFTFPLPHMAHESLVTNSVLRLSLQAWTIALHSYNQQAHEKPALKSPLARFPGLTVHDGIQPAVHLPSAPMHTPSSHGHTLNCHMPHSPKNSEANHRGGNIKTIVTGTIPLTCNTSGASASTNVTRAPNNFGRCLRNSPRLTISWLATLPHHTANVQRDEHPNA

SEQ ID NO: 967253 - protein, 362 aa, Homo sapiens
MAILATCRPAGRRQNCQPRSWLSFCGGLSEERQAALQPAFRLADFPARTSWPQRGPLLRVSTPLAFCTRTRSRQKATRSLTDTTGHSSRRPPYRAARYSAHSQNLALTPRALHSACAGQPTRQHRHTTPPGAQPLLQPASSAQRTPTLAHWPHTPHARQLHHTHVRKLPHHAQTRISCSALLGRSGSPANTARGAPRSTNEGDLHATGRPRHRAAAPPRNTLRRTTPWTRHATGHQPTGTRAHPRLPPTRHSATHIPTPRLYRQLTTCHQAQSPAWPTPGKALNRQGEATTHPSSPTNARSTPPSQQPGTLRIPQTDAAEQPPRPHHPTVATRRHPQTRALHHHHRAQASAHTHRTSRSTTA

SEQ ID NO: 967254 - protein, 428 aa, Homo sapiens
PRSQTEQTQPLSLSLKPEPLGATMSDDAIRHRDLHASLRTSTRAHAHLSPTWDHGTCTPKHGILQPCRHPPHQWHSRRHSSLHSHRLPGRDHRHQTAVASIAKSLEYIYASVQPPTALGSLGKRYPTIAFNFMTPHTAHNLANGYMEEDKSSISNEDEAVVGVKIKVDVVYYGGYDGGRNSVGSRKTVKLTKCNIRFKTVLVGLRRKGRRQSDVLTAKESGEHRRRLVYERLYGEAGYYTPSINLVIAIKLVKCKVTGTRRKVIREGLLKYKKDAAPQRPHGHNDRTQPPPPHNGAVGELTTDERKSTLRSASRNPSPPSSLKGNHTGQRARRKRAAPARHNDNTTAGRNTTQEAKTRNTTDHRNTRGNSAQTQDPEQHMRKTGQNDHAQTAQRKKNGEKLDSKHPEETRSERTQRPSTQRTPVDTAD

SEQ ID NO: 967255 - protein, 342 aa, Homo sapiens
SPTRPVQVGLLELVCAEGTALGLGERVPECENRFPGPALPVPPGRHSWSPTQPWLKNNRGRMSRRLGTCWGQHGRTDTSPRDMSKGYCGSRESPYASKHRQTTKRRTADRQQSRAPEREQLPITCQHGTRRCTHDNNKIAGHCHEQARQPQCTDPKQYPQAWQNHDTTRSSKHQSGTGQIIAHKIRSTYTSQRLRTQANQWNSRKERDTNEKTVTGYRPNNRHNRPTQTEGVTQDARRRRGHSRNEQEGTEVPGLKNRGQAHTTAREADRMRDTEQHGGGDGHNTRTPRKPEGGRQKKRRTAQGPNERHTWTDRTHAARRAQQNDATATDHNKARAAHRRQT

SEQ ID NO: 967256 - protein, 33 aa, Homo sapiens
FSLPGQHELHHIDSTFIHATYRIPWDSDPGAQH

SEQ ID NO: 967257 - protein, 487 aa, Homo sapiens
DVKRDLALPSPGPHLTLTHSNLHAHSCFAHLVWQLACKFTSAAQATSIKSTAHQGQCHTGQPGSLVMLFLSPQHSHSTHAPISIMHLPGALAQRIRYRRALPGSSKATGIKGFQMDKHRAQLPLHGHTQIPADMCISSDQHSSTSSKHHRSLYKQGSAQPKSSRGTSHHKRFSAHKAIRTYVERGVASMTTISRKKKITSSRNLFIAREKKEDTGDYDQFWIKPSGIYGKNITVRGTQVLAINYRGNTAGSLTKELMHISKGPSTNYKDRNRADHTQALVNPGVAHAYLPRTPGPTHHPGPPFDYTSNPFGKHQIAPGSRKYNRLELGHRGDYEHLDNVPYPITYNGGDISIPEINEDKKIADHYNKDTARENQEATTRKTKGRNNKRTQGQRTQWEGTYNNDDTQHDQPPKGKDDQTNNDINDRAAATHHNRKQKTTMTPDETTHNDEDQAATPTHQATKQENHKTTNDTGSERTMESVAQTRERA

SEQ ID NO: 967258 - protein, 295 aa, Homo sapiens
MEPTRHTIIANYGPRVNLTKTMAQNGEHQSMASNPMYQQIFTTKQVQRHTHTQHKCCWDHNSGARFHPRAHTPLGHDKRVNRPLDEYEHTARDKAPAGHPRNTHITTQQLPLLHAMRTKDHKDTQRIVTTSRYTHFRPKDTQRGTTEHGQGDDRVNPPYNAAHIKTQIGTALGNRYIYKKHKKRERPNDVDTRVRDKLAPNCALTLLEGRNHHSSNSRRTTIEQENNEPHTQQCERTEHEYTTRRKTTVTDQKCNEVTSKQQKEETHTTERPTPRTQTVTKRKKAKPRRHHNRRT

SEQ ID NO: 967259 - protein, 248 aa, Homo sapiens
RCAGPARVGGRPRGPCRAGGAAGRVGIHSGRDRRLVHKRAVELCSLLAGCLSCVGPRAMVHEPRGPRSGEDPEQRAPPSMSSGSKGPREVTTSTPLGAATSYAAYQLNLQLRDHPRQGLSMSTLSDLKGVTWEHSIPDFAVAASFGTCCHLSRAQKRHLALQPGWAMQNGISRGAFSLHLARGSDLGTPLTGYKALDHCTVWEPSSHSVTIGSWLTLEALPEKENQRWALKSHVLPESKFPRTRIPLH

SEQ ID NO: 967260 - protein, 241 aa, Homo sapiens
MSSVEEAPSRAHLGTRRSNGRRGQHISKARALRASTINKTVIFRTLAPQSNAERKKSRERSSSLLGLADNVKLGLTKNVGNMTLVRDLKTSEGRVIPRCLASAHVVRDSTTVEGLGPERGYSRSMEQMGALLHLQGVNVRESDALASMGAVQKKIGLANCTFFGATRRESIHSGGSEENCCTWRMGTGQTFVVTIGNKGVYPHWADRRSTAKGPGCVGIASLQKKAFQLGQQNVKPDSYLV

SEQ ID NO: 967261 - protein, 164 aa, Homo sapiens
MGTMVQRSHINIVVIGHVALRARSTTYLLLILIYIHAVAIDEKNRIDNNLSKAGCMRLGKGLPSNVVPGLLRLKLYSLSRGTVDIIHCEYSSLANLCSNQINVIYCTTQLTGPTDIKTTFNQQSNDFRGSTRHGLIVLLVREVACCVIGEFDTLVVVQEVGSTR

SEQ ID NO: 967262 - protein, 188 aa, Homo sapiens
RPSPHLKLPPPNTAAAGPSSPTVSPRPLSITGRPQAGLSHPSNPGPPGTWRLAVFSGQRPPIFPNSCSTSDFINPYCEERTLHPSSPPDPGLGWTERVAIQIPQKKPSPPLAAGGGDLDKLETKTGGPRGEQWTHTWAYHDSAPNHAFKRRKQGKNQSRPHPNTTHSRGEHHRRGPKDKAEPTNRPTT

SEQ ID NO: 967263 - protein, 400 aa, Homo sapiens
RGLSARRERHAMTVARCAFSSCCHAACRCLHRTSVVPIGVPAPVVGRKFRVFTRIVSPQAPVAARWGQGTLHPVPLSETRTRNARSQEESEEEEDEDDEEEEERGQKQKSLNPWQGTAGQQPTPSQSTLRTIASLFLTEQSHLQLHKDRGRNFVTIEQDTFVFQVRQKTDATLEIYSKLLYNRPGTVSSLTDRLWVSSVAFHLKPGKCSNIHNSTDTTMFAPTLENAMFKEPLVKVLRFGHITVYNSDLVHSSTLNLHKLGIPKAILCANTIRRTILHKPSLRHNGTDNTDNVNTASRAWGNDQEGYTAKPRRLLWTKHRPAINTMTSEQKPSTFTPTQGDEFHHTNATINNTEGDPPNNQNRPAEHTTNHEQHTNSREDSSKRQRTTHTHKTHTKIRRK

SEQ ID NO: 967264 - protein, 284 aa, Homo sapiens
AKKSRFFFLKSGEERGGKGAPVFEEGALKQRVEEFIAKSPVGFGGIARGASDDGASPRQSGLAFSDGRCGLVVRPEPWLPSRLPALRLSGPRSVADLAVPIVARLKRSLKKHPVGGALHACIVLVVSGLVFTLGVYGFISRGGEEVALLPLALDWSSRAHAGPSFGGALALPEVFLPHTEASHLCYIPREAPPERDPRMVCPLGDKAPHSGVVGPKALGGQHTSRVRGPKGRPSYVGPSKVTKGPHRNVAGREHPTLDDVLQKLAQLHNGFCSSPTKLAHIMCR

SEQ ID NO: 967265 - protein, 275 aa, Homo sapiens
MGPASERALCVCVCVCVCVCVCVSPSDALLCVCVCVCVSPSARAAVCVCVCAERAETTRSEEAETQGYNTTHPQHVTSCHHPPLPTSTRPTQPHHITTRPSFATKTHTTQHRNTHPSVPTTNTCVVRSTPSPCFTLPRRTPTPTHLQRTLLGHMHHTRRTGQSTYAFLTYPSPRQTMHSNTPLPLSPLTARQPGSPAHNIADPTQHTHTNIPPLTERRQPIPPLPNLTTPPTTREQPKQNTDMAKRTNTTPAKHNHRKPDTTNRERTEASTKPHK

SEQ ID NO: 967266 - protein, 232 aa, Homo sapiens
MYEAKAPGVTVAIATEVKTIKAMWLSSGLSCLVSEKAEPTVGAGCKGPGRGLAGKVVEMALIAGPRAGPHLCPSIFPGSSLILSLDLTMQREEVESVAGKLELFPGPSCLRWGHLCRGRVPMFMEIRGVLTVWLEGARGGEQESIPGVPALAGRKGGLKRPSVDGGGPDMDWSGGTGGRAKGTKVSDSVRVMVARDRAGGREITRSGEGNERQVSKGRGQTPGGHQKGGEHG

SEQ ID NO: 967267 - protein, 497 aa, Homo sapiens
ALFSLYYAGANTLNDRPWASDTWGKNRAGGARAPNTEQGTPTPSAYDRHSVLQRHHETREAQFLSTSTIDTLYFFLQCGYFLLWCGVVVVISSQHKTNTNTKDKSGTHTQRSHNRPERHHTHTLYTRAETRAGGEMWPTERSEIPPKEGRTRQPRDARHTSGGNAGGSTEEREKHSGGPPLCEDPPEENICGESEEQTHRETRRVQVHTHTRAGEEVRDHRTQAPSVSNITTTGVEKEERTPPQVEWQTSEWRQDEEHQTERRSHLEKQDRRPTRKNNYIERRETTNSTPRGEATHTQTQQNRESTQRGNITPQRDADPPLMCTRGGKTKPTQITPTGEQRNSTQDEHTTNTTNNKTNDTEVATQHNHPKDGTTKQRRRTQTQTMKTQGGKTTHRQDTRHNDSSNATWSEPNTYQTRKDERINSPPQSNRPRQEETEQQDQKKDYTSIEGQLTNYDVAMTDNPQQHYNGGTTHNPHVIINDTNRQRSLTKKDINAAR

SEQ ID NO: 967268 - protein, 256 aa, Homo sapiens
ASDPRVGEKLRELCGTPGYLAPEILKCSMDETHPGYGKEVDLWACGVILFTLLAGSPPFWHRRQILMLRMIMEGQYQFSSPEWDDRSSTVKDLVSGGRRGTVGEGQETWPSIVSRVSLSDISRGGAGGTPEATPEQMSRPYSTPSLSVVKAANPGTSPPQGFRVAVWTVLGAGRVALSTHRVTALTKNAAVEGPLCAAGQSGTSSTTVAFRALRALGKRRGAAERGLSPSTAPGLSIMGLKRGRPVYNEVKRLSGK

SEQ ID NO: 967269 - protein, 265 aa, Homo sapiens
MCLNTTEANLATLLNERILNNSYYGLTTLLSELLYKIGLLGAESYVLLTIVTILLPLGKILYIFLNAFKLYQQNHTCMYTRLSYTLSNSPSTHSKSLLPLCTCYNVNEFRLLVDTILTLMSIRYLPINDATMLKVPGSPTGSIQAPPGDHARTQNTDQLANTKQKDNTHTNGEAPKQNMPPRESTQLNEDAEARKKQSTPQETPNKKQTREGRLTRRGRKTGNREKRAHQTTAAQMENPTKTSQPHKQTLRTNQTHEKKHRNESQ

SEQ ID NO: 967270 - protein, 405 aa, Homo sapiens
GCGVCGAGGCRSSSSRNMRRVLMMPRVRRQTTAPPHPRTARAGPRHQPGPPSSRGDQKPRWPHRCDILWTRPQSLPAGEGGRLAERTPAVFPTIIVDVVPRVVRELCSGLERPLRRSTLTGEGTGQQHKTTEAAGARQKGPERTVRHVQGRVLPEDAGPDAPGLEEHWALAGTALGGVAPSGPGGIGATCGKTRVLVSTGLCRDTLPERPSRIFTDSIIREIPEQEASDDVFNLAPPLASGTADRQPCRKEQQNLAEEMPRKQCEMRWRKAGELTSHMNADRPGQHREKRQKKARDQDNGPKKPAGLNVGARPCDREEGKKRIDLMRIRVTRYERYQYRAHQKIEHEVETVIIYHNKMCRCHRVERTPRKKITGEMNEEREVKMNVLADLSENRNLEILIAYEID

SEQ ID NO: 967271 - protein, 486 aa, Homo sapiens
QSRLGCCAQSQPGCLEPGCPELACSMPHACAVMPAAHVPVWPVLCVITVNMLVAVCCAGCLPWDVLWPSLDFSVCRPHVIGRSLDVHQDLRCPWVWHTVPELDLTTSHAWLCTLRGYLAWHTNPPVPLANIGGYVYQVCPDGNETSANNPSLVRPRHADSWLFQDWWWQPDTKARTGSGAPGYLSDVGIVQDTCVDQFFSTSAGPYHQNTVAVVLPVDIATETKTPLGEFPVKSIVRFKTVYHSQQETVRGMTCAEPTGLYRRGQNRKLQRTISDKHRQRFMSVTQVESRYFGAYLLKKERTLWDKFGHALPRLSLQEPWIVGHKAVVGIHIEDWEMDWEDVGHREDIRGTGHSLTQEDPRSRGTNQPTGPNGTKGTTTGCNVEHAMEPHGDNTLLCSIQLREPTKVATAPEDRYQRYEYRTNPDERKRDTEGHRKDEEHQGAEQTGRNMKAKQQEKNKEKARKKEQRTKHNEPISRQTKNERRQR

SEQ ID NO: 967272 - protein, 187 aa, Homo sapiens
MQSRLEKSTLAKEFWPLRGGFLMVAAPDFLQPMRSQTPELCDQQSAHKWGGLVGGEGRLLLVGDTRGVPAGAGLSQEDISNESRSTKLAAFQDLSGRSYPKTLPFFLIIWESPFTNLPYPERGGGTTPSLAGPDARAWDAMERKDKTGQGPFQKDDRDGPSWQWKRQDRHTRHTGQHPNEQTPNTNP

SEQ ID NO: 967273 - protein, 356 aa, Homo sapiens
PEAWPRCDPCRRYTARRCLPMQLAAQARPYSVSVGTGHHRRRLRSIGHWLARSALVSQPCSCSVARRPARTRVPGSRNMPWRRGPPERDSAEAERGRPDPGASRPLDSTPRWLATVGPHPTCHRQRRRHPPRPAFRAGKCRSQPAIRVPAQTRPRLFRRGQLHKGPRPPGGSEGSTEQGMAAPLDPPGTGAGLRSNRQAQAHPPQPPPGKDAPTQAACLDRRVDATATPGTIHWTTNSRAPAKGSSLTRTLRPPGTHERPRLGRPATALSPKPDRRPPNPAGSDHKDRHHPTGNPCPSRCFRRPLSTIPQAEITRRLFSLTTDRCFYSQPPPYLNGHHLHGLIDSLSQPMGHFLTR

SEQ ID NO: 967274 - protein, 113 aa, Homo sapiens
MRIPGFVQCQAPSIGGSYPMTHLRHPVTCLKCVQTHAVWIRLAYQLLPLDPPPLCCHSATLHCLIFVDKHSVMVPSLFEQAIMGEAISEDMTIARRPPPTVKEKLNGLRYPHV

SEQ ID NO: 967275 - protein, 118 aa, Homo sapiens
MAVKCCLHPSPKYKSGSSKTTAENEDSQATGGTALKPASAYPAAGPGATKDERGRRLHEISIATRGRQNARTPPLGPKRVGYNTPRHESRSHSTPWPEPRQHLPTTVVARSKQTQHLN

SEQ ID NO: 967276 - protein, 329 aa, Homo sapiens
MQEVTIRTRVRKVISDGDFCIVPTEIKKSGAWVELLLGVIMRRYHRLQCGPRSRINEGEGKKSNYCWNPLPHVSHLLLNYWYKREDSWQKRLHKETAQAQEANRANAYTNMHMTATYRNSPTMGGPAIMNNGLHRRFIDSTSPRMLKNAMREGTEQRIHLATKPAPYCKLATITNRPTCRPHPSEPKPARSTTHNNGHTSRKNTASQAQVKHYKPKTAHKPTSKRRQQRKPTEPTETKSKPRPGPPKPAQSPATTTRHTPQRRDAARGDPQHDRAKTGPARQQRSDARGRREIQAARHSGRRDRHTARRAPERRANCETRKLEMETKPH

SEQ ID NO: 967277 - protein, 82 aa, Homo sapiens
APTHILPPPEGTASKRRETEQVGGSEVPQRKRAEGGGLEGECQGLEARNRELKDRAESVEREIQYLKGPAHRGLQGPEPEDP

SEQ ID NO: 967278 - protein, 207 aa, Homo sapiens
MVTVYPGDSIGLAHTPHCTGHSKDSTHNRTLNVIVDFTSTGGDTTWGSTQTTGKNTHSFHRRRDEDNIIHVELDDTPQIWRKTIEQHTRIEDVANGIPFDKVGNHTRWETITQTSTNRGGRTHVNRGRGPMGPTYIISPFINGHEDIENFFTRGLNITTHKNNQKPSGGNDGRANIVETTQDTPTTGKAIDASPHFGQHVPWRQVTP

SEQ ID NO: 967279 - protein, 323 aa, Homo sapiens
FSLPGQHELHHSLPPFSTNYRSTWALSRLPSIQEPGPVSSAAQRSYAGAWVALDYPDLTMIHDPHPASRAPAIEGPGGAKAHQGISQRCVLGQGTLGRPSPSTRSTRQHPNDRHQPPGTTGNPHLVHLPLHRWRHPAARKCKPLAQQPCQQTLAGHGQPAHPIPGPRTNMGQHHTTGNPQGTQPPSGKPHIHLTHASHPPDHHARVPIQKQCCQAQHNLSKDQNSPPAIPVALGQPSSTTEGPRYPSGSGSNSHYSASSKSSPDSHPTGPGPTRRNKTNRLGQTHGHESHMRGPPRAHTDARLAQNTTPPHKVPDTGPQATDT

SEQ ID NO: 967280 - protein, 77 aa, Homo sapiens
EFRMCGLLFDYPVVLAVQPYFLQKDQINCCSDIWVEATIGMEQTASKHFETHWISLNAGLTRQTQTNCNFIQNTNAH

SEQ ID NO: 967281 - protein, 90 aa, Homo sapiens
PAAQPGSDWCSLQCLLHGPALPACVPGLVSPWESRACASGIGTWGAGANISGSSQGPSVQSHSADGVVPGGQTSHSGQWNAGMERSFHSI

SEQ ID NO: 967282 - protein, 160 aa, Homo sapiens
EVALAGPALELHNCMAKLLAHPLQRPCQSHASYSLLEEEDEAIEVEATVCTIPVHLHLSWLARDGPWALKAWVLQTGRLLCGPPGVRGVPARQLLRVPCQGSLGGKPTDFQEGIPGTVRHPFFCALPAHFHSYVRHGYISVLPCCDLFAINNYTNFRDSY

SEQ ID NO: 967283 - protein, 220 aa, Homo sapiens
RGLPTRSDAGGPGQCAMCLRVATMATELMLATKLDAGGLQMDGLRAGGWDPGAARAERWQLAAVWLGAPDECVPRRWCIARTAELSCQACCGAQTSTRASCEPQSPSRRVFNPYTEFKEFSRKQIKDMEKMFKQYDAGRDGFIDPDGAKTHDGRNFGGPSDPPGPEKHGSRTVDEDFDSKLSFREVQAINVVSRFEEEIKAEQAEQEEAGGSEMKQRKAA

SEQ ID NO: 967284 - protein, 86 aa, Homo sapiens
MKSLSLLLDMWLMGLGRPCLSLARHPAGASAVFGSDGRHAAAGTRCLAQAAPSVNQHCEQTMGHQREQPASTQCRDHTTPCSIISS

SEQ ID NO: 967285 - protein, 396 aa, Homo sapiens
LLGPPGAGKGTQAPSMAENFCVCHLATGDMLRAMVALDSELGKKLKATMDAGKLVSDEMVVELIAKNLETPLCQKWVSLLDGFPRTVRQAELLDDLMAGQQEQSTACILCIAHPSHPETLCCIRKQSPGKAAFTPKSGRSYPRGSPNPPTRSPCKAMTSTGATRASAASSMINAHQASPKSACNAIHTHQSQPHVIEYIHGNGGSTPALDASQHHRRRARQPPSRPPPQRHHPRITQGPAQHCRQGPLHPAGVHPCVLTRTTRRERAATETKHHTPRRTRDTTGPTETHTPTRPRHPTHIPYPPPPHTPPSGRQQQEQKHPASALRATATPQAPPHSGSPPARYLPNTQHHSYPPPSPTPDTERQPESTANHPHHDSSDHDRPLTAEPTREHAHPP

SEQ ID NO: 967286 - protein, 312 aa, Homo sapiens
AESSDSEEDEKPDQATQHKANSQAKHTGQLAEAARQQKATVHALQAGAAWILGGSQSPRMHFDRLVLSSPNSSILWLQYMDFHLQATEIEKARAVAERALKTIILQQQAAGRSCTRVGGSARTWQNHVTASQAVPDPRSNERAVQYNEPLKVFLHLADIYATSENFQDAGELYKRMLKQYRQEKAGGSTYGAILLRQEPGCSQQRVLQPSQAVHATTGSMWLSLPKDLPQLDAHAGGMPSGPTPMRHTHHTTQAHQSGRPNRTTSQARKPEGRSGTTDQEQHLTWPTNTETTQDIRETATSEHTTTARTAQP

SEQ ID NO: 967287 - protein, 260 aa, Homo sapiens
MRLHHIAPPSPPTTGPWALSRRPATGARTVSSADSVYAGAGGSGSRISVSRSTSIQGRHGAPGAWNTGIAGGLAGMGRHPAHAAQAAHATQPDTHRLASSPGTAVRSLEHEQPAGWSSPNPGSTWQQAQGPQGQQHWSPFTSKHPSEAPAGLHIFAKSLWDNARISSARLHNAHVLLQCMTFSSHSHAGQQLAHAPGLMLSNDIHGLRHRSSDDTNHPPHGSCRTAHRRLSRTELLFMKNQPRPARNRPQSPEWPTWVTG

SEQ ID NO: 967288 - protein, 475 aa, Homo sapiens
QLIMPLLIPEEFHDFDQPLPALQHAHRMWPQPVPALHIQQSAVASSINPCSSKQVWATIESFSPSKMHFACILGQWHASVQHHMQHAQASSFTQSMHAPWFKSSHSLTSQPSSFSSLAQQQPPSHICTCSTQFTPSFSTSCTASNITGHASHICAARHTCMGGTSFSMHPHFIQSITCMAGSSFSMHPPCPSSAGQGREHGIAQQASPATNARIIGHAEHAINVHPQGASEPCTHVHANQAGHPSYATQMAHTPCTCIPHPTTWSHKCRAQTRQSALERPILGSTQTGNNSKPTKAATTAHPGKHITWVDNDATHGAWALTPRTTRTTPLADTQDVTPNIIADDNTHWAPMPPPHTPQRRDRPQRPAHPGRPHAHYTGDAPSPGTGPVDRPTRRHNHARQPNTPHNTEQAPERGTQRSNRTHKERPGAPARSTTDDHESSAAQPRPTRRRTTKSTKHSADPGGRATHEQPEPSNA

SEQ ID NO: 967289 - protein, 316 aa, Homo sapiens
MPLHSSLGITARLCQTHNKHKNQLTEVIIAHTYLMPADINKLGPILVLQTKARDIYNSSMDKPWHRQAHPLTGDARNGAKQISNQAQPPDDQAVTHINLQSRQSSQATPRQTFPDTSHSSGWSHSIFPPRPEYPELLEQDSKTNTHHEDSPCKLHANRIPHCPKPIPVSEPAHAKTRVAYPFMTKEGKECAHDTANTWLHAIITISRADIRMPHMRWHTPSRNYTYRRSTRNTSPYALYDHQTPELVATETSTTRVNATELNMAEKGKPSIQDEIRIKTESRHANGKKTTEKRMSEERPKNRQRRWRRKGERSPNA

SEQ ID NO: 967290 - protein, 340 aa, Homo sapiens
AGLGAGAKFDTRRFSASTPARIPSIRQQQAHIMHFAFFGRCFQGTGTFIGKPSKSCPQVCSGSHPPHTSIQHSPPTHRQQHTTQHSSSLNMHKGKQGSQQPQHTTTGTARIAIPAHMCKYPHSTAQVCSHHHTVGIVTINGQGTATTHYATALQHTQYPSQHEHSSNSQTFQATPVRHEHRDQHTPDKTQQFHTYPMTAAHSQTHDHTFPTVPHSGTNRQSYPKVTPKIVGVNHYIHAHNDCTPGDTLHQRHFEHLSNSRKSNALSQDQRKYPSHALGPRDNPTHNWPKKATKISTQTGQKDHSTPTDSNIALDPLGVRRITVYDGRIFTLAFTKTLRST

SEQ ID NO: 967291 - protein, 103 aa, Homo sapiens
MKTRTMMTILKKNMDCFEQNNPYARFLDNRTISAPGTSRSECFPRDVLQRLLKAKHSGRPRLAICGLLTFDSVTCQHSRAGRARGDLKDGLPLEWCLTPVFCL

SEQ ID NO: 967292 - protein, 263 aa, Homo sapiens
VCESQAYLCLPTQWQHPGASFSPYVEPQQFPTFSNSLANEPCHSEPPLHVASAFTYRTMTASLLQLLPPSLLVLRCTPLLRAARGTPARCSHPDSPRHTVSPRNDSFRAPTWSRPTSPTATPTVQTAARLTSHLPSTPPGPLPQRSSMASSALLRLGALASMRLPYTRPWTQPHACLPAFRLHRLTSPSTHPLHFTFTSLFHTLRPLGTARLLVHRTVGPLRHLQPSPPPPPCPPSGLNPITAKTVEPLAPLRQHLTTPIIHT

SEQ ID NO: 967293 - protein, 431 aa, Homo sapiens
PSITTIVPLARLAVTSGPEQMASVNGSSQNCVSGQERGRPGGPWPCPASMNSCPQNCVPHGISEAVFTAVMFQQTFSPPCQTTSPRHNTCPHSDRARLSTAARMQQLISQQVSLHFSSRSLVQMFHHKTAIAVFTPRFPCWLRRFPDHIFQYQDTHSPSAILMTVHFIIGSALSGTARFLGTYLTTVTFHTVRTLGDQGNAQPSQQVPTPMPLAASQHSPAGRMRHRTPGPRHHNTKATQAWERDSSGTATDHFVGLNGIQNDRDVGHAGTLTGHTAKRRASGDHKRMASITATHSTALSAPKPGTQATSKGTPVTDTLTSGEVTNEGHEQRPPPRCTPGQTTGFEPTHRGATNTTRQRTQTPATQVQKQPNTTPRASDTPAGSQPPASKQTIHTPKRVHTAEQTHHEAAQQHERQKMRENHIPEQANQQM

SEQ ID NO: 967294 - protein, 175 aa, Homo sapiens
MATTRDATQTQPGDHPAPTHPQPTRKHLPTTTHNNNELPGPGIDTSTPTREPHTHTTTQNGALAHITRHAPTQHDSNPHAEISKPHNRTHAVSSRRRHLHDNTTASDQTTSPYTPLHSQPPPAPHTQATTSDRLKQPANAPAPLQRPRTNTGACTSSTETTGQRHAPRQYTIHRR

SEQ ID NO: 967295 - protein, 81 aa, Homo sapiens
VVERRCLPGCRRQPESLGELRAADARDHVEAAWLALCAAPAGALVRFLGTPPRQCWREDTAPSTKFEDRFPFLKKPKLMIY

SEQ ID NO: 967296 - protein, 44 aa, Homo sapiens
GRGLRTHDNGAVPDSSRWRFEVVKPPHETLARRDEAPSDRHKTA

SEQ ID NO: 967297 - protein, 367 aa, Homo sapiens
LINSPTLSVIESQPGTLLRNSSAFSYQRQTSNRSAHPPGAPTISTASGDNQLASRQQQHVSMATCSQHRQASRACRSTNVQAQSRTSRSSQCSHYLNTTSSMSPGHDRHRPGGHSSRTSSTGPCQCLSGSRDPPVSYWTPYGSAYMRADPESLVAVGVVPVVMDSREHCAGARTWQYTGPAAAADPSGIHSHKHIWGRQTGTRPAPPTHSPHHPKARQQSRHSIRLNKIGPKKRHTTHPHTTSKLHYQHMAPNDSGTSPRTTAPPETASPLNHRRTHDRQTKSRRQTPTKRKHPNKQRRTTRRGGAQRRTHDRTRKGRQNDQRTAKGQTKRNRETTKATTTPQASKEGGKQRNNTEREQDHSQHRDQ

SEQ ID NO: 967298 - protein, 338 aa, Homo sapiens
DPTACAAWSPNRKAGAAADTPPLETLSFHGDEEIIEVVELDPGPPDPDDLAQAAWQACGTLQAQHSRQASRANDSRAAVLSNPRQGAGRPAMAGPRLIARSPLHLHSASVFSCEPGPQDQYLGSDRGLKHDKAFVWRLSDGELLFAVAGHKDSVTCAGFSPDSTLVATGDHEWPLAQCGQVAHSRQERLVLCTRGQTWQWHGQGNPRRTKVLSGRHTRLTAKPGLTAQSRTADWTERTRVPKSQATRGPELIHMIATHSRGDGHYTNADPPKKTGNTRTQRERPHTRHRQQGDGTGTPRPTHTDVPRHHSLTPNPPRPPGSRSPTVQAHQRTGEGTQR

SEQ ID NO: 967299 - protein, 419 aa, Homo sapiens
MTRGVRTSLVEQIYSTLGAYQHMSKECTLTTCHGHTSGGHRRLKKQRTHRTRSVYIKRNPGQRGSRKWQKLTPILQTVAQPRRISHRKRNTRAKESLLRRGALSEDPDRVLSYNNPYMGEAPSAPKYKPLWRNHEFPVFLGVINTRASSRGVALQNTRCGPSASPRGFFTFPTNTAKKGVVTRRVNLFIRYKKRTSGGASEGNRGPAEQAKASIVGDKSANNVESQPNRGAPWFPKGAPGRLSQKFPRKKGTWVLLKKKVLSHRVSHDDNMWVFHVWNFHLFPLNAADIIVHNLPLLQRERTNAPWWGGPGGHSLRREMKTAGQFPKPIFITGGSHTVRAVGTLEIPGLVSTKSLPGDQGRKTVHCEKRVAAVQGDEHEEGAHASRDGYTRNEATNNPKTRHVMSSLSKDNPAIEHEST

SEQ ID NO: 967300 - protein, 77 aa, Homo sapiens
VFTTLRVQSLTHRLCMPQGKHQGDRGKSNITSIQASIQTHLACIHPDTLFPYVGQPAHIVGAPTARNASHASLPIVS

SEQ ID NO: 967301 - protein, 67 aa, Homo sapiens
GDAKRDQAQKAAGAGDAKMKCVYEVDNCILSGDCTVRNTIYFSSFIKMQNFVLLFFFLKRQCGSSTT

SEQ ID NO: 967302 - protein, 98 aa, Homo sapiens
ETEYERGCTSLTQKGKLEPAEEDTKVYLEKHSDSRFKSDRSPEAAVIAGGVVGFLLAIFLILLLVYRMRKRDEGSYDLGERKASSAAYQKAPTKEFYA

SEQ ID NO: 967303 - protein, 143 aa, Homo sapiens
MRNNCIEGLMPALESSDAESTEMEAGTAWAGSISRRALTTTSSSCIAGAAAVSAAGACSAARPSNPSASTVDLRPISALPNPWYGNHGSCECAALMRGTQRVLAGAVPGRDRWRRFVRCTAHRIRADRSGKGGAWSRFVGAGS

SEQ ID NO: 967304 - protein, 33 aa, Homo sapiens
YNGCREDDRRGIGKAQKNPFGGNWMMINKLYQI

SEQ ID NO: 967305 - protein, 192 aa, Homo sapiens
VEHRGRHFLDALIDVEEHDEEHQGHAERDLGPDAEPEPQREDRRQHHARQCVDHLHIGIEHGGDARLPREPEADQDAAGRADHEGKDGFPQRDRKVLPDHSGREPLHNLAEDVDRVGEEERRQQHLAEHRHGGEDLPQRQRDDRNQDLQRQQRDARHQAAPACVDWAEPFITSSFSTPQISRCRAWKSFSIL

SEQ ID NO: 967306 - protein, 214 aa, Homo sapiens
RSWPTVPGMRAFVSASSMSLDFRHRPVTAPDILSVCERTKVLIGSSLDSSTSSSLRFLYGKRSLSRAFVISDFSASEGRNISVIQSFSSVYFVMGPQQGLPGRPFGTCRSYVSPLMPPSRGSFMTDVWLRLWRTLLGLFAGKQAGGIWAWTTRPRSKVGESSGGAGGGWPHTSHLHCSPSCSPNHHNQPIPQSMRDSSCGKGELFQNTELISGF

SEQ ID NO: 967307 - protein, 91 aa, Homo sapiens
EEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 967308 - protein, 100 aa, Homo sapiens
KAIAGQKRGHRNQRQHTALKIEGVNAPDETEFHLGNRGANAKKAKNNTGTPGGKPNKTRDIWGKETRAHGNSGMVRAKPPTNLPAKAIGHRRGTLNPSRI

SEQ ID NO: 967309 - protein, 247 aa, Homo sapiens
RVPGLRALGGGGCERRHCGAGGGGQRAPSAAGPVGRGMRKRTEPVALEHELLRRCWCSSSSGSGRRWLLDCLTACLKQNLTPDWALVAVLSRASAACRWAMKLGLPGAGAKARVGLAPRGMILFLVFWGWYSCAFHFPHHNYVLDKQAKADFLLTFRTEFPNFIGFEENHRIRVRITRVTYYLQPEEDVTIGVWHTVPAVWWKNAQGKDQMWYEAALGSRHPIILYPAWERRYQRRLTTAVELYQGA

SEQ ID NO: 967310 - protein, 392 aa, Homo sapiens
VVKTTPKSQNGKLDKNSISTPLSVDRHHVSIPEQVPPTHWPICISSTCGGIDHNSTPIATNLAARQAAAAWAHRAPFNVMPRVLGSTLDKLERATMVITHLHHLLAGTILQTQPTYSCDYHMLPPGHRRLYHKTCITGDISRLHCAVLTSSMLVLVTSERCVSPTHGADPTSMPFWLHTLGVKQLNVGRQHTMAFHLSHPTASNSICRQIAPGHSPHPTSRTHWPHNPAHSTPRAKYQDRERVHNNCLLTANVLNMPCAHAAWQVTRQDATCPATPRSIKALAGNQHQHVQMNHAHSSLTTTPERQKTTAPRGAPPQHDRQTRISDQQQHSTATHANHRSHANQTVTHRPPQQPHQTNTTDTHKQHATNNHTIETNPPTHQTQQNTQAQPKP

SEQ ID NO: 967311 - protein, 205 aa, Homo sapiens
MKSLLWSRASQRDSVVFFSISYRISVEVQIRHDLPGGVSRDTWCHACAELSRASIHHITPTEVSSLCSRMGWQCTHSAEEKSVSPGKERRKHNNAPEGLGSTLGSATHKTAVIPGGCRDRDSQGSSSGHRHHGVLPGQRTLTQPSAASRRSTLTPPGLMQKGDVAKSTDPDTTDPTPKLGRRQWPTAREKNNKESGDTKDNYQEN

SEQ ID NO: 967312 - protein, 546 aa, Homo sapiens
MGRVVRASREVLQCECITCEDKRGRMNGGLEASSLHGGHLDRGLMDGGRRTGRLDLAAVLRFSAFYYLNVIVLSDETVTSPQALACCEVMAMMRVSQEIVVNWGVVLNIGAYINVRVEHGIHSGLASQPTLAVGSLVGCVTRTERVHDACQRGMFRIGGMIHERAAHAPGAPVTCWTKGEHAARSVRSGSIRCGSSEHQRGGRKGHRHLGTRCELDVRGELICRKGAMDSKADAPATRECIACERGLMADAEQGTLWAWRARVLVTLGGRFSGPAPWLCYVGRQYCDVKLGGPPSKLAEEPPNGGKVYGPEGKRGPRTRQGLRRVRIGAFRTGDLAAVVAFELSGVAREHRNAHTSGRCHSFDGTRRVAKIAIARGGKASRGAKAEGPVGLVGEIPHVIPVGYGGCDRLVRRDIEGARNPSQWGPDSNSEGDPIPDRGGAPQIHRDCPRYHLSWAKDRYGAHKHGATKRPTAQQRPDSTGSNHAPGKRGNAAAADHGGATHEEGDYTTRSGFNTCAAKMRPGTRGERPDANNTIERRKRANKRRHR

SEQ ID NO: 967313 - protein, 70 aa, Homo sapiens
DCTACGVCVWQEPVTGERGVSRLLELAVQKVVVHPLVLLSVVDHFTRIGKVGNQKRVVGVLYGVMGKEST

SEQ ID NO: 967314 - protein, 118 aa, Homo sapiens
GGPLSRYLNAVTESEKALKSNHFELSLRTESHAGAWCSGDGRPQERADYVALAIVDVALQTELQLGSQPVVLRSTSDPVNNNRWLRVVDTYGSRGKVPCKVGNEAPVTGPPRVGATAD

SEQ ID NO: 967315 - protein, 304 aa, Homo sapiens
MTFSFEQGSSNSCVISHHQTNFTFNTAVMQAHISIKRHHIASPGTGRWQQAGQAAHIGPACYIRDSISSKAPASFTLAATSSSKHQHYQASTVRSKLICTAIETWLGIQSHGYLLRASNHDTQLFSVQFIDVAIYHKNPWNILELINSKSDSECAEQLRQLAARIKEDHVNQHGAGSGWDQAHLWPPRRQKNIKEASETEKRIRRRRTLKSTTQRPKQYSVETNAGTRQAEGRRQTKKKKKNETGTREPDAKRHPPHKERKRGQQEPHTNSDTPSVHQTKKASRQREKAASRHHHKDDNIRELK

SEQ ID NO: 967316 - protein, 437 aa, Homo sapiens
VDPPPRLLVLLPQEPGGSRDIHVRAGCGRRHDGMMWRTREDSLGPYISYPCMLVHASMDDAGAPDQCTAILTGQTIVRIIHATSFRHLRPDDPSFDTGPRDRMLTATVAPHISCTYDTTRWTARPRTAHQKNPRIGHGQYPARPDIKTCAARRRADVAVWHIEQFYRSWHGGIPESFNCNGMTPQDEHQGTHWHRVPLGVASRRQHSGTTLGHTHHNQATRWALPVGRGPHTPTRHSRRHIGNRPARTCHHTRNAHSEHRVNRGPPATDDHDTMAAYNTRKYRPVHTKQRKRLRHMDSPTGGTQGTHTHTGDHTTSAGPPYTSHPTLAQSIARTLRPSQHHGKFTSHNKDGVAKQGQHSDHIGATAPKEQPRKPHTPGTHHTHRPTRRQWYHSTAAPVQPTPPESTCETPPQSPNDSVDATEATTHPAHMRPHSPAA

SEQ ID NO: 967317 - protein, 153 aa, Homo sapiens
MGDTPSAATEHRQLYTRINAQLTRTASPPERSPHTGKGISNHLNVFVGKSPNTHETKKKGGEQLRVTAHWDTWPANPNLPGTGLKHTGSIHRPGENTLMPLVTHTPLQSRGGDHRRSGDTAKFPDDRQTQREDESGVATKGGRRRPTQTAQER

SEQ ID NO: 967318 - protein, 114 aa, Homo sapiens
MAQASAPWAATLPRCGWCSATAMNQETGRTKNVLVTPNRAPMERAQGRRYKRANTGRQRAQNLGTRTQSPPQPRTEAGDGAHERHTHGHRTRRPPARPPHTGARGHGAQAQAPA

SEQ ID NO: 967319 - protein, 227 aa, Homo sapiens
MCLIDDAQPCALNDLRVSDPVPLVCAICPQTWLGISAFCSCELDIKEIAEPGVSSDCYSSKFLNALGPTSPRSRSQSSLLSHGYAFGWGAVSLPLMCDIIFAGETRPSFAHAWRSYIVNHSQCCVAVYPEHSPLCSLGEGRFGHRKIGSLTWLPGDLSPRHAQAQQGLVMQRFRSLVEDTWVREKRPIPWWPATYPFPRHISYTHPEPSAVMCPHPTYGVQIARISC

SEQ ID NO: 967320 - protein, 398 aa, Homo sapiens
MSFTDSLHLLHTTYLVPGALSSAPSYVCPGLVQQLLAAVYACAAGGASVIPCDSPVIPAHNQAFRGCGIGGPGETLWATCEIRQGRTWRRRLGTRIPSTRADRTDPIDTHALNTEPALVAFLTLGTRTCSETLCDETGTTPREGLGPEANTLPRRRNLMGQDNETGGTTSAPSTHLRHGPLQLSKTDFALRHWDAIAAGTLPKSFPGEHLTWLGQNMDPGTTGDYGKHFGPNCPRTISLGLELNLFTDRSRPLNWTATTQLFVAQWASPNGQWIGTRQRHKSTLRPSPAQTVVTFGISHYPQLHTTADLGPATVHATTHNSEGGPPSDGVMDAMAFCSTGITETPTRHMHGRGHTGAPSQSPATIGPRPSVAIVPPHGSALESGAPQNLRATSRTQHT

SEQ ID NO: 967321 - protein, 347 aa, Homo sapiens
KRVSRLSTSTTIENIEITIKSPEKIEEVLSPEGSPSKSPSKTTEEIPHSFVFCNIKNKQTRQKVEAIQYKSLLELIIIHNVTLHIYNHHIEVDHSIMPMVRSELRGMSAQLDFQAHWHKQAFHTEGQHTFQHLIISIFHIVPSNMALLHTSSQRNSLRSSQSQPLPHPLQVISSIQFPPHKHKAHLLLHIVPSRAFLAIHHPVQAHSKFAPAGSPRCSTSCHFSQYPRLPLCITSHISIHYYLIPMHSFEASLILHIGRGYPQLWLIHAECQFLSPGHWALLTHTTTSSLLGTQVANFLKLQPRLTGYITHRGSTPLQASSRPPTTRASTPKGNHRGFAKSVGGNIV

SEQ ID NO: 967322 - protein, 104 aa, Homo sapiens
AALPATPCSHKMPSDVNGRWGSSCIRYMQATQYERRRDALGPKALCSMAGHLGAPNIQSQSIDRSSLPLELVSLRELSLVGSEVGRVTTQYSCGQSLDRDMPGT

SEQ ID NO: 967323 - protein, 152 aa, Homo sapiens
ATPSPFTLRARSPAVLPFRVPALASMTEQAISFDQRLLGRRHRRRHLQDGRGVRSERVKLLLQVQHGHASRSPSRASGTRRIVDCIVLHPRGAGRAVLLEGQPCQRQFATSLTPMPSDLRLHRSRVQGEIFPGGLQGTTTTAQILDVYFAGS

SEQ ID NO: 967324 - protein, 334 aa, Homo sapiens
IRPRVRGEPAVGLSLRQSHLQGHDKSVSSSSVTQKGKYRNASPDLHTAHTGDREGVDVIRNQSNAVSTSSMPMTHFGTMRDSAARYCVFGYNRGETWGSWPRQSCRVSGATAQDGCSSHGSGASGMDGHVGHICRAALSRLDDVALTGSPKVLRRGELLSAGMGLEDIGKGDLALAVPLLVAAHVGLEVFDLFFCAIAGVPRGRRCHNSSGEADGDLVSQGLWHVVGGPIGASELLSLGQLGGEEQLVWQSLLLSHFLGLLKNFPGELHTQVTRSLSRGEGPGGLDGQALFLGAGPWDLDECPNLENATREQVSGLFGDGLRKAEGVAGEAKDS

SEQ ID NO: 967325 - protein, 79 aa, Homo sapiens
DEESLDGERYHGVPNISVYVFVCSFVRPLVPNNIMAKQITCESKPWDKPEVHQNTDIFAHHEHSSPEKLCVAKNAIVRL

SEQ ID NO: 967326 - protein, 282 aa, Homo sapiens
WRFHTLYGQGFKRVNIKEKDIWIITTALGAVINKKFINKEVHFSSHKYLQKSSDKKLYSGHSAQYTQPKACSNLQPLNTSGSFHPVLPSPFEEAISTVSKRSSWPCKVALNRREFQRIKAPVAGNNGSDKHLENTSGHLRATPAIRAPTSWDWLQSSKKRVVPIAGSWSTQSSRPTRGHIVFRNHPTVSNPPFRQHSSQKSIPVGLSPCKILRRGTTTDVPNRVQIEQRSSQEPSLAQEAMFRAISIRPQLLHDTARHQTKLHPDRGEPNPTTTEQASNRHP

SEQ ID NO: 967327 - protein, 270 aa, Homo sapiens
MVVHACNPSCSGAWQQEHNSSSKKNRTKRKLDAGWLRPSPFPGLELRAQTLRTLCRVAAAATAAHGASTLIRSEPPPLLLSAVRSLRSALPTPPARCCSGRRLLQPPARRTTGTPYSAHPHSRCPAPGTHSHTLRPAHRHHTPARAPPPKAREHTSQNDPDPRRLTQGHEHRTPHAHKNAKNPRHPATPPPHQPPPAHTTRRPTPRPTAPPTPSPPPPTPPSTHPPNHATPQPPHDETRHPHQPPPQPTNNQPHPTHHPRPHNNHTRPND

SEQ ID NO: 967328 - protein, 143 aa, Homo sapiens
MDIRGAPSGRGRTVMLWGSRGVKSVKVGKQSKVAFFKSPGGFPTIEEMAYKMAREEGLYMLWLKEVGSACARVRSRSQWVGGPHPVGHGGPQFPRYVLRRANYAGTRGLGAGATGVTFPEACKACVRAGEPGKHRMRWEGCNN

SEQ ID NO: 967329 - protein, 154 aa, Homo sapiens
MIIRNVSVVWKQTIVGSRRRWHAVSVDVAVREEGLLVHDGAQYIIPSAAVQHGASSRPWAALSSLGETLGIGIPPPKVVPWRKKTSCLAFNIPGVDTVALVDGFQPHTWPRGTPEILRAWNGNSTRVDPSGFLGLRGPRSLPRGGSQGPLALVP

SEQ ID NO: 967330 - protein, 176 aa, Homo sapiens
SILNEENLIDEDFQNLKLRSTGFTNLGAEGSVFPKVRITASRDSQMQNPVVSRHSSSPALTIRIIRMWNAMAPNHMYISIILAVFDKTAWRSEHHVKTLASGSFFFHLDILPVLICNGNVVQCLANDIHAHLLNEESMTLTCSSDAISACQSSVRSLSTQATNSTCRQLGFTGYAT

SEQ ID NO: 967331 - protein, 444 aa, Homo sapiens
ARRLLNRFGMDQASHARPRWQVHWCMHITHVAHSIAWSSPGAVHPAHLGMQALAQQLTTGTSHSLLGAHDRAAVSMAGLSHPSTVTTTHSHAFMHSCTQQRTFHMPARYIGTATIHRAQHMLRQHSPCCLSLTWPQQAIATASLHQYAHTSFSSTSRINSNQPLTLTQHHASRWQHVITATAPCFAHHAAAIPVSCTPAQPHTHKHSSHHSTAGWHPRPLTLVPLSPRQHRIRGSLPPVKARLPSSSFQAAWAAVTQASTPSQVLLHPSPSRTTPSFSHPSLHHANTLTYTPRCCTTPTADTPHQERPQDTHGAPRPRRDPTRCTTRARRNPTQHHWAPTRNHSHPTWQDGKAPPLRTATHPHRDHRTARTHSTPRTIHFGGYRDNATGRPHTSRHPPSRARIPGGATTQRRARDADANPTGRSPRYTNHAASTTRTDATTAPT

SEQ ID NO: 967332 - protein, 245 aa, Homo sapiens
MARSSILFLAKMGALHCDIRTIEGRGLPYDDGAYTDYDIQSGSMTAMQTSSPRYHSHGILRTTREGLERKQKDTGVPPSTADTHDITKSKLKPQADGSYSLETPYPTGTYSIHAQKEHHYIDTGQHQNGSDTHITWHEQADTRDKKNTERNNRQQETANRTHHLNKTRRRNSEKTSLETRERRPAQRDKANPGPRTERKNADKHNRKRNTKYPKQQNTATQNKNTRPHNPTHNNTKPKHQTRRQH

SEQ ID NO: 967333 - protein, 352 aa, Homo sapiens
RASLARVLSDTWGERKAWRGPPRQAAMRLYAEPPGASPLSRLPGTWAPPRCKRALGLTPLACCPWTRDDPYRTRTGDFTCRRAWRQLETHRVNRPMSQMSRPRLVDVSSDHQVHQIIQMAMSHKILQGNKQRNCSNFKDNFELEVLQAQYKELQEKMTVMEEEVLIKNGEIKILRDSLISTESVVEEQRRSHVLLSKRKPKPLSDKGQGTLQKLQSCSLHSSFKDAEMNDLRDKAQNKMNEANKLADTSVPHVKPRNNPYWGDTGRGCHTSVENISTTKRFKATCLFHLSAGALQPGGPENKHNQGEPTTQRSHTVTRQSTHATRDKNETNTKTQQSSPTRTKRHNATNSTS

SEQ ID NO: 967334 - protein, 414 aa, Homo sapiens
IFFYFKWHRLPPKHLVGKYDTQCSLAGSRELQHGRIGQEALAPCSNTAHRSSFIGNTPQHTSTRDYGDVTPHILPHRYSGFTASTTPQFCAQVLEHLTLSLLRYNHTHTTTFYTARKTAIFMILSQPTVKHAATPAPIRPNSLTETLPQSVTASTMPQGTLPTSPSSFLTFSSTGDSAAQQKVRGRAPAYLAIALMPSLYTNRTVASAPNSPQPRTAPDTPSPPIAPANGTTTFNPPAQHGRSTHPSTPPSTSLHPPEHYHKAIHNTTTNDPHHAKPTLQTTLPPNPTPPPHHLYIRSTGAQTTLIIHNKSHYYITRSERRDIPSTADQPRRASWDTAQKLTMGNTNTPDMTNDNTTTRQRGHTNNGNYRPQYGKRHVDSNANQALSTQTNTQRQLTTTKSRTTHESCDAHNAT

SEQ ID NO: 967335 - protein, 117 aa, Homo sapiens
MKTYIRNIYATAPTTQRTVDSKDRSIPYRGLVNGLGPSSYRNTSRSEEDRNRDLGHSALGAASCRPTLETEEKEKTMLVLGPAAEANEGGQSHACPMLRDVLSHNSEFTLTRTYAPT

SEQ ID NO: 967336 - protein, 67 aa, Homo sapiens
NASCTTNCYSNPVPRSSIDNYWYRGRTHDHSPCHHCHPEDCRMAPTWETVCVMCLRGYYQNIITLAY

SEQ ID NO: 967337 - protein, 234 aa, Homo sapiens
MHKPCTNIDQAAAWHQLLNTLFGGFCQKGTSGKHTNMWRILALIDGRLTICTISCFFAHSGFDYRDYISTPIPESKPVIGYCRVISYFADDREILTIYTSYKEKSIFLVGPQEKILQDMDPDDYPRTAVLPALNPRPDRHNNPPMDSLDPHQYKIGVSNHKASTRAPRPIAPKTSPIRLTVLTATPPTLGTPLGTLDLPLCHPPDNLITMGIPNFEASCSWPLYEHAKHYTRKP

SEQ ID NO: 967338 - protein, 269 aa, Homo sapiens
MRRGRDDVALQLWPSSSEALFILLPSPDSPGGSWTQCSSSPLASHCQMLVEVGEEAIDDSSAEMVGGTMGSGHRGLLVADVWSEVGTGHASWILRPTRVLENVPTTLEPHCRAPRAQTQGVRPGAALQGPRGLSLEGKCTRMITRQYGHLSRDTLSTELLIRPDIGSSGLCPQWFEQALEFTQSEKELLESLKEALHTTRTSSPSAILEAESRMPREKLLYISSQEWIAGQKEPYWEGHGPAVMGRLGPQGAEEIVNWKRIVLSRNGKP

SEQ ID NO: 967339 - protein, 476 aa, Homo sapiens
GKNKRLTKGGQTQGSPSKQSGCIPFSSSTQHWSCMCNSTVLMFNHQAHIIGTSTLRTPGTPRHTQHIAILHGISKASVLSCTVQILPASMPAHACTVAISATHSTAAFTAQHVPEVNTTSLALTLPMAIGIYHHVTPHTCCSHWSNKHEASTIALHSSTVACPKHSPAWFTCFPYCSCVSVFYSNTTAKQSSITAQHLLHSCQPTNKGPPKITGKQSMHRDTSMNPQQGCQQNMHLQQQVGQNTIGIPQHKHLATSTSGQTGFAQLLLLFLLPLHWSFRFTHTSNKHWLAKTGPKVLAPLGRHTASLGTAFHEVNRAGHDFWGTQSSTWGAHQTHHGRPNTALQTRRLGLGVIDKPNARTHKTIRAITRSTELRNIMLLHTKYKKECPFCGATHTHNTTTGAEAAHTQYTPKGSTNQLQTPQPLTTKGTLILTAELNKHSVDDYHTSRQRPVPGRKLRDHIVLTDANNAMHPAPPT

SEQ ID NO: 967340 - protein, 519 aa, Homo sapiens
AGKQELRRVLLKVENKEREPGDCPREASPAVALTRYVVGSLLGAYIVRGQFRRMCTWVDKQRDQITMNRRPLDDFQLSTSQNMCSSQTWRGHPVGWYSEGLEEKAHSTHKESPLHKHSHLDTADLMELAGATCEAGGCKGRVGVIESFGCGPMRSWCPWLLGVQGRLGMEAYRSSCTAIDLACSGEPERVGATVKSVSTIEEEQSKKGGEGVCGLKGFESRKDGMSKQACDLVDKTMRTRGKHRQHGGRQQGYEVMTGVITNVYREMANRDRNWDIRGNGLAKSSASLCGPRQPSWASKRRSEHVNTEIEGRTWMGRGEYMHRVTGAANYMGELSHQNMWDSKPPQDGKGTHSRPAGVGGNNTWVVTRRHGRGVRPNMGAVIWNTPGHGVRRTFDRRGKKRLTGGTKKGTCRKRDSVKPVKEQRVPTGGKGTAGGTDKRGPTGSPVAASVNNRGPLNEHNIGAQKAELPHTEGRRCPAEQGPGDPHYTAGQDSWLQENTLTETTRPHPKKGNDKENQTE

SEQ ID NO: 967341 - protein, 562 aa, Homo sapiens
RRPALRFEADPLRTPTPVTPGTYISGMSPTALQRQTQLLRRPAVLSRVGGRQGIRQWTVDVASNRPHEMQPPTAEQTLTASMSPRPGYREIMRTQRSDKSRDIRQRRSKHTAHRHDPVATQTTATCHYTDAPTTGRLTSSCQDESSHDSAAERTISEPQAGASHTPSTTRANSRATRTLNHTHQLPRHTGGLSHSNPIQALHHLIPTLRINSNTSLAATGAPSRLSDHAGPASPHELPRNSRTANGRHLARTSRTTHQYHSHTRHTTRHTKQTRTRGHTPRDLRPTGTLHAPYQQPGNAAPPPTMERPHTSRFATAGSAPPRTRLRGRQPHSARPAPRTPNDTTLSGHHHHTARPPTHLTFTTRRTHSHHGRHKHGKQHSHYRAQPDRSARHAPTRRPQARTNSDKRPKEPADSRYPAGQPQTTPTHNNADTHAAAPGPCQPPSSDNHTPIHSLATVPDHHRPQRRQPTHGPRTHTPWQGRQAQTQTTHQPTPSAAHHRAHARHHQRQHTIHPRPPPHTWTSDTDAHSPPSASHPAHAHPPHRATSTTHTDTSDPTTTTQPA

SEQ ID NO: 967342 - protein, 406 aa, Homo sapiens
MRGLTHGADAPTIGKFRTDLHTDFGHRFPHRTLTSGTWVTNQLGIFGFIRFALVRVTEGTHNVHHKRHPCKTTNNIKSQFTCGPSDTTYPYRVGLTKRSTCQNRTGVATGAKQTSRGDSDTSTSTSENTPPLSNPPRDRTEVGHPNHQNVGRRRRNPEHGSGYTTSKQRSRIVPTTPQPTSGEHNRHPFTEHTQRHLVAPKTTELQELTRRVPQMPPDTSTRTTESTQFQNNIALEQATRPRTAVTATSAAHNSPSTGPALIHLDADTPRNATRSHAENRCPTLGRTRTTHGVAPTTTSQRQPGMRPPLPPPRDRYRQKEDHGSQRNHETYHHTTGSRPIRTRAHIKADTGHVANHDARRTHANNQTDAALPVTTATRHRGHHPALTDTTTNESTQTAAPITRGDD

SEQ ID NO: 967343 - protein, 115 aa, Homo sapiens
MSPALGALTKLFPNGPASQYERPYRFFFSPSPPGSTGGPPPFRAGPQRTRPLGPPNPPLAPHANGPPDPPPPQDRPTARKTPERAQPAQPAHHLPAATHAPPPATPAPPDAPLTP

SEQ ID NO: 967344 - protein, 423 aa, Homo sapiens
SSRLEANDYFKAKDYLSNCHQCSTAMAIELNPSNAIYYVQPAAMAYLRTECSWLLLLERLPLRGHLSLDKKYINGVITCLVLARQHGTGQVPGACAEETTMLVVKVKPHDKDAKMHIPGVQQDREAEGLLSGPSRADEHKRSAVDSLDIESMTIEDEYSWTQACTTANVTNQFHRSELMHLVQGTQNETSTWKVCHTRILGTRSQGGPSPKHEHASWKPSSKQTDAPIHTMWGNRPWAQTLCTLTQPYPSSNGINLGRHNATSPSMVNYVAPKAIPVNVHLTLVRVHTSCTRIQAPTTVRAEPRQHDTREPQQQRPGGAERTGNSDRERQRRKGRKTGEQQATRGGQGTTRRSRVPRHAAVQYSGYPWTAQARAQADRRPGDGSEKVARRTHRSGRERSERIETKQRSRPAPLRPHSTTGRTQ

SEQ ID NO: 967345 - protein, 546 aa, Homo sapiens
FLRISAICVQPLLLSVPKHKLTLAVFVPWLFCASYQPAHVQHQPFTCMQFGQLTTLAAEGPCNCAPVHTSCARSKMQCTAHMAASGKHRPHSSQLFSKPGRPVGASMSPVTHAPHSSRTTPPQQASNRPSTYTSNTRLLITLQIFVNTPHWHNRLDHNHYTLTSLAEEHTHFNTSTLLRIPHTPRTPIAAFAGTNSQHTSWGSNFITSSQCKRHAHPGRPFTGSTANGCSPWLGRAPSKAQAQANARTNEVASPIRKQDTLALVNDFQINTNTNLSTDHPFEAEDQMKHASWVILGPPNHLITSNTHSQPMVTHPKQESCTHPDNCRHYWTRLGHYQWKADTTPTPQTDSLTCPHTRERQLGKGAHTQPTPRNRTRADDTKTSTPQTTEQGDATNQSHDKIVVACDNASHKTRGPTTPDATPHRHRPPELPSNTQLETTKLRRQTAHTSRTGHTTNTERDTRDQTTSRTPGHGASERQTANDRNQTADKSPDENTDQRERRDTRETTDTETERGHTTQRDRTRTRHRRRTSDEHQRDRQDQTRRSK

SEQ ID NO: 967346 - protein, 245 aa, Homo sapiens
ICCWWSPHHAVPVPSVPTVPVCPLHATFLSISDGVALMFTHDVLACMDSSGTPVGRVAMATMAMCPDGDNSLRTRDMGMEPEPCGPRDPQATQTASRAALATQSSHARADAADGGRSHPLSSYTYNNNAECTFCRLPNISSLAEVTTTAHESWAACIPKKSLKVIPKDPYDRYPSYWYPVFLVRFTGTHGEPPTLLQRVAPEGHNPKDPKTMTGGQIPQTDLGITLALTGPERNGQGIPGGWGTV

SEQ ID NO: 967347 - protein, 259 aa, Homo sapiens
MTLVHDIAKLGREARHPTSPSIRPATINAVTYKHAEHHDAGTPAEPDDTHTTGPTAALPSHTTQEVAHPAEANAPNHTVTPTLGNQRTEPPGQQETQTHDDASHENERVDNNKKQTTPKEDHRLSTITTEDRPTLAIRPHNHRATAEEGGIVLTPTLRTEQLHMTPRSLVTTPPPTSSNNKQPKTRHSSQQPNTNHQTKPNIQQRDKHDPNAAAAREQTGYRQTERGKKQRGRNQPALTRNHTLSARNTHSQNDERPDT

SEQ ID NO: 967348 - protein, 389 aa, Homo sapiens
VHVILGANTYAACLYPSNLVNSTSQGQAPIPGYHLLYMGCWSHSTHSPAILETKTDAIVLPLENVASGDGSTVTIQQCNVLATAGSRCQPRPKPNRHASQKPIFHSETSLRQCTVRPYRPTPDPCTLTATTTPISYRQGSGGEGCGEEMNLPVAPQCYPSDLRSRSGCQLHLEIDDATAQPHHHTHLHGTNQEPDSPTCSLMVQMDGTPPWDWLKASPATWHFGDHPGLDDIEIPTTPQSPTREVADPRRTMNISSPTAQLRHAPREPKLAATTDRPTSPTTQCQLGTRSPAWRVHATHDSQLAATEQRKRRRNQTPPTPPPRNQHPPTKPKKQVEAKTKHTQLTPTQDHTDPTPETNHDGSRTRSARENDKRRDRPLQTEYKQAQQHE

SEQ ID NO: 967349 - protein, 97 aa, Homo sapiens
MDFRSGCPGPSTLSASDTLTYRPYLLSPASTIGLAVPGQTPGIPPCPSLLLPSSDVAAIISSLDRVHHSRYSDDFFITEPEVPWWLLSSSSLAYLYV

SEQ ID NO: 967350 - protein, 286 aa, Homo sapiens
ASAPRGLAWSPRSPRGLSPSERGSSSGTPKLIQRALLRGTALLASLGLGRDLQPPGGPGRERGESPTTRPPRQRPRPCPTDAAPLPRLICFSLKTPDYPGHLRATPCQLSDPGRIPMKRTTRATRTHDAHHDTMQATDATDAPRSPATRPPRTSPHTRKPPPCPPHDTTETHNGHPQYRLPRQANLEATTIKTDTLSRPTRHTTRQQPRPRTTNSTTHLNAHSPSPHSHPRNESHRTRAPLHPHYGSLVAAQSTELRNPRPPMMSHPLLAPTRNASKPHALAAQPH

SEQ ID NO: 967351 - protein, 232 aa, Homo sapiens
LGLVSPGFVKCGKPEAQSCRDSTILAFSTAYSFGGDAQADEGQARKICMLQRRFKEFLRASYLHCAHQNARASPFKLQRMNIKRHYNLAGATGLERGTHWRTLARLSHERPWPTTSYQSSQPEHLQLPGSEAAQARYPALRLHPAPGPPCRHGRCLQEPSRVIAQDRNAQHLSKHSRQPEKHQNNECHNQEKTESHGNQSIAGHSCEYRSQGINRHSHIPVTATMPANTPTP

SEQ ID NO: 967352 - protein, 175 aa, Homo sapiens
MLARLWRTKDRFHNSRWECHLSSTIVHDSMATFFKDLESELPFHPASPITGYITQRTLHWSYHYDTGMSSVHSQPYCPYTTTGLRHRCRSGFAWLRPWLLSAAGSSPGFSRLGLWSFGALARLGGHPVTICGPVRMRALGVSPLAGIRAGTLALSTFLSHRPAVSCVHSPRACVP

SEQ ID NO: 967353 - protein, 487 aa, Homo sapiens
VVKTTPKSHNGERKRLISTLSSLDHVSIRATVHHYWPSASHQMRWPSHKQQPIDTTFAEGRLLQHGQQALTSKLMHWDLVHQHCTQLAAVHTWIITNCHPSTICGNICSTQTRSLMCNNPLHAPRHTSRTFHTTTPCNYPGTSQELTSCMIPAFKPASVYRCNTSDSLDISTGTGDRHTRRLPSLDLTTPWSVEHNTLTTIGCNTQNMDFTMQAHTLHSTKKTKNTLHGNKSVHRRNAHRQRDQSTRNTRWHYHTPPKAPADANNGHQITARSRTSRRTNTDWKAPTKTNHRPRDHTGIATRSHQSRDETTPRREQPQRDNETNTRNLANHHTTTTENTETNPTDHEPPNSQDDVITNKLEGNTGAQENAGQSPDCNTRMLPDTAQDEEHTIDHPTTQPTKKTHTATPETTKTMRNSTLADKRRHKEQQANETKPTRNATCQQTPHETRQEEKTNKQKIRHTRTNRTDTTTQQNENYSEVGRSTNAT

SEQ ID NO: 967354 - protein, 350 aa, Homo sapiens
AEGIMVQYETVWPRCLCASVGLPCACCFCGWCAVCLRCVLVLPGLAAGVLLVVLVLLTRGMRAGAWRTLDMWRLQRFADPATQHLGLSRRCIARAPCTQLCAASYTVRELGPCRPVLYHLMCGTGLGKDTKGPTVVTSVSRLTVRLRMSQCPNGRDMLLWRTHVSLKECFTYKGQDSTLGLSLNCRGAGGVATEVMVHVLKLQGADALTCNTNVPQSMFSYDLQYHLFWPDREPMGQSSKSPGESSGGDRGLIGSRSSTMGIRAPDIEQGSIRIHLIISRGHLRALQTRSETRDHKVGLQGTGTEQRKDTEHTEGPKTREDRPDRRRHHASTEDTSDPRGPGPTKRGTQD

SEQ ID NO: 967355 - protein, 311 aa, Homo sapiens
MAAQADGGGLRHEGESPHTLHVDGDTTRLGQRRSTISTGGTRRIQRPTKKHRTDPKKHKDHQMGGKEQLQTREHDKVVGVSRHEGTNGQKKSTEDPRQTEETGDRRNHDTDRQRQHKKGAQPPGHRRIYATTKSENEHLKRFKTTHNNIEHHMKPTMEIDSHQIKGRPQPYRARDRPKEAETTMDLGTQNEPKEHCPRETDTSDTNSATKGQHDSTDNPEKHHRKTEKESTKDTKNNAENHHREHNTSTPLRTKTKNKKIKDTGKQERKRKRNNHTKSTKTANAPGKKNNEGNKQNKENTHTEAHTYHRAA

SEQ ID NO: 967356 - protein, 392 aa, Homo sapiens
MFYILYYISIYVYSSIYIRHTVQKRQRKNTQTTSHGTLGSHSENSSSTNADDRTRDPGTRNSTPTNHTLPAGFLLTCKHSRNLSHLSDTRGSMLSHASPLHHTRHPWPIKQNTNSLPMPLATLLLSWPIGTLRYHDAHLLLTRSTLPHPAGLPDAASPSLSPPLRTSFTTLYPPSQSPPNTPARGAYASSTHPPPPPTALRLPPTHPSHPPTPSPHSTPPHTCHAGHPPTPHPTPSPLRPPPPTLTLPPQHSNAHHPLSIAATAHQTQPHTKLPHNTPPPHPAHPPAPLLTPPHWLSPHSPSWQCPPAPFFPSPSPPYTRQLHPPTSFPAHLPSAAPSTLPPAPPTPPSRSPLLPPPQATFPHLIPLSDLLALTPATPPPTLRALSTPSLSL

SEQ ID NO: 967357 - protein, 653 aa, Homo sapiens
MAELSERQAQLITTYIHSLTPTLPHHSGTLHNQTQQQNTPTHTTKKQGRRPSANSRYLSRRRGAPQRDRSHAVYTQGYHSDETKKKRSPTYNTRESAETHNTPATTDETRAPTHSTNNSNHQPPTQHRDPHTQADQHNLLRGTHHPIMRRDKDEKTTIETNRTRAEEVVVDDKHITYLMRNPQNNNRTQQLNEKRGQISPPDCPLHISAALTHTLSTKRHRTAQTRRADYQPTRRSNNTKHKNERNTNYQRQTATQRNTAQHTHPTAATPTTQHSRPHSHQPSHPAPPTHPCLNTPTPPAHAPPPPEKIKKQHPPPGRRSAIDQPHTPPRLTTHGALQSHSQQRQYHRAEPTHRRNIQSNQETRRRITNASLHARDDRHRTTDSRKPGRADERHQSPGVRTHPARRAPPHTAAHSSSGPTHTPSAQDGRQHRRRARPRTCSRRARVHSSARQRLDEHTRARRAAANTTAMRHTAPHTAHRNRRPTQQPAAQPNTTHRTPPAAEGAATHTHVSGSGQQQTAREDSSPRPPLHPQRATPEDERRHDTGLRESTRRKTRTTRRESRENTRGRRRPSSCAAGPPRRRASPTTHQQGPTQATTTHRTAPRPPLHDAQHRHSGTAARQPPRDSRTAKQQETHARTTHSNRPHAPHSPPA

SEQ ID NO: 967358 - protein, 221 aa, Homo sapiens
SWLSLKQTLYQGRLRPVDFNVRDGKISKCFLDLPEKLQDPFQKHLNSTEEYLAFPLRTSASHFFLPVSVVYVPIMVGGVMGNVLVCLVILQHQAMKTPTNTTSSAWPVSDLLGSCSFGRPRGGLMTCGSNYPFLGRARWGCTFKRALFETVCFASILRITPSGERLRGNPTPVRAKLRSTRVPGLRNLGILWGYSEHFSLQNQHHGLQFTNSNGPCPRWAL

SEQ ID NO: 967359 - protein, 426 aa, Homo sapiens
ALTIQVHPVLFRNGTYESNQLKILTQSSCCDYTEEHARPRYFLDYSRTSNDASAAMSSNSLLLTRPGRHASPATRLFSSLTTTSSAAIRTAQLVYSYSTRTSTLLHDATQGISCNGSSPTCIPLHSRLTYNATTPEIHSQTHHALHNHADTHTRPQPALTPTAPQPLKRRYTPTTTERNRHLTALKRNLNSNGTVGYTYLRHRPIPHLAPPMAHTGAFSTTRNKTYSPQEVHRRTTWLPIPFATRTNSSHTYRRTPGTPATAPNAPSAPLAPTIGIGSHALHPYRHTSHPIHSRRASALAPTHSGTTDGTSKRPPRLQDPVITSLIDTYPPHEDRTPNAQLPITAILGAVRTIGSDSNSTPILRPPTTTWNTPTTNSANTAHVHAPPTKQTSASGRPISPTPPSDSHAHRTRAVNDRYTRHTGRPH

SEQ ID NO: 967360 - protein, 63 aa, Homo sapiens
MRAKCDSARRGWNLADDGLVDASRWCPVRGEPCLSAVVCDGGAWGHPGQLSGHHGRQFLNNQR

SEQ ID NO: 967361 - protein, 317 aa, Homo sapiens
FLGMKMVGELLRMSGAFFMRRTFGGNKLYWAVFSEYVKTMLRNGYAPVEFFLEGTRSRSAKDIDSYIRSSELMGRGPYFTKRESLMNHTHVANSSYASHDWNTVSLSKPTFLYVVMKLARSVPKPTKNSTSWVAEQPERFSLKIVEALHVYLEDPVSLRSLARWEDESELNNLVPRYIPQKQSEDMHAFVTEVAYKMELLQLTNHGFEPLDLIVVSASETGNHGLDAPVQTDLYGYQVNPGMGGSSWLIITAESCPARISGFQLPPAHQGPRRARNRRARARQATPVHTHAHWAIETFATGQSAGHRESPTPKGEKK

SEQ ID NO: 967362 - protein, 361 aa, Homo sapiens
CLPQRMHLRGPGGRAWPQRSKTACEGAFTGRQKFLRAERDQPSCIQSWMAVEHWSRRKAAKRKLGRHRPSGGLIRGFVLRHAPRCPENAFFLDHVRTIFILLNLRRQHAPECPGHARGPAPTTCPDAEASELLRESCITTMVGNYCRSISPELEAAACKQKAAGYVSIFQGKKDNSPSEVYPRPLSSRIDAWYTIAITPRSACRTLGSEPIHALRCLACDNPTRKGLKASSREAEREKPNAAPTRERRPNAYHHDWIGPTPREHRHTQRDKYRATTYTESDTKHKGNEQNKKHTRNEKPHTTTLRATAKKCNTTTGETHTKETNKDGRLNPRERPVPTDKAAVSTQNTQNKTPHNETPQNT

SEQ ID NO: 967363 - protein, 135 aa, Homo sapiens
MDVHPPIIVLQRCCFPQWGEILLDPNTVCLLVGEPRSSFPIWVCCKLLYCALRVACCFWEQFAYSNHLLCWDSSFQRCRYTLFSSRLDLLLSWCPWCKYTSHVLCSHFFSSRHIVICDPLRWGFPWGDLGCDITA

SEQ ID NO: 967364 - protein, 287 aa, Homo sapiens
MAFPRINQHKLHDSYFAISPTPASHTAYRWRPEQEQVEQIYHLTLAGNYVHTLAAILVDRKPVFVHYTLSQVISILSSGDHQVYSQQQCITLVKDPLAINPHTHNAASIVMITELNRADVTTYLRIIVSPSPKPAGHSLIVTKQIGNDINSEHSIDHRRDGGAPTVSTHKHIILHINRVHPESLLSYPTTGSDHTYQHDNHTYGQTQHPLPPYDEPTQNHNREHTDNQKTTQDYTKQNDANREINTRTKKPTTPEATYHKHNHQKNTKQHNRTKSTRSKDTRVQNKN

SEQ ID NO: 967365 - protein, 199 aa, Homo sapiens
SRVRGKCILDSVDGAPPVLREMELPAVAWLCGPWRTLAFVLGNYGLTSFLIIKDQRSMVRVLMGALRPLKSHITGPVIGCRHILHMRIIILDQLGLYKMMVDNGWGCDCYYMSGVTILSMMDVDHQIAKRDGGTLSKSQRDDDPLVMESRGVVVPGVVPCSDEAEPVAEIVAFIAIRIVDGYEQAARVLLKHWELVSCE

SEQ ID NO: 967366 - protein, 48 aa, Homo sapiens
MRVTARQTLPLAPSFACCPPTNCKLLSKVLLRNRSHTLVVSNKQRAWK

SEQ ID NO: 967367 - protein, 396 aa, Homo sapiens
KRLFTALGSASAWDHQALEAGFHLQLGLPYFCFSLGCGKPRRFYLSFIPQAAGVPSFFPRGCLWLQLHEHPNGVRPVAMASRSLPTEHHFSNFFSCPSLPGALHKRFCADLHHIAPLVPSVVAHCTNQHIAAKLMASQCTQAHLHVMRVQPAQQVGRSSKAANIHQQPQSAATQFPQHAQQGSTQSCCKTTVPSPCSPAWPPVSKCHELPRTGGITHHPGSNQHRTNTGATTIRPPTDHRPRQSARGFKGTTSPQLDTRTLIGPPPGERTTGDIGWPIRLHNLGTTKTRDPNPPRVDTTARTRQTLQAQSTTRRQTNPPNTSPNRGTLARHDRKTAHSTVAHNPMAQTQRHQAPPAPHDPRNTYTSLTHCTHRSQKTNRPTGTEHKPTQTNAETDN

SEQ ID NO: 967368 - protein, 230 aa, Homo sapiens
PWCPGQSPLQPFPRAEQRNFLRSSGTSQPHPGHGYLGEHSSVFHAAPGHLPLLHISGRGPGTPPSPLPTPAVGALPTPITQQSFKQRITMGFPGFEKSGGTARARGNRGGRLEEQRVPRGRGGDTKEEQTDVRLRLRCHRVRINSTSTQRASLGPLQVTGLGYGYEKTLETLPDDVWYVREKFEGDIKQEGVRAFERGLPNKAGVTCSCGNYGGWWMNKNCHSLLEGAGM

SEQ ID NO: 967369 - protein, 115 aa, Homo sapiens
LEARWVSAGVSRGGCVGLQEKMAVSNTELYTASLLTPFRLARERTLNDSDHKHGASANRAPRLTPAGPSQTTALHTHYCTPSNHQAWPHGHALNLPPPPTRPHNSTAHTPRTLTH

SEQ ID NO: 967370 - protein, 41 aa, Homo sapiens
YDVAHFHYVLSIGAVFAIIGEDEDENEEAKQTERKRERESE

SEQ ID NO: 967371 - protein, 113 aa, Homo sapiens
SNHASDHRSRDPRDNGSRSGEPPPMMWRLLEEAVRKNGVARRGGELHNGRDGRRPMAAYYPSPAPTPRTRDDRTRTGRPEELHVLKNHFGAREVRETRLKFGSSDSYAPFRAP

SEQ ID NO: 967372 - protein, 144 aa, Homo sapiens
MVRSDHQTTRGAHRRGARYTHFTGGQAKPRPAVQRTNTNKLIKRETDENTPHTILHERRREKRTRANKSSRPTKSKLEDQYRATQHEDTNYHNTSSGEESNTPRGARAHPNRTGTINNSTQREENTTSWRTRVKLRSGNINKTR

SEQ ID NO: 967373 - protein, 106 aa, Homo sapiens
MREDYLVEAMEILELYCDHAAGFGFGLIQSMKELDSGLAESVSILILWLLLVSPVQERVLGVWQQSVADQLCAKYHAQDIIGIAMVRTKARLRTCGIDRLKCTELM

SEQ ID NO: 967374 - protein, 173 aa, Homo sapiens
ANMNYVHRDLAARNILVNSNLVCVLTWLPVRETEHYTQCGDPRDAGPSYESLCTTGACMSCGGDTYGRPTDVNTVISINDVRSQHGLPRSPVMIMLERACRAKSCLVAPDSSSAPILNLLIDPVLSSHREVEGASDGSMLGPQIRVYGDHGPVHGIESVHDNEIKDCVRCRAK

SEQ ID NO: 967375 - protein, 259 aa, Homo sapiens
MPSGLSLLPDYEDEEEEEEEEEGDGEKKKGGRQQAALRRTGQGALQVSVLSPVKVDQRQCACSKLIYSFSYYIPPQWPPIMSSFQGQVDECRNTLKTVVDRTRKHPRKRYRNGLCWIDSLSVAMQGRYEHGFDCLQRNDSDWTTRGGTDTCQTRSNEGMVDSYIPTGPIRCPTERVRERDRVGNRSKPLGGRSECSPRLAVCEPGTVGGKQSLGVIRPQALNTLQNNNPLKEKSLHPINKQPARTKGRTEAMPDRRTMQ

SEQ ID NO: 967376 - protein, 184 aa, Homo sapiens
YRADKHVCVHVCVCLCVCISVFCKLNIQHNTQNQLQPTSSIYHQHILYFIFITHHQMQHHVITQCPRLIITHLHTHSSFYAAFQASNTSRSFHHHLLCPVVPDALIASQTLRAHTSSQTWHTHTNGFYFGPDSKATSSQLAHSALSGNTFYGPSVISSGTPQISKLNPKVLANTQSNTPIVPNY

SEQ ID NO: 967377 - protein, 412 aa, Homo sapiens
REKNFPCVRYRLSECLLASSHHVHHAHIGGGVAHISPITHLIYHTHLHCQSKGFYIILFPISTAAGSISIETIPHTIHISISTHTYYQRLILFMYTVHTSQPEHTSGLDIHETDRQVTSQPSTQPLRRSQAAINIIITTHPLPSPLGQPAQGEPSASPDFDPQHKHRLQQFFASFQLAGFKLNTHMFTIGSSGLMRSQKLRLFSHLCPSCSAIENIVAFSFHPVDWCHQTTRSHQYCNLQSEFANYLDNLSTPEHYSLLTVHHCNLPAVPGPPTPKRNTSPGAQLPAATTGTYAAGDTHTKRQKTAGTPRSHNRTHPCQAGKVQTAHNGEPAPPATPAQDTGHPFGKPRTVTTAGHDMHRGIKEQKQREITDHKQGTNHSHHTPSGQNTAQLTQRDNTEQRTAAPPTLLVAA

SEQ ID NO: 967378 - protein, 521 aa, Homo sapiens
CSLPEASRSSCDVCRGSQAVLPPDHPIREQPTSTYCGTAGMDVPDHLTRPTTMHRDLPIIAWHLSLTDIQNTQTTLSAVDIASCYQCTDYDDAAAYNTKCADRLIHRDAILYTILADLGPRDGCAETRVMRVVEPQTIGQQRAKATENSSDRSPIGHGAHKLHWRPESKDTKKNAGAKQSTSHSTEPPEVETFGKNGAAEYPGEKATITPVSGAVRPRMGWKGAKLRPDQLDSPGGGSSNVGITEPADSTQDTRPTKGQGHGHSGLTSKPQPRSPSATKPEATKRQQSKHNTPGPEAQGLGTTMEKPTSYGPFTTATTKQHRDSGAQTETSHSTHGSAANPAGNNEHRAHMSDSTGTEHHDITTEDKGARSASRRGSKTEAAYRPTRRRKPPHTHSHPPKPKRHRNQTQHTCQKHTQRRTAPHPRRRPDNPKAGEDGPRRNTQNGQRQGKMSTPPPEPRRQPDTSSNRNTETTGTKTTGPHASHDPSNRSRRRQRPPRPERKERRETTVGRTTPTSQTTDN

SEQ ID NO: 967379 - protein, 216 aa, Homo sapiens
GSSFPLASVPSSPRPPYAYTHALLDKANIPLSRTLHLLRPHSLGGGDIALLGFWFGGALSAPSLFPLASHSCGLGTLPLRLTKGPNPHLILARPTPLPWQQQVWPMDGGAGPQDSPSQTVFVTTLRLTYHPSPPSLAPRTQAPHPAPYGSREGTALVSPLLPLHCGHSPLALRLPSALHTAAASPLPLPQRTHVTPHRALRTPTSRYAAPRPPTPY

SEQ ID NO: 967380 - protein, 130 aa, Homo sapiens
ELVHGIGRLTAYEFAQHFTTAQLVSLGIITIQPWTGRQHQLPNMRRALGAKVPYSFVVALRANRSKHHFTSSCQQHRCKASTHWQHVQSFIRQTSMRGVSLITSSIMFSSPPQHPSQHSQHSTLICTRFT

SEQ ID NO: 967381 - protein, 132 aa, Homo sapiens
MFPPSSGFWRTEQLVRSGGGPLSLFYSGSPTSYFTKRLQAGLEQSHLSEGNRSSPLGSGEGLLGLRPGPNGHSHLLKTPLGGRNAALTTLLPSTEPSPEGSYVGQHSQASDGHYADSYLKRKRTSLSGWHQR

SEQ ID NO: 967382 - protein, 315 aa, Homo sapiens
PLPTSVQNLAHHARSRVDRLSRPWMVSQYNPAQTAATCVTPPAVTDCYDSADMALGCCYYSDYWQIGEVPAAQPLDAPHYPPRSGHASPVAGSPKQPAAWLLPLAAATGWHRYDRLHNRPHRCSHQMSRAILDQGAKPDASGSSRPHTSCPHTAHLAPPAPCLPTPYYSQPCRHTILHPQLPMDATITAPSHGHNPPAPPPPARTPQTSPPTCEHKNPTPPGRPPACPTRTADHSRSTQTAPLPPPPALDKLNPHGTSPRTTTPDADRDPRNLRAQPHPPPPPPPTTHNKAPHRHQPPPPPTPPTPRTPPPPPAP

SEQ ID NO: 967383 - protein, 314 aa, Homo sapiens
MHTVGTSHISRLGPRTLCGLSTHIPSHRPHHTRQAPMRMAQKKYHGPRTFSAHTLYPLAYRYTRCAQATSPTSPQGAFLNVTRQCNAKEPSQRTAAVSPSPPGIGTAYPSGTHTRPYAHRRQLSLRYAHYTPRSQRGSHRELHPPRRIPIRQQAFRNPHSEQRARDSERRNSTRHYRDTPSLRPTTGNDRPRKGPAQANRHHTPPPGNALAPWPPPHAPHHTHKKQQLPDGTTSPRRNIQIRAPRDAQPNNHRTRQGERTQRDLKHTNDGKKNTQTGSVQQTQPAHPLPPDKIYGQPEHTGTNHHTRAEARRQE

SEQ ID NO: 967384 - protein, 487 aa, Homo sapiens
KAIEKMNGMLLNDRKVFVGRFNVSKEREAELGAKAKELHQLLYIKQPLGNEAGLTDESAKQLFSPVWSRPSSVHRLHAEIPNGQIQKASGLVEFTHKHTQACPHQRPAWQGSMHMATQANITAALNTSIHLLSGPAATTPSKAKANGPATKERSPHTPANNTPRTPSPPGTPPHAAGKHSLSDPQSIRRRARLPHIPPYHFCTSHTLWANWATNLQFRHIGNCHRTTLIQRGHTTTPISYPYAPSIQGPTSHRFVNPKRWAHSTLSHHLALRHQRDTGATRNKRHKHTAGSSQDALRHRRTDSARSALPTVTLPRWHKRNTEQHPPANRPTRYTPRVAPHTSPTPGRTPRKPHGTSEAHTAQTGTPEPKRYAWRTGAHVGPHTHNTRKNGGNNAHGQTPHGGTPPPWETPHNPQTHLTYMCHHSAQKSEPWANNGEHYGRTTPPPRRQTPVTATAVNTERHAAPTRTRANNESTWANHPNEGSTNRQ

SEQ ID NO: 967385 - protein, 221 aa, Homo sapiens
MGVDAQAGRWTLGAARFGEQVRPGSPAVQGSFPSKVAWERDGVQNQDKGDPWVHRDTKLAPQKRRNASGPQAGMPPPRRPRGGVRSSGKELPELAEGGVADDDPNVGRPVLGDQVNLLNGGLLIRPAELGPWEPHTESEDRVPARPQNRRIEPSSAPGARDPQSRTGRRSGPGDVPGPRGSHLCCEPPTGSPRERGGHWPATQGGQNAGYGSPIRGGCVHR

SEQ ID NO: 967386 - protein, 573 aa, Homo sapiens
LIDSILRESEPAPGSVTDPHGRQGPHGHRGPASLPPDTNIPTPAKVPSDIDMTWNKNETQEDTLDALMDNPTHEQKPSTHHCMSTRQRQYTAEETNKMPHRKRTIEQAPLRVTQKTTEPLRRAREQARIATSTRPHGPTEYIPQQRPTQSSITHKAKNQPPKQTQTTEETSKHTQERSNGTTHGHSKPMSSHNTTHNGHPQPETPNDDDNTHSAPQLCNTTAHSQHQNPTDTENAMQTRRHDRTHAGIPNRTYTAHRTSTGAHSPHQDEATTTKRTEHHRTARTQGRATGKARLPPQTGIKKQEHHPHIGPVPLPTRTRKRERRAYAHPPEPHARQQPHPHLPQQSETHDQYAQHHGTTRQDDTKHYHASTTKTANTGEQRHTNSTTKSHTTDQQNPQTTKTERRATRTHNEQESKEPTETGSTQKLKQQTKHNSTKERMRQQQQATQRETRSQSSRISTSRQRHQTQRKQTEQKGTAAARHHQTDKTPPRDAHAEHTRTATEHAPPSTPREEPDQRARAAPRPRHYRSAPESRRNESRESPTTNNRQAHKRQTAEQQTTPTEASDNKRDTTG

SEQ ID NO: 967387 - protein, 402 aa, Homo sapiens
TEPRHLPDPAALSTPCRQLTMDDDIACCSVVDNWHPCMCNGRLRCGRRCPPGPSSPSIVGPPVHQGVMVGMGQKDSYVGDEAQSKRGILTHEVPHRARHSSPTGDDTGRNIWHETFYNELRCGSRGAPPMLLDRGPPEPQGQTAQTMSQIMYETFNTPSHVRLLSSACAYSLLLPSGRTTGIVMDSGERGQPTLGPSTTGMPSPTAILQSGPGWTRTLTDNLMTDPHRAADYKLHNTAERNRCVTHHAESRPRTPRDPTHMMAHERHQHTRRRRNAPHRHGITAPPTEPRRESPPHTTGPQPGTPEEPSSPPTRRPAVRRHGSAERASAAHRVTTCAGGRGPCSTEGPEIRRDRSTRGHQELMNGRLAALINVFVLPLSRSSAIKATRQRQRRKRENSRPRG

SEQ ID NO: 967388 - protein, 425 aa, Homo sapiens
GVRGLGRLLLTLPLLRQTVGKVLAHFYGAMNALEVQGAHAQAVLGDALGHDGLSARGGTGWWFWQDLPSNAGHSPKGMAAESLGSGQCHSHAGRASAMPSAPGKRGPTTPLLTPPSGVSRSWGNVVCRLLVPQLLPHCEAHIRAPKSVAAALLEAHKGALHGIAVGVLSNSVIVRARDSGHGAPRSRPRMSECIWLTGLSPYAPYFISRSGDVGRRQTWPKMPPFDASSHPFAIWGIYVLPPLKSNNFQSRTPRRPWEPLGVGTWLSRKSGSPKKAFLQGGLDRSELPFLNCPRSMYYTKARITENSEGLSSPGKGSTTGTCGGPRPRGAPRKTPWVREKPRKTATHKRVNIWEGDERKTRSMERMNAVLLEDTARPIVKTEGAEPHNDTAHTKIDSRDRKTKKTTTARDARGTPAQTEGTDAIH

SEQ ID NO: 967389 - protein, 366 aa, Homo sapiens
MTTWCPPSSAPAQLTALPLCGSTAVFSFGADTSSVLLETTTHDRQQQGAAARMFMAAQHTSPIHDLGVLADPADGSRELLGSTVDTTRLQLPAPGAFSFGSRTEWEHSHLPTPSQGAIGQNALGTTGQSTPIAFNVGQHNWEQSLCLEAPTPPPYGQNTPAPGDGHIGQQPLLWGIFTQPPKAPSVSDRRIGGPYIAIWCGIQDPGLDSDCRPAGRHTQNSSTLSPCPCTRQPLPLNLDIGTYTQDAWPFTWIRTLTGTMELQRKGRSSWGHSPRGNHTHGRATRVSTSRAAMGRTKRKKEKGSEKAAARAREDKERNNDSRTVEEGREGQERKKETHKLRDTRHRAEGTGPEHQDIVLVERKEER

SEQ ID NO: 967390 - protein, 353 aa, Homo sapiens
MPKLDEDICLTHEHQVSPTNRRNDNPDSNSMFRANLEHNWIFLTQDVEPNLPQLQAHCHEKQNCNEYGTQQLPLNDRTTDTRTNDTDNGYTGTLDAATAPRLLRTTNTYDLYLLQKRLQRDQTTTPKDWLYAQQMPTGKAKTSTQHTQTANAPKTEHNPQDTQTGGTNRHTAQAQGEKAHNERDAATEGPTNNRWRSGKEITHTAGGTTLNETTTHSAHQQNKREHPPALTNNTSGATWRARAHNIKPNTNTTMRQKQKKRHNQAHTDRTHQKQNKQTNRYDKKGYKTTQKPDPANSKKTGEVGDETGTNFRTHEQSNKQINSKPGYNASYNPDTRRTKSTRAKDTAPDGQQQ

SEQ ID NO: 967391 - protein, 286 aa, Homo sapiens
SSHHRTVHRHRPTACSMLPQDWHAQTAQSLVLRQGPLAHTHCCPSHAPLLTTRPPRLRDGDPNAHTARRPPPYTRPSMPAPQQQRASHLPPNRLPAPHQPPRATANPKAPYTPATPPPPPPPETRSHLPPSPPAPPPPNAPAHPAPPPPTPPQHPTAPSPRPAPPPPQTPTPVPPPPPPHTADTPPHPRANDPRHPAPPAPKQLATTPPPRLPHPRPPTRPPPPPTHTPHPFNHHSTLTPRHLSLPLTLSPPSSQPPFTTSIPTPPPPHPLLPSLHPPTSPPPHPT

SEQ ID NO: 967392 - protein, 417 aa, Homo sapiens
LFGRSRQGMSEARTLPDADRQTRMEGSRNQQESLSPEGVHQGPWDHDTRLTPRYRESKPDTGCLQGLPSLGDELKDLCMTCHALSPGTNAPADYTLKHPWAYARPGLKGTLSPPPAAPSAHAAARFNTGQQKTMRTPCLLTRAPDSRHVESKGTRTELLLPRLSSLHTEATDLRLTRSWQRSTATAHRATPAASIPPTAPSTGPRSLVCTTHAHPPPELTAPRQPPAAPHSRATLAPGPKRQPQAAPPQRPWRHTPTHTGLAPLAPRHRRQHPAPQPETNYTPASNTAPASRDATWHELANLAGPRANNHHRTIPGAPPPAHTPADTTARRTTPSPEPTHKGFGSPPPTRAPLRPPDDRNHGHHAHAPHSPRTPPTAGPDTQRRQPTVPVHTGTTPPCTPPRAHHRPPPPTTPPHAM

SEQ ID NO: 967393 - protein, 199 aa, Homo sapiens
MHDEDLIHGDLTTSNMLLKPPVEQLNIVLIDFGLSYISRTSRRIKGVDLICPGEGFLSTIPTNEDTVLEAFLEELIPLLPKGQAVLKHFSCSAPERHTEVLVARTHRDEQPPPGDLPAQDIDSKDKHDMDLRHGAPHNATDHDTDKQTRPATRPQGTTPAPAKEATDGQLPTNDTQRRATKHPKTAANARPTPNPTSNP

SEQ ID NO: 967394 - protein, 151 aa, Homo sapiens
MRGPPRAVTRLGAHGDWNATRHGWQRQMETKQREGQRTNHTPKSTNEQPKGLPLKESTQTGGKARNSCRMTQESKTGRRPHWSTHRTTQAQRRRATTRRTHRGPTAKSTHNTRADNKDTKTKPATQHNHTTHTKKRHKEKQPECRSAALHQ

SEQ ID NO: 967395 - protein, 85 aa, Homo sapiens
CCQRRDASDSPIVINHGSTRAGRQGDRRARVSRKPYTIGQDISDSAQIVGGLVALELYLDERAIEALRQEFDMKTVHWPVSSNQV

SEQ ID NO: 967396 - protein, 439 aa, Homo sapiens
VSAIGYPRGHWLQVPQWPIISCALAHLWVAAHGSRGHVSCTVTGTVHCVATTIHHSWHKHSNPALSSCTHGIGSRSACMHCVVTTCRHATVACTLCTAASQVACIVRQAWVTPTCALKRLSADLTLDVGGTDIHIQVAQAHMHSVAHYVSSVLQSHLFISGLVRAMIGLYRPCYITKATIDGAPECHGAHHLQVQGDIEYPAVTPTLRRKAPVVLLNTTTNNIHAWDVHGRGALVDTADYIGDGSTARTQLALQPTDGAQVDSGRGGSIATCTYQIWSAQRRNDNWILKNNTQEQCQDTAKDTLQYTAPPDKGLTHSIVATTNAVAHKVRSVTSSKEAKVTHRAQSTDTTGPQPETEGDHKRGPKRDQETHRESVTTRPGTKQHMKHRQTETIEQTHRSEEQAQRRKPTTDRQTKATAKTQDTNQYHSARTYTTAVSRS

SEQ ID NO: 967397 - protein, 364 aa, Homo sapiens
MSQDLPTHCFEAATCLWLCSAVLSADKNTSQHPNVTTLAPISNVTVGAGDVPSRWSPLRHQKPVKVETAACPSVNVQRRFNHHLLSGISNVTQHAAAHRSHINSNQLSALSTVGHHDQTSGSDSTATPVPTGNSTAHTHSSDLPSTSSKHSYLHQVQQHHTTVTPTSHAVRTVYLLMQPVSLEAIDLDLRVCQAGTQARWHHSPAQLYTELTRATTSGHTDPSGTPTRHRLHPHDVTHCSTHTTYSGPQWIDGNAAEPKTYLEMQHRKYGSDTRRAHSHIPAATTATSAPPRAAARAAQQPKHHREHAPLAGPPPPRAPPTDDTTTRSSHSRRAAPPQREPDAAQPPHTAPPQRGSADTHPTTA

SEQ ID NO: 967398 - protein, 313 aa, Homo sapiens
MPHSMSIMYRFAIAIRSEHQIPRPSMRILLQSVQCQMANGGVQQAAVMATQESTRLVQPSYGVVCSLLGSDTGRCQTQLSSVPELERVLKAPRRTSEGEVQRSGELRFEGDEENWQICNCRQMGKIFDQDDAKSITVPGHGRWRRRGILKVSVECNYTLKVLCECELEDTLKSRILLSEEDAELCSPQATLGETQMAHVRYHRIKITRPKYIDEPMTNGLRTGCRSSTVAGADDDSNVADLTTADRTLSDARNGRDKRKNSTEDAEDNSGERATPGPVTPDTTRQHRPGAEGKEQRDDRQRREQASAHRSLTE

SEQ ID NO: 967399 - protein, 143 aa, Homo sapiens
MTRKLLPLTESTPAALATCGLLPCHSLRPRFPARAQRPPFVKGVAAVRQARFHSTPVSCGPQALVVSLPSIIRTVRAQRLPPLVPNAAVDAQTQHRARFRPWCLLPALGVAIPWRRTLSVRSPPPHTCPPVAASYLVVQTISL

SEQ ID NO: 967400 - protein, 235 aa, Homo sapiens
MRRCSRCVGAAQCGLQVDDACQDLAIGPFVGERTVGALSVRRCNTLWMSAECHPEGSVEKQARLWRNLVPHIRGNVGFVFTKEELSENHGTVLLARLRCHAGGSDAGDIAPCEVTCAMPRTTGLGREKDYLLSRLYGISHVKLSRGTIEILSDVQLIETGDKVGASEATLLNMLKISPFSFWAGHPAGVRQLAAIYKPEVLISPEENSAFSLPGGCRNVAGVCLQDGYPTGGSVP

SEQ ID NO: 967401 - protein, 394 aa, Homo sapiens
PESPEQTHRLPTALVTITPRGGASSCLQPAPVTITATMSKRGRDPADERMDTQEQRARHKDRRAHTTEPPLAPYTGTTRHLQKNTEHEHRPARHPQTVTSPEAKHVTPPTRQTAPATTQKTRGEKRSTTHRQMRKQPHPAAKPPRVDSTTANTPGPTRRRRQNAHARRRHSEPTPPTRRQRQKKRARRGGRESTEKGAPDERQEARRRTNTESRGNEGEELRRTIENKGKKKRSEDRAKRHAKKRERKKQRKEREKRKNGKERGGEGKRRKERKQGKVRDGRRKRDASNKERGQEEERRRKAQTRPDRNRKKTQRTHATRTKESHRTRYGQAEQDKRMRAKKAKEEEGRAGRNSAAKTPKKKGEPERQGKEEAQKRGGKQRRERKEGTDVKVGE

SEQ ID NO: 967402 - protein, 52 aa, Homo sapiens
MSALQAFAKLRPFRASQPPTAAHFGTEGGRYKGLWGRTPGKKKRNGLSDSNV

SEQ ID NO: 967403 - protein, 100 aa, Homo sapiens
THLMGARSLEQHGERSGSVTDDQCLVPYRTKYVRKDLKYGTFRVTNSQGPKTLVSLAVNEECELKIVDLGLARLTDDEMKGLRGALGGTGGPEIMLKWMR

SEQ ID NO: 967404 - protein, 325 aa, Homo sapiens
DSQELTLLQRGIMVIGHCQGSLAPSCQPVSIAFSILIALIAGKSLRQQLRHILIALLHACSRQHILHGGASHSRNRFHIPGHVSHRQQHRHLRSSPSEDPRPSKARLQPNNHLQPQQAAMVSIVGMCRRNPLRQSFGTRICTATHRQTTHSQCPIYYTDGQTWGTHSEETPCSAARSQSNLDETQGKPSGTPTRDRHTPPHKAGHAMQLFPSLGATGLYRIGSGIFEDDTPGPNPGTVLPPMHSTKPEPISFTHGSGTAGRVLSTQALGKSKGLLEQQEWMVIAGQGNKSQHYQVGNPSKLGKHAKELGPMITRLDVKHTEGIME

SEQ ID NO: 967405 - protein, 256 aa, Homo sapiens
GADVMVERVLRKPLCHPPPPGPLVRDVPWTCMCYAGASGEALLETLWLQFLVLELGGLEQAEAWASVSTDLLQLLLPMIELEVPIELALLLAVVQLDAGGERASHDEVEGLVEKIRFPMMFPEGGSLSCCSTVPVLEPVGPVPEEDSAGPGNSTLCPSICCARCMGLNLGVDIYEAPVLDLDHLEAFVSDSSWSAGGLHWSISQHGGFWSRYSSDYFHDPSEYQIDILTVLLKSNKPHSSSEDIWCLTVEYSRIQN

SEQ ID NO: 967406 - protein, 73 aa, Homo sapiens
PHVIPAPRAMHVCMEEVLARIHRAAAPPPCMPQDMQAHSEHDPIDHENVRHSIESHRRPYPHTARDRGMCKSL

SEQ ID NO: 967407 - protein, 190 aa, Homo sapiens
MAITLEAAARDTRDQFLEYFTTPIGPMSDQHPFDAGASGFAALITRIVQQKDLPLTRFQAVVASAVGRLADKSVLVCNNAIQLLARFIHRPIILSPEAIDDADLARTTCITGSTQKLPAHEGPEGELQQLLQCWTQRRSGKPCMPDVEVYPAADSTDFPRERRRSLSKIANTETTEDVNRTHHITCLAKS

SEQ ID NO: 967408 - protein, 79 aa, Homo sapiens
TIQPPDSQTLRIKKTLAKMVESQACKNLHGSNPSAGSKLVALQAHCPYRMDMAWHIQQWTSQDVNLVLRLFLHYVFTGC

SEQ ID NO: 967409 - protein, 74 aa, Homo sapiens
RHTILGKRFSNLLHANVKFHLAEHYTHAQQQSTYRKCTVFNYMLTGFNIFCSTGSTIEYYTKVGILQGEGMLSS

SEQ ID NO: 967410 - protein, 322 aa, Homo sapiens
MTRLGWNGQSHTMTNERMPEGNPCSTGGVVAHSRQASETAANTSAGSASKACRQQQGTQQGCTVAAQAVLQHSSRIGRPESVASMQQGSNGSPQGKEQAGKCCTGKWWQSAGRQQAQHKGGSGHIGEGNLSTSLLPPPWPPPPVKAKHLAAVEEQEASNLWWPCWWRPRCKKLEIKLRHFEELETIMDREREALEYQRQQLLADRQAFHMEQLKYAEMRARQQALPTDAPTAAAAPQNLPQAPGYPPKWLWAPQPWLVWLSLCSPVLCMGLQKLAFEKMEQVMEGHERTWNHNGETRSTAGQKQRTKEPEQEKEPRKQEAEN

SEQ ID NO: 967411 - protein, 231 aa, Homo sapiens
MGAHPTERYNSIQPGPDQECCRHNSRSGEKKEREERKERKTRRRKKERMKNTKKQYQKEQERHKKKQEKKKKTSEEKKEKEKKEKTREDNKKRKTTKQEKKRTKEKRQKKRKKKRRKRKKKTKKKDKQKTTKKKNEKKKKKKQKTKKKQTKKQKKKKKKKKHKEKKRKKKQKSKKTKKENEKQTRKHQERNEKSTTRKKNTTRNTQEKTQQNKTATQQQQTETRKKTKEQT

SEQ ID NO: 967412 - protein, 139 aa, Homo sapiens
IPPSPGAIKRKNIPHEYCIQGPTVCYTKMMNADMDAVDAENQVELEDKTRLMNQVLAHSNHTLASISSAQAVRMPVSRHSTHICTAHTIQHKTQVLRNQSYQQHHHVHALLDALFSHTNMQHKTAKQTKSRALHHPFVL

SEQ ID NO: 967413 - protein, 276 aa, Homo sapiens
MHRLLYILAQITGTGHIPAIASNLHALQQELRNTASTKQKQIPTVGTYRMMIQQSSNSNKDKLCHRIMRKMTIYSRDTARGKLTSHQIAAIHTATKDKPHLRSFLQNQGRERHERQQRRKEEARTTTRNRTRSTTEHDDNCDRTAQDTPPGNAIKQPPAENQHSRNGTQLTDDPTDHQRHNAANASPQCAHHDQADMDTETSSVKEHIRQQTNCQEMRELTKTDQTSTHRQHKRRKENNTSNYKSERTSQNSTTATPSGTKNINETKPAKNSTHTH

SEQ ID NO: 967414 - protein, 520 aa, Homo sapiens
SYTEVSGGNESVSRCNVASYISLFCIIYSSFGSSTATLGKQHRHSSHHFLFSCEQNRLKQLHSIIISTTVNPASKVSTMCIWFKQSHKFKTVKQLHHNAQFTTVSIQHNFHHHLLDQIIILHNVVMRHSSHRHNINSCAANQQAHYINSRSKASKPQHSQNMPSFRVFSQTCGVFAAKKRHRQHHSKNFNFKTSKPKTKHRGHPLVYSASATNSKISPSKSLIRDSLGENLRHVPSSALIVHPHIFKLQYNVSNEASKQFHGFAAGNMAKQHNQHTNSTLGEFTLNKKSIAFYKLKSQSTFKDLNQRNITPRSTYTEQYDHGIARWRGSKQGQPNKRDERQRLDTLKLRRTTKNKANTENSSSKAKTTEIGTKHSRKNPMTMGDKRQEQKDKYDQTTYEMNTKRLIEADEEARTETVIETPRGNDRQLLQHREHDVHALAHTEQQSHTVEEQTNCQELDHDHTNCQYTPRGNTTQRGKSRKNNEKQRRDRTTQGRARRKQMNRSVNAMKDTHTERRSGHN

SEQ ID NO: 967415 - protein, 420 aa, Homo sapiens
PVCASPRSSPGPFTMHMQQQCMACNAVDAAAQGTIHGAGPCALLLPDEALTLAVGTARFSVLLAAWYSLLPPRPGRTWVHCTGWTRLATGLWPLTCQRLGGTPRKTAAPAPIRGARPLDSFLGRLVVDALRARGPPASVIPVHSHELALVLHMPLTITGPLGITKTTTGHLCEPSETTQLLQLAHNIKMLAHTYCQVGEQNSQLLTSTHGRPGTPMGSRASLMQATMTASMPQTHPGEAMDTPDTRPEGNPHDQHLGTQTTTDVGPNQAHARNYPPRTRAAPTMNDTQHTYLRTWTDSRTSPFPSPHETHLSIWYTRHIYNTNTPRRSIATTEPCHPRTPPGHHSAGPPRPKQPAHKRHHAHPTLLGRTAQPRRHPPTNNAPHTHPHQTGPQPSTHAHPTEPKHPLDEPTTPTTTHKQPA

SEQ ID NO: 967416 - protein, 364 aa, Homo sapiens
MQNELIIFTVFLQCKVCLKYVQARMYINLYQSMCDFIDQSYILSKFCPFRLTFIIDVNHSMQRVLYTQPYGWYEPYLHTLGASMRTSLIAFLRTYENHDNTTLVNWYSELPVQAHYINTKLSNHGAKSSNIRNTTNYHFVAYQHGKAPCALWRTTHNGEIRESIIQAYTNNNFLKNMRILHDTHNCRSTTMIRLRKTTGPWPQVRLIQPRHNLATQRRKHNHTSTRNHHKHTTTPTPTKENQQEKHDQNRPASTPRTHHRSQPTSSTQRHMDNRKNSPDQQKQTSGGAKKGDSDGQQPTKDREPHAESPDKQGARATNSEATANEQNNDEKTKRLQTNHGSHKPPQTEEDRLKTPTKHKKKSRA

SEQ ID NO: 967417 - protein, 246 aa, Homo sapiens
MLEGSTLLKSHHHSLISSTQGHKNCGRPQGPLPRKARYVCLRELQMAQEAAGALKEFLGKYHIREKIGSEQRPPDTELLLMTRCLQVSFIVSFLCSATLSVYQATPPDKTIYSEKTEANYKIQQVPHVDYIVPPTGLGGKAPSKIHGRDTAKRREPTVHHPNQAHGQQAKQRIRSHTWTQQPEVAKQKQSPRDSPPSNMMCPGRKTVWCNPTRRVCCQFCPVHHHNHCLLLYHFYQLSPWQRSKRT

SEQ ID NO: 967418 - protein, 106 aa, Homo sapiens
MLHWAYLCTQHTSEVCSSQCINTCISEVTAHFSGHITQDKLWHTGSIRDIKFHISIPEADITSGLRGGEINTCTRLYTISSHTPYLYAQDRPRSLCGKTHVVSIFS

SEQ ID NO: 967419 - protein, 170 aa, Homo sapiens
KVCNQNLHAMQMQAGIHFGTSEWHWLICENKTVMPYISTTPAKLRNPCTSEQNCTSPIIAHKNVLTLTNKGEVIQCNLSGTTSAIILANLAFSQTGGYRCPSCTVAVCGSLIGWRNVTRLLVFSTRCRVSLSLEHGQNLVRIAITQMHAPNADLGTHQSCTTHAANSFID

SEQ ID NO: 967420 - protein, 288 aa, Homo sapiens
MSAESVLYECIGYSHISWIINILSYTIGGEPGMRTRLEPLRHASGDRSKRYFATHGQQGPELWHLHPSRGSNGVTRLAPIAHMVAGSTEEMAHQYQRTRNRCPGPGVEPPGLPKTFTYNLCIGTPKWALFSRIVLAGGNFRQHEEVKHTRVACFTPRTHGNHECAFLHFMRGNHKRCVWVGGPSVHKLRTCSPSAGWTARLPPPGALCGLLGILVFGSQGQPVSLDCLRGWLVTPTCGLLFLTDVILSPRQYPHWIPFLGANGSRGGRQEGEAHLPTWGVWGAPPKRI

SEQ ID NO: 967421 - protein, 97 aa, Homo sapiens
STSPPHPTSPHDETSAHSLALSTDPPKINATRTITQPSATYIDQDASNRTFHLIAHDHSETEIMVCTHSVYLQRQLEPLIFLYAGARIATNNRDESL

SEQ ID NO: 967422 - protein, 239 aa, Homo sapiens
GLGSILSSMEKPPSLGEQETRRNGPMNEAARPEMKLQEHEKEQKVEFRKRMEKEVSDFIQDSGQIKKKFQPMSKIERSIHTMMWWKWPGADSPSPLGKSDDCRYVMIFTTKEFAPSDEELDSYRRGEEWDPQKAEEKGKVEGSVAQRQEEEAAQQGPVVVMPCQRVQGLVQPPHRQWSRRKTQPHATGPIRSTVCAVANKEGHTLHLNEADELKIRAKKASAAEGERVGAKLLMAPPVL

SEQ ID NO: 967423 - protein, 137 aa, Homo sapiens
MARVSAECSLFAAEVGPAGQLLVTSTVYQRYRHIAAMHCVVESNFYQVTTTIQVNPARRLGQIWTRYRTLIESVAPCNYRQCCAGDQTRAIYAWRDLVYRPVIIAYIRASLSAYSGEGRERGYPVRTVIPSPLARAT

SEQ ID NO: 967424 - protein, 312 aa, Homo sapiens
MISVCSERTLKWAPGPPTAPSFLRALTKGGVSLSPSPQWPARSNRCLRAPPRRSPRTCSGPLRHKTYDVLAPGRKEIGLVCSQVGRQDGSWAMLLPPSFTGTYNRSGAPGNYPSGPLKQFAELGPFIDTLTVWPEVKLRLLVMGYSHPRRAAGSVRQIVGQGTVRTNRGNSVRVHILYEKGRTVSMRMIGVLAILVRDQHYESGTPPKQGRRGTTRPVGGVRNQRKITERQRRKNREGVFLQEECARDNERGQAQLMIMSPETFRNAAPTGRRKKTQSKRQGTERGFTRKRDKGTRDTAQSGAGARVTKIAV

SEQ ID NO: 967425 - protein, 350 aa, Homo sapiens
GHQASHIAQTSWKKSDGRSQEDRGRMGRLVTTSAVNSGKVDMVASNDPFIELKDNGVIDVSKYEFHATGEEFHLKCGDQSRGLRTGSCVFAHVRIAMRPVLPGVEIPPIIKWGDAGAEYVCCESTVIFRHQWKKRSGLHYCHAVWTPKRVIISCLASCCMPPMFRQLGCEPYVRSMRKRLKIDRADLPRCDHLNCLVHPGKVIHDNFGIVEGLIDHSHAITAPRRTVDGPPGNCGVMARGLQNIILAFYGAARLLGKVIPDLKREAHCHGLRGPQLQVSVVDLNLAFTENCNLMTQSGARLKAPQGFGDRASAPDSRHISIYGVTHLSVFVMSTGLQQTTTRNGPPPQRI

SEQ ID NO: 967426 - protein, 250 aa, Homo sapiens
PCSHHTTPTEPSLRLFSGSQSGHRRRPGHRHPPAAMSTRSRDPSYLLPQGCIEAARDTVSRPSSSRSLRDYVQPEPTAWAARCAPRTSRSLYPLVPPGQGVVLHNDGSPLPGAALQKDHAWPGGQQETHLAQDLRRGLLPRTGAREPIHIPVSFNETTPGKPTEKGDTRATEASTRDPAYASPTHTLGTTGAAYPGHRSRTYEFRGLGRTRRSQASTRPTAQDSPPRGATIIPSAPKHASTRPPDKLAPS

SEQ ID NO: 967427 - protein, 204 aa, Homo sapiens
MPVEPSSSDEMRKRSQESCAKTVCVVTFQVRGTSRELWSEIIIPSMSLHRLLHRYRIGARSIGTILDKNQIKRTCALTTVSNVQDKLAGLHRSWYDCVALTSLTLPGRGAYHWVPPRNKRVERGRSRMRSTMSLEQQRPWQLGRTSPPSVGLMETSLEIPSATRCDKEPQLQDTRLETEQIRGCPEEDNTEWTVSHWQMAILTD

SEQ ID NO: 967428 - protein, 94 aa, Homo sapiens
VKPMCVETRLRLSSFARSLGCALGYETDELRWVSIKAVDKKAAGTGSVTKSAQKAQKATDSVMPNYSAMPTSYLMAGGYNGSQNLCCVKLDIYV

SEQ ID NO: 967429 - protein, 134 aa, Homo sapiens
MLPHWKRHLAISIINLPSTLISLHNSNSTDDPRNRWRVNPGYVFTLLVSLYGREPLKQTHREIQQHTRATHKEGARAKNSGRRPLWTPVFVKGPKERLKAETRVKHSEKRARTGGHMGDHGARETRGKMGGPTR

SEQ ID NO: 967430 - protein, 111 aa, Homo sapiens
FLAALYGPAEPYRSHLRRICEGLGRMLDEGSPEPRRRPSAPLAPGALLLGAGGVRGFFSTSFLPNRTPAKLPDMGLEPWFTCDDGLLRHLVAAGFKTPMVTFSSLAPVPWA

SEQ ID NO: 967431 - protein, 150 aa, Homo sapiens
ERAAADEIAVDRDVPWGVDSLITLAFQDQRYSVQTADHRFLRHTGALVGAAPELGPLATRLEFRSGKVAFRDCEGVTWRRRGPAARSRRARPPVRQRDRMLLVLWTQKLAAQGISAGRRPTRGTCPRARYGPVCQSGRGDRTSENLSQAW

SEQ ID NO: 967432 - protein, 117 aa, Homo sapiens
MCLATTYRESKSETRRECKSTYRQCADERSPSHPGLQNQRTPSDLLLFLLSLMTLNSYSQQTLLGDQTIVPLVRALCNEPASTIKPNDIALFGYTIRRIRSLNKLRRASLPYYIILI

SEQ ID NO: 967433 - protein, 96 aa, Homo sapiens
ADAWGRNARRRESEKSLENETLNKEEDCHSPSFYNLPNPDQPLKGKCQARSTKGRNCLWCKRSFYPLRARISDALDTSSPAYKWWGGKSTLQLQAI

SEQ ID NO: 967434 - protein, 121 aa, Homo sapiens
QWADRITFEIIIVFEPEMNVVPQSYYQKNRIQKRSDAVILRSSATMVPLKVDLKCWNDRKYATGQSTYDVDVWTVIVNSVCTTSTSEVSQDVASYTYVVEAMYCKVVEAKVLALQWVIRKV

SEQ ID NO: 967435 - protein, 141 aa, Homo sapiens
MVGDQESATECVTKLSCSNHLVLIVGWRWTVVPYPSVADVDQWKRREKLVDKHMVKERGLASNFVIEPNTSGEQGNEEVDREQRMEDVKKIKAAKVMYCISRQDCCVCHSLCDRNMVLTSEERGEDKAYRDWRMRKSKEEG

SEQ ID NO: 967436 - protein, 246 aa, Homo sapiens
AGCKSMWSGAWTLAAKRHVGLADVHAPERAAHQPPAGATIFALSSGQGRCGIAVIRIHAAPAAVHALRILTAPRELHLARACQPAPGSSCFPCFRGSLWTAHWCSGLPRSPEFQPVRTGVEFHCDGGPVSGERSSCRPLGSVPGLLTVRRQAEYTRTGRSPLAKLKPDRSWSGLGGPYPRCESRGAAVRARPRPGSLGRRSLGAPLPWLGPRPVTKGFWPGWRAYSRFRRRLTTWMDGVPWWQRIV

SEQ ID NO: 967437 - protein, 91 aa, Homo sapiens
MAYRYELRLSARPAPGAPLCVCRGHASATHHPFVGEESAPWPSRSLSRLCRFRRVSTLSRVLLPAWVFPFKSARGFFHGNSFVRGWTFCVA

SEQ ID NO: 967438 - protein, 224 aa, Homo sapiens
CISKADLCTEALKLRLNLVGGMYDTVQRSTQQTTEWAMLLLEIIIERHCRHAVANNELFTDCVGTCWAVLINGHIGCKYMSSDLSKVACEDNQACILEPWRSNLQKELGGSGQSDSLAKEFASVACHMTKQNLRCHQRCEATGHPVIDTKANKKIAGFESPSFNDGRALQVSTKQKISSLGIFTEGLDSRQHHFSWSWFGNSPEMDRRSGSSKREQHAGRCSTH

SEQ ID NO: 967439 - protein, 142 aa, Homo sapiens
MLRTLETAIKTKGVAEVTIVNILDQPQQCTETGLLPSPTREGPHRHLHQHCIVSLIWPPGDGASRAYRMTPAQHDASELTASMKGLGTGEDSLLAIFCSRSLPGSSRFFPCPPRLASPPPRPRPSPAPLPSAPLVAVTGAPG

SEQ ID NO: 967440 - protein, 398 aa, Homo sapiens
MKPGKVVLDLAGRYSGTQSCHREEHCMMAPHASPLQPMPLAGLHIDPLPPPTADRPPTGATPQTPLAQHHSLRLTHSSPVKRCYYTYNLTPTLAPHRLPPASRLSPPRAPPHLLRLNSPACSPSATTPVPSPPPALRPRPAPPAPPRLPPSRNPRSPHPPHYAPPPTPTVRLPSPPPPPCRRSLPALAPLLPLHSILPPTLLRQAARASGGQPLKPPAAPAPTSPAHTAPSRVRAAPPPPPLCTRPTLPPSHTRMPTHHPHSPHTTHNTPTRTLYLPTHQHLSTSNTQIHKRITSYRSPVTYTTPSPLPPPLYHTSTFHGRARAQTRAAHLNITPPLPPPNPTNQHTTSTTPQHPIHSTHSHHHPPPTQPPPHPPPPNTNTPHHHHQPPPPPPPPLTS

SEQ ID NO: 967441 - protein, 116 aa, Homo sapiens
MPERKRKSTFEGLYWVLIRNDKNLTGRLCYYGESQNSTISLSATVAHSNAHSNNFTEPQPGTSPIYQANAMRTSQHSLRTGFIGAPIVAPCAFSRQVEQDPLHGRKGGIVGLGRMH

SEQ ID NO: 967442 - protein, 130 aa, Homo sapiens
MRLAYSYTAYSAIYRSTYSSTRVYHAIAHGQLRTSCDYRHTHMAQYVPPYEPPSTDTYPPHPIVYPASYLEDMHTSYLWHTRHPLTSRVIADSRPYNAASLPATVIGTSYYSLHLNVPYSTLSRARLTVP

SEQ ID NO: 967443 - protein, 218 aa, Homo sapiens
RNIQNVYMQLTTHLCTHNKKNPIPISTAPTYYTYKPTSIILFYNTQTTHYTNNIKVYITTQSTYDRPTQLNITPPTHTTMERTRMRSPTHQTNHHHYMESGQRTTRTAHLRGDRRHTATHKREGADASIRTPTLATCTPRANKPSILHPYIHKRHPPISQHYNPNTHPLPNNTPTTPTHPPKQTLSTHLTLNSHPQNTQPTHSPHPHLTPNTPITHYL

SEQ ID NO: 967444 - protein, 348 aa, Homo sapiens
PGRGGGSGTGNTLSSVAGNWRGSSYRGGETWNGHTIKVKFKAYEDWMMIQHHRRSKRPSTLWQLVAQFRYLIATLDICTFQKCTSNTIHPAKPGASTGYYREQLPTEQDATAATSTEATTLTCTAPICLHQASFPVETNCGHLHTSVTLLLPAIQSEDDQTQDVPETASRISMYTKRSIPQGPPQNSTHARATHGTYPTLLSSMQPRPHTTTTRARLNCDRYPAITAILPLDPTCRSILNITTIITYQNSDTLKAHAQEPSREYLTNHTNSTLTSNRTTSLTISQRRGSPPPARISTNRAQLATRNTGSPRPSHTLGNIAEPSEANPHNEEQDTTTTTANHQSDDNTT

SEQ ID NO: 967445 - protein, 187 aa, Homo sapiens
MTDCTWRISAFLCDCQQVSLAFRSCHDLHMPPLSYQLMSILRSFSFCTWRVRSVLSYVSLCRPLRGVGPLCGFCASGSPSGLLLCVSSICVGLRVLVCVRGSGMFVFVSPCVVSLCLPVSPASFLSPAVFPLAPGGFTPPSVPLTRFARPTSFWGSSGVAPRCRVCFLACLCVRPVLPPRPPRPPPR

SEQ ID NO: 967446 - protein, 88 aa, Homo sapiens
MASLHAGIVSMTHPDPYLIHVSPTSCTHGSRVLSAPWSCRSDKDVALPNRTGSNLAIPNRAENNHEPICTPFLSRHIPARSQSLPYRL

SEQ ID NO: 967447 - protein, 328 aa, Homo sapiens
VKKAEAGAVGPSETGDAHIIGRIESYSCKMAGDDTHMFKQFCQEVPCPTVSGVHYSPPPDFSDLMPHARLMPPHAQVPVCSDVTWPPLARPPHDPPLSSRLTCPPVSNLTSSLSCLLHLTLPSHVPYVPLPCPSWMVSMLLRDCSHGSFYCLAGFGSITCPPLHTSCPWSFALPLWPFARPGCTVGALAIVLSPSLRPNPIHRPSLAALSPELCVPGRRQELRSLRCVPSVTLGLHPLLPLRHGASRSPPAHRPRSGAPLFWGIFPPISRRRVTLHLACRGRRSVAPSPDSAPPFNPLNLYNRLTIQSQHGPAAPVTKHARKKIPRPH

SEQ ID NO: 967448 - protein, 467 aa, Homo sapiens
MIHALIIIFLICFLAPVCPFPNTHNKHKHNTNISRRSGNRTRLQLSCPPIILAPHRPPTPYALLYHNSSDVTRSLPYHSLSHSRTPTPTATYHLHRTTPAHLTPSNLPTLPPPHSLPSHPHARTLPHIPCTLHHLAVLPPRHDTPPLSLLPHLPSPPHPSSPPSMHPRPLTHSPPPHHTLPTPAPLSPHKPPSTRLHPPRHPYYSPAPHRSATITVPTHPTTSHLLPRSLSLHYPLTPTSLANIPHPLLSPLTPPPTHTTTPSSSEPPLLTPLPPPPPNTARPARRPQPYTLPRAPPPITLHLHTLPPTARTTPPPTQPTNTTTPTRHNTHPLLPPHTCTYTPNSWPLPLSPPLLPSPHHHNSTRPPPLSHQFPSHYPSPLLSPYPHSPLLHPLPPSFLPLFHSPHPLPTPPPHHTPTPHPHTTTPSHTHSPTHPTPLPPPPPPHHLTLTPPPSHPPYPSHSPLPLP

SEQ ID NO: 967449 - protein, 249 aa, Homo sapiens
MWADLHMLAQCMLQWLDPGHQCPGPLSCSHMTGCSILGSWTRTATFFGCPLEEQQPQKDGGTDGSWYPGSVQDDARAGGRMSRTTERQGWSPAPGRSMEPRPQNTRKKPRTTRDAGAQTLEEDRAQEHPRGWRTPAPRGGRPNTQSNKFNGRPPVTTRGAQNKDQTAEILDRLWPPPQNPSPPDRYPRAMPGRHEVTTEITTDLRVPIRAPREESWLGAIHTEPGALETGSPLNREITTGKPIARGSVT

SEQ ID NO: 967450 - protein, 116 aa, Homo sapiens
MASRLVLKTAPRCLILGLGTWESPPGEVPEAVNGGPLTSGTASIDCAHVYQNENEVGWWPFMEKLQCSQCGEAVRSSIIVSKLWCTYHENGPGEQEPAKKTLSELKLDYWTLPYSL

SEQ ID NO: 967451 - protein, 389 aa, Homo sapiens
MSGANVTTRKHIPRSSTHHLFQKGHSIRDKSYLLTVRSFGIFGRIFLRPFTTSRPSRLTRRIEEEHWNHATGINPLNPLRSPTPKHIRITRITELINQLTLTIVYIENNRNEDNSSTGYYQVHWVSIFTLLQASEYFESPFTMFRRASNGSTSTEPQAYHGPPRHTMAQSVLTICFIRQLIYTFTPNITLGFQGQPPEYWALSAHMCVGQLLAMIITLSTRGATSTHDHKTHRSTNPTAPPPHTHDATTRDTTRQQGSKEQQTARRMPQQRPTQSRHINTTTQAQAYRPQTRRRKQNTDRSTREHTQKLSESRNEHTAHQQKTHAENTTTDADRSDHPANARAAKSMAQNTSRERRNKNESEDSEANEDRNRDETTARKRTEQDKNSTP

SEQ ID NO: 967452 - protein, 255 aa, Homo sapiens
MRWVDHNASPVDPGSGTRDQKLSESDDRCMTPLAGSALLNLNASAAKSDAGTLWLAPQLQECGAIGHYLFMSPLHTSLIIRWVVSFIEEPARTSQLLSQTHLLQKTLDFTPWLIMIKLTYVSLPNNISSVLTVTARRYIGHVPFVITMHLQIRRRPVQFCQGTNRHPRLRRLTGTHVQNANLRYASHSGPGPKTRARQRTTTRTGKSQSRHKNKPATDKARHKTQNPDNNATRTRTDGAAPKADKTRTNRPDSLT

SEQ ID NO: 967453 - protein, 291 aa, Homo sapiens
ALKMAAAVGLVAPSVGCPRCEVPFLGAILATEVLRLLHVSREQSLTNLYVCLGYLVEAKLFSIRVPQCHAPAVTLAMHPDFRGVQACPNGQSKDLSLGDFSGEILVLIFYPGIISLCGVLQMDVACYVTKLSEFQDVNCEVVQQSQWIPILAILTDIVHQERMVVRGNEIVVLSDLIKQIPETTVCLGEGAGLPKRSRSYLTPMESTALRVRQIVTVGRGWKEPRLGWVRMDQPWETREEGHRSYEQPIVAKAARNQSAGLLTGRQGRHKGEEHPNKRGGNKESRDKTIPK

SEQ ID NO: 967454 - protein, 279 aa, Homo sapiens
ACLCSQHGCLCSLMGKDSAVHSPLPSTRATPGPDTYPACERTPGNERPPRRNGTTVLGPDDNMALDAPRTRALSGSHTTPHDTHSNNPPCQHPLTPVPHLRPNHTLTPHTAVAPMRAQRRATPPRKLNTKHSHHNTPCPHGPPTLPHPTHTPPAATPPLPTPHHSHTAPRAPPHAHPRPPRTQHTPTHEQAINPHTRPNSEPPPPPPSTPTHPHTSPDTAQHPPQQTTNIARPQHHTKTHQHHLTEQPTHKHTVHPTNNPPTTSHEHTDTGHPPPTHPH

SEQ ID NO: 967455 - protein, 162 aa, Homo sapiens
MLVGHTVLGATLQRLATHTPRSGSNEISRELQSMATIGNTNGEPLRAETLGASRIIEGQTAYRENRRTHRRPCSTNTMYKGTLRGRAELGRGTPKTSERTTLRKTAATRRYNNHEATQKDKRRSQRVNATPIPARGQHRQQHMQNDTTTEAGNTAETTQHEE

SEQ ID NO: 967456 - protein, 190 aa, Homo sapiens
MRHWTNKTGPLTSEMQEFRTILEHEVADAVPADIHSTKLLQHFPPRTLRCLHNGLSDCQAVKGHQTGTHGHRDVPPPLPAVSHARPQAANHPNTGPLRTLPPYGIHQFTHHPAPCHLHCNPLPTSSPDRTIEITPLPQAHTGNITRAAARPQPQHAHTEGDQNSTAPTPPAATAQTSTPTYTTRATPPPT

SEQ ID NO: 967457 - protein, 117 aa, Homo sapiens
MPDKYNPEDSDMLDWALEDMGDKSCVVNCCVEVQEKVPSSCDGVYTQKEETERDGISMWALLIIQWKKRNLNGDFVMLKIRLSRSKLSVNKNVQQLCCAFKLLSGLYTVVYCKTVGV

SEQ ID NO: 967458 - protein, 141 aa, Homo sapiens
LGSDEDDIDEDGPSTSFGSILAQARLHSMEHACKHWASTACIAEAALALAQAHSYQSIACMHSINPWLHAVIEHHFNSSSFETSFQNRSIHVVVIEGTDYTVLNATEPQGQTQSTRGTIRHTRALASNRTAASPMKSQKCI

SEQ ID NO: 967459 - protein, 414 aa, Homo sapiens
AAKGPNPSYSPSLTERKPTRRPARVTTVKKSSVRLSRDRIKEGLDVQWRDFWLTGNLPTISEVHSDISHAFKPSQIACGFTTIIGTCGFPGRCALCSTNCWPMHSPTGGRPQQQSLRTAHLTRITLAIDALAVSDRLTFSLHPIPSNSYHLALCMVCTTPQQWPLTRPTLIPRYHQIGDFLAISQTPRTCMTGDAEHWATLRVTTPHSLTGSLPSSQLHCDRYACTTTRGPLTRHHLRRAHLRRHLAEHRTHTTAPQDPRSTSAHHGAAGTRAEHAGLTTDTATTTIDTTSAQQQGKHKRRNKGQRTGRTTTLAAKKTGGSLHNRHQQNTASYRQNTHHAPAHTATPKRKRTATNSNKQLKREKRRQRSSKRDKAKTTQAEPATRDNHKNRRANTHQPNNTSNHHPPHSTTNKP

SEQ ID NO: 967460 - protein, 273 aa, Homo sapiens
PITDLEDRPILKIGEEHLKTLMRTNNGTTNKLHEYMTIDEYRTLERNTDKDEKRIKPTDNNTARPEQGSPPRTNTQDTRHKRAAHTRARQRNKKRKTHKTNNNHKRSKKQQNKKKKNRRTTQPYKQHRRKTHNKKRENNGSTKNQTANQTDTKDETEKKYTETQSKTTSNNHTTDAHEEEAKHSDKEANATHATENNTERVARGRANERRQKREHNGANASERRAKKRETTTTTTKGKNKNKGKPKTQVKEYEAKRVKAEPTTTKKKQTYKKR

SEQ ID NO: 967461 - protein, 52 aa, Homo sapiens
MARLEKVRHASRSYSPVCQCPFYVNCRNGSTLLGDKVSDWSGQNDRKGASLV

SEQ ID NO: 967462 - protein, 178 aa, Homo sapiens
MGSGYLHGHAYGEADMTDRRPGYFYLTQDRLCSYLRDRRPHRTERMNMLSLAQHQLTIRYGGYIDAEIQNLLEPSWRSCSRGAQQIPVIPGGTFSLGNSLSGRIRVPVVRAGSPFSNGTKREGTAFVGKGVPFRAPRPRAGPRIKKDGREREEQQQARPWEEISAGTGETSQSGGGEP

SEQ ID NO: 967463 - protein, 95 aa, Homo sapiens
HLRLRQLEAYRAVSFCLTELKQFSWLTAHVVGKRKYKMRLAVNCLGIMYCSSNQGGLLNKCGNKALQQVKICHTTLEMVARIAVRDPTYTVALIT

SEQ ID NO: 967464 - protein, 82 aa, Homo sapiens
PRDKALQDTEEVVEHKEIDGVFKELREQLTELTKQYEKSENDLKALRSVGQIVGEVLKPVNDRKIHVKATNGPRYVGVSVER

SEQ ID NO: 967465 - protein, 129 aa, Homo sapiens
MNWSLEVDLDLQAYYLGNSSRPMAIAYEAINLGVAPSTHLQYMYSTNYFGGPHFRGKLDPCANSQRKNYPGDRDPTIDKERCDNSYDERYIENTLTGNTTDCCTWTKRIRYLTGMDDKVKHNAWHTGST

SEQ ID NO: 967466 - protein, 73 aa, Homo sapiens
FNMRYRKSVISVFGAHLSWTRGIDVVRRMCTGVFQNFGKIYMVIKHFKKKRQSSQEVKGGGPKSHFRGTGKLG

SEQ ID NO: 967467 - protein, 101 aa, Homo sapiens
GGEHAAVLVDGERSHSGLVRGGWGCEGKVAKELGGGLLTDGFTKTKFNRNSGEYSGLRQIACRFAESDSKCGTKTAKCEENSSRTLQQALQQYFNLRVKFK

SEQ ID NO: 967468 - protein, 335 aa, Homo sapiens
VAGDLSSVRDVILSLGLPRLYVGGVPHVRDAQIRCDGGHVTLLGSTDSMVGKFCVKITWAENRLIMFKVELMMSIDVQVSLSRSGAVYGAVGMDVWGTCRWQVAVCYVEQGKFKVTGGENVAYIVMDTHREVLLVGLEDRQQARWIGQGLKCGSGQDDYKLVRILGCGGRHDAGSGNDEDGVRDCEILNVLVWDRGHDTGKAGSHKIELEMAYLVVLTRVGDAGRTSCRMQTHGGRHIGGPGTAEATPREVKHQQAATPHGNSKRTEGTKHLQNPTQETPEPAPRPRQNDRQTSVTHKTTEGKTRKDDHAHKHKKKARHSLRKERSQAYLRPRSA

SEQ ID NO: 967469 - protein, 353 aa, Homo sapiens
LRGRSLEQRSFISVRLLSYLSACRHPMRRFDWTLAHCSPLEAPEPIFFGCELNAPTNTHYSLLTRWHNCLTTLSHHVTLLTTRLSSPRGPWPAHSAPEPPPTLRSATPTHAPTPAHLSPHTGHAPKLYTAYTNLAHTFFSHPICLPAYPTAPPPRLFPPSGTAPPPLHHTSPPPPPPQLALPFHPRFAHAKPADSQTQDPTHTPHSLQNAAHHSPPIQPLTTLPAERATPHLPHNPPPDTRTRTPHTTRSTATPAPATNPPHTNPPYLNSLGPHHTTRNSTWPTPPLCDTRAIVCLHPPHKAALSPPTTTTNTITHHSYRKHPLRTPPPPSILTNPRTLETLHPHNHAPPAHL

SEQ ID NO: 967470 - protein, 70 aa, Homo sapiens
QRCMRNYIKCRKAGLEDMTPGPLYVLQKVAYTKLNMPWKLVDMQAPVAGNFSKLMVCSIGSGETQHPRAS

SEQ ID NO: 967471 - protein, 97 aa, Homo sapiens
VSGCVVASRNTGSACSMGDHLTVMEQYDTNVKEGLFHVISDERVGDWEAYYTNKGIGKPVSEIVWGRNPTEAELQDMSLVKVDADWVMAQVTSLKFS

SEQ ID NO: 967472 - protein, 197 aa, Homo sapiens
MSGPSTRTDRNLARCLGFLDFLAFRTTWLDLGVTKTGRRQNVDEGDYVVMIMLLQDARWANIRHFYKRPESWLGHLCLGKEGWMAYGEWASRMTSGWLQTTRSISGLDVVLNEEDIGVSPKEDPDGYTNVSTSIQSRVACSAFFVADAEPGTWFKVKSQMPEKKGYDSGSWRRLNLRIVDLGIGRTYFLGQWLGVEE

SEQ ID NO: 967473 - protein, 158 aa, Homo sapiens
TTSKHQTNTQKHKNKQTQTTAHKTNRESNTRREHTTFEGEKARRPRRRTEMRARKRTYAPYTHREATQHETAFDTLIRERTSSTMQTQKRTQEDHTRSKKRHNTATRTGRATMNETTAETRSSTDAESEDRRHGQKRRTSTSRTLAQMENSIREQKEE

SEQ ID NO: 967474 - protein, 119 aa, Homo sapiens
MTLSQALRSVADTAKPVEYDNNTNGSLPTSPSADKWSWPGRSEDFWGVTARGSCLPGPRVMTLYEKRSVRMVRVGVPDVCLAACWLFGCTGPGFHPPWQPYIVLALLSFLLTILPSVMY

SEQ ID NO: 967475 - protein, 356 aa, Homo sapiens
LKQPTHDYGKVFFLLTAELLWMMLTTPANWRDSGRRIGVVRKATRQQSPAGSNKADTITHSAELALLMEADPIHLRLRTSYTFSPPEAVLTPTHDCSYHRELTGDLLERRADYCTTAAGSTPTLGHSLWDGQHKRRTCLPATGRRALKASKLVLLLRPNKCTNYWPYEPFDTPGAGRTSGNGRDHDSVLSFIYTYDRSDHYAHERLLTPNCWKDTAPSEWPLGALPAQRRMNGENFFSRNSFKSRRHLRTLANRPGTWSGPTSAKRPPKAREHSSLEPWIQLSQIPCNKLSTQQTTAGRPLALMDPRARPGGPRNPTRHGTHNNTRHRAHAIPLPNPPPNPCHVRAHDKVANHNYA

SEQ ID NO: 967476 - protein, 80 aa, Homo sapiens
RRLVEPTRSGTYKYRSAIEKIDDWWSVPLSHTLQDDTCHIKTIRLRDRPGLYHRRYPIDNELTDVTSRQWTESSSSVVLM

SEQ ID NO: 967477 - protein, 102 aa, Homo sapiens
MNSAKIERKNKHSTFMMKSGVERTMKLVTLYKHRLFGTIPQMNQQFTTLDNLLSNDETTMTVDDERLQRQTIYINSAPHQHFTLVHALTAGRLTINSKLTIA

SEQ ID NO: 967478 - protein, 90 aa, Homo sapiens
MLLHPLARSEQISYWVGILSGSRECFDKMNNTEWEWEPGIAPRCYLRVSMSLMVTLANKKHKRNLKALYCPCATKLQRGGLWSWPRANMG

SEQ ID NO: 967479 - protein, 225 aa, Homo sapiens
EACLTDLQQGCGHTMILSRGVSLVLSGRGTLLACNGFKFETTGNFEETIIQRGLKSIKNIRENDQVYENGSGSKHMPELQRELKPCSTTTGIGIIQLLYEQTLTINGGHDRQRSKHPPYSRVSIRSQALLLAAHLIPSTCSQHMTPRGLPTTSTPSPWRNASSLPCLGHSADHTIQRALPLSRTSIPDPRFPRLAHSNRTAGARNSPPHHSPATHSWFNIHLDPL

SEQ ID NO: 967480 - protein, 111 aa, Homo sapiens
AVIRGFWYMHGLTEQCRARSSTPLVGMIALDDCASSGLLDSWCDTDSVQYHLKLPDHRVSGPVYGSWIPVTLVDSRTFRYHVDVRIILKLMGSVWCGMVATILACASLLVD

SEQ ID NO: 967481 - protein, 290 aa, Homo sapiens
MHSCRLLAATNRQQTPQTYSDVRRIPPSDRQFNEVSSQKPCANSASGFTNSRQGMKQGEIRNPTVLTGDTTESRELQLAVLGRLTLRKPDTHKFHSDSNTSHHRTYRITPLRLTCTTQHTHYPTYSHGLRLSTLHAYRPPIDEAKLTAIKTLPRHCQRRNPKRLAPKHRTWTDSLSHHDKALETCHYHRHTHNTTGQPPLRGPPHEDPYHHQHDDTPSKEHAHHVNGILKRNNTKTGPTPKDNRTNGIQSDKNKNTTLSYFRKRQLRHRTNIQHPETHPAQYTVTKHKQM

SEQ ID NO: 967482 - protein, 327 aa, Homo sapiens
LLKDGQNTRLTARLGFYMHLRNYSTDFTTRKLLATGGIGIIPDTSLITEANFTLDATRFQTPTRNPDTTTLNKRWTHDTHILRRKRTYWLQTSDCTDSSTAYPIQLLTVTTQYYKTHKHRRNKDYTHTGANPHTQYTYTSHWYLSNPLGIPPSTITIHIIPYERLISQYTTASVITNDYTTNRLVPIHPRSHTTQSARTPIHIATNTASSKQTTPHNQKTSNKSHHQGRNEEEPKEQHTQSKKQDQRAQANYRRPQITHPTRKHTFQELQDNPTPIDESTPERTNKNICDGFHKRDTLTDARTQKENELTSNKKHSKSPKRTLKHTT

SEQ ID NO: 967483 - protein, 116 aa, Homo sapiens
INHSFIDLPTPSNIIRMMKLRLTPWRLPDPPNHHRTIPSHALLTRRLNRLFINRPHHSRRKLWLNHPLPSRQWRLNILYLPLPTHRARPILRIISLLRNLKHRHYPPACNYSNSLH

SEQ ID NO: 967484 - protein, 371 aa, Homo sapiens
ATEAGDRGIGRHRRRRVDWEPAGYWSGRRCRWGRRAPGWCRVRDESEEPREGTSGGNMSENEEEAMSRAEEGSGDYDSRRDSSVGIERPRALGLSRRRAQSWKPKARRFEPESPGFESRSPGLVPASPELAPRRPESDSQSPEFESQSPRYEPKSPGYEPSEPRVMNPGALAMNRESSRYESQEHCSSKPRAQNLEAQKFQIPGKVLEMLLNPEAHESFEYLRRSQPGGLLHSGSQREQTTGHWRIGAPKRCDKERHGYNAVDSYRSPELHGAKEPRRRLASDQATGSDRGTKERGHGQKRMRGEHQVDDRTDGRKDKKEESTTSHNAPPTGRRKGANEQGDRQRYKTERKKELGNRDEERPTRPGPATKH

SEQ ID NO: 967485 - protein, 101 aa, Homo sapiens
DPFRFNEWFCHSVALSTRRVQILVSNQRNQGSLERWLILRLGQETCKMSLELLVVTGSKEALKCAPHPHTPPPLMELCQRGAETTARLLMANAGTMTARNK

SEQ ID NO: 967486 - protein, 105 aa, Homo sapiens
MIHKNKQQEDAKRKTHARRPSNTAKHKQTYTTSGPKPRNNTKKPRQSPPKTQAPTGQKAHTTNRKKTKQTKHNTKTEAANTRHTRQNTKPKTQPATHRAKKHTQT

SEQ ID NO: 967487 - protein, 69 aa, Homo sapiens
MSHRTNNIIQTAHGPGRRKQHHQTGATQTTPKSPSTSYHHGLHTHISRTTASQQRTTHRETHVRYSIEK

SEQ ID NO: 967488 - protein, 293 aa, Homo sapiens
RAAAIGAAKEGHWSKEFPTSIVSGRAGQTRPQTTTNCSNYWTQLQYSHYTMQLWGIHCYLQQLRYGALDAYYKRCRAARIRMQTAAQPASLRSAVLTYAEQTLSQLPQAPAIQPWPSSPSPPHSLDPYDRHLLADLRQLPATACLLPHARRCCCSPARFHFILRARIGPPCVALQPQLPTCRTTGYRLRGLQTCRLSQSLQQPSATTSPVRPWPGYEPGPSSCRIGPRHSAFFNLRGWHCVWADPPRCAHAHCRTYPAIRRVRPILASTTLTHLRRCNIHTGHPMHPHVNPFA

SEQ ID NO: 967489 - protein, 53 aa, Homo sapiens
MAWLVGAEGLLSGPSIAIPSTVINFHRGKGLGDVPMGRKGTRLGDAFLRPPVG

SEQ ID NO: 967490 - protein, 103 aa, Homo sapiens
MTVAGVPAGVEAWVMQSARRRRRKMKRRSRGWSSKQEAIRSIQVESSGVCDDVLRVYKYLSHRNLRNNVGDRNARKIRYQHCTRCNSTSDGTVFFKSWDCESD

SEQ ID NO: 967491 - protein, 51 aa, Homo sapiens
GPEPRPKRAPRLNDLASPIDHHLFVQQPAGRPCSEGNAHQSHRATRKKIGQ

SEQ ID NO: 967492 - protein, 203 aa, Homo sapiens
MMDVGKVLGWYRFFWFSFFGGWSGNRVWLWSLRLGVQGSILGSLQPWPPKFKGYSASWVAGDGRRPPPKPGDLGVPGGDRVHYMGQATLKLQGSGGPLASASKVPGPAMTHLTRTVGERNRGTGLWAQVDGGKARSMATLETPGRSKGLNRLKLTKGGSRGVSHHGPHHTTIREQKQLDRGQRVKAEQNIGTYTPEKNSRNKE

SEQ ID NO: 967493 - protein, 244 aa, Homo sapiens
MPRGKSDYPECIHHMKHPIICRLIHFSNSSNINNFHDSEKPSVRTRKSPNSRRTLHKPGVNIWMPLKRYKHSKNPYTSHLRPKNRTASKPPKAGFKAQAQGAPRLRSTDTDTEEHRHTQHTQTRGGTGETHKGTPQRRTQRELDQRRAHRRSAKQTTEQGEYNDGHKRQHGRHTLRTTPGGAAHASQPQHRPGPKTHTELTRPTRRREVYATKETVDRTNSTHHGHLNSNRETGRTSRHHAPIA

SEQ ID NO: 967494 - protein, 252 aa, Homo sapiens
QKDVGEKVPRKKWMSCNFSREVARVWVRGVVVPNGPRKAQLPRKGNAARIGEAPYGPSGRGKDDLVIPRSPHALWTRERECGRGLCGNGGIGAGGLWNLCLEEFPGTPVTNTKVVPFFRSLGRGPKKTPKDFEVAELAGLGETGRMGNSGGGSGCPPEPQELGPHQGRSPETAGAPRGMQALGKKKHLSIGAPEEPPGGRPYNTKQGPTGSRERRGQCARGPWGGRRVGGDCDPLLKDSTPQRTIVRANKKS

SEQ ID NO: 967495 - protein, 120 aa, Homo sapiens
MPTSHVNHTFIATCVHDLQDLLKSVGWLAVRVRVTTLGEALSTYVYHSRRVTCLPNGEYSHYIYTKKSLNVPHLTLCSSLVNFVNNTMINSSNCVASHGSERGGKRSNHDREHIAGTGVD

SEQ ID NO: 967496 - protein, 170 aa, Homo sapiens
RHDCSRAQCTITVDHVVTVRPDESDAVVMADVAEESEIISELVQTEDLGRQLSSEHMEPQLTDGLLVAHRLQEKASCCLVKWLSIKWGGYLCLQTMSRDAMWKTNYNICMVYRHEEIGMLYAIYLHWPENGVLNLESPITTSTTKDNNAGNSRRSEVVHRSSIRGLFIVS

SEQ ID NO: 967497 - protein, 166 aa, Homo sapiens
MPSRLSGYMHNSVLAYIAQVNYTQENYQNNAARIRAITHYIKRRDEPTEKPKPRRKPKKTKARIKRTQQRPDAHGANAQAPTTTSTRPRAEHKDNNRTYIQTKAENAYRMAPNISYSLLSLTHTAQQKKGTSTPKELRRRNYGTTHKTSSLPPRIHNRYKLRPGST

SEQ ID NO: 967498 - protein, 234 aa, Homo sapiens
LTDNLYKDLLSSPPSPTTSSHVVSWEDRCPILTVTAWVDILHPEGGCSHRKQESRFCVLSYCNSVWATSQGSLLAILCVVKSRPEAMTICRPCSAGYRRIMLNGENSRDSVTREHNRWTLALGSMPPFSVCRCPSSCESPFAKSTSLCSDIADPIRNRDSRDRSNRSTVPLGAVLGYVMLKITIISSDDPRGSSRVNVTITAIDQLALPGRKGTELREVTTEGTAELQEPQEGS

SEQ ID NO: 967499 - protein, 107 aa, Homo sapiens
MRPFTNSKPSPITPKLGGHDPKQASPPLNPARSPTPNTPIPYYSASGVSTHLQLTTSLHRQHNRKPNIHSQHCVINNFYLGVSYFYPILTKLSRATFAAHPIPPIFP

SEQ ID NO: 967500 - protein, 214 aa, Homo sapiens
MAISIDWYIQRPRQFNKAIIRSFGFNARQHNSSPSYPKHKPTTQLRPTGACITGINVRRNSYTQQQGEPLGAGARITHTTGYTDTVLNGHFSNKPKVHESVGKVGLREDSGFKPFKKTIKLYNSGDIEDERKKLQSKMEWLNLGIQDNRTGSPQPLWVTRATTSKANQFHNLTVQTNLAGRRIKRDNTRNLGSGHITYRVYHLLHPDTNTPSAA

SEQ ID NO: 967501 - protein, 464 aa, Homo sapiens
SIKSKFMVGLKKNNKRVQYVVRVQDMCLEFAWVVTSLSAGLTVWARLNSVPPKPFSIPLSWGFPFYISFSSLFLHILILLFSLYSPVFISPFFSISRVLISPFSLLWFSHYMCALLSRRSVEEAGLHGPWWNKRTLLSPREYVENIFITWCLITLHKGSITVHTYARPTSTTTPSPGAVKNYNKRKIRAKIERKRPQRSAPTQVGKNTQGDTDTEAVINPESARGEKEKESKERDNKFPAKVPGSNNSSGRKTRQEKSATKTTTANMKDRETIENKQPKGGQKKNQKRKRRHRENNPTLSTQWHNKPTRDITKTHTNNTPTQQTNTTQSKKSTHTAEQKEPKQNEKGKQRQKEETGTAAAKKTTVIQEKRNISDEKGADNETTNTDNIEEGDRETNDGMPETAREPRDQRETKHNRKRKRETEKRETKGQQRQSRRKQSEVSRNRAYKGGRGTGTGRATAADNK

SEQ ID NO: 967502 - protein, 99 aa, Homo sapiens
MHGNTVQRLMRAAGEVAPAEKSRAHTPQRTDWERDTGGHPTAVDTRDKGSTRGTQGVTNTPAKGEKPPYDDGNTNHSQQKHLESASNRGPRTTNSTHVD

SEQ ID NO: 967503 - protein, 133 aa, Homo sapiens
MQFPDAPKTKPLSPLHDRGYYLRLNALKSVEQNHQLFMPIVLQLIPLKHLLHRARYLPYSTPSTPLEHTTPPPPPHPPHPTGAPHNSPPRPPHPRPPLLSQRAQTTPQPPRQRTLKRRDTPPNLRNPCGHLAT

SEQ ID NO: 967504 - protein, 76 aa, Homo sapiens
MANLATLRPYPQYIYNYTPYTHYQSTISSPYNPLYRTHHERHTTPTPQLSPPPHAHHNTPQKHTTSIDNMDIYYYD

SEQ ID NO: 967505 - protein, 299 aa, Homo sapiens
VGSEIERMGLVMDRMGSVERMGSGIERMGPLGLDHMASSIERMGQTMERIGSGVERMGAGMGFGLERMAAPIDRVGQTIERMGSGVERMGPAIERMGPEHGAHGVAARYGSWAVSACGPPMVVSQWCDRRVQHIMANNKSCETGWAMERMGTNRLAAHGPGAHWVPTASERMGPDMGPALGAGIERMGLAMGWRWQVPALTVPSRWSVAPSEDATKVPRVELDGHAPGVDRKDCQIYGNICIRFSHGTMLPDQFHELSHDKQADSNCRRESPKGAVGSHKHRLPQGAQKARQHEERPSK

SEQ ID NO: 967506 - protein, 179 aa, Homo sapiens
MAKRGRWVDDNLDSRRTIGEVPMNAPRLGYGCYLCLDLTCVCPHYHTPPGRSMSTCTFLRSDLDWDNYSEFPLNGTASQQGLSNGTITLHLLGLNYYLQHNSWLSSAQTNSSSFTIPNITKASKTQAENGTRSQRGDRTILEVHPLWMQGLPKQDKTKRQQNRKQKGGTQKTKKGTNQG

SEQ ID NO: 967507 - protein, 184 aa, Homo sapiens
MKGAGAPYTNNPRKGEPKSRQHAELFDRQSERPPTRRTYKTQTSSAAEKHPNRKQGKPSRHGHTGKNPTLGAGAYEGTHPHRRLTSPGRHNQHEGSSVEHPQPVVCGRRTNWPHDKIQETIRAARQLHERTAATSNQPSKQAQRPDRHTTHTDQKQRDTDKTPNKEQHTLNTQREHRHRKTYSV

SEQ ID NO: 967508 - protein, 107 aa, Homo sapiens
MVHTYRARIFVREFALRRVVGECYPDKRSVRARSAEIVYESYLDAVRSERAQSPEVMERASSRDHSNDRDVVACMSGVPRPSDRCNNVTYIASLECYAGNESVPDNG

SEQ ID NO: 967509 - protein, 263 aa, Homo sapiens
MGGREKSPQEERRQAGGETKRGGGGAAALRREEEREGEQRQSGGSATTSAKRGGGEEREKKRRRDGRGEGEPKTQTQKDATGGAEQPPQETTTQKNTHEKKRNTRDGQAPNPHKKPEQHPPQQESDRQATHPYNRDQENNPWMTYTTPPHHVPASTKQTPNSRDNDSTTRPHTKKSEQQRWVKSRYERRTGERNKKPPPRRRGGDRHATPKKEAGPRQSPRPKNPREHERGTRANAPQTTRNPQPQPEGQQKTPPEQGKKAKG

SEQ ID NO: 967510 - protein, 516 aa, Homo sapiens
MLNTGCHMHGCPSIPLVRATRLGRMMPGLRGANGCAGVLAHVSYESRMLVTQWCYASQSESLTCPMSVEWSMSRQYSAPKEESVPKTTGECDGPTLRGGAYPVEGESNLRGHNLLLDRNGLACTSSDAISLGSTDRMASLRQTDRLASRACVAERAERTGRQRERPDMVSKGVLRGDQKGPRSYGKAAIRSYGARKKRVYGAMGRAKCASGAVNSTTRFLDNTKGTHGDNNREARGRSRPKTPLGLAPRGWPLKEEPPLAKRVAPLSARVGPPWMVAVGRRVYVARGERGCVAVEAPRGAWRWGMGSRCLWAKANWGSSGAFDILVPLEIHTSRPKWGEQKPQLVVAHTLDTVGPYFQNIERGATTTYGVREDKYFPEGTQYITLHPSGMRVRTPKGPWVAGTKEHSGCWRPLTQGRHHRNSAAPWACFRHGTCLFFNKMFRVLNTPRGEWKHHPWLSESRAFCNTSTLATIHNGRTLSVVMVDPWIGTTYHQGPHTEGGLCGSRQPTAGPMTLSV

SEQ ID NO: 967511 - protein, 244 aa, Homo sapiens
KAGESLEIPVRQVGRLADKDRGEEDADGSETQELFRRGCAPFLNKLTSLQSVPCSLMRRYVSAAGASTPRNASKGLIDLIFDKAIDEPNILLMAYANMCRCLMALKVPTTEKPTVTVNFREAVVESMSEGDLRKTKMMIEVLEKKQKEMDEAATAEERGRLKEELEEARDIARRRSLGNIEVYGRVVQTEDVNRGNNAMSVWSNVLKNHDEKVPFEVPFVVCHHIGKELEFEKAKARMDQYSNR

SEQ ID NO: 967512 - protein, 255 aa, Homo sapiens
MIRTITIVVLNVEAHVSQQRLIGSPRVIISHRTSMPAEEKGGLPIGHKREAQSNPRSRSTILHEMKASSQSSYSSIYAHHSAVPYTIIRLVAYPFIYIHHQSHTYSPSNLTDVQKNNILIRVVEAITIDMHHRVSLCLSEPHIVLRVTYLRYPLRNPLVWSPPYFNIALRLRLPYELPHCAEDTLQHAHTADPQTSTKRAPQANTATPRPVVTAPPQSTLANHDTTLTQHDATNTPTPTPPVHHPTTITHHLRPP

SEQ ID NO: 967513 - protein, 128 aa, Homo sapiens
MVGELDVIDYAEFVRTKSCEIDTCRSRDYDLKMHAERDDSVTYDKSTQYLPHYRSLHNAIHNVHTSRVIEGDKMSEKYKLNILVSIPVSLNELMFIVWYRECSKVRDLMFWVSYEMISCPIVVECNLP

SEQ ID NO: 967514 - protein, 362 aa, Homo sapiens
IRDVPDTPVPAYHPYKLPSPTAPYRQDPASPLASPTRARSHLCCRPSPTHTPPTLFLLNPPCAASSRPAPTRARPGPLAPPPVLAPPSSLPPSLLLPPARSPRPPHRPSLLPLPTSLPPPPPLSPSPSPPSLPPRSNTPAPPPPLFSPSAPASLLLLSLYGPHHTPTRPVHPTLLFHTTNRPHLPSHPPSSPPPSSPSLCPRPPRPPPPPPPPPLALSHPSPPPPPPSPPTPSSPPRAPQAAHRLPLPSPPPTRAPCRVPNAPPAPLLLTPPRPTPCPPPTDATAAPPLPAPVNGHHVTSHARAPLPPPARCFPGVTGGGQRLLDKKETIRTSSQPAAPVPDVHVPDGAHPLTAARRARHSR

SEQ ID NO: 967515 - protein, 329 aa, Homo sapiens
AGAKKVSFFTKPIGPGEKKKRGGGPPRVPPGDCVGGLWRAGPSYYSDEWGCSQPGRGGGPPRGCVWAASAPCSRIYPGRRADLVLPRGQPSGWRQKPGVGGRLVKRAWGGSTSEEQPGAGGRPPESGGAGRTPPPQSGVLLPIARPPRVVVRQNTEQLGDPPPHSPQEGGSTGDSKTDPPPEKSRGETPARLPPGGDAAKTHPSSVGRASIHPRGGRNPHHHTGGEDDRGFGRKHPRKNLSIVPPTTGWRNPKKEEGGWCSPPHQRGLIKVSVPITSRRTKEGTKVVTNRHQPKAAIECDQERSRRPHTEPRWILSNKRTTRGQDVRVG

SEQ ID NO: 967516 - protein, 322 aa, Homo sapiens
PLEKLGMTDMFSTGSSKTSRVCSDHEPLHVAQALQKVKIEVNESVAVASSSTAVIVSARMAPEEIIDGQTFLFVVRHSPTGTVLFMGQGDGIPLTLGKDSLHLGQNVEMHRAKTNTPNKRISVFNDLFLKAEKTFGLCVKQMVTPGSSLQDLGSPWRTFRSNSLVSTVRPWERSLKHNSLKVSRTEGDACWEHLGHWFHRLSATRAADWFQGEGPWQDGNYGAYRSFCVPGRTYNWSRHIAIICLLDYDGGVEGKGSGETPSSKNHVDGTIQKGVKSKGCRLCATCRQRYKQGSISRNRRDTPYRNANINTPSEGISSITKT

SEQ ID NO: 967517 - protein, 494 aa, Homo sapiens
MPAERRTIMLGQSAQCTVTLACLEKDALLCVSHLTVCVSLYPLRVSVKAPVTTAPRSVSASHIIVRVTRDSDQMIVTDSVTWSTLSTRHRTVSHSSYGISSFVFSAGHHFFVDSFERYHTERRLSWGGKFVWISPIRVLSSCQGPQRLVGLGFDARPKGVDPFSGLCAAWSPGHPFVGRLDRGTPAEVVWWVGSHPKVGGPLRIPPDPDHAQSCIPIVVSTPWVALFLGSFHAVRFLQARGMVQEGRGSPRLTLWDGTFPFFARLAQGEVNPTGAGGIGVSPLRELGPRQVQPRLAVADVGALYWNALLWRRTRWPWKLIRSRTPDGALELSSIPQGGISACGSQYENPEKGSLNWKDLTILVLISLRRTPHNKTQRNYVCVSRSRSVCGVPPTGVTVLSHTTTAPFSVVTSSQAPCCGANPRNCRRPPPCRDWRELGRQGRPQRDGFSQRRHHSLGRRDTLHTVASRKKRGDIHHETPAQAHAQRMGHPNRRR

SEQ ID NO: 967518 - protein, 125 aa, Homo sapiens
MYLTIFSLTPSRCTPLILGAINVIDEQVINDKKPRAITQYPERRRLRLIQSYITAVLLSAYLSRVTVAVLASRYTTEQTETVKPTSSTPTGGGEPILYKDYSDLRANLKLFAYPTRVRIFPFWYT

SEQ ID NO: 967519 - protein, 59 aa, Homo sapiens
MAILIIPRTSHTRVFTSDQRIEPPFILPCRNQIDPLGLVTYYDLDLTNTEPEERNQKPR

SEQ ID NO: 967520 - protein, 95 aa, Homo sapiens
MWVPQRERHRGEITMGHYLRPETSPHNAVDNHSTLGHHTTLGMHPKGMTDESSMRKTRDTPTYPMRTVQDKQLTRDEVKTTNPRERRSRERANTN

SEQ ID NO: 967521 - protein, 251 aa, Homo sapiens
MKLRLTPWRLPDPPNHHRTIPSHALLTRRLNRLFINRPHHFETLTSWLNSSAYLHANWRLNYSLSASSYTSGEAYYLRTHFSTQKPETLGIILLPCNYTNSLHQAMSSHEAKLLISAGATANYKLTIRHPIHSGQHLLQLNSDEATHLHTSHPHTTPSTFHFILPFIYRSPSNTPPPILARTRDPTTPYESPPIPITITFHPYYTTQRRPRLLSLPSLLNDIHPILTRTPTRPNHYSQTTPQTPPQYAPRH

SEQ ID NO: 967522 - protein, 400 aa, Homo sapiens
ELSFPALSSFNEAMHSALRAAGGARLWKSSRRSYSQGTTTGLAASPEMTEQPDYDLETFAEPTARNSASEPSHSHSHSLLTPPAHDCSLTGPLPPWAHLPRPAHTTATRPKPQHHTLPPRQRTTAPPHAAPHPANHYTHTPASLRSSGPNPPGPLPSPPAPPSPPRTHTPSARYPLALRALLRAHAASLARPARTTRLSCATHLPHTLLRARHLPACPPRGPRPARARARAPRHACTTCAQPTVPSLSLAIPPSRPSRSCPPLQPATHAHSAARPPSHASHPPFSSRLGLLPPVPLSSHLPPRAAAPSGSAFQVPLTHGPFTSFPDPHDQPPPGHPLGAVLPRPLAALDPLTLGHRAPPFPPWGPAFSPPPVGPSLWARPHTRAHPAHGPLSSSAYPAAL

SEQ ID NO: 967523 - protein, 278 aa, Homo sapiens
NHVFTVTDPRKHSVLTNETLSRVRDKIVDDYRLGIVPPGLTEYESCRAEDIYDYSFFILYTGEKDDFDRKNVSPQSYPMNMTIRVGCMYDYIQDYSRLCCSGSWIEPVLQCRRAITANRSGRQHPSLSMSWERAYVSATTGADSNSSRTQCIDQACLTTDRTSVPFAAVAAANCINIPLMRQRELKVGIPVTDENGNRVGGVGDAVKQAMHGQVVVSRILMAALAWHPSIHYDTLERKPFEEVPWMSAHQLAKRPRGFATPCCARSPKVRLYRWSVAE

SEQ ID NO: 967524 - protein, 483 aa, Homo sapiens
MPYEQDSTYNIAVTMQYIIQQSKRQPVDTPRLAKPSPISSVRTTAPITRRIQHGRHTQFIHKESSPGRARLTDHLTLTVTCTWHSSARHRHDTHTRTRPYLRRRISPVTLHSHQYSHKGGTPSSRQSPTVTVHANVHTKAIQYMDMQPQRHNGQTEHPTEQYKTPDGPNIKNDQTKNNVAERRINLGGHRKTPIHTMDKHVQALSNTKRELHLNHTWQVTRRRLTSSHTHNSYSSSKGGTLTDTNLTLQSYANAPPYDKRYPRPHTTTRFINNQTEDKRKMREDTPRTTRPPPTEHREEPAAQLTHNRADHKSTRSRHVKTQDSRTAQRVTTHKQPAHRMIDTPIKTEPHHNNNHTPRRTTTRQTQSHMKDPGERHTQQHAHKHRQPPHVDHKESESKRPQRRPAIKRLHATPTNTGAGPHTTRHHTSSACTDHRTVHTHARQTQQTRETTLNIKTLDETTKLKRATTYHTERRTSPAEHTTA

SEQ ID NO: 967525 - protein, 564 aa, Homo sapiens
MHARARLAGNPSLQSSARLCPPTGSYECKIVCERCTCTYTLVCTRGCALAMELHIHENAKAKGTVKLHEASYRTGDPCASPFTEPSPVGIAQGPTGVSDYLEECRLLPVRHSLRPRNKEPNSEVTGISTAHRIHKKRGRGLVRKEAQKLTRPSVRGPCNRPSQETTQANPQVGWTHPLASHRQFKVLPGQMKEDVRSQNRIGTAQRTANALRQRVTHPHGQQTSRRMREHNLYGIVDHRRGAPTSQALTRQPKEATVPCHTTMGKHTQQHHENARRHCAPHGTHGPPVATHISQQHHVVSQPRDIPEVGWYTSTGTQGQHARQMAGTQHQKHQLTGTNSKPTHSRDRVTQLNTQHEAPPQVNYKIDGREDDLTGLDLCSVAKLMNTNEPARPPHKSPALCDDKAHDQQSRHYSASKLRKLNNEGQERQRCTTHQQIRMHKPVGDDGTDIVHDAAANTRTERNKHQGNRMRTDTQTTYTPRPATTMPHKPQAAETHERRHKTTTDETSRAHTTNTHGSNTKTAHHSNGKPQRAEHTHSTNSTGSTKTDSKHYDYTYQQNNDEHTQ

SEQ ID NO: 967526 - protein, 251 aa, Homo sapiens
MGGYQSQNLHETLPSLTFTAQDMPGIPKQGRFLDKRLQETGPTPQSRESRSSTRPPKANRESNISNSRPVPDLGPSDGVMTQCPSSSGWKGAEHSGVLPALGPNISRAMRRRTMYKIPRGAHKQDVSPSTSPGQKPNGKEPRQISRGPGGNNIGEKPDTGGTLPTAKGAKVHRGGRKHEETKFRNKGPIRANKNKTPEKERQDNDRHTDDNRGGTGHNDRAAANDASRDGDVVNNTAREEAERRTGQSKKQ

SEQ ID NO: 967527 - protein, 264 aa, Homo sapiens
HRWMKMPLPVDQPERLGERLEVANLSEEVMYWQKTKLITLLLGVGPGCEGLVPVGCVTVVTSVNEILYDEGRPGSIGEDGVLCGSLQQTSERDVVEQVNGQEACTGGCKYGSMRVTTGVPSRNDRGNRKACLQMDVSYANRQREECWRNQSIAGQMQGYDELRDRGGTAQGCVTVKAIPNGGLDMREGTIGDMGILGITESVQVKREVLLSAGDQQQRVILRVDRHHQSGTRKRVLITTLVSIPTVAWIFGPDSSTVVSDRILY

SEQ ID NO: 967528 - protein, 95 aa, Homo sapiens
KTYIPVLSTETKPSDHEKLHIYMLYALLRHDNTQSYIILLIDYRCVHTNINLTALIGKHKAINYSEFQIHLHYYYRIHSVNCDLIDYIITYLRAN

SEQ ID NO: 967529 - protein, 286 aa, Homo sapiens
LQVVRARKQIVIGVNYFLERVSLWSIPRMYQRTPAQSLCSKPARYPVSTAITHEQGDMTFRVSLPRSSAGCSLREGYKHRTLCRKSYLVSVTPNGCLVTRAEACCQLPALIATSFIDHSNVGSLNHRVYHRWCTLHLVSDMASSRECCTGQHQRRTRIMYHTVHHEPVTFEFWLTSHKRGLLRDTSILHVRRIFPVLFTFIKRHTAIVMRRIVDYLASPSRLLGKPHKVNLRSSGALFNTWYRRLRPIGTWAHSGIIRRETAFNSNIKKAIPGNVERPEQPVTLTV

SEQ ID NO: 967530 - protein, 96 aa, Homo sapiens
QSRIGTAPRQSTATHWNGQQGILHYGTESGEGAAYECIDDNHIIDCRVCDADSLNPGGLTDRSCRIVLWARPLELEREELPSNLGLIRYVHRVLML

SEQ ID NO: 967531 - protein, 304 aa, Homo sapiens
MARPAGLHERRHGSTPRVTGFQDVRARGGHPHPPNPAPPGREPPQTPWEPTFRVRCCWPAILAAGLTRDPKPLASAPLGRENDEQYSGEAQLQGRPSRSAIAQFAEAAPDTSRLLMSMSNHLPVPKCPPGQTADSMVGLMCRGPIIPFTITLVGVFEWHVGWTVCGPSTCSAQCQAIRQMRELHEAVQQELVFCMGRTQGWYMAWPDVANQPLADSHWWIAATLACPLVPPSDSWVLACWGLHLFPGALGPLVVRGHILPTSEICPCDNTTGSVALVGAAPRLEGLGAAHTVSLRAHERPCGAP

SEQ ID NO: 967532 - protein, 147 aa, Homo sapiens
WHQKAYIPIGPKACRIVKKAANGLEEEAIRKKPYNLARGPYKSRWAQQGSYSCLKVSLSKRYSPSPASGPPSLLEVGSGGHPIFCDKLHFLHLGSESPGSHQSMGVRAGRNPGHEDPKRAVVSAFPPGQGELPVASGVYAHSSSAGS

SEQ ID NO: 967533 - protein, 311 aa, Homo sapiens
LCSCAHVKHRKGAAHLRSTVNYAERPGYIKGIVTGHHPRPGTDVRDPSAKVCLSGIRTRYLRERNCELITFASEGIHTGQFVFADKKAQLNIGNVLPVGTHALRVQSLCLPGGEAWRPWQAVPRASGNYATVISHNPESKELTRVKLPLAGSKERKSPQPTEHVVVLVPDVLAIDKPILLKAGRASHQILRHNEGPAWPQSYGGVTMNSCGSNTLWEVEPPGHIGKALHNPERCPCWPQQGSHAAAGLDVYRGTKIVRKQDTKCSRPPKVGSLPKRQKKRGAQNQQGTVHQFRQATQAKKRAGNTARNACN

SEQ ID NO: 967534 - protein, 116 aa, Homo sapiens
TELHTGRETKNITSILVSLILGFWSRVSVCRRGWSTGADDLGSLSTILPPWGVKRILLLSYHPSSWDSQVLCQPTDLKRKVGYICMRWSTGVIQPCLGASGLVIEILLYPWQEYCS

SEQ ID NO: 967535 - protein, 176 aa, Homo sapiens
ATNPDHDPPHGCCHLMLLLLALLLAASPVRRLERGAQAAWQGVQAGCPGGCVEEEAWGVAAEGLQRKLRAVSEREGQECGVYTPNCSPRTASAIRPRTTEATFAEAAAARPRPLTSGPERLLLQEENPKESKTQAGHCPTTGMLNRRDQQEESRHLIPSPPRPILAGCPRHLRWAQ

SEQ ID NO: 967536 - protein, 418 aa, Homo sapiens
VPHPPPCYAADRLRPRRLLPPPRTPCSYYRTESLNSRFLFNPHASDHRRAPPCQTQTVDTSSNIHPPKALHTGKDSTGNVCGKQASNNGKQQLPTAYRRTWSHSHRTHMGAASAGLHTLPRSSTAHAQHGTRKGRRATRTRKAKATAHSHHATAPRHRARPRRPHAKRHPRTPTLLRPQPTDKTQATRRATTPSANAFPQRPFTTPARRSAPETTGPRRMATSADEANNTTHTTRAQLWDHTPPAPQQLWAKTPRVNTRRRTIPPGQTSSEAAPNKPRPTTDAPPANAGSHTTSRAAAHNTSRHTRSKHHPARTNSARRRHTTAFRRQTTAPGLYPPGATTPPPPTEAPTHNKQSQHANTHPTRPTTTTEPAGAANHPPATNSTAPPAAEPFAPTRPTQAQLERIPSLNRTQQQPCHR

SEQ ID NO: 967537 - protein, 254 aa, Homo sapiens
MGESCGGEKKPFISGEGENNMGERTTHTTNNKIQTHPEERKIIKLKRGREKEVRENTTARKIKQRERRERRKRGAAQTRARYGTREKKYYKSAGAAPPPHLKTPAKRREKKERRRTRRREKKEKEEKERGKRREEVKKKKKRKGQEKKGEKEEERKRRRKKRKQKKKRTKTKNEKEKKEKKKQEKKKKKREGGKQQRTNRKEKKKRRKNRETRKKTKRTKKTKRKKKNKQEDRKKGRQQKKGKKTEKEKQEREK

SEQ ID NO: 967538 - protein, 108 aa, Homo sapiens
MEHLEYSYHWKWWGLTLIPIWSSTDMTSKEESLCLNAPNSSFLKSTARYQGCNPSTTWTYYPTYAPRLVRQNTHAFFATRKRDHLSGNRACVVPETLANMPGTGKIAR

SEQ ID NO: 967539 - protein, 121 aa, Homo sapiens
MDQPPPCSYDIAVDGEPLGQSSPLSCNADKVPKTAENFRALSTGEKGFGYKGSCLHRIIPGFLCQGGAFTRHNETLGGKSIYGEKYEDENYTSKQHTGPGILSMANAGTQHKWFPVYTICH

SEQ ID NO: 967540 - protein, 71 aa, Homo sapiens
LEHYTYYSAHELEILGTATKTYLIRAELGQPGNLLGNDHIYNVIIRHSPCICNNTSIHSNTHHNRRLKETD

SEQ ID NO: 967541 - protein, 110 aa, Homo sapiens
MHIDIVLHDTYYRCSSLPLCPINRSWIAIIGGFIHCLSPILQATPLDQTYAKIQFTIIFIGRKSKLSSHKTVARTIRNAPDVTRTYPMDTPHENILSSVRVLHFSNSSHI

SEQ ID NO: 967542 - protein, 266 aa, Homo sapiens
MKDIEKRTHKTDEKKSKKNTRDTYTNNNDSTKTTGQQLTNTADRTTANPRQEHETHKEDTHETRTKTKNTKTQGPNQKTIRRTTQESTRNTTEQTREQKNETAATETHHKKQREGNKKTRMSKRQKQQQTNTKRKDETQQNEQQAAAKKERTKERGRNNTTRKQTTEREEREKKGGQREHTKGKKTQQNEQNKTTNENRSSRTAKKQRKTKRTEKETREHRQEENQANKQRDKKTQENKKDATKTKKRQDKSKRTRRTSKRGQRQR

SEQ ID NO: 967543 - protein, 115 aa, Homo sapiens
MTRCRSTSAGTHSVCAIDDRNLTGEAYTIPGTRRTEHATAPPAPEADATTHASNNDQQPNHTTSHPPTTPHSPTPPLTPTTTTPQHHTNTPHSHSTQPHTTPTTTHPPTTPPPPP

SEQ ID NO: 967544 - protein, 164 aa, Homo sapiens
MANPNSISVAPILVRQKFNFSPLEKVLFDQLRGRAIIPRNEDSTPRTNPAVLRKPKQYNDTPQQCTTTKQGGRDRHHTKKYIPPARGSPKGINAAGSRPLLRGTQQEGGHPKKGDDSQYIKPYRNQSDRAVKNSAWVSCRQIRDSRGPQRGKETTKSRRGRHQT

SEQ ID NO: 967545 - protein, 96 aa, Homo sapiens
MDNLTPTTESQNQKADRKTNKPTANHTHNPPHPRPNKPRNNTNTTHTTTKHTKQKPPTDTRNATHAPTHTENQKHKPHKHHKHTNNPITKPKTKHK

SEQ ID NO: 967546 - protein, 153 aa, Homo sapiens
MDTDRLTRQHRDRLKIFRRKEERHLRTLANFNRRLRAITWGQRDTRMMERGAVEITTGLRGPRRPSTIYPRKTRRTRGFTADDTHKSGLVPVRGQHVARSRAPTNLRRHSDQQPNNRAAKQPNHAGQETQRKPTDTETHKTTTPPTARNNPRH

SEQ ID NO: 967547 - protein, 103 aa, Homo sapiens
MTRVISIRNFYQKPRGLPVEPCGQSLDFAGQCNLAAQCMVNYSSCQLSTLMCHYDVELVRHSMSISRWTQAKSPGWIVLLLQRHKEALEMILNDENKKQKKKR

SEQ ID NO: 967548 - protein, 38 aa, Homo sapiens
MLTYPFRQVLSMASQHHRIPAMAACTHSHAATSLPPSS

SEQ ID NO: 967549 - protein, 122 aa, Homo sapiens
VILLLRQVQCKPLLESQKPLPDAVLEELRIKQSCPTSTLLFHAWPVAWHMLYQSQGMMQQLQSMCYQQQQLYDIWAIPQPRARSGTLRHSSPHVLVRSTQPTHLLPFSTHTVLAHCAFTPII

SEQ ID NO: 967550 - protein, 74 aa, Homo sapiens
SLPLSPVPSRPCAFRTRALEAARGRSYRMSYPELHLSTLADAVRLMTCFLLALTIYPYKNQRETEEDLITVKGS

SEQ ID NO: 967551 - protein, 230 aa, Homo sapiens
RPEPGNERFALVAQLECNGTISAHRNLCLPGSSDSPASASRVAGITGMRHHARLILYFFVVVVGGGGSLHCWVRRGLETPEPQGDPPCLGLLKVRGIYRRWATCALAYLKFYKHFILGNCVFPEKEKWQTIFSLHDAYIWASGKPKPSRMAGRMGEPRLLGAGGYPGASYPGGLPRGRHPQGLILGQAPPGASPWEHLELIPGALAPGVTQAPSGPGGYPSSGPAMCPEL

SEQ ID NO: 967552 - protein, 125 aa, Homo sapiens
ENLNGKESTQSSSPTYEGLPSPVTKRTEQTLGEMPRNLPTILKYHIGDEILVSGGIGALRAAKVIIRKVTTLESQLVINESVVSVNEWSLLSEPDYHGHKVAVVRCQSTNVSAASSQARPQEERG

SEQ ID NO: 967553 - protein, 98 aa, Homo sapiens
MPRRILGLPRMTYTEMRHPIICRLMAFLYSSNINKSCTDLEKPSLRSEQSYIVEEPSITAVAVTIWMPPSATHIREKPSYIDLYDQPQDGIEPRKAGP

SEQ ID NO: 967554 - protein, 463 aa, Homo sapiens
KKSKPAPSESAGYGIPLHTDGACSKTDASTAAGAILQIHADVNTTKGFEASQSHATSVQTPPTGRHQQVAVTGPLKHHTSARNRTHKVSYFYSIITTSKVSQRTAFMPTITISTSIILNHASSFQAYSPPFTHMHLIFTHLLAQLHAALSTLYNGTIKNWIYRICRDTQSGRISKLICTLPKRARFLAKHVRNSPCSIIPQQQIHKATHIEWIRYRSVPKHFQSKRQATQPSALAAFIKACTHQHKIQTRIITYDTRATAPITITQGLQRGNYHIPTPLSDDWYLGCLLTPSPLLGSTQDNPWRYNLQNSRGTSKKFTRPSCDPPTPHTGGINLQLGTTDTQHIDNAPREYHNILTITRHTNNISKPQKHTQTNTTRHEQKLNNRPDRSHAAGNRHRRSGTARRSTYANNKPQREQPTHTRRTPATNNTMTRGHKHQRHNQTTKTGNNTKALTTTRNQTSTRT

SEQ ID NO: 967555 - protein, 147 aa, Homo sapiens
MDRVRCRPTVVSGCVTYLWIVFACSIDTPWGSGARQCQDEYDITLIGYVYNNSRDTHRLDPSYVEIAASSTNKTMISFLYEKKAKDYGVGTIDDDVEAWLYLGNVSLVQQLAIQEVWWSWDQYPKMCKFGNEYWVPRKAHTMWPLKE

SEQ ID NO: 967556 - protein, 228 aa, Homo sapiens
MAQLSLRLLIGVEDWPGGPSPIYPGLGTDFPPYRTKKTARPPPTHSNPPTPDRPTPPSARHRTQRNSQTRPHRSHPPRHPQPHKPTHVPHPPPAPSTTQQHQHTPTDTPHGSHTTEQHAPTPPSAPPPTHESRTHHRHAAAHPAPRRPPSPPAPLHPRTRESERRRHRLPPPPGTPAKGGNEGETETSPSPPLPRPRRHHSGPQTEREQKPAPPPRRQARQNKHRQPH

SEQ ID NO: 967557 - protein, 191 aa, Homo sapiens
MERRIALASRDGGPIPGAISALGPHGTVPHEVCALSREAFKSGGCSRGCDASYHKERVARIIEPFLVRYREEVAGTKSTDSLKARRVEDEGVRSKIILFAQEALGPMTGDSSAEELKLATQLTDRHARRNVYKKEKAQSHHLRKRQNFKAFASLRMAVARPVFGYGQKEPRKPQNQDVDTRKNKPPGDLES

SEQ ID NO: 967558 - protein, 335 aa, Homo sapiens
MAKVGVAFLKYHRVGRGARLESSRLNREEPGGPNELTSYSARDKESRQSLYRPRRTESVVWTEMRSLNQYHRPSPGVTPEAVPLYEVLDTVESQVGNLIYITADADVSQEKQTSRWTLQVGYAKSVAGGSDPRYCQSCCDNPSSNETSPEIMSLETRITLDVLVFRHDNILWQYNHYNYWAHVSSGIERCTPDDEEHNQVYPCRSEQEPQVHNRRNPVRGSMKEEVRSREGIPIVGRQTLYCRAQGGCHKVPEESTDKNVRNGAVDCTPWTARTCGPPGEGPYYWGGHPGKTVRKNSSGREKFHSFVVPSDIRRQIDINNNTPNHIPTHSHSYHY

SEQ ID NO: 967559 - protein, 111 aa, Homo sapiens
MGREEERSIRNLPKMWISQALNQQVDSGRGAYSYQTSTPFWLYCGQQRAAGLFLLPVLPPTVPTGLQGLPLFLSLVLGHPQWFLSPMRSWFSHTLLAHRHPTVPPQPRRGR

SEQ ID NO: 967560 - protein, 221 aa, Homo sapiens
MARCNTRKHIPRPPHELTVSKKAFDTGESYLLPQKFFSSQDYSEPLYHSSLAPTPQLGGRLAPNRYHPAKSPYEVPLLSTSVLLASGCINQPESHHSLIERQPKRKSNSRRLLYYQFYWVLYLYPRYKASEYFELSLHQFSEGQSTSSTFSRSHRLPRTSRHYGSTFLTICFIRQLIFHFTSKHHFGFEAAPDTGICRIVVRPYFLVLSSILIGFEGSYPN

SEQ ID NO: 967561 - protein, 124 aa, Homo sapiens
ETSGNLDDLEYKLHDYGLREEFLFPRDCLAIGASAHLAELQEEQIQEQDLLYLKKYYGTKDPAARLMSVPAAEHSDHNRLGGKTHEKDAFEHIVTQFASVPVSVARAMSYDIYNACDERYGVKI

SEQ ID NO: 967562 - protein, 318 aa, Homo sapiens
MHAEPGMPPRNIEHRPIKNLTGCGHEVHQYVKASTTDANRQANGHHADPGIMPPCAAPTRRSTGTPEEAGNYCDHATSHTSRHIYSSRRHALEEAATDLVIVGRVLRTETPPSIQVDSNAPYTCSPTIDGLSNRTLRRPGEHSDAVTRQPSSHLRSNRNSRSVPLHQRTTPHTPNGGGPGQRGTQFTTQHALGNPAGETQMRSQDEPLDLPSGTRNGDTTRQSPQRAPHPTALRLEPLPPAQQGAEPRAVGPPGGQPRQSAPETRHSPRHAAPWRPTPSLHAQAPAAETISTSEPATTTLGLPRRNIAYSTCNSAYAD

SEQ ID NO: 967563 - protein, 544 aa, Homo sapiens
SAEDILLKTNATKEKMDQAANAGSCSTISHRSHTSSKRFWTRGISAAFGTAIDSQLLNEVIEQWQMPSDPHSQFTAHLPPAQHHTCTRSCNSLSRRQQVILQHQCCCTLPELQHVVQTASSHKQQANKCHTRCSKSTGQHHGHTGTALAQHSRTTGPQGRPAKQHTANFKTQPASHKHHSKGNPQDNIASTYQHKQVCTHKRAFLAGQHPLFQTADPPSSHSSRQSQASKANGRAKHTFQAGHQAAPTQTHGRPRPRHIHIRHTHTASSTHSPARTRPTQSAQAQDMSPTDKATYRTQLGGGHTTRTRQTTGSLHQQHGQTKHPTHPRAPTQNHNPSHRTTQRPWKVAKHNGTNAPTMARPDNRTATTTRPPTNPHQQTTHNHRAWHTEPPNADLRTQDNNTNGPPPQQTHTTHTGPTEQLDPNREQEDTSTATRHHQESFKNKTNRTDLQQQACNQQHNKHGTQRNTGPPTNTRERIKHHHQNYTHTRTTLERPNHGRNTQARRYTTKAASEDRTQDKQNVSSERTTPTHNLTQHTQNHETPT

SEQ ID NO: 967564 - protein, 451 aa, Homo sapiens
RSRLLLRGFFPARPGGPDRGILPLDLICAALAGAAQKEQAGAVVRAVCVGRPWPGAAAGKLGWDCSAASCPASSSDHARLKNWTYLVAIFLSPSPSASSLQNSPAPGLASRSAAATPARRRPRGLHPSSHASCAPHHPPASLLRPPTTPRHLRPLHSHGPTPCLPAHRPLRLLAPATSPHSTPPCSQPAAPPALPRGSAPPPPCPTHTNAPLPPQPGCHPRHTPRCPPAPSRPAPTATLPLLPPPTPRKPAGPPRPNRAPRRPTHPGRATLGHATSDMPPSTRHHHPTPPAPHATPSHPIPTHKAPANPQTTDKHAATSTNDATTNHRRARRHDQPPDPLAPPPDPRPAPRNDGQRTTSKNTVTTAATPDGRAATQQAEPTQAHTRSNPSARLRETRATHYHRANTRTAAPTPTATPTPEVAPPPGTHTASDPHRQQRENRSKPDNSSRCE

SEQ ID NO: 967565 - protein, 223 aa, Homo sapiens
QLLTASDPPASASGGAGIADGVSFTRCSSVAQAGVQCVISASYNLHLPAARLGLPKCRDYSLCPAATPSGKLRSVSAWPPIVWDVRSPSARVPVWGGEERLFLVRDAIWEGGVSLADCPSSEAVEEHLQATVQIAGLVRCEETPLLRSSRLPVLVQVLAPVAWAVHCTVCARMAPTVQNSTCYERKLMQHLRTALMGHNPINSTRLGRKGKTITADDKACVEK

SEQ ID NO: 967566 - protein, 149 aa, Homo sapiens
MHRNNRTTNRPHRTKKQTENEHKHHEDDKTNERENKQRTATNKQKTERKPTSREGTRDENHSAPPATTEDRTQQKHNQTKKTSEDRKPKKSTKQVEEQQKRNQNTKDKKRRKKKKKTQRTTAEEKKTAAARETEEKKNSDSQRNNGARH

SEQ ID NO: 967567 - protein, 125 aa, Homo sapiens
MAEEQNGEKNKDRTEEKKGKRNRRGEEEKKTERQKENKERRERKKGERKAKKRKEREKGGRRRRNEERRRRKKRGKRREERKKKKRKKKKREENRRRREEKSKKEREKRRRREAKSANGNVDKDK

SEQ ID NO: 967568 - protein, 205 aa, Homo sapiens
MVEKNNARKTRDEGHPHQPRRRATTPQAKRQNEQRHKPNQQPATGAMQQHHTAHRGDKNAATTTQEQSSDIIEAPHHYIAEQTQQHSHHTRRQGRRRRPKPAPDGGTTRHPTHQPRKTKHLRQTTRPDEQQPANRRGSTSQASADHTQPPETEDDQTAAVPPTHRVGATRQETTQQAEQPQQTRHDPDEKPGTQHHARPEHKPHG

SEQ ID NO: 967569 - protein, 277 aa, Homo sapiens
MPIRTISSRCAHQSLVCSPTSGPLLSFLQRGGPQRKHIHKLSVKWWSEPCRRGGCPPLCLKRPRSTKAALLYTHTVEQQNEKLFFCGRTKNISQGGRGNRWRFENTQPQYNPLSVTNALSHINRHTHHKTKDKNHTIQRHSTHQPTRPDKRRGGGRRSTLNYKRTSTPPTEEGGEPTQRYTNLSRPPPSKSVMAVCTHKQRRDDATHRHKREKHERELLIYIANSSKQKQRGSRRQRLVKQNISADTVIGRGRTNQLTTTPGGQPTLAKSKDNQLHR

SEQ ID NO: 967570 - protein, 110 aa, Homo sapiens
WGIKNFWDPAPLGGHKTTLGAQKGGGWRLGGKGPRRGGSRSVPSPGEEKRRRIPYNRLSARSIGGVAPPPMVGRGRDTRDTNTGNGGGPPTKLHRVAMGGKHRRRVASIK

SEQ ID NO: 967571 - protein, 108 aa, Homo sapiens
MASEYESLTHIVYRKQRNQIIKHCLLQFTGSLFTSYKPQSTSESSLHHFRLAIYGVNIYCSHRLPQDFTVIIGSTFLDYLLHPANIIFHFTSKHHFGFRSPPPDTGIL

SEQ ID NO: 967572 - protein, 104 aa, Homo sapiens
AAFFLFFWTSLHQFYYKTQTSILSFCKGNGSQINAEHETLTNHQVLLNYATPTIYFFKTSTKQSTAIIITNRGHRGIVEGDSQTHDNKSEKSQWVNTVNYSSPS

SEQ ID NO: 967573 - protein, 85 aa, Homo sapiens
GLTQDYKNGNGEGDSSRLERASPKVQMWPRIGMALGGFLNSHSKYEMRGHRKSLAILKATPLLSKEKGPVLSQVHTGEVISMASV

SEQ ID NO: 967574 - protein, 50 aa, Homo sapiens
GGEAELENYIEHVLLRRHVTALPSRRRHEGAGQGNIGAGAVGAGARPGVV

SEQ ID NO: 967575 - protein, 506 aa, Homo sapiens
GVGQSWQGELPTECFIKEALLDATANATIAPVHRRTFTARIELHWKRKLSYCRQHDTTLAVQKDSCIMTCLLPLSTSGFLTLSHLAHFETVTQLATTTHIPSSLTSLNHHWPPFCTLTLPLSTYYYFHTSQAANPGSLPTPTQPTLGNNCSLTTHSWRGTSLAHKPFFPNKHNTQTLRQTSETHMATRAAPHRDRPSGPHNTSTFHRAYHSDNPPREHTPRQPHHTHHTCRHVDPHTATNPTQTSNRRQQLTPRASPHTQHQPHTPTTPPQTHTPPRNSSQQPPTPTAARSSHTTLSANHRPPPPMRNDSHTEPPRRSEIPPPPTRYGNLPPKRGGPHHTIDSRRGRKNTTHTLRALHSPTTQRPSLAPRPATPTTPQSATTPHTRRRPHKRAARPTTTGRPHPTTPSAEHTHQQGTNNMNHSDNENTSMGPTTHTSAETPSIMNDQPPPNPLHTARQTPTRPTTHNTYSHTPNTTQRPVLKTRTETQPAHTARSDRLPTKPPPPA

SEQ ID NO: 967576 - protein, 273 aa, Homo sapiens
MTETSINTCTDNCEKQSPHRTINLYHQGDTTQLQEHSHTQEQTWTKQRMITAKAINQPCRTAAKQGAPCHKTPLAYYTHTISQMAKEAEPEENVGNTHIGNNEKAHRTWGHKLAQTIPTYNRATKKQQQQDTQEAPPKRELGHHGIAGHTGATWTHTMRTEENPTESSTTEPTHTPTQRTKRQHHEAPAKPSAPNRQRLKTKENKPTDTTRRHTTHKRAPRYTSTNKKANKQPPTTTRQQRTTTTTTRHTYKHPSKPGTPQHAHTPAQTTHNY

SEQ ID NO: 967577 - protein, 120 aa, Homo sapiens
PGETPPLGGEIPRVQFGTSDKDSDLRLVVGDSLKAEKELTCDREFRWAKGGHPKFIRQMEVSSARLGSQLHHVLGLAPFPFGPLGEKGPPKTKKFPRKGKTPWNSGHCVPEPSSSGQRLY

SEQ ID NO: 967578 - protein, 256 aa, Homo sapiens
TRTSSHKYVPRAILVDLEPGTMDSVRLRGLVDISSGLTISSMGPRVGAGYRTGDQRVTTSEGAESGGILVPWMWCGRSVKTCDCLQCVPADPLAGGAARGSGMGTLLISKVREEYPDRIMNTFRRRALTQGCQTRLVEPYNSRLSIHQLVENTDESYGIDNEALYESASAPQAWHAHYGDLEPPGIWAPGAEVTTPCGFAGQLKADLRKLGLVNIGALPALDFFHGRVSPPYKAGKAWSTGPWRAGVTQRFSVPEL

SEQ ID NO: 967579 - protein, 96 aa, Homo sapiens
RTVILQRTYKNRASSGSSGTSAAHQLNCSDANPSTKVISIAEIMLRVKDPKESHCIFILGVLGPDATSTKCDFPIMKFTLYFLAYEDKNDIPKEAR

SEQ ID NO: 967580 - protein, 135 aa, Homo sapiens
VCGAKDGSWLLREIQPRSPWLLMRLAWLQRQPGFEPRAGAPGGGYARKAVRDVRTAWRATRKRASPVRHECQRVRKRARVEKPSGRGAPGGVRTPWRKPNRVEPPRGGAEGPFPFIDGAFDGGGDNHGLSGDRGS

SEQ ID NO: 967581 - protein, 313 aa, Homo sapiens
SRCRKQQPLLFVSASDRKSAKKEPMREMLSIHVGQAGVHDGHACWEPLVPENGIQPDGQMPSDTDTLGEEMIPSTPSSDETGAGKHVPGQCLRLGNPRSIDEVRTGTYRSSSSLDNLSQAKEDAANNYARVPLTPLPRRSCDLVWTRIRKAGQTSARVSRLLGFHSFGGENVVLGSPRCSWKRFSVDYGKKSKPGVSIDPAPPGIHSLIVEALTIHRQQQDNLEHCDCALMGDNEAPKTSGKTREMRDHRDYLEREGQGAPHRPRNGEAECDGESNHGATGHTRESRTGKPQKAGDTRLAHGDPAKCARGNRD

SEQ ID NO: 967582 - protein, 32 aa, Homo sapiens
MLQHEAVDPSYFGAGLRLTLSAGDNHLEDKHN

SEQ ID NO: 967583 - protein, 39 aa, Homo sapiens
MCGRLPSFSVSFSTLPRGQYYFDAGSAVSLRRPTQSCGS

SEQ ID NO: 967584 - protein, 327 aa, Homo sapiens
MRTTAQVVTHRLKRRASDEQIRNLEWYSPQEYAFDYIDVCVTPFELDHYEVSITDHFFEYANLSLVRRIGNSPSNGHFPVSAIPRKSKKRKGTLDFLHETLARGKPAPPSVNMRRRHFFRSSAKFRLTALTCDQSVTLEDHIGEKVGAQLVGPREMSCNRSFATTKFESPLNGFVIVNVHVGLPQGPPCFAFGDPFGRMWAANGHNASASSRKELGLGRLTQPNTLRNAGPCAPSRAVPDNHIGKSHRLASYQTIGRKHTTIPNQSAGCQSASPQSLYHRAGHDQRSVAYTRIYERVPALSEPSYNRNNVNVTGTCACLISSVHDKL

SEQ ID NO: 967585 - protein, 209 aa, Homo sapiens
MRPGEKDNREFHRQVAWSARIDGFYAASLYGSTWLLCCAVCEDGRQAPLHSPFIEDSLDNTAPDTASAHPTVHHDRARLRHNSTTGKKEPLTHPINHLHTHSKPTQQLTQDDPGEEHELLTHYTYCSPGNCESLTAARPTHDSRNERIADPPQPPAAPQQRPRIDRETTDATNSHIPQTCNANKQRHAALDNTQQQDPERNKQLEPLRQ

SEQ ID NO: 967586 - protein, 267 aa, Homo sapiens
DASEEGLPIPIAGRLDLPYQTVPLWLPRLLPATRRVDSTLQRQKLMAVTRIYPPRNQPSTHHALSISYPAPHSEEIGLIQAIIRREHSSQSSTDNLTARPSARIVALTCRGHSSLMRHQPAGNTETPDRRILAPRQVPEALPATDSTVPDILACRLSPVGGTNHCCWIQCTSPNAHTRHGHGLFNGPVGASPRPTAQRSAALGVEHTNPPAHATGPEIHTHVTQDTTKHKATRNSHRPGANERHALTQPPARTKNTHPLGSPETNEP

SEQ ID NO: 967587 - protein, 129 aa, Homo sapiens
MRDPTPKQRPSRIKQALPYARPKSFRPTHNVYLISTHTVGTPQGRTHRYQLTTLSAYSSLTTMTDKRREKSREHKHETHRARETDRHPQVDRLYPHSSRERYTSILVGKQPPTYFTAILASHRLLKRTC

SEQ ID NO: 967588 - protein, 323 aa, Homo sapiens
MLTWLVSTPETQVIRLPQPPKVLGLQARATVPGLNFASYKGVFQRTSLQTFAILTLSCQGHSALTERRLLALHQNSALLTHDTAHSSADQRLGNTHASYHSYSQQPMQIYSISLLTDDRHVHGEHHSTIYAISGGTLKLFRIWYLLSECALTPMSQHCLALNTPPHGQTPAAVRQNVTHTDDRPDEPYFPGIQRGRDLVCVSSRTRPALAPRLARSPMSLRLATGSPAAPDHPRPLPCPLTPPESPPVSSPHAPTRNLSAAPPGSRGSIHSRNDAPGSTNGSSPPAPTRALPHPHAGSAAAPWTSPSASPPPRRCTPVTCLAL

SEQ ID NO: 967589 - protein, 309 aa, Homo sapiens
CEAVGELLLEVCRGTGKDDAGIKTLCHAHVQEVCALAETTKVQVNSQVSPVYAPYRRMVEKMNRNELIVALLVEHDIPCHMEEHAKYKMRIATFPRTSRRVPKVKLPSMGRKSRPLQGYSRRGGSEVSEHSIEDQLKALYISDTRHQDSCAMRQGSHEQVGARLWEITSWSENTIAYAVLSILVELSDCALFGRTMRYVTGLRAGPLETLGQLGGSVPVSPVRRCVARSDSRRFRAVPVSNRSHLGWYSLVVLTPGEASAGGSPDAPRHLFSRGVASRFATAIQLGLAGPNLTAFTLGPLVTKLAASGS

SEQ ID NO: 967590 - protein, 84 aa, Homo sapiens
KGVVLNLSLNAYRIAESGSDEAQEEYDRQVRAGGDGAPGAPMARQRDARRAYARPWHVQGMGERSETGGGSWVAWYMVDDVLEN

SEQ ID NO: 967591 - protein, 376 aa, Homo sapiens
RGLRTALRAQSLAFADPDARPHPAWQLTMDDDISLRSSIDNSAPGMCNGLCILLWRQMHPRGLSSPPYVVSAPVTPVAVMVGMGQKDSYVGDEAQSKRGILTLKYPIEHGIVTNWDDMEKIWHHTFYNELRVAPEEHPVLLTEDPLNPKANQREMTQIMYETFNNTTMYVAIQAVLSLYASGRNQWPLVNGLQRDGDHHNCAIIRPRSATTPHCILSMDLAGRDMTDTHERLLHTEAPSYRVQTANYDHTGYKSWRYPYGRQDEQKVDHEPPRQKIATREQIQPVETATKLAEDKDITRVKRTDPLPPGRRLTATNFRNKTGTTTTPPTLRDSRENTTRCTTELRAPRRSNIDTRQKKEAVETQNTRTKTDDTAGN

SEQ ID NO: 967592 - protein, 208 aa, Homo sapiens
MLQIQILANTQMITFKAFKSTGFYPLFLQTDYCQLYIVFSYNILLFSIIANQFPATFIHHTIPDPIIHTVRLSHISLSSLAPTLPLVIYTIRRCAHTRHCIYQVFYHTMELYKLPNITCTGRLKIAFHHDAHSFAHVLGQTNTTSHYVKSNKQLTVTLMLHKGMALSDLRRHNTDVPVYRQNTKNKKGADPDTNKRFSPPRRGAHKRP

SEQ ID NO: 967593 - protein, 221 aa, Homo sapiens
CCPLVYRSGLAESYISSVEYSATSRIGAVRWPRTVGVRFLEKGWSRLTGRPPFQTLIAVVGTASLPLLSPVGTTVRGVSEKGWMNMQVSALLVSRYVYQSCESESTTSLTRDRKKLDETRERIPMASMARARDVDGDSTMYESKTKLRPRESERPCRATKRKKSVKGGPMGAPRRSANTPGVPGQVGATRKRKSAATILGVKAPPKACGRFAKLGDSPGDL

SEQ ID NO: 967594 - protein, 207 aa, Homo sapiens
MFVDVGVTGSVQCPRFPRIRQLEPCCTRMRIQRSTCPSPCVTSSSCDLLRMRFANSLVGNPLYISLVVLSALGIRCRSGDIGFSSWSPLCVRWPLLPGDCVVWLHAPGAAPGAHLPGPCLDSAPLGSYSPGFPPTTHRSSGWGSRSYDGSQSSQPVAPHAPHPSDVFVPAIWGPPGRAVSGGFPRVVSLVVAHPWGPLYIGDATLSL

SEQ ID NO: 967595 - protein, 440 aa, Homo sapiens
MAQVSDKHVSIHSLDLFIILFLSITALLPGAENLTSYMYMTRWAIFSYHVLHYILYIKLIENELLRACTILHTLLHGLYAVKYIPVILKAHYEPWHMGRYSLPRSAQKLYRALYLFRRCYADNKNRTRPLPSLSSVEPRDKSRCVGRHRSALPWIALRQLIWVTIATLIATANVMTATPDTTSEYGCAGLLMGYRTNTIKGAVTHLPELLGSPLPFTPSLFLHTTTDHRTQCPTTRTANHVTEARSAPFPRLSIHISAQPGSLLRAGRGATAEALTSHTRLTVRSSELKRVTNNSTGCGTTRPSMGVSARPPVVLVGQRSSTSPAPGLRHRHAARHTKKHREPTPPGSPSRGREPSSRQQGEPSTRADRGRARETRSRAQHPAAPETKAAVTQKAARSHRRISSAASPRARQGAHTRQQHQTHTQERKPRSRARGAERAT

SEQ ID NO: 967596 - protein, 126 aa, Homo sapiens
MPLLVFVLGGPGRLGEPVRPHFREIWLRTHFLQESCFVMKGRNPDSQYGELIEKYIIEGKIVPVEISISLIRRGKWIDTMACQCIRRINALIDGFPRNQGQPFKDGTKTWMGRQMSLSTCFFDCKY

SEQ ID NO: 967597 - protein, 192 aa, Homo sapiens
TGASLALDDCSAGKHTDLRTYPKSDLDVDERDGMRSASAFHDENIRSSDVIDTLKYLSDLENENARSFLQEELSSSLGDFIYGMPIGNDRHRGVMKEAIEQIPILHSSGALGERAARYLTLIPQQDKNTILSSIVDSVIAVTKACTGSVTCGTIRQSLGHQNAVQCGKLLQAWSLYISIVLARYGVGLLSPA

SEQ ID NO: 967598 - protein, 344 aa, Homo sapiens
MCTDERDEAATERQSAAEVSGLIPELPQRRAEGEAANQESITIDASYAARWSGDDHSPAGPRTGRTQYPARADKQIKTRRDTPQRVKRGEGTEDSTINRTAAPTPPGTPTHGATATASVRQPTNHPAATARMAPRTSQNDHPTTPTRPSPHPAPPRARSRQSQTCTHSITGGTREQQRSTTRTGQAGREGNTTLRRHGAVAPAPRQGAPQPKDVPPVRRAPDHQHQLTHRALPGELTRSGMQECHTDQKRDRADGRASGDARSRTHSRAAMPRARPRRGTREARAWLDEEQSDRQSSGTASNHRGPHHQDEHRRQPHHSRQHARANSARQDPNTSTAEQAHTHR

SEQ ID NO: 967599 - protein, 83 aa, Homo sapiens
LYTVVLEDFHHSFQYVVLAQDMHCEWYRNWCSIDSLQWIDEPVCIMRKLGTFWTEFILHSSRVTHEDLRTMFSGVDTQANQHL

SEQ ID NO: 967600 - protein, 178 aa, Homo sapiens
MSKRNSVVIISTKGCVNGPDVLLSTRRRSREDALSAAAGMDNTDRVAGDHSHGSNNQCMATDSVDHEIGPVQQDSVVQVMMLMRRSNKGPLLVLCEDHRGRMVKHQCCPGCGYFCTAGNFMLSVSPESSISHRLHEDCASRVNNASVLVPTVGEERAPRGKEVTIAKARHDSTVMTSS

SEQ ID NO: 967601 - protein, 344 aa, Homo sapiens
MDHGVVQLIYALQTFNTSFVLIITREHRKTKSDQEDEHHDEMDTQMINRDNKREEKQKTSIKARTARKRAPKVHGEPNERRTPTAREEGGKRPTRTDKSAVKDEQGLGHPLDEPAAAPRCETQLREHVNLRRAPSRDDAYTETRHYRKQHTDPQQMPRETSTEHNKQTRAHNQGSMQALCGEHPQPKDTQNINGEQQAHWQEEAQTGRMNKNTQETKYAYRNTTRGHPNAHNKTNERNCNHTAQRRRKAKEPTEETKFNTRAQSHIKNRGPEEEERRSRGEDGGPTGHTDSEKSTAIAAPGTAGPDGNAGTDTPAQRGAKERGAQLRQARKRARDGRIGEAESD

SEQ ID NO: 967602 - protein, 390 aa, Homo sapiens
QKKNKTGKTISLTDFLSEDGVRTGRSDSHLMYSRTRSRVRAALNIGMYLSDTEYVIRPRCAQIHDDDVYRAPSKLTRSSRFPLGSIVVWLRESQIFDSEACLRQSRHPTLRFLGNLPYDVTEESIKEFFRGLNISAVRLPREPSNPERSTGLGYAEFEDLDSLLSALSLNEESLGNRRIRSGTLLIKHRINTGHDRTFGRDSRNRDSDKTDTDWRARLLQTASDELPSLEEVMIASDDQVSTIRMNHDRHRECGIGDATRRWHTPGASWTRKCERRKRQMKNERSRGNLLQENGRLKYPPGILAQQLTQQNAHLTEHWAEHPASVTGTTTEKTVTDSEAIVSTSRAIPTRGRSRLMGSQTENTLQRNNHTTGTVGGRPTELRQSSRSTIY

SEQ ID NO: 967603 - protein, 153 aa, Homo sapiens
MRFWSRLNAISLYTDWLGPPPGVVLPQYFVQLKPCSQACRDRDTGPIWNPDHHQSPWDGYGKACHGHSPSYPRAASPVAQGDLRTHRRLCEMAQVGGPHSFSSWSSRAWAPFFSGFPRPSPFVAFQSGALGKGLETLSLGGPMGLPTALRTGS

SEQ ID NO: 967604 - protein, 227 aa, Homo sapiens
MCPFRHISGAEDSCVQPPGCVAYGKKGDQCEFLHEYDMTKMPECYFYSKFGECSTQGMSLPAPSTPESKIKDCPWYDRGSEATVPFAGSRTHRRSHLCELPRWDSARRGPRVKFMHPRFELPMETHRVMPQVAISKDTRLLEKQENLRRVIGGAMASVPQQQAVAQPGDPGHLKRPPGPFVGEKRAVTATGAQKGTGLFTKGTLHPLEAPPQARGPWWESHLKVIAL

SEQ ID NO: 967605 - protein, 77 aa, Homo sapiens
YEKHIISNSDHTIQATDFYQTKKKQWCYNCEEEAMYHCCWHTSYCSIKCQQEHWTRKEHSAPAAGEDECWPFPESPR

SEQ ID NO: 967606 - protein, 93 aa, Homo sapiens
AGAAGGALEALVSLGWGTAGGFRGGLGSGIRGRGRFAVDGAGAEAAKIDVGKAEGSGVDCPSPRLLAVLARTDMKINVPGGRFYLFSLPIKGI

SEQ ID NO: 967607 - protein, 143 aa, Homo sapiens
MRECISIHVGRLVFRLECLLGALLLEHGIQPDGKMQVTDSEEMIFKLSSVKGWTRARVCIVTRLMKSHWLRSLHPEQLITGKERCCSNNYARGTTPLAEGGTFIDLVFVSPHSAKLADPVQPRLPGRSLVVPTTLLVGGNMVS

SEQ ID NO: 967608 - protein, 78 aa, Homo sapiens
SLSLSLYVSLVALDSVDRNLKDSRKDENGDNETIVALEAIICHQMSIIIGDFNLPLDKFLQEQHQNWMNALGTFRDNA

SEQ ID NO: 967609 - protein, 245 aa, Homo sapiens
MGRHAQTPAHAATQHQHLGMPQHHSMQAPCFKHSHIPANVTQPAQRPPQAASQLTPDQSAQRSPPVHTACSLCDSHNLSTAISLCTHSQVIVTHAVSHSKTTSQPGHNHSRLPTQPAWLAHSQATHSHYTPKTTLEHTSATAPNTLTPTSNHKTRTITQQLPPPSPPTTLVSFPAPTSNVFTMYPNTDTDANRPIRTTTVKLSNLPHLDPPAFGTTGTTQVITLMSPDITSNYTPSGGLSQKTPL

SEQ ID NO: 967610 - protein, 146 aa, Homo sapiens
MGVQYWGGNGAATPAGGLNRAQIGPKPPKFFGGKKKARTRFGKGGRSPLDAYSIQGQHTISPLDLAKLNQVARQQSHFAMNAPGPRATPPGGQIFPPREIDSLSRGERLLGKFGCISLKQTASWENRSRRNFPNNLIGCIIGRQGA

SEQ ID NO: 967611 - protein, 498 aa, Homo sapiens
MAAFVFPGDDIPSASFWSLHTVSMNLGLASRGTLLDALMRLEGRLALCQNRVVSPRSSSRWRLSLGACLPCERRGVLRLPCLALFLVGRTLLLITCVRELRFRIAGFAWFQALGLTVLLSAFCAIDQLAGPGSAGQTLASTSPLQGVGQSLPFPVRQAPGMGILHKRLCAPEPFWRPFDEVTLGAMAPHSPWAQANSIAGWSNFPIPGGHTRCAHARRRGFPICQGPGKEQVASSWGTGKKRGQMHQQSNTRRNTEAIAFAGAPPQGLTTRARLQAFGPQRGVFHKAQWALNRPTPVGWHRRPAQMTWLSNVRAPAGPFYNPVFPHFPCPKRGQPFYAGAPLRAPNGASPLGRAGPLCVVVPNLCGAPIIFGGRLHYSFGYVVSRKTADFGGELAAQDPLVAPKEKGAQQPLWWAPHRGSRFATPTAVWALVGAPLMSTRSSVAPTSSISWASSSVRLMEGTDLSQYFIITHSELGYTSGTTTSVGPTTNAAAAFTKA

SEQ ID NO: 967612 - protein, 31 aa, Homo sapiens
ILISSASDLLLFGIFKIRTPIFWWLSLGSPT

SEQ ID NO: 967613 - protein, 169 aa, Homo sapiens
QRSRWWDLTVAPISLFSALVAVIFSGNLEMALAGKAGKGLRAKSQDNRRFTRSQRAGLQGPQWGRYTSTSKDLGQTQSWSVWCATAAVYRRSHPGSTLTAEVLDLAGNASKDLKGTSVLTPRQVATCKSVEMPELDSSHQGYNWPGGGVIPRHPEISDGDRKDQQNDLS

SEQ ID NO: 967614 - protein, 411 aa, Homo sapiens
EFFDAIGFQKVFFGRSGSGGPPEEFYVLSETTLAQSQSLGEAQGDSVLACGSPVRGQAWTGERRRTFLALRALGSRSSNCLWDFVQASQQRRSSGSRGSGPEAVGGGLDALLGAPRPDAGKKRASQPGRLAPVYQFTRLMARCGHSPDGLPSWQRDHFSKRLRGIPLLPEAVCTQEFSHQVKAPLHKARIGLGIGGSLAMPFGEVHTTLCPGCTDKSLGLWNRILHHLDRPFWPSVGPFLGGQHWLALDATTKGPGGAQMRGPPFVRKPPELLLARTAGERLLGELTNRGVLSPQPCECFLCTRVLPCELHPQGTPRCFKHPFGIFGSPLETWMAPTVKFANVPLWTPTPLGCGIPPAVWVCPVFRLIVEWSRANEFFGRPYVSRSCNTCRGESVTDKFYVFRLNSVSHVV

SEQ ID NO: 967615 - protein, 79 aa, Homo sapiens
PPASPASLGSEGLQHLDQQLLCSISHWALAAFLRGRAGDLQPAMPEPPPSPPWVPAQSEPPQRVLPPAQGTQSHRPPKG

SEQ ID NO: 967616 - protein, 422 aa, Homo sapiens
MGHLPDGVRNRAMAVVNRRGTRDTKGCHLISTQQGHGFGNNAPNYAEVGLLSKFRVRPIGFAQPWLLGAKIHGVKTLGWDKRGLAPPIWRAPRDSALVRVPKLRTKGWRHETNNQHGGAAKLRPGGIDDRSICRTEFAARCVAPQSRVWLKQIVSLGGQQWLGPHKLVPAETWRAQHFGELRRPLSANNSSAPIVLSSPQDVEEWGFAKTVPHGEEGLRVAEVARALYGSGRVMRMMSPECAARDPYGEYAYGIELAFILRIAGMGATSLLTPSGMWREKTPKAHYHSEDLAKRPHYMRETPRGELGHANVEYDPGQFHGKPRGHGAKTTASNAQGGDNTTQGTLKVHTPHGDITGRQPQTGGTGATQSVAIRPTQEDAYHSYYEVDNNTGQTKDINKRGTDPLMSTNTKRSKQREYHAVHK

SEQ ID NO: 967617 - protein, 204 aa, Homo sapiens
MVIRSKKDYPSEVRISSVPWNIFRLLTVGLCEVDMRMTWVKKLRKLDLSHNILKSFSYNWENSIHLSGIHSGGIHCGHLVCNLCRLPLPKYFRSLGPWENNQGLRCVGTPGIYKFNCRKVKGSRPCGQRGPLNTPPVDAVTKEPKARITQTHEKRSSRKSDQQSPKRHTTAVTPNKRALPTSGQRYGHLTQPTARHHDKIDLST

SEQ ID NO: 967618 - protein, 321 aa, Homo sapiens
MKVFVNRRIAAEAVEVEQCGSRIEPDSPERRETRVEVWLGAHRAALTPLRSRGLEDPGMRDEWGPILKVIERPMIWGGYLTTWVFVMEIDRQAWDLCSMAYTTRWSLRSSSYRRTSTNCPLIIDQHARRLSGRPSEEIDMKMGWRVHASMRTSPRPGNGGRVDAALNRQRSDMIRVYHRCWGRIGQAQCSESWKPCSVSQSITCDTGRRGQGCREAAGNSRQSLCVHLKLVGPVCFHFVGGPAQLQHLWRGTSGDDCTSASEDGMDTGVVQRASAGGEEVADKEDLFPRRWQVAGIGLVAGFEGARRCVSPFLGRELGIAP

SEQ ID NO: 967619 - protein, 129 aa, Homo sapiens
MTSENHVNDSDEEVTTVDCCAYRPGDDSGQGANVSHLGDTNFQFRNLAVHYPEIEAQKEGPAQGPSTHGGTPRNTRHNLVTQPPGETRGRPRAPKNPGDRKKPPVKHRAEVAEYGHTSKTARTGANRNT

SEQ ID NO: 967620 - protein, 116 aa, Homo sapiens
MQSALLTNSQWCVIVEASRGARGLMNGYRGPANGFRGGYDGNRPSFSKHSKAVVIHSLSSVSPRDYSWLSTGMDIRLEFQAEALGQSGPRWSPIEVAGWARPENQQRDAANEHSGK

SEQ ID NO: 967621 - protein, 116 aa, Homo sapiens
MNRSSYLLMGHRVADKHIPSCPNSAWKGHLSMDKSMNPMLLAYFEELLHVAGNRRFFAPYQNKAITVASTHIELEKSIGISLESAAPGGRGGTRVCFPGAQMRVNPVDKWGAIPVP

SEQ ID NO: 967622 - protein, 126 aa, Homo sapiens
MDKNIPDNRHPQKRTLATPRDEPHRFSHMREPALGQSKRPTTAEKSIKPLNQTTRRRDHHPGHNSHMNSNTGPHNTDRRRTSQPTKTDEHPKEENREQRRARHQQQSTEKNHNTDEPRRIHHHESG

SEQ ID NO: 967623 - protein, 127 aa, Homo sapiens
MGGPLDRPELGGGPSQYFACQGVSPRKGPGFVDKNSQPGFWQRKHISGGNGSEADQIQNECSPSGLCTKSARTQEVPEENPYHRGGNTLSTWCDQVVHPLENSHKRISEQERKYAEHNAREENSREQ

SEQ ID NO: 967624 - protein, 533 aa, Homo sapiens
AVPSGTGDCLRARVRHNGEERRTRSDTVSMHELVAGTVRAYSRGYAGGTTRLARSAGRFARIRCAAGRLLSKNTRVRSTWIVDSACQDTGRLVTWCDRRAQDDKSCATTWVAEKVARRYETGGRLSQAMWATDSGDATTLWLVKRPCRSESGRVAAVGPLRREATRYVCLELTQSGHARMKRAQKGADTEPGRESHGTSEEIYSIGEHLFNKRPEELMITGGHESPETQCHGSHIVTASECQATQTVLQVCSTGNLLEQSLARVHAKTSCAEYQFYYKKGEHNTRHSRAHTTQIPLAVLREPLGALGPREEPLELEKLNAFEFGHVHFPFRVGQAERDLINGIYQPKIGTRATEVCGGPHFRGRQERIPTRGDDKELVWSYQVLGPPCVNIFRMSNGEKFWCSNRVLGEIPYTVETTRGRDRQRYKKRISGPESVAPKDSQLQPRIGGQHVRHADSERSTHRKKPRRSIQKSKIIITEQQYDTPQAKETSPIRTRRVSNHTPTSKTSEAVCDSSEEDTEKRSETRPEWTVRRG

SEQ ID NO: 967625 - protein, 131 aa, Homo sapiens
LSRYGPSNLEPDSACELPGVLPARYPEASTEHYKAALCVPGLRIVGHRVVPLKLGDHPLPFTRIAVGVQSPTSQAELHHNQVIRLSSAVRGATMTANGEPAQRDLERTEPLRRRAQPECLLGDRLLAVHGW

SEQ ID NO: 967626 - protein, 359 aa, Homo sapiens
VTSACSYWVSHESPPALSRHHDRLQSSGAVTRTHYTSGNAGVLAAQLCASSVGQLAVQQASEPKSACDTIGAGVPGAVIAGWIAVSLCVSQGHYDFESLSSCGFAAELLVLPTLDRLRMQGVARTRRTYDAQYSPHASLTILEAPCTGALPVRLHPWTLDRNGPLIHHYVAPLLARPQGDALDKRPIVYGSTCRRIGELWPHELEIERPRADSHTVSRSFARAREVGSPDEFAPVQAELRCRYRSYPALLVGAYPRRESSIYVPRGTPTKKEGDLRMKGRGPPLRITGTSAPFEGYRVVSRENIPPPPSREQLYGGTKMSVPDYGSTGTREVRQVFTYYHTDIEKNAYCTPTISLRKRN

SEQ ID NO: 967627 - protein, 229 aa, Homo sapiens
MGTTRPHQQTENLRTSNTPTQQRRSAPSTAFQQITPPHPGTAHRQTHQGNTLPDQNEKPHHITTAAISPTKPTGRTNTPHPNNTQDLNAHAHHAPPSPSQSPACSKPPAHKHAASNTHTSTELSTHTGPRILTQYSAAHTERKHTDTLLAAASALHTRTATTTPPRQTHPAVASSRSLRDHPRHDVRSAAPTPPYTTSPHHTHAAATSTSTPTTTHPLPPTPPTTDATA

SEQ ID NO: 967628 - protein, 559 aa, Homo sapiens
MNATSELRSPPPNSNPGPRTVEESSTITPTARPTNTPRRDRKPTGPEQRHALTTGYTYSTEDPQLARALLRTSTRKRRHSRTTKTYRATGTHPNAPQTAQLPHKPTRHPTKKATHQTNHARHGPEKHALHGRQRPDTYTEAEQGNRYNQHTQTNNQSKHIPRQNNSRAPTRDNSHKLEHSTAIRADSHTTKPTTGYSPHTMGISTKHTGHKRQDRHAERDDIRTPPQDTTQIRTNTQTPTQKTRELNTHRPPPPRRRTAHNIDDHSGNTRTHTTASHTAPHDTSSIATRIDERTNNSTSTLDTPAGTRLHNPHPDATRTTPASRTHQLPASHIYQKGEHTPQRGTKTYTQEAQQQDNEAETCPQRQQRRQRSPKYNIGTTDNRTRAQSPAEQYNDRPRGKIEKQQPGGTNRRRTTDEHKQQEQRETTRTGNTHTEPPRQHQTEAHTHATSNLGDAAAPVAHRAPQRCTAEPSHKHDTQNRDAAQTDRTAQKNEQTQQHTPDEEQAGHKTRQSAQSHTERQQKNGTAQTITKHDTQEEKEENANDTREAPHNDTDANQSP

SEQ ID NO: 967629 - protein, 328 aa, Homo sapiens
MYKRGEKAPHKGYFTYKHKAQDIENNNKIFGAMVRKRCVVGLGDPPWIRRPHGYNSRENGLMQTDRRTKRWAQQKTPGTTGECSPSDQRRRAKKHSRDPTHVRTATHPQGETTRGVDKTSTKRTHNNKNERKLIEPLEGPKNFAPPEEKESYTAENGATDVTEIDTMSTEKENEEKKERRGHCQKKNQQQQRRDHPRGTKRAPEASNEMMTKKRGNNIYCRMMNTQGDANATSEHQRNAAAPHTWAAKQKGADKTNGKSKPRNHKHRTRKQQRGRANKPGAGSSNDTTHTARETPGSKPTDLRKVTELHHSEGRRRKRKRSSSSKRDT

SEQ ID NO: 967630 - protein, 315 aa, Homo sapiens
RSQPSSTQAEQAVGCGSYEHGGTEHTTSTLDTGEAALRFRAGGRAALARHVPHRAQPQQTATTFQLTDAANRTRRLRLTRSAGDSTQLSQALAPSLLVDQQLALGLDSGPYQPAGKVVWPAAEDNSSSGRLLRTIVSRSWTAAGKARSAHQPCPAPPPSRPCSSFTAVTGSICWLLAVGPPLTLTDKTLPGPWHLTTNGPQTPNSPHRTVTGFGILVFPCQDPPGSLRIPSAPQLPCSGQDEHFALGSPGPPPLHSGCLQLLTASGTQIHSEHGANNAPQNPPTHPPTRGQRGTAHPRPPWTAPSCRLTPWPPRH

SEQ ID NO: 967631 - protein, 121 aa, Homo sapiens
MRLGLICTRLMARSVFLVCYRLNGIYTFEHFWGKKITYRGNQWHGGGHHALARPFPTFRFAPDWRRGQRRNTKLISVTFPKMEFLRHSLSKIRPLALLYQFEPVTWETLAPKKGHSGTSDL

SEQ ID NO: 967632 - protein, 30 aa, Homo sapiens
PEPGAHAAPSQGIPEPEGEAAGKMTTEEQQ

SEQ ID NO: 967633 - protein, 55 aa, Homo sapiens
MHKQKDEQQRTKLTRQRQRRREHDGQKPREGEQTEADGTKSTETGRRTQDEERRQ

SEQ ID NO: 967634 - protein, 173 aa, Homo sapiens
MCNRDLIHVLVNTFPIPKLVLINKRLTSFHVCIPPRAILPPCALIPNRSNMGLYQGRNFFQGPAKGVLSGPTKVEKPKTEGERPPNLTGSPPRGQRAHPRQRNPEYKARRDKPPDGNLLQTNLSQAHEVFGNIFKLPLDLISTNGGSYNRLSQTSTRRHIITQPNLLGAPGSV

SEQ ID NO: 967635 - protein, 96 aa, Homo sapiens
KEYLTSALTCFLHIGHFHTMEVLSRILQFTLDIPIVHQVIVNHICNRSLMERQPSSYRQAVSSLCALLFMALSNSVWDWLTLIAIHLDRDSRDTAL

SEQ ID NO: 967636 - protein, 150 aa, Homo sapiens
QFQSLTHQSPPQQNVQPKKQELRAASVVQPQPLVVVKEENIITTSQRAFALRCGEPPSTGELSPVTATRMNCGCRERDRPKQRTHRGLTDNRTERDQCAKTESDMALAAMQASTPSHSSHQRSRAVAASERDVRGPESATAEGESVETLR

SEQ ID NO: 967637 - protein, 127 aa, Homo sapiens
MTPVTLVIGARRKTSLFPSALGITTKISRGHLLKSWVVRYVASVCLQIGYPTVASVPHSYHRRGTNEVLGLSVETDNTSHCLNTVKASLVIIWLCVCALLVVPHSWSCCGGTPEGEAREIEDIARFG

SEQ ID NO: 967638 - protein, 242 aa, Homo sapiens
MACGVGCQGEARRVLVYCGKWCSVFSMRVRLFVSQLVGCQRYDCWYVEMTEAMPHTIICLNTDRLVHCKQRMTQRDCWVFGKPLGMKENGGMENIFAVVCACELWSVGVTAYHPRSLFNETCCTVFVYEPEAFLDRRIHSPMSICATQASLRASEASYVLGLAHIAAPGWDLPVYDRVRAMAKWVLFYQLLPRDWLWEEIACVPPRGQATIAVLPVTLDDPDEEKSNCLRLTSTLDTLRNSS

SEQ ID NO: 967639 - protein, 126 aa, Homo sapiens
MNQLGEGELAKICLEIMQRTGAHLELSYGQRQGLSIMVSGKLDAVMRSSEGHRLLTEESGLSNCCHSPKNSHRFVDGKQWRETGGFGAKHWEQKSNPPARVTGHSVRIRGHKGSNSAAEVNHLREK

SEQ ID NO: 967640 - protein, 264 aa, Homo sapiens
MCSSCTRLSFSVSRDGASSRGARAVRRSGQVHRLRPHGIQGSSIIMETRRTVAAMPQQSVAAITLTGRLCSAGSSHPLAKSGTQEISHAWLQHSWHEPDRRLATLTTDIRQDPLPTHDQPTRHSTGPRAQPHSPNQRPNHAYRPAAYRPHEHGFTDSLTPEPRLQQQQLQSSDPHHTCHAPQDLKAPGIHPALQGVPYTSPQSGNFPQQATHEATHWDTPPTPTMDAHRLRTPERGHMALRPTYHYSNTNDLTPRTHRFPKLEP

SEQ ID NO: 967641 - protein, 545 aa, Homo sapiens
KCRDYTLSFHSQFPCFLMIFSISYISVQALCVSSWATPKVCPHSFRQLNQEEALYSKSAHSSFRLYCVIPALWVTQESSIAYSYCTILYWACIPSAKALDSAYSPRNINRIYSVDTTIRPCSSWDLPSRALHTCTIQSIYYHRLNYTTTMTERVRGHHYSSISRERYAYFKTHITRLHTKIYGGTPCWVMHPWKDSLASCNKSKKHLHMVHRPLVDRLTGSHTYTRSPIDQGEHWKHGYPLTTIYAWASLTPPSNRQGKTNRQRNTTIKTTTQPHPPKSSTQQKHHPRPTRGDNHQRPTDTYMRHPHTQTVRTPHATGNTQGAKDKNSTRNRGKHEKKYERNLGAKHSRQEQSQRQLAKSEQPQRATYPTNPGDKEQHGMAYAGQHTRETLTPHPASDVSQAWRKKDTSVTQTPKPNPDQLRTNTTATTRRKTQQERAPQNERTDNSTSTQEKRTSATYNRKNQLAQRTTTDAQTTTRSTSGGANNQPQQQLAQKPNTSTPRDIERTQNERRKTTRKYNTDTSQHINANQRITINQTIQPPVQKH

SEQ ID NO: 967642 - protein, 251 aa, Homo sapiens
MATSFRRLALLLGREASPKSSGHIWKAADPGIVNLECMYETPEKVCVVMEKLHGDIVEMIHDQCERPVPDRLTSPHHPRSVVALRHLHFKNIVHCDLKPRKDVAGMSRDHLPQVTLCDSRLWIAIIAPTKPHTADVTAARERPEHNHGDPDGGQPQTQGTPNRLTTGTMVGQGPQLNTLLPYSHPEKHITREHDELEDHHRDPQPEKSRPTKVPETGNRTTLHRLHAHEPPHTTSCSCKCHNAPGDPNTAH

SEQ ID NO: 967643 - protein, 262 aa, Homo sapiens
GLSLRTWTFLKNQVESLQRRVEDEVKQWSGPGWLAVVLPVSSRDSWLRYVVCQTEGHQQLIVAYADEAPVTGIYAASGMMLCPNVPEDIKRTSLQVCYRKWARLALGAMARGRMSSLMPSGVRHFESRIPQLSSDLPIVGTLPCHRSILASRFLQIVDSSSSGCTLDSFFPFLSSMGVAPRLWLQGTTMPLLFKPLTVGVWLDASVSSVFSLAMFHGFLFPGELASRNLMFPPTLLQSRWPLSPRRLGGHHLSSSGFSARGV

SEQ ID NO: 967644 - protein, 197 aa, Homo sapiens
MDSLATRVEGTIVYGTLCTLCKGQSLSRESEARGDACWRDRLASTVGPKQEHIRSQEHWRQCGTLQLRIPSVVEETRDTKPKQIVDDPRCRPIFMNGWNPSAFRPGIPLCPLLHLRGLPTGARPTFPIASRLTGHRNIAPCSTSRDDSIQRVPTQLRNHAALPAAHLAHSLHARVYPLVHTHSRKTALPLEQHTHPE

SEQ ID NO: 967645 - protein, 170 aa, Homo sapiens
MTPSCSAKTSYVTYDVRTHISQRENSRYLYEKVMIIVAELRASNKCRRTQREHPASAQTIWGEQLGKRAHPSCATASNSKPVGRRRQNEPHSRADEDKDDATNSRVKEEAQKGKDKTQTRKREKQEEGTKGGARADHAWEKRPHATRANIDGDTRALGRQRSERASTNSG

SEQ ID NO: 967646 - protein, 343 aa, Homo sapiens
GGPGVEFARLTDQASRVTIRVMASNSTKIFLADAGYGEQELDANSDPYGIGQRPEDLANLVNSVKQIVRFPRLISEVSIPYSYQFCIPNSELMFSELEIISCRLCVLHSYPTNSETHIRQKHLTHVASTSRASSTSLLCIPSVTCILWPRAITLRHVAKSWHQSIPERKNAHHSIRQSLDSHDHCRSQTAAWRTREATTHTCRKANGTTATEPRNPRSELIQERDTTTPKHKTKPRQTHRNKKKEETSSRKKEHTAPHQPTTKGARGADRHRKRHEAATREKRSNESGRTAEREEERDDKTTQRDTEKGKEAREKEHDNARRTARPEGNRGGGGKRRKNKARD

SEQ ID NO: 967647 - protein, 184 aa, Homo sapiens
RVGGPQEGVMGKDYYQTVGPGPRMRLDEEIKRAYPPTRLLQLTTRTKNKEPGDRGELFKEIAEAYDVLSDPRKREIFDRYGGGRPKGELAPMWQDELAGGADGTIFQRTTFQWQTRHAMFGVSSSSGRNPFDTLFGRTWNGGKEGSGSIDDPFSVLPYGHVGGFSNVSFGGPRSALRALPESKR

SEQ ID NO: 967648 - protein, 251 aa, Homo sapiens
GCLPLSDGTGTYQMAGFNLGSKLPDSCKWSSHTVSRDRGIWMQNVVALVVVRRNPEGGVGDAPFRACWLSGSWSLTSDFLPVLELWPRFVVVTLSFVSEVVAVRYLLVACSFQRDPGDCRMRVQGATSVGPGLARLSLCIESYTWLAQKSMQLVYGNDDYRVITCPIHFTSSFALRGHWSRICHIARGEVTRKVSKFTGTPEQTILTQVVGVDPCGSGLGPIQGPGPTKPWGVPPGRPLKRFPGGRLTLAI

SEQ ID NO: 967649 - protein, 93 aa, Homo sapiens
LHTSESHLAACERVGSPSTEEFSVSEFHPLLRNMTRMDIIRFEITVQMSSYYRDSECNGGWSMCIFSCGSLLYMSVSDARFSSPRVSNGVVHV

SEQ ID NO: 967650 - protein, 30 aa, Homo sapiens
VAAPGDVAGALLKPRRFEYQPRCSRAPLAV

SEQ ID NO: 967651 - protein, 105 aa, Homo sapiens
DRERRPFFLSLALSPRLECSGAISAHCNLRLPGSSYSPASASRVAGITRAHHHTQLIFVFLCSERGFTSVGQAGLELLTSGDLLRPQPPTVLGLQGMSQPRRGPL

SEQ ID NO: 967652 - protein, 106 aa, Homo sapiens
MPFLNRSDMVLTSSIISSQVLRLSGHSAISYHEPMNAAKPSHYQPLFRHPGRQWSEDARDVLITQTTLSMLDISSVFNPEMFDHSVSITTGFWNKSPHIVDLLHPV

SEQ ID NO: 967653 - protein, 115 aa, Homo sapiens
MALIFPQLPTDLTPLLNAPPSPWPPCRTSHRPCARDTPRDRSPHRSSRSRGRPHVAGLPAFPPRLSPGLTRLCRIREGPRRSTAGPPLVRSRPRGACRSGALPARASATIARAPL

SEQ ID NO: 967654 - protein, 322 aa, Homo sapiens
MSQTPRVGVIFVVIKGDDQTRGIKQLRVVRMQRDDIVMRVLLTETWLRSNGSDGFTYPKFYLLGHVVRGSVDSSARSMRALVSLDFRERRILALHVIHNGSTCSLGSRAFRLGNDALKFPLLGRRLFVPDACRGTVGLVPGISLFFVPFVLCPRGGWLCLVHVPVASRLFSLLIVQECPCAFAPVCAREPATVGALSSCPSSLVAPFAAVERPGDEPRRASLLGLWPSVAAAIGACDPCLRPCSGVPRRISSAFLAPASFLVRGRSGCRCHYVGPRFQVLSVWVPCALGVLQCSWLSARFSSPVSAPVAVAGGPLLCPSVFS

SEQ ID NO: 967655 - protein, 154 aa, Homo sapiens
MMVPWRIDCPSVLLASCSARSSRCLVVRPLVGFGSPLLVCLLAAVSLRRFASSLSLLAWLHVLSCLSLPCWPCLPLVCGVCLACRGCGAVTARAARPSLCPLLPLCVPALRCGWLVGLARALAACVACVAVLWGVCGAAVLCGGPVAAGPCSSG

SEQ ID NO: 967656 - protein, 91 aa, Homo sapiens
PLSQIQQHPATGNSLAIAHSRHGQTRDRVHDRNVKNMYPPPSFPYNTSCALVQHSWRRCLPPSLKPDRATNSLSPSTPITSLNCKPITNPH

SEQ ID NO: 967657 - protein, 341 aa, Homo sapiens
MPRDCGPDVRDDDGLTECSATGAPVRPRSASSVLIGARRHTMRPSMTTAGYLHSISQRPCMPIARRDLAQKSANHTMSSSGFQERLATSETESSRLPDGPRASSRIHPRLRYLTGTMTYAEPTLHGTETDRPTRQAKKRGPPLASMDSATRNVRLRLTGPPTQAKEKPTRMATRAKATGCAGKHPGEYRENHGPTHPRHEPRGSSDKQTHRPPGYPRKTNNPHNNAATPAPKGAQPRTHKTHKHGEETPTTMCLAGHQTPDDILTTDTRGQQLMTPNGDALKNSSRATPTKRPAPNEGPQGAQCSQRSNKTEPNHPRGQQTKQRTSNDTTHTSARQDKQTN

SEQ ID NO: 967658 - protein, 336 aa, Homo sapiens
MAHRELPRSLTYENRSSILGISASIYITDWTVARIFRFDMRFNLAIGSKNARTWGISHWPNVCVCFEAKLKPLHRNRPIRVSKRVASCGHGLNLGGSLPENGVELGVYPLVVPLYANIVWDTQGDIFPIWGNTVSVSVPLAGTPEAYAENVALRYPVCNTVWRPVVGGETNFCFIAILNLGVVWIVRGDSLGHVVPFFDLRDTLFGLAFAFGRHKSTRLRPGSVRAFHDFPDLFPGVGAFDVVNPELCFAPMLKRHRCFNARPRHTYGGAGAAYNRKVIRATEESGGAPHLTCAYFTRSIVCGFTQWRAANKVGHLRFIMIRTQRTRPYYNKHLCN

SEQ ID NO: 967659 - protein, 201 aa, Homo sapiens
ETVGMWNCLAPMWTGEKKPRVSVFVLGIPRQKTEVRNRLSEEDSHQAEKKLGIPKISSSLVLLVLLRTGMADLTFPGYCKKARDGRSYQLAGLVSQCWMFRYGFGKGPPGLQHARGREREERQKTEEDEGKGEVRTNRWGMWPETLRIQELTQDELLLPNCYPGLAREPLHHRQSSRVWAPNVELKERKETQNAAGRLQTG

SEQ ID NO: 967660 - protein, 76 aa, Homo sapiens
DKSRTAWLLAPSLRTKTRRTHFRGGGAGSSLSQVTLTQPSGWEIRLAYLMYSTEICDRVLPHLGSLESLSHGILAL

SEQ ID NO: 967661 - protein, 130 aa, Homo sapiens
MDKRYQKVAQRNTPWAHTKQNRTTHKPQAPRHRTHTTTPRAPSNLRNHHRTTLTTEPSRAPKKHSSTRQAAGAKNDTKHQHNQDKLDQAQPKDTTQSQASTTTRHTTPPAKPRHASRTTKHNNDQQHSKP

SEQ ID NO: 967662 - protein, 103 aa, Homo sapiens
MCYTVQRARLKILPPGYWVRSARWGIQRSLSLLLPDVLAGAVSVVEPFVTDISFSPRVLDYCEIPCVGSQILSCQRPASPEGKAFLCGLRLFLCCSLPATSIS

SEQ ID NO: 967663 - protein, 343 aa, Homo sapiens
MRRKNNLPNERAKKRNKQKTQTNRKETKRARHNKREQTKYNNTQKQNGGTQQAKNNKSREKKSRERTQNRQQQRRDTKTRKKEENSQTTRQARESDKTTKSGRRPHKTSHTQRKKTRTHTRDRPNNNTTDNAHNQDDAVTKNKGERSHKTQTKQQDQHKTRRPQNRERKTKRKKEQQARHRADKKTQQKGKKETTAETRHPPATAAHNQIKAHGGEEENNRKQEKEEKKKRKNNSKQNTTTNSHDQRRHKHKERADEDTREGKEAGSATEGKRRDGREKPRDGTGHERGAGPGTDERAEEERDGGHGGQGRDERRREDSRKPRDKNQQQEPRRQQQGRRAATG

SEQ ID NO: 967664 - protein, 213 aa, Homo sapiens
IAASPYGAPRYPDVPFPPDRHTPATAAERHIRTAVTTEEKESYSYVRLSTKPPLISTPLFDCKYSGDDTAILLAPCGLTIQYKKFNQTKPRSERTPLPPYPFDSSPPCCTFRPLPLVTYTLNIHTTTSHIPYSIVTTRRFLNVNRTTNSHQQHNRANLAQLARHPQATYTEPPTASPNTTTSTQTAPPHNRPTGTPLLGPKFPTQKHALSPTR

SEQ ID NO: 967665 - protein, 104 aa, Homo sapiens
SGGPESTDPGGRGGQARKAEHPPPRPRELVRGKVNRAAGRMQGGTPNARSPGQSELYIREWLDAGDGAAETCYEAGRKMNPQQQRMAAIGTDQGAERPTGLQCD

SEQ ID NO: 967666 - protein, 218 aa, Homo sapiens
VLYITSLVKNERIKTNRKRGAGLKFFKKRKGKRGKENKIRRFMASPQHPPWSPPSPRELLAFPPLFRHDHFGLIRAFFSLSSISFRAFLQTCVWNFRVHFLSISGSGLASSSWLGALVGKVSAVGCSRTQARIAYRAFGPSASIHRAVSLVWLGTRFFRALWSLRIEDGGLAPFLLVLQELEVTSASLLPFWEIVLRGKSEQFGPHFKKFLFIFFPVS

SEQ ID NO: 967667 - protein, 213 aa, Homo sapiens
MVRRIGEEVACKHTIGGLVGYYEVRTGGNPIDGSPEDIRRNDFSVITLNELTCNARDRVYEDIGRLKVLYVLYRGHFTEMYLAKQNSVWGIEGWANELAGWRKAFGRILTDSNCTYITVVRCSTPRMMPAYHHAAEKKKGQAALEIYGELESDVVRLRYGYGLPSGLRQAVPETHVFGARLNDEAIGVTQGKGNGVPTVGPRSSRKPRARQGP

SEQ ID NO: 967668 - protein, 112 aa, Homo sapiens
MTSTLHASGHCVSYLAQALLAHGLTHHESTLRAYLSTLNSTQYTQHPTAYASPHLAHKATNTQLFDTNSELQLAHDFLTTQFTCAQTLHKRFIQNTTCNSYQASYPNNKLNH

SEQ ID NO: 967669 - protein, 100 aa, Homo sapiens
VRQPFQGEWYVVIAILGKRCTTSVGAPWRGQNPYQHATSSSRCTDGSRGPSDSRHPTGTHRDQPTADPTTHLGQHDRPMVQQYKYVAIIGIPDRQYFIDI

SEQ ID NO: 967670 - protein, 72 aa, Homo sapiens
LPADCSADRFPHSALSRRTVPAAGRGASDNYTGGGTRQMLSNAHTGCSYVHGKILSEDEDQSKPCEGVPRDT

SEQ ID NO: 967671 - protein, 134 aa, Homo sapiens
LGVYSDSALSISHCDFTLSLADRSAIQCMMSDQMDGVFGYTSLGTNYIGCVKGVLYQYMSTRWQSHRSNENDGKIESYTPCLRGDSITNWEHRMARCDSESYLAGPRRPWLANGDRSKDQSLDLPEKIGVEFGP

SEQ ID NO: 967672 - protein, 279 aa, Homo sapiens
KERYSGMNMPQVQGREQGQDWNRRSARGLLRMGLVLSVWCWRLAPGSVLTRRGDSGLAGRVLNAVLVYSTIGGIAAQRYDIVIDAPDIRRCLGVADISTCPICKMSIHRHQTRVCTRKESLDDGLALAIRGQIRAVCTYLHARDGIAMPCRDVHNPSCSHPSFRGLTVVVVWDTLMCVRPQSDACVACSWAPPVVRGRCLICGTISLAERCRRGVPWPWGVLPHYGPRSTPSRMMGQLLVMRLLIGCPKWGIPPGKKGLQWACPSREMRALPPGNGRLF

SEQ ID NO: 967673 - protein, 234 aa, Homo sapiens
MLLAIYVRNSFQSNGQRGTQEWTYLTLNRWLCLAFICFGKASTYRVQAYSRAPINARWDMYQSPISADMWLFSQAWWLMPLTSLLWQADVGRSLEAEEFETSLSNMVKTHLYQHKQNKYQTLSRHHGGVHSRHSQVPLQQALSGQCMKAIETPERTRLPLSIPGPGMTNTLKPLYHTNLMTSHRHYFISRSHSIARRTPPQLIGRLTSSPSLIRRYAHIARKNTHTFNRERTPS

SEQ ID NO: 967674 - protein, 521 aa, Homo sapiens
AASGGAPDFSSLDPAALPNTSPMPQPKSKMFTGSLLTSPPNPSRIGGPKGKSTRSVRRRPFLRHTTSPPCVILASLFNTNMNSQQAQNKHNTGTISGNTFIEQTTKYITTPAQRLRVNTSKEGAHTPKRRTPPPTNNGEQTTQHHPEHKSSHTAQQPPTTPGHTHHRQRATRHTHGDKQQRDAPNEHPRAHRNEHTPAKRRKHNTQNHAHHDPPPTHPPSQPTPQHRTTPTHHSPGPPQGAAHNHNHTPARGATTPRYHGSKPVHEHTRHDATTHEPHERTRRRPNHRTPESHPSTTEPTTNTASDAPQRQDADTPHRRPRQKRKQPRDSERTKRTTPKQDKHPPNDPTQPEQHAPNTLGRPQTTRQKRPPNPTSTANSRQSNDHARTERPTRSGRAPPRPARVEAAPRGERPPIRDNESRSRVRHTTGPTTTDGRQNTHTAQRESSSTPSAATHSTQRATRTTSQQAPNAEKRRTHTPDTGTRAAQRGTQRSREHTHEREQRAAAPRTNVRRATAPAREQ

SEQ ID NO: 967675 - protein, 210 aa, Homo sapiens
ACEAGCGSARGDCARGWRAAPPGPRSGRRDRDPREPLWRTGHERSSRAQRVPVMPKKLRSGLLGCLELAGTVSVALIFFLETNPVGPPLGAKIPDEVDNDPILVQQLPPDIQNYFHNDYEDQMTHRAHQPLAFSQDPLQEPVTYQPPYTLVWEPHRRPSCILSWWLATWLEVKKGPGIETLSQQFAPLYEMSSLRQRLAMIAFHSLIVWT

SEQ ID NO: 967676 - protein, 119 aa, Homo sapiens
MLRKCSVPLREVPRLLYESCSAFYLFCVYPRCVGTRYIKMGATICLITVVRTLGGAAVYILPDNVFHVRLWEIPFAYRALGEAHVRVMKRERLYKFLFEERVVGHVIWVGRGSYGFGKK

SEQ ID NO: 967677 - protein, 296 aa, Homo sapiens
GECRAGHHGHGRAGHQAEPAVCRWRAMGGVRDPGSSPGMNGAACGLRRGHPDEAVEALGSADCELERLDACCGSQTSWQGIGEPQIAPARARSSYLRKPSSRSSPRKQIKAHGRSMFKQSGCRAGTGFIDLMELKLMMEKLGAPQTQLGLKKMIKEVDEDFDSKLSFREFLLIFRKAAAGELQEDSGLCVLARLSEIDVSSEGVRGSRASLTARSRPFDVSSRFEEEIMADQDDVDKAGEDDEQVEAGSIGGLPGPPFYVSRGVWIATAPWLPGPSCLWEKGWGFREPRLRILLRV

SEQ ID NO: 967678 - protein, 322 aa, Homo sapiens
MECLLCITRVLIADSACSLLTFQGRHVRPHKCAIPLYVCPVLNVMRNYLILKTSNGLRTTGHEVNHCSAWNAHYAKTWLGNYKDTRPYGKERLPRPTHVKHPGADASPRIDINSWLALGALRATDALICALLSCSFRPVTTGQDVTKEDVSWRIAKRSQRTTLTSGELVPEYLYHVRRCRGGTLCPPEAATLVTAGVDKSRETIACAIAPLAGALLPLRSPKEGNGRPQGSWSERRKHRKLSERFGSTYLSGAGDASSHSGSMHIRNALGLGTIGLPPIGNVPWRPGDFHLDCRFSVWGPALLAWFEGGRWFAPFPPEKGRP

SEQ ID NO: 967679 - protein, 86 aa, Homo sapiens
MNNKWTRQKLNSNSDTFILIRTSLFDTKGSLARWDYQCCGFNWPFGNNSPQKHLFCGEAAKGKRLGFHAGTGTLAVIEEPRLGPSM

SEQ ID NO: 967680 - protein, 580 aa, Homo sapiens
RPPRPTPWAGTGVWACHASTTHEHRAKSRHRLGLGKARLRLAQWCHLQNSSTKDFGVQATRGMRWARELAARLVAAHNPTSMGAPQHSSWGLDLYSCVPYVAKFIQYLSAAAKTYEHWLERGCTTTKGKPMRTEAIRHEKIVVRTRSYQGIRRQQSGHCDGWHGTAEEHTTTGQGVPTPPVEGHVAGESPQKSPPTQGATRQSTEGQPPRRDATPRRSHAGTRRRQCLPEARRHKRPDEPPMPQTPTTHPDTRKATYRRRGPPHGAHPTRNPVAHTQDNRQGEPAANNTRPHITAASPRVANPSHKAHSAIARGILGPPKGHIQRDPTTDNKRRHNDQHTAGASPMAHNAGAHQQSKPTLAASRTHTNAQWARRGEHTTTSTHSTTPPSVERHEKCTRSTNAGTDAPKTSQHSPKLDIERHDGPDVRQAETRAKARERRVGDTTSAADRRKSEAQKSGRQSDYTPARGAPRSADGSKEVVRRNKAAPRGNTQPTNTPHQRAQQRAARTNQQATTDAHSDLKRTDPEPRIRAWEDAGLNIDVTQAERRQQEQTQGDDTDRPTTQSDHTRSRCEQPQRTDDE

SEQ ID NO: 967681 - protein, 231 aa, Homo sapiens
MRECFSIHFGQCWMSRLAMPAGELYCLEHGGSSTDGQHAKLTKTIGGGDDSFHSTFFSLRLGCWQGNVPRAVCVDLEPTVIDEVRYWHSTSSILPPCITLITGKEDAANNYALRSSTSIGKVIIDRSVLDRNFASWRDQLHRLLQGFLVFQQLWWGNLVSGFTSLLMERLSVDYGMRSPQLEFSIYPRNPRLPQGCSWSLYKIPFVNERKSNPVSTSGLWPSLVRHSRAVY

SEQ ID NO: 967682 - protein, 374 aa, Homo sapiens
QTFPYGFGDQAVFGELPSGGGTVEKFQLQSDLLRVDIISWGCTIHSPRGQRQAGAEPRDVVLMAIAEIAKRYLQKPAIYMEQLLGRVANRIAKGTFKVDGKEYHLDHEQGTQTVLNGGSQEGYDTVLWTPSECCQMAVQFSAASVQMVKKATPAEFKVWVTYNLDGGELNSQLQEHKASQGKPDQPDHAILYFKTWQASFPRYHMTMQVTIDAEYYIQPCGMTTSGYLPGTKLATQYSKASRPYRTMRKAPGILGTPPEQDIPADQSRGTPDILHRKGAERLGPLLKRQGRRQAADKPSRYHHSDHTTRYRESKSSHQEQLHQDYTNNQTHSRHWHNNKTQIRGKSKHNIELYTLVQHISYYVIHYTTTAYIIN

SEQ ID NO: 967683 - protein, 352 aa, Homo sapiens
KTSTFGASGGRCALRVPGRWLVHSSSYYVTRVSTPVCASLPDNPKKYKVAGPDVLPPGAEYSTIQEHAGSAVNATPGERMTVDELWVVTFRINRAPAQVDEIRSIEDHHSLQLHVQSASDYALLSHVEQHAPGPSSLKISVMRCRSWTTNPQGCTFTVLVAHDEKPALRKMEKIQVIKDFPWILAEMSRMSTCHEPRVIPLKNMTSDILTDAVYVAERARYGSSGGRLGNPVMPNVNFGGSALGSGAWVRRIQRSYRPVCWKARPTRGDQGCRRKASQEGVQDDRNSTSQPRGSPAQRWCHNERGGHKGPSVCNTQKKGGQNSQGAHTPSDEATGKKEQGATAGCTEHLRDD

SEQ ID NO: 967684 - protein, 169 aa, Homo sapiens
MGLHCWRPVLGCFVGSRFVHEGGSPLVRRNKHRALVCHPSTDVVLGLSGALLILSHGIYGSYPGVWYIRRGRFVTLEGLVASHVRTSYTWDHDGPVDWAWTPSILSLRFASTNMVLGLWWISLLVRWGGGRHYRGLVACDARWPAAWLYPYLVWLAFREHSQVFAYWRG

SEQ ID NO: 967685 - protein, 104 aa, Homo sapiens
MQPWVSRWTSGFKTKRGQIYTVPTRVLGGLPPVQPLAGRGNHGGDTPTPESAADGAPQAKHHERSTNPPTRQTKQNAQHGEHTRRGHHRDKEGHQSRHKPEDHT

SEQ ID NO: 967686 - protein, 98 aa, Homo sapiens
PSYIRSQAYTTSNHVTKETCSMVLDLGTTYSCVGCISSTGKVEIIATDQGNRTTPSYVAFTDTERLIGDAAQNQVSNEPHQHSILDAKRLIGRRFDRC

SEQ ID NO: 967687 - protein, 95 aa, Homo sapiens
CESNRKVQGHGDCQSCCMMVAAESRVQRRGSKHPKDPMTENQLLWFRSKAPTGMRSTDRWCPGNTGCHVLEEVPQQVTFPPWASVGKKASRSFQL

SEQ ID NO: 967688 - protein, 396 aa, Homo sapiens
IRPERTATQPIPLETIDDRHYGRLPYRLQDPDLSHGMPPGSGHWPSSMDHLPQVLRTGRVTSTPLSKKELKELNPAQELTIGSKLQDAATLQGCMEALGTGNKDPEQVNFPGSHVTIHWGPYGLVTLQMKPSRAENNIGKMATPTEGSISESNPEAGLHRPIPLTPGSPLHTNKHTNRTQNTDTHKTGDSGRQPHNLQKERPPQSPRGPPQAHMTQPQETPKQRGTKTTERRQTHTEHGTTTHRTRERDTQGKHGRATHDPGQPHEHARGCPHHRDPPHPHTPTSRARQQDHTETEQKRTPTRSPHHTHRAAAPTTQTGRNGASQQHQNHNPRARHANNNPTPKPTSPKRRRRQPPTTKQKGAQATSRRARTNNTARPQPQQKPARQTHTDPTPAP

SEQ ID NO: 967689 - protein, 473 aa, Homo sapiens
MSSQAQVSSSHSSQAASSGRAPAGACRQASSRTLIGRPHGHVPCATSSMYEAKEGNVSIANTCTVSNRAQHKKANMPQMRQSIAIVAHLHSMHTHQGCTTWLVNPDNRAHSCTCKHLHTHAISRIRVHQAACTAEHSNSMVPWSHIITGSTNLPPHREQAQPHPRPTSGHSYLGAPPNATPNGSTENFTHTLPTRHTAEQQKQQQHYGHNNTHKRPTTSQGHTKGARAQQPGQHTAHHMREHDQLPHTRAGTSSRIHSKEERTQLISRQSPVKTGKTTKEDSAKLTDRDTKTAHADRRRAHNPHQTLDHNIIERPKYTQRHGTNNSMDHSTITPVATTARALQDSGSLTRTRPAKHARADPDTTEPSRRASPQLDATRESSISATDIDRRPVTYTQNTKRRQATRRHTRTSHTRHGQNTSQQRGTHTHTHKQHSRTRATPRRTHITAQDHEARQTINPSAHTQHSLHPATTAL

SEQ ID NO: 967690 - protein, 195 aa, Homo sapiens
FDRRLLETRVLDAMCRLELTYQLYELNWLWVLMVPCRITAHPDPPNTNDGGYLGASEAKLANLSGSCLWREGPHCSKLSIIVDRSILQSDDSVIKVPNKDEGDVCNHEKKLQILALNQKEHQQKKRSGFRDRKVMEYENRIRAYSTPDKIFRYFATLKVISEPGEAEVYMTPEDFVRSITPNEKLTRTLGSGSHI

SEQ ID NO: 967691 - protein, 304 aa, Homo sapiens
CTSRRTRVPTFPPPSLFLRLRGAMAKPLTDSENADADQRARLAGLGDVGGAEELQPDLHFMLVKDRNVATPATTSSRWRTRCATTRGPLDPHAADYYERDPKRIYESFPGIYMGRTLQNPDGEPGPSECLRLNPSISGVRLAQGNSRSYARTMLPWEWRPGEAGSVSLTHWLPWAWQHTAMGLRMNWAFYPEACHWAGRVEGGRTDLGMRLTGTPLGRKRGLSYMQPRARTTDRVEPTPTGVAVGDTHTVVLAMAKENPGPATGTTAQPSGGVRQVHRNQARHSPWPPHGGARTATHPRAPQEP

SEQ ID NO: 967692 - protein, 237 aa, Homo sapiens
MLPDRGTTTRPHPDPDAPRPRHLGAYCDRRLPPPTSLESLAASKRGLRRFRQFPNRGRWLPPGGARTAARRFCCPRRPGRPVAAPRWVPRWIQTACCGTGGRAGSAAATGRCSVSALGPAPLHKHNHPPVHFIKPCMVQHSTTKGNTVGAFSAQHVRWLQHINLSILHGYRCHVQGTLACPHLVTSIFCTASPSSGSTVQHAHPTDAAQQCTMLASRPSWHSTRTASTGRELTTILL

SEQ ID NO: 967693 - protein, 256 aa, Homo sapiens
MQAVKQEDGSTKDHSQTHSRHFREGNNMQNGNMQLKENDAMITLDAPSLTDSDDASTDKPWYHMCNPMYLRCTHGQLTTLHGTRVANSSDRAASESCTTLDHTSFIRDYEVIKKCNERLDSGPNSEARTSELATLDAKLKVTTYLISYTVLTILHRILKPRAHSVSQALSLNIAKRPSTCYLSRTDTTKHTQTLREDTHKETHDTDEACAYPRNITPDERTPYNQTNKTPPYRPEKGESDTNTRNCANRTTRTAPT

SEQ ID NO: 967694 - protein, 96 aa, Homo sapiens
MPPNHRQQPPTNATHNTPAHASNTRHHEHTAKQQATPHTHPKPDHPDNHEPPPDPTPNQKHTDRPAHPHRTPNNTQNTTTSTRTQATHHPQTHPAP

SEQ ID NO: 967695 - protein, 109 aa, Homo sapiens
MKVQNQENSKELVSLELNLVIALVLKIVIFFTAIDDIDLKAFKETERHINKAGDCSEGTACYFKHWHANKHNALSYVKLIIKQQNARNSNNANQICNQTSASIKASQAL

SEQ ID NO: 967696 - protein, 75 aa, Homo sapiens
AGLRISASNGFLHRRIKITINWWYTSYLTDYQLSCKKFFYQGVSKLSITQGRSTNLEAKGTRVHSWTDSMDAHQD

SEQ ID NO: 967697 - protein, 253 aa, Homo sapiens
RRRQEPETRAVAGWAPWTGITTIEAVKRKHPRFCSQQASMMPAGSRAERHPSAEVEGSNRRAREQAAGCRWPPLQPVGIQRGCKQAAGTVHQGSAWRTALTKAGKQAEQQLLMQSAAAGHAQVHCKTGPFTSMQAHQHGNSRQIQLQQHSSSTLRARRQIRQVMTARWHRKVGASIATADLDRNQRNRSCSWQKVPLPQTMAEPDLDLTGTKNSDTVYMRMLSERHTYLLTKRRYILTADLQDSLLIKLKAGH

SEQ ID NO: 967698 - protein, 45 aa, Homo sapiens
MCGRIPQTHTGRHTQTEEQTRRLLPKRTQNARYCTPHNLTATESP

SEQ ID NO: 967699 - protein, 152 aa, Homo sapiens
NYRLISLINIDAKILNKILANQIQQHIEKIIHHDQVGFIPGMQGWFKICKSINVIYHINRIKPKNHTIISIDTEKAFHKIQHFFMIKTLSKIGTEGTHLKVIKAIYDKPTANISLNKEKLKAFPLRTGTRQVCPLSPLLSNIVLEDLTRAIK

SEQ ID NO: 967700 - protein, 72 aa, Homo sapiens
MPLIRRGHIGVTRWCHFWGYPHKEAYGVSQPDFSSQGALKPCPSKLILSLDGKYPSRSDLRWPLKPIGGTYN

SEQ ID NO: 967701 - protein, 334 aa, Homo sapiens
MREYKLSLFVGSWSAVGKVVLLTLYQLSLHRQLFLSEQHHRSLTISTRFYIRTRKALNVRNAQPRATCSEHSLGYLQVTPGGHTLPLQLDVGISIPVATQTWTTRAPLPFYAIYYPNHQATRSSTLNLKFNKGTLQQTHALTFDALTRTTFDVTCFPSLELSNALRNLYTLVTLCGTDCTPNVATRGTREHLDGATTRKLLNAPAWEAQGWRHSRGFWFGRLSRFERQTSLIPMAPLSTYRKPPTVQQPWLTPPLVTRTVDIVNVEASLKELGRGAEKNYINTPSVIAIIQRFPQGIGAHWSGSHTARPVSVAQITLDRGFPRFPPLVLSHGLL

SEQ ID NO: 967702 - protein, 39 aa, Homo sapiens
MGLPTPDEVDAEEFSLTLEFRVYPSCKIRAFTGCAFLQI

SEQ ID NO: 967703 - protein, 312 aa, Homo sapiens
WARMPSSQFSMTSVPLGPVFSIIGFAKPDQSMLKDHLISVTPSTVIRYGESVHSTMMSPTVRCTDINGALLEGHQAPQQVRGPQWHLDDPELSLIVFLTDGKPTVGETHTLKILNNEPRGRRGQVCIFTIGIGNEVDFSAAGETVVGELWPSTTARVTEDGGTLGSQLIGFYDEIRTPSSLTIRIDYPPSSVVQAQDPVPNYFNGGDHHCGDLGGPGSWDHLQQWSVTGQHSKECIILKSKNGACAGLEADTMSQEAARLRAEKGPTTWGFGVPRKGGAGEGRRQRRERHTQKTVNLNKGGPYTSRVAQEEA

SEQ ID NO: 967704 - protein, 357 aa, Homo sapiens
MVDIDIETVDPPKDIASRVRTMPEGVAVQFAERPVFFNCTRAHVEREALHICIGISCDTNNSVSILNTDALGRINRLRNFTCVCAPSHAFVHSKTCVVVTVDNPLHTAERTAHIKARAHDKETARTSGHFLKDMANRIPYAIPTRGTPRSSSKKILGPTDGRTVHTVPFITAPGQTPMAAFRQRVCRAHPKLQIPATTSLESRTLSFPTCSLTLIRPTRREHTAHVRRLTDIIRASPYMSHTCPSIHEDRKQRTPFMAPFSTALQTEHTFVTADDLSRRTLRTKQMPGNNERGTIGDYQLRHSVPSAPYYQTDSDATPPMGINDYRNNFDPTYQLNRSHHHTKPHVFRHYTRQTART

SEQ ID NO: 967705 - protein, 371 aa, Homo sapiens
MQDHNSDHEPATTEKDQTIELSVDVKSDPSTSDTDAHTTPHTYGTAVPRHARTLEANPDPSGKGHRAATHHAGTAAPGPSHSALEADKATHRHETANRTPERLHARSERHDPHHNDTSLRTHRTASPYTPQPRQPQQQEHRPSKPGANTAPVTRARARLDVAPTLTAASDRATVLDTAQPETRERNRQHAPRDAKSTPDKTDNERAHRTGIAAHAKATVERTQRRRPLGTPNASPDQHAGRRERRRQHGDKQGRTTAATACRGIGRGDTCAHAAPGGQPPPTTALGEQQATTHERPRDAAPSAAATRTAAGAAASTHRRGERTGAPTHKSETAIPPTAREPDAQQATTHHTRDEKPDERQDGRDSEWDAQT

SEQ ID NO: 967706 - protein, 107 aa, Homo sapiens
MYNVHLCASPTLLHAAHALSYTHTRTDHSTSLPTTHPPALRQTSPDPPTLSRTPASPPTPHPPHTRTASTPHHTTRPPIDTRARACRPLFFFILSSHLPTLRIIPLH

SEQ ID NO: 967707 - protein, 133 aa, Homo sapiens
KPIFFAFRYIAFSLVLASRLEAVADFGAARASCFKSPACEELACGTRPNASHNCGDDYEALNFGVINEKGMVIHRSQREWLASRLEIPALWDGRDSNSLEDQDVDLILRIFASESISTNTQIVYINRYMLLSK

SEQ ID NO: 967708 - protein, 427 aa, Homo sapiens
AREPRVPRLGMQRLAVLCCAELLDVCVLEWMPAGWLCSMLHAEHELETCGLTPRLADHQCLLNSELTPNGPSQRTFPRRSDRCCNACKLVGGSGLGPAIITLQQIQLLNDQIFPTFSTSAIDIYLLRHEGIPRGPLKLAHADSDITRQTSSHTAPEDITPFPLGQHAVLMPLKPSPFLRRDDSMATLIICIDQLFYLLQGKAATPTLASSSHARSLLQTTGVMAWRTNPHSFVLTRNNRETPVHGILYHTPFCFFVYAQPHLDTTLNLRHFNHTAPLLHFLTIRYHSLQAPLWRHWIDSFRAKRKRWAPTYPVRPTFSALRSYEYTPPPPASNRKRFPITAFISRAHFIVCSMRKDALGLINQLRRFSNGNFRKAHLSSFIPTEDVWGVSWIYRGSVTRRPTWCHILPPITISEGLPSIIRGLIHYN

SEQ ID NO: 967709 - protein, 226 aa, Homo sapiens
TKVRAELKEKRHKKPFKKINESRSWFFEKINKIDRPLARLIKKKREKKQIDTIKNDKGDITTNPTEIQTTIREYYKHFYANKLENPEEMGTFLDTYTLPRLNQEEAVSLNRPITGSEIEAIINSLPTKKSPGPDGFTAEFYQRYKEELLPFLLKLFQSIEKEGILPNSFYEASIILIPKPGRDTTKKENIKTKILMNIDAKILNKYWQPKSATHQKVITMIKWGNI

SEQ ID NO: 967710 - protein, 106 aa, Homo sapiens
LRILLGPCAFRRGFSVLLTVWCCCIVAAVGSVSIVACSENISDKHSHSRDVIPSIEFGKFHAVWYTRNCGEKNLLMVDTFLVTVHSNAILGLPMFSYMEVLDTCLD

SEQ ID NO: 967711 - protein, 149 aa, Homo sapiens
MGNRVTESHPDGCPDCVTIHEALKTVIDSQTHYRLPGGQDRARAEDLNERVSLLVCGGDDLNCPWFVVSYHVQVLLFEKLPFPVKRPFGGGVPFYARILSQGPLSPGGARLYVTLWAVPTRGAQIVGAVFCQRFAPVGQPSRVCGKIGL

SEQ ID NO: 967712 - protein, 208 aa, Homo sapiens
MGSASVPLLAASPLPSFWISSGVGTEPVQGPHARLACETTPQRCDPTSHLTHIKVSLAQDFGHLKTPMLEYTRAMCGPTRCIHACSLSKPDRALSQDTYKCSLKETWAASQEQWTGRPEEAVVPHRRLVRASTGIGRPGLERIYPTCGLQRYLTTTSLNFTEGVVTGSKAEPCRTTPSTTPPKGETYNPRPPTPRCISRNVHKLHVGT

SEQ ID NO: 967713 - protein, 429 aa, Homo sapiens
MGERSSIYDNTYTRTAGPAPLYHNHIETSSVRKRSEKTQGETSLYEQPQPTHTSLILHLSALRQLKRSTHTHKRAHTTTPSTLNQQPIFIIYTHPNSHATHTQQSQHTSANQTSAANIIDSGVMISKNNASYGGALIRDPDASPRRHDEKTTPISLLIPHKYNEEKKKQRQGQLLTTLIEDKQKWLAIYKSDAAHAADATTQHIMNGSTNNNTTQHWQQPRDVNHTATLDKATLALTRNSDTHSHRDSESHTRADTKTRHITHSTRLHTRENDSRTTTHNTNTPTHTQASNQQHTTQESDKKRNEEHADSHTCMTADTGNHNDQNTTEKQRCNVRRLADDARTARLTQRMIRKRKKESTTRRASQMCQSARHASSRVTVSCRERQRTRETKEKAATREGAADSAHGQTETESTDETVSSAGGLQVRRGE

SEQ ID NO: 967714 - protein, 139 aa, Homo sapiens
SCSRRALGKAEDQCCQVPRMVNCPPCSQRDGVWSSVIQSASSKRRASSTDTKSVRQEMDAYIPRHPTLWKLAHDEGALAWFEIFASRFRRTSDAPFVHDMVANALWSQVDLSAKRRVQDVLWCCQCLLEPTLAIRTLSA

SEQ ID NO: 967715 - protein, 258 aa, Homo sapiens
PRVMHVLNADTIVVKLNSKLIDNDRFTCPVDPTTEDCAMWDEHPGIRTKKLLTLYDIRYMLEAREFSIIIKSLWGNEGRTVNGCDYHIDLRPGPSHTRPSALFFIRAVAWCHMSSIARTKRLHEAPLSGERLLAHPVNPYTRARIDDQRSSYYWMNLLCVARVPIAAYRMDNRSCPSRIRQWHIHRSIAGIYLGEYTYSKAQADPGSSIRGPGRPLKASGLESSSAGGSRLASILPESTGCRYQTYLRWGHLIGPKSR

SEQ ID NO: 967716 - protein, 117 aa, Homo sapiens
MVLVIAIMRTLDMACCRQKSFACAIVASHIRSRLSSLCSRTNTRRHASLVARKCSGRANDEAYTTCRHLGSTYAGSQAGQRRDRRKTRVDFRGAGRHSRGHKRTHWMTDGGPTWDVS

SEQ ID NO: 967717 - protein, 169 aa, Homo sapiens
MDFLQATQNYSMKHPESTLWLMCTGALTDLWLTACCTCAGCTPCSCPCADAAAPPRRPSASGRRFLRTRDAAAPGLPIHGCSAQPPSLAAALACPTPATSPPGLTPPSSAPSPCPPLAHLLRAPHSPCHCATFTQHPLRLPRDNSTPSAPRTPPQRQFLIHFPPKHGTP

SEQ ID NO: 967718 - protein, 76 aa, Homo sapiens
LYAKFISSAQLILIFYREQVAKDNDVSLLLPGSRPLHTHIKLLDSTDTLQYGVLTSSALQHGSYNSFLSADPASSE

SEQ ID NO: 967719 - protein, 178 aa, Homo sapiens
ISVCRTCMKKRRKQQQLNLHEVEEVVPDTGNPQQHAAAAAARSINTQGHRAAVVARSCPHASAARSPCQPSAGQALDCPPPDEMKPHDRCSEGKIYNCCIGAGMHAAEPSLADGPSAVSPWHLQHTAHIRQAYSQQAATDQQGMLQALAVSNHGLGNCGTIPDKTCYLGTTQGCETTY

SEQ ID NO: 967720 - protein, 67 aa, Homo sapiens
MTRASRRQNDADDHPPPPNPPRTRPNTHHTQGGPKNTHQKPGEGNGPDRQPTRATRRSERDPDTQEP

SEQ ID NO: 967721 - protein, 172 aa, Homo sapiens
WVGIRYRLPRQPPLSRSEPLSSGGLRRRQLCWRDWLDCQQWPRCPGPLVADSPHLSARRAAGRAAARACTPRRRRSSSRSTAAAPSGVTLANDESAKEEKSDLTGTILQDVRRPIDFILIQQDKNSGTGDKEGSEFVHRVPLASIPYDMTMASYYKHLMRAERRRGYIRGAL

SEQ ID NO: 967722 - protein, 78 aa, Homo sapiens
RVGSVLACGDELGPSAWAAAALLRWVCAGAVRLCGLLGSWAVAGAGWCSVAAVAVQASSGREDSLETCARVKGHGTKG

SEQ ID NO: 967723 - protein, 147 aa, Homo sapiens
PLKAKMGKETTHINIVVIGHDRFWASPPLLAHLHLITMLVAIAHKAHPLHTHICSTGRPAAAWATGLHSTVMPWDLGIKLHTAAAVQRASSTHTHHLRCWHTYCSTKPKSLMLQSSISIAPRHPQQTLFIHNTHTCISPVDTIITRA

SEQ ID NO: 967724 - protein, 148 aa, Homo sapiens
VEYGCKVESIFLNVAGVNTTPGQALRTWTSQDSRGSALYTVPAHQRPMFIHCDSLGSALSSDKSGVIPGPPVCVIVTMAMPGYILEATHGWTEPSRPPYPSPPGLLVDSRRQGCAWFLTCCKESLDQICICMGCAEVAQTQFSSGDSS

SEQ ID NO: 967725 - protein, 225 aa, Homo sapiens
VAIAWDAAEWSVQVRGSLAGVVSGVRRERRFGGRWFSTQSLQMPGRTASRDNGENLSPIYCICRKPRHLSCLHDRRVTICNEMVPGDCIRITEKMAKWPSGSGTVGSAERTYPKLEIRYLVQEVHGSVRMANEASDYGSEPPGLDGSDAARRGLVPDPDLRAAGAAGQGSTGVGGHAFASWALFSPPGISLSPQLPFGVPSPKAGDSPSSKAAAESLWVTPAMFW

SEQ ID NO: 967726 - protein, 103 aa, Homo sapiens
MLRTKGYHVHTKNWAGTAAILEREGPRERVEIWRNPAPRNTMPAARGGTNGTGHTLVGTLREQVNKGHGSREARGSGQQGNAMARWNLPTRTPEAGDSRGSEL

SEQ ID NO: 967727 - protein, 125 aa, Homo sapiens
MTPVATIAGFSRFYDTILCVIQYAMIRPHDIIANDVEAPSCERDRHAGEEVKPNEAMEIPGALKGTACAQGVRECHPPVVGGIVQGACSRGHCRLMSSVRPSIMSRHGRDMSPLNFLACFSTPTM

SEQ ID NO: 967728 - protein, 141 aa, Homo sapiens
SGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 967729 - protein, 305 aa, Homo sapiens
VIVHRQLDGRVLLNTTVAPLFFAEQFLQQSTSLPSQYIKGIAEDLNPLMLSTSRTRKTMWKRDLAPTPGENIYGSNPFHLALEDGGSAHGVFLLKSNAMDVVLQQSPALRWRSKGGILDVYIFLGPEPKSVVQQYLDVVGEKFMPPYWGLGFHLCRWGYSSNAIIRQVVENMNREHFPMVKWEMEMDSRRTFTFNKDGFRDFPAMVQELHQGGRRYMMIVDPAISSSGPAGSYRPYDEGLRRGVFITNETGHPLIGKVWPGSTAFPNFTNPTALAWWEDMVAEFHDQVPFDGMWIDMNEPSNFIR

SEQ ID NO: 967730 - protein, 142 aa, Homo sapiens
MSHGRGFSKTKHFFAARAAYIPTEKKRRPLLSSPCCALPVEKNATKGEDTKRRRRRGDLVAAPHQEDPTNATSAAWRRAHKRRRLVAGGALGLPTQKKGASLCNPWGRLHDRGVEVYTTLVVENNGPKRLLVQGFVLTPTLV

SEQ ID NO: 967731 - protein, 324 aa, Homo sapiens
MGEPIPNQRTNATRIATGVIPVDRYVSPGKAYSVTNICNIHCAVGSGINVYKGRGSRGGRPDRRGNTRGTIGETPRTTKGTPPRGHSRSHMKARNHGALQTNSGTSLTTAEFALMVPLPPYTGRTVPPCATPARTCETERRALAGPPRKSPKHGTHIEDLRYEGTRRRQESAHDSTDYAQQTPIEKSSKRRRGTQQKPTDTKKRERAWEKNNTSGYPWTKERQTKAAEQDPHKGPKQAQAREDKRASPGDPPTGEQSADHRGAEPTSRTRTRAQGEHEQHDGQKARTALERRDTQPTDNIRQRGTKTKHHGQKREPTRETQPPA

SEQ ID NO: 967732 - protein, 315 aa, Homo sapiens
MQRLFPGCRSRFQVLDYKFTIGIRQCCLISISMWITNFINNPAGPGRLGCQEAGMGAFQTRVASRPASLKDEVGDEAIVELVDEWAEGEGEQSMTSRSMQPAQVLQEWRHMAELTCLSEASRASTKLQGALLLRGSSTPIQDCSCDVVINPYKNLPLYSAEIVALYTGKTTARDCPLTSYVHSQTPGQHGGPAVPDPVMNPATLSCTWCTLAAGHAVEHLNRYYRDQEVTWCTAQYNKHGPQTPLTSLLHRTTPPRTHTQAHPDPHQTHNTPQPPSTQITFKPPIHNSNITLRDNRHHTPTSKQPTTPTKHTKRP

SEQ ID NO: 967733 - protein, 616 aa, Homo sapiens
GCLAFYVDTNIAALFRGIPISAYALSQTGCSLHTKNHKYGLYSQLLFVSYMSRQYCLSFLVLPAAQSSAEDHVSNSFFFTTATILPNHFIFNFVLSSDFPCLAFIHYPNLHLANQGSSFSSQGTLPWPHSFKKNTGLETAGQHQLGSHAKSGLIEYIGHSHLHQHMWNHFSTFLGSQRRSITASHPIQSSGHTSNTQGPRDKCYYDQAHPHHKFQRNWPVGFPSTLCEPILALETHSDYNKFLMNSQVSTTDSLRPLHNASSFGVRAIPLAESRYTQRRHYYSTEYTPSVEPVCDLTVWDRHSDYPCHAHTQLNDVYTDNRIMFAVDTLYSILCAQTPQLLTRFICYYYTSSYSYKTTPSINSSHKLMDTHTYNAQTNIVSHQTLYTLSTQPVRANRNTNIYTHTNPARGTHTGADHTAGTSANDYQQTTATARYNLHTRLNTTQLTLTPQATTTHTPYRDDIDIHRLTPTHQGHIRATLTHAHSDLPQINAATHRSLTAQMQRKEYSEQTEMEAQHYNDEHSDNPPLSIQESRIRYRNQASDRADEQGQAAQTEHEIATTEEKDTTRKRRNRRQNAEGAVTTSKTQPIARPEARYTQAVRQKRTARATARSKRVQ

SEQ ID NO: 967734 - protein, 217 aa, Homo sapiens
MPGTIALSHPYGTYPGSPILITTSGDIHRSTYTTWKTLDLDDPSSMRRSLHFPKGITMDDIMAKALGDHQLQSGSITAIHTKDTKHMVTAETYSTSGSPIPGGEKTINIATHTYGGHTPPTRATPEDTRHRNQRGTLGRVTHQQGGVSTRDHPQNITPKEHTQQPGRKPDPPHGPIAGATTGAGTTIGSTAQETKQEEKTSTTKATHSAREDNTTQT

SEQ ID NO: 967735 - protein, 177 aa, Homo sapiens
MAIKYLEVIKPFCVILPEIQKPERKIQLKEKVLVDRILTLYYLSYRCAGQSSPVLGIMVSQSSVMTPLYGMRGDSSLYTEGTSMELGTLSYLVTVWHLLMSISLAGAKIIEVGGRPRKDRALFNGAQKLFGLIITIGQSIVYVMTGMYGDPSEMGAGICLLITIQLFVAGLIVLLLD

SEQ ID NO: 967736 - protein, 209 aa, Homo sapiens
MTPHFGNEELDCHFLDDKVLLPKDILDQQTYMKISSSDDKDAFYVADLGDILKKASEVVKKLSLVSAPLMQSNVMIAQRIVKTPCCYRDRIRTVLARLKLQVGAKSGVPPERISMQILCKQVFKISMLLILAFRMTHLIVIELTEVAETSKAKCLDCTDIPELGHSTLGQQNTVLDGEANHGGPPETAQRTADNAKQANKLRGKEKAAP

SEQ ID NO: 967737 - protein, 148 aa, Homo sapiens
RQDRCRLFAGEACVWRTPRRHVGGHRTLIVQVEKFFQDNMWWIVLPKSESILPMSKLFQNGGALDEERPAKPGNSLRKDNVQRLIVRHSMSVLQTKLPRGHWQGPRRPGSCQEPALGSGGSRVLVKTTTMFQKANLHSAHVRSALIRK

SEQ ID NO: 967738 - protein, 86 aa, Homo sapiens
KTTPKTCQHWERNRLDINELDVIATRRYGTSPPLLGIVDLVDSAGWESSKMKLLNKYYDEGGACLRLGIGRTFKLCHGVCGIDVKD

SEQ ID NO: 967739 - protein, 227 aa, Homo sapiens
LIKYSLRIPKTSLFGSELSIPISLRRAFCQPLVLSLIDALPHSPRCVLDLPGDRAQWFGARDTSGRYKSQWSVYTKSAVVSIMAIDKKEDLTTIYDLCDNMVGLASTDLMYTYVYTNILCARITQELCDFVTLSVKYRKRIAKIQFMHEDHGQSFYISTVHTLIHEAHVRKTSYLLRHEAFALPNSHGLSARLSSTCYCLCRNVSCILSCTITRAGSLPVFISVHEP

SEQ ID NO: 967740 - protein, 306 aa, Homo sapiens
EVCFRIYDMDKMAIFPMGNSSRYLKMMVGNNLQRYTVYRPTLLDKTIINCSITRLDMETNYPSEELLCLLCAWPRYSTASMVARCVTSYHESTTQHFCFLSPLLCKDLLQARSSPCLLLLLFTMRPSLSSSCWKPTTFLSHTTCTPRTIHAAPEPLSALTPATLHASHYTSACYATLFSTPPATAPPPPDPAPLLPCPGCAEPRPPRLRAYLSDLPVVRSCFVRTAKEQLILVVYSSAKVSLVLLAHSSVTAFPNTTCQPPASPPHPPVPAITFTEPPPRLLPRVPTWHRDASLHSHPTPCISHTA

SEQ ID NO: 967741 - protein, 184 aa, Homo sapiens
YNDCLWQRNIPLKYCAVTWEQCNMFFTGFVSTAEHKHLIRDKHNTKKQQTQNKNKHKTNNTHTQTDNTHEQRHQPTPHEPRAARTKRRRGGQEERSLRITERRQGSEPHARLAEHNGPARHRPAEDREQQSRRNHKKRKKRASNKKTEQGGTERDKQEGSTVKGHKGDTTQGQPREKKVQKRTQ

SEQ ID NO: 967742 - protein, 148 aa, Homo sapiens
QVPVRRTMRQVGGVLLTDRRALRGCTISGPIKTCMSRGGDSKRCLVGRAGVERLKIVYVYKSPRGATSWSLKDQVIAPWKIIALHAIDRLGTYDPSQPSLSHILPSRQTPEQGQWQLSGPDDLVFGWALGQDRLDEEHDAHDYMTRAG

SEQ ID NO: 967743 - protein, 139 aa, Homo sapiens
MRKTGKGNEETPDRQHIKRETHRKGEQGSGGPPRETKRGIGTHEKEQHTAEGNRKTREERRNTRKATARIEHGTESRKKDTNTKGQHDRRGEEENTQRTNKKKWERHNDEEELNKKQTKQRARTAQKKTQDERRKSMDG

SEQ ID NO: 967744 - protein, 267 aa, Homo sapiens
RFRGLQRFFPAVVLHLSKAEAVELEVLAGVKWLSTNWWWLEQVVLRETALLTNSQANPEPPWLELKYDPTIEDSYRETSGLEIGETCLSGHTGYGLDKKTYSAMREQYFEDRRRLPLCICRSIIGSHLRSINLYRERPYKRVKDSDDVPMVLVGNTCDLRTRTVDTKTKPQRTGQRVTGFHSLKPQQELQGVEDAFYTLVREIRQYELKKIKGVMMGLTVYGDCMCGGCTRCFKVCRKEPFKLHEPVSDSGERYTVVFRLGEGVYSS

SEQ ID NO: 967745 - protein, 147 aa, Homo sapiens
MRRATRAGQSDKCEVTVRFRDASRRLRGKLVRSEGTTKRSQRLQEVPGDCGKLVTSDVGHSPGERHRGTMLSLELIILAILMALCRGYINISWGRGGGPARGGIISWAGVPLERRGLRSAELTAPRGVVSLSALPLYSLVGTHLCRN

SEQ ID NO: 967746 - protein, 280 aa, Homo sapiens
MCRSRSRRPGDPRTRGDSAIPFPAPQSCMTSWLPRHRPHPVLAGKQDVNRYHVMTRYTTINRYSHPSRRRHRFRSGGSPVSVLGYCKQASMQACRQSCNTVNLAGSKGKQSPPSIPTEDQVALDRRLAFMRYNGHDRRSEPHVPSSGDRHTGVGPGAQPGYAHTMGANMGRGHQTFPSNERRYMPAHHSHFRAKPTTGTPRSLARRSTPSQGPWRGNLTPETILRAHAGYNDKTGMHKSIDNRGPTENRFQGPPPKEPPERTHGLATPLIRREACKNGKP

SEQ ID NO: 967747 - protein, 328 aa, Homo sapiens
GPEDLEPSNTSLGAAWIRRRFSWLIQWFGPYQGLQHERHSSVSVCDICDLLADLVFPWVLPWGLRSYECRESVRRGVICQGDGVSVRGKATNSPTQRLPQSVWITTGLVVGDAEVVLTIRELDSLALNQSTGLPTLTLPRGHDLLTPWLTPLPGPVPAACLLVGEMSFGPGKPPSCLHDSWNPNDASWCDQESKQPVPGGLNGGFNLLVFFVTVLACWHTSIVSFRQLRKEVLRKLSMWGKQWHPAEAAFQNANRNLEGDLKGANRKSITEGQQESDRRHSPREIFPGIVSPGVTPTAWQTGEHAEITGLRTLMNGSRNTGEKIKRHE

SEQ ID NO: 967748 - protein, 345 aa, Homo sapiens
DEEEDDDSEEDEEDDEDEDEDDDDIEPAAMKAAAAAPASEDEETEDDEDDEDDDDDEERMTLQDEAMADYTSHRQRTLQTLVPVKAKQRGSSACKMTKQDAEDEDDDERRSMMKMMHDEDACTRRSEDAARQDSSPVTQHAPATTNAHGNGHHTTSQPPCKPKHPTHLRRHRHRLTAFQSLTLAQPKPLTPNLLLESHTLGISDDPRLPPCILLPARLSRHGHSTTDTSRPIRGYRDLLADNPRTDHQQRTSPGPATPSAHLQPTPPRPTTNATHKPKQPDPGHAPPPPQRPLTDLSPHPRTNFRKDNLTRHRVRRMSHANPAYPRPEPGQAPRQLYRRLRPAAH

SEQ ID NO: 967749 - protein, 528 aa, Homo sapiens
TSCSPQQHWHSLLLNPSAAPLPHLSRRAAPPPSPQHGTLLHGLTLAPAALCTRTCPHARLHAHAHTHAHAHAHTHAHAHTHAHCTSLPPCTLCPYSVSLRTRTHCAHPHPPAPRTRTRPDAHAPCARPPCAPARTLSPLPLPNCATPPARPPAPPTPRTAAPRPRHTARMRPLRHPTSTMRRAHPPRPCPSAPRTTQHATRPMRHPPTRAPPPTNAHLPQRPPPAPAALHTGGPPRGTGGLTTPPRNPPTLDPRQPGLPPMGAHRTPCAPTPPGASWPTPQRARAPRQPPEGLGFSNPFPMPRVETPRPAPASQPSPTLAPPRQGNILPSHCLPPTPSHLAHSRYERGARNRRPTMRIHPGPGTLPNTASPWPFPAAPPPKRPPAQPNAPHLPFPPPAPPPGPPWLAPGTGLEPPSHTHRALAAAPGAPSAPCAPHWPSPGGPKASHPVMAPRGPPTPRETPRRPIRPRHNRPPPINPQTAAPGPHSPPQSPATNTPLLPATPRRPTPRARLTNPLPHAAPHNTCRPH

SEQ ID NO: 967750 - protein, 296 aa, Homo sapiens
MRRWALGCPVWPWDGEPAVASCGVFRQWHPGAWGLRPWTGPGAEAAELAEARPRIRSRMPVTKLGRYGQGHEDQVPGGDLSLLPAPLKELTRSLDFFLRGPLSRHEALEALCQCRSRPDAGHAHQRSNGIFVSYTADYNAATSELARSSSAPTQRGHRHPLRPLILAKLSIVPVRRTLLGWTPDRPAPHCSLARLTAAAALLLLRLIPSTRRPGIVSAPAAYQAAPHGWYRRPAYTLSPQHHLPHSSTYRQAPPTTLSPTPSTPYTQPLARNLSTQLSQLKTHYTTPTTNQTHHTH

SEQ ID NO: 967751 - protein, 229 aa, Homo sapiens
TEQKAEPQDDGKSTESDVKADGDSKGSGIGGFSLQKGPEFIKSYMKEPEKLLVSYEEEQFSVCWRNLRYLPKGPLEAVVISPSPTCMNVSCASSSSARYMRVTGRLCWMLFWMMASLSPHLNSWHALQIEYERKNVDLQLTVLSAKAVLSGSGRSLLRGLLLPELHAVPYRRGCSLICQPWGSAGSGYLHPQSGTVELIVATTKTGRNGRDFCRPVEAEGLEAVQCPLP

SEQ ID NO: 967752 - protein, 93 aa, Homo sapiens
MIFGGKAAELDIVNDITSPTMVLIRRFSNYRSGPSDVLSNIMGLQGCVRNGCLCMCEQNQLKNVTRGAGKEPRSKSTMHEGKWVTNSCISKND

SEQ ID NO: 967753 - protein, 111 aa, Homo sapiens
MAQDYRTAWCLIDPRPLAIVNIGEQATHGADKMSKITTPSQPNTKHDTGGAPPKRPEITPREHRKDKGDESMPAAVSVTNAGTNTKAAPSTLTPRETPHTIDQQQNQSGTA

SEQ ID NO: 967754 - protein, 73 aa, Homo sapiens
MPQTAHRKHNKDIQHGHQKVLYEKRDQKRKTTKSRANEELVTSHITGEQECTHNTGEPRKTHREPNKQHTEEN

SEQ ID NO: 967755 - protein, 404 aa, Homo sapiens
HAHAPHTSRTHCSLPSAPRPTPPYPASPNLPAPLCTRTLTPTYPTRTPLTYTPHCTPAHCTSRLHACANAHTSPLPPLYTSPATPCTRSAPPPCPTRLRTPHTRTHYTRTRTALHPHGHACTRAPPTRNHAASLSRTLRTPPAWPATLLRTLSRTQRARRTYSTTTRSGPALSTPPHTRSTPLLPCLGRQLAAQLTLAGNNPPTSQLHYSATALYASACTHTTTWPLPAAALWRLKQDPTGPLQLPNLHWHTLSLSYTITKTMNPTWLLIVAKLTSLATLFPGLAYAHFWNDRGLPREPVGNTAGLSNPGRSKPPSHLPPPPLAPPSPSPRSAPASPSRRASLPPILRPLGPTWRPNTATAAAPPPSPPPALFSPHASRPFPPPSPPPLLPPCSPPPVRAHPRP

SEQ ID NO: 967756 - protein, 197 aa, Homo sapiens
QESSEARWQVLTQLWMLDKLTVCVMLRRPSTGSPLRLIECLPLIIFLRNILKYALTGDRTERRFRIASEFLPPRDEAKGPELDYNLTRCCDSSRMSSIQFDGDRVTMNLPPGSIDDPRWSHFACTIVLHLGMEEPKSYVVQRVKRSLWVTQRNPSSGELMMPGIHPLPRSASIKVNDTIQIVFETGQITDFIKCETG

SEQ ID NO: 967757 - protein, 116 aa, Homo sapiens
MPWPPRPFGSPAVTDNRQAKTEDPKLSPSGPFQSKRRPPGEGHLSGRHVLEVKQGGAHRSQLGHDLARPQMGFENGLVHRWGGVGLGQMVLGPTLSVRDFGFPCGPWARLNPPNFC

SEQ ID NO: 967758 - protein, 135 aa, Homo sapiens
MLRAGNVNTASVIILPPLEPLWCRRRDANPRLVRRAFCVFLLFHRPFVMGAFLEGEISAPYRGGFLPVAGRTHPPVFFYTSVVPPHGRAGEATLLCFDSPQGVSSSTQETILLRTPSLFVVHTRWPPTRGEHPAR

SEQ ID NO: 967759 - protein, 140 aa, Homo sapiens
MTLPYRQVGTHDGPHGLLLPPMETPHNGAEHMLRPTTGTNGQASSKQSNPKLRHLPSYPQRLRHGDVKHVGLSHPILDSGISYHRIHTALVKHRLGHKHTTIVDISNYTTLFAGIHPHSTLGEPTTYAHEISPTTPLAIN

SEQ ID NO: 967760 - protein, 199 aa, Homo sapiens
QPEQPRLYGGLGSHALATRWQHLLPPTDGLTSDAQDMPKHPHDVPEEPELASRDTCPYTYPRYPEPTVDPMISENSRAAERLSSRMTTKPVQPETSPRHTNSATSSKEPQRQTERHQTLRQRTRTRHDTCIETQKTIQTQTTKPTKSKSKKHTTENKHNTHNTQTQNQKSYTYTTHKQHPAHDYNTPSPPTAPRERERK

SEQ ID NO: 967761 - protein, 191 aa, Homo sapiens
PLGTRRRARRSPSLPSQPSSLSRATLPPARVLRSVLSLVQALVFGTRRFVSEFAISDGVPGATEAGLGLLLPEQMAAIRKKLVIVQVMERCGKTCLLIVYRQGPVPTGVCAHRCLRTMWRDIEVDGKQVELARRDTPGQEDYDTPEDTSTIAQIPMIYSHCVYTIDKNLISARKQIARKKWDTTRNVTAIT

SEQ ID NO: 967762 - protein, 311 aa, Homo sapiens
GHLSCAAEAVWGEAKSNGRRWDRGMWAPNYGGSCYSVPAVRRHGGKRDRAAGLRISPNGRRWDRGHVGPKLWGQLLLSASCSSAMGGSEDQRPTGLRAFSRGRITPDCTYELYHDFGKDNLCRMTVKEGRLIVNFTHDTRHGVLELDTGQHQAEDSVFLLQDAAPGTTPPTSLSILGPAATLHRAGITHRSTTHATTAHWCQYTLTLGYTDHTRTICDGDRKRPLLSRDRGHKTRRKAGLADRHGEKGPTLNRTRTKSHTQPAGPTPGSTYQQRTHTTTMEETMTGDKGRRQQSTQNRGETHRTEATNQQQ

SEQ ID NO: 967763 - protein, 318 aa, Homo sapiens
MLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQEFMQWASPMEPGPTRGVVAPYGLLTGSSTRPQWRPRQSEKTLLDRGLYDEFKVAGLQAGGSAGAIATVKAVLHLQTHHQARRWVVQCSGRLDLMDQTAFTCHFQRQRGDRQAPPMGLQDYFYVAILRGRAGAKDTGSMVHAPVPSVLGLLEQPTGHGVWDRVGSNLRRNPQGETVPHRDRQGVEKHAQRGTHGRWWTQQSQTNHQHQKDKTHNPALARP

SEQ ID NO: 967764 - protein, 105 aa, Homo sapiens
MNVGRAYADQAVDTWCYLPNLPASRKSVCSPVEWRGNLVEDQVAGDEASHVRSSYLLGVFVRSIVLRRSFGGTDLRNLSSFLKNCAGVEKRYGHRCRIRSVKKCK

SEQ ID NO: 967765 - protein, 222 aa, Homo sapiens
IPPRRPATMEEGPLTGGLTSPEDAMVTELFKPRRVQIASENIGLKSTPMKYEEDEITTIQQKKTYTRDPAEPHSEPRPCNGDTTADAWRRPHWQGDQRSTDESIRPAEDDKQTERGAAIHREEAERTEEVPRRHTDDDMRRKQSERHHDARDTQQTRTTNNANDDNLCLGPSHENNPPTDNNGKNPETSLIRHPHERSTMRRSHEKEQENITHNPGDQNHSK

SEQ ID NO: 967766 - protein, 226 aa, Homo sapiens
MRRKPRHRGTPAGDPPHQRNSPMIGSVTPMWIKKHRGGCKEPTRGPPKEGPTQRVCASCTPTTKKRGVAKQRWEYPHAERQNNLRGWWITPTAHKSTTSIISTRTYYHPTRKEGGAPIHQHTRMGGRKTFHLCTVDVSSSSDNRNQDFVGVLFFQETSLSQKELDTDVAVVDYYLPNKTRGERSARIPPPPKRRTQREGPTQRNEDDCSLSNIGPICLMLVEHAPK

SEQ ID NO: 967767 - protein, 563 aa, Homo sapiens
MCCTLGFAYSGSLAGSRCTAASRSRVRFLARSSTLTHRHHQLDDHTATDSLASRTLATRLALLLALNPTTGHCTQFYTLTTTGTLWFSTPFYCAHTQSFALRNNFPPTYTNPWTLGLILGNARQPSVAHGPYTTLRCPNIPWALTCEAAPTKQLINLAYIRPNADMAFRPIIPRNRLHLGHRAQTPQANINGTQRLQTDLQPPCHHTPYSAPRRPYQNYQDRHTPTHTHRRPQQPTAHNLPRPTLADLHIFGPKFQPCATPKHQHRGASPNPLTIKPHVLRSPPTLCRNTLHTLSGTKQAERHPHTPTPPRRGTTSRHSPRTHPSNTDHTDHTQKRTDTIHRQQTNQRPAQTAAASSPTHAQDITTHNHSTAVRTHKRDNAAAAHTQDTTRTRHQTNHDATLLTTHTAPPQRSGHPRILPPRWDATPPTQLPTYVRRTTHAATDHEPNANNTLAHNTTRHAGHPTPAGVANSSTTREQTPTPTPSAHRPAHATRPGIHCAHTNNEQPHAHAQRSTNEPLQQHTAPTNTPEPPHHAQEHSRRNCTPANKSRPPSHTTPPAKQTP

SEQ ID NO: 967768 - protein, 258 aa, Homo sapiens
RALGLGVEQLPVVFEDVVLHQATILPKTGTVSLEVRLLEASRAFEVSENGNLVVSGKVYQWDDPDPRLFDHPESPSPSPQEPLFTGPGCTSTEELRLRMDTTTETSYFQGILETQACTVTPHARLHSAKHTLAPEPSMYHHMPANCSIHGTQDQQKRPANIGQPREQTTQHTIQTYTNTTAKQHVTRNAAPTTQPQVGYTMHSRSRVSSTEQTKNHKDRHITHRSHKKHQTTQHKPQDKNNTQETANPTQPNQTHRQR

SEQ ID NO: 967769 - protein, 345 aa, Homo sapiens
EAREGTQGERCADGMEERLHLCCEKDGKALAGYVPSLGNTVTTPWSLLRRLLQEYQEKLQVDISGNWARKTESLADVSWKVVIIANEDEKQTGREIGVGNTEHLGFDCQEVCCSNGKNVPWLNEEAREHAEGAGRKDEREQLRILGGERGHRWCHESSRAAYEELILRARSRGATVQDWYLLQEVIIVLERSESVDLNGPGLLPLQNSGVCAMCQGEEDAEDMCVHIHSGIRHSNPWVDTFRKIGDKLGWEDPSRRIPGMRTVDRYLRPWGRTSPGHFWGGKSRKGAGRGVGQTGREGLRAKACTGGVKLWGSHPLGTAVQWGRQRGRLYAAGKNLIVRPELYLR

SEQ ID NO: 967770 - protein, 121 aa, Homo sapiens
MFRTFYYSTKLLECSLIDRLVVILHHVLSSPPSPPPPSPPPPSRPPRSRPSLVSIDRTQPTPIPLLIICSHPPVPTPTSYQSICTSPARNPSTPLNPLLLHPLTPSNHTPNTPHPLTAFTG

SEQ ID NO: 967771 - protein, 268 aa, Homo sapiens
MPDESVKKEREPPAGGIRSYRYLKQLHFTKGDKTATSGAHRAASSDEHAANESNREEGKLKKQRTKNKAKKKIKRTNTRPSNAQNTRQKNNTSTQQTHNDKENEQRDTYSQHAHTNTMSTKYRTKESKEEEEYSNKKSKARHGPQNRQQHTHKTQNNKMSQEGQPKTATTRNNTRQHNKPNHARESQQQQTEQEGKDEEARNTEMTSTRPPNGRDEKSTEKDDRQQEKQREEEERQIDDKETDKKRTTRKDEDKDQEEEKRQKQKRRE

SEQ ID NO: 967772 - protein, 99 aa, Homo sapiens
PTRRQQRILGEESGAPSPSPQIRHGVVLVDEEVWGLPEEIEELRVPLLLLPQGEETLLARRRSGDVAACGGRRMRVFWYEEFRCLAWGPVVPAILTPRP

SEQ ID NO: 967773 - protein, 147 aa, Homo sapiens
KASSLHNPQSTAYLFEESSHRSAFRSLSSNIPCIGQGILTHHGILAFCSHHRCNSKHPYTEPTHRGIYDLVVHAVVTKHQGSCNDAIQMHYVSGNDLLPLYLDTIPLTFHGSRVKVIFDIMIKSFANYYETQATIYWLADLEPSATT

SEQ ID NO: 967774 - protein, 192 aa, Homo sapiens
TRGSIDCKGAIHLYAGINSSSCSRRGGNDYSENCFKANRQLYTHFTHNERLCDVKLSAREAAAGQVWWLTPVIPALLERPKQDDHLSPGVQHQLGQHKKTGDLWRFRVMMNISRGHKRSNARLEITRIIVERLRREPRTHIEGTNGGIGTMKPKCDTWRTLLIPNPWGKTRVKSNQIPQHKHKESAWRDGRK

SEQ ID NO: 967775 - protein, 318 aa, Homo sapiens
MGFEAAGGIKEGQEGERGGGREERGPEREGRAEWAREGGRDRRGERRVGAERGERGEGDAARRSTRKGRAAGGDKRGREREERTSVRSAWQANKPGRERDEEGGRRQPWRTQRARHPFQERKKKLGHTEQRRTEQQADDKTQRLISSRASYQTETTYMRTEERQKMREAGTKRNRPCEGGSRRAQTQGEEQHNDPRHKGEHEQQGREKEERGHTTRGGAKAPDRAGAHGGEENDDEKAEESRRAQNDRALNARADGGDGRGGDENDDSDGRRGKAEKRRPAGHARRRGEDEGERERDKKHARRRTQSRTDQRRERAEA

SEQ ID NO: 967776 - protein, 322 aa, Homo sapiens
MHWGRRPCMPCHGAPSRSLAPSCAVLSKPPRCICTISSYAARSFIFNQQKALENSEELDDFSPFFKIIDSPSAPRHLSPYLTLCFAHLDFLEKGVGGDPIGRPPLEKCLTFYFNSQFIHERNKNRLIHRLNETTPGPSHHGRDSPVPLHRLGRVPGLDPRGLHLGCASGDNNGLLGPARGHPEALHGHPCLAKQNPPGANVGLGETEKEMSARESLDKQGPSIRRTIPPLITNSDSTPYTRQHQSKERNNIKHIYKECYHQKEQTRGKHTQPQHERRPHEPMPTQSHHPQCATKTNNLVRDTQQRSGNTTHNQQDVAPTDGT

SEQ ID NO: 967777 - protein, 182 aa, Homo sapiens
RSLRAGKRRHTAGKFQIVRPNSAHCDSRTIAFPWGPLQQIRILKRTHLSNGVVSQPHTPSHAWCHRFQIKSLTQREAEDAEARKRILGSRLGPEEEQDEYPVLDRGQGRDLRNREDSRQPNNVTQTAFGGPAWVSRVQTAHINAAQEHRCRRSAAVTGSWVVLAPGCAAVVDMLALDAEGTT

SEQ ID NO: 967778 - protein, 322 aa, Homo sapiens
FAAELRGSASTQIGPRSPRHRPTPRRPSSCAIPEAGSSSIPRARHTPRRPGAGKAKCERPRTTSASLLSRPPEPPLTHLHTTGPFLMGSTADSPTNNHSAFPPLMTHHPPPTTASSRQPRHTNHPPPRHDAHSGHHTLSHRLRALSPRALRPSTPPPCPTPPTNPTPTASPSPPTRPYPPLEPATPRFKLRTASPSTPSPPPRHPPPHTLPPTRHNSTSSPHPPTPLLPPLHTPPHPYNPSPPPRHPPPLTPPPPLTLFPPTPPPPPPPTLRHPPPPPPSPPHHNTPSPPTPPSRPHFSPILPPPTGPPAQPPPLYPPPPPP

SEQ ID NO: 967779 - protein, 108 aa, Homo sapiens
MPGYYIVNTEIRVVCQVRSKPNGLNTILLNDNKTLKLRITAGLQTTHGIDTKPTWATSTVHKILQQPDEHNTSQRTKKNQLAQGIHIHPATSTSTQIKRTHICLRSFP

SEQ ID NO: 967780 - protein, 193 aa, Homo sapiens
REKGRCPQMLSAVVGRAPDNAGVRAVVSSVGSYEEHADGPWGRRKGWRRTPVMGPDREPHAYMSLVLALSWLPPSIPSHRGRGSPGLADGAPALDMNPHGSCVAVGGIFTCRDPGLIAAVSQSPLRGRSGQGSGPDGGSWTLPLSRHGPSRSPCILPSRRLLSARVLRMPASRLHRAIALSPEQALPLDLHRV

SEQ ID NO: 967781 - protein, 106 aa, Homo sapiens
MAPRANTMPLTVRLELVDIPRGASTRGRILRNSRQQGFVCSIQTSVVNFLDQKVLLRRDFLRGPEGEIRPYTASIGDAKPSAYRGPLTGNSSENTIPESQVQTLGQ

SEQ ID NO: 967782 - protein, 112 aa, Homo sapiens
MLTIPLATQGQPSVSQNIQHAQQQEVQSSSRCPGRCQALYYQAVLQELRVSHSHENSTKPFMGESDPHEPDPSRKGFTSNTEDQHFHMQIKDGRSTPNLNMIHSCYIKHDYA

SEQ ID NO: 967783 - protein, 113 aa, Homo sapiens
LGPHKNVYLDDNKTIQLVLDSTHKEQRECEKFVLQCATLEKTRLFYVVTHLLLFSIKYKCSTKIYLNYIVNISYHVEQTRMCSNIARHKSVPLHILQHHCGTFVAPTCIPPIA

SEQ ID NO: 967784 - protein, 241 aa, Homo sapiens
VERAGPAVEWNVMASSSDSEDDSFWLLDQEDTVLEGTMDQDEAAPPSIGRLRRLDIIGPCRTLPARGYGVYPVLSLTSLRNTKLRPLSSKQWYRLINGVAHQCNHGNMTVLSSDGNIHMATAVPILYPGTPITSALSRHTCMLYLMHIKSYVTVQRHALLAAKTDGTGYLTHRHILKTSDTYSEHSQWNPDPDGRYKSANTRSTHSPLTAQLLGAERPRGDMGELAGLRALDLRASARYVA

SEQ ID NO: 967785 - protein, 168 aa, Homo sapiens
MHAGGAQGAARRVGVHTAEPRKDHVVERYYQCLRCNGCIVAVHSRKHHKSVQLEAKRLTHTYTETANDIAMDHSRQHKSTSMSVDTRTTLVSRHEQSVPGHTIVQAQSRYASSRLHRRHEITRRWSSTSMRAEPGDVRECADYAGWQYRYLSAANHESTQYVVHDQLS

SEQ ID NO: 967786 - protein, 309 aa, Homo sapiens
DAGSYLRLATVRASGPQTSKGPSQWLGKPLTTRSPIPSSPVLLYAHTTSSLDGFRSPASSVPLLSLLQKSRFRPRPVSCVQLPHPQQYLRWLLERLHMSSKLLQSKASRELGLGSYTPVPTDPESTGNLCVSIWAYLACGGHRCVYSLCPLPDSSSHRERASERQPGSTITLPEIQTVHQVESERPSQQETHIRSYYKGLPRTMGTSTTTKPLASNPNYTPHHSSLVTPRPPKPSSTHFLTLALDPPTPAPKAIHMLYPKPGTKPAPALQAKAITTNSHRANPNITITAAYYTALRSPNMASTNVIALT

SEQ ID NO: 967787 - protein, 139 aa, Homo sapiens
MSARTLIPDMERTERDTDKRKKRSPKPHYFTTQRAEAAHALRITQRNSIASNRSQITGPTEPHGNSISQLAESSHTAGAQSNRERGESTKTHDPPQYPVTREAKTSQNITQNNGNAIEHGLLQTTPTIEPTTLEREHEE

SEQ ID NO: 967788 - protein, 69 aa, Homo sapiens
YGSRAYTSYAEGTVILLPARTPSDDPRHRAKGYGIEASRLSGASKRRSMDEFGEYGIVVDAVDLLSLDC

SEQ ID NO: 967789 - protein, 107 aa, Homo sapiens
MGALATPLPTCDTFNTPRALLVALHPAPTHSTLSYLLRRTVLHLLHSTPLTIQLPPTLTRLYLRNTTHCCSLLHTCNIPHLLLPYATTNTTQQKDFEHLHFSKAPLP

SEQ ID NO: 967790 - protein, 369 aa, Homo sapiens
EQEVGTSEGKPISSLDAFPTQEGTLSPDEPGQTTQIAAGSVYAMYKSMNSTLKSISEMKKDGNKEFKMAAKNEVFSWLALMEEYEYTLHSDEFQSHSESSSSESDDECDVIEYPLEEEEEEEDEDTRGMAEGRHAVNTEEFEVCQGWKMKCRFKNVNAETVAIRERYELSDRDEICMQLTELILKVTPKLRAAKIMRYWSETSSSTSGIRVSSQKSASSHGGENYISWLMKANIPNVLRLVISFAEGEEKRLPYSGSIELEMVSWRYTARVKREYQTQKTNPSTMRDHQVRSTHQDRAAAHTPPSDQLPTQVTAQRNNNERKAVTDKSDQREYKAERTDVRTEAEIAETDKGNHTALHARACCMLCRAV

SEQ ID NO: 967791 - protein, 104 aa, Homo sapiens
MLTEIQEKWRDSRRWQLSVALTDATRTGDGPWGRTYRRVSQGDDAVEGSAESFQRVAAWTRNELRFRWTSGKAVESPEQDSDQEVVTKVTMMHENKEARSWSFM

SEQ ID NO: 967792 - protein, 75 aa, Homo sapiens
SGLGWEQSDPGAVVRNTLFPAQSSNHYVRRTCMEPLSTILRSHRRPDDQPQQCLNPTRYRAKDSSEVDLARYQCP

SEQ ID NO: 967793 - protein, 233 aa, Homo sapiens
MIKPFRNTKRRNLNEMIQQIKETGANLAICQWGFDDEANHLLLQNNLPAVRWVREDLNLELIAIANRRADSSPGSQSSQPEKLGFSWSRTGSISFGTTKDTMLVIEQLYRTPELYPLLIRGRDLRTDSLTTATRSLHDALCVIRNLIRDNRVGVMEEGLAWRYPDSPCQLAKRRNKLPQLRTVIAMRAYAAAPAGHPQGLSEEQSAIKSPSKNYDRNPKPDRSRTITADLEID

SEQ ID NO: 967794 - protein, 217 aa, Homo sapiens
MAIFPIEKWPHLGEPARQKGDHQSNYIWEQSPPRQGKGYPREGQATPGRRHTNRYAHRSSMRTHKGEVVTNMQLDGEESTRERGGGHQEKPVGTIRMEDEKRGTTSTREGTKWRQEKPLGEAPRFWEHAPEDETYRGPGTTDQTVIGGPQTQYGTPALVIVARNERHYEQQQTAHKRKKESIRYNEIRGENYNDRGTTERRNRYERQVELKKEQELS

SEQ ID NO: 967795 - protein, 280 aa, Homo sapiens
GRKRFGFIGNYLKRVPRGRGRGGSRGIKVETLLWSWRLFWEKKQKHKFLSVSRPRQSSKGPRPGVCRALARFSLVSLSWCLSLSLSCLCLVTLLSHSSWALFSPLSLRARRPPRYRGWAGARSGGLTGAWGVIRGKGEDHPPGPREAGGARGRLRPRARAGGVPGSRDRQEGAQKLLKIFTLPCPVHLLARACKLAGLEPSPGPRAAVGAQVEAVLLSVLVRNQAGHSGTNTQSPIDAGQGVSPCGTGKRTRNLSVPTRGCEPKTFKVTCFRAQPERDQH

SEQ ID NO: 967796 - protein, 253 aa, Homo sapiens
VPYRSHAVILRSPQPCGTSKSNLNLFLFPVLHYALLSHRVTEQHYIQLTLATSTSAGIAANRLLANMLDTLHSLDTGLPHGQPGLRHRAFAQRAQQLQTRQHTVGDKRLWKILLHEHLAIDTWPFRPTHHAWPRNTNGTNYSGTPAPQQDWFPTTALRHQLAGAHLWLIGAHPGPVQKALQPPYGSQLPISKGRNHAPEPLEISRPTLSSRPQFNEHPLKHAPYPAYAQHPSSRTTASHNRTQTNLAPLYGDG

SEQ ID NO: 967797 - protein, 278 aa, Homo sapiens
MPSSGHARAVYHDDACNYFKRKRILITPKKDKTSNMINVAYNNTAHMHSATQNDLTTSIKYDESKQTLTQDAKTTQNNDTTAPGTTPHRRNRQRINETQTQTHQRSTTTNQRRGQQEPTETGTERRQTRAPNTHQAERTTHTRNKSTEAHAHTDQATTTANKDREMKQGNEVSLFHPRQVGRREGRTARSGQRSTMNEPQAERNKRKQTNTRPQEEEDKRKKQNAADKKQQREEKTTGHHDTARRHGAHRRRAAINQPATPRKRRHTSLSCEEKERQE

SEQ ID NO: 967798 - protein, 49 aa, Homo sapiens
MAVTIVEAFKYMWKCEVKAVFNSRDDKKSMVINRKRKLVSKEERNEVEV

SEQ ID NO: 967799 - protein, 335 aa, Homo sapiens
MAGLYSLESEAYFSDQGGRKYMEDVTTNRSGARTDRLKKSPRRARVAVPQPVCLRRHVARPTYPGRRSTRGKGPDGGKTREATRTLYHGPPRALHTAPKPDSCPPTETSRWTLLHRPVMTNGATGRSEKGAHQNGAHGDATMLRGSTYKTSSKRQYTNEPDPGPTGSGGLHHPANGLTSAWTPLPLRQRHGRTWPKNMTGFTLATSGHQWPREGPHQTAANNPSTTAHGTEHPRRGQGQPTKTRTHSTARNSRRTRQAQTQTPPGRETSGTAGRRASEDTEGGPAQQQRPRRPPAPTKAAQRGTRATRQESATRAARHTGKDTRAATTRDHKGQP

SEQ ID NO: 967800 - protein, 248 aa, Homo sapiens
PGQAENKEHSREDHKACELKLGACTGHLLRAVTTRRGHTGAYGDGSSPLDSHQDPRPNPVTIDHHPRYPTNLYILYHTHGTTRLENPYTSPRSITARCGPPGIIIYPHSHPYTSPLQSQYAEAHNIIGYIAPISPYSQWGHTTFALTNLTHFPSIPQDRGMRGATLLNTGTATQHRFQAAHGAPHGHRRRDNPNASATEFPGRRPRAAPKDPIRPPHWLNRELAKWDPKRENASDWAKILDCTPTNVS

SEQ ID NO: 967801 - protein, 73 aa, Homo sapiens
DRCRRKHTPEEDQNGKGKDSYQTLSVIGHVEFGGKAPTEPYWVTEFVASHNMTAEEIRTNIEAIEEDLEKEVW

SEQ ID NO: 967802 - protein, 95 aa, Homo sapiens
GINTWQFNFKFNLTEDMYSQDSIDLLANSGLQFQKHEEEGIDTLHFAELLMTSGVVLCDNVKWLSFHSGYDFGYMVKLLTDSRLPEEEHEFFHIL

SEQ ID NO: 967803 - protein, 70 aa, Homo sapiens
EDTTLNYGKVSQTVCNCLPIAAIVEGEDILLFMDGYITRSSDLCEQLFGEIMRTNMMYQNQWSSLRSFVV

SEQ ID NO: 967804 - protein, 74 aa, Homo sapiens
MDCEIGVQSRASMEASDVFDARMKRLIRREFSSWAKVEQGLYRKLRDWIDINESVEQEKACCDYFKEYVLVEMI

SEQ ID NO: 967805 - protein, 420 aa, Homo sapiens
SCSQCYGREREECTMCARPLAHAWARIGNSCTGSSCRMRLRWASVSLLVGAPTGVRARRLGLVILPTHTEGFVLTSRFAHRGYRRMQVRTSPEDDLEQDEKRVSICTEIETHGTPKHCDMCCPFHELDDSVNAFRESTFTQVYTYMSNMHENYAIRVNPPEDKIHFIHQSSLGRKLISRIVPYLETLVCPHFIRLSGMEICLRLDVDIFYLGPQGKENSSFLGGKSPLKRKEVNAFGGGTFVPLKVRSLVWMNSKVGLGNWLSQGAYSHISSGHPFGISVIVMGSHIRTSFGLDWRKSGSPKKSIGKNRTTERIGGIGFFRNLLEGVTSIYRKSNPLRLGTTILLGRGLPQWGFNSGDEIGWPTKQGTRIERTFVANSDPKRILFSNRDMGEGPRTRLRIIGTGKSTALVDKNEIADGLI

SEQ ID NO: 967806 - protein, 176 aa, Homo sapiens
MRHSLDALTKLGYRYAFGLSMRTFHVDVAPWSIGAKPDHVTTPLAINRGARTTSADAEVPILNPPNYTDNSHLLCQPRDSTLYGVLLQPKVTLQKPVVYVFARTHQLHEFAAPAVIGPPIGSLFACTGHLELALTWNQGPCVAALVLGSGLLILPRCARASSRHFRHSGLTRWWTA

SEQ ID NO: 967807 - protein, 144 aa, Homo sapiens
NTPILRSSYAELNSGGRRQALMCTINSVSTIRRVRITERRVFCVDPSLYLRGRGAFQSEISSVLEETRVSVRECLRDGSHQSEPRQRCAAWNTEYLANSPPIYSHTSWCSCSGHKRVLYSNASKMPHSDTYALFSSYTYLIVSI

SEQ ID NO: 967808 - protein, 163 aa, Homo sapiens
LQPRVPMLAEMDPTMLVRMWVMACILCSNAVSCCAIQMLHSITADRIYHVTFDLYDRHCTEVTAHYSLELDTGQGHTRVRLTDPSYAHRYNQHTETPTHPAPPASQRQAGAAGARGADQGGRRQEEGREDNREPGAAARKTTRRGASAAKRQRRDRRPTATPA

SEQ ID NO: 967809 - protein, 157 aa, Homo sapiens
MSGAPVASSILVFESHSYPLSFHCVCEILQWVENPGGVHSLSIISTRFLEAGVVSVNSVYFTPMRVTTLPAFITLLGRNSRFPLGPQRESHSAFGPHKTHTRGAPRYHQGTLPPLLDRATKTQQITTRQNPAPPARTNLLCVSTHTPANPSTPGISN

SEQ ID NO: 967810 - protein, 204 aa, Homo sapiens
MAHSDSQTAFIASNHRTLRAGHYRYAHSPTTASSLSARIWRFLLRSVQTAPLASPTSNKSHRFPEFEPTPQYQAAQYHPNNKQQQQQHYGTASLISHNPQGSGCQHSPPQHWWPVRLKQAPPTQREHHHEISTRKYNRHTWRQSGGDCAYTMVVTAAKPPLRTFVTSLKEAPQHSRTTEANRRTRANKDDKTHTYHTNKQPLTR

SEQ ID NO: 967811 - protein, 268 aa, Homo sapiens
MDNTLICCDFLSTVVSHQKATTMYLGDYVDRGHSSPLETICLFTGLHKSKYPADFSYFIQRDTMNVPSITQPHFMAFSCMHMLTHSTASPTFTTHGTNSSTALLLHTCFTSISQHIRGMQHASFQLVHGSVLIHPSIFHIIMRSQHIRRNLIAHPTCMSPSIQGPPTARTPTKTRPAHPAITQHAPSRPRRLQHMHQQAVTPLNNMGCQQKWDSQQIKSQEKPLDLHGPLHTSTCYEGPHVKGLRSGPALGTPRPYRTGTRRTSTGRG

SEQ ID NO: 967812 - protein, 55 aa, Homo sapiens
ELQRPFQACLKVEKFGDLILKATEPQMVLFNLYDDWLKTISSYTAFSRLILILRA

SEQ ID NO: 967813 - protein, 171 aa, Homo sapiens
MGSSKAFSASQHAQTPFQQRFDARQEDVASQYARLKLGVKDARAEASCRTGCRISNSKGMLQDAREMLNSSHSSRPRVPQKTPDRYADAREKISFDTRSSPAAFIKRTHWDSDPLTLKLTKTIQVPQTESHGNTSYPYCRNEINVVNNHQAKPESIMTWMTMTMVIASVPY

SEQ ID NO: 967814 - protein, 409 aa, Homo sapiens
LRYWSQAYTPATMSTGPAAGIDLGTTILLCGCFPARTKSRYIANDQGPPNHSTPMLAFTDTERLIACCRKESSQQLNPTNTALRLTNRSDWTPTQTTAARSRSDYCNTCTLLMRRRTLHCWPRAPRLQTLPTTNGHQHPHNAYHIPPRTAALPPWLSSHHRTRRRNTRQAPPYPPRHRRAHRKCHVRPTPRQATDPHAAPPPEPPAQYPPGIPEHPTLHGLNNRPLSNLTTQTQNCPPGPQPYAAKEQQRPRPTKDTAPPQPDTEHRCATLRSRTTLPTNWSDCATHPTQRIKGAQHNNRPHHSHHPPRQHDHNKRHSFTPLIAPGVSAQPGGGHTPQDCCVTHKQVQRLRSRGRKAAHHLDAAQTDLEPDAAETDTSDTRRSATATTVQAARRHSNPQGQRCRKQENA

SEQ ID NO: 967815 - protein, 159 aa, Homo sapiens
MATLSRSPAIASLQVNRIITVAGSHKLVTGSKEANKPTHSEALIDSAHSNTIQPRDTVGCDKKDIEGRRMERTNETTRKWINDMQPRKSHENRHIGRSRRQALLACHACLGTHSMLTLLLRHYAKHARLDSTLCEHGRRSPWSVEAAKYADLDMCRTWN

SEQ ID NO: 967816 - protein, 40 aa, Homo sapiens
VLAACDAARAGLAGAAVEDAAAGVAARCRVLFSVENLERL

SEQ ID NO: 967817 - protein, 200 aa, Homo sapiens
MTSCAFEQGTTELTTFKYTVYTGEQVILLLTGLSGCSSDIRQKLVIREHSRDVEAPLSSVLVYYGALAKRFGDCYVMVFTGSSFTEHSGSGRYLKQGYVSHERVLQEHNPGSGTLSPQTGPTTQRLCSPGKTFRPGEPPDKVASPPRHHTSSGNRGVNRNQRAPKKSPKPRRTQYSSSHCGAQPRTNNTAKKTEHHEARN

SEQ ID NO: 967818 - protein, 204 aa, Homo sapiens
MPSHSSLGDRPRLGLPPKRNHLTVTCEKRATSEVGWATKTCTFNHMCKPILATNLCLIYCQKLALAAVTVEPATDKTASQPKTWYYAYWSWHNSIANDMSRSCCSPHLSNPTYVLKPDNVERLLSDYTIPVHANILKRPPLNTLVRHTGHTGAARESRGRQTEQPTTLETTHTGQIPPRPQPKPAGHQADPGPPQPKLNDSEPQ

SEQ ID NO: 967819 - protein, 119 aa, Homo sapiens
QNLLLHTDVSYNMFLEIRTMRVHLERYGRGFGVPLSDNEDSGTYDETMKRAKSLMDQYFGPNVLLDVKYGIASTVIQYSCLQGYLWRVATNDQLVFRRKASSLDKWIQRRSIQILLKMQ

SEQ ID NO: 967820 - protein, 337 aa, Homo sapiens
QAPGRYSIGGGMETMQSAADAAWCGHQLGGAPLRDLLWPGVTGCACVCHLATTVAGAASRAHKRIHKASCHMTQGSSGHADRGGGAEHAVHTANGERRREAREETGPHSQRSREHTPKGRETTRTRSESYRERNPDRTTNDERKRRRQQNKSDTDPSAASRRARRNEQQNTGDRGSPQLTEHHEGTENEHGDRSSNEQSAAGTQPATGRPRPNEGHTADRDEKRQRQRTGAQTTGQEPQHANGAPARAPASRRQRNAAEGQHTRRKERGDEKREKRDRRKREQATSTADDREKKRRTGERTRRKRRGEEAEPREEKQGKTEGRERPHAGAKGRADAA

SEQ ID NO: 967821 - protein, 126 aa, Homo sapiens
MVVFGGPLSDGCRGGGGAACVSLGYVMVTRMRRTVSDGGKGPSTSLCGIPGIERAKREETAGAELRTVFIGSHCPTFRPLTPCGVWRSVPWSPRVTKICDVGPLYIEDLSLCRSERIHRISVSRVY

SEQ ID NO: 967822 - protein, 94 aa, Homo sapiens
KLTIAMSQEFPLGIELLLNVLEVVAPFKHFNKLREFVQMKLPPGLPVKLDIPVFPTITATVTFQEFRYDEFDRLHLYYYLMTTRKTQAVFLIFN

SEQ ID NO: 967823 - protein, 284 aa, Homo sapiens
GSEADGKRYGPWTSVEHGGTWRQAGGCVESQTEELSMRVFVLSACRVYTEIAQSDDRRSDGLLRMHGARAVASRRTPRRQCIGSGRIGATSDSIRDYKNGSVDGLQEEMKQPVNTTQSSTPRETKGEPERCPGTEINTRAVCKIGADGTHSGGPEGNKLWPDTNSGNDVDCRGPGHEHGESRVPRKIRTDKHGAHEFVIPIEGPTRDFREVPVGVYDPPKYALTKMGRLIVLLGNPKKRMGGLGGNVHVDGLHHIGTAHIASSGCHSEPRSTLRTDDLTRGNKS

SEQ ID NO: 967824 - protein, 339 aa, Homo sapiens
REHIKVQQLMDKGSDKRRGGPPGTIPSAVDFPYVDDGGWTTDDPISKGSRPIETSRLTKITKPGIHRFYNQLSAPGGRLSWGKGSSGRLQEPSPPARQHPAQLLAQLLVTFHIAISRPFNQAVTHSTSHSINSTCGCRGSQLEPQHEAQQAGAPAGRPDSETRVHTAARGAPTSGTRLCIRSQPSTPELTTSRASLSAKGNSATVTPRTVAETGLHPQSRDTETGSTRHRIRPSPRSASSKPVSSGEIARAQAERTHAHYTPPVTHTSEKAGHTSGTEGTNQRKKSPTRPQSNEDTRETQPTERDNKGRAHRDATELHPTPPTRYHTTNRQRHATTPDR

SEQ ID NO: 967825 - protein, 161 aa, Homo sapiens
RKLQKEQQRSKDLESRQRSRSQANRSLQLQKFKELELQAQIHGLPVPPTPGCFPWPRLRLLTASSEQLDIEEEGRPGAATFHVGGTLPRAPSCKPAWQRALRCFVTCTFPSDHLGDLGDPFHLGLEDHLVEFGKEEEGVVGGLSGGALSPLRGLPIPKNPL

SEQ ID NO: 967826 - protein, 170 aa, Homo sapiens
MEDLERGASKKSKSTGNVVEKISCHISTISPEEHSSFNQMVVRTYFRMFWAFLAGTSLVKRSTHRTTKPRKIHKPDHLSASAMPRNKAVTHDTFGALRNRPLDTHTARTRTKPQKERTGPCGRTRTRQASGVATERSRTKASKHHARYRGRPTQEYMRSDERHNMLTDHK

SEQ ID NO: 967827 - protein, 225 aa, Homo sapiens
LSVIGCDRRGQSMSLWEDSVLRPYATMTRRISLRSGSSGLTTGKIAGARPVCLWVEVLVALSYSAKLGFPFSGKVYAENHRLIFMTKLSRGWFLVPAAYILFHMPPAPLRLQCGSTKTSLVYQKNEQNLQRLPHNSKIAMRENSSFSEQQVIPCRSQALRFRPEDLVSRNRITLNLVTENPKLRLSRRSVLIYYKGASTEEVESRCHRTSRQLNWVLARAKKPGK

SEQ ID NO: 967828 - protein, 143 aa, Homo sapiens
MHVPPRTETQATLGTVHSTITPEAHHRLHTSQHLYNPWSPAQRANHRPRTSTTYDAHTDVRQPGQTGQRLDNTSNTHNRRLTRTTAAQQHNRQQTRKAPNTTPRRPHQQKPRNAATPPNNQTRHANPRHHPAHSHTELNNNRN

SEQ ID NO: 967829 - protein, 74 aa, Homo sapiens
MLYITDEVNDPSLTIKFKLWGPNAKVGTETYEYTDYGGLIFNSYILPPLFLEPGDLRLLDVDNRVVLPIEAPIR

SEQ ID NO: 967830 - protein, 178 aa, Homo sapiens
MSPVERPPFDYILDWRPPIGGTAACRSARVGGVERHAGLHGWEMVGIGGATPPKRGAASLAERHERTGCTRSVRVLTSVTGSGGESPEIALTAKWVGHVPWTWRGAEANKPGVVATTDVRPYSGPTSFQGDRGTQYHTGDDRSGYLRSTITYARDTMAKGLRSVLTYVSVPGEVTLPS

SEQ ID NO: 967831 - protein, 285 aa, Homo sapiens
MCPQRKRFHREGLFSPQASLTWWEVESKRTHCVFTCVGLEEVATTRPHQRVVQITPQRECHTECARQCGENATPRGSPNPAAGRWPPACVCRTTECVRRLKTSVVPSGVETQHSHHHTQSGGETPRERHFYSLFHPSVKSLSESVSQQGPHISESYHEGREAPVVERHKSPRDEERAPVCSLFCGGSLAIDFSPGERKGPPRRGAPRISLPSSKKDEGGGLYKRRRGRHKNGRGGYSPMIRVKRPGVLHTRGGFPQRRGKPLQYPTCVCAPNPVCFSPPRRRDLY

SEQ ID NO: 967832 - protein, 130 aa, Homo sapiens
MVSSARISLQTRIRISEPNAKVNEDIKVDHTSSESKAHSQIPSTRQGETHDVPPTRDIVKGRYRGGFYIRLSRFYYRTQGSVLLVPVLNILKECWSTAAAALPQVSITRVDVDSSGATGGIVPRKTGDIS

SEQ ID NO: 967833 - protein, 106 aa, Homo sapiens
WQEQAPYERREKGAQKKVVDPIFSRTIGPDVKAPALCSHIKTHIGQDARHQDPKGNPKLRSDGLQGSVCLTVGVLGLIFGATACKVLPFPRQFPACISLARIVPHG

SEQ ID NO: 967834 - protein, 359 aa, Homo sapiens
MTYYLTFQGTRELSLHRGGAEDTQAMPVAHLHPSLYQDKMEEVEAYACSQRPCKRWRDSLEVHERKVTLYLLDSLSISRDYNLNDILLQLGTGGTPSLSQMAELCQGSAVGQVTLASLPGWVHKADDYDVVTRRATESNLLPAAVKDQPPCCISVRQGPLVRFNQGTSMMSACPQQTPTNICFSEQSHQSHRSLELAIKHGEALGSGPCGCQLDCLASLRPRPGPVAPSGHGHVQPLPAYTWPRDPHSPCGMPSLKFPARAPLGNLVQTQHATGTRSSTAIHARRRVTHHPTARAPHSRPQGDAKIRPPTTHYSGPRKGPTRTRAPNTRSEHSAHIHNPSSNDSTHNTAQYRPDHTRTT

SEQ ID NO: 967835 - protein, 434 aa, Homo sapiens
IFSEEPHWSKTITPCSVEPSVIIHCRMSKAERFYMTKAGYPSLDRAAIVTHLPRRTVVDGWLDTHLSSTDITDKSSIPCHPECLQPCCGWTFIDALRLRRSIAPSIILTDDNDDSAATTLRHASHVHRLGDLLIVCPQRTNAAVVTPNHTMQVPDEGMAQNVRRLGILYTLAHRPRLFACLARFAPGCVPLGQDPTKYSSLFALLQLAPRPGQRKTTIHIDNKKGCGPRLLHEFNYVLRSAARPPGDSHRRVLTPPRLSSACALTNRDRSSTHHYRSLNRSPSFPLHPPDVNPAQAPRDAVLTRTHRAYAPATLWAHNIRLAPHPLCSASPIPADKPADQPPPGPCRALLEPLYPLQPAILHPYPNTHLPNRASYAWHPFITKAFTRAATQPRAPPQAPRQTIPAPGPTNNAPAHTPPRALPQPTSLSPTHPLS

SEQ ID NO: 967836 - protein, 295 aa, Homo sapiens
MALSFALCCCMCYPLAVLTTFVKPREHTTDSDGQENGHTDIRACAEMDLARMVHWFLGMRLRTSLGQEGRSNEDFKGTYDSEDDNVAHGIVNTNKLSRDGLVGFATRDTIRMVAGFVPVLPMNPSRVSWAEALFLLRSTMVTGWPPVSQAPKVSFLFGRRPFGIVIKGPGNFNLIPGVLELVFPHRQQKNPLGENPGARKRAQSRSPSTYLVGSSHNASHTVGGSHLRTLPQSGGTHTWLFPSPGMIAFQRGRVYQKHSRRTINGAVFNHATPKHRTILILRRKNNNKAVCVTMV

SEQ ID NO: 967837 - protein, 100 aa, Homo sapiens
MRSAPRRPLAPPPPPGAQGTTHHHPRGGHMTSGAAPPQKTRPPQHTTRQTPPTKPRKKNIPPTTRRSTPASTQHNRRHKRAHTTPQHHSAPPRPRDSPPA

SEQ ID NO: 967838 - protein, 223 aa, Homo sapiens
MSRGGVEPGVISLVLVQNLSVALQHCKFIHLKLPVLRYLLSFDVEAEPSRFRHAFGRGASFMEDRVGPKFLVGIRQTCVPVASLDERDLVDWVEPLRVSTKQARGKSSCYKPLAVHTEVCSGSARACFVELSPRRILFAGARSCRVRGGPFTGASAFQPAKQACPRPPYSFLLRAPECGTVECGSVQARGFATNFSQKPLGFSQNRQQQEPGGWSRRVFGKSS

SEQ ID NO: 967839 - protein, 42 aa, Homo sapiens
MYGDLKGPVWAWTKAPSFGSTRAAYTKASNGTKRPLANSKTV

SEQ ID NO: 967840 - protein, 171 aa, Homo sapiens
MGKMSLCLLVLQVLLCRARYCATLCIKPNLAVELIPNKTASICLVHVELCHVSSILYSESVRVLAELWLYFPEFEVRGTHRSGQDACVNHVSEGRMFVPTNKLAPLAVDRVNSYSHIKRTITGHHSVFLRLCLPYTTLPASGRLSQVVIVERKYPEAYLGSSRDQVEGYEE

SEQ ID NO: 967841 - protein, 343 aa, Homo sapiens
LWRTSSALRSGLGLLPCRRSAIEVQRFNLSIRSQFPLFPSNSTSRNNPHRDRALASWCDVSAGPERGRYQTLLGMIVRGSHRLTVHTRRVAAHRRRRAPLSVASTHHGSSHRHGMYAREIVYGTERCTGCGVALSPRDRNPGIDRRARASQRPRAQEARCERKRGDASQAPVASIRRVYAVHRRSGALGPLALVPWPMDSRPMLTAPLQCVDPQQLAGEAAPWTREPGLGGPGLWWARVVVGLDPWWASRSGLECSLYVFFDLLWYSNWVAPKCVMEASHGQVHLWQEYREEAGEVRKLEDLLGGTPRGGKLLVGLALLGALAVKQALVPELVLAKAPDLVRQ

SEQ ID NO: 967842 - protein, 434 aa, Homo sapiens
AVRRSGGGRMSSGFGRVSGGAVSASPRHSLTLQYTEPQRHTRVIPTATRLSPETTRSRPTPRRATTLPPRRPQSAAALHLYPLSPHTTHLHINTHAQHTHARNPTLTAPHSKLPHTLLYQNTYTLQHLNYNLIHSTLYTHNAHTLTTLTPHTPPHPQPPLTSPANTHNHPNTTPSPTPNTQPPTHTNPTPAPPHHHPTPPPPPPSTHHLTPRPPHYPPHARPLPDQTSTPPPHPSHTPTHTTHPPTPSPTLQTIDPPPNPPSTSPPSPTHNTNTQTTTTPPNRTSPRHTHTTHYTSPSQHQNPHTTSPPHTPPPPPPPLRGPNTPSLPHHTTPLSPHPTHSTTPQPPPPPTPPPLPTTPHNPPPQPHPPPTPNHTPLTTPTLAPAPSTTALHSHTATTTPPTPTTHPTHDQDTPPQPPLLYPHLANTRLPLIIT

SEQ ID NO: 967843 - protein, 115 aa, Homo sapiens
KRYLCSIAKDLECRLSEDVNEEAVHARTSAQSPQKPGVLTHHRSRLSSRYSQKNSITLALHGDTQLEREGTRGLLIIAACYLQPEMLIQHSLLAASDKQRRDNQALDMSSIDNKM

SEQ ID NO: 967844 - protein, 66 aa, Homo sapiens
QAGHVTKVLGQDRFSGYECTQVRVEFMDDTSRIHHPQCKRPRCASWLTLLIPFVEIRAREPRRYSS

SEQ ID NO: 967845 - protein, 169 aa, Homo sapiens
MNINRSYTRCSDYDMKKYRTVLFYRGEPFKENDLLNQEKCPRILLQSLTCTRIGHTKKRIDSCTHTRHSPPESTGLAGRHHAPTAAALLTQEAYLPWGPPPHGSPKKTQLLANIGRIETRIPTTLTPTNTRPNPNIRASVHPQHSRTNPHQTTQTTVHRGTHHTGNPTN

SEQ ID NO: 967846 - protein, 370 aa, Homo sapiens
MCDVVMYISNTKQPYFRTNIMEHDIYMMKIHAIIKRTDRRLVKSVYNTATRGACKHNDKTTTARIRRTHEQSETGEDTATDKYASHTHHQDTRQKTHDNRTTVNGGYDSEAPNPGSTQTLDPPINQSRPRRTKNSPIHRDSIHTLTPPRMAHDTRRGGTHNRARSNPDIDANPQSGRHTEASPYHERVHEHDTKTPPGKRDNKTENETQLKMTNTRGHIICTATQRTPTAQVDRRGQGTCERLPGSTTDHTTRHDAKQKQHHNIQSRCEIERWRDRLKHRRQTRSTDNPKRTTTQSAQILSTRRRPAQGGAKHERHRCDAERKDKVHRRSAATLRPTCDTRYEERRDSEQPHSSDDDNTKPQRAPHQYDP

SEQ ID NO: 967847 - protein, 111 aa, Homo sapiens
MRDRPSVMMRRVTVMASLLRPLSHQSSCGHDRRGNTPCLWKIGVADATMQAASTQQCSTLIPSVHECGILDPRGLLPLNSHEEPLCMAVRNSTRRFVAPNVTLLRLKELEF

SEQ ID NO: 967848 - protein, 407 aa, Homo sapiens
EAKFNPRATFSEFAAKHANRFKHSKAIANSMQKHRSTAYGFNAALVARCSRKQQQNSKHSQDPAGAASINIGISLHTIHRQSIHLRQSSHRMAANSNTAPTVAKCIPRSQQPVRIVHPSAAESTIFPTPVTIMQHNISTKQFQHSSNTQQHRQLATGQARPLEAQAIRSNSSTQGRVSDTRTLVSGTHTPTPAHISISSSSSQQQQTRSKASSSSNFKRYFWSDHGYVRSRCVHGLDTRRTLRNRSPLGIWILIGPDDENRAAYLHCHTLNAPYQKTSTEHYSATFWTETSCISFTSTCTEVTHTSLNARTIDGPQKNHHTRSRNKQQRQHGAHTPRKRHIHRHQVTNGQPWTQPAGATQHQKNAKTRPPYTTKFKQTEQAQTRQQRTNESKQKEHQTKPETKQPVT

SEQ ID NO: 967849 - protein, 140 aa, Homo sapiens
VRSGSRTRLHGIVFNENWQHKPRTWRETRQLRITAKPDRKRTRRTKNTLPTKAAPLTQRRTRTLQTFPNDSLRRHFPYPRSLLRSTPSLACTAWQRNAANPANALRTAAPPQPCNLLHTPGPTLTPPGTCPPRPPAARSS

SEQ ID NO: 967850 - protein, 140 aa, Homo sapiens
RKNLLLEPSLEAKRQTVLDKYELLTQMKSTFEKKMQRQHELSESCSDKCPSGKIESSCTMKLQASTSAYILPDSTSWRAKHGTSACIFVQSAFNGKQQHTNLPTGQQAAKASRTLQTGASDNATAQFTVLPLISIFPGKP

SEQ ID NO: 967851 - protein, 114 aa, Homo sapiens
GLHDRSCCCSLVGSVPPLRAVTLTAKVCNFTPGASKTTNAPRGMNNSGHTIFKNRNTHRKGCNFILEVSEAKNPSIPYTFWWLLKETVTYHQVVRLLPSSEIFAKWVKNHHQSG

SEQ ID NO: 967852 - protein, 352 aa, Homo sapiens
MRPCGRGRLRRDALTANRERRPAAAGPGLPVRPGRRDGSLRACTPSPSASQCSPGTHVAAAGSLRGANTKSPPDRTADACGTGRQVHFSGLSTPLHTEFYPGENSSQAFSPRLGTPGGTRRMGSLDTPYLGPIRPPRERHPDPRAKTGTDKHTDEKSGGSPPEGRIKRLEITKAPTENTSPLSPLGHPRAQPFPKVDTCERAHMQGHTRSGGTPQPGDTHVWAPRSPQFRVPVGRLYPRPAKALGRANHSSTRTGRPSRGMRPVRRTHPNTPGHCHGQVDSAEERPEQEPRSALPTSERRRTPTPPEGHSSGRTGPPRRDHDARAAQEALQNTARTADRTHKATTTASNTSG

SEQ ID NO: 967853 - protein, 324 aa, Homo sapiens
MTEIEAIDYMRMEVRRWTCCYSSYLAHVGEPAKGDLPSGEPIKVQVQSPGYYKGSAPWEEGLERNWAGHSGRGLVVAIVGHLPLENSETNTLVGWGDLVWNLIPRPLKKEWTLAGAGHCTNWKKRVCILARLALGKLAIGVIERYPGVGGEKRNLPFGETVRVYQQAEETVNWGRNMFRKGWDAYKMSSPRLFSVCPSGGRPPRGPSISAPNLGPRDETPWGKQGVVPAGGAQRECQSTNPRLARGATTLAEGGRHPPGEEKKVGRKGDPQNNTGQRRRRHGSSCAATHNTSRKSNTPWSKSRPVRKESKDKKRRARRGPTHIY

SEQ ID NO: 967854 - protein, 209 aa, Homo sapiens
MSNWPAQCTHGPTRSGRRDPSGVVVRDGPAELSDDASIGIRVGDDQARDCMPGHQIRRVRPTRQLSMTRRHVYSRKTHLASTIAHSTIDHRTEPCQIDPLDTKAFNTPKTDIRDPEAPNRGTEEMPDRDGTEMHKKPTYATPHETEEGPTDTSIELQTPERNKTENTTTHKKHQLNRKEETDETGNHKLHRMNTVNQHIHTKRTPHHKR

SEQ ID NO: 967855 - protein, 246 aa, Homo sapiens
MASIECQCCLRLVHALFISPALKEEDGNTSLSLNPRACGIRLQSRLDDPEMHDDASPDLAEELNAYLGGDHMNSCICDRPTSQANTQHGRFRRSPGEVLYLGYYQSAFDWDDEHSQRSPGSIVLNATKARPMGNGSKCDLVGGPGMVEVGSSVNEGAGFSGDVPSIAVDQPLSALIVADHFDSSGFGLHPVLAGPEQGSAPRANLMIPIPLGHVIYAMVRRYTRHTLLVNTDQTTKINAPESAINW

SEQ ID NO: 967856 - protein, 99 aa, Homo sapiens
MQAGMRKGGLVYTNTSSIGSNQTMDPGRSSWNFVVEDGCMDLAGLSTAARWTIASDKTHNIDNRGLDRKKPEFTGHETNTTPEIINNKAPIEENHIQIK

SEQ ID NO: 967857 - protein, 74 aa, Homo sapiens
TSVKSEDEPPALPPKIGTPTRPCPLPPGKRSINKLDSPDPFKLNDPFQPFPGNDSPKQQRKKLFPPFLGQKNIL

SEQ ID NO: 967858 - protein, 485 aa, Homo sapiens
MNKQRLGQGDRKLHSFVKLLGGTRKRLCRLTSRSVLCAPSIRAMRGTFPISKALANSPDMEKFKCLGQLPDQTEEEAPPSGGELGGHRFQFFGLAKELLMQQAVRVVNRLASAGDTGERANSECANILWLWGKAKTYMRKPHRGRITRYCSWNGKGQCTGYTRRRQNWLFINLTRPQSIKGAKKQVCRLVHESKQGRTRGPKSAGDAIFSNSDRKHSPGCLTLPGRRGPDYRQGQPNMIKQRFEGPKPIPSITEDTFRLKYERNAIGKMPPSRRKRPPTSYMAPNLQHCSVKFRGPAINCDRHKFIHGPQEDEGYIGAHNNVRSRMRMPPWLGTGIFIASLVFAPLITGTDLKYVPLVGRREQRSTPLLSWDKSNRSGGSFATVWPFWHALESLLAYSRAPSLRELRKSSQKQRESVHHQVVPHNRWTQQPSSFGRLIIKEESHQRLYAIRRMAVPKIEPAAADWETAHRISWHRLCGSFLLIVN

SEQ ID NO: 967859 - protein, 367 aa, Homo sapiens
RYQQSGAGLGDKALRELGTPPTSHPTAIAPGGDRPRENHGVWQYRLTSEEARSLRECELYVQKHYIQALLKDSIGAVVQLLDLRDPWHSSGKYFEKVGEGRRQNRFRICRTAGTRTDSKGRMQHFSSSSQPSGFTRSAQATQVLSALQVYHGGKMRNPYDRKVIPKDYKDNGRLSQSIEKNDADIPILMIMREVIYRDAMVYESPFIQGETVIQQGDEGDNSMVIDQGKTDVKIKMNGKQSWSTASTPSTNMQQNENTAKEPMPHHQTKVQGGITQKNENHRSRDNGNRSDPSTTNNGHAKTRRKKREEGANKRTEQRHGTRRKRGSGDRARDKRRRTMPRCPARKEDKDRRKGDERRKERKKRNER

SEQ ID NO: 967860 - protein, 299 aa, Homo sapiens
MLSGPPVYAYPDTHRQSPWDPNYLHIPVNCPIPCSSGPTYQRDGTDVHAGQLRAGAPNYYPNSLWCSGTTALLTLETQHPTSSGEVRRFNTANDDLRLLRCGPSTAHVLNERHRGTTSAAENTRRATHDTHAQTIIQQAQAVTNSLRSTLTTGATIQALLDQYMLANLRLRLTPTGRPDPLGAKGQQANTVKASAPCPAPRTHNRHPRSPPIRTHHPPPNTINASKLPQNKSTRTTHRVHQQQSPGQQTTRQAHRKNQTDPTQHTAQDNTQPTPKPMRKRNHANPAQPTPPTRHKTKDE

SEQ ID NO: 967861 - protein, 79 aa, Homo sapiens
MVAQPGMAWSCKLHLHKDWQRALGTRGVNQSVRQDPQTYGPGRRPEGATRIASAPPRLAAPDPRPIDAAANRGSRLTKD

SEQ ID NO: 967862 - protein, 117 aa, Homo sapiens
MQSEEKPFLRKIHASAKIAEVAEANVIPEHREISAAVRDLQEAPPSQQTPENKVTGRRAMRVTELGRSRPAVKAGNGGLSDQRQQDPAKEMGTPQDDGRRHHNCELTRDNTGYATGD

SEQ ID NO: 967863 - protein, 509 aa, Homo sapiens
MRQRPTSAHRAARTRHAHATARALQAPPTPSSRINQRRINTHPRVHIINNGTYNTMQTHHRTTHTPTHTFFTYLNPHTPHKQTMSVRHTHERYTNGYERSPEAQTQHVQRIATGEHPRRLSHIASSIPGKPSTLHQVKVMSWCTLRYGELSGKYSDSALFHSSAEPAHILRLQGVTYESARAHDSGTQITTKVSIHHCPRERNVLQPHEHCTHASRHSVINTTEAQSSSPSRARQSAALESGSDEKGVIDTTDSEVRRGGATNRGQELGFVRDERTAKSSNELNAITPKPNTTRENTHQCSKLETPSTSKGQITCYAMSRDFTQGNPDEEETQVAAHNYATTRTTTATQDADQRTYGDRQGDNPSGDDAGGDICITDSTTAWELQHLSRRKKKPIRQTSKDRNYTNISNVIILTDDRLTRPRRDSVAPRPCVSHDSKHSGTLQPQQAPGVRLHAANNVDYHTSAHPSCLHLLHILINSIHRSMLSAHMLPHTTTSSYLSQPLYVVTTTS

SEQ ID NO: 967864 - protein, 518 aa, Homo sapiens
QTVKSVRKAFNQILSALTRHKMIHTGEKPFQMLKSVAKASYRLFTTLTSSTRDNSQYLERDNAYITVKSCGNSLTGRAPSASLPEHIARRDFMTEREGRYKTAECTPHCHKPSLHWLHQPSRTTPLPQALHDTLSVRGTHETPYKSVEEAVATAPLRPGSSHLPYFEQIRIHLNTLGVQQDPHKTTLLQPDACWRTHDPYYIHDFVQPPFYPSNPSSPLLFPLACARRMAPVAQTWLDTDNTAGPTDAPLLHHARPFHPPAFHHPQPRDPQLQQSRPTLANRTNKPSATTTGGCDEYTDYARTGRSDNSEQTHSTNRVNAGYTVKRKNTLHRPRARKRAHPRPSIAWNETGGDTQSPWQTNQPIHKRSTTHTTNMSYTDARNLGPQQQRTEETRHLGYNNVTVATTDTRQTHHATVAPTKAPTLHYHHTSNPDTTPRQAHPEATGRVQRNTVAHTTYTDAPTQPPPGANQHQDKETETVAEQPNQEPATPAPRSRCLNIPPHNTGEHTTQTQRRKLRD

SEQ ID NO: 967865 - protein, 373 aa, Homo sapiens
WGLSQGGGWSGEVGGVLGLRRASWMRLRLVLELWLVAACEEAASGLAGVLVPVTERPEVAGQRLPVCVTPDGAGVVLVRRHALTPSRQSSTENSGEAPGVALGSVTQPLKQRDESHKWKKRLSYDRWTTTACNAGHEFLGYSTSCLNGRKRDLGCLEVLCLHMLLRAIDHELAQSNSLMVQSITLANMVHLQECYDELGNRYQLPVYCLAPAINMIEAKEDIETLDIPEPAPILDLIVQLRLRLSTGKDLELVVRRTDTVFTIDETVALHATDEPGRQGDKLEETLRDQRQFENLGSQGELADKGTRQQHQCSDLDTSGTVSRAEWRDKVQNRRSGAEHTQGENSESNREQQGPEDLVDRDVEPGHKHREDSP

SEQ ID NO: 967866 - protein, 401 aa, Homo sapiens
MGSGPMRRASAPTLTLEDEEAYAMAFVKPSSSYTEPTGGQFPVPRCKCVPHTDRLSVHHDTRAETSPGIAPAQRCVHSGVCVIKMRIAKRLVALTWLRRKGALGATGRTYVQHAQSSMVVGLQFTKARRTLKNPGDLSIHTGLVVLGLDDFAAARLMADGRCLSNHAVSSVPHGDWRTAGARGTALTQEPPKSTPCPRAALRHGSNEQRVTSIFATDNWLLAILGGYTHLGGAKLCTTPPRGAPNNGEFRTKLATPCCSKKNMALWSTETPGEKALSFQTLGQTLLLCNFPSTCLRRHFNHRGWVSQPGPMCGPVHNMSGPTRDRPNPQSEESRYSPYGEDNTARPTCVIDVIERTTTSIEHKHNQPTRSGLIQKHEDKNTPNPTAAQPTLSSSHNKQRRE

SEQ ID NO: 967867 - protein, 104 aa, Homo sapiens
MYYVRVAGKKEDYYPVVVKSYIATIRIETNSLADQVAQAITMMLEQEGREGFVVKVRGLRLVLFTRVESDSRFFLLIAKIRFDGHDRGHSFSSRTTQRTARTKW

SEQ ID NO: 967868 - protein, 306 aa, Homo sapiens
ATPAALVRTPAQKAAKHKAAEVVLKHLKGGSMLEPVPGGQHHSSSALRTIPVFYCCSELLPHSSMLYPQPRSPHTIGNLIGPCLSSMRSLELLKPPVGSSSKRGLVVSTKARRGMPGSYDEESQGSLGRKSDPDKGNANMTLSEMEDRCYYRNDLGKSRTFRIDNFGRTRNAWWSIIGHGRLECNAVTYWSAPRYGHMTVDDRYDGPTFSKKGVGLRVVGWVFRNSRGPRVCTLGITLRNLLSEEIDPLCPPETCVPWAPWGALGACLLAAFGSAPEGARLPVRDPDIGELARWLSIALWICPLTA

SEQ ID NO: 967869 - protein, 294 aa, Homo sapiens
MDFLIQAQYGVVIPADVTKFHQLINDHANPHLPITLAMCCRWNLVSRHSISTRLDEEFFGFPNRFDWHCVIERSGPRKISGDPADVTGAYQKSGNQSEGAGERRCHLSLALRVSIALAPVTSSTDVSRWTGKLYALVRTPELRLPEDLLGHRCSWLWRLLLCVRNALSASVMSVRLPVHPACAVTFYDLATCVTLSTTAGIGESTPAKMLPCSGTSNGDSLLFSPYWDPLVQEAAREHPGGFVWPNARDSSSVHTRSAPTGASSLLSSASSPPATGSWAQGHPPLNRAPPSAGR

SEQ ID NO: 967870 - protein, 54 aa, Homo sapiens
MALRTITLPDLMRWLREGCWWEKDWERPLLPDASPPSPGQQGCWGLLLRERGLA

SEQ ID NO: 967871 - protein, 185 aa, Homo sapiens
MNTQKEAQEPNADENDKRRAPSARKQSEGRGAQQTKGDDYASSTTTGRSPHRDIQTDRAKTTHKKTRRRRKKDPLQRGEHRHSKTPKEQEQAQTNTRTNKPHRLRTQHTAAAEPPTSIPGATITREQQYYEHDAHTIQRNERAGGNRNMRRGDRDGSDARQAGAAEGNTRQQADDTGTCTHHAGH

SEQ ID NO: 967872 - protein, 96 aa, Homo sapiens
GKINSAKIVARTNIKLMVKVVMWKNGEIIDTLQIVYGDNAPKKSVAVYKCITSLRRSKVLDEACSSRPVTSICKGKVNLVYANISIGSAYTILMEN

SEQ ID NO: 967873 - protein, 237 aa, Homo sapiens
CLGVAPQEPGARRLVPGDDPGSITYVRFSCREDGLIDSTLVILKLPDVRMPQALAECVPQLMVCLGERWCPTYGVIHGVQITDQLSLESDIWPVIARGFAMTGYGILWVKNSWKTQTYLRQRRNFVEQCYTHYVKLPTIGTELSYTEGLSLVYMAARLDGGLAAVSRAFHEIRARNPAFQPQTLMDFGSGTGSVTWAAHSIWGQSLREYMCVDKISGMLVLAEKLLKVVPQNLGEAF

SEQ ID NO: 967874 - protein, 264 aa, Homo sapiens
MQRIDHQQVSLITQLHINKKTKNKKHTTTSKTVSQTQTRHFNIKQQTVRTVKASLTQNQNVTTPTDRQKLKVGREEVGHAQGQATAGAGSYGERRRTTQEIRGEKEDGGEGRARRRGRNGKDTREHKGGAEERRGSDRRRGKREDEGTNEERRREGDEGRSKAEGGGERPGEKQRGERERSDERRERGEREDERGGRGARGKSADSEGERTTGENERGRRGRTGRGDKKTGRGRRSGAGSEGKTARGSARRRELARARRGGGDG

SEQ ID NO: 967875 - protein, 137 aa, Homo sapiens
VRIDKEGVIEPDTDAPHEMGDENAEITEEMMDAGKMINTQWLLLKALNDGELQESQLTLCHMSAIQAELHRCGVILGSAKEGQVICRSTVYSKTETVCPSGVTGADAKYEHKFRAFSFHAPYESWAGGTNATNMDFS

SEQ ID NO: 967876 - protein, 226 aa, Homo sapiens
MAEDAERWDLSSSLAVYCGLRCTELVDSGARAATVQQAPQFRLTRVGGVEHTVRCDCASCELTPHFVDPVRVPLCEAVLWSSMAQRPVGRGPGGPDGEQRLDNREPAMSALVHGAPRRVLASAVAGRRERLLTSQGLERHGIRRVRRGASCGAQNSGSPEAEGEEIRPGESPGLGGYRPCCPAACAYVSPEGAHSTGLWLRSCRPRQLELGAEPTRCCVDAAGQCS

SEQ ID NO: 967877 - protein, 144 aa, Homo sapiens
AHYGERWAGHRACVDDSERARLTPVPSHPRAHINGDLPKDLTRGLCTLYLRHRRQENSLALERATPKARATAERKARQKGKRKHGHTEHNRTPEEAKKRRDKKTPTTRRQPKNNKHNPSRKAHKKHKHKQRDTEANENAHETKH

SEQ ID NO: 967878 - protein, 243 aa, Homo sapiens
MECLLNQYRRTHNLLTNAGRNTPQDQTRGKKQRNTHTKTNKKDRDREHQGSRQQTAYKQNRQSEETDNPTQANRQGRERSTEREEQERKRERKSKKQDKKNRKEAERNEKRREARRKETKTKKERKEEKKQQKSVKKKKTERQNKQREKKEESTNQAQQATHDSSTAQAERKTTPSDRERREKGRNRQEEQSKQEQTHADKREEIKRRRKDRTTTGGPSQAKNEKDEDSEARKTEQETAARRD

SEQ ID NO: 967879 - protein, 209 aa, Homo sapiens
GYPGFSKNGKMASFHSQPLTPEEVSSCPDTLELGVGSAGFKKQNKLWRREPVNKHHSKSLLHFYKRPSNRIMHHLRAFLLPKHSSLRTTPRTHLLPAKLDDGFGNDENFEPVRAPQQFPESASSSADGAMSAPPQELTRMEPGVTSTKNNVNLNSATTDSLSLRSQDVPPDAPEPANLAQKQHAPEASFQHPFLSLHRADPSSKALHVG

SEQ ID NO: 967880 - protein, 275 aa, Homo sapiens
YCHNSNSPGDRDVTRIERIGAHIPHSGDWRLDDAIGASAGFARHGGSAWSVRRWRHGVVLEMIREGMIAWIGQSLIAWPWSASTAVIPAIFHGHVRMALGALTQPIHYAIAVSEIFSLGDEHRPEALTQCLPGGSIGRRIIGGDGDHRRGGGVDPDVIDQQQERAPMVKLILEAPQDHTEMGDHLRFWGTKMIEVPDLGQLSRPGNVITIVQGDLVTASPKLGRSLTTRPSIRRYWAPQTKFVLCPDGGNSKTPEVVHTGPRIYSYSPPGSGFSG

SEQ ID NO: 967881 - protein, 44 aa, Homo sapiens
MCLVYSGIFGPKAPLRAKGVSTWGPLEIRVRALDTRRGCGAAWN

SEQ ID NO: 967882 - protein, 128 aa, Homo sapiens
MVRTGKADAYSCTVVYLFGQRFHSKHDLLTHVRTCRLYRTQLMEGKDTKTRSIGNCLAITGACVSRKMRQNGGLPSRRLMPKRDTFVHDRRRIYACGRSHPDVLSNSIVHDFRLVGERLLDETRRDLS

SEQ ID NO: 967883 - protein, 361 aa, Homo sapiens
MARGAHHQSLALVATTTNNHSDKHHRQQDHYYLLPADGLRTRWRFTRTQSRRIATNTYTHILEHPRNAGGARRALSNNRLPVRTGSSHQQGRSSTHGIASSLTPHTSDAPPTFLLFDHTRTKHLFVGRRTNRPPFILSDTSYSIDTRAHSMTQPAHHRWLYSSSFDGARPIHNRPLVHRSRCVVSCVLPPPLLAITRCTRPDFNPPMAEPPRPRTILRPPPLAGAHSFRGARPSCCGKAPAPSHTRSDPPQPRLALARTTATPWHTQCPRRMPGRYPPRHTTQPSSTLPPGTTPEPPHLLLTADTRPRDYNRPRSAKHPHRGATADNIKTPRDLLADPTIADRGHQHRLRTTTAGPPSATT

SEQ ID NO: 967884 - protein, 137 aa, Homo sapiens
MLVGREQRCAAGEKDRGGAGGARFAQSMKPRGRCRRIMKCHEHFAWRAKHPVRVRAQRMVQSRLRCRDGYHTRVARCATCVRHLHVCIDVMVCCRAQFAPKRLSLRQVDHRIGVLVYSLVRAGPVDARGRGGGPRVR

SEQ ID NO: 967885 - protein, 296 aa, Homo sapiens
MWLIEHEKHATVSSNHDFEENGSMDNVMHIFINLANDPTIERIITSSTGIYTTAEFHGRTTVQKHVLPYSKPDMSSYAEARSTRFHASHGQEVPGSTDAFPGYLYTDLATIYERAGRVAGRNGSITQIPILTMPNDDITHPIQDLTGYITEGQIYVDRQLHNRQHYPPINVLPSTITVYRICYWTTDDQERSCPCIYPAILLLCIGNDVKPYSSPRATHPLTTRTPPYPHFAKLHCPNIATHNLQRASAGPSNIHATSYSNLDTSSSTHSQIIAPTRLRQNLPQPPQAPYTPTLSN

SEQ ID NO: 967886 - protein, 233 aa, Homo sapiens
LKVSVSGEDLVRRFSRSLKNKKSRGPPIPVTFQRMRASDSCRRVDAFSLLPNLPPVDRYWYDPCGHAGHAHSCESEEDICPACSFAYGEESSRERREEAMKSNIRSAHELRKGRKPRLRLLCLTQTRLITQSALQSRAPHYNRLLLSRKYRPVSPWSLCLPFPYASLRGRNSKVGRSVGNLKLRLATRPRSQQLSSAPERMSAHKEDEPVDHYLSHSKLWMDPRWTRSEWATR

SEQ ID NO: 967887 - protein, 82 aa, Homo sapiens
MEEHQYFQLTLNQFIGYVIPERRGRMYDPRTRQADRWSLHLGPSVFPTGRKETPKLLTRHHFRNSQTGLYTASPRGPHSSQR

SEQ ID NO: 967888 - protein, 101 aa, Homo sapiens
IEDASRVCKVFSHLVMTAVRTGDRTDSVSVPAPTVLSDVLYIRRYLPVYTNLLVSAILKIIYYRIMVYVCKVHAVSIKTQFASYGRECRTHSLVDSPNNHI

SEQ ID NO: 967889 - protein, 103 aa, Homo sapiens
MFELCHVRLYPRRYRLTLTSTAMSSTGRAERSECDFKITEGCLCRVTPEAVLIVNRDVNSTTCHRRQISGSSECFVTKSLDSIHSSGHNKGISFLVLRTTLSA

SEQ ID NO: 967890 - protein, 79 aa, Homo sapiens
RGVGHTAESPLDAISGSSEAMYACTGMADLGIHMYRADDGGTDSVPYACNTQAIEEAQGGVHASCMYTLSLYYRIDALS

SEQ ID NO: 967891 - protein, 143 aa, Homo sapiens
MSDGYMVSSDTSVLMRRHPEWTHYKDPRVARLGNHDKEVPLGCLMTHFAERRGCDRWGSGTDLNEIVKSSPVRSILFAWVSLGGDSNTRIVCMCYVGKFLWRKENSCRGTGKRAFKISTRTDYSRGWGPSYLNPPSRVELSWI

SEQ ID NO: 967892 - protein, 154 aa, Homo sapiens
VCQPTESLGTSPSKVPVLGLPSSQALVLSPEIRKAPLQQALLSNLCSSSSSSQKQKHQSFILWKRGTIPLSSGLAAICPRRLSLRPSSASMVTDIFHVEIPVVGQRCWQWLIFAVSSRRVRTRPIISFAVKASPGIPAELPVRIEESAKFTEHI

SEQ ID NO: 967893 - protein, 170 aa, Homo sapiens
MVDYLISGGTSYVLDDRLTVHARLCATDGRQRAYYPYEWYLSSLLRLVIIIRSFQPAKEHHGWGTLNRMRSLSWTTRMNRPSNVHLIRTSHKHVVYSLPCTPIEHQAVSTHEWDLGALGHQFTTKVGLTSGRRDSVILRHIEYTNASISCNILRYSPGDAKLADVLRATG

SEQ ID NO: 967894 - protein, 126 aa, Homo sapiens
MIRQYWGCMWVTNDPKFDVSEQSGSKVMCNEVKLTVASTRYLRPYLRALWNLDRKGANLDLGKRAPSSPHFTSSRIAFPWIARPNFYSLDFSPPAMFQTRAVHNLALYLSNAFTGGDPGLLATALL

SEQ ID NO: 967895 - protein, 178 aa, Homo sapiens
MPPIARPWSGGEMQGDSRYLSQSLLCSPEHNNDHLYLIRSHIPVVRQPSADPEGTVRQTVAPLLQDAQIVVSRGASRLCSLTIVTHPKATFVCAWHQGATAKNLAWRVSEMFRGSNSHVSKPLVDKQPSRTEGLTKILAAIALVNPTLPLGRASKGGPDSILKAHRTLLKTQAGPIIG

SEQ ID NO: 967896 - protein, 138 aa, Homo sapiens
MRPTLRLLGMFNECYALAEVGPEPCYSVGVHLSRGANASSHSGSPSGWPEALTWRETLQDAARGLPTHDRTLIKDVSEAGLRSLDAYGTALNPPDNPRVPNWGNLIFSLALMTLIESLAAFDGLAYSELTLLEPFRTC

SEQ ID NO: 967897 - protein, 73 aa, Homo sapiens
NEFSQTRITIRVWYTSVAWDSCEQADNPYYTQLLSSSSRGSRSSGIKVASRISNLHIALRSPFITDVEFINEK

SEQ ID NO: 967898 - protein, 265 aa, Homo sapiens
TTSCVCDYPMSAPSIIPSFLSWALRAPGWLLQWHCGVDCLPNKKLGRVISAIPATHSDYMTDTGLITKPQKIASKCNFLTCSRNMHFTENNEAIQIPDVTTDFQAFETNGHQKISKSAPRINQTLTCSSFPSGSSMMACSSASYPNSATLPRYSHHSFDNAKASKEEAPKAEPHYDLTLPLKTTHKQPPSNARTPPTHCSHTRSPQSTPYFPYYPPSQRQQQVPLPGTPNPPDAGHTPEDHNPATTNRTAPPHPTTRPPHRHTPP

SEQ ID NO: 967899 - protein, 126 aa, Homo sapiens
MGNPVSSSPQDLVQEKYREVQRQVPYQVIRATSYQVHYGGREEPSCMITLLQDMIESLRRLFRAHSNRSVCTISAAVVLITIARIIDRWRFDDGLTVMRTQHHMSSIADVYDAHGGRHLTGTAELF

SEQ ID NO: 967900 - protein, 324 aa, Homo sapiens
VASNRFSVKTTPRESNNRVGSVCQGVVRSVPLVRSKFLALFNDTSVTMSDAKKMYHYNKNCSTYDHIKNLSKNYDFDYGIDVLSRYWSRGSWIPNAIGPLRGITTGSLSTPNDDLCADARLQARFVDAPLRNASNLLPYHRYAQAVVETSTQYSTLQLHDIQLKLHNPFEPISSNNGTIGGHRPTVLASRNPLVSNNAGKIRQAPFLGRRAKEESPAATTDMTADFYRSKCPVQILTPLCVILQCSSGSARSCENLFTLTNGPPIRHAKTQRVPGMLATGNPPSPKVRLADIALIADRHIIGPSRLYNDDKLNATIQVCTATLE

SEQ ID NO: 967901 - protein, 214 aa, Homo sapiens
GELNQYSCKSGERVGELFKERSSRQIITDIQIIQGHDHVCDRVQGSHIGRQAFVTPQMSGYIMNDFPDDERPVQISAGTSPPNYDHVVLGRWSGTSMDVTTNSRQGYWTRFEAQSSSIWPLTEESRKESRRRLGSLSTSVATSILMASSVLAVGGEAWLRPYPLLRAYSTSNPRLEAYEAWILLPGVGGSMPGHTRCTLFIYMASAGHLRSRRS

SEQ ID NO: 967902 - protein, 175 aa, Homo sapiens
MYVDIQAVLVPLSPLGSNKSAIVMWTARDGEFDPSTSCALFSQMCVNGPSLAKRPILAVSVEPESGARVNLRTQYEPSIERYPCNSNGVRVPPMTLRSSPTGLCKTGRQFRYAAETIHKGRKGFGAFTCPGPWGLSDAKGNDCARPARSFPSLPVLPWAAQKHNGWIAPEWAQGP

SEQ ID NO: 967903 - protein, 72 aa, Homo sapiens
MTSGRKMAHVTPVTHLGFSETMANQDTTSSNKRDSARDRRNAYSSKTAQKATNEWSATTDTYKSCAHSPHQH

SEQ ID NO: 967904 - protein, 370 aa, Homo sapiens
MYQIERHILTCITMHGICSVLTTSNVMKTKTCLNEHGMPKQHVELMRDNRGSVGQTLSMPFLEETREAYQRKHHICAYGARTNKLIGWIHMVTVVTMFTDTTEVTTDGMAVHRIEIERIDSIYIQWARHVAGLAIMRMDARGCTYNIDFSLPPSNATLGVAVQAADIDNDLDHSTFSILQRSKDELTKVVKTGHTRLFLEEVGVVLESHKKLTRKIGKCEVQISTCRDFANLWQECKHAHYCSNILLGIDGVLRGQSCTEHFMTANGMAKTELGPTRGRTEASGTNTAKRRPVHSKPEVHNVPTSDAKTTTLAGGPRCRTHSGETGGDTQGEQPQQARKTTEQRNSAKGGDTKAKRVEKRKDRPRTPDVA

SEQ ID NO: 967905 - protein, 309 aa, Homo sapiens
MADVTRESTYQGHQTPAVQKGLRYGIIRIYYHQKFNLHVARIFSEPFTNSRHSPYPPQLGGHMVPRAGSHTRYIHLESRHFVRAHPYYSHQEYQSPERHHSLDRITTENQNRSRHCVNYKCYWALYLDPSVQSLSRYFDVSPSPFPSGIYGSTSSCSHRLHTDFTSIIGLKFTHYLLHPATNISPKHPKESKMEATAADTNTATCKTRSRPTTAGLPRMDERPTHTPDPHTNTTRAPPKHTPQRASNTADPKSGQSGTPRRCNHTDAAAIKTREHTQRGTPDTTTGGKRRPPRRARQQRRHNASQSKKP

SEQ ID NO: 967906 - protein, 66 aa, Homo sapiens
WLSVDRQAWLSEGQMIVGFLLQNCKMDYRKGHPQCRFALESVRSPGTLRATCRYRRHIAIVIMDFK

SEQ ID NO: 967907 - protein, 105 aa, Homo sapiens
VLYHRLSDRAVRLSSTYTVDVDVDWHCVTMQFVPHRDRRSATSVPQALQDHRHLAVVLASIRPRGIAHVETRTQSIGSSRPGDMRHQRSACVNTILAYGERHKGT

SEQ ID NO: 967908 - protein, 209 aa, Homo sapiens
MRRHNHHRSAITHCESETPYKRHPKEQVSHLKYSNTRMAAKQASNAGRHNKATTNAHGGNHHVDLDQPTRHRQKGWRSHSEETQTHQRVPAGRTSHLRNTHGGRVRSREHDSNDHVTATETRADASTPHRRTATIESQLRLAISSSAHTPPIIATPLRLTHASINGIDQHSSSTQYDQTSECDIASSHSTLDDSHRRVHRSSDRSDLIG

SEQ ID NO: 967909 - protein, 132 aa, Homo sapiens
MLTHLTDEEDIIKPPRMATSTPPGYPVPPPRAPRLTHTTRHHTHPDQNTHQGARTNTRGHEHTPDYKHQTHKTPPHKTRQQRPPRPRSTTNKTLTPTTTMNNKNTPPDPIRPPPHPRTQHTTRRPHRTTRAQ

SEQ ID NO: 967910 - protein, 567 aa, Homo sapiens
SLSLRREREFQKRHRGGVQQAAATPGLGDIRVHHSSSAVPMDCKADNKEEQRGVQREKKTERRPTQNDWHREQKTQENESHKSSPKTAVRDHRTGTKQGDTHDNKRRNELTRADTKHPRTEPKEYTRQTGPQRHPKQRKKGTTKRHPCNRNHCGRARRTSKEDELPHRTASQHGAPGEWTPKGHTKGTGRNAGPAGTRTTDTATPGQRDRQDQREEEGRQTRRNVARKAEKDRASRRHAPAPTKAHTTPTRESEKTEEHCKDATRTRKRNGHGENRENERAQKQRQRDKRASTQRADNRERREEPPPRDAETRAALKHTQADTTHARETRTRRTADQPRRQGHGTTREREPRDETPENDQASRTGEDQTLGRGDTTRRTQDRDEGRPTTTGNSATRNRERRRRGRTDAEADRRRRQRAQGTEETTRGRRERTPKREHRQKTARRQTTTQDGARRGERTERGEREEEKNGAASGEERGEGQHRAQRSDRGERAGESEHGAARQRRGNDEDESEDGSERSDRTRRGERARVAERLRLATPRRHHRRTAAGRANATDDSDEGRKAEQADP

SEQ ID NO: 967911 - protein, 82 aa, Homo sapiens
MNIAGIGWNIENWGLLWVTQGRSKTSVSTGGGFITKNETPSVGKNPLRTLTGGALGPRQQVLLIDHLIEHTRTQVSRARPSS

SEQ ID NO: 967912 - protein, 110 aa, Homo sapiens
WRLVRVAVMYSQGCLKLHTRDSLTTNRWQPDCKEVDKCASSGKNLSIMMSLIINISSRNKDVSLAEISLISYSCIEYWRMAATHPGEAISCDHDRQLEVESTGIDELDVS

SEQ ID NO: 967913 - protein, 99 aa, Homo sapiens
MRPGLGDSHRRAQCRKGGTTTAADTSGDTFHGDTTGRRENTWWANSGDVTAPTVCTGRTTSTFSARELMPHADMLDGRHIYMLPRNHAHAEEKHSMRDA

SEQ ID NO: 967914 - protein, 111 aa, Homo sapiens
VLSCLGSYPRGIEGAVTAAYGRFGIGVGGFYGGTHMNSGVGSSPRTEPEVASRQSTFVRMHPQTNKKGVKIPHPQRGWRDYLPVGQRYAWVLVSIAFTSPFCKISSDPSKL

SEQ ID NO: 967915 - protein, 340 aa, Homo sapiens
MTRRYEPRYPKGTQNLQSAWCSRGGVSWRVTCLHDLPAHACIGCDVRHIFKDLEFTGHHGSRAEKNLPARIAVHGPVAILHRGGLKHVLPHGSKRHTGQDNMQLHSIDSSGNAQENCSLVRYTYAMSGRDIIVVRGLLAYNKDDRPESKKYREKSPRITWHLANQNRGSRPKKFRNRTGLTADTVNRTPALRGCKNKDEACETRTGGVQVETWSSKNQGTLGPPLTIRNEAYAQNLNFDVPSYPMEWSLADLRPLMVSPTWAWTRTRPPKGFLATFGGNKRPSNVGTHLSHRRCKRAHTRVSLGAAPTGNWGVTQYRTEGVPQTMFWPPDKLCYLALICS

SEQ ID NO: 967916 - protein, 132 aa, Homo sapiens
MDMTRGAAPTILEIRMLAARDERTAGSNNYRERRQERRHDEEAMDRSDTTLSKDERRRTPPRTQIATHTMWRRGRTTDSDEYVSHGHAARKSEDRAEQQCEQHPATEQTEATPTPRIEQTGQPRGQRQREKG

SEQ ID NO: 967917 - protein, 66 aa, Homo sapiens
MPETTQREITQCVTRSSKAQANGRSERGIKRHSAQMRATQTRGDAKLDSITTIIHDNPKHTRTTPT

SEQ ID NO: 967918 - protein, 80 aa, Homo sapiens
VVNKEQLHVTERKGVQALLIEVVETPKYETDEAILPTAMFESYYRVLEDDDHDQRILDESGSVRGIDSSILGNGVFCDVG

SEQ ID NO: 967919 - protein, 254 aa, Homo sapiens
MNLRTQGRTLLNLAVQAGITPAREANPPQDWESSGDYGDHLYKSLSTGGTLICSVGQYRCERLGGSKEIHGNLYGVNPESTMSFYEWFYKTAKAIRGMALCVNTGRLWEFELNGIPMAVLAMYLEANANSRDSCRIDLYAVLVKNSYMCPILHPNLFWHWDWVPPYTMTRVIRHAPVLNARRGNPKRRGCYTTRGGQQTAGDTLRGGNLGSRGKTGRTRDKKPGPEGRRGITKARRGATGTTANTRTAGLGQRG

SEQ ID NO: 967920 - protein, 116 aa, Homo sapiens
MDNNHIISHMIQVDTKALIYTIYSGVLHGRPCGDALSEPTLHDQLNLQLTSIKHWHHDHHLVATTSWARSYTQLEPPLNTCSATAVTTGTHSNTQTTQTKRRPGPRTPVDQRSIPP

SEQ ID NO: 967921 - protein, 201 aa, Homo sapiens
EEEVEKAWARAAEVGFTRMAALHDNAGRDPAVGPQGKQERALDGPPHSFTHVHLILLSRVSGHPHTEPGTQSDADWDRSCIEHLSTDDDGDSSNHANDDWPMQEDGSVWHEPSTLSFTHPLNLYEFERTTWPTLLQCNNISIATGTHLNSCKMKKPLSPHSTTGGRARLNPKCQEVHQTLILDPAQRKRLQQPECSSMFSS

SEQ ID NO: 967922 - protein, 354 aa, Homo sapiens
RWGTRRRSAATAATTASARWRGKGGVSPGQRAGGRRRCREGRQVGKAHGRHFSINTQPSHQLFIPTDCWPVQQGPKRWSSNVQRSGRMNSEDCAYTSRDHLSQYSHILLELEAPLKICGDIHGQYYDLLTTLTRYGGSPNQNTATTCLLGDYVEQGNKAVTSETGICLVTGLYNTYQRILQHRIILLNRGTHECCSIQPGNSIGHFTARNGQEALQHKHSHVWDNTLPKTCFDLHNGIARHTRHVSRIICMTMGRLRQQHCSILWRPISANYYQPHARYTNNGTSKRTHGEPPPSETIHSLRKNTSGHEYRRDTGEHNAKIEENNHTHSTQPAQPHTTPTRAPRGSTTANNGTS

SEQ ID NO: 967923 - protein, 110 aa, Homo sapiens
MNPVKPPRPTTFARAGILSLSSKEMNNEMRGSLSRCSADLRHSYHTSAPRPDRHGHARRADGYDPSNLRAVKKLTINKLPVRFYLVPIMTAIGQSPPENNKINTPKKNKK

SEQ ID NO: 967924 - protein, 196 aa, Homo sapiens
GLSPGPPGNNEAYAELIVLVYAAGKAATSGVPRHLLTPRHLMPTLSPAKTQNPTQTSEFPWALTTNGYPGGYLETVDKEEPQLAGHGSILVTPPSAFRATRTRSVASDSPQWLPDSGQQHDDLMRVLSYLAHRAGHLRTILEHETRTEDRVERAKTMTITYHQRRLNGDLETHPAACTNPESRHDELTRTHPPHSH

SEQ ID NO: 967925 - protein, 111 aa, Homo sapiens
LKVRVRVHYLEYREVPQSSSSHIIEFPCGVRRALVHESIKGRKYVGEFIGAKAERKRHVPSSVSIRGSKDACVTRMWKRESLGHEIDDQLNELLNVSMDRGEKPCEFVIVS

SEQ ID NO: 967926 - protein, 394 aa, Homo sapiens
GRSQALGRTDPGRIEALYEKYNMWAIELLNMELQDIVRAWICRKSSCKDASMPKKTIYIVSVRESHFLAQLRYTPEIARDSQDKQYAVLIDDAMDKSWLSKVMYGELKQDIRFQNQCHHDEDKLRRSSSFVACPLPCLHDFRILTSLAVCSDTIPEAYILGVESMCVPVARLDSVLTQRSHRRPTGEQIYACILQREADAVQQLIYLVSTTNRVEQSISLRGLIYSDTSPRMRYVGSCQKPTTNLDAGSGMRLNMERAINEQKVWHEVTSVHILTKRKPHAQRPDIAFSYREGPAGLAFRLNISVLGTWRPGNGAHDETVRRRLEQKGLQKGRSNPRGTSHWQHTGPNHTRRRNNEARNVKQDYGKTLQSNGEPTEYRNRQHRAKIKTTQPHNH

SEQ ID NO: 967927 - protein, 99 aa, Homo sapiens
MVCSTTCSIFSNEGGRSQHKQPEKRGTLVITTRAHQGFQNAPHRGQKYYKGSRVHNLNHHKSETEEAFTPTAYNNIARIGETDTHRVHNYPQTDKKARH

SEQ ID NO: 967928 - protein, 291 aa, Homo sapiens
MRCRGSWVAEEVAAAEHCLCFMEESARPPVSRRCLVWALSQKAGQESGDGWVAIADNFMLEMQCIAVLKHCEGTLMGPFRTCVLGKGRRHASRDTSNEMSSTLGNAYLEPPDITSTRVVSRMHLDHPTRETWEVVADTPRHPTPRYMRTHAYHISLSRRGLSYVRTYCLCAIVIQVQSLLHGVGAPWGRAQGRNCLKRAQDKKARNFPEVTMALIPGGFNRVSYPTFSTRPGWAPCIPGYLVCNKVYVRPTRSSLSHGGRRHTGGTAVCELHKYMVRENRRKGIVRMCLAT

SEQ ID NO: 967929 - protein, 154 aa, Homo sapiens
DKVLSVYDLHDKSSEKTAVSVFLKMNWKLDELQQIISFQNPELYIRESVKGSMEQEEVMEQACTNRYKDPQDENKMGIDGDTRSSVSDRWTLESTSSIECVDYCMEVQSMQHSASSPKQEFMDGMTEVRMCQHRRKLKGQIPKMEQELIEPVTI

SEQ ID NO: 967930 - protein, 104 aa, Homo sapiens
ANATAEENRCTISQWSTPPVFFDIAVNGEPWGRVSLELLADKVPKTAENFRALSTGEKGLGYKGPVLSQNYSRVNVSGLVTSHAIMGTGVASSTHMWGRTFVTD

SEQ ID NO: 967931 - protein, 107 aa, Homo sapiens
MGFANPSEVTRLQLTTTNSHVIICSLRGSTEHRLQTTADFHDRPYCSLWKLKCHDCSMHIGFRGICIVTKMCELRFMLVFFQYLLCEDSKKAKTCEPVVISIIFLCA

SEQ ID NO: 967932 - protein, 72 aa, Homo sapiens
CFTAVAGWSVRERHLGSDWGRALACTSELLCTRFDSMSTCRPEMTLYSGSMHAARLTHWAMEEPMQICSLAV

SEQ ID NO: 967933 - protein, 316 aa, Homo sapiens
MNVGPHCGKHLGVEWNVDIEKDLENNGTLEREKITSGEEQKALPGRAVGVLEKLARKRFIHATWPGMGPSTERRHTRGTLHDLSGGKAARWDTLCAVAAHMIPRGDVLGGGTIRGVGQQHCSLSGKSMWGPTRTGSLDIVWRMALDRHAEECGWQRRSKGPGLSEGAHPLRIASGHTGGGRPRYDESPLTTGYTMTTTALGSLLTAPKKAHEYKSGTLHQCQIGTRTDGCTTCETNTAEDRPERGKMATRIDALPARSGVQRTTAHATTKDAHTTHTRHTDDNAAGQYDTPPAVATRPRGKQREDRSRQQTPRSLD

SEQ ID NO: 967934 - protein, 112 aa, Homo sapiens
MAQQMCIKITRDINRYELRLEGGWDPKLPEVEHALSQGSTNKDRAYIGRMQAKNGQGLMSCSVADGYSKGPRKSPQKAGLKPKSPKGCQLVKLDRLVYIATPPKHWGSCVSV

SEQ ID NO: 967935 - protein, 118 aa, Homo sapiens
IWSSHVQVVAVDSQGPPTSCEMSSTGTTIRGLRPELKGDRPGSHYSKVKPFTTMYTSSTYEHALAVVKAGSVSDGLVLTDCSHRDLECTVSVSVRMNYTIDTLAADVAHEACNLTTLS

SEQ ID NO: 967936 - protein, 387 aa, Homo sapiens
VGLVSLPCEDGGRTLIVVTHCDSDDIVCRVYIATSSSCPPFASYRVTSCPSRTASCDVYMCVYNVAHAGIICTLIIRALWRRHRGVLSNVVEGHGNRHAVLTQAPLHRVSSLAIWCKSSTNPWILHKVDGRFYVGIRPLIGSARTISICETKLGIAGPPIANWGTIDNALDLRGDFVWVRKQSKARAYLRATACVFVAYFAIGQRRPCLGTNIKYPSVFHLSSYDGEDRPDLDITRRNAILPPWTRNTLGKRTQWAKVAESGFIQPPMERPELNLLGVYPIRFTGPGDLVSIAHLTTGAKNPWHSEGFRGHTYRDPKIQALWKHAQLQVIRRPNNGFGYQLSITHTCGLCNPFFDTHTGHGGLTVGGKLIGGQMPFASALIIPTPVM

SEQ ID NO: 967937 - protein, 302 aa, Homo sapiens
ASLSVKGLPSGTRMDARMREIRALTASDCKPRYSEAGIRGCGGSGSHASRRRERWVGRSLFPSSRELCLAGYPRQTLTDDEDGELEFGLYPRDSSEMTVGMSYVNAHDIFRIYVNGKKEVAGGSRPPNPCSSMEASPAKYGWRPRMWICDGLAIGPLLVSEPCYQVARCPGHALRPLCVMRTSRRRTRGLTTRGRRSEGSQFCSPIRSSVCEGASRLKPLVSGKVTKREDFGVGQRMVTLGVHSRKRWTPDRPPSCCHGEEPQPMWAQRVRNSEYLGSNRRESGGGEFPERPVGRELCQVGL

SEQ ID NO: 967938 - protein, 167 aa, Homo sapiens
RIAAAGVLLLMPESDARGRRAREMHYGDRKESHYSEEHLCKGSLSLIVMLFYAGGIMTGPCKANIQAQKLCKNDPEGIKDLIQQHVKLQNTNRRPTKVEQQHKDPIKAFYDQQGLTHARSLSAPIFTTSTINLVENGKEISEKLIQRKWTHRLRNQNLTGGRMRGRR

SEQ ID NO: 967939 - protein, 89 aa, Homo sapiens
MDARHFEQRFHPREDENPHSVVEVVWAVVPLGRNTTILEPRHMRVPTPGRLKALHSVKTGRGLPGCRKQGGFKQGLEITRTGAFNAERR

SEQ ID NO: 967940 - protein, 193 aa, Homo sapiens
MTHYGAARYLFVVKLTYPCMHAQHVGVFLPKGDIITQAGGNSRHSASGKHIPCASCNHACNPMASAEQICLFVIRAGVRLQHHPIPRLRMAILGPYGSFHTRSHGPQGFYRTHVSVHASHARHYTRCYAPLIYHGVSMGTYPCKKRAVSPNKSLCNLLLSQLSFTCYPNLKQAWLPQWHLVLQDSNYERPRWN

SEQ ID NO: 967941 - protein, 376 aa, Homo sapiens
RGKGFISIKAIMKYVSLSTTGEGRKNIEFQHVLFYKCVQEECDNFSKRVKKVAEENGVITEASEDSWMSPRHTLAASSLGFSQKSSLQTLLSLAGGPRIMQEEKGIRWILGMGHFKDALSKMGSISYTQVLANQRSINVNSSKTFRHRKAGRRQRKGTYEQQGPGALATSLVHRIPSPEPKGVHLTVSPPCSSSEAQSTPKLHTSLGSYPACRGGSAYLTKAPQTGRPPLGTNKTVASSHVITSAHAWKHTHTRNGITQTALARTRIGQKARATPQGPLTENSRRTSETKSQKTPKGPWYPHQGTGRTSDNANSKETNQGTEKQRRQRNRDPANSTDETPTATQRQQRTKDTPTTRRTCDERQSAIHWTTANPIMK

SEQ ID NO: 967942 - protein, 100 aa, Homo sapiens
MKTDETAWNPGDDADDPPGHTLENKACKSNPGAKRAGRPHRARSDERNRQRKATGGTRKTYKSLGQRPHCTHTRQTATQHRGDMSKQRQHTDRRHNAVQR

SEQ ID NO: 967943 - protein, 102 aa, Homo sapiens
MLLHTILAHVCATDFAHDKKVRSVALHVHCVNHRIQLYLLDDLEPQVMTMSAWGHRSADPLRRPLRFNVKLPYIKVIKRTKIYARIMYQPHDEQTLVHKIVE

SEQ ID NO: 967944 - protein, 116 aa, Homo sapiens
MVVTEPLCLFLASGSCVDACPAMNERVQTVIVLGHRPDGMYPCQVSVSVTWRRKFFIWDRHTRYYGGRECIYNTIGRFIRQISNTRITTRVNGERKRLECRLVFPNGSLWLMVERA

SEQ ID NO: 967945 - protein, 107 aa, Homo sapiens
GRGRVPSPTRPRMDDALRPGGLVLGGGGRRPLMTPDGAVSGSVRECWFLPIARLLCAYGLLRQAIRPSEPLSLIARTCWGPDKNLTEHGMVFNEIYPVWTNVYTLGC

SEQ ID NO: 967946 - protein, 207 aa, Homo sapiens
ASRAPTTHTHRALGSPLLREPVRATVCRPGHRHPPSAYASTQVPWSFGPSYLQDVAAVPWHSLSRADAPARSYVIYCPALEPYSGVGMLLLRPLGIQVQRGPRTAFQSPVAEQYTLLSAASFMSLNACRMTSSLRASVSRERVTVLSVPKCNYRGEYSVGRTVGAREQTLVPMDRGMISKCKHQHSAQSRYADSERAGKALCQCGGL

SEQ ID NO: 967947 - protein, 103 aa, Homo sapiens
RTHGPRIPGVLHAVTESGLVAVSTSDPEIRPSHMALEREGPPGSGPARRSVEDAPLYCYFLDACHVSCASIRDRTTRSWCASNTSMMYERLVLVPTIGDWHRQ

SEQ ID NO: 967948 - protein, 164 aa, Homo sapiens
IPRLRCRRGWRLLVHPVLAALCPSVGLTGALSVYFYFAAVTIPLISRAVNLSDPSVSTVVEAPGGATCPVSPAETLMGPAAREGLREAHPPRDCPPMDLPSVRPPTPLPGGQAHVNQTCETARGLKNEGKSQRPDRARTERSAPGRRAQRHGGHQTSERGRANS

SEQ ID NO: 967949 - protein, 113 aa, Homo sapiens
MADFDNKETVMNLIKNWDDVEEMVEEEETGEETKSQSTSVNCSDDAKSSDFLQPFKKDLMVWVETPTGYFESLLRVVKRRVIALKNLQVKCAQIEANFYEEVHDLERKYAVLI

SEQ ID NO: 967950 - protein, 243 aa, Homo sapiens
LVAVLGTRVRDALAGGSGAGEPCLAEPQNGWRELGGGQKHGDEFSSLDLQMLLGFVGRSKSGLKHEASFPGPSSWCSLTVALSCSRRSRSCTKERPGAFKSPGGPRRTRSLPHSRTGPWTPDHALHLRPGRRCAQDSAGRPQVIDYPVLYGKYLNVTLGGEGDGLPAKTLKPEVPALVKLPFFNMLDELLKAPKPRGNLVPQNNEKLQESPCIFAFGRQEQVELIRNSRELQSGVKAVQVGPE

SEQ ID NO: 967951 - protein, 187 aa, Homo sapiens
MGHLCHLERDHPLKRDFETIKLIQTMAPMGLYFLGAAPSPPGSRFAMKKIKKQNLILRNQIQQASWTRDILTFGENPFVVSMFCSFDTKAPLVPGDLSPVDGGRLCHSAENYGGPALWPGRASHLRHLCALGITHYGWAVALTEPPYIAGPFVGFVVTVLLFRHCWGLTARSAPWPIARVSYPLALF

SEQ ID NO: 967952 - protein, 196 aa, Homo sapiens
MKNTRKKNDHTDEEKKTTPPITKEGEDRSEGETAITTPTDETNNERTGEEEHNTKNDEDGRQRRDQTQTQQNHRHLERATHTTEKGRKQLDEATTHHITWRCGVAVDNTSTPLPPRNDEAGPERKQEVEANTQTDTKRGNNKDRERGAPPNTKQRLPQREEEEDTHHAHALGSGESNNKKQPPARWRKTTHEQKLL

SEQ ID NO: 967953 - protein, 89 aa, Homo sapiens
MTIIHREGASKIAPNPHELTPEDMEDEMDGMEIPQSPGVEATNNSTVEKKNKPRESRGHHTVINVKPVTEDQQQDPTKAREHKHHRTNE

SEQ ID NO: 967954 - protein, 185 aa, Homo sapiens
MRRSACRQALLVSAAPRARSREPALRHLALSQSTPGPVRPGGAAHGPRSGLLPVCTQTLSRAAGHGGGACEQPRWMGAPGRAECASTPINHPGLAHKLMEPGSCWLQTEGGPSSSITSTSQGNPHIMANPGHGAGAQYPTGPGQARLDRRTICSGHILLHSRVLPVGRGKGAFLRWGHTIRERSL

SEQ ID NO: 967955 - protein, 230 aa, Homo sapiens
MYDEGGGRNIAKIHDETKGSEEDNLPPSKPDEEARIGVPGGDRGTNPPTHMSRDRRHHRTGSKRARVHIQRERPIPSNESRGDRSRVRATLRRPTPPSGVRGPQQPVRTKQRAGGEKAQHGSGENDHPRERETHAGQRHGGEPHHPMGARPPTIGCSTTGATIPAGVKHSHRGTARRGPRADRTEREEREAQRWGSKPRGRRKNQQQIVEEDAGHHSAENNLAQRAWAKP

SEQ ID NO: 967956 - protein, 112 aa, Homo sapiens
MFRGLLHTWTLLFLQLSHIDQVVLGRLAVGLTKVQFDCVLARKSPVAGAYIGDVEPKSSSVAPSGPRVLYGEDLRNILLFLNLIEWQLGEILQAEAQSVSPNDFMYVEAVLN

SEQ ID NO: 967957 - protein, 336 aa, Homo sapiens
CRLNSARKKNGNSQYDGYEQDVVAPTLCGLRLKGGRAARASVKSSYTSSPYRKHIKGSIRVQSTSVWLPGLSAEDRSSCWAIVDCGLEHPSEVQHECIPQAILGNWTSCDQAKSGMGKTAVFVLAPYSKIEPVNGQVTVLVMCHTRELAFQISKEYERFSKYMPSVKVSVFFPDGLSIKTDDRSVEDINCPHVVVGDPERILVLVPEEELRLKNVKHFVLHECEQDADAASHLRADLTEIPPPDTPGTAGMMSSHPEQDIDLLRTVLQNPTAGVGGRRNQINCGMKRIVNKTEQGSLTLKELQGNNTKHGSSTQEKSAPRAPERHITYHQGDKNQI

SEQ ID NO: 967958 - protein, 102 aa, Homo sapiens
DPELLTQRVAHRTGDPQRHGVSGSLSREPGLVLELAEPSPPSSPRPPVMQTAARARPRVCAVSPMVVRLRAMAKHEQILVPRIRPQDLKFKGPFHRCSHYKS

SEQ ID NO: 967959 - protein, 237 aa, Homo sapiens
MAGKSIEYLEQPTDVLGRWGPADMLASTNVSALGGEGGLLEPCSRNTMAISQLMQVIGSQPARRSWDGHGGPVTGPGLAAYWEQWASRSSSSSSSRSQSEGSPRHPPALPPVPAQPLLLQQLAQQRSPSPAPKFRGMEPSTASQPDHKPHPSERPPEHPWPRCTVPSSGPAGCATQSGTVASCADRREIMAPIHTDKRRMSRSAWFPNVPSGESLAARPGINPKYLELAQFQQGLGM

SEQ ID NO: 967960 - protein, 190 aa, Homo sapiens
MWMIAVEPSLWVSSSGGVFQAIKGFRKCPMLEFSATGLRGSATASEDPEPPKNWQVAFAVVRGRPCFHPPIDCGWCGFGARRIACELYHQWTHLTGAVLAARRCPTGPWWAQPMHAGALPAWPSLSAVGILRHSLHSASSSRNCARHSWRTPAAAPTDGTRAQATPAISQYHLREATATMAATFSRSLPR

SEQ ID NO: 967961 - protein, 316 aa, Homo sapiens
NLNLAKAHLTAFRSLWFCGEAASRHPGSLPDFSLPTGPHPSASPGQPPDRTSSAASSRYTRTATRPYHRVMSSAAGAPGSLYPCWTNSLRARNPIISNTMVKRKEMREHTEANPQARSFLSQTVPLDVWMSPKASRHCRVVPPLVHRPPELSTSKGACYQLSLCPGVRSAGQSGLFASRCKVHCRSIAIPSIRLRWTRRPGNQRLRGATFPVRNHLTGVQPTVGTDQPRNPAEGEPDYSPVQKDTRGTPVPSNVHEFIGLGAIPDPRVLAQEGRRPMGHDRGSQDGNCKGARPNARLKPSSGPDLGNEDPVPAKRK

SEQ ID NO: 967962 - protein, 276 aa, Homo sapiens
EDESAKVKTMIVAGVCVPARIGLMVTKCRTYWTAQNITPMDFYNPLLASVSESEEMGASLYVRLGRLRACLLLVPGGCFAAKLSTPQQTKPYSAKYSAVPLCCCQQLRVRCHGSTLFLSACSSLDSAQRKACDPRRALPRSHWHAVGTRRTGQRLSQAGRQKLEPSLAHSDKFPRPLLLARTRVHPPLDIGEGRDSDQVWEAEMGRLGFLRGQRWLTPDFGICLNRCWTLSPLPFTHYCLLEFLWCGRLEYLGRAWPPNRPRNGELPTLAEPPTRQ

SEQ ID NO: 967963 - protein, 141 aa, Homo sapiens
AVRSIEKLDQRRYHDAESICTNDAVSDEVQYQGSTTIRSILKVYTTACAKAADFLDLTEQEFRIHAFLFQTQDEEPRCGTSGISALDGEFQYSSEVDFYIDKDMIHIADTKVARLHGDLFIRQIHKFEELNRTLKKMGQRP

SEQ ID NO: 967964 - protein, 100 aa, Homo sapiens
PRPELCQHFPQVTVAVVQAHFSTTHHVQTEEAVIGHADLSEEMQKDSVEMLLLQERWEHTNHRERHAAQYQNDTHFDYMNVTSPHPGHCIVAARNFGQVM

SEQ ID NO: 967965 - protein, 84 aa, Homo sapiens
SPRVIESGASGTQVWRRGSEQPFRCRSGSTETGQTNGFTEAYADTCSTVGLAAREGELFHVLRKLLTKGRSVDVADNRWMDANS

SEQ ID NO: 967966 - protein, 401 aa, Homo sapiens
MGLYSTICARTHECETPHVPGPHHTHTRKEKLHIKTARTHVGEHAAHRKKKNNSPRREGGRPTRDVKSARDNQPPAGLSSVVENTTRVGGPPPHKKYMSGATSGKINNIPRQRGSRTEGRPAAGVIKNTRGRKITGVKPTAGQWLSGGEHHYVLSSKGDTPMHHSWGGGGRPPTRFENQQHTTPTTGGTNKHAYNEGKTNNIKAFHTRVLKTRGGSHPHTAAEKIRIRRAASEQIYMETNTGRYTMRKQHTYNPRRGTGTRQHNETNTEARKTKQNTNSRAQAQTGTYTTRRTTKRRTKRADGRHTELDTEKPAREKITRRRESKQINKAQLTKPTQTNKHKKRDKTNNQKKRQTTQQKEAGANQQHTATPTTKTIHDMKQQHEHNIENHEDRDKAAIHTI

SEQ ID NO: 967967 - protein, 88 aa, Homo sapiens
GWTALQASAGGGKMEVTGVSAPTVSYISSPSEPFRSEKRYRPEAQPSVRFKCNVELLVGSPVPAWNVELFGVDDKVLQQAWIKRMRSW

SEQ ID NO: 967968 - protein, 326 aa, Homo sapiens
MRTFYMETKKNTRSKMVSASIHEDKYIHVAKIIKPVLTQESATYIAEEYSRLRSQDSMSSDTARTSPVTARTLETLIRLGTDHAKGPHEQRLWTCRMQRKLWSRSSMLTLRQVLEKEKKRKKRSEDAIRDRQPAEEKRREDQEPASGTSREELASPEWPHMGNTYDPQGLQSTKRQEIASKVQTSQSREESQEDKDPGRGHRLHHGGRDYEAGPHGMDTGTGKWQQHGEKADEETKTGKGNKPIPRSGTRESERTGKNETREKGEINKRTAHRERQTKKSVTTKQKRDTTNNNTATMNDSIGDDLYHRERRTNMHTYFIIYSTALE

SEQ ID NO: 967969 - protein, 145 aa, Homo sapiens
VSIDLVQRCATTDTTLEPEGASLRNCIKLCSSIGRSVRDSRSRKLREEHVATRIERARYSSSNKMATPRMLRDTEFYRCVYVDELRVLTVNSECVTPKDHDEFRVSDPSGLTPEEYYATTEMYVERATRTYDSSVYMSDYEVSSV

SEQ ID NO: 967970 - protein, 98 aa, Homo sapiens
FFFNLKRFKEGNLGYRDPHKEEPPWLWGAQTTCGPTQKSAKTKKRAQEALKCLTVWAGFTSLNFSMNKPEGKVRVTPQHPQVALSFQVGVCREYQRVF

SEQ ID NO: 967971 - protein, 221 aa, Homo sapiens
MCAYQSPRGEVNLLHHAGWLYGGRHENSFLFKENHYPARLKKPPRRSSTLVVLSPPQRKVGGVRPPRRSTQTRGGTFSPLYREEKPPTSRGGLKYYLTPRGGGNNKLRTEGNLYTSAQEEITPPLGTEPSHEGGNIIETRRVHLSLRTPKHAAGQEKPLIKWRVGETIRGGYQKGLSRGRNSAPREGGEQSYTPLPPTEPLVGRAGKPNNNTEKTRARSST

SEQ ID NO: 967972 - protein, 311 aa, Homo sapiens
GKMTKGIPLLESVQKNPHFGPPWGSRAYPSSKVPWGKWWAHPWPRPQRSNVITGSWPRAKHTRNTTGEQCHNERRTIKMVYRKIQRMGSRGRRHNTLNPKKGTLVRRIPDLILEKSDPPESSAVPTQSARVGCNKTITTTQTKTNKQRKTNKTQHNKRNHHHRQPHNTTNAYCTNQQRRRADGATNNHHLPTNDATDTNNRTTHHPTLDLAETLSHAPTHTQTPPPTIQHDAPPRGALMTQQHAARRTKHPTPRPPVRVISRTTNTHARVAGPPNTEAHPHHQQTTRHHALTTKHPHRATRADTTTPQGAP

SEQ ID NO: 967973 - protein, 364 aa, Homo sapiens
MLLSSAAAARPSIGLAGRRDHAVYFKETAFWIGARVDFPPGLELHNHTRHDFSGHNFVLTFPAQLLRLTRETRIQGFADTRQALPRILTASARPSFSQPSSRTPTGPRRLAGSQLSTAAHPLAATQPLAHCCAGRPYCCNGLVFHTLPSLGTHAPAPLATANDLPRHYDTTSISYLASPRHIPSWDPLANPPRQPGSTWLHLPFYTYTHNVAPTPKPRCPVHFNQPHADTPFPALRPAPAPGTSPRPLQPHRNHPGSNPTHPLHPLGLRPRPTQRQTRPQPTHPSKFANTRFRTSSNSLASHKQRAAATARTLCQSASPVGSCSPPQCAPRQAQHPAHPFWGCANPSLARSGLPRDRSQNPSHS

SEQ ID NO: 967974 - protein, 413 aa, Homo sapiens
NNYPKKPKWDKEKTHTQHCRSLDTLHSGKSTTTGHLIYKLRVASTKEPLEQQFDEGRLLTMGKGSFNDMPGLLRLNLNSYALNAGYHHLTIYLAGKFADHSNVLLLTTHLTAPGHQSTFLNTHHCTYTRTLLTACTCWLSLDSALHRLRARCNLLTQPSVLFQTTLRAAPRRATDPLSCASTSTPARCRTTNPTLRSACLHTTTIGTIPTRAHTQYQSTQTHALLDAQHHCASTGQRVHATFIPPLHATHHRAHHNPPDPTSPPPSGSTNLPLRPRTHCGRNPHPHRPRRSPKKHSLQHTTTTREHHTADPARTRRTPRPTPTTAPPSAPTVPPPTRPSPLQPPPATPSPFPKPNSKSFPSPTSAPHAAHLDTHCPSSHTFSSTTNSTRTPQPNPRPPRTRPQHTQQTPPPSP

SEQ ID NO: 967975 - protein, 144 aa, Homo sapiens
ILQLASHQYETRPSPLNIIETRPPLQPLSVCVGRCWLGPGALQSDLCQDWFHGRCVSVPRLPLARPQAQVPTSSPLLGLAGKWEQSVSCVSLSARLEHPGLWSLQNCCALPGEPRAQERAHCRRPEPGSECDVFGGADSASTVN

SEQ ID NO: 967976 - protein, 151 aa, Homo sapiens
GGPSCFNKKNPSKNCENPPPGGGARVNLRGYGKNFPKPPSWGGRPIKPGDWGGKRRPEGVPTQRSSKHCANFVNMCSIQLLVLAKDHENDRYVGRIRMCVPPQSCSYREANMWHPFFLRQTSYCDGRRLFLHHFSRAGTSLEKNRHLTTRS

SEQ ID NO: 967977 - protein, 261 aa, Homo sapiens
PFIRIERLPRCRPVSRGRPALYDLGMWLLQLQKKQRTLLGHGSQEQVKGKTHDLLSGADCMHRALAPQSSSSQQHLQNQKLCTFLAQPCMHSRALYAIPGLDYVRHEDTYPYTSTDQVPIQHELFDRFLLYDQTTAPPFGGSGRRYGPGKRRITPGLELSDVHRETTENIRVNVTSHFYMGMREDQNYHVYWWRYCIRTENLDSAVVQLRKQALEAPPDSLAPWRQCEGQGGRWPGQPRISNEPPAIQSKHTVRMQLQWPL

SEQ ID NO: 967978 - protein, 351 aa, Homo sapiens
EQKKKRTFRKFTIPTDVDLDQLLDMSYEQPDADCTDARQRRRLNRGPAAGSSTPCLKRLRKAHDRGASHGRSRTVRSQTHLPATIIILPEHGGPPWWRALHTAHTTYQPRLARSSPSMIGPLPCAPHFSHSTYQAPLPAMARTRAIGGPPQLPTRIYNPVLKLTLASRAKLTQRATTAHPDTPPAHHRPSHTPAAAHASHNTNTAASEAARVLRGESAYNTAVPWAMPNTKRSAKRDESYQQTDYRAHATPPRARATRLHCAAQPATIDDRRPARNKRDWDAQHNQEITTNKKDSDAVGRTIVGQNAELTGRNYREQAEKPPLMRVCLLDGTNETSAHLLATASVLSTTSP

SEQ ID NO: 967979 - protein, 152 aa, Homo sapiens
MSEVDAHTQICAHKHIIYTCYNVNMRYKRRRRVCTAHYPILTPPAVLHNMSALYTYTRHTHLPKKNNRRSVVGSKNQHTTPRRQTRRVPRCRSPHIAHKNAATLRAPTADPTPKEPAPPPPTKTSLLNSHGQEHGRRKVGVSQIQKGSNKNE

SEQ ID NO: 967980 - protein, 154 aa, Homo sapiens
MPQTVVRALPAGSDAYSTSRWYRPYCQACEASCIRYTVIEGRYAHQLFILLPSKQNKLGASRKGSCMQSSTNPARQPNSGIAIYNIESLIVHSASIQQYKQPTNSTINQPQQQQDYIIPTPPHRDPASNIAYALATTWFRFHTQHNPHRKLRYY

SEQ ID NO: 967981 - protein, 285 aa, Homo sapiens
MVVIGHVDSRQVHHILAICIYNMRCASDQHEPLKHFEQGGCLRLGKGLLHSMPGLLDYTEILTVNVGIIHLTISFGGEFDDQYKVPMLTYQLIASSDTRDFYEEHDLQRHTLTGLHCCMLAESACLPALLRLTLLAQPVLIIPTQLAHAPRAALPHSWRYDTWRCWTTTYTVLSGAFTHTMGLRTVTRTPLAGPEQDDLLARNMCSTGQRLTAAYSHLTRKQLAPHQNPRRKQTKDNANLMVAPQPQSVGARSNIALNPTNLALQNPPQGCINTHIPFGDLQPRE

SEQ ID NO: 967982 - protein, 477 aa, Homo sapiens
QTKLLFWKNWAVQYLKKNVTLKEAILQLSFRLSGAVHCVVYGARCCHGVLQWWWELRGRGRCGAIHGAGLSGRTPRRCGRGDATWGILEKIPWTRGRGTVVPRPSVDIPPKRGNVPHECGETGGPNVSRREENSWTNATWERVGAPPFGPFPRVGGENVEDTSEVVPFLGNHSTRGTQRRGRKRRLGGECSQSEVEHEGSKTHNLGTKLGGWAHASGEHRGEESKTRGQKSAGGVGTTPGQPGEAPKASPQKAEPGNPSIEGSEKREQHRSKSNESTHFDPVTSCGARDTERGRKRPRWKGDATPRHTRDDEPHTNCASWRHQGKQVAQMGTEPKEKPFREQQHKGALTTEAHNGLVVGPHGDRKAGYTANGSPGRQEDKSGAHHRGPPGRVNLSARQQRSKKPHAVGPRSSGCHPGGIAKKKVGHREHHGNRVRKRRPQRIDTPGKRAAHTSLKRDTNGYPGEATKQAVANTREQE

SEQ ID NO: 967983 - protein, 423 aa, Homo sapiens
TTSDSCLTHLHQPHQLSINLAMDHPLMRRDAVIIGISRLRLKSALAHVHYQQRHTYSPIIPILDYYRNHQTYVSSTKLALAVRHKPLTLLQDHHTHATKLGSANPSNYQTTYTVPSTLIIFTSSNSSLTHPKKSHVAVNPKPYVVHTFSSSLYLHRQQHTQTQHANKTQTTHTKKRQHRTKIPTRHPVNRETQKHGNKVTTNKKQKTRTRHQDNHTTTHQDHRNNMAPPEKQPLQQRAGPTTEPPHADHHRAHTGTHHTTSRPQASPQPKTNEHAPPHDRPQRTTRSTHSPTGAEQHRAHTPKPHPHRPQTNGTQLDHQNHTADQTTPHTGTDSLETRRPREPERNDETDEKPKKGRTDTKILAESRTRQNRRDKRARDEKQQRREQEGKGTTKQEKAERNNAKNQKKRQKRKTKQQARQRKT

SEQ ID NO: 967984 - protein, 246 aa, Homo sapiens
MRWPTPAGGGAYRRGAAGARINVAPRRGPAALRGAGAAAGAMQYPAPRSQAVLGSRGGLPLYCAHSQLLQTARPRSATFTIEGTLLWPAVGHAAQPKGNEPYRDIDTEQTKNQSLSNKNSVIHRITGKAHEIVTKNQQPRKSTTKRAYIDETKSRHKTRGQGRGVEKQRNPRGKHSEAARHNEKTTAYPTREKDSCESRKHTPTKPPPPRNSQYSTERHGSEDSREPTITTGKTQHYAYEPADDAT

SEQ ID NO: 967985 - protein, 142 aa, Homo sapiens
KYGAVMAMYVLAMSLAELQSRWQREHPVPPKNRSALFRLRPLEELAVRGCGFSVNLGPIGVLREELVRNDLRSYCKERKSQVPVSHHGITRSLTRILAGLISHSEVPSALVYPMLTLVGGCHRPCCEPLRLDLGMCSTLGLA

SEQ ID NO: 967986 - protein, 146 aa, Homo sapiens
MTEHHWLECTGGNTSFYSLLKQQYIEQSHGRKFIITGLIAVQSAHRAATRGFTSLWLALALAELQWFVAYYSRQANTSLDLYPDTKDALSICVIAGNCTGSLLHKHRLRGWGLVAFWGLGVGTSESTSGSQHPETCPHHTTDQGPT

SEQ ID NO: 967987 - protein, 71 aa, Homo sapiens
ANQFAACQRALSPSPQESAGSSLPTILEYDLMTSIPRILRECTTSSLSKPACAQLILRLGILGPSTLLANK

SEQ ID NO: 967988 - protein, 40 aa, Homo sapiens
MAEKDDVNTNNYVWYQTPRLDSVPKNAPTNYDMALETRDH

SEQ ID NO: 967989 - protein, 196 aa, Homo sapiens
LKADCDSPYPHKGILTPLRAALEDSGPEAVPGGPRCFPPAKLCLMESMSSRPGEAALHRGDRLCHDWLLLFRTWTECTKLVASRRGFVLATWGVNELPCSSLTRVLGDAVASGCIDWRRRPVKSMFILGDNSTYGSCCVDVLGAEARLELRLSDHFGPCLVNALSALLRLSVGFVLRSRSVALGALCHGLWGPAYP

SEQ ID NO: 967990 - protein, 165 aa, Homo sapiens
MGNRSFPFQLFGKELPVSVGLSPRIHPQYTKVDRSLAHDGHNLSKRQGKGSLTPTGWKTTLVHQIGNVWTSFANEQNGGTQFTSSSRGTKQLPLGSLETFFPCAKRGVGNLKIFGPPLWWAQEAGFLRTQHRHRTGGNEGFTLCPHIAHSHSERPLRHFWEPPNR

SEQ ID NO: 967991 - protein, 82 aa, Homo sapiens
VTASHSLPSVHLFTVTSRDCPKGPPTAVSYSPQSAHPVRRSDRSSLLSTSAIDRSSESSSAWCAIDYHLMDVRVRVNDSARE

SEQ ID NO: 967992 - protein, 354 aa, Homo sapiens
MANNSISCRVCAIRFHDSMCSFTDVSQEKLEAFVWTGESTSVVLAWTPFQFLSLQRVLTPGFPHFSVLHPISSPPIITHALVRISRGWPPLLLAFGCFGIHFVVCKLETNCCFAARSPSRVFGLPDRIVTPLLKFSFSNSGGIMGSRKGSSTACLPFASWGIVLPGCGTPPLFPGGFEGGLPSGTWAIFRLSQSPYLAGCQHFGVLFGRPFVRRFCSFFSRRERWFSSHTQVLLLGVPSPGGAPMLIPLAVWAGGVGARMGVVPPQALLFFVVCPPRSCCPPGQHAFPTAAAGNAVVVECPHGTGFGVWRRHPPWAQPHLLVATLRHTACLLSTPVCRSAGRTPPSCSCHASPL

SEQ ID NO: 967993 - protein, 216 aa, Homo sapiens
MAKTEALQYNLPPRERMDLVCPGTRERDACVEDRWCGQWSVECHWYTLLGGFVGLHLDGSFCPLTPGIVRPDTMLVVEQFDRGTVLQRIVGGGHSLEGWHGGSGFVPRRPGPKPRAGKGQGAFPTGGTLGGDPTVRIMKFTGGIAAGRQMSSPKYGAHTREWGEPLGATMSGPRVISKNGKWGGVHGGSESHRASRNGDREPPMTEGENAGEDARK

SEQ ID NO: 967994 - protein, 244 aa, Homo sapiens
VLYELAQYASEPSEQELLRKMASSSGEGKELYLSWVVEARRHILCHPAGLPVPAVPPPIDHLCELLPRLLGPLTYSIALILQGLTPNSVHDLCRWIVEYETKASAASTRAWTDQLDCGPMEPVGENGGRAGCVSHCSCRIGPRFRLPFKATHACHHGGPRHRGWHPSVGFIQERAMAADQQGQGGGGDSCCTTAVRRSDEDYLYREELGAVPQGTVRSPSSVAFSREQSTGSTSSTVKQDREHR

SEQ ID NO: 967995 - protein, 92 aa, Homo sapiens
MDTLLSCDLLLIVYASRPPFVGSIQKLQFGVQKVRALSSDAEVVSVQGPYPGISSSYVERGPDLMVMQSSVEPHLSVSMSPGLFSSSQFCWA

SEQ ID NO: 967996 - protein, 289 aa, Homo sapiens
CCGAAGCGLCCVAAVWLGRALCAGWKTNSVSSDGPAGQYGHPVRILQTLVGLSSAMDCIWFSDRKYPPRHKEETPCNYDYRAAQEEACMGISSLHNMEFHGSEYHRECFCDIGCTGPCTQKLRGVRYRVSLYLPKCPRRIALCKYSLRSTQAWVVMTAKTACPDRWEEFHVAAPMHEKRALKLIDSQGSILGYQGMTITGIETWLVPTRRWNEFAHESGASKRPFLGMASCEMTTVWSAHVSRDESSPCPCFCECWGLSYVTGVFNWLVGPEVEGFYFRRLGQGPGGAL

SEQ ID NO: 967997 - protein, 226 aa, Homo sapiens
MWLIEQNYHFGAYCPGHVGGAPAVWAKCEPTSPLVQSYANHRSSAESCRVNPLKLSSRKSGSVVPGNLGRTFRFYTRDRECSRKARLLVWRENTSECEIEGSGSIGFRAPLKWALVVSLLRKKGGGVFLEKLFHKGPEEPSSRVPANPPRNALLKVPGGQFSGTHGNRVPGGPGLGEKEPDGTWTRLVQGVPPGGNKVGDPQGEGIARGGFHTVPEKKESAKPEWK

SEQ ID NO: 967998 - protein, 249 aa, Homo sapiens
MGTRERRMMWFAIELSYLMNTIRVGHSILYAQHCVWETLGCTAKVTALSTAVVALQYSAHCVLNASWETCKTGPFSREPVDGLVDTLGEVDKEPLGLEQLGHAKTLDLHEVKPICAVLEYHCVPKVVSPRGGSGVVRGRTSIIAIVREANRVVHVRALGGQGPTLGLGILEYLRKQEYHWGIRAAFGSEDNTQFNKRVRRLDVGILPLLNRHTGEFDIGIRAKCGPRIPFCPVIARRESILPKGIIGRL

SEQ ID NO: 967999 - protein, 117 aa, Homo sapiens
ANTNRTWSGDRYLDCQCAILLGEISDFDCELLIEGVTTQYHSVVKAISIVHGRRNLLTRDLIERVVPRASCSVFPGKWHGRLPVGVRVASTCLCVLPCQRIRVCAHCGCYLLHMSPL

SEQ ID NO: 968000 - protein, 56 aa, Homo sapiens
SARGLHTTVVPWYGAAVHRGHVSGGLFVTGLRALSVSVAPHRVGAGHSVLCAALVH

SEQ ID NO: 968001 - protein, 135 aa, Homo sapiens
MAKTRVNLVVRTIARFGNLAFEPNGSFEVAYVESYYWGIYEKNTINLVQLTNDRDHVGRSITVGPYVSVQVAHLWLCMKPKRIEKAGETLYVQGDYSRDKRTYLYTNAARRQPHNTPSGVRVNVDAPIVERAQSS

SEQ ID NO: 968002 - protein, 638 aa, Homo sapiens
YRVIYDEEKLEDDSVLRLCRETTSAIAVVIELRDTGSIQMHAFETCEQCTMKVPCHFLAAGTISSHPRLNARMQQRIIDTMEKVPPLMNDRDVLDVHRRVTGNDPGVRELIRNECPQWRWNLTHGTEESLLLTIHRSVPLFIGVQVDTYRYPEKRKRAKRAGNRYEVTESPVVGSRWVHTVSMGYNDWPKSKYQNPELLSPYSKSRVQWIYHNCKMELERAERNIRGFPYVRSPPVVSQCRERTKPIGGTSMKGKEAFSEKLKNENLSCKIPKWLTRYLLGQVLSRYTGVQYALCQDPGLIAGPPKGDRALLRGNVAQRLVCKTLISVHTCVVITPTVNLPCTNHVGRLRHTLWVAPHLGTPVQCANPDTPLRHVGGPKVRHWEHRWCMAQQTDTVIRLAERSPLGDANSVVYRYENATNQEPRVLNKVRRGERLVTQYHGRTSPTEYAPSTFHKTQYEFTGAIITTPTPVSRVANKRPRGYCETHILAYKDRQNIGGNKEAILTKHPYMMVVGEHNVELVSIQATRLHESDGDGEGRSSTPAEMCVMSCQRIGEAELVLEARSRSKECRLATCAPRAADCHSVKMIQRHSSGVCRSTERGMASSQSNEDINCLIAQTEAAPIPAVLDAAVTRRTTEV

SEQ ID NO: 968003 - protein, 108 aa, Homo sapiens
MTPGFRRCIDIYAKSGTKSLSRQDPRTTITPIGFFMRLPATNLALWQARDAWLIRHEILISSHLIKHVKRIYTSACEQYIGVLHVMNYDIEDRTVNTETEQAKVLQNG

SEQ ID NO: 968004 - protein, 139 aa, Homo sapiens
MGLESLVVLVRVDSHMRGSTSGAQYDSYLFDPCWNIESYTGKCDVSWRKLAGSACSHAWGRRESYMSVFECLSVGLIPIDLIRARRQSEQCRLDSFRVVPLEGSWCRLAFCVPSQSRYLPRSASIVLSIRECCMLAMTG

SEQ ID NO: 968005 - protein, 67 aa, Homo sapiens
MYHKQSRRGDTALAHDDLIVKRAPYLAQRHNRDRKPLSKNNRGKKNIQRDVYKAHSYDQVRYNNAGH

SEQ ID NO: 968006 - protein, 170 aa, Homo sapiens
MSNAIQLPSSLLCSRNTTTLIVRMTEHDRSLTVATLQGCTNGWCNPDTLLPPLVPGALSSPPLEIRPYIMWKLTRDETKYGIPRSSALLRVHSHLCYWMCVISSDGQLGLSGSWDGTLRLLVICINGVTTNDVDLVSVHYQRMLLIVRTCSSDKPVMICLWIYEIKTSQS

SEQ ID NO: 968007 - protein, 145 aa, Homo sapiens
RTRFFNRERPAIVEEEETKTYKDLGVKDVCVEASEQWDGQNPPRYRWSYSLALQGRDIMGLQETGSGKTGRLCLTILNSTDGRTPQQLSKPVSIYHHRTREDWTHTEHFNSQNRRPQGESLIKTGRTPADARKHTRKRSDNQTTK

SEQ ID NO: 968008 - protein, 266 aa, Homo sapiens
MCTRPFNWSVLSRKENRCAIRQGAGRRCVVLEVSAWLSVPHSRGLLVLRMITLGHRQTKRDPSSKMHCGAEAEAPGVSMDFVLVSPCQLKRAGVRAPGTVRLRTACYPCLGHALLLVNQGGVSTLYCVDHEPAVKEYFPVQVVQLHGLLGIYQELLGLAFHHEEGASAWHEDVRLYTARDAASGEVVGKFYLDCPAGKESTVHAAVWPAAGCLRQDGAAKIASRHGGNFTKAKRAPRVQHDEVRLLPGFGHVIAQVLPRDWHVRGP

SEQ ID NO: 968009 - protein, 176 aa, Homo sapiens
RIPLMLNDSGSVTVPCPSICRQFSLEHVHGSGPYSAPSPAYSSLQPLRRLMLWQLCDPIISDITELAPCQPPMGSPGGSIDERPLSSSPLGACQGGAPQPRFRDSPGKGGESRGPIFRGTPICVPEPASCELHPCGRVNLSPRPPVRALTGRQGGQQRDTGGARGPRTSPQRFQTS

SEQ ID NO: 968010 - protein, 251 aa, Homo sapiens
MKLLKRVAAPKHWMLDNNLIRVCLITTSIQRSPQVERVSPPHHSPEEPDVEYALRGRLKVGKSLHACGFINNSMAMVRRREYNAYPVLPSTGVSSAFDEGRERIFRLTLVTPRVRFAVTIVLHLREAKVQVCAKVRTQIYMWRHEEREYPSSGDLMMSRTMAVPRCPSFKVNDTIQIDEETGKITDFIKFDTGKPVSGDVAVLNLEDIAVITNRQQAPWIFDVLHVQDAMDNSFATRLSNIRLLGKGNQTM

SEQ ID NO: 968011 - protein, 218 aa, Homo sapiens
RVRRMATDASSSSLEKSYELPMAQVTHHWASERYPAVRQATDIQTSTYPWAMVSLCETSSEHHPFKRPLYESVDVEQSATDLYANDGAVGRNHHVSGALLTGCRRRSPPWRPATMKINDHRSPQRRKYSVWLGWTPSWTSLSTFQQMWISKQEYDESGPSIVPPLNAIYRRTQQAEAFADMGTSGRIDNLPRGKVHTPHASLTKTGLSLRKEIVLEAS

SEQ ID NO: 968012 - protein, 384 aa, Homo sapiens
QGCCGREHQPGTYTRGDGRSPHPGPPVMADGSLDRGRRRWVLIPRVSAGEEVVNRVWDKLSPVHERIYCALSGSAADAQAVADMAAYQLELHGIDLAEAPLVSGCCKLWPRKYSAYNIIERTCLHILMVRWAGTNVKRRVRYTGTLGRELLTRQPLAIGWLGKHLYLWLTVDAAYKPGHVSRGVHALSPTDAIGSGHEPGWLKLGVSSNWLTITSCRLWHHRVILLPMNLPQSTDAVNRTPGIPRAYWEIKLSQRPYKQSATTAATNRPRHRSRARPKRGPRHTAHPRAGTNTSQHPLARPRPPDGPSQRQHRAQHTPQAGAQTAEPTARDHPPVGGASTAPSDRPAAPHTQPLTRTARAEPQTTTTPRTTSPGAATRPRPPTR

SEQ ID NO: 968013 - protein, 73 aa, Homo sapiens
ILEVVPSPCSASRFSCFYMPEQFKVVAEAFEDDLGGHCIERAGPANVSTIMFLTKKYKNTLCAVRIAVYAPHV

SEQ ID NO: 968014 - protein, 82 aa, Homo sapiens
MNDDYEYLRSTTSGTCGIHLKPSLETNEDSTSLRDSILSLFCERTLQSAYPRESIYEIALSTPYRCEHMLASILKTGGTPLV

SEQ ID NO: 968015 - protein, 139 aa, Homo sapiens
MGKKPGVYIPQDLTAFCSQFPLRKPLGALYTGSNFAGGENSPNFTLTLTTTRGTPGEGTPRGTQDRQGYLRAKAPRNTPRGVHTWRTAQNWVQIESVPLEQHPGQFHKDEQQALKRTALPKRGEVVPKKTQGVVPQRPD

SEQ ID NO: 968016 - protein, 179 aa, Homo sapiens
MTLSSGHRRLIGSFHEHITNRTSPAIPGQSRIHTQTDSTSSTHADRTDTGVDRPRIGRPYQTPYIYHISFYEAYQDRQDLQRLPRRSMRQHILNYPHWSIHSHAAACPPSEVPTGSHVNVQPMKSGPDHRRHAGDSEPPKRATIDPTELSRLEKSISHANHYRTPTLCTTVICTKNPPY

SEQ ID NO: 968017 - protein, 253 aa, Homo sapiens
MSRSVHGTILGVTKGSIHKLRSPGRRAHWYLQAYVTAGHRGPCTLTATTRTQTAYLTRAWERMRKVASEAHSMRPPYRQLAADPCEQTATIDHMPVGLCSNQGRLVATCYCLFRCPTPQVTDPWGQYFDMTDSRHWYQKLNRSLGLSDSTFSTITDQGATPNIHKTAIHWLVTPLMPKVGFQDFWPLPRFLIYTLRLDTTVLHYEESYKLPPTWFLPPPLHNNACGIPNLLSSLQPYTVKNELNTASGQARAH

SEQ ID NO: 968018 - protein, 241 aa, Homo sapiens
MQQATRLTYKHRTNRFVRMRNRNCDHTHHHSLQFSTNLYLIISMTITLGSAPPHNRQPNHGRRGWYAPSTAAAAPARDRLRATRAAPAPPPNSTRRVPTHVHARPARQRTPHATSTNPTISHPTPTRRARPRTPVRLLALPVRRPHRQPSLGCVWLSLPPPPGGGGLACLRGRLVRRLPGSAPPPLTRVRPPPPQRALRVVAPPRRGAAALLLGGSSGRSVPARAPSRPSLTDSPPSHDVS

SEQ ID NO: 968019 - protein, 363 aa, Homo sapiens
MKERGCAFVLVVRIGDFLLIVTPRVSNPHVQTRAFIYSSSIQKTPFRTIGLGPLFLSPYITLRPDSARCGLQNRIVRKCFIPTSKSHNFILLPNNFHNNRKTIYKTKNSKEQHKKNSKSNHNHTYPQHNEKEQGHNKKNKKQRRNPQHNGNNEKQRTQKEEHMKKDQEKNDHSTTGSNSNKQKQQEARETKRHSKTRDKRDNTERGHTATQNKKDTRNGRAPTTDPTHEQHKGGKTKTDDTPAAERTTHTTGEREQSNRNTTTNRKKRGGNTKMDQHEHKRKSRKREQQHKRSKETRKEEENQRKNNKKTKRQTDKTPTTKRRRQLETGAATREDKDKTTTNQQAGGPDHNTTESRIQRHEAT

SEQ ID NO: 968020 - protein, 91 aa, Homo sapiens
VVLLGCWASVSAQTDASPAGDTEGLNSTEVALATFVNFARRTRPPGISQVSSGPPLAPHRSYHPVHRYSWADSQVLYSKSKCIYFIEVLSR

SEQ ID NO: 968021 - protein, 301 aa, Homo sapiens
RVNYDEENWRKIQTHLSEQTTSADPVFSQIGHRIFNDAFNLVLCPEGSLSLLALNRHPSSCIEEMTDTDPWEVRPDAAMSILHELSLFDLLRASHGPTEEPTCKNAGHYPVFSCFSNISSQCNAGSAAFPVRRPELAPVHADALSANHATSLALNRAFREVLERRCVVLALCQGKMDCDEAPIVHIPRSQPRPWRFQLVLLADAYSPQGLGQRAQWRLSALGSQFPEIAYTWSHEGLTKASGQPLLAVKRVRWIPCNRCTLEGLHPCGTPGTLNSRGKPGERRKPFFNPISIPGLLPKNKQ

SEQ ID NO: 968022 - protein, 223 aa, Homo sapiens
ARAWCFLSGRDHTGVTAETGQARHMLGLCWCIIPCHWVNSLPTYRRDEGCLPWALRALMRFVVCAGSPFHRGAGWLCARGMCGARGEWCMPLPVQVVACRPWLIPPTLLEPWHYWEGLSARGCIAIGVSATVQRGGAILNNDRREAGAIQSSNPAVANKSRTGEALMWPPWLVSELQPTSLSSHVHLVRWRMSARISPTPPSNSVEVQVNVMSENILTGAQKG

SEQ ID NO: 968023 - protein, 510 aa, Homo sapiens
MSFVFLVWSLGLCDCRCACVWFRCWSCSLSSLYVSSVMSRFCLLFVFLCSFTAVRWFVCWSPVVCVVSFRRITWWSLVCLCARLCLWLCSALCSVVLCFVGSLLFISPFFVVPAFCVLLFCLLLALCLFVSCVFSCPGRHVFLMCRSLCLLFVCAVASTLCVFLVLCSCVGAVLRAALFPAVWCLPFACAYVLGALSLRLVSSTLVHLVLSLRDTFFSASLSGTFWYVLCTLQSSALVSSVCASPVSLLVYFVRYVLAAVCVCCRCVAASPASCGHVADASAYRSCTRFRSFGSLASAFRPLWGCAAGLAAFVSRVGTCRDVSVVVPRVARPLSASVRARCSYWSVHVLASFRCVCAASSQCFSSVFADTVVSLSCLSCRAIMVLASVVRPYVYFLWSFSGCVSARLAPPVCLASSLLRFLGRSVARSAGGARAARGGRLKDVRSLIGVCRPGRLRYSSRALVASCLLSVPCLSPTAVSLSCSVAPSCRCGVYCLAFSVRRRCLLFCCCA

SEQ ID NO: 968024 - protein, 363 aa, Homo sapiens
SRGVYYRNILKPQAEKSVPIQVWMWGVEIPPSELHSISEGPSVPWHVSFFFPLFTLRPCENTPPSVSREKNPKEKAFPPVCGRGFPSRERVRVFYRRQETRSWSLSEQDSQPPTPNFNVVDLVVRQPASQCGLCTSAFFSGVSSKENTSGDTRGAHRVTDVLTWAVGAHTRHLTVPLQHSGDTRNFQGGPLHSLEIVKVEIRDTEGPLRHAGEPRPSGAAQHRDGGDFYISRLTSLGAALVTQGPSDWGALGRDLPRLITFTGTFRKHLLDKTADKNRGNSQVNRIYPGKRKSDVTFKINQKRGNRHLLQEARKLTKLTEGPSGTHQAPMGHISYKAEEVKPQECAYNEAYENPRNIPSHPGY

SEQ ID NO: 968025 - protein, 95 aa, Homo sapiens
DVDQPSLLAKQTFMTIARYQRCGTPGKLLNKELPLVLQVGDVPIVCFESSAFRQTAGRLTGTRTGELAREQPQSENCSMRESSSVTEIREIDMQL

SEQ ID NO: 968026 - protein, 193 aa, Homo sapiens
LGLELSLKLSYLEECLMDGTCDPQMTPVTSGPQWGIRLSEHRVSANKRFTYSMLGVSHHNVILAKAASAIVSAQCCYGLSDEPPALLLDWLTPCRCSRGWVWQLQGQHDEAWRLAGTGQLAEPFTVLTAPILWRSYLEWSRDARADTGRWLYTRVDSSARCNAGTQGQVVAPALRFMPDAVRRMIPDDRDYTL

SEQ ID NO: 968027 - protein, 102 aa, Homo sapiens
SVLRAVLPAGRGSSSSARLAPPGHTGFFPIRRSECGSSRACKGAAGGSFSDDLERGLRDCAPRRAACGSRHARRLRSRRLRARLGLPPASCRALGLARHRGA

SEQ ID NO: 968028 - protein, 347 aa, Homo sapiens
AAKGFSWDESGFCLSFWMHIPLKPRTALWYRLRVPGDSRISEDTGTGTRYETIPTLPSRRRQTYMLSKCTTTDTRAHTRKHTRRERNLAGPRQLCAPLLRYSILRTQTRPDTEHGGAGETGSRAASSRDRKLRRAVRDPEDGEALKYHTHFSELLDEYTQNVYRVQLLNDPFLSEKSVSIGEWNLPRQYPETISSRLSTSYSLLRGGSGPSRLHHITSDKLRVTDAGGKLKMRQCSERLSYQSIKTAPITENQAQHTSRLSSVHPTPPEPECTRRNLVWHIHKRCTQNEPVLKETRSVRANADAQKAVTYMDSSKSKTWKKTEKDYTREDKRNDNKANTRERIESNE

SEQ ID NO: 968029 - protein, 81 aa, Homo sapiens
LVSGIFGSYTSIAWVLDKLKAESVNVVSPYDISLWKFETSKYYSDYTYRKPQDTETIIKNIDYRDILRLDCSCPRYSMLAR

SEQ ID NO: 968030 - protein, 291 aa, Homo sapiens
MVGIDFTEECKCEVDMFKTLHGSALFSTRTHTGACTVTFDSLDSGIKSDQVITAINGIQDNNFMLHYESPPYAPNDNVAKSLVQLDRRTRAMVLLLRKLAYPVIPRDFPFTTHESHSANVLESPLAHLPTGTLLCRHAPPIHRIHGRSNIHSAVALRYPTTDGHPQPILTPPHIADPRTPTPLSAHWSIHKGQGPTHQPAPKLTGTPRHSQAGNSNNRDYALHLHGGHHHRFAATTDLVPSQTTAPPPSPPTDIARATDAPPTGHRAAPPNHSPPHTRPPRTQPPRGNAPR

SEQ ID NO: 968031 - protein, 184 aa, Homo sapiens
MSSEAELRVPPSTGELTARGARDIALGGADIERRSVSTHPPRGTGPQRAYCDCPSGQQCGFSKAMSTSGFVVDKVQVTGPGIVPSGATSMDDEVRAAVPPGLVLGPWTGLQTAAAAQGPRNRTLQRQDGSLLGSKVTPATTLTVRTTGQLPFRSPGNLPQPRRPEPDPTDDIPLASGRAPVLKP

SEQ ID NO: 968032 - protein, 517 aa, Homo sapiens
RLSCHSFPPAAQEFDLQGIWSRYRSWNIMLVDSKIPAFQPKADFQIRHVKVDLARFLLVFSLILNSSMRFKASSSLGLMRNSMAAWQLNTHTRIAPSLMHNPTHASPHWLNASRLKPHAVFNRIIPRPTTGSQQPHIVSLHSRNSLSDHSRATTLEHPRAVTLASLARSPRNIASKALRCAPHTIAHRRLLPLRNVAHNQAKHTIAPRTHRFITRPSGHASSSHPSATGGYPPGSGGGPNWAIDRTDTPRHNPLHPSTPLSANTDNSHPSQAEARNLAMDHEEGDHYALTHSLGLITTSWAHHSARHFIRNTFGFGNSAPQHTSPPGATTTVVPSSPAITKWIEDSSPFPLPPCPTPLEQAAAHASSCEPTTNTSQPAWHNILTLRSLTRAPATHDNTHLTTSPIAWPWSQTPVSTTRPHIREPTGSLHSLRLVCNFIYSGSRPDTSTISQQPSPLHTRATTRLRANHLQADKPLDSPTHNIITHTLTRMDNLLTACHIHTRRHSLTTANSDAKLNT

SEQ ID NO: 968033 - protein, 401 aa, Homo sapiens
DEMKKKREMDELRSYSSLTDNVDTHYCLQITDWQLTSDDTFMENGRHTRTTHTDPSDNDCDMYDDQLCSTVCGIHRVLLAHIINNHHTQHIHTLSIPHHNETSPSHYSQRLYTHTHHLSHDLLHLAIAPSHTTAPSHASSLINTISSRYTSATTPIHYTYTTAAPTLEIYSPNAHPLLLCVTTSADTTATAPLTSHNEVTHPAQQLSTPHIKHTFGHTLRSSLNTTKANHTLWTIAPSMAGSHNIPQPVEQHKPTALGFPSSAQPRRALSSLASSYPPFISDAALQTSLIHHPYSTPVSHPTHTANHLLGFSQLGSRSESSLHFGSARPRVNQRPHQDIPNPLGGVSTPFTAISSQRGTFTLGQRYHIGPTHQRPTRTLAFTTRHTSHVTGRKQTQVLTRS

SEQ ID NO: 968034 - protein, 234 aa, Homo sapiens
MSLPTHIYILFPSPPPLPISSTHSSALLRLSPIPPSSIPLYDHTSTRLSSPYLKHTLNPLYMTHYTIMHFSFTCTTLHWHPSSLTQPHPTLSALTLPLDPPTHRPARPPHTTTLHPRTQTSHIYRPPHSPHQPAPHYPILLRSLTPNRHTPTTYTLLHYLNIIHHRPFQIPQLSHYTITTLTHPHITHTPSPTSSHNIYLILIPTPHPPSPPSPAPSPPSLLPLAPLPTLLTPP

SEQ ID NO: 968035 - protein, 67 aa, Homo sapiens
NVELGLWLQRVEAPSCGSFHVVFSLQVQQKSRIEVGNLHLDFRGVWKCLDAQAEVCCRAEALKDNLC

SEQ ID NO: 968036 - protein, 101 aa, Homo sapiens
QRTVRSRKNNYYYLSSQYCRNFFMITLIYKSVPCMLSRCTAITATSQKACYFAFLCTSMTWKLLHRQHSSSWLGNKAQQSSTPRVSRAKGHRLLFPGESSG

SEQ ID NO: 968037 - protein, 302 aa, Homo sapiens
MTNTHLIYHPPYLSLGGLTTLTELIYSPHGPLSKNSQQHNSLIIPTHHSHHHPTLTSTYYLRLIYSTSITLLPISHNVQKSNAAHCNTTKANTKHSHTLSRRLTRQHLPIITLDIATNSAPTRAHPPQPNHTEQTRAHRTQPEKERKPADARGQRPQPPTSAHARPRERPPSKAGDSAYQRHGNNEAEELHAATRDCQKRSHRGVASSHRRTTPSHADDESKRSRADMRCPSIVPRTRRRHTIRAGINKPRRERAGRRRVQTSQRERRVLHDRDNNTNIMKRSDRSVADGTRSEAIRGGDAS

SEQ ID NO: 968038 - protein, 418 aa, Homo sapiens
HYRCRRRSACDSPGPWLCSLEPHLCPRPDHPELTTTMRSSASHLLSSDRGRTTDLILDMQTMAVFHYSTLDAMSSPHHETSIQRPSMPACMDAALIHDCHSGAQKPDATRHDHILDDPGSWSWTGTLLHRLVGLGWLDRLWEHSTPDPCTTTWHSHKKDTIERGRHKRRAQGIHTKRGQQTPGTRREWQSSENGIKMTAADYDFFNKASYHSPVMARALAHITDDTTKHRQPNTQKPPTPTRHPPQPNQQTNTNRSPHQTHTAAPTPAPPKPQHRKTPTHRPPTHTTTQKPRQHPQHSHHQTIQRHKHQHPTHPQQPPPRKARQTEQTTQETEHEKETKQRQTNQPTRGPADEAGNGQRATAQHDRGAAPEPRATDTAQKRKHEATRSTDDKTRHNSSTTDPDGVTRAQEEDSHRTKK

SEQ ID NO: 968039 - protein, 194 aa, Homo sapiens
MNVGVAHSEVNPNTRVMNSRGIWLAYIILVGLLHMVLLSIPFFSIPVVWTLTNVIHNLATYVFLHTVKGTPFETPDQGKARLLTHWEQNGLWAPGLPLPRKVPSRIFSHIGASYSPWPSFYTRVVSACASFPHSHTGLIAKVYCWPKLAPVPWGSCLWHQQILRDGFGDSSMGMGKALKQRTIKHQKQHKPHTT

SEQ ID NO: 968040 - protein, 500 aa, Homo sapiens
NLHAPTRPHTASAPARPLRHSPPPLRLPRRLRAPLPCPSLSSPTSLHPHALPARTPLHYTASHTPLPLCTRTNALHAHCTPPRTCTPPAHAHTHTHAHTQPRLHAHTWPPPRTRTRHAHCAPTTPSPARARAHDTHTCTRTRTARALHPPRTRHAPSHPHAHRTAKRTRTTHTHTQHLAPSDLTPPRALRTRATTRTRTPPAATPCNQAALSTTTPATASGAPLELPATRANGNASASLAEPPKPPTRKHPPSAPCLAASNFLNAAPVATTALFSNHCVPLTATPTKHPTHAHCKTATQTLPHRPTQQRKLAWAWPKRAQPPSWQLARPELKPRGAPHTPPSQAGPLARNQPFPNYTQQNQSKPVSPPWKRKPATALSPGPPSSPCNHFSTRLGLKPSFNLVNRTPLLDFPPGLHFRPPAVHWGPLLGAHLPVALVATPPGQHALRPAHPSPSPHPPPLLAPPRPDCHHLRRTPPPAHSAPSPSLCHNHPRATPPPPRPP

SEQ ID NO: 968041 - protein, 91 aa, Homo sapiens
MDLQQTPTDLQLRVLTVRRKTNKQKGYPHQNPSIHHHHQRPKVDKTTKMGQTRAKVKSKSSTSPLKECSLAQWTVVAVLAWRQSGTSVRSA

SEQ ID NO: 968042 - protein, 116 aa, Homo sapiens
MLKAGVRSIGICTSVVRVWRSCIAVSAMMLHPSSSQLHPKWVMRDGKHIGDDDVWDHPPNRKFGKTRIVDVIESMAVEVCSLHGLRGPIDATPFSSSQRRTSAVKEYLVRLLKGAL

SEQ ID NO: 968043 - protein, 224 aa, Homo sapiens
MEAPVMNIPLHILAWPAWLMTRGIEATRGIADPLQEVYLSMHIVRHCFTGPDRCSIALLTPADQRIPLLRSSHRTYSPCNTPSNNQMMNQKAEYTAEVKKANHTPSQSAFPPQESLNSRTRMASTGYHHAYTAITHGIQHSTRTDKHTCATRTLCNNPFEEHRSTSRTEKTRRLNTSNSRPTRRHHHQPNTPNTKTPTPDAQTSSPTATQVHHTQKRNPTLPPL

SEQ ID NO: 968044 - protein, 290 aa, Homo sapiens
SALLQRSLHTPLCGTAQARALRLPFARPSAAPPGARLPAHGPSHSRHFYQPLSVSARFCLSSDADSSSLQRPRRTQATERHFNLINPCNTHYSLQLASLSKHTPFGLVPASGKTSHGLQLIYESAITCEYLDEAYPGKKLLPDDPYEKACQKMILEVVPKVPSSVRKLYYEANITKTMMGLQHEFRKEFTKLDEAPDKYHNKTLSGVHTLSPINDILLVPGLTAVPTDLKAGLPTLKLHRAAPPRNPRTHRANSKTPAHTPHTTTSATTQTKNTGPPTKQNEDNPPRHST

SEQ ID NO: 968045 - protein, 461 aa, Homo sapiens
MVAASGFIPGISSTHDDTTATPPCSRPPVGAQAPRRLSALAPVVGGSSVERCQELDAEWARPPTATHTSPDGPSRRISELPSHHPKMTLNETSFVNKAAAMMPWSMPLVLAGLTCLPDYPAGEPRGFTGQALLATPWYIVTKVPNITLLSLATPNINPTPLKRHSLAKNKNTQLSATTPTATTSTTYGGTKDVKRDQPSDLTCDQKGCNPELDRDTAQTYAYSTHSTDNEHTNTHPLTPSPHYPCNYTPSGTTPISNILTHYKHILTCLHDHLPLCTPNINPEPHDLIKPILPPHTTNPTSINTFHPHQASHHITLFHIIPSHATRTIITDYLTTPNSPHHHFQPTTTSSTLNPNSHLTTTHPTHKNPYQHHDRFDRARPQAEAERARSQAKKHRRETKTRETKGATRHEATQGAREHRSREGATTQTRRPGATTGKQTTNEHTTATAAAPSAKHPSHAPL

SEQ ID NO: 968046 - protein, 365 aa, Homo sapiens
GRPTRRIRLVAEKMIWLGKKDPLPPLDPQAIKPILKALLDNTKAKNTDGQGLQRPGNCQPPQACGRAEEVISAPSPTILDVDSSGGADPRLHRQVPAHDTLASHGRLHGAGWTTPLLTLSSALGPASSICRLHTHSPPCFSIFLTKYTKLPHGRSSAQTGRCPGTALPHYSHYTHQPKRRYPSRTAPPPPCHHSGLPSNPLHPIYHDGTTAEREHTPHRNDSTHAKLGTPPGSMTDPTLTRHMGLGAPWHTYYNSPQRHQAPWMGSTTPSLHLLPTDNPRMNQDRQHGAPHPNTTLPDLVPGTHRRPHTHTAETNHTCTQPRRTKATRAHTPHPAPSLRHTARNMQAEPPQAPPTQANQQQHTHH

SEQ ID NO: 968047 - protein, 96 aa, Homo sapiens
LYVEAGKALVTVLVPYQYYYTCRSCSTGMWFDLFFKLLERERKQKWDIEGSGVLCAGCGMLLRPVPSAGSGKCLLALGIICGERVLKSSDASIFLV

SEQ ID NO: 968048 - protein, 330 aa, Homo sapiens
VQAQLVRVITRYTPQVHMGLSQPILIFDAERDASNMKQPSKTKGVDEVTSVNSSGPTDSECTETGYAFAVPEKDQKGTCISTEVSLIWPPGDGDFGPMKTPAQYDASELKSFPCTGLGTDEDSLDEIIVRPEPYQELQEIETRVYKEMYKTDLERGHYFGHILVTCEGDGCAGKGKKSRGGSVIEYEVIDQDARDLYELELKRKGTDVPKWIRIDDRAEVGTGRKYMLRYKSYSPDDMCEAQARGEGDLEKVPEPGAVLQTAGIMLSGVELLMAERERLIERSAEWQWIRQIKKRSRNTKTGVQTGRGETRKQGAPRKEQPGGPKALCTE

SEQ ID NO: 968049 - protein, 553 aa, Homo sapiens
WKGKSYMVFLYKNVHQIKVKGVGGKIALLREIYARGGHAPARLFTPSLLRVQAPCALESSQRNSTGLRALEPGRRGQEGVRRALTTERRGEEREEISPQEALKRRQAHTNLTGGSQAARGLRQGERVSLKGGEERYISLTILPPSQYLTPHALSRRVCATTLRRRSAFTRRTRCACVSHHISRPLCCVSLHLLVQRENPPDGLLIMRAHTCEDPHVLLREPETVVGTPVRAESAGMTQQKHPQDLCHTPSLWGPPYILWWDRPLTRRGSTAPGSIVAKKTLSHIYHPVCRVTPPKGGALYISPWGRHQHVLPSPPVCIVEPPTARCTVARFHKEKLLGSPPKKMFGDIPHEDRAPPLQRHLIPNIVPRILPRHQNLPAPPPPANITPNTLRRPRGRHCHRLANFRTKDIPPEETLVRKQGGGHQRPARERKHYSPHTKNPQQRTPWAEPHIKPHKYTMPEGSNMKLLRQLPQMRTNVAINAPTNNYETPAGWVAQRKVDTLLSELTRDDQLYYRRLFATPVSNEHYGTNALFDVNPPPTHEAEADRHEPPKIV

SEQ ID NO: 968050 - protein, 142 aa, Homo sapiens
IFKPPRLWSQLISKRGPEPYTIFHLQKDGGREVYFWTPSHAYTLISTNIRPGRGTPITGITLTGGAHQSLCVPPLMCGEAAPPYRNISHTPYIPSLPLITLYITSLSHTISLYISLLSVETISLYRKICGVARPLYISHDAL

SEQ ID NO: 968051 - protein, 261 aa, Homo sapiens
NQAVTLAAQSLACLRAGWNLGFHAPDELPACVNVEGETHHQCGANGSRLWRGRLWLLVVDQETDDGAPPCGKLTCYLMEMLPSEGSSPRSTTPGMPNARLGHTPVAHSSKAGKIGCQWAPEESCALGSGNCERDLRAYGFNLHSDKSRPGQYIRSVDPGSELPPALASGPRTWLIEVNGSECGRELRHAEVVASIKAREDECPAAGRGALRQMNTSSGFRVQTTEEHVGRSLTSPSPNGTSLPSSVVVMVSSEVTCWYDRT

SEQ ID NO: 968052 - protein, 524 aa, Homo sapiens
VAKKKKFFILETKGGVQLQNTPLSPSPLSLRGFRTAGHRGVEAKRVCVERPAGEVCVKRVTRETPREVEWEEAVPRERVGGWCLPLTERVERDEECEREHINLEGSTIRGARESARDERDGREKVSLPSERVGSREGCGACVASLCCESAYMSVSPLYLLCDKDVERQSHPASLTSHLRVAPNRECVEGLLCHESLRDNKRGASINERGGPAWPSLSRSPRVRRCVFSQTVVARVCVFFLSEERCCSGVFSRSESVMRVDPFSTLCVSDLCVPPPHPLSPPGGGGVSSLVWRRAVCRHRDVVTQRSGITHEVVVEKQEEEEEGTTPLLGRRQPDLRGGRTAVAEKAGVAHPPPTPVVGASPHKDESLHRRRKEPAVADKNELCKKNTLLRVGDGGRANINKHPPNGCAPPRIVVVTLPRKEIKSTRPTADDPPVVITPQQGGDQHLRDDSRTRSGQHQTPATPQGGELLTKDIQETQARPGTITKRVHPEPDGEKTPPDLRTRQAGDNHKAGGTNKTEATMPPL

SEQ ID NO: 968053 - protein, 128 aa, Homo sapiens
MERPSNRLRARETLVERPWANRKSLCVRLHVHIYMCVSHHSNKSVQASPDAPTLAGAGPTQQTHGARRKHTTEGNGGALRREKRTRNTAHTHTQTPPLYRPALNPRGTLPTRGSPQPKNHTTPCGSTA

SEQ ID NO: 968054 - protein, 103 aa, Homo sapiens
MYQPPPNTPPIGGRHKKDHHIKHRPPPVGPKNIIPTLLGDPQINNTPRVTTQSAYISKATCHRGAPLCNAPQRELTAPPRWVKRKARNTRNKEQSQNRHQRMT

SEQ ID NO: 968055 - protein, 150 aa, Homo sapiens
MWRISENPVGEIRTYIPSETNSLTRETLPCVTTGGCARRFKKNPKVFKTTLLLGGVGLMGDSWRNTQKPVLGLGYGPKPLAKNHFGVPSLLWVKGRGKLVDTQTAQGEILKFGAQKKRGEERILLGKRSSETNGCDTRYYTTRLPGGRHR

SEQ ID NO: 968056 - protein, 159 aa, Homo sapiens
MLGGPSYTKKNHSLYAEEKRRVRPKRHPNNNFFFTKKQAGEGRHTPPRERGACHHQGGGGPPPRGNQKPREHAVSTLERNTTETTTYRSCRCSPADVVCSPPEELSSHKSSSFCCVGNKPDGTTYECRSVRTTTHYEGSEPAKRARVKHRQRKKKRGGF

SEQ ID NO: 968057 - protein, 300 aa, Homo sapiens
MGGGFPQAQNILLSQTAQRATISLESGPPCANLLWPGTFFPRQTAGASNRQTKAHESPAEHGGRVCPPRRTMMPSSHTDPLQLTGGHANSKKNRAAAAGGKTNMLADHPQVRVDNSALKQYLIGSPPAIIQQQTRHQIHTAGPRRLKRQTGRTTPWAGIDAHTADPHDQQTETRAIGVGSPCNRQRGERVIPPPIDSSQERPLWTPHKTRGGHSGVDKRPPRREGPHPTAGGTEQGGTTHTDRVSLEKRVIAKGQHTEDNQPPGRDRQLHAPDDALYDDHRNEDRTTQTSSTDRLGSTND

SEQ ID NO: 968058 - protein, 214 aa, Homo sapiens
MAGCSQTIPSGAVRWSGGLASSGLPEDLLGGCVGDVLLLRDWTIGRNRSEVDFGCLQWAPRNGRADWEGLRNYQAVWVCWRGPVGSVPCADAWPWALPDRREPSKIQMAAGLGSRVGGDRGLGRETWPDGGHRGRPPRSTVLRTRRNMEGALVKRRCARKPGERLESPGSGPYYTSQDALLQPKRTDTSTNREEGQGEVSIQEYRRRKSVRRGG

SEQ ID NO: 968059 - protein, 278 aa, Homo sapiens
MTPEAETSLVLYKTPKNSSYYIFLTRSGGSYERGPLRKTTFLFWGQGVTFVGGPLCAFLAKTPEASHTGGQKHRRGAPKRGVFPRRARTGTQCVSQTENTRGALGAAPIAGKKGGEPRGGRTTNNRAQNRRYKREARREDIQDSPHPAHFKRYHPPEGVLPPWGKKPEMVPQVETPRRARANRAARGKQGHHLSVSREQGKSGGLTERRRQRETAVGRPNEIDESERNTAGGTKTQTTRGDEREKSTTCEETRMIVRDREHSRKPEAPLSTQMRGDSR

SEQ ID NO: 968060 - protein, 464 aa, Homo sapiens
MASFKWKQTQKMSSQAPSVCVQFHKACGRKHRHRTRTSVLEDTVSEVYTQDTKAVELVPAEGGIFFSWGEWQRGRRGAHRGCGATEARRRAHTGLLLFSTLCAPRERVPVSTEILCVSPTNFSQMMRIYLTPSLSPFSRDLYKREMSLRGEHLSAFSEREESISLSLSVAESHQRVDTLHRESSFLPAVSHTHTIEDTVVATTPWWRGDPLCGPPPPEEKSTSLTEKLLLSSSAGVVGIPHQKRENLISSRTKRATNIIMLGGGIIFYILHTQDEGVGELLQVALETKFSHISRNNSSLLITRRTNNHNQLRADNSPRNTNNPLVAERQTAPADRENKEGSLLPGGERTRRLINNPTRLVGRPDRSNRRKGRRIISKKSQSIPPPPFFCCEQTAGTYELTRSRKKTQKEEKSANQQRVVRHGAPPPHEHDGTINQPTNEKQSRTTTHATGPNIGLVHTPPLRVE

SEQ ID NO: 968061 - protein, 113 aa, Homo sapiens
PGSGQMQETRPGSCGCHLSKRQTMVTQGGKYTPRPGHLSSSAPDMRLTQKVLGHRVHWCQLRLQTGENPSMCLKTVRCQESCSLSPELYKLEISAKKQAGSAPLTAHVSVLPN

SEQ ID NO: 968062 - protein, 412 aa, Homo sapiens
SLPPLNTGGVRGGGGERERGEERVFFHKKNTNHAPARRREREREKTPAGRPAARAEDHRERERGGLSHNIEREGRRERHGAGERGRRGAGRENTHHKREREGKNKTQREREGDGRRQSHHPRARERDRTSADARPHSGRDKSERRAETNQRKRTHTHAAHGEPPSPVRPLISSRTPTTAGYLSAAQHRSPRAGAGNMGREKKKTMTPLRSPAGARGTPPRAPRRYTLASARETSPPPPTTGRGRAPLRTTQESRSHSRAQARGGPPHATPPTIPHPKLHNVSTTRKKHTQPNEEENIKRRRQRPPHPCRAAPPNSPPSITNPPTTSAPIPHTHQQTNQSLNINRTSLYNHTLTSSSLSSPCPPLSPHNHFHLYTNPITHNTLSLHPLTYRTTTPSPLSTHNPKLNPPLTTMH

SEQ ID NO: 968063 - protein, 150 aa, Homo sapiens
MFGRTNFPAVDEAANNNRRQPPTCKMYIPDHTTSLVSATQQPRPLCSPRAILNHHGFLRPGCAADIPYSDSPHSKGILRHPPKTDREKLRWGDTRWVRAWKPTFPPSGCSEPSSHVGRQAAITLLTKNEKTQQAWLFTQPYFVAHIIPYE

SEQ ID NO: 968064 - protein, 438 aa, Homo sapiens
GNKVSPFTQAGVQGRDHAHCSLNLRGLKCDSSPCLQPSQFSCGTYMACAPPVFVAFIFCVQCECESASEARERPTGRVSLSKELLGVSEERMLRPVVEQGGFQSLWHHSANTPHLCHLVNVGSSHKSSSESRNYLNIVEIRGDFKSVVTLLENSSFSYNFIRRSGAFSRAGHNWWPQGAGKHRGAQEEKSPNLQEKAGKVMELGARAQAGAKYQRYGPPGRISNTESVIAGSYTQKYRAREVGTVGEFLRGRSKVCVLGKNTASIRMFVYKCILNITEVGFGYPENLWVKRHAHSGHHSTGNNPVTEQGVTEVPNYRRLPPEGRKDGGGQDGSPEGTHDSFFNPNKTLLKKFRRHCGEGDQSVAPHQRSGEEKGTTGGSLGATATEADKSWHPRNFSEDKRSRPFETSAAAKLLVPPQQWVCPPQQNHLLLERSRPTS

SEQ ID NO: 968065 - protein, 130 aa, Homo sapiens
ERFKRFMVPKKRPSGMKGKAGSPEPGAMVCRAPKGKEGGEPGKDARPPAPPRACGPGQPRTPPGWAGAGESLTNDWEDHCGSEAFFSVKDSCGIQSPLYCVPRGCSFGSVGKQKEKEQHQMVCTQSFHQG

SEQ ID NO: 968066 - protein, 392 aa, Homo sapiens
MAGIRLPGSSLALDSPALARCCLTLLRDSRPWHAAGKNSSAGGWPGSCPLALKQQSLTSAAGNAPVRYAGLLLPSLHSRQRGSHSLTTGLAAIPERLQLYTPFSTATWRRSAGPTSDSALLDTCTTGPHHNQPWPACMASPPCHPTHPSLPGALTRQRPLPGSPAAARPRAPLRSRQLAPPTPPTPAPLLAPPDTPATWAPPTPPPAPPASPSPSPSPCSHALPPTAPSRPRHCPLPPATAAHPRPAPRAPAPPRRPLPPGPRAPSSPRLPPLPCWPAPCPSRPCHSLALPVAPATTLSAPSGSPSPVSAAPPPPPPVFAPPLPLPPAPLPLPPELTPWPSLAVSPVSCPPALPPPVPLTPTPHQGPSRFTAAPTLRPTPPPPTPPLPDPSH

SEQ ID NO: 968067 - protein, 175 aa, Homo sapiens
MSLCSFTRKVEFEQMWLVWRAMCQAPALKGGESVGVRVFEVSEGKPPGVLSVEPRIALEGGPSERRGFTTFLGVSSYWARFSIKRQAQVHTGDIVGMGATTEGTVPVELPGQARGMTCAHKPVGKAPDKRQGKMSWEEPRGPINGQTVPPGGGRIHKALGGQEIGMDLGGHESFQ

SEQ ID NO: 968068 - protein, 190 aa, Homo sapiens
GGGGGERGEPRGGGGGGGHKRGRDPHTKVFGGGEPPTGGGEKQTGGAGGHTTPHTPFLGFFHPREGAPHRERGEEQHTRGGGEEKTPGAPHRTHTEGQKRERGAPHPHTKKNIYIRRDERGGSHEGWYTHRRGERGGCATRGRGNKRGHRGGKSQKVGRPEVWVGCSAGEHPTPPARWVGGGRKGGVALI

SEQ ID NO: 968069 - protein, 224 aa, Homo sapiens
MGRKKRSHAIEDVQEETAVDLSGDSVKAIAKLWDSKMFAEIMMKIEEYISRASQSFRSDGTSGGRGLNTAVIVDANEAVTVEMKNELNIIHNGSSGISTQHEIALNWMSPWSPNANCDYIRTVKEAGQLSRGHVQMNNENLLADPHLNATIMVVSVTDSTHTPRGQQLSEEELERLQEACDMALVAETASKHRIYEYVESRMSFIAPKLSIIIVGIHARKIMGV

SEQ ID NO: 968070 - protein, 276 aa, Homo sapiens
GFPKGFSSGASLKWLVAAAVLLQGLRKIARIKATQRGVLVLQGRVLRSPVSEEGPGSAFVQKGVSWWCRPVTFVIFGEATERSLGVAPVGVPLKFRGVQLSLHEVPPERRYTWGRGAQVSEKATGGDASVEALEAKLGVRSRELVGNRWRSLWDISKERGIYSYIIATALRAQEVLRDTYGHRDRNRFFRGVMWVLWKGGDSVPREVPGNTFFGPRYVAVKPGDRKNECRATCDAREKIADLGPDSRVSGLGKQPFSVSRAHQVGGGPQGTKVEQI

SEQ ID NO: 968071 - protein, 341 aa, Homo sapiens
MWGAHVCATHKDPNRGAGAPESAKTQRGEREAQRVPPYKREISKSLPRKGGAPWGRNTPQHGEEKAGGQRVRTAREEKMALSTSRLFTRPLWALERTMGGGPRRYYTRGGLLWAAVGAFSGRGGVSPLCGDFFYPLLGGGPPPEGFPPRRGPRCLLGGEDEGRDLSTRRPNAPREELHTRGGGGGTTTRGRGGESFSLQGKRCLGWPRGVEGTKTIRPHEPTLRKQGGGAFKPKKRHPKAPQEGASPQSGAHTKCEKRKEGANFKNGGTHVVKGSPQEGDNDHRGRPKPSGVVRSTRMLTQECGPKKKFGRCGNQWTIWGDIPPGGVTQTHLSEDIKRSPK

SEQ ID NO: 968072 - protein, 149 aa, Homo sapiens
MRVAIMNSDSIIPSRHSREDMRCERNTSIPKSERVTAQYNIYGKAERPPLPVRLWPPRQGRPQPREAVKRKIQACSSRRTRRKTARRACRGSLNGKRKRRKKAEGDCGRPQPKHPAPLREDLDRGQERVSQGLKTGGAQKCMKWQRQEG

SEQ ID NO: 968073 - protein, 99 aa, Homo sapiens
TRGKIPLIGNPTKWQNLVPGLLSSSFFLCWQFRVLFFHVVPLWIWLFFLPPMGLEKRAYGHKFGRWVCQWTLKGTILSPKRPGRIRFWTPRQGDLAEKG

SEQ ID NO: 968074 - protein, 219 aa, Homo sapiens
MWGGEVSPQHTPKHFEVGAGRGKIFAPCVAQLQCATINTWGAWGPRTRNMWPPRVWSALHANKRQRPFWSAFQPQGEGGRGGQQPPTLVRRNQQRVVGNPGGVASLPPNIMWATNKLPHAAPRGCTKQNSPPTDVGCPLGKPTRPHEHGVSLSARAAVGETTHHHAPDGAPLNAQVCVRREHTHNAPRGKNTLGSTRLEQNIISGGPNKKARRAHPSVG

SEQ ID NO: 968075 - protein, 109 aa, Homo sapiens
MCLIYNIAHRYKRQKECGADLSQRGCVLYNKVLLHELSTQKCPEWVLSPIYVSPESLPCSCVSPPDRCITPGVSSPPVYKHRARVLSPRVLFAWGVVSCGPARGERDTS

SEQ ID NO: 968076 - protein, 86 aa, Homo sapiens
MSVEAPTHDGGAHHTVDRDKNGCDLPSSEKKHASRCSGNTTPTNPRSLTATAHTTLCAIPLSRQLKRSTRTITRWNRTNDSGSDAH

SEQ ID NO: 968077 - protein, 300 aa, Homo sapiens
WSGWTWIKLRASGAGKAIGVLSSGGDANGMERCCPGCDAHGHLMWVPRVFLIYEGYEGLVEGGENHQVRPTGCGVSNIIQLVRHLSLGRRSLPGLYHQGGVLGRAVYNLVQARHHQAVRHRRGWQASLGCQHSSRASGAACWKELLAGRKRVVTRTTARRLHRTLNIAGLVGSIDDDFWVHRVVTIGTDSASTASWQVIDAIPNTAHEPPEDLRCLEVMGRHCGVTWRWYLALGSGADWLLIPEAPPEDGARTSLCARLVETRSGVRLSVISSLGVPGRRGAFVLGRLWSGGCPVCGLGG

SEQ ID NO: 968078 - protein, 277 aa, Homo sapiens
DVNDLLKFIRPLHEGTLVFVASYDDPATKMNEETRKLFSELGSRNAKGAGLPGTAGCLSGPRVCTNKSPFEQHVKNSKHSNKIRSAGPRRWRWKAVSRGEARAKLCTVQMPGPGRGEARPWEARALPGGQRLRLTTPGTLEQETLPGSQSTSGAPSAVTKNRGLKVVGAMGAVQGVVLPYFVHGSPGYPLLFVRLFPPGQVHLALCSDSFTPVSVPDLESCVTALGACPSVCKSGSRPGGLGLSSRNLSLLSTLRCGLNLFPCDSFSEPNPGGGFEP

SEQ ID NO: 968079 - protein, 138 aa, Homo sapiens
MGVCFTSEDRHVEAPRPHDVLANKIYLSRNDLPDSSRPNPLIIITPPATRERNDHLYALCVENCDDARESRPQQLASPPHYSARHKRRATHNSASSYPNTTPARATTARLETKRLRTTLKLQRTDRPRGRANERRYVS

SEQ ID NO: 968080 - protein, 136 aa, Homo sapiens
MRVLPVDTRCRSEERSGKTLASRSIARDAQRPWEWPRAYVVVTSGVPGRSASPRRRLACAPWAQMAGRHARTSGRLSSGDEVDGRVGTIVAYHRFDGTTLGCTKVISWMYWFSGFGQSVTGRGTAPHPPCCVCVCG

SEQ ID NO: 968081 - protein, 100 aa, Homo sapiens
MRVRHAFTATEGRTSRGWCWTSRRMDDHAMSVRHSIEGYCQCPHSIMRIDIAGRDVSRLPDACYLRKERLQMFHSSSEFEIVKDQYENEPVTYPKIPKRM

SEQ ID NO: 968082 - protein, 214 aa, Homo sapiens
GKFSLNLHNHKLNSEIQLGLGGKQGKTVEPQEETCSEEAQRIQGITCEAKVGVEGVPLREATEEEVNRGGKEENNKVSKLYIPECGSTSLSNVGDSFVWRAVCHSPVDHKGASMWPSNNIFSCAFSSHLVAQKTPYYGLEHIHKPSHMSLGDMWRIYETKWLGDLICVCVWCVQLFVAYGETREWARDPVYMRYKGRMRMFLTILHKNYSPPLI

SEQ ID NO: 968083 - protein, 317 aa, Homo sapiens
MRKMSWNYTISPNKLGQVDFTHAKMWGGYGLETEERRNQAGNTTNMWALGSLRRERGRKMRQLGRSARPKGFPETSWLPMRTQAGLVALCGYPGRRSGATKQRWCAPESEIRAKHFPWTSYIFHIPRVWRTGVRGRTTPRDSKLLRTAGIEAKLRQAHPGEHPLLWSLVSVRRMCVVTTHTTPGGFATYRDPPGGEPPSGRNNKGGGSPKRSTNTGGGGSHTKTTKLCGAEKIRPTRGRHKHLRADTGSYKRSEEPPPVISKAPNQDEAPSGPPHNQLDDTTLMRQHSEENNNIIATTGGLPRETHRRGQQQTQRAP

SEQ ID NO: 968084 - protein, 134 aa, Homo sapiens
MKNGQKGPARYPDVERLRLVRTPLRQGQKGVRWVSASGGDKSYNGPRVIEGRSNQEVSWWLVTKACDRGQLEPLIQHMVGITQKARAKGDSHHEMVGATRSQWRRSGPTVGVRRPTRIQQAPELTTARPKGGSE

SEQ ID NO: 968085 - protein, 337 aa, Homo sapiens
QVKKPVDLMARGAGGPGALGGGGSGFLSFTISTGLSVAAQEMWRRGPVGDVGCHVRQGWGGIPVGLLGEISVVSRRSGVAESAVGGEDILVEEKWVARAHTYERGGGKGYSRVGGPGESSRVYKMRPTHRRETPFLGACAELLRGGLSQERPTKKRSLMSERGKYHKDRAGEIKTRGQRGKMGGGEPSFKRVTIVGGGPPHEEKGRRRRRDGSSEANNNLSYSCWRDSKRENIRVEDDDKRISPRRRKKKTQSSTNIGAEKNFVRPPNRTVCVGTREEESTFPPIMPETRRRGGGGAAPHKRGGHRRTKKTEQQVVGKPTGREKINTKWAPTPGGGT

SEQ ID NO: 968086 - protein, 268 aa, Homo sapiens
MIRRVLPHGMRPVCLLEPGGQGTLQRRLSLDWDGKVSEIKKKINVESVPGKVHGDRTARRPAHLASRAPLAVVISGRWRCSVLVLCGLIGRDRSLDEQQRCYLELLVVERDHNVYHSGLLLGLIRKVGIKSGSVSIAHENIQESPLIVQPSYSTETIKVSTWTGSRMRTVALDLRFKPLGYLLLASEEGMLQPWQRQGEQCRGKEGAKVSLMSSVISFVNKYPWINTEGVALSASYAESQDEGSDRSPGCPSPRGYAGKVQSFVRSFN

SEQ ID NO: 968087 - protein, 223 aa, Homo sapiens
MCRKHLQEIPDLEIAKRCQQTCTWGWDSQLRLSSNMLSRQWGVFRSWREEEPAFSGEHPLRNGLSEIWANQGEHRSNGKRVKEQRDDQQTFVIVRQVLEANIERELTRVYHGDSLPDEAVSVGVLIPGAVRFPELVEGLLVWAREGGIARRRSDESRSGETVRTYRGKEICDPDVEWSGLLSQGAVIAFPLPTIMYGTNHGVNILPLSVFQQMDLSKLSDRSV

SEQ ID NO: 968088 - protein, 362 aa, Homo sapiens
MRGGAKNRDPRRVLSFSPGGWGDARGVVGPGGRGSSLRGATERHTEREPPPRRGPRRDTAEERVEGEVVCQKITAGESHGASHPPLSDVWGGPTPGRAGVVVRREEHTPHAGGTPFLGGGGEKKEKWTVRVRGGTQTDALAPPTDKQVGEPLGRGPSGSEEYLFWTAPKQDKKHTFTRERGGGGRPTKQNPGSPERRKLKKETLLSGESETKTPTNRERRLRQQQNTPPQRDRILEAKSYSDLRPPTERGGTPPGDSYNTEQLDRPPGAPPPQSTAAHAAHNTTHKEGEETAAKCLTNKLGSPSVETNNLAGGKKRRTHSKKPAGAHHNNLLLPATEGEVAAPILHRSPPHNLLEHTSAPDY

SEQ ID NO: 968089 - protein, 241 aa, Homo sapiens
MRLSRKRRHETYKGASPSIYIVRSIQGVWGVPLCGADISPPPLFLWRPISIVYLFRGGVIAIIYQPLSSGESGSPLPSLHTHQTFHIYHTRKHDATSQYDGNFTGGALLYSLEAPIYKFPPHIKTNKRPTINERKHQQHAATKNNTPRWPPNAIGQRPTTHNTGGALPTNDTPNIYRHIVRAINTTALAGTTHGGEHPRVGLQRKTTQPRWRTGRATYKHVPPHKTPPRVANHGGGRPHTI

SEQ ID NO: 968090 - protein, 188 aa, Homo sapiens
MTSVSASCAVVTPPKSWGGCTSYVGERTVVVAAPIDTTEKGPPVADLPPPVRRYSQHPFFPARNNAPEKYYPRWYRTTQGYSTCCHHTRWVGYLIYTKRVWADAQYNFSLHLLTPQHGPQQKGRYTEASATTAVLSPRGAPPTASLYTAVVVGHDTPNNFPINQRGKGEEENVRGGGTPPKYGWDSPT

SEQ ID NO: 968091 - protein, 136 aa, Homo sapiens
WAKNWFSSIKPKVVFLLGFNLRGWIAKQWKQMGKSGHLRGGVRGASTKVCISRATVGKAERGQESTVEARGEFQDTHRLVHTTMWGTLPISVWSYKKIYKILYPRECGVARVPIYMSPETIRCGRGREKEEKICRL

SEQ ID NO: 968092 - protein, 218 aa, Homo sapiens
MCANYNENFSGTTDRSSNQGPQGETQQLALLRRGPKGGPGGSRESGGPSGAGSLAHTLHSTVRASLTTHIPNRLGSHWDNLVPGAYNKRGAGTINFPKRAWGILSSPGGPHICCCRIVVPNQHGATRHNTEVESPPGCDSANQTTPRGGTTGDTRPRTQRGGEYPKQTPHKHNHRANTTYSAHAHHKGVGTLRHKSKLDHLPAHGCHMRHQKGYDHSY

SEQ ID NO: 968093 - protein, 421 aa, Homo sapiens
WTNKAVNFTGVQVGWVQKVVREVEIGVWGRLYRIGEARWEITVKGDGSSCIGRKLGVSQGCSGGELWDPGMSQEKRNFHRGKCHQLKAGTRHFHFFGEFSSLLQAIGDAITVPGSPRGILSGLEAGASEEPDYFAWSSFPGVQEFTPKAWGTRGDAVPRGRFPQGSTLGRTQSFQRGLNLEERSGISNIGAETCPLGGVGYGALTERTQNSKAGHLSSMGGQSSPGRTRGHLDLPQGEGPPVNPELIGAPKTSIPPLALSQEEHQKQGVRGVGANKGLGLLTTGWGQADGDNVRGKNRGPMTLGPVGVSRGTGISQKHTFPVKQDVVTTINRAPSTHRGPTGVNPLWTADFNGAPQGAHLTEKRAADKLRQHTRSQKRFPREIRRNIYRDRTLIRTDHPHDTKTVQYSPYIATYALLYECS

SEQ ID NO: 968094 - protein, 80 aa, Homo sapiens
RVAGGEHLRLDDVTKRILQFMRNQHRGSTQTRSRFMGPGGKNNWLPMQAERLLAHTERQQWDYARDSDRRNNGENRNDQW

SEQ ID NO: 968095 - protein, 468 aa, Homo sapiens
GFKKLYSHLGPRLCRIVKKAAYWAVEGGGFRQNPLFTLCKGPFQKVSRGPQKGLLARCLKVEPFSKKIPRHSHSPRGPPKLVCGGCGSGWFHPFFSLNKLLHSPSFLEKVSSSRKRFTKKMWGSPGAGQEPQGACERSPQRWPWFSGFFLSPRGPIVDEAFLMWPSLWGVFNPPNSHYPLKSVRLLCVRVARCGTQTEAASPAPQGAVEICGHNSFSAEETRCARIKAPSTARVIFPLFGAQDVSRGRKNTTCWGAYHQRPFFHKKKRRPIFSTIEGGVHGTILKDNGPQIEERATVLQRGVALTRTHGAPFGTMVVPPTTFFSAPPMASCVIRQPAVVEPPHPQLGPAGVRGRTYQKFLPWRKGENSSWGRTRHPMGGSTALRGDTTEEGGGRFQTRTSKKHRGWSAGEVEGFPPRRKAALGEANNGSPRKQKVYGGVPPAEDDFLSQTTRRMKREKHSRGGGGAKL

SEQ ID NO: 968096 - protein, 158 aa, Homo sapiens
MFCGRLNMHYELSRIGKWDSDPSGTKTCYLYQGKAILQLFAKEVYPELQESPNVVEAKPTVDHPELRGKGGPQASARTQFPNFWVNFPLTGWLKVGEVGKLMPFSFLDKVQILYTRSRMDGFGKIHSSWEHASPKRELAVKKEYQFDMDNGLVLALGE

SEQ ID NO: 968097 - protein, 264 aa, Homo sapiens
PENQFSFLLAQGKVQGRDLCSLATVPPSRVQAISSCAFSLSQVTVGHTGVEHTMCPAIILWIFLSIKSGVSIIVLCAEAVVSLEHSPLTSRGVILHPHLCGLSRESVPWRYLTRRYEAQVWPPGPCGHLCDCVSLYSTPTKTHFCEHCGTLLWLSPRKICGHNQRHLYKCEIKPLCATYMPQTLSLLCVVGEKNREGPPLCVVLPKTSYHPVCLSKKGDFFVVSTKAPNRGGSLVGGFSLLVGAPTRGVVEPPIFWGGALIPSF

SEQ ID NO: 968098 - protein, 334 aa, Homo sapiens
CFFKNPSKTVYNTSEFGVTRGLSVGFLVASAGTRASKLLGLAATRVSYQQGPVIRDEDVLDLLLGSLIHIFLGNRPPGLGRWHWTDSINLGPGDHHPLHGHGCLHQQIAPCRESRTGSSSWSWKRARSIDLQGPPVHLDETMAALAVGPKLSLASGVRRPAQTAAGPWHGMWLRSVGLDNRHRACFPFQMEGCQGSQLNKRVELTIFQGQPEQEAPIGHNPREVQVPLRGSTYCAGPKHSGVSQEGFPGTWGADTWPHRGQASKAQGKFTQGWGPRSHRGPKRVCDTQTQGAHTWGNCDQVHADKHRGPQQYNENGTPGGPTQALGGQNTPCAT

SEQ ID NO: 968099 - protein, 142 aa, Homo sapiens
PGSCPLPFALSVPGKVGEPALSYDPPKTFILQHEGVEYKKGVGVGGTAARADEDPYFVPPAFQNEVTSAAWGLTRGEAKKGSLSFASCETREHIKTPRGVPLWCALCKACVCDTSKRREGSPLCVCVSSTHRLCRETRQTCV

SEQ ID NO: 968100 - protein, 166 aa, Homo sapiens
MSNERRGILNVQSRLTEAETAVNWRTSADVRGSLYGSRSRGRALALRGAMDSLAVLLEFAEEHVEPTHVVFGSDKKRVRTERAVLRTFMHYRAGDVETGAIPGLSPRDPKRCDKGLPVRQRVSARGEESGRSGLEIRPGATLLRVGEREGNPRVGRGAGKKPPGKR

SEQ ID NO: 968101 - protein, 289 aa, Homo sapiens
GESWAVRAEHVRLVAQSWNRARSPVGLEPHRHLLNRPADLCPRHEWALLWPPAWAQSPPCVPSMALCACCPPACRDRRLMPLLWPLLLLLAPGNRSPGCASSSATRGARPARWHRGAACATCCHHVPGLYISLVTWKRPDAPANHQNVAASTLDGSQLSPDRSLGSERVSFVICQGMSTGQDTEAELQDATLAFHGLTVEDEGNYTCECASFPKGSVRGMSWLRVIAKPQEASLRPRKVTYSRVTLRTVALCILEEGDHLPGSRGSQFLDLGQAQQTQVLRGPSPELVM

SEQ ID NO: 968102 - protein, 226 aa, Homo sapiens
LVAGGQLGELHKVHSIVRSASCLLSGSGHHLVAASTSSLVFTSEYLEDVLEESDIWTCPGSLVIIKSRASGISPDMVRMLNGEHTRENLERVFVLHVTRYGLDILAMLVVEHGDAPSGNVITGGLLLPELQPLGGSLRGDVVEGNFYSATRAGDQCFDVLELHFHFRSMEYSDRASVMVSSCDQHAHRHVSQLFCPMWLTPGRELPQRGYPPDPWIEDWAQMIIRS

SEQ ID NO: 968103 - protein, 125 aa, Homo sapiens
RRKAVVRATGKAEGEDEHDNEEPQERDDEERQRAQGAVRHLSPILRGQAPHMIDQSPGGRGDAGPGCRRAVCSVKSLGCGAVRGGLDSFLCLPATGGAPCWVLALGTARREPGGGGRKVSRAGFY

SEQ ID NO: 968104 - protein, 67 aa, Homo sapiens
LEEQLLLGLDSFAPLPAARPFPRRNITTTLCAPHFHCASPQLHSNQPLRAPMAEWGESLRISSQITL

SEQ ID NO: 968105 - protein, 277 aa, Homo sapiens
TPRRARGAALLTDLYQATMAWAIGARAGRGTAAEFELFFRRCPFGGAFALAAGVRDCVRFLRAFRLRDADVQFLASVLPPDTGSVRSSSHRSGPSTCSVGDGAEPCPRAPSPSPGCAVPAGVRAVLVVQCWMTTAVSAWVIYASLGGHQRSAASLDRMGREKLVLEMGLRRAQGPDGGLTAPPTVAGRFDSSEQPCQGGHAAEVVPVAGTRGPLLRHFLFQAGEGAPWTLNVGSQQLVKGPGGWTWGAKGQGVVGSGVVATWGLGVQEPDSGGTGQA

SEQ ID NO: 968106 - protein, 252 aa, Homo sapiens
MRGCALAEGPNSYPQLNPGSKWLTHLAGARLKKLLAGDDARGPIRRTPGGKSKSGGKEWTVKAVFEPTINTRGTGALEGGQNMETTRGRSARGENPMRILKDKPGNMGVAAGKNRCGRHTGPRGEGPGQTSREEHKGSTRIEAQVKPNNREEKWSTRRLSENRIKLLLAKWVQQAHCWQRNYSPRQKDERQGGLIVRHKQKTQYIHNRHTTRGEENQNKKDRQHSTPDKRESRRNIMMRGRGCRSLRCYARD

SEQ ID NO: 968107 - protein, 570 aa, Homo sapiens
VKGLIRLIGQENENNPAAQGGNGGTLSPLLSFGRSLQSPKPQPCGPFLWISFLSFNAGPGRANPPVVEKPQRERKSRVVLIVGNSEGGTSEREREVFSTNRGCGGTRGLVGAWAELRKREARWCGCGTVWPKAPETLETHLWDSVERSVSSLYREDIRLYIPLRGPREIWVISQELLQIFWAPFQYPQRNADKIGGGTHCAVAREKAQWGPCLAALFRETKRTRPGGRGSPLIHPLTQQRRDCSTQGTNDYTPQQRGQEGGPPITEDGREKNYPYGGEHRRVLLTYTQHISVVDEPAFLCTQRKNPPYNKAMSYVWCENRRRGRSTPQILKSSTAAHREQDHKKSTSTTSRHYPEEGGPHETNREERNTSQPPQQRRRGEVPHNQRRGGRAHTPANNTSVSLGADKHKKTPPNERPPGGGPQRLGGHMLRRATTAEYTPPAVLYVGGAPIKEGKHNPTHLLRGERSAAVATKKAVAAGDNKPPVRRVRAQTNTTNERGENRTTHKKRKRDVGRTAGREQRKEDGHNIAEEKAPRVEKTDTGRRQNIMRASVVRNNTHINGCAEREEHMHI

SEQ ID NO: 968108 - protein, 228 aa, Homo sapiens
SLSFTAATHALAAAMTEQMTLRGTLKGHKGGVTQNRYYPEFPDMILSRLCEKDHHQWWKRDQGMRRNYVEFPTGVCSWRGSPPHLCEVSGGYLLRVASWPSQAPWEWNPCASWDLTRGTTTRRLGGPIPGSVLRWGLLLDNRKVRDLEINQARENRGGVQYPARMRATQRGGLGSGSRPKGEPYNRLRGRGQAGQGYGTVVNGKLKTNHLWHTGYLNTGTVLSRWILW

SEQ ID NO: 968109 - protein, 382 aa, Homo sapiens
ARDVGALEPVPLTLRSSWADPNQHERRTHSPMMQVASGNGDRDPLPPWMGDQDRPCRPGWAFFVDHQQTAPLRGNDHAAVALMSGPKETPSSCQCALPWEGSSAACLLGEWPPCVHPRLRPGYISHSVCSIEGAENRAWCNRFPCLSPAWDAGEFRTEAELAAPQRSQSPLRGMPESTQPDKQVWTGGRGGGSHRPQAHQRTWGEPSLELTSDCINHSSILGQLHIPTGQEQAGRKQCPAERYDLHTGDTRREVTRQKAKHHYQQAKEQNKGKGEVKSTSWYTRPGTILGAPPVRREPGTTKYKGTGAPEEHKAGRERKPTAARCKRRNQASDRAQKHERRKKERQPWHKTGQTRRGQQQSHKRRDTTEHRKERTRDNRKKQ

SEQ ID NO: 968110 - protein, 447 aa, Homo sapiens
GKSPWGGGGKTLVTPGGCVRGGTPETPPRVAPHPEATEKTPLCVSQKKKKKKKPREREKDPIFRGEGETRRGWEKDTTPRVYTPPEGEKSPPQQGGEIRTRESGETPQKIFHTKKERGAHEERGAPCATPRGGCGERKPPPQSVARAPRERRARAMCGAVEPSERGDPPPPTPLCGGGAPINTLLSSSEEKRRTLYILAEQRLPTTTPGRKKNTSYCRQRERSSTLTLDGLMERTSMRIRSMPNPQSVSAPRSARSYTRTLRSSTRGPPAAAVRASRTPARAQRHTRAARPTTGTHKRRRRARRKRARRTRDHRRGHPDKPRSTPDADAGDRSTRTSGTGTGAQHINEKESKVDQSDDNDSAEHTNNDQQPSHPQHPAPPATTQPPQRDPKRTPLNRGTQTKRKPPTYTQYKKSNTRPQPPSPTENIKKAKTTIKPKTHTANAIRNE

SEQ ID NO: 968111 - protein, 118 aa, Homo sapiens
IKVFPSLIKSAILTKRRIWGFSPDRTTRANSPRASGVEEQWRGAKNHHRGCRFLSVVAFHLPVQPWSLALRGPQNNEPGAYTSSLPKGGEKVGRQKQREGWSQKEGSHRGVHEGAPPR

SEQ ID NO: 968112 - protein, 274 aa, Homo sapiens
PSGSAAEVEGPPSSRSPSPLSLPPSPSAGLFRVAAASLGLEFCAASRSLEPAGPLDLVWPPVTVDGGVCAGPQELRYGSTSPSQAAEMPPQGKGHGWTTVMACRMPLQGLIQPSPSPILGGPQVSKPIRPQEPGACEPLEPRPMSACPTGQAYRQKAGRQKRRHGGLANLAQVTQIHHPIQARKRHNDATHRRDRPHLNLIQEEAPRPMQQRQRQHRGPPAAPSALHAGYPTDETWQAEKTAEAGEKRDRKKEPEGRKQDKSQRTTNHSHGPKG

SEQ ID NO: 968113 - protein, 471 aa, Homo sapiens
KGADPVNWGRKTKQPSPPRRGTGWTYKLLSSPSFGSLRAPAPPLGPFLGISSFFTGGRGGHPALGRSAKKKSQMWCFSVENLPGRNNCRRETRRLFSTHPVSCAETLREICGPRGEDLRHRQTRVGVRCELSWAQKPHESSKNTSGVSLRRRGRFLSLLEEKYLSLYNSLTRGPREICVYIPEIFQYIWWPSIISRREKPPPVEGGGKTQSSARAEQQRRGGEMSLLFAKKRRSRAAGGGSLYLLHYSTRRCGHRREKIPPGGEGAPLWGGRYFLRGGHRECTNICGQPLSRRRNLSTAVMRVPPGETPHIKLAGESKTKVSTHRTHWESAQKRTEKTISLAKKGGYPPAGGGATPTKNSSRGRTKKPPKSPPGGAQIGGAVGRGPTSIYPTGFWGAIKAQPGGGVGSPPYKTTTAGRPILLTTHGGSDIIHQRVAHKYAQRLLTPYQRAEIFLLADKPSFVVDDHTDSCS

SEQ ID NO: 968114 - protein, 248 aa, Homo sapiens
MGAPIESVRCVLAEHTGGGVSLHKEAWVPTSSCGAIFAKAGKGFFSQKGDIEALSHFFVGPQPLGSPGAMCCPQREFFYQGEKGGPSFPLVLNTITQANAGGQHHNEHPGWWDQPSEEERSHRLVENIPRGGSSTHTFSCSPCVWGPTKRARTTNWGRGKDHADGRRGECQLLPTVVVTPPPCSTNTCSLSAEDNDDEGQSPQLYNEGAPLGVLKHSAGRCTEVGLYQSHKRGRHNTQTTQLSQQQTP

SEQ ID NO: 968115 - protein, 576 aa, Homo sapiens
GPIAPSARVIRGERKFMFKPKNIIIKITSGKKREISKLGISNWDYGQWWNTGYRSGSSMGYYGDMGLDIHWNTCSPAQNTYSRGGEFIEGNITERGVYTKTRVLRRHLSHNTPECVKSANVSEPCVSNKREITRETISLSHVWRTLPNKIYKETQHKDKEHQNRDLCVGHSDDVSLSPEVGVPPKGKCYIHREHIIKDIFLYQRKSRVDPRRERGGGEGPSGGDDTAIGMTTFPKSGGRDHVVEMRGFSPPNNKAVGDEAPLLWGAEEHYTFHQYTKVVIRQPPKRRSLRCGQMCGVYKINTREGTPPVVPPPEEEYHRRKMSDQQSATGVCCTPKGYLARGEEKPPRRRDNVGATQKRFIFTYKSDEVFYSPSPHKKRLVVTKRRFPEGKKSPFFGLFPPSAAEKITTKKGGPPYINYSPIKLSEEVPPNFPRTSRKKNSNSKRPKRENQTSVRGGATKKNTEGGRAVLTPRSYGGEKTSLPPTKDETHTISVRGTADEEGVSPLDTSSEITQLSKNSNGWSDVTRRELKKTQPREWKRHHTKAMAQLEENTTLTCSKTKEATKRQDQRMDATEQ

SEQ ID NO: 968116 - protein, 258 aa, Homo sapiens
VSSIIMFFRYWHHNLINRDDIFGLKNIRKIVVNEEVGDTGRYNFGQKCVFWAAIIFLVLLLVSGVIIWRPYFAPAFSIPVIRFALMLHSFAAVALIVVIMVHIYAALWVKGTITAMVEGWVTSAWAKKHHPRWYREVRKTTEKKAEMSIRIIPQDELGSSEKRTADMIPPLFVPSAQEFIQRRPRRLRELEKIILWVITWAWVGLSASPGSGAVRTIPVEMVLGLRACREGRERKARWILTSAVIRLGKCDWRVVSET

SEQ ID NO: 968117 - protein, 193 aa, Homo sapiens
MWQGTKGAISAYPGRVEAPGFKKTHLGGEGAQKERGGGPETLRVKKHTHGRVGKTSHKSRAWRNGVGDHVEGPKEMCGQPTRESQTPEKNTGLSPGGERTRNKPLRTLPEGGVGGAQRGEEKHPIREEPLIRSKMARRKPLTGELPRPEKNPGLGGTRDYEGEGINGYNPHEEERKGGSPGMCPQKQTRQRKS

SEQ ID NO: 968118 - protein, 393 aa, Homo sapiens
MRDIPLTEWCPGDIPPKRKYPRSAAEDHLALWRASHKRTNVPHERRGSATRIPRDVAPRGGPQQSIGERCTHNTKESPRGDTTQPTSARVLCAPGGAHKLWSPVGLCEAPPRCSKQEGGAGGASPTKRCARETTNTGRGGGEWADYSPHIKRGAASGLPSQTRRVTLGGQSSSHKWGRGAPPSRGREREGPPHLRTKGRGGSRERPASGAGGVCPAREGIWGPPTERKKKRWPPEEGEDDHPPREYSLVRKRNTPRQATQEGRTPLARVGDEKKCVAPRNKEETAVAKNKENYGPTCGRPHHGSGCGAADTTERTMRCWLPRHDNASETNRTRRCITLKIESNAQKRGTRNHYYDDNDREHEGSSCASPNKPQSEDGSNQSSTASRRHSYKTI

SEQ ID NO: 968119 - protein, 71 aa, Homo sapiens
RKRAEIGGPRSLVWACLAVMLGEGDCCSRRCGAQDEIYIAPSGVAKGTNQPEDMEWGDIIEKDIQWTFVIE

SEQ ID NO: 968120 - protein, 152 aa, Homo sapiens
MTTTRGIPGGARRKKTECEPPTAQGRSRRLQRPPGGGHTRSTGRERGTPSRVTPTCGPSIPVCARMKGRHHAETGGAAARRDPPEWSRKWGPRKTGNWRPPTSGGQGGPGQTNITDVGAIPRSSKDGPNYEAKCRHRGGRERPGCRPSERSA

SEQ ID NO: 968121 - protein, 262 aa, Homo sapiens
RRVQAPVGSARRGECWGCDEQAVGPGTRKSISRCLQTVIQRDFFPDVEKLQAQKEYLEAEETGDLERMRQIAIKFGSAFGQRCPGEPPQPYVTPATLETPEVHAGTGVVGKKAQAPEAEAWEDGRGWRGRREKEAVPRLDCLPEAGTRVRTIASFPARIHGGLAKAEKPGHANALGSTKAEGTVGRRGQNRYISEIPGQQKQPRPFEKQPRPNVVENLGQFQGAKKFPSLSNSKRVVPEEEPLVKERPPVQVGYISKQGAIH

SEQ ID NO: 968122 - protein, 345 aa, Homo sapiens
FVFFFKVKKPADLMARGAGGQELWGGRVRFLFTISQGFVACAGCGAVARGDVAAMCAGSGGYVGPGGLSVSDAAERWGEHSGGMGGSAHREGAGFRGPEISGIRTTRTPWPSGGRLQAQSLGGNQSGCSGKEWRGLQVIGAQGWKVWVNSSGSGKLWTQFRRTIHGKMRRQGGGPFAGGTGPSGPRQGQGALQEVLGGGNLEDERAEAESGGAHRTLNAAKVPGEPRGVGVPLMANRDRPGKLNPKFVGGLPKLVTREQSGGHPGGRHWGEHTLAGPAGWAWGTTRKSALENTHSLWGKEGHTWGRDDRHPVWKEQEQALKETATRANKEGTLTRRERKKQEKDD

SEQ ID NO: 968123 - protein, 543 aa, Homo sapiens
GKSLGGGGGKILVTPGGVAGTQEYTPGGLPSPKDKQKNLRVSKKKKKKKNSPREKTGRASEFGGGETWGSGESAPPARSTHPERRKAHQRWVIYKRREGGITRIFSPRNRERARAQRGGRVHTTPRGCVCGANTRESGRAREREGARASRGARRAPARFIPPPSRGWWPTHISLSLERRRELSLQRESPAARDPEEGGGHSETRRVVAPLRNNHLSEDACVTPSEEGGGEPICVVEYSDNYHRVCENNTPLLGDETTSHENTQRVEKTYVEQSLSPEEGGQREEQPTRGGVAVRPPRWGGGGPPPRRTRGAPPAELTTQLCGVADKQVGENKQTPMNVEIGTPPIVDVIIRVSSVPTRQRKRNDAHHTRSLSPPRGVGERPGRQNIELVGSSTDTTLWLVWWPPPKREEHPPQRVRRVKHEVKQNPPRVVVVCGEQADDQKTLRDGVWSPPPSRDSLCECTIEGGHTNTRLRRKKKHSAQEEHPINSGRGRGQAHLNTNELGAFCVEPARPQTENTKTQHTRREVYTISSCGLAEHRTDGDSK

SEQ ID NO: 968124 - protein, 476 aa, Homo sapiens
ARQSLARSPGWGARVQSGLTATSTTGGQASSPWPQPPKLAWDYEARVPPHTANFGYFIVEEWGFTICGQEWSRSRVTPGVSTVASDLPKVAWDLQGVEPLGAQKRFYTKTLKAYSSRAHRIHNFLFPELYINFPEVWFSKSPNVGKFRENNQVRGEKISIVFYSLSCEVVFSCKGGPGCDPQTSRGLSLPQKRGYTNLVAIHKWYSRGEQSIRGYQSLANVSSGALFRERALSRRIIGGDGRSVHIRRIHFISTHGEHVGSGVFPKRHYSRISIRIKLSGGQFIFPKGQQVTTTLIEAPINCGGHTDIVGVMNGFIRPIPTQTGGNTDIWILQYNSWAPQRKFDPLETRFRVVGARGIHLGRENLCCGLKEHHESHGHQKRDSNTTMESEPSDATTDDTRHTPESGRWGVNHERIITPLVEGTQMKPPEEMKRKSTNRPTTEDSFVTRTQASNMNRRDRRSEPNKQHNERAARAPL

SEQ ID NO: 968125 - protein, 77 aa, Homo sapiens
SSLVCSHKTVWWSLHSNANEIGAITRIRDLPWEINPLSSCSLLHEKDPPTISAPQTNQPKEHLTNFKSDLLSLAAED

SEQ ID NO: 968126 - protein, 443 aa, Homo sapiens
MCHLVAYRARPCVKESLMWDKSLCGESSIFTECGLHSVRALCGENVWEALSLFSRETPRRVFMRGHKQRRAGGTLSHVCGPTQRGASQKCCCEDVCPLWAQRGHYLRVGGPPSLFYICFLAVRAHLQRRNIFVCGLSFSPHKGGLPYILYLSLFLSFGEGALYRNTRGLIPCVPHHVDSCGGGINPVQAAVEGHHVGLENAVKYNIVALREDNSGEEQRAEKNFLLVSQGKGGRTPFPQKVQVGGSYKPPKFLVGSSARKGGDPGPQGTFSVGVGIKRHFPKDTQRRGGTCYPPQRKGEINWGPLECELPEQKEGRYTKGGVSTTNTRLVVKGAQKNAGDQYFERVEKYPPPGSTGARKKGGPTKWEKEDKRAKEEAAKRGVARRTPNTEDKLRERGESTNGSGRTNQPTTTGDRDSIATTEDPYSEREMRNYRLRKGLEQRA

SEQ ID NO: 968127 - protein, 200 aa, Homo sapiens
VAPERRRDANDEAAVIGGVGSICCHSSRGRSQALASKITDWTEYAVERTMTWALQVQHLQLLCCEVLRLGRGYLYDSFHSRQTIGHCVLAMASSVQNGYRDCSPVIANVSGHTVVLSPSQGWLFATFTLGNNYFTWSQEDGPVVIGVYQLQLDQGGILAQREVGQAILRLIFWSWAGFGVMTLPSIGYPPAMWYSSQEEI

SEQ ID NO: 968128 - protein, 293 aa, Homo sapiens
MAPPNARPATLGGCGPDARPGSELSLPMEVFASRSVIPGPRPAGSSPRLHRQWAKWTTRSSVRLSIGDALRSQYGSGMPPRRPCDRAESGPARYWDLGSTRKHAEKAPASLRTQHGCGTAGEYPVCRGYIQNARSGRPGLIDSRSSRGHGSGCGLVEEDLSTCAAISSRCCYQAKYALRTARRYTRLLRRRDLRALDRVRTWRAQSYREQLMWGRRRPKCWTVISERSNNLVAATVPVYSGLRWDYRAKKPRDIDDRLYQGAQGEPHRKKRDSKLRTSVAWIVMNPIEKPTRG

SEQ ID NO: 968129 - protein, 172 aa, Homo sapiens
MAPRWTTILKPRVNSIPSRIQREIEALKVYDFECGPRKCNTCYGAEMPNRIVSRSSLMLAPLKPCSPATVGSIPGTSRSPLRSVTYIFLLVSPVLCTSQPTLVAGGRRHPLPRNHPPGRRASPTDAPLLLNTRHAPVRRSIAATPALALLCSTRTPTDQFARLLHRSSSHSF

SEQ ID NO: 968130 - protein, 181 aa, Homo sapiens
MSSPYLKGDTGPKWLHHDLFLIWLNFSRHSQISTSTATFEKHREHLPRGERRLGVKQREIIPQMVLVTMVPNEVRRFLAPDLPVPHDLWTPESRSISDSGDQLEESLQGLKENKTGGDGHTHERDQPAKVKRSLLWSRRRAHIKKNKERRDTQEAERRPATRTRAAHHKRRRHPTHPTTPH

SEQ ID NO: 968131 - protein, 190 aa, Homo sapiens
AREARALEEANPGRNEIHQKRQHDSGQKQHDAAAYGLLDEVHPARWTDLHWQLQRLVEQDDMNCRYLCDCDECQTEIKSKRNSQTRATKGKKAQSSVWCVLRRGESGLNDSSRDLLPKILVLLEFPVAGDCRGTQGSGRAAGRGIPVWGSHAPGSCRILLGQSVGLCGPSQQVMSPQGRGTVAAAAAAAH

SEQ ID NO: 968132 - protein, 52 aa, Homo sapiens
MVIRGVMTLKRGPGPLAGQERGQTLSISLSKTFMGDRGVGLGKARMQGAATN

SEQ ID NO: 968133 - protein, 146 aa, Homo sapiens
MTVTRKQQGFAKVLLIMHFQGHDVTYRYLRAYLLILYFGDGNQSTSLSSKHCQSPRSPDFASSFEDLSCDSSPERCVLVTPVRRTFLLLSCGQRSSLCCQCGPRLGQAGGWLLKQAHRGKDRPFVVRGTTSLVGVMPRRRLDPTTK

SEQ ID NO: 968134 - protein, 134 aa, Homo sapiens
MWRTRYADGTRIITKSHLDHIQEHGYVLSHIRILSAGKQERGGITFLCAPWRQFSSIPIYCASYHPNDSFDSSILKQEPKPRRFMAVVTSQTDDLKEGMHEVDRAQHSHSAPPEAQRKGEPLYDNTEIEQTIIL

SEQ ID NO: 968135 - protein, 241 aa, Homo sapiens
RLGTRLGFNRPREGSAGRPEGAGRCGRRARGPAERVRAPGNADSRGVNPGRGPASPFWDLSLPWDLWRRPQTMLLGRLTSQLLRAVPWAGVRRLGPSLECWAAGLRAPLQHIAGGQVGRLSPSQGGPAGAGGDAGPQEDVRQPLESWSRAGVFLCQTCEYRESGGTVVSPAKIIPVCDAANIGEGAEQGDEGVADAPQIQVQKRAEDAAAEDEPHKYRKLVKEDAGSCGGRSREGRLETPR

SEQ ID NO: 968136 - protein, 465 aa, Homo sapiens
RKNSWGGGGENSFDPGEGWAGNTRESPQRAPTASEDNKKNLVVVSPKKKKKKKTPHERKRESATDFPGGDDEHGRVWEKHPHPGAHPPQEEKHRTPEGGENNNREEERTQKYSHKNKRARTGEEAALGHNTGGCGERNPTQEWGAPQKEARRAYVSAGRHEGPPPPRGGGPHTSLSLYEERALHTQRYPPEKPHEGGARTYERGAPPRETRPSERAVRPVWGAWRHMWARECAHTRGRAEKRARSVSHPRSCRASVQQRRGEKYPPQGGAQETHPRGGAVPPRGGVPPPTPPGGAPRCAPTCVLRLTNCAQQTNHNVGRPHRARNTVTKPAQKHKIISPPQTYPHGWGGGQDKNKMERAADKPTRVCGPQEKATTTHYSRIDSEKTPPYGGLCSREAGLTTRRGGWLTPHENSYVTKVATNKSTAAKAPCKKNPHNSEGLRGGLNQQIAVWGRPHHKPNNNTGRN

SEQ ID NO: 968137 - protein, 167 aa, Homo sapiens
MQSISMLLRGDLFEEPMLLSEALDSRIRRYAPCESKEEQAGYAEMSSLRVCVDYQIASLNADMELYIEVMRRSRYVLLLCEQHCIVGSSRMSWRLVRVALRIPADYRCVLHFNPTLCTTLRRADMSSSLNWCPVMEYSLHRRASYPRMRLLGMREKAAKLYVPPGLV

SEQ ID NO: 968138 - protein, 148 aa, Homo sapiens
MYARWHGDRLTPDRECADLNPSQHRVSRLITQRRIEAMHLGRRSDINRPTFPDHLVPTIGASQHMLTVEAPKLRKIPLTQLPPRPTWHVGGAIQYGLSTYGRIQSLTPIVPDSINIPTFQTSMPSYVTTTNHSELQTFPHRNISVDSP

SEQ ID NO: 968139 - protein, 135 aa, Homo sapiens
MKPGGAKKKTRIQQGAPTKKREAAGNPALNTHIKREATTYHRSHEGKQEYHREKTHKKWTDIHQQKKRVLENTRRRKVLSEPKTYHAGKKQTSKKQRMAQKNTNHHNNIATRNEKNSKKKETEETHTENKRRRLT

SEQ ID NO: 968140 - protein, 144 aa, Homo sapiens
GGDRDIVQTRTCLPIRWIGCILSLLLHGTDFSYSLDRTNYKLMDSSKRPFLAMPTLLLQPHSLGARKHWSITHLVSLTCFPIVSSSPPTCVPAVNVSGGNAQRANAQRQRHYRAYNRLCQSAIPYSPCIVYQRIQCSLLLLVSM

SEQ ID NO: 968141 - protein, 122 aa, Homo sapiens
CSLLLQLLLEGNDLRMSHQKKHPGSPSSAAVSPATEDEEEPSLCAASYFKLLAGGEGLTDVSPETTPGAPVFRCTFPRDQRNLLATPRTRNGHFAKGWGDTPIMKNQKKWAVERTRTIQGTH

SEQ ID NO: 968142 - protein, 184 aa, Homo sapiens
MTHHTQMTTNYDGGTYIPRPDDDNAPAGNDRTPNVGPPTERKKAFIAMERPHKPIFVSQTHENGGSNHLSAAAGRHDPSIDERRRVDVPNDRYSLPLLDASRLHGDQDERNTAVGRESNTPPPLLSIAETSVAIHDCAPNYNNEEPTQTPPASTKMTQHALPRKPPQLRQSTTSARCSTATQTN

SEQ ID NO: 968143 - protein, 163 aa, Homo sapiens
LVHARSHAVPKVRWQSVQVFGRKKTAAAVAHCTTREWSQFKVNGRSLVDDGAAHSYTYKLLEPVRPSRQGERFAWCRTSGVRVKGGGHGGPQIDAIRSVQSPKPWWPITMKYVDEASKKGDHKTSSSEYRPGLLLGSMTLVVCRVQKSLEALGARARYQKSYR

SEQ ID NO: 968144 - protein, 73 aa, Homo sapiens
WQKSQFFFYLVKLCHKSSSVCANVVHLCHNFAPGVCSGVSQQTEVLWPFSENRGQGEVCTWGVVRAFAWRGIA

SEQ ID NO: 968145 - protein, 320 aa, Homo sapiens
MRLGASLGVNRQRGSLVCYGGIICILHMASARPMSARQVILSPPALDEDSRRLMPSPPDPGRDLPPFEDESEGLLGTEGPLEGRRGWRGAHGDGMERDYRAIPELDAYEAEGLALELSEDRKELTASSEGGTRTRAMRQREREAGRGLGRCAGGSCMTGMTEDEERPDRKRRQVERATEDGRGRHAGDDRRRIEEPGPISNRAPLSRQWGEHGGPRLRHPPPVPRISCALTSTGPAHKRSLKATALNRTLCNRHPGRARCQNTPDTRPQRPTQPRQPSSLQARRTRADPRPRARNGPRHVPTTPTQQHTESTALPPPPTM

SEQ ID NO: 968146 - protein, 352 aa, Homo sapiens
QVGFYYPCSTWGESSATDLCYGGGYKVMWRAPVPGGFSGYTFRGTCRASGECKCPFKRKVLCLEGGVITAAGVITFSVEAPGHTGCPPGGRSHKCLSRVQSARGVLQAENSLLKHREKRKVCGSAECASLKYAPPDCAREKTPEGALKRGAHTKLWCCAQCGREKYSHEGAQEFTREAPHKRRHQRRRGGPQKGEQETKRREGEYQHATGGISLRDQKGTQAAHLRGLSSQQEGDQHNTSKGVLCAPQQKVLCSPTEERFLATSAGGESLPRQKRGGGTHVASLLQFSRGVDNLDNKEKIFPTRRGVSSTFYFPPKVLRIFHNAVVVDFGLPKALRFPTGVRPQPAAFRCFG

SEQ ID NO: 968147 - protein, 358 aa, Homo sapiens
MCEKSLPQRKCGVPGGLEHSVAWAVGLFPTKNISTARRAWSYTTERCHETPSPKRHEGGPTKRGGPEKSSRVYTSQLTSPRVDTKRGGGADSLISRVLHKCAKGGGGLYSRGVGSFYREGARGERETLSPGGPSGGGGKLSQYRESAEKAAGGEEISRPHTRGAGRAEKTARDPGAIENEAKTTKGGGGLPKGWGAPMGLPGEKSLGKGGAQESQREETALSRLWGTKTPKKNAWGRRDTTTQKQACRRGPSLSACGQGSPSGVGRQLRPKESIVPREIKILSLPRGVRTNTEKPPGNVCSTTRGGKEESHRPLWFPRRQHKNNQHTHGETNPVGGPERAEDDAEESGVTDDQSKWET

SEQ ID NO: 968148 - protein, 120 aa, Homo sapiens
MAVSPASPQVLRTYNHTTVINDPLLYSSAHNDTPTTLPRGLTPDAAPPTTYFIHAARPKNPSGRNPAHNPQPLHQLDRPASPRSETNKRTDYTSTPTANSTDASTRDSAKTPKRKNHIHR

SEQ ID NO: 968149 - protein, 165 aa, Homo sapiens
MAVLGLYRGLSSLLYGSIPKCGVTVFWNVLSSISKHMRDAQGTAGRARVWPAVRPGRWRVPSAVVVVLPHGDHHSEVHPPNMNSRKAQVHEDSSTGVREIVPGTRGLKGTYQGLTATVLKQGSNRPSASIVMTPCATGTEGTTPKVHESSDHWGPRSYCRRTQVF

SEQ ID NO: 968150 - protein, 178 aa, Homo sapiens
LGCVSVTFSIRRAPSHPPALPHLSQEGTKRDNEIHDCELRVHRTDSRHGPQLASVRVGWPVVGICVRGCGPWAAPSVCGGRRAVALRDLLCVALAPAGLRHLCAWRWPAGPGRSACVALRTFYEPGAIPGIDPDYLKPDSEQTARGLKLSVYVHVNVIIVLAEVQMIFMMVNKRRCMP

SEQ ID NO: 968151 - protein, 274 aa, Homo sapiens
SPAPPPSAAAPMHTATPSPVPGTCYYQAPCPYQISSTDPGCSKQGACHDTRSPASMAPGNGHPGCRMSPHGETLPRRHDRSTMDTEKHRRKNQAAFYTQHADMTSHDQHRRCTPHALGRMIHTSFHEDHLLPRNGETDARVPYPTKSFTQTSKRARMIDRRKSNGIQHKGRKKDPTTCDNEAKRKTSDRTHPYPNHPNDAHLRTLAAPLDTTEKTRRAQRQHQTVTPPAKTQSTHPVSITAPLDQTIAQEHQTKTWGTPNQTDIDVATTNTDTL

SEQ ID NO: 968152 - protein, 235 aa, Homo sapiens
MTVDHLNNAAYGSAGDTVTSDAHALAMDYSESGTFGNAWQKLRVILSIIDQDYMPLTRFEFDWFRISPTTLPSGEARERRPRGPSDTFLGDLFGHHPHIAHPLVLPQQRPPGTRATTALNHGTAAQGQAELGTIPEAAGLANAPTASSDRCSLRHLRLQHGRTPWDYHSGTPVRHSPYTNNGPSSHGAPPGRGPINTPARNLWSPELRAPKHSPKHAAKYAAGTNTQGHGRTPNP

SEQ ID NO: 968153 - protein, 332 aa, Homo sapiens
MGRTSVWCVPRTLALGYATCLRPISRKRLPMNDGKPAEVLVLDVVRASRQDTKDSRSGGSSHPEKVSCSSDDKTCVTVPVDPVHGCAVTARLRETYIRVELLAELRSGRDKKEPTRVTASRCAGVMRLLLHETAERAKGNAQGHMSEFIRDKELMIEEDYAKNLAKLYSGTPWLHRRKAPWGEAWAQCERRSLAGTERRQFTLRVLLAKLAQRRWRQRLMQFPENVKTRTMEPRCDQARLGRASASSAPADIASEEKGPERPTQTGQKGPGDMTKAARRNIKAEHKEPSTDLKNGGAKVPHRREKTTCAMGSQHSAGQRSRTDAPPKGTRRG

SEQ ID NO: 968154 - protein, 137 aa, Homo sapiens
MSGFFACGRVGAMVLQFFSFSHADDFAELSIKDAVITVPVFFDQAERLRLCCRLLVWLARKWCSVIMSNIATGLRYVCLPRKDFKHAEYHVYDMGSGPYALGASQLGSTPGLGFPCIRGVPPLGPGRLTRGSTADPV

SEQ ID NO: 968155 - protein, 214 aa, Homo sapiens
SKSKSHLWEFTDNKWKGRFPPPLKHAILFALRAHTGIKTPFRLSPEGSTPGGWGGGEGVLLRQAGGAGDRREDCAPSPSGSQSLSRGTGCWPPGPGGGLTNRAHATMSRQEVARKRWPWCPLAGAGGHKGAMLVATGGSKGKYSAVYTTGGLERGYLFPKAVPGGQERGEVTVGTAVPGQVQASVPPEGAQELELRYSWGGMMVRMYRKNVMMS

SEQ ID NO: 968156 - protein, 104 aa, Homo sapiens
MRDPYISADPYGVHVAHETVMYASRRRNYMIKTQYYRGYEQLKICATENRRWWTFMEPLWVLQGSTESPGIHTDSPVKSSNEEEREPHMGGESACQSVQFAHTN

SEQ ID NO: 968157 - protein, 97 aa, Homo sapiens
MAQKHGPEQPALGVMKEPSAHENKRLQITRIEPGAPELHQSLTSTKWTRTYEDENANAEDRYHLTRRNKDGLESVTNVGETKANEQQTGETRRTPLA

SEQ ID NO: 968158 - protein, 270 aa, Homo sapiens
MSRDSAPLAHTCGGAVSDTPPLSFLSRPFCATLCHCVCHLSPPEPSDVPVPRCVLSPRRHLFTQHTLCCARRVFCAAPCVSPPTLSTQRLSEWTPPPSTVSPHRSVVSPLPLVRAGHPSATFPVPTCGAPPSPLWCGAPGYSHVALSIGTPPFRTRRSPRVAPYLSTPAHPLATPPPLSLTQRTSVLPPSCFPPLLWPTFRWAFTQGGDLLTFLPGATPLGRFRGHPPTPRGDPSALPPFFGVAPGEHSPFLAPSSASPAQPHAGDGPRF

SEQ ID NO: 968159 - protein, 162 aa, Homo sapiens
MAGLGGGRREWGGRRGWPSPRAPQPTPGWPHAPRATVVPAAAVAQPLEPGPGPPERAGGGGAARWVRLNVGGTYFVTTRQTLGREPKSFLCRLCCQEDPELDSDKDEKDAYLIDTGTPPTLVLSSNIPPPTGKTHSSTKRELATNHRSARHRNAQLSQTLDS

SEQ ID NO: 968160 - protein, 136 aa, Homo sapiens
MQGAPRIESRSSVAVYAGYPRSSSSNLILDDESNRHSVDNGVIMLRLILMALTLFSGFAQASVLLQQPITLDTGSGELFGSLLLPRSDAPVPVVLIVSGSGPTDRDGNNPDGGRTDSLKRLAGVLASHNIASVRFD

SEQ ID NO: 968161 - protein, 185 aa, Homo sapiens
MGHEQTLDAEEELGGIRKKRPVCRATKLVELPGIVYLGHIPPRFRPLHVRNLLSAYGEVGRVFFQAEDRFVRRKKKAGAAAGGKKRSYSQGLQRRDGWTFRDKAAYAKDAVGGQFYMKSAYVGGPSGASPLYRPWIFGESRHSVLCNPFFDAVIPDLSARHPPDPFESGQGLAAGAGAFEVSRSG

SEQ ID NO: 968162 - protein, 361 aa, Homo sapiens
MTPKLQALIFFRVFFGFHCSHVSSLLLVSLRPIHNPAFLLAALSVASFGPCPWWSFSLGKDVPDSLMVTELATVAELICQHIKTVGRCTFNSTRCMDIGLALERAELAWVSLLSVVSACYVFRSRRAVQSLCSIVSYASYDSISRAEGRRLHIIIAHPETSFAELFGDAQSVDRVSLRGRPLYLYAHLIARVRFRGRMLARVGGGWLSVDSACRALGLVRGLLSLAHSVTAFQRSDSILIIPGLRVKLVVLGGPQAADLGLDTLRFHMDTRWGRNMRTRHGYPPRKRTLNIRIENAVRNNLLDKTQLLRDKGVHCLIDTFPYCPRKKDQITTNGKSKTPLVSDPQRNNREHRFDEYHYKNI

SEQ ID NO: 968163 - protein, 385 aa, Homo sapiens
SPGGRRAVFYIGPPPPLCGAPPGGGPPRGGVWDTQVGAPRGGGRPPMCVFSWGDTHTPPAGPPLWGFFSSLFSIWGAPPHSPRRLLRLSLSLSPARVGAPRAVWVGAPARWRASLSLSVGGGLRPHLLLPPRAVRVVSHACSARARGCVGGWCRHTLYLSAARPTSVCLSPLARVCVMGVSLSRDSARVCVCGGGVVVSPLRARCVSLSLCAAVRGGVGLYLTALCVCWLCVCRATHTQCVVSHLRTPLVWGALCGACERASMTTLSLCVAHIHSQHTHNTYIITQHEGGGGARASHISFSLVSRGGVVLSLNHTTSVLRGVVVDVLLFLTNAVGRTLLASHLSDSPPSSPRKLDLFCAGRSAPTTCLPAPLPRSGGGGDPPLGG

SEQ ID NO: 968164 - protein, 108 aa, Homo sapiens
MPQGSLLTGTVRLSASPGPGLICDQVLPRCGLLDHASSHEAKAPVIYPQQVASGAMRFPRTARTSIAFEHAARIPTAGSLPEGAIPAKNPGHQACSKRASTVRGKGVA

SEQ ID NO: 968165 - protein, 111 aa, Homo sapiens
MCRHQSCREGRLLFITPTTKDQFSCWDTHSWSCWTAARFYTEATSFAMALPGPPCLAGPCVDHADHTTRKDGRWSLGRPPAWGSLYSIERTQRISILSAFPPPASTRPEYE

SEQ ID NO: 968166 - protein, 231 aa, Homo sapiens
MREQYDRMKDEVNLQFLIDSDCTTSYRLDRLVRLPQYKRIIYTMKKLLPIGLFTNSHLTKSSSDFDVQRGISWPLILTTLLELFTKLLIYTNNKPLHGPPPIELPKSAIIQAPHRSVNNTCPHDPYTLLRPFLLLRYHSYLHPFTKQLTDPLTIQILNEAHYISSSSLRNTYRVPNYTSTHITTSNLTHALNYTPLSSNHSHISLTPQPFLPSSPTICTTSNHLTSSSTYH

SEQ ID NO: 968167 - protein, 143 aa, Homo sapiens
MFNRQRRAAVTRLSVLCRKPPRLVLQYAVSFPPPLIIFVRDNLFDHPPGEGVCQLLSVRSITAYSPMSYDIVVVECSPCVVRVSWWFVIIENAINTMTNGGLARRQQAKNDVFKQITAEEALREKRERKQGEEGRQLRLGSLI

SEQ ID NO: 968168 - protein, 130 aa, Homo sapiens
WLKKLKGVFLPLASRGKILGIFFFPLIMLDAIREYQQKAGFALFSHNIKKFFHLNKNNTKGGAHPNKDSPKTGPHPLSTDTPILICTDGRLLIMESLSSPDALATAAAPSCTTPRPPCESEREDQVSNRW

SEQ ID NO: 968169 - protein, 163 aa, Homo sapiens
MACLIPRAVHSHGLASRIDAIGSPRNKNSTISGLKDVIISAPLTKTSRNLRKSNQVMARIGAVVREKVQGTLWIRLGSSISPARHRGTSCQQEYVVALFRWPRERLFPWSMRGALGYWVPGLLETDGEHGVILPTFLADITPADFNVTASIGALGGMPQLGTR

SEQ ID NO: 968170 - protein, 421 aa, Homo sapiens
MAAMFPKGNINSSYAKHPDGLRKTHVLSVPLSVHHVRGNPHYVSFKKHSWLYKKTFPLKEALQRRGVVGFTLSGGGPGEEIPAGLSQWAPSHVWEAHVGVAAFPPYGPVPQGASVFQGVCSLKMGCVQKEIVREGYTRECGLLFTGLYHLFGVRSAREICATPHANVSSWGSYRGSTSFSTPCSLPGTPSLSLPPSLLCGGDKLWVWTGLWGIPPIRSVFPPRGWAPRGPTCGPPVPLKIFVWARKYEGSYRESTRVRAPGGPPLLEVVASPRKYCCRQGDKNEAPPISSRRGHYLRTYKINCRFYPPINREGTHPPYDDTTASTLNYKGPPQCMDDPDNNPPSECPKRTSLFEQRDTNSLAQRTERLVGRAAPHINSAPPSNETVDRRPKCEPPTEYVQKESAEGANSRALTILACRHTA

SEQ ID NO: 968171 - protein, 425 aa, Homo sapiens
MEEQLDNETKERQAACKQVRRTEKKLKDVLLHGVMTDAGVNCLMQYNGPCADNGITLPECMLNAGSLEEAWMQDVPMLGQLPPDRKPCMLRRWTDRHVETGLSAIETCESHSLLYHEQRLKCCSGDPARFVSADHATRKLAPVAQVPPVRDCALRNRTHAHRHGQTHGPGALHAPTHPMPGQSDDPSYIDQHMQGPLQKLVNGTQPPRTNATRTYQRFTHSHLARTKAPGPFLQTQAASYMAETAYDAIHLSLHNHIDTITYNFTTPLTTIQTTNIIPNYNITKTKTESNETLLFTTNKTNPTHKNYPLHPYDPDLTRKNNNGENEEHDTTHRSQLTTVNAINWNRPEQRAIRGPDIQLRQEMAFNPDAPPKAARTDGDANDRLVSISEREHTSQQPPPGHAKDTDGSGRHKEDERAGDGIEIHD

SEQ ID NO: 968172 - protein, 241 aa, Homo sapiens
AEPRKKKWTLSLKNLRPEDSGKYTCRVSNLRAPFNATVQGGCDPVGPVGNARAHRHAPRESRQVDFEVWTTLLPVAKGAQRAVNAGDPVAEARGVRSAEGLPLKSTIDVGGQKICECVPHGVTVVVACPYAVSIASHKLSRSTLCPPRDRCGAVYICLGANDHGCYELPASAFLTVLPDPKPPGSPVASSSSGTEPAVARGHSAIPAGAVFILVHPAPVGLPGQKKRAPRAGPSLLGTAAG

SEQ ID NO: 968173 - protein, 325 aa, Homo sapiens
GWYQLLIDDDSRPLLNALVVGGAQSEMGRKGMLEGCPVMSVGASKLGEGRVRPRAHSRRPVTRPKWRAAGPAAGTCPGGLTLTHTRTETQGRLHNSNQCKMTWAQLISEGRGGNRVVEAWNLSGKNGKDRKAQNTRETDRLDTHDHTRDVCVARRRSLPAWRSPALGIDVRGAVGSTLSAAGVVAPVNDGSSPSAGVVSLAGRRLLVPDGRPRMIGADEVPGPLSSTFEKPDPELRLVPWFCNRARLLPLPQAKQGSAPGSKAPGLILGEAPIPPSCGSGSPEGRYWAPRGQAHTARSFAPPTQVSEAAPPCRAQTVVRCPRTGS

SEQ ID NO: 968174 - protein, 104 aa, Homo sapiens
GAVHVEPVALQVAEEDLGARHVGSPSRTTAGADTSSISLLHAMRRLWKLYTFILSERILIYTHVEETRPQMGRLEAHHPRNETCTMVGSAAERNIPHNSPQRNT

SEQ ID NO: 968175 - protein, 104 aa, Homo sapiens
MGLPSIGSIRTDYQTSPSRTLPRVGELVESVARRRSELLFDEARTTQEEVNRPRSTKIARALGCLICGRYDCAPKYSRYLRQRSWETSGSQYDELVRKNREELD

SEQ ID NO: 968176 - protein, 148 aa, Homo sapiens
VFFIYIFKFMSLINSYSYWSPGLVRTSKSDNYLATINGAGAKWILPENTPAPLFIKSALAVSTLSPGLARYPCLAPAHIRIALFPRRNRGENLVTTQPWVRGERRRQEGGEGASGEKTEAARGMGKVEKDCQRLMEDATKDAQLIRLE

SEQ ID NO: 968177 - protein, 218 aa, Homo sapiens
YGGRVGGPTPDFRTTLAYFLPHSRLPSSFPAAWLIGYLPRVACERQAKAWQGLSGIPMVPTAHQDSSARSSQTAPRAFAPVLEQSCISDDASRLAPTCPSRALSTWIARQSLSLSPSCGFLGSPDVSSLTPDSPKYCFGERARIVDARDCKARPHVSDIPKNISFPKLSPILEIAFLTQLLGLAKEMGKGASTYGRNRKSSEALEACAKGTQRVLGSG

SEQ ID NO: 968178 - protein, 72 aa, Homo sapiens
CSRVSVPRSFTMVSPNLIYLLSACLSAAFLLVRILPALCYGLPTQREDGIPCDFDWREVEILMFRLVPLMMM

SEQ ID NO: 968179 - protein, 320 aa, Homo sapiens
MREAPLTVERGAPSGVTTSCCCCKGGGDHHELCVLRQRTFVAAKNTSVVGVFPPHKSSIRPLLLLARPTGGGRQPRQCWGDDNVLLLASPKMSSCCLLWRRPPQKEAMMFGGEGWWGHQTPLPLLLGRTTTSLFITTTPPTNEKAAGERLDGWRPPQSFVVDKDVSPPDRKKYRRSTNKRPTMNWLWPLFGGEQPPPCGGRLPAGDRLVVTAQVVHTSARRRILPCRDIHSSIGQPTSCVGAPINNNTFPFFPKKKTTPVINKYIPQFYVIRRQHRRGGVRPPPPQMGGKKYSSTKHLSLTKSVENNTSRFADEKNIFYR

SEQ ID NO: 968180 - protein, 212 aa, Homo sapiens
MVRGSGGQTLAKTEEAAAGTGFPLPPWLSLAPKPGPTRPGRGTGGNVASPGPGRLGHGLSEPGPGPQQGWSWRTGELAPQSSAATRLRGHGLGTPRLPKLAEGRIPVLNAKPILSGSSSPESILLRIVRAHLRNASSTFSPVRALVSRNISSFLLGKREASRKVTSRSGSQVLLVATEDDHDVGAGQGAGIRRKAPLSCLSSGGDVVPGVRA

SEQ ID NO: 968181 - protein, 184 aa, Homo sapiens
MASVRPASAEAMILSPPALSEAPGRTDALTSRPVRDLPPFEDESEGLLGREGPLEEEEDGEELIGDGMEGDYRAIPELDLPMRPRDWARDDRGAVEELEGQSEEIVAWKRRHAGGRDREAGRGAGPMRRGLRYEQVRDRGRQETLCAASVRTGGCGGTEETVQEDKEDDCEELENLGDLQRALC

SEQ ID NO: 968182 - protein, 311 aa, Homo sapiens
IPNAYRNEKFYAIYNYVIMAPNVCEAPYGAYYTPFGMTGLVEYSFTKAPKTLTSTHHTLYYPPALGPYEPLYQYRSFVTHEPRTSRVTLDTTALEDARALKDCAHRILSATLYVLCPCTSMTSVSCREAMDSPCLPLLEYGAGDMLHAKDKAPTQHNLPTNLKSCDTLKRGYQYALAHAYLVSASQSPRRTFPLDTHSHHTLSVKQTSGGSIAYSNLAYAQAISVSTMCDHTSWTLSSKTRYERFNRITLATSAYWRSIETRSDGLTESRCAETATFVLITRYDERYLIAGHHKAASPNIVGLEMGIVNVV

SEQ ID NO: 968183 - protein, 174 aa, Homo sapiens
MVTLPCSHCYELIGTDSSVYLVALDPVGGICAYVSVSAAIAKVACGCESLLDYFSELTSPSASDRSGDAGPCITSRTRHINHTLEWHSHVRAYEPELVCTPMIRNIGFAQISALVLYVGIPDPKGYLNLRALDKEVVPQGGPKRRGKLTYIRIDYTRRVEAFEHSGQLERQYTE

SEQ ID NO: 968184 - protein, 146 aa, Homo sapiens
MAARVIRRILSYPGRRITVQTFKEPGVAMCQGLPGIGRESMTSWLGVVSGGSMCLRWLSVLPSIFLANWRCLGNSQWTGSFHMAYKSGIVRVCRCHPRTSNANQLEDLPGEQIAYAHERVVATIPLETPFNADYSQTPISFWDPIY

SEQ ID NO: 968185 - protein, 250 aa, Homo sapiens
IFYYFLSLYFYCTENAASSLGQYHLFIDPRKGVGTLHAAPSPTPGSIWQDWGREPLRGWRSTPSKHLGSCAAAEAVRRCGVSSELYVQVRYPERLASRDARAHRVYSRYARPGCPCAVGLGPSRACAQQVRLPGAPDLPQDPFGSSSRVALSPVSSADVNTLTVEGPVRLCGQLGAREAVSSRAQPESPVSSYDPAYASPSELQGDCCRGSRKAKPGPGTREQRAHDNASTHHARVDPRAPTNAPQVKAK

SEQ ID NO: 968186 - protein, 124 aa, Homo sapiens
RPTPESRAGTQSMTPQLLLALCPLGQLPALQWKERAPSELLTLPRVQVRDAVLEYPIAVDCSWTLPAVLQTPPSPDVLHCHVQAPAQCAARGHSWPCLQPRHARHTAPPAAPSRDCYPKALAFP

SEQ ID NO: 968187 - protein, 376 aa, Homo sapiens
IFCILLLKYVVLLIPPHNKNLTQAPHFFPSSPFPHTPSRNKVLQGFPCRHVAICGGVSMWVSKWWKPPRAFGGKKMGGGLEGMSQEGLIMEGPWRTWRHKAELQMLLIIWDTVGTQNSYPGCRHWRQVPIALSRKALGDGGIPGTILTTPPGTMVVTWATGCSHARVTLVAIQKLPLRDTFIFSTGFIHFFWEGGMSPSMCSQPSGASTESLSPDGHSNARIWNIQSTRTPWRHLFTPNSLGHTGHNSVTHEGTPAERATRPPTKTTPTSRGAFRGHHRRHNTREETTPRGKPHTRRAPHLVRQGGHPKRDRPCADNNTPSMLKRAHSHDARRTNNTMRAVNRATNDRRDDNTGKTNNSRSIGNYNYIFFIYVHRA

SEQ ID NO: 968188 - protein, 83 aa, Homo sapiens
AYRLFYVDGSSHSWVSPGMSVCESDSFNELSCNAKKKRSQRATNSAPRSDNTAQSVFAIGSLHVTAMQESFNDEGHSTTALDS

SEQ ID NO: 968189 - protein, 285 aa, Homo sapiens
MLLPGGGPLLESERPNLYCVEKRRVPPTKGTSLLKNKHGAGARDTKQTAARQVGSTKTEGSGLLVVRRTTPRLGGGEQKLEAPKTTTSETDRSDATADGGATTKLDLGGAEWEECTTTKRLVTRVDRRPKKNSELPKKDQLMPDTAYHHHRRRRPRYQPHARTSNHQPPDLHQTHRTEHTTTRKRRRREADLGSLEKRQTGRRVVATDRAQAQGARRSGTRGGRGPTGGGAARRRANAEQRAGQTHTSNEQAENQRKAGRTERHDKGSRRGSEKRATGASEAGKG

SEQ ID NO: 968190 - protein, 226 aa, Homo sapiens
MAPRYETLRATTTPNSSEGATRKSTQLRRKNDLLTHRPDHLEQSGPRLHSPTSILLQRKYTRASRRSSTRNTPVVVSTLGHGKRKTQTHTAQQTERHTRQHSKTIRSHTTRTPERENETTPTQNHQTRKQPWSSPGLSNNTNPGRDHNVARSRRQPQNQTHDARTNPHRPYDTSRERQHPKHSSNNSRATKKTTRRTRNNTNKQDKRSSARKKDKKRNTKRHNGTR

SEQ ID NO: 968191 - protein, 193 aa, Homo sapiens
MAANENHEMTNTSGDLFPRVIPPKYFRRDRVRTTGTLRRQFSASHAPTNATPRQDKRHHRRPSTATPKRGQQPQHQPTRVGGHQKEGRTTTRHTPGVTPRSTTSWRPNQNTPGRTKSTSRNRGIGRRRNTRRQAENRIRHTRRRIKGTNEQAGATETERTPRPAARRNKSTAKTTQEDSEKDENDSKGDGRKS

SEQ ID NO: 968192 - protein, 125 aa, Homo sapiens
MHEAGKRPTLAQRPPHTHEGNGRRTIDAHTRHQGTQPRPPGRPPHHTQAAEADHQRSAGSERNGAGDIAEQYERTQAETSRTRQRSRQQRHQPAHARSAAATHNSTDPSASQAVSQQIREETQNR

SEQ ID NO: 968193 - protein, 206 aa, Homo sapiens
MGPSKVGLTDMLVTIGSLESMYVERVVFSADTGSGQKERKRKTRSEKSRSSLSPGTEVDNTMKIGPIYPYAWHWARARHQSMLPTFVRVFVWILPRVEQNIEQVYTRERFTREGPWERLLYQSPVGRDGTTPGSANTTKCRNKGGQPTNGGRTGATLQQRRPWNRVSRIEKGPPMGQLVFINTVTAERRFYPGHPGTFDPYPGGTT

SEQ ID NO: 968194 - protein, 320 aa, Homo sapiens
LKNLAKYFLHQSHDEREHAEKADEAAEPTRWPRPPVRISRRTQCKDGETAADGEGTRDMDTPAHNRYRTTQAHELGRVGTKPRADTAPTQVNDHIEQQHEHTSHSLSQQGTTRLPPTNPDHQRVPHTSRTKKADTPHPNAQDQATQENHPTRNNSHRKHKQTHALNTETTQRRTIAPGTHSGEITHHDRRHTSSKQTRPDENLHQRTTELHTPGAHQKTDDKTRQHESTATHHRAYRTKREHQHTNSQKPSKSSSKTDRRKNTKQPHNQTATTIQKAPHKAAHITQRTGEQPNTSNTDTTTNSTQQTHKTQEPPTTHRHN

SEQ ID NO: 968195 - protein, 404 aa, Homo sapiens
MTSRQSHLNSSNPRSTWVHLAYEYTRAVTVRLTSRERSRLTTRPIRCGPPIGASHDAYSSAEGALHVTTPPDTASHPAHTDAESREAVTISHILLKSCHYSANDQANMGCTRFAARDPNTKRPRHRSHASRPPSGEKKPPEQSTDKEPDHVSRASHKTIDHGRKHRACPRRPHGQNGKGESHHTPQVPRQKSPHEQIPRHTQAQHKTPVAHTENTPQRQHRKRPHRARANPRRGHAEGTTTANTTSGRITQKRGTQRNERQQNKKHTSEACKRPRQNTTKAHDTNHDASTTAAARTPTPTATTHDAPTTGANNERPPHGRRNTKTGEHDTLRRLHPRRAHSTSAEHTHTQGARKTTTNHNPRDTPPTRHNERPPPTRRTTHRTNQTPGTHKEAHTRTHTHTGDQ

SEQ ID NO: 968196 - protein, 434 aa, Homo sapiens
TENRTLFQGPEGLFKIILHSHLWKFSVWRGCGPSFSRKEKSPFVCAATEGQKASRRLWEPGCPHVTGPCGAVVRVPEGPGVRHSHTVACEGAVTRGDDVTTKRHKREVFCGTLWRAVRAHDVRQRAHNATTQHTPEERHYTELERARPECTTLWIYTEGRRESHLCVGCVRCCETTQEQRVPPFRLSHTQESLTGGAVIQLRGPPVVGVTNLKESLLCEMCDESSTTRRACAAQCVLSTMWAPPRKRSTQARSERCARIKHTGVSSPWANHLPPLWGPPKLGTPPECDNYFPPQTRGSGDNTTCVGGDNPRAPLLPRLYKKLFSQHTGAVVPYSTEELTLRDKYKDTEAGLSRWAHTGVKNPPCRSRRRTPRGHHPRRGTTTNAAPTTDCTTAAHTDSGELEHPRPTPQAHHHDGVGENTSGGGPPGSPPPPNT

SEQ ID NO: 968197 - protein, 98 aa, Homo sapiens
ALLCATGAIVSLSVCWCPGYTDNSNYGIAFPPVADPIRFGYCPSYFDVDFTVVSAVCYTFLRDSYKKTGNLVISVRLSDNCTEKDKQCSIHRVLEKID

SEQ ID NO: 968198 - protein, 111 aa, Homo sapiens
MRAERNRLRPVVQCTRVTDPVSLRRVTVVLSEYMRMKDLNTDRRDVELASLVTAIACLVQHLCDRTGLRFIALLGLSRCRVCKEISLLNEAKEPYEFDDQLKTRWLIGDYV

SEQ ID NO: 968199 - protein, 72 aa, Homo sapiens
VDMTLPGLAAIRSCSCDMSLPVHEFNIWRPLHVYEEDSLPLIYRDETLLTSKFVLGSIETVRKHSLSIVRDA

SEQ ID NO: 968200 - protein, 55 aa, Homo sapiens
MVRHPKRGGAPQKEGSAADPHKEKRQNTRSEQKTLVDRGRSRGAPHGGTTLARGG

SEQ ID NO: 968201 - protein, 264 aa, Homo sapiens
MPSLARSLPHGSPLTARCNWPLYGSLAPRATCSLAPHWSPCSHASTRTLRCLRRLPGTPSRYLALRATARATTALSNLTCCARPCTRRACTASALLALLTTRQATPSSRLLTRYPPSHATWPTLLAAAVRHWLTHAARALRASLLQHLRSPALLHSYHLALCYTTPCTPSSQSSRPCTPSTTGSNTTPGVDPDTSPWPPRNLRSSPTPPPRTSSLSPHPGPHALAPGAPGTPPPSGARLLQRCPAGSAALTVLPHCVPVETPLN

SEQ ID NO: 968202 - protein, 111 aa, Homo sapiens
MQYATGTMLKFHYLCFLRYRRVFEEYMRVISQRYPDIRIERTRITSLNQYQYDRHSIFPVSLSNLVLIGLIIVGKDPFAFFGHASVHNHSATRCGAKKEIRFDAMYDWFSS

SEQ ID NO: 968203 - protein, 35 aa, Homo sapiens
MSLIVHSFMTGHYLLLTPGALISRRRQGYAVHHGI

SEQ ID NO: 968204 - protein, 106 aa, Homo sapiens
MCRRVYVRFDGLTTLLCTVDKPALEGMHVCLAALIRPYGGWNLRGRRCPSVKRDGRWLPITLSCFLMRANTCCFNVGYLLVGILNEPRRKRCREFRLFVINVLVVI

SEQ ID NO: 968205 - protein, 116 aa, Homo sapiens
GLPNLFYGGKWASVGVSLPGLFIGTVSRVPGASSLRAVLAGWKTVRCTGPQRLSSARKARIVGLLLVKLRDRHRHPELLLLCTDCGTNLKQKGHFLWWRTQFYVVRSLPGSEFTPP

SEQ ID NO: 968206 - protein, 173 aa, Homo sapiens
TAADMAAQITNAASGRRPMRREQPESLPGGPVRGVAPSDTWRTGRRRCSARTPPRVHMTHQPISDHEATLRCCALGFYPADDHTDLACGIGERPRPMDTELCVTTSACRGWNLPERGRLWWCLLERMQRYSCPCASMMRSAPSPLHPEMGGCLFPGLTIPIRGAVHCWPGSPW

SEQ ID NO: 968207 - protein, 490 aa, Homo sapiens
MAIDHHTQEREQPETRNAKTLQCSTQQWHATPKHLRETHTYTCKKTHKTHTHTQYVEAAAPPKPRIPHKYPPKYIPPYTYSKLGDNHEINIKHPHHIDRRSRQLTTAPPYSPTLRTTPADPHPHTTATQPNPDTQPTPRHTNAPTQTPGATRTYTTTSHAPPDNHRKTQIDANTPDNAAPHHTYRSPPHHLVANTTINYRKYSTPHDPADNKDTDRDEYHDNSAQRSHTENTNPPITHPQHTATHASGNRRRLPAPDHSTHTRHRDRTRTPRHHPNHQPTACHTHPDTQQQRTHNNDTHHPTPSDTPTNQPTTPPDTNHNHKSHHPTPENTPTHHLSTHHHTHNNSHSNTHTPLITTHYKNTLNYNHSTHITTHPPHTNPTPTHHIANTQHQPPQQHFPTHRPHHTITAQTPINTQQQYTNHQPPPPPQPPPTTDPTTTPLPPPPHPPTHHTPTHHPHSTPTIKTSHPQHQLPPHSTQHTILTIPPSTNH

SEQ ID NO: 968208 - protein, 424 aa, Homo sapiens
MAFLIAYRILNIYSRLYTIYCYIVPQRLYCSLRSTTNHYADAIKLYTKEPLKPATSTITLYITDPQTISSHHRSYYYENPAIHQYPKHPPEIQTSTLKNIDQVQLTEATHSHSRLRPITTSNRRETAEYRGIETIRSSSHRKARPQADRHAHEQTARQPPPTTTQPLMTHTPHTNTHINNVIPELNLNTLGSPIKTYNKPTHKQHTNTTPQITKTNRPRAQHMSTLRRPPAPHKHTSSQQPTPDTNNTGTRRTHQPTDQKKERTPPPKPPQRRGQRKENKTGQATMEPQPHTAQTADNRHTHPLHIHPHRQPHAATHQHTQDTPRNPRHHLPRPHPPTPPRTQTHTNHNQHRIIETRAPPTAQQRQSTPPPAEPTHQPSTTQERRREDHNNTKPTQPKKNQRGREQPPEQDHNKNAPTPHQRTP

SEQ ID NO: 968209 - protein, 156 aa, Homo sapiens
IVELESEEEVKLALKKDRETMGHRYVEVFKSNSVEMDEGVDSIHGPNSPDTANDGFVRLRGLPFGCSKEEIVQILIQEDMRKLSSPMAMTHASRTFSGRKTQGDSPICCKIMTIHGRTELEHRPLTESTERIGHRYIEIFKSSRAEVRTHYFPLGN

SEQ ID NO: 968210 - protein, 111 aa, Homo sapiens
GQWDEFYIVRQNQLHNTKSKNHPHFPPLCFPGKGGSCGGFFWPCRGVWGGPKEGQKRDKGTRGHRGRGCGGYSVRAPCALCSVELCPCGLSVCALSIRGVAPPVCCAAPDP

SEQ ID NO: 968211 - protein, 187 aa, Homo sapiens
MKWSTRRTPTRHGAPSDREKISRDDGPGTQHSPWKVQGTTRALNEGSYTENGAPCRWHHGRHLQNTWSSAHGPVPTFLLVPGQPGPRHEAAPPAWFNLMRSSLIHHPQTHHRTSTKQTCYSSRTPMAAPIHPATPHTWPQGRPKIEAPTNRTLERHTHHTRPPRASTRDPPGTVPSPQHARPTWAPE

SEQ ID NO: 968212 - protein, 366 aa, Homo sapiens
RSENGGFQVGAQGPVVLLCASDLLLAAATATTSLGPCAGQKDSPGDARTSHTTTLHRKQEEGYSAHLQVMHDMADSPSLARKVGHDKNELTHLTPHGRIVSQRRTQARPISGHHMHRSLVNRQQHLAAPTRPQAPLPQRPYVAQNNLHLQTTHERTRPIHPPGNMVYTIRTTWRQFHPRHTASPIQQMHRNQAASSKARRTQPPHPANGPSPLGHHGGDDSPRSAPSLDTIASPTNSKFGNTRVHPTSHTDALVHNSVGPGPAKHFHTSTPLALAPYSVRSLQGCAPHLSRLDEQHVHAKRTIRHRDPSPGEDTLATPRTMGNTTSHAEHTGGTTERISPHNGNPPRRSIGLGPQGTHSTFHAPPP

SEQ ID NO: 968213 - protein, 262 aa, Homo sapiens
MGGTSVFIGGTKTKGGPQGGVWGVGARDWAWNWGRRPKPENGRKNPNPTKVWPCEVRMAAGPPGDRGNNRGTGGSTRGLGGTNLPSPQMMGPTKSRHKGTPGGHGKPQVTKGTGKKSLSCETRGHTCGETSEDTLWSHRGDMEAPEMCGGTRKEIHQERTSRSSYTRKVPHQGEGTICITPHHQKQCRGDTGEPPHLWAGTKSATGAQVATHRCGHERDKRASEETHVKTGGEHPKGAQQTIYKSKRIEGESNHRGVTSTQL

SEQ ID NO: 968214 - protein, 52 aa, Homo sapiens
MRDQHTTASKTKADANRRGQEQEGKASEESGRQRHSARKSQTRTANQPEQQA

SEQ ID NO: 968215 - protein, 239 aa, Homo sapiens
SIQQVLIEPSTTCQTLFYNPGKGGVREPVDLLPAVTLSPKSEALQGNRVWGLPPCRGTGKAECYKKGGSPLKMRRLAVWRLIAWCLSQTEGEGPEEAAPVEQRRHAEKRPVPGYHSPFLQHRDYAEIFLEEAPDLAMWGCTTSTPGKKAGLEYCGYKEPRKCRLVPGRLWKGYKGERPECPPRTGARKAIQPSARRPHLAALRYRHNTGPTATCQRVIPKERPQPCAENGWRPGEASKP

SEQ ID NO: 968216 - protein, 172 aa, Homo sapiens
VLLLLSAALALTETWAGSHSMRYFYTSVSRPGRGEPRFISVGYVDDTQFVRFDSDAASPREEPRAPWIEQEGPEYCGSGTHRICDQSHETYRREPCGSRLPLLQPRRAGRVSTPLQRMYALRPWGRTGASSAGHKPSFAYDGKDYIALNEDPDAPWTAADTAAQITQRKWEA

SEQ ID NO: 968217 - protein, 81 aa, Homo sapiens
KKSNTFICAPLSSCVEKVAVDLSAAGRGIFVPVFEKPKSSACTEFEGVFLRQQVKKVGGQTSRCVILRGGRFRGLSTVGKV

SEQ ID NO: 968218 - protein, 110 aa, Homo sapiens
MLGFLVKKKKIGDPHVLKNGDPKRRYTTKYRSKTGYTIERPPIEINQEADATTEHTHRTGPRQKHGTNAGDIHRQRGNTKNRRKTTTKPRRRTQNRQNRPQTATQGKNHI

SEQ ID NO: 968219 - protein, 110 aa, Homo sapiens
VPGFRPEPALHNPLRLSMFQLPGQSLLGFFFSLTEINPIELKKGNMIRYKRTRPLIRTLTIDSTDQKRIKDEIQTMKTNQEHHQKRKNSKTAISIKQQREQRRQKDSDNV

SEQ ID NO: 968220 - protein, 364 aa, Homo sapiens
MWGATHVVITEGDFIYWPYITHKCSGYITICGSVILHIPECASTKLMAPSLQGTAFYVFQYTTQSSVTTHSNEVETVGGRGGAIPIDSRGSQWHCKGCENITLELPGREHIKGVKWDAKRGAMRHNKRHRERSPRSYPKGNIIQLITTRIQSSQEGQFTIQPSVGHTTGDNNWHQAPGEPSGAGHIGEGNAETQQNQRTTCDRGDHTETPPRPTTDGNSKPGDKHQETPMEILTTTGERRQKLHRQQTPPKQPGATPHPETTRQAQNRKQQSKNRIPPHAHSGKKYRHSGENRQTPIRSNTREQRPRRKPPQKDNDEDTKSGYSHKQRIWEKRKQGNQQRQKQPDRRSNPGSHRNGRRDGATTS

SEQ ID NO: 968221 - protein, 265 aa, Homo sapiens
FFFKFDQKKFFVQLPTTGFDSEEGPPEGVSSIFPYFIFSPLRASCVRSNAKPQEEVTLSPCEVSPSVVSFVFRLHSSFHSGLCAIFRHSVAVFEANVGEAPFVGSGSFQAPFLCAQGVCVLVCLPSLLCRELLVCGKMWRTEGGRNVACVFHGGTLSMWTCRGSVGSCESARLRGERGPNMCEAAENTGFNYIKSPVCVQTPHAGVFFANLFGPVETGGETPFVCARRFLPFCESACFVCKKPQWFPPKRHRAPGKKFFFRVALT

SEQ ID NO: 968222 - protein, 252 aa, Homo sapiens
MCVCGGESPHRGGSCVCAQECVIAHACVYIFRERSYYPAGGERSSGRDLSLCEPPITTTAPIICVLSVRIRTTMRTTRGVVGRPPPMLVWMQPTQHTRGGVSTTSEVRDNPLGGAHTTHADGRDRPLLLYPKKRYREEAMTPHRSHTNIHPRRGEQIVGWGAERMHDTPNKQRILTPLSPQHNHITFFLHQPDARCGLWVGHPTIQTEEEHLPSTESKHNQTYQAHVYPSPYKMEYYITTILYSSKQERTPL

SEQ ID NO: 968223 - protein, 38 aa, Homo sapiens
MVRHVHDRNSRNLTDSSLQVPVNCGHKCNTICMSYSHV

SEQ ID NO: 968224 - protein, 72 aa, Homo sapiens
SDPPPKVMRNLSRDIPPRPDTVRSHLAPRWLTWSPKFFDGFHLLILGMCLICSHTNGGHFCQWPVCAVSSRD

SEQ ID NO: 968225 - protein, 67 aa, Homo sapiens
MGVIFVSGQLVQNQYVTDTHQIYQMSCTLHCIQTALPVITVWFLDILKEDSATSMVLQLHQFLILWK

SEQ ID NO: 968226 - protein, 48 aa, Homo sapiens
LLCHNFKMQEAQVICCEESTSRQTCRGITYWAVLTLLASSIHTDIDEI

SEQ ID NO: 968227 - protein, 108 aa, Homo sapiens
PLPMDEKLLPMDKRHVWFGESMTDGFQFEYGGHGLRPLTAVAIQLTFLRLMSTEGLPERSRYHVAGTASSYMCPADVSNLKQGPAPFQGLHGASEIRAEGKKPFSTLQ

SEQ ID NO: 968228 - protein, 89 aa, Homo sapiens
KDPSQDRILAVVWRVHTRSRSVAAPSILFAECSLSGMNTGIAPFVCFCEIKIAAILGAMVATRADSTQGSPMLYLGQCTQILQTADDMI

SEQ ID NO: 968229 - protein, 38 aa, Homo sapiens
MILLKTLDSDVHSDWKSGEYWIDPTRLQLDAIKVFCNM

SEQ ID NO: 968230 - protein, 169 aa, Homo sapiens
MKRAGPRENKRSRGQVEEQLAPVGVLHDKAEAVVGLERVLQGCEEGVPGVLQDAVLGECVGHLVLGHDDLLLEDLHGVERPVAFSFTRITLPKVALHSSFRYSNSFMVTRCLGLCRGHSISSGPELHWVSRPEVISSSSSFLMRQPQSGWWLSTLRSQESPKVCVVVRV

SEQ ID NO: 968231 - protein, 38 aa, Homo sapiens
MALELDEDDLEAEEDALGDELLADEDSSILDDCSICPC

SEQ ID NO: 968232 - protein, 68 aa, Homo sapiens
MCLLGDLERQITFDSSLDRLAVRDDRVRYLDGDACVVLLQVLQADLQVHVAGARDDVSPDSSMMHCTM

SEQ ID NO: 968233 - protein, 40 aa, Homo sapiens
MQPTMSVDHNAGHHLWHTEGGKLSKVNTYCEEEGLLRLLE

SEQ ID NO: 968234 - protein, 33 aa, Homo sapiens
MRCMEKIETGQVRLFKKMVGPGKAQLGMIDRVV

SEQ ID NO: 968235 - protein, 76 aa, Homo sapiens
LAGSLWLPAEVNEEDAGEMELGLRKQTHNNAVVKDACLLRPGELPDGDRRMVDFLGPGILGVNQISRCACLGDKFR

SEQ ID NO: 968236 - protein, 70 aa, Homo sapiens
CGYSYCDYPCQQAHCPEHMNVCYQSATAPQQEADAEVNTGNTSNKYSPGELHRSNTKYSHPSSTTGTKRP

SEQ ID NO: 968237 - protein, 62 aa, Homo sapiens
MIRGTLETARSGDLAELDKLSGGAEICTLEMLPACSTLVAIPMRKAVTPKAAFCAGADLLCC

SEQ ID NO: 968238 - protein, 125 aa, Homo sapiens
MGRDMRTSHSDMKLRGDTLTYVIMLSDNEQTSKPRVNRLNTVAFKENSNEGLMKSSPEERERMIKQLKEELRLEEAKLVLLKKLRQSQIQKEATAQKATGSVGSTGSNPSPLVRGTQNIPAGKPS

SEQ ID NO: 968239 - protein, 87 aa, Homo sapiens
SRGSLWYCWRSHRVALQVTTTASGKSCVTLMEKLCYCRPWTSEQEMATGASMLLPWRKSYELACRGRVITHRAMSGFRVPLKASLSS

SEQ ID NO: 968240 - protein, 39 aa, Homo sapiens
YCVLLEELMKKREERRKVLEEEEHEDEARLKPDLKTQRG

SEQ ID NO: 968241 - protein, 57 aa, Homo sapiens
CARDDTQSGKSSRSACIYTAEHPFIMLKPTDHQHGVNTIDADVLHNVLQLPLAWVSW

SEQ ID NO: 968242 - protein, 57 aa, Homo sapiens
DRTILLLYSFMAKILTTTVRFVETTPTEGPKAFQRTLCLNGRPCSMGMEGVWRIPKT

SEQ ID NO: 968243 - protein, 43 aa, Homo sapiens
GGRIEILITLHTCFKRVDVEVRPECVDDERVFCCVDNVLLCCV

SEQ ID NO: 968244 - protein, 65 aa, Homo sapiens
EVGGLVGNRWYLSLKLSGRHRAGRGVRPGPCQDRKQEQNTIPRKTYGGTLQAQGAAGKFTPPVFP

SEQ ID NO: 968245 - protein, 87 aa, Homo sapiens
QIEVTFEIDVNGILRCDMLKKWVLGTKIMITITNDQNLPDYLKKSKGWLNEGRVDAGELVSQRPMARASSRAGACRNAGSLVRRNER

SEQ ID NO: 968246 - protein, 75 aa, Homo sapiens
AAVLVLVLSLKYPLNYQVATEVPVHPHPQLNGLELGMGHTMNERAPYVLPTVQLNACSDGICMHVGYLMLRHSVI

SEQ ID NO: 968247 - protein, 39 aa, Homo sapiens
MEYSAARDCIEALMEELLYMKKNHEEEVKGYKPRLQLWV

SEQ ID NO: 968248 - protein, 149 aa, Homo sapiens
EDPRPFIILLFISCSSVTLFRTSTQTGRHVGLDWRRQVPPVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCA

SEQ ID NO: 968249 - protein, 44 aa, Homo sapiens
GCSRGSGHVYMKDIHYSGNNRVQNSRLEVIKQFKREMKIERGSH

SEQ ID NO: 968250 - protein, 44 aa, Homo sapiens
SCTFRSSGCAVYWSYVEVCGKVELAIVMSHSKAAWSLFKDHVTL

SEQ ID NO: 968251 - protein, 149 aa, Homo sapiens
MNDGITRTTEHGSISQSSVSQPTTEGAPPCGLNKEQSNLLLDNSLKVFNFNSSSTSHSSWKSPSHMEKYPQKEKTKEDLDSRSNLHLPETKFSELSKLKNDDMEKANHIESVIKSNLPNCANSDTDFMGLFKSSRYDPSISFSGMSLSD

SEQ ID NO: 968252 - protein, 36 aa, Homo sapiens
GIVVLLGLRGAAVTAHLHDCLRFLLPPQRNLLLRRM

SEQ ID NO: 968253 - protein, 41 aa, Homo sapiens
TLRMLRIVVLLPFQLLGTAEFQHTMANGAGALVDELDRHGG

SEQ ID NO: 968254 - protein, 51 aa, Homo sapiens
MCCVLHMCQFKSLFYSGTVLICFVSFSVESELFGFINRKITISITISITIS

SEQ ID NO: 968255 - protein, 79 aa, Homo sapiens
AGKPIPEDCLGSLMTSTQRPGYGAYDAYKHAVSDPSILDSIDMNEDERELLINNINRRLTPQAVKIRAAPRFFPRIHRG

SEQ ID NO: 968256 - protein, 45 aa, Homo sapiens
MKRNRRVLHDVAMSCSRQCRCGAAYVCRLRPCVCLEVHSWASSTT

SEQ ID NO: 968257 - protein, 45 aa, Homo sapiens
MRSLRRTTYMGSATVIDDTNIAALQLETEIEALKEELLFMKQHHE

SEQ ID NO: 968258 - protein, 35 aa, Homo sapiens
FVSWYMWLPARRKRKYNVECQGYKTKYHDDEFRHE

SEQ ID NO: 968259 - protein, 40 aa, Homo sapiens
RILESSWWLDKVMACYHEGEIGTLAGVRSPRRRRAGIRLV

SEQ ID NO: 968260 - protein, 75 aa, Homo sapiens
QAGGYQRIWRGSVPVMLPERPGWCPSVTDHVLALLQLFIREVPRILLGLLREPVGIPRELFISGYCQPSTSTSTS

SEQ ID NO: 968261 - protein, 106 aa, Homo sapiens
LVLIVYCGQVLRSPPCGEELRDLLRYDSGAHHNMYCEYRDLTTAVAVTQCYRDMCAWHRARAHSIQIMKVEEIAGSKCPPRVCKPVHDFQDQVPVAPPESGTGARI

SEQ ID NO: 968262 - protein, 89 aa, Homo sapiens
CVVDLRIRKIWCDDAAGMSSRIHVKRSASRAAILTFSDLFQTRWCLTAAHKQSFIRVDALIQFFPIDDVLEKLLNLADTVEPNNQDNIM

SEQ ID NO: 968263 - protein, 39 aa, Homo sapiens
VYCGQVYEKSPLRGEELRVIWLRYDYPVAAPTTCTWEYL

SEQ ID NO: 968264 - protein, 41 aa, Homo sapiens
VKTGCGQQCGRAVSGACGLEDPGRPATQRQLSIEITTIVPV

SEQ ID NO: 968265 - protein, 39 aa, Homo sapiens
MYYRNSSSGCSCECNLLMYPQGQVWVPMFRAGVIKSYLS

SEQ ID NO: 968266 - protein, 36 aa, Homo sapiens
TLMLREENGCCSSVRAAPVLGIRTESARLVRLSAPD

SEQ ID NO: 968267 - protein, 62 aa, Homo sapiens
DPETSCLLPISCFWLRRMALALRMAAMRKVGAVLVYADSCVQIAAERGASNLVRWWSAHKEV

SEQ ID NO: 968268 - protein, 104 aa, Homo sapiens
VPAGHVYNIFYKSSDNYLVRHADGRPQSHILMHWDFYYVQYKRVEYLHIQQCSLETSAKVICQGREEGVPAITQMSSRIPRESTCYIISVLEGLLPIPLEIIFL

SEQ ID NO: 968269 - protein, 95 aa, Homo sapiens
DLLVCTDSAWDPARSLRTRNGQRKPCAISNTAPIVDSPLWCTRIAAYTNSYCGFVLMILQQSCTRILNSTTPPIPASHYQNNIQIPDYCLYYFYF

SEQ ID NO: 968270 - protein, 424 aa, Homo sapiens
WLGLYTKNPNNQKIKAIILKHTLCVCGDLSPSPPTPCGGEKCGGVLETEKGRKKKPLSPTPTRGAHAKEHIFLCGVSSLGPACVCGCGTQRGVLEESLFPKKSLPGESWRGVGKTPIYNAPRVEREREAAGDISSGESQVVNLISPIISLFSPHISPACERGALENLFNKREKISGGYLWGRCGGSLEPLVRPVESALWGLLYERDKCVGVERVREYITERDKKNQRHPQREERRRTPTRRAPLSPASAPRRALVSAVTRHPRGDEARVGNESSARERATSNHALWGGETHTQTNMWGPPLLLRGTLLKNDPLTKVGAPRGVPPTQRGGRAVDQQGGGACSTPRAPPVCRPPSIMVAPRRGKTNKTTKGERSTAEKTPCYFSLQGDKIRTPLNRGGERKNTSSCRVEESHRTAVCCSLKPHGTS

SEQ ID NO: 968271 - protein, 70 aa, Homo sapiens
MRLKCPGGDECVAPAGLNSPRNGLARRAGGDREELIPGPTSSRLQWEKDQQTRSSGKECLELSGGLNALR

SEQ ID NO: 968272 - protein, 39 aa, Homo sapiens
MSSSGPSVRNSVSECSRARKIPQEEDQPLPARRFSSDCS

SEQ ID NO: 968273 - protein, 41 aa, Homo sapiens
CSLDSDYFKYPLMALGELCETKFGKTHPVCNLVASLRLWLP

SEQ ID NO: 968274 - protein, 139 aa, Homo sapiens
GYPVTTIAQPTILTTTATLPAVVTVTTSASGSKTTVISAVGTIVKKAKQDLRGHPGLERTVQPSDHCPVGGATLYISGLGPTPQMPPERSFCLGIPRCETSTLTRETPTAAVNDVSVHATGCCLLIHIEKCRILTSWHL

SEQ ID NO: 968275 - protein, 405 aa, Homo sapiens
HQLSNDPLLEMFPFVLELAWAFPQHHVVECHRVIVSEDVGAINIYSPRDVGQFPEDSLYKWFQKKFLVAKDLGCRISVSRAMCVTILHSKGDFSHVVFNVFSRVLFIVSSGVVSFERRFVMTSGAKSAKRGHNPLSNVGGTCDRVSDMCAQFSLCVISFEALSQFTPVCLFGTFVHLTQPFFLWKNRDHRGGPDLFVGAPRGKKVLAPDFSLSRCHLEVIAILASAWGGSNLRTAIGGRPVWLSGMNPVFGNDRKGTRLWRNPEVSLGISGERGGPRPPFFFSSMSITTCRRYVSTSSIYSFLMLLMPYNLYHNEITYEHTPPPTQSIATSTRNPRNDTTGGGAASTSRHRPTRRQRGDRTNTPPGGYTTRWGATTRPRKNYTPEGRGRAILHRAGTTRPPASES

SEQ ID NO: 968276 - protein, 54 aa, Homo sapiens
SRPSLSDSELQVIDTPDASNTDVFRSGTSRGFSGSTFLVATGFHGLHVIIGSTF

SEQ ID NO: 968277 - protein, 156 aa, Homo sapiens
LNQVLMYLLFCLQSSSSWLGLEAVIHVVWPVGSCLDPVDHQSSCILELGDKPVPNTFYVGFYILIACGRCHDCSLDSWAATGPSRNPIACCGRSSPAWSSCFACEDGRRNLGLLSTKDQIAKDVKASLSPGPYSRAVVDDDANNAKDVVKTFHETA

SEQ ID NO: 968278 - protein, 253 aa, Homo sapiens
MTYQYPALTPEKKKELSDIATASDGTMAKGIRGMQHEIHMGSHCQSRLQITYGHQSNTAGRTGRLSTRQTCMHAQACKKQTDDTTMQLGGHDTILYPLTNTLTYHTAHEAAHMNRNASTYPTHTYNKKIHKAADELDRGPSHRNTPKERQIESTHTKTQHDTPTLNAQAQETNTKHRAHNKREHDTTNRTERPPHGTTTRKRNQRTPEQQYYDPHRIGPRTSIRYPLTTEHKRATHHQHTHNVSKRTNTAKSH

SEQ ID NO: 968279 - protein, 227 aa, Homo sapiens
MCLRLGGLSVGDFRNGADEDRPGAGGSWAMSASSHAALFHGTVLHYVGTPQDAVALPSTAVVNILSVIFRASWFIYLQAIVSHRVVHASLAYHPPALGPVFSSSVGCALLSLTCALGLLGSTLSMTFASQGLALHGCLHFLGSSDSTWVPRHRDCPFVALYAVILGSQPCASGGIRLGALRGGSTVLAVRCAQLDPPGCCESEALVGETQPTDDCGETPDLVRGRAC

SEQ ID NO: 968280 - protein, 34 aa, Homo sapiens
LYPSCIFQTAFSNMNFPIRYINHSGYGRSESFNG

SEQ ID NO: 968281 - protein, 37 aa, Homo sapiens
EHQFYETLPAEMHSLPNKVVLCAEMKELCLIAYLERG

SEQ ID NO: 968282 - protein, 217 aa, Homo sapiens
FFLYRLLKLILFFPNRIPFVENYSSLLEMCAHARKTRTYAGTGSLGKKLPPVVLTLGIEGFRGVLCQNKWSLTNAEQTRVSLCELEDVPTIFSRRVLRYKFHHRSPFFARRVESHVLTLIYSPPSKRRVCVKRFVLKHMCQVPSTHFSKTTLVIITTCVSHPKPWGYCEDHHIHNIHNLNHILTGRAFVPRSRQRVGFSDTLVATLPGPIDLAMCAQ

SEQ ID NO: 968283 - protein, 463 aa, Homo sapiens
FYIGSRGGRGGAIGKIRGPISKIFRGINSRTHGHNNCWLASTRIIKALTVSIPPSRVSGAKVDWSINTDPGNCNHVIKQPIKLVGAPASIAFAKNRLCCNVNIFIPQLEGSHNSGQITHSAFCSTRSTGSISQSSPCVYYYRAHLRGGEKFMFRTVCRNNNIRHPAQTDSEMITISIRGIHHKITQIDAEEAQTCRHNRTLRNQQRNGGHIEINTPNRHQCASCSQQGDNDQIQGHWTQSGRKKSHLRAMAIGGGTGERRNRQGINIFTAVTDLGPTVQAHQSKNNVMRDGCTEKRGAPQRAMRTRSSRGTRDDSGRIRPRQGDEGRSTIIDGKGEAIDKATKSKSRKDDRRDQQGEAQTKTERTYRETGTHVGGRQEGEGAHAAPPTAGRGTHRHERTSQNESTMPGEHIGGQSARDQDQAYTEEKRKREDGQRRGATQHQGRTERSNRLERGQDRRSRERR

SEQ ID NO: 968284 - protein, 79 aa, Homo sapiens
MVVLGGSPVYAQPAGLESVIDEGWMDDDDDEEAEEKAPVKKSIRETPAKKAQKVKVRSGKGLRNQSSSDQGSKGQGSPF

SEQ ID NO: 968285 - protein, 369 aa, Homo sapiens
MTPTLIAIRSTYNIITPYTIDRLIIPHNTYRRAHSTYSVNPTNNHLLQTPHEPLTPPQYAQNRPHLHYRILAVPGPLQMNTTIERKMYVPHLVFHQRSHRQCNVKLTISTSDTQPRHHEPPAPQPRRRNRQTPRPEPGNGQRSTHHIHSNRTAKAKRPQQTRTPPQTPGPAQRSRHKHPQPTHHTAATQTTSTRMRAHIHRPTRQHKNTKNPTNRTTTHNTTRAPGTPTQDTHSGLPQRGQHTDGGHAQDKHEAGERKRTRQPPRAEKDKAGDTHTTSQDTARGTKRDRKRPTARTESKQNNSTRSGATPNSHHADEAPERRTTAPTRTREEQANNQNKTPPGKGAPRPQVGEENKKHTAADTPQGATN

SEQ ID NO: 968286 - protein, 116 aa, Homo sapiens
MCIHVQNSPPPFCASNIRAWPYSLSCNTRDSSSPKCLSHLNCCVINTERFPPRSECVVFTQRGLLSLIIRVIKLYSPRLTRRCWCPRCTERSLLLSTNRKRCQIQHKRPRFSPTVM

SEQ ID NO: 968287 - protein, 124 aa, Homo sapiens
LLVFLCGLCHRISGSQPLDWHTPLRTSSVTEPTLPPCGRLRPSGPRVAAPLALDGMTSFILFRCIKRTELRATETQMRTEWFPMCSIDYSEHEHARGCMTYQDRTLPSVTALNHTSALVTHFNV

SEQ ID NO: 968288 - protein, 178 aa, Homo sapiens
PYRVVVALSLGARASRQTPKPSHRIPKQPRPYFPYNHRTRPATGPDRLSTSTSATMHLCRSISRLPPLHIHTRPSPAETLLRAIPPYAATTAHAIFELRRLDSRTPLSRRSLATAALPRPIAEVLLSVTPRHPPPPNSPSTSHTFPTTQRHAHPTTRLPTTLYPIFPSHPTSPPPDTH

SEQ ID NO: 968289 - protein, 221 aa, Homo sapiens
LRKRCGSRDKKPRDLFGPPGPPGAEVTAETLLHEFQELLKGQPPCTAQRPDVPGPCADPAGRLCPPPHRGHGAPVLRASGPAAAPGAGLRLVGEAFHCRLQGPRRVDKRTLVELHGFQAPAAQGAFLRGSGLSLASGRFTAPVSGIFQFSASLHVGEPDGAVPCAVTGLGWLSGGAWHRRPRVRVLLGTYPLPMGGLGLGMGSLLHAAQGPLPAQLLAVWF

SEQ ID NO: 968290 - protein, 104 aa, Homo sapiens
MATSSTTVSKKAFERDKSYLLPHEDSLYLRAGILCLMPFLANVHDRRHRYPPPKSRQGVTGTHHSRSITPELSIRPNKVPSAYKHYSLVHFKPLRAISRGSLFT

SEQ ID NO: 968291 - protein, 223 aa, Homo sapiens
MWATGRTSKNCVIPTSGGRDNSNYLMQPFLHREGKYYNIGQRSSKRATVSAVPDISGARYNLPFSQDAPPASGKDVTRRRLSRFKRIKNHGTNVGVPIFPKGASCGVWKQGLLFRTPGGKDPTAPEMYTVHNFHKCLGPPNIGGAVFYNFPFHSYYLKYTRCGRAYRAETNTLSMSVSSGTTGGPLSTQEVGARVFNTKFPRSFSSEAGRNFQQHGTFRAAKI

SEQ ID NO: 968292 - protein, 50 aa, Homo sapiens
GARYLLLATLRLIWRKLIYGLNCWVPSDDVCVEESFIGGTETHNARRLSV

SEQ ID NO: 968293 - protein, 413 aa, Homo sapiens
MPREDSAELEDPTTSLKIIPTIGMHSSSKCYPLWAASTMWASKQHASSIRNVPIAGKAVVLDGPSNTHDAPRPSSRAPEKTHPASGSKLHASIILVWNVRLYVFTKAGTSTEIRDMLLDTKGARLLPSSWCHMPHVKSLCQHTEHWYSEPEKTSILSRLLGITTTNLQWDTIDNPEMMCRLIKTGDHKMGAQRKPRVLTQCSPYSPFLHRELVHPKQACSDQWAQQSTNSESASNSETENSWISSNTLDMGVPRLDAKIVYDLKTLGYTELIAFTYPDMQRYNRGTNRLLSLTDHTDTQTHTYGKRDQAPHWARKHDGHIEDRDNPHTEVGTPQQNTTLVDCTKDPPPRYYTTGHTDEVATTDSTYAEKQSTQTHQQDTINTKKHTGGAPNTRGRTNTATYKLEQHHNDSQKT

SEQ ID NO: 968294 - protein, 144 aa, Homo sapiens
MGTTERKLYMWVSERVLPKERRRRGEPTTANSTNHSPTQVLLVRTPTKRKEQQACCQNSSATTTELLSGTHPLVGGGKDTPRQPHTLLHSIPYMIKITPPTKIRRPVSWRGARCTQGSHCSMGSAPPAPPHDRPGAALFTRDSR

SEQ ID NO: 968295 - protein, 154 aa, Homo sapiens
IALNANKRKQERSKIDILTSQLKELEKYSSKHHFQSSAAQASNITSSIQQQQLAQAHISSTRKHTRPSNNNPHAHPRQHRSFMHTHDRTNTSASARASATARHINSTATQQQHSNPHISTTSNTKCITQGASSTHRHHHEQITTHSPIPAEHHL

SEQ ID NO: 968296 - protein, 385 aa, Homo sapiens
KEESLEDEERDYGPWEVDNDQLRAIIELPCTTHSPAQHTSSEHIITHESISGRSSHSAQPTLDKVQTQLAEVGASMQLQRKSTTHRFDSVSLLFHAHANQPNPFLQSGIRRTIVRCTTVHIFITNDTPAQWLDQEAAPKQFPKPNFTKKKVMVTVSDGLHAHLIHYSFLNPGETDYIMRSMLSQLGKMHRKLQYLLPALVTRQGPILLHDNNLNCVSQHTGASTQLKALGYKDIASSSIYTPDLTDNRTSSIWLAILNKLDCTGHNTSSIVLTKDAYTEVRHAYSTAFNRITDINRHVYHRPTRLCNATATSSGTDRHNGTQDAHWLKTSASWTMRNERVMRMHCYVAARRTLSQLIWPDDWVARLMAKTKKKIQRADNIKDKKE

SEQ ID NO: 968297 - protein, 224 aa, Homo sapiens
MILIRKQGLLHSRTVYIDSRGEFCPRPIVSPSDVGSGAYGSVCSAIDKRSGEKGGHPRKLADPFSPEHLRHKRALPGAVACLKLLLHAIENCHWVLLGSSTLSAPPLQRTSYDFYPRWMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCI

SEQ ID NO: 968298 - protein, 482 aa, Homo sapiens
MWIAKRPFLGFSPVEFAPFPMWQMAALPVCGLQLSSPVELKGLQGDTFSSRRGCGACVALWRSPRVSAEGALGPVALRRERCVFSLFYTSVVSRGVARLVGPVGYSACGCIEGLAGEESRLLLSGRGLVEAVERERSLCIQRVRVSRAHREPSLCVLLSERESARSVCVRTAPFRENNPRRVSCACVSVGGPIVSCVRPLFFERAPQQRARDLPPRFDKKCLFLRAPMRRGVCGLSPSENVALLCVEALFSPSRVCAFKVSPARRGSFAGGVSPPPKRGGGVLVWRGPRLFVVYDGVTRGGRGTSHGVGAKALPKREGSPSGTLFAPGFPLSVGGPRLLDTGLHRVPHFFGWTPHGGPETPYSMGGTALFSSYLITPCCAGGAPPRGGAPFGGNKHLSLLSGPRCRGYTRGVCAHAPVVARPKGSFLVGPKGVPGTGAPRPRVPSPLSLGHPILLLRIFVLSIISVSVKSTHAGGRASTICV

SEQ ID NO: 968299 - protein, 355 aa, Homo sapiens
DQEELDKTKPIWTRNPDDITQEESWQQFYKQPHSMHWARPTWQSSHFSVSKVKLAIPGHSLIYSSIGLHFDLFVQNKKKKNNIKLYVRRVFIMDRCDELIPAVSPIFIRGCGLTLAANLPLETSSRSKCSSKSQQSWKVIRQQTLCASKVALKLYLYQLGQASTKEPHTSKQHIPSWQSHFLLSNRHLQRPFGANPRTQSTSQIKPGADAHVGRWQGLGNARLSSSITPIHPKIPGKQTVHRHWHHTHNMESRKGSHGYNAQDHLETERNQPKQQRDTPKTLTFRNEIQTHGSSEQKGQKRNHTEDLETHTRFRAQSRRGGARQEEMAETQTRERDITQNRRWRIKKYKYNATTR

SEQ ID NO: 968300 - protein, 199 aa, Homo sapiens
MIYEFVVQQPRYHSKNATTAIITTAETNQIQQACRESEIVAGSHSTESVMHNTERICKSQPTDNWEWRSTITYVKHSPPYGGETKIQPTTLSECLQQQPYKDVVVEGTTQDGHADKPLDDSIVNERHHTQATRNAPHTHCDVRARRGANSTIPRQHVPTLVVANATHTYLMTLVSWNAHRYGGTYTTDIDLDCHTYVSC

SEQ ID NO: 968301 - protein, 443 aa, Homo sapiens
GSRSTACRPYWNKPTVKSLPCDICKDVVHRSWCICCTGQCQLRQAASLFHLAASNMCTGFQKPQPCLLHARQHSGTPTIPVTSMAHPFTRQHNAASPWEQDVLSLINHLQRSHPSKQLDSSCNHTRSQLAVQIRSQQLDNDMQVVAPIHGPTHPIIHPHHPSGRTTPARQDHPDKTGIHGRTSFARDCHSSMVHCTSKHMHVRDPTLPTHIDPGAPCARTHLTKRPEVVQPDMRDPCTTGPERIMRRKPNTQTRHNEAQSLTPEVTASPHFQRNQARPTGTNRGRRPGEQRHAEHEKTHTHHNTTDPTAAPRHTKKDSPDQRTSRNTMKERTRPSTRHGPLNDAKKETRTHDTQEKATPPTSNTTTLETDQLTPSPTRAGPDENAAGGPTNQRGGQPQRRRAHSQRRPPARATDDQLRAHHTSRHRDETRTNSTPTKQNEERH

SEQ ID NO: 968302 - protein, 242 aa, Homo sapiens
MSTFRCVVISIEYIIKTKKMSIGVPYQMVIQASSLSKWIKADIYRKVFNLQRHLQSPSPGRHIKPNISMARPKAGHSTENKKKKTKRQTTQQRQTWTHKDKHQTLTQRKQQDGTRRKAPEQEHSRSNTRAHKNTQGHRKRKQHTNKYALTDKPERPHQNKTDGPTQPHIAQTNNTKQQQTKIAHKKKQPQGKEKTRTTNTTPPQTTEDTGRQKANTKHTRKVEQTNTDSHEKENTQRDRGRE

SEQ ID NO: 968303 - protein, 81 aa, Homo sapiens
SPRSIDVVCDRTFEIWGDRYSTGEGEMTNHLMQKLNIRHKGLSRYTFCLMNKLEITLERRAERRKHPAKTQEANYLMLEQT

SEQ ID NO: 968304 - protein, 144 aa, Homo sapiens
MECVSAISLLIAYYFYLPEKTVIYNRNSDGRWNGDAYRLLTRSQFHGLVGRWHCAGRLTLSFTLTRPHPCVAETWGHLSDHDNTLKHTGARTCSPDRQNYAGYWAGAYWGATGDTPSRDNTGTRTQGTTTTRLGPREPTQGIVT

SEQ ID NO: 968305 - protein, 109 aa, Homo sapiens
MSPSRESGESRTPCADHCYPGLWASRDVGLGGLCVIRLSRCLRCSRVFCTWLLQYARGLWLARARGDLGSRDPALARWNPRDSLAGVVARCEQFSLLLCCAADSVRWRR

SEQ ID NO: 968306 - protein, 216 aa, Homo sapiens
MAINHSPKPKTARQPATDTTVQSSGPKGQRTGKTRYTRDSNTNQGNSQHGTPEQDHKQHHSRTDTPHTNNTRRTQKETEPKKKERTRQQRMKPTQTGRTKRNQGGRPRGHEGGTRGRETDQEATHKQSHTTKHDQQNTQTNSNRKEEPARKPQIAHASPTTPGSQTKQTETATQAPTPRKNRDNYGKRNAGAAPTQTAHHTQSPAPEAKEKKEERR

SEQ ID NO: 968307 - protein, 100 aa, Homo sapiens
MWYKACGAQRDETPSAWRSLARIARGKLFLRSIATFWMSNPLTKLGHGWLINLTSYNEGISGRLVPWRSHMTVGFTEVLVKNTTLLVSDSRRLDDLPESS

SEQ ID NO: 968308 - protein, 311 aa, Homo sapiens
MSRHPTGRTKASTAQCACNPQALSCDERTDPALRQVGPLTRHTRAPKPPPLIPISPSGQTTRASQCVKHPGTPPLRDTPLAILTAQSHVVPWHALASFPFPWRPWSQTRATHAHLTDLADIPQSSPLVAPTNAGPLRSCPRKPAPRPLGTPPPLASAKQLYRLWTGEPPPFAPPTSCTENRYQRCLSLPHAFGDPPPLLPARPPRYSALVTLEYTAPHRPRNTIFACATQRIMGATLLVRAAQPPSAAPPYSADGPSKSFHQKKGVWHAPRHPIMGGRVAQQFCNTTATADICYLTPSPSPLRRDATSSVP

SEQ ID NO: 968309 - protein, 33 aa, Homo sapiens
PLPVTNGKGRPASLAGAQFGGSGKSGERGAYAS

SEQ ID NO: 968310 - protein, 127 aa, Homo sapiens
TESRCRARLDCSGEIPAPCNLCLPGSSHSPASASRVAGTTGAHHHTRLIFCIFSKNSLFTHVWFRLVSELRGPSCIHLLGPPKVAGNSRSLSRRTRLSFLLLKAAQYYSVKHRVSTREILERIESNN

SEQ ID NO: 968311 - protein, 184 aa, Homo sapiens
MSTHRRYRIGELQWTVTVQLEKRERGRVSTNSATQQRERYYTIENRNRLESRTLYDHLINTSRYTPMRTHITPRYQHTIRVRQTELTPPYNQQLDVTERTTMTSPHSSLDHTSQTYNTNCSPAPTHSAQLLATIHRTSNQYIPTSSTSYTSTTHARYVPHSQSFIIYPTTHNHINATSLPPHAT

SEQ ID NO: 968312 - protein, 262 aa, Homo sapiens
YLSEVGVYDGHCDPSPGSGLGGQKEIPSTVSRLRWILSGPQQLAAELEVEMMADDVQQNDQCLATRKCVPPHYKEAELSKGRVCVPGPDVSLSTWTSMSGWANKLTELSMLDDELMKRVPGMRLWAIAMRSLSVYHPGVYPNPSHFNIRAPCWVSFGDRDAVSHMGRPSRLNRVGRQNTGVVEILTLKGLTDGQGNGLFARWSSCGRYMREFITSWLLVLKAVDSNKDAGNTLKGGADMERAPKYGLVRIMKLRGRGLHDFL

SEQ ID NO: 968313 - protein, 133 aa, Homo sapiens
GEWNERSDPDADLYKKTQETLYTGRTEDFSMPMSTVGICHQQEAWRHEELCDPSSQFEDRVGTIKSKVVGDRENGSDKLPSSEGSGDKPLSDPAPFLSHDGCIHPTDRAHANQTSASQNEASVQQETSQTRAG

SEQ ID NO: 968314 - protein, 245 aa, Homo sapiens
LAARELSRLGERRPRHPVTVGATRKDLIIMDLRQFLMCLSLCTAFALSKPTEKKDRVHHEPQLSDKVHNDAQSFDYDHDAFLGAEEAKPFDQLTPEESTDRLGMIVDNHRRGIQRWVCDGGGAEPPGLSTPRTNSIYDNCRKPMDRSSASESTHGLLSWDEYRNVTYGTEPGMIQITDDWITTIQTAWLRLAACTEGINMGTKTNGQTLQCHTRKRNTTEYNLDKHEGSSALTVTRILLNNKENK

SEQ ID NO: 968315 - protein, 400 aa, Homo sapiens
MNHYYNVETDKVPQNHPFQEWTLQSPRGAKARGHHRANTKIHARDSRVRNGRKRAQAIPSDNMEGARYDNKSLEGHKILKGRNTTSYGHKTCGTKSPETTPRAIPYKDMIEGKYRRRCRWDLNGLPGGSHTGHKKKAKGNPQAIRGERGATRGAATGGPPGKKKAIARANAHRRHNSRKIPRKPQSATQGLARHEGGSPRGDHEAHCTERPKETKGTPYERQNKRDVTRWGQLPKTARIPQIRIQRISANTGPELIEDNHPMRGEAPNKHIANETPKKLRIGTQQGVDPTINGRQLGNNQKAISTLVEAYEFYHKNDAHGPQHPASPRDNSKPKGTPEQQVKWEQHQPPTTYHSSLTSTHENQSHTLVRRNTLDTSGDTNPHHEPTPTRYNNNIRPSTAT

SEQ ID NO: 968316 - protein, 98 aa, Homo sapiens
ASQPRPGQEGGGWAAQQQHVGDFVLPLVPAAAVLRHATIRQPPRITRSPSRYGGGARSIGGGFELSRLCPYRLPRHTVSVFPLIPPIPGRAQWDGGGW

SEQ ID NO: 968317 - protein, 109 aa, Homo sapiens
FFFSTFHPVGALFSHVPTPTVPSTRQTEGRERTHTCQRVSQAVCGPPTSGRRGPHLELPSAALALEPVLRICALTLTRERAKAEGQSCQPTASMGALGGQTVERRFLSP

SEQ ID NO: 968318 - protein, 176 aa, Homo sapiens
MVSLKDYCTRMKENQKHIYYITGETKGPGAKLPRPLLCWGNRFFPGKHGLEVIYMIEAPIWEWRYCVPTAEGISGEDFRCQSTKKKGLELPEDEEEKKKQRKEKKTKFENLCKIMKDILEKKVETGGCVKPIGDISNLICSNQKATYWLTANMERIMKAQALRDNSTMGYMAAKKH

SEQ ID NO: 968319 - protein, 54 aa, Homo sapiens
TCTSLTPLKLTKTQPLTPSLSDTPTIAIYLFLASTVPGILVDPSTSLTLHGIAM

SEQ ID NO: 968320 - protein, 341 aa, Homo sapiens
KKNRDQPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMAEEQSSQKTNISGGGINRAELRQGGVRGPIRGPGPLQQFRGLNSLRGVPHGCHGIRARNCVCFGTRLCQGSADLHRAVWAQYSGGGTGAEALFNKQGLRQGNREEATDWTGWESSAHDQTCGGAHSTQQGATTRHNARNHLTKERSNG

SEQ ID NO: 968321 - protein, 177 aa, Homo sapiens
MSKDKNKHQPTDTQHRRRHPGTENTEERQQRKRDNSNKYHAIGAQAKNELWYEYKSDERKEEQKNDRERKDSNNLQRDADATKVDEEAPQARTRNTHAQQTDGRNKLTNTKPESSKRSSVTTAKSRNQAHTRPSIDAASKAKTTTLIRKGEYKRRQRRELEEKQRRKEKDRLTYPMR

SEQ ID NO: 968322 - protein, 135 aa, Homo sapiens
MTIFQLFSGEDQPLSDHEECLPYLVIFALTVLNGVIGSTSRVMVLSVSVFTPICIPPLIRSTMCERLSLDVVVRQGAPIFQLLSGKDQPLLVRRNAFLVLDLCFDVLDGCPGILFSRAALVRACLCPYLHHVSDA

SEQ ID NO: 968323 - protein, 75 aa, Homo sapiens
RLLTPNLNHRDEINGKRKTAKKQKMIHVRKSCGGELRTTTNATSSLLQERLFATEPEGRERSIGILKNSLTGPTL

SEQ ID NO: 968324 - protein, 488 aa, Homo sapiens
TVYYEPWLNPTVFFDIAADGEPLGRVSFAAVCTTRSQSTAETFSCSEQLDEHKDLAYKGFLSFTATYLHGPSMLLSGCADLHHRPLTWPLAAPTLHSYCGARNTSAHALHDTLSTSSNTPISRRSLGHSVGSDWPTTACALARPLQTALLPTPSSLRSFGTPVPTRSLARPAPPAAPAPTRALSLAPRLSRAPTALDPPHTGHCKVTCGWRKEASNVCANSPSPYSRRGFRQTGTRLAPTHETPYAQLTQHRYFQTPIFLALRLPIGFTEPPKSITGQHIYNGPSRRATLSRPGPTLMNEYRSKQPPSHQTETFQTCFPAISVGITRPFNRRHTTPSTPRPRFSSIPLRPQFHMGPYPSLYVSYSSPPSSADQPVLFRPGNGAYCPYSGASLSAPSRPYSLAAAFLFATAASFSPRALVPFSPPLRRRGALSVAAPSPTPACRSPLSVHSASPAFSVLPRSPFSTTPPSLYSRPSFSLSGRTTYQLHR

SEQ ID NO: 968325 - protein, 73 aa, Homo sapiens
MPPPTERGRPPENRKCSNARKSCGGEQRTTTKAKPPLRQERLWATGPKGRQRSTVIPQEGRYGPYLTAETLKN

SEQ ID NO: 968326 - protein, 312 aa, Homo sapiens
AAADAGDDARGRVRGPGIGLGGRGVRDGPGTRRCCSGSTLSAQPAMSRKKTPKSKGASTPAASTLPTANGAQDRQRIRDMRLSRPQTRRPNGPIAAPGTALALDETGVSTSTTVTFKVNAGGETRGDGEDLICWIDSIQGWMTYPGRGHFIIHREALTSGTKFWTVDGVKVQPADCGTQHGQERFRSVTHAITNGMLMLCCCSTMVTNEASFEQHPGLADTENTKSKPQQTCTLMMLGDPGGILTMNDVEEDGGTRKQGHKRRQATHDTRTQRGHNGTRHTSPQTEQDKHTKGTHNNSTVSTVQGDERPRTR

SEQ ID NO: 968327 - protein, 212 aa, Homo sapiens
NPKVRPNPARFLQNCRAPGGFMSNRLVETQPLPGRSIPASKAAQPQTANKFFQAAAARAWHAFPEDFCRHKVLPQTADRTSSSANAGDRLSSRHHLSRMGKFLSAEEYQQKIIPDEMVKMFSSTDRAMRIRHPCRQMEQFIQYLDRANSQHPDLTTHDRTWLPGHQPCHPGSRQVKSMLILDPKLNEANHQVELTEAHCTAYRPKDEQGPNR

SEQ ID NO: 968328 - protein, 136 aa, Homo sapiens
MTTMSYLWERSSLMDRMGDHKMAMDGIGVFKTFWSPSDGERFMQLARDMAKSYYEANDVTSAINIIDEAFSKHQGLVSMEDVNIAAELYISNKQYDKALEIITDFSGMVLEKKNSEEGTSEENKAPENVICTIPDG

SEQ ID NO: 968329 - protein, 122 aa, Homo sapiens
MEELSISARGHARAEAVMHRKGRESDDRRSAQHLQQVETGRAKQSEQRAGLAGTSRRTRQRDSNAKTAQEHHKPTTNHPATPAARPPPAQQVQHPLHATQATDNHNTRTRDRPSTDPPGHHN

SEQ ID NO: 968330 - protein, 370 aa, Homo sapiens
MPGHQSHAPARRQLPDTASASCSSPPFGACLRQLSGAGPPNGHTAQGECMHLHTDLGNSKCATTRCNTASRSAPLCTMHAFRPPPFPAGPNPPLLPNYTSDALSMPPPPGYQDQEKQPLHAGPARPRANPADGQLLGPRPTHGEPGDRAETPANQQENMEQTSHCCPQGAKRTDPGGNHRPPTNCRRRRPPPTQTNCHGARTHRTQHRASHTQHHRARLRAPHSPHAGLGTAPRRHRRAERPSATPAKTPSPHATPYRTQRKHTKETEKDTNREDRRSTHTAGPKRETPKRATRHRHEQRTASADPRDRSNAEHIADTPAHTAKNRQLAPHYRAKQTNSTHQPRTDHPYTTAQRVTTNEEGIKKQTNDET

SEQ ID NO: 968331 - protein, 198 aa, Homo sapiens
SLPHKPRAYPPEELIILFPPLLIPTSKYLIDNRLSHPTKQVTNQTNLKINDNHIIRRSNRTEPESLILVSLTHSYCSPSLSLLGVLPHSFIEAKPLQLSINLVHGIPFMSGRRDYRRFALRVNKCPSPLRYHKATPTPLIPILVIIETISLLIQPIALAVRLTANITAGHLLMHLIGSATLAISTIKASLYTYHLHRF

SEQ ID NO: 968332 - protein, 253 aa, Homo sapiens
AAGPYAGACDALAGMACVLKPHFHKRLVRRPRWTTVVQPGRGRTGSPHDVRPGQAKARRHRSAPRGRGPTPAHRALHSTSSVLTTEACAPAVGFSLAGCSEDGAVDSREQAWTRDHSDIILCDSERRAESKRSTRMSLTGPSGAGVSEREYPIPKLNPPSREEAASGPPSKWRRVRAERSVKREDTQIDQDKVMPCPGTSIRTDDSSESITDGRDRVSKAFAKSPSWTVANARLFGIRGTKSHREARRTGIVS

SEQ ID NO: 968333 - protein, 291 aa, Homo sapiens
FFSQGGLPLFLFRAGGPKQHFPLKAEQKIILVLSSWCTWSVSCTVPHPAWNKKRASRVLAPGREATCGTTRQHVACWPPSSCNLPVALDHAQGLRPWCVAIICGLMCPGSSLRWLPEPVRPLRVAGRHATRGSPYSTDFEKISRGAWGYTLFLVCFAQGNLCASSKTRSFTWGQVPKPQAPTATSKPYFLRYLVTQSHLVYTGKRLLSQSSVCPQNRVFRSSPGEVTQGAVFGLGNRETPGTVFPTVFRPRASQDGRPYIVFPRSGWRFPVGDHPGLREPTYVCHPVQPVT

SEQ ID NO: 968334 - protein, 34 aa, Homo sapiens
MANAGSQRCEPLVPCIFYAVKAHPEIVRHSGDML

SEQ ID NO: 968335 - protein, 149 aa, Homo sapiens
LFFLLFCWPKFILILAHIGNRILSKENKKEKRANCVCKGKRIAQTLCFQVLPLDTTDALREFLHHQERVSHLQRSVGPTPPIPHNVETKSGQESVPKVWDFPLLQESGVSTDSNNYLNAEFSGAQTKISWSYTDKTFGKFNNTVCLEPQ

SEQ ID NO: 968336 - protein, 185 aa, Homo sapiens
GLVEAVSGACCGMGEGLAYCGVELVGSLHWAYDIEGYGPVLIKGIDYGLVGGACEYVSEGAWITVGSGNGAIGKGLYWCDVGACAVLKGPDSVDFIELTSIVGADAGYGSCICGDTSLCSHLTGQSFVATSRPASRARSEQALGVLSMWWELGVSVGYVPQARAFLGASGLHLNPQSLPLYTYPR

SEQ ID NO: 968337 - protein, 347 aa, Homo sapiens
LLLVIEIQNRSQTWRLEDEQKMLPDIRQIREEEEAGKRRNSVASRSTHSDEQPHAEPVWQNMLYNGPERAELAAPADCSSDIHHRVTLPASRTLHRHGSHHYAPYPCHCSRRPNCSMEPTEASYPNTPSDTLTLLLGTITLRPPTKDSFESLMRATQANSWTHATALYARTWLPACRIYAFTPLGPKPWVHAYHDCKHPFNCALYMRHSPRLALSPPLTGLHVYGKSGTIHTSLNSLKKRSLINWNSLPAPQTDANESKARAPHARYPPATSTYQPTPGRATTNDDQRNGITPRAPHPLENTKRKSGRHQTSGRTHCATNQVYRSPKRTDNRQTPSHHPAHPHTQPQ

SEQ ID NO: 968338 - protein, 471 aa, Homo sapiens
YHRRAYQRFHDHALIIIIHIICFLVLYAHFPNTSQAKLTKYVTSSDAQDNRNRCELSVARTSSKIRQSALPVRYSSPFTLSSTRVKRLPSAYTSKSQLGHTKLASMQTPSAATNQQRNETSTQTYVQTIHVQYRNHTRVGMPHQPHPKRTDHMTEPPPLAPAVAPTRRHAYSSPIPTGSSRTRPPTHIARSLTSHTTHAPHERRRGSPAVAPAPNPIHKWKDTTASPSPKKPARADLLTAHTTQRTHATNNAAPRPGDTPASTTHTTPPKPTTAITDTHPAGPPPPNSQHTADEHALPYPTKRESRRETVATHGNKRPQRNLRKARKQTPTAKRQRRHNMTTTQRHRTHTHTRRKPNYAEDAHAPRAIYKTTEIPPDTATEQPHERATTATDLRHPPPTQHKSKHTRTPHIPDTDTHAPLPHQHQDDPPRHHAHGDRNQHHTPRGQRSTTQHHTTRHNRRRTQPPHDPRQG

SEQ ID NO: 968339 - protein, 127 aa, Homo sapiens
MPTAAKDTTTNSGQYAPQTEQPLYVATRNIETQQRKPERHHNWHRHDFRQAQRDTTQRSRTTHNAGAAPRASTATTHKRRAARPHSNTRRAATNRYGSARPPYDRPPNVQHPRQAEPPRADADPRRT

SEQ ID NO: 968340 - protein, 292 aa, Homo sapiens
KKKQFLISSPKGGSKGWINKRGRKQRGGPDATRGTRAGRDQEEQTAGVTPTQPEGEQHPPRRPPQRRGADNTRGEETQPAHYCHTSTHTEGGTIELEHDPRGRHKRGGRKGALTHTHTKRKEEQLEGSSETAPKRGEREEEETKTEEPARTTTAEKPIQHKKPKRRRRARAQHKKGGVDRHTTKKTRRGAQASPSEKEEQKEGRTTDRTNRKIDRRQVANQKERESRPQKKQKTGSKSNTTNVRGERQHHKARRQPGEGAEKKNDAPTRGHKEEREREQRHKKNNRQTTRST

SEQ ID NO: 968341 - protein, 129 aa, Homo sapiens
MRRDELRCKYPPRAEQMSLRAQAGHRYRSVKVITPARAGGAAQRLTWAYPTPFDPRLPRLVNGTRPRTPQVPTRAAIPRPPGDLRTIPRVGANTRHDHKEDPTDLQPSSSTKTHQHTARAQHNGRPCHR

SEQ ID NO: 968342 - protein, 284 aa, Homo sapiens
MPHTETYYIYSGGKEGDTPYRNLSCVLTLTAPLQQGETENPLWRNPRGCVAHKHISISPTDYICVHTPCVCCGRTDILWGGGNAPKRKKGLSLTKRGGSCNSRAGEHTRYVGLLTGGGNVLLGSYTSVRRHTFEENKAGEKSLSFTRVPSVGRSRLLKFSRDITQQKAKRVSTKKYIPSARGGGPHRVFSPGFYPHGSLFLWSPQGGVPLIRGEQSRLLYKTANETLVARVSFYHNRVGRSWAQQSCVNLWGDSLWWQKGHFILFWVGCWNIYLGHTIHLTAKI

SEQ ID NO: 968343 - protein, 115 aa, Homo sapiens
MATSVWAVKVLQGGGHRKIRGAIILDKLSIVPVRRGVLGDQDREVPTLVLDKVTGRSGSVLVRLIPETKGTGIVSEPVPKKLSDGWYSDDWVHFQPGAWTGNLGRISAPATLIAL

SEQ ID NO: 968344 - protein, 51 aa, Homo sapiens
MINIQKSGEFPSWRVGKQIRLGTMRLRVRSLPLLSGLMIRRCRVLRSRVFG

SEQ ID NO: 968345 - protein, 56 aa, Homo sapiens
EKTFGVGVELGRPPAKQQCPRCQRQPDPPWPYGVDGAGGETGKRCDPEPRSIGAEV

SEQ ID NO: 968346 - protein, 48 aa, Homo sapiens
DGYESIGTMRLPVRSLALLSGLRIGVAVSCGVGRRRSMDPTLLWLWRR

SEQ ID NO: 968347 - protein, 196 aa, Homo sapiens
MHRHKRRHTHRTPREAANNTHTNSRRHCTPPKQPAHPTRSAGHIDANRSHATATRPPPPHTHTLPTTRNNPPQDATPPLRNATHLPHKQPPHRKTDREEQGRRNATRRSDDSHQEETLAGTTADATKRREKRNRKRQHKTIATKQDATRTGEPPSGNPRTKERKPHAKQRQSEHRRETQPHHNTQPPEGPPAAARR

SEQ ID NO: 968348 - protein, 574 aa, Homo sapiens
RHLIVPHASSRQLLGPNAAALSRYLADLIYQPKPGSSRQGPWREGPPTDIHGAPGPSDSHVTGILSPNHSSTQTDNIPEKQAALKTYSHERANIPTNEARARWSRTRRDQAHRAQRFPDCNTTMASPMALQTTAKSTAGHISTADPRGGLLEWPTHMSQNVKTQRNNARLSRDRQGTLHSHHGQQDTAADTFEALGQGPKNDVADGKRPSHNLGIEKSPSPELPWGYILDIRATNTWEPYPRPLEFPPRGIPRATRDKLGEYKSVARRKHTVDSPTPHDTPPYTQTQTRGHRPTTKEDNTPSAQAATHKRLTPAATPKQKREHTQPRATYLEPEAREIYNTKRDNWAPARMIPQPTPGTPSGTQTAGSSIAANTLRRQTRPLSNTTEDDGTQIQRTNKRHRPTTTIHDSQGAQINKFTSTSSNNTKPREQAGSRQRANGGGRETPQRERQASPPTREGAQQRAQPNGAEDSDRSSSTRSTRHKNDDNDRQRRRTRQKRDKRGSAGEKEESERRDETDTEQEDTKKTENGTDRADDKQNDEPHDGRAAKTRRAATGRAGTEQGTQETRKRQNQSE

SEQ ID NO: 968349 - protein, 48 aa, Homo sapiens
MGSNLILNNECPNIPLIGLLLAQHKLRQLSKDLLVQISNPLNSTHSAC

SEQ ID NO: 968350 - protein, 72 aa, Homo sapiens
PRRCDTPMGHMEVPRLGVQSELLPPAYARATATRDPSRICDLHHSSRQRWVLNPLCKARDRTHNHMVPSQIC

SEQ ID NO: 968351 - protein, 268 aa, Homo sapiens
MSSEPCGYSVILPFTFQLRTFAQAWGFNYRVIQGRGFCASVGLQKARLRVSASVVSFPEGSFSVPPGVVTCSSQLSRTREGVRREVQITFGPAHLELHPGGGQGPPGSILQIRRGEPGLRILPVLLGNDLIWGFRCHSGFCGKLVPGSRNPPSQCVPVPTFGPLRDSDIHHRGLLGEDSFIKRLNGNPEGIIWQGYMIYDPVEREYIWAPTTMRKQFGIYKVARDACDRMIHRNRDVIGQIYYRDGIGLTRSANHERIIRRTLEECYS

SEQ ID NO: 968352 - protein, 68 aa, Homo sapiens
ASNKSYSCRPAPQPQTRQIRAMSATYTTAHGNAGSFNPLSEARDQTRNLMVPPMGASEPTNSPLCRQL

SEQ ID NO: 968353 - protein, 135 aa, Homo sapiens
GGEYHCVCLPGFHGRDCERKAGPCEQAGSPCRNGGQCQDDQGFALNFTCRCLVGFVGARCEGNVVDCLMRPVANRCHHAFEELNRHSPCLCPEGFAGRFCTINLDDCASQPCQRGAQLSETVSTEFRHGSCPQWL

SEQ ID NO: 968354 - protein, 35 aa, Homo sapiens
LGVNQSCCHQSMPEPQQREIRAASATYTTAHSNDG

SEQ ID NO: 968355 - protein, 151 aa, Homo sapiens
MLLCCSIRGETVLAAATILPVTASLASSLPRPGVSLLGCVRHVVLPARPRPPTVLGPPSSASLRLVCGRGGGGYKRRWQSHLKEGPLWRQSDDGWCSPTNRRRASIPKAMNHESIDTISSLIWYPGQIDALTQLSNHHTKRDFSSFDNTCG

SEQ ID NO: 968356 - protein, 46 aa, Homo sapiens
YIARDHRRVESPSCSDMKTVLVLYEFPLMGLLFAQDQWDHTLRVRD

SEQ ID NO: 968357 - protein, 240 aa, Homo sapiens
PPPPPPPPPPAPIGDTHHHPNALFQHTHATAPGYPRSRAHFPARTYSARTPTPPPAYLCACLRLHTHPITPPYTYVPHTIMREHTTNKHELLHVTPYPPLPRPPPLPHLPAVCTLSVAHHTHSPSPTLYPCAPTLPCNPHYLPHRCPRLRLTSAPTHHRTPPTSGTPHTFSCTAHADAPCPCTHLRAHTPRPPLSTRPYLPPARLLCRTTHPCTPRPARRLSHPLRLTSNTTLHTSSLHL

SEQ ID NO: 968358 - protein, 59 aa, Homo sapiens
HRRWSVAQWLTNPTGTMRLGVRSLASLSGLRIRRCCELWCRLQTWLGSHFAVALVEAGS

SEQ ID NO: 968359 - protein, 457 aa, Homo sapiens
PSSLPFLPSQGLSSPEAQLTAHFPAILLLLAVTLHPFLVALNRKPAILHFTCIIIFTPANWLGTTAHIPFLHIYYYMAGNLQRSTNGCASPPLALQQHCAHARWTGALLPLMRAFPPSRPLACTEPRHARTHPQSLHHTSHLTPQTARGQQQLTQHPSDKRPAHVWPCPSPPTTVLPQLDRLSGLPLMDYIAADHQHPTCMHAAANLHNPGPTTKRTHTNTTNNTPHHNTHHPRAKRRRNSHLSDHHTLSTHPAPRRSAEPNKREHNQTPASFTPQTTHNPACDATHTEQAGERNHQEKKRRRDEPPTILTFHHPQSRAPPAAPHAPTHLTPTPPPPAHANTARRTPHTPAPHHTTPCDRYTFSFRCPYAITHTATTDTQDTADRAKSNEKKGQRPPKDNVSNDNTQHHQLHTTNTNQERDKPDKDNTNAHKNREQHTKRTPHHRDNDAPTTRRDKN

SEQ ID NO: 968360 - protein, 75 aa, Homo sapiens
CANSWQRELRRFELPFDWPRCPVVSPGGNPGPNEAALPSEDLSQIGFPEGLTPAHLGEPGGKRREARLRNGAFAR

SEQ ID NO: 968361 - protein, 64 aa, Homo sapiens
CAVRMAETKKVNSPGRGWQMGTYISTMPSGKLAGISVKPFPRQSTMLLLQVQAEGQEMESRLRT

SEQ ID NO: 968362 - protein, 342 aa, Homo sapiens
PPRRARRLGFPRTPPGPGLPRHGRRCRFSDTSVLAIPRDLSGLPARVRAAGSSGFEAVEVAWRTRRRLRRLARAGESGAGDCTDTTRPRATKRRGHMGTRGPSPGDRRTSERELEQAVRNAKALGCPRIQLIGLDEYPRKLDRISSQGWQMESTNNPWENTWTGHMPDMRRLANPEEETHQMATLAWEAPIQTTPRVPLKPPQYDITWHNAPKVKDEQSTDHYTERDKDKNTKTSQVTTIGNKSFRSASRPHGMGTVDRQKYREDHAHEGPMAGATGPQGGGETQQTERRRVSPYSIMRRQRQQSNRGAPTDERQWQTTTGNQGTPSRREAPHQDDAKDHTT

SEQ ID NO: 968363 - protein, 45 aa, Homo sapiens
YIRNGRLGRKTGGRVNKNHTVSMEMCERTESEVWQKQARMPERGW

SEQ ID NO: 968364 - protein, 46 aa, Homo sapiens
YGIIAYLGLLMSKNLSLLGCRPYLSRKAITYNNFTAPNLHLHHHLI

SEQ ID NO: 968365 - protein, 106 aa, Homo sapiens
EPNNVYGGPGYGVKRELEPPVYTTATATPDPSHICDLHHSSWQRRILNPLSKVRDRTCSPMVPSRIHYPLSHDGNSGALVLKWVVPIPVGRNVEGDFDGQQGFSGQ

SEQ ID NO: 968366 - protein, 85 aa, Homo sapiens
MSGLNIKFALWEFLCVAQWLTNPTGNHEVARLIPALLQWVNDSGLAGEAVDVRLQHTALDPHVACGSRRRPGSMELTIRPHSRGN

SEQ ID NO: 968367 - protein, 72 aa, Homo sapiens
AVSQSLALTILKVDEILHQCVVSLMDEGHVYGEMGSVHRSPAPSPSSRQGKVQGEEQCDRGLSPSTRPSASH

SEQ ID NO: 968368 - protein, 66 aa, Homo sapiens
QCDLEIPEYERSEVIPFPEPYILVYANDAAISEPESVVASFKDTGISLLLCPNWIATLGLPFLQKG

SEQ ID NO: 968369 - protein, 74 aa, Homo sapiens
ASYTNSYSQPIIFDGRRVLDELQNELHTIGFQIETIGKKVSSKRIPYALLVKFRSYSLQDPTNKKPKVYRLLSA

SEQ ID NO: 968370 - protein, 51 aa, Homo sapiens
MSRRDMEKKSRAWVQEKTERHKAPRQERQTHDNPDKTGRKEYKVRRVQEHR

SEQ ID NO: 968371 - protein, 34 aa, Homo sapiens
KPLHYAQFHASCSFEPMVSSFWIRPLDSSWPSST

SEQ ID NO: 968372 - protein, 36 aa, Homo sapiens
MVVLVIPRRQRASLLCGSPQYVFNVIVSESSLNACI

SEQ ID NO: 968373 - protein, 48 aa, Homo sapiens
WFLLRNDDMVGSQLLLSELEENCIMLSLLPSDSAPPGSRCRVLPTLST

SEQ ID NO: 968374 - protein, 105 aa, Homo sapiens
MGQNQYHELHVPRDPVASGVPYTCCIRNHAQRCCQHHVWLEYFDKERLSVQDVIYVRVRAATCRVSSWCSGQIAPSWRGILLGHLSPQLLGMLLTLLYITRVEDI

SEQ ID NO: 968375 - protein, 141 aa, Homo sapiens
MCRYRRESDSQVYGVIAEWAFGDTRAEHKSSDSTFLVLMSHGILERESAELCYDEKKPDVLLYDTIFQIFNNRDCLSLKDKPKVIIVQAARGGHNPVGNCGSETLQHPLEVASSQSSENLEEDAVYKTHVEKGFIAFCSST

SEQ ID NO: 968376 - protein, 70 aa, Homo sapiens
MVGMIERIAQKSDGRIIPTIIADHHPRVKPLAFYLRRESTPPRITLLPISDNVEMNDSCEHTKPDPIPPH

SEQ ID NO: 968377 - protein, 105 aa, Homo sapiens
MLNHTVVVRSGLGFQGRLHVHEQELDYLLKFGSMKSVSKDRRTEVDNHEDDSSVIHNDNEAIARLLDRNQDATEDTDVQNMNEYLSSFKVAQYVVREEETLGEIE

SEQ ID NO: 968378 - protein, 85 aa, Homo sapiens
FVPHSVGPSRDSKIRYESGDQVAVYPANDSGLVNQLGEILGGDLDVIMCREQSWMRSPNQEAAHFTVAYVPTRTVLTLLTEHECT

SEQ ID NO: 968379 - protein, 111 aa, Homo sapiens
MPSNKERQDTVQNPPLESHVGWVMDSREHRARTASISSSPSEGTPTVGSYGVYPSVIAKFQHPSHELLKENGFTQHVYHKYRRRCLNERKRLGIGQSQEMNTLFRFWSFFL

SEQ ID NO: 968380 - protein, 44 aa, Homo sapiens
LEDPVGEGDVGVIALLSVAAFGCVWGLVLCANAWDSSCELREMM

SEQ ID NO: 968381 - protein, 66 aa, Homo sapiens
MYVEVMIGVIDGITIQLYQSYKAALVTQAPNTTKSVDSDLHLPHGVFSDVARLATQNKMRLTVEQE

SEQ ID NO: 968382 - protein, 36 aa, Homo sapiens
ATWIYWIWSFLCPEIDIQIKDAIGRYLPVPVNPTFC

SEQ ID NO: 968383 - protein, 44 aa, Homo sapiens
GGRSDSEVHWSEPIGSNRCCSFFAIRQIFNGTFVKLIKASIKML

SEQ ID NO: 968384 - protein, 50 aa, Homo sapiens
SEFTPCVSFVWSVFNSLFINTCCLWLHSIRLLRECLVDSEAWLCDRDLWA

SEQ ID NO: 968385 - protein, 39 aa, Homo sapiens
EYSFFRFYVRAYQATESRRNQVVRNMAQVGLHHCGVQRE

SEQ ID NO: 968386 - protein, 37 aa, Homo sapiens
GSPSRRGLESEWYHYLDEGIGVADGAGISESPDEGFL

SEQ ID NO: 968387 - protein, 59 aa, Homo sapiens
IIIRGSCKGGGHLHWVQREGFPLSSKERLHSDPEAHIQMLLAAALHIQDTSWRTRTATI

SEQ ID NO: 968388 - protein, 33 aa, Homo sapiens
MGCDEDDDDDDEEDDDEDDDDDDFDDEEAEEKA

SEQ ID NO: 968389 - protein, 43 aa, Homo sapiens
WDFTGMVISLDCVASLGMGASTVSVVVGLGYSYSKVSTQSKPV

SEQ ID NO: 968390 - protein, 37 aa, Homo sapiens
GRMQVSAARGHEAQVSRPSSRMGRCVTVDYTRNAEAV

SEQ ID NO: 968391 - protein, 39 aa, Homo sapiens
AGDQSIPSVALYHIVEVHAVLTLEFRPNFTIMSTSLRET

SEQ ID NO: 968392 - protein, 39 aa, Homo sapiens
MTKRLQSGSTRANRTMHSSISSHHRALIWPIAILFQSSG

SEQ ID NO: 968393 - protein, 46 aa, Homo sapiens
QDLFIGSFFYRGGCNFHGIFLGSPFQLIPGIPLGLAIAYRKALQYA

SEQ ID NO: 968394 - protein, 38 aa, Homo sapiens
MGKEATRVMLTSPKYSSIMGASISIVILVQTGPDESKM

SEQ ID NO: 968395 - protein, 106 aa, Homo sapiens
MGLAIGKARQRAKTEIEKLQMKEMTCRDIVKEVAKIIYIVHDEVKDIAFELELSRDGELTNGRHEIVPKDIREEAEKYAKESLMGERWPSSPISCFDNQQEVNYRN

SEQ ID NO: 968396 - protein, 67 aa, Homo sapiens
VRTTSLDGLYLDYQQRGHSIESPLYGTKTGRFVCHHSGEKPYECNECGKAFSQSSDLISRIVYYTLL

SEQ ID NO: 968397 - protein, 144 aa, Homo sapiens
MATFPQYTWHLKLDGRAELVRLEGRVMVCIQSESLLEEEEEEEECLPCLLVLVVLLVLVHLFMSFLHFLLHLLVYYHCWSNHARSQGIHRREFQGQAVGMEEGRDPTVGILDTLAVAQDEGAHLVGKAGLPWGAPGGGGQALGK

SEQ ID NO: 968398 - protein, 45 aa, Homo sapiens
YEVIDHRMDCTLEKCDTEFPISSTCMILVSKYLQIFNENQVGELV

SEQ ID NO: 968399 - protein, 116 aa, Homo sapiens
RQYVVNGRFMPRLVQGNHRHGLSLPFYKQYLNKPGGLTDLESIDREFYNSLIGVKENEYGGMWLGNVLLLCDKEILGEIKSHDLETLNGGNILVTEEHKEEYISNGSGGSNDAGNR

SEQ ID NO: 968400 - protein, 64 aa, Homo sapiens
MEQFWELCQLGICEPKWHEEKGRLLRAREGMGQRDQVGPDMDRGAPVDMGAGCERHGGRWWKLG

SEQ ID NO: 968401 - protein, 63 aa, Homo sapiens
AFRAKDVLSVYGGMDERRFLLWRINWSKGPGIHPTSWRALGLRQADWTGNPGQPRLRVRERGG

SEQ ID NO: 968402 - protein, 55 aa, Homo sapiens
PDQLIAFGDESKRTNPISRSDSSDSSLVSTLAGAAACSMEHAVVAAATGCSSHKW

SEQ ID NO: 968403 - protein, 120 aa, Homo sapiens
RSSYLQKKLKKDVQLSKEGGLFPQQKRLHVATPAKKAAVTPCAKMCCCNTLPMNDSYTMPNAVTTHCARREPHQCKAYVEQLAGKKGAAIPANGVQRMARMPRSEDSDEEEDDDSEEDEE

SEQ ID NO: 968404 - protein, 161 aa, Homo sapiens
DDVGESVHELEKYKRALEQQVEEMIDAMWKSWMDELEATEYAKLRMLVNLQAMKAQFERDLQGLDEQAEEKNEAAVSELVREMEAELEDERKLLLLMAVACPEDAGDGPEGPGGCASTRANKNRDEPIYNSCGSYVVPDEGLHSRTGLPPSPLVRRFLAHA

SEQ ID NO: 968405 - protein, 89 aa, Homo sapiens
MKRYAVERGVYFKEMAEVMMRSQHQKVVVSPNKNGLELPHQPRKHGITPGKKAAATPAKKTVTPAKAVTTPGKKGATPGKALVATPGKK

SEQ ID NO: 968406 - protein, 126 aa, Homo sapiens
MCRQVENEAMYYSPDLLLNTLDDRRVSNKVEPDTSHLITQWLHDVDCFYGGFMTEQMCVLGLCALIDMEQIPQVENQVSGQIMPAYILLLYRIDNEHMPDMQNMSMTADDDDEAEHNDETEEPGSD

SEQ ID NO: 968407 - protein, 42 aa, Homo sapiens
MSSEDEEEEDVKLLSISGKAVLPLDGGSKVPQKKVKLAADED

SEQ ID NO: 968408 - protein, 43 aa, Homo sapiens
LLILLTVIILLFITVFLLGILAILGTGARNGKNAQTEDSDHGD

SEQ ID NO: 968409 - protein, 45 aa, Homo sapiens
SDQDYNSPRKVHLVTNSTLGSMWMASSSNVATHLYVGMIVSSGDP

SEQ ID NO: 968410 - protein, 88 aa, Homo sapiens
MPSGKPFIELFRLDHFFTKPLVLEIPSEIESQAIVVVKIRGSTFSAPQRLITLNFIVSVKEDPVEDYLVPELGISNLLSSSHGPKGYR

SEQ ID NO: 968411 - protein, 167 aa, Homo sapiens
QSLSRGPRSSFEIDLTSRIEQIAALLAFALTMSPCVLLRASPPAAGEFWGQDVAHCRRVTHKFYEELFSLLLPQVSLSPVLPNYDIVHPKYHKERFVQQLKVCADEVQQQAQFSTIRSFLKLYTTMPVAKLVGFLDLTEQEFGIQLLVFKHKLKNLVWTSGISALDG

SEQ ID NO: 968412 - protein, 66 aa, Homo sapiens
ALRIPRILLYKVSGIRKSNQQNRGPINCSNRCTELVEYTSKDEVAVGIWVSRALIMFVTFRTHIQL

SEQ ID NO: 968413 - protein, 106 aa, Homo sapiens
TAKCRIRSAAVRCCTLQPCIRLLARLGDAPHRAAGPLQLHFALRFNGGVKTRRELRLFTFRPSPYLLNPISGSPRRNGAAPGLLAGPFRTRELRGVRTKGGVLPWP

SEQ ID NO: 968414 - protein, 41 aa, Homo sapiens
LLLSKVLRASSRLLPSDFPPHNSRTQLFFGLFGGHGAEALQ

SEQ ID NO: 968415 - protein, 30 aa, Homo sapiens
MASSISDCWQGKENVNPTGNFLSLIFLFSM

SEQ ID NO: 968416 - protein, 146 aa, Homo sapiens
FNSEKDPEDEEEEKELTPGVRPPKGWKRQIGACRFNVDEEPFVLPLCWGDGAGLPRLQTCNEFHKRIQDIVGFLRDLGAQREEGRSRSDYLNRLKKDLAIYYSYGDFLLGKLMDLFPLSELVEFLEAIELPLARHPLNHYLENPTN

SEQ ID NO: 968417 - protein, 95 aa, Homo sapiens
TSRGSTQLTNRTGSALLNQLATLQACGPQKLRAPIVLRNHWEDSLRAGTSSCDSISAQTLGGKKIFMAPNPRKPALDPGVSRPPGSSCQVQTCLI

SEQ ID NO: 968418 - protein, 33 aa, Homo sapiens
LPDEELLRDPLYIWLKHQRVHGEGIDDLLDEFS

SEQ ID NO: 968419 - protein, 57 aa, Homo sapiens
PKYEKLDHHPEWFNCVQQVSQGYKPPVCNNTICFPGSPACQLQILGLVSLHNHMSQF

SEQ ID NO: 968420 - protein, 57 aa, Homo sapiens
LPTEYCTELVITGNPITILPVSEIPPKSMWGDAWRMSTSVSVHMAVFTYHWMNGLGL

SEQ ID NO: 968421 - protein, 45 aa, Homo sapiens
CHERKKSLVSVKQMALVIIMPHRDSDKEGVGYVTNVLIQHISYET

SEQ ID NO: 968422 - protein, 112 aa, Homo sapiens
WSFFYQASKQKNNSPWFWLYPLDLGLSSESSFFIKARVCFYLQFFSGCFFPDRILAGTMWSLYLYMFVLFMFHKWRVFLEYSKILVGLPVILLADLLHLDKSHTHKYLLYET

SEQ ID NO: 968423 - protein, 39 aa, Homo sapiens
YGTSWCLTPPKTMSYGRELERRVTVIGKEDDKSNSTLKF

SEQ ID NO: 968424 - protein, 157 aa, Homo sapiens
SRESPVDLEESEKVKLVSHKISNRSGVPPYRILLIEYNIEEQVGRAIRSRIADGSVKRGDISYTSKLGSTFHRPELVRPALKNSLKKLIWAYVDLYLIHSPLSLKPGEELSPPDEIAPVLFALCGSLYHLEGHGEVYWLQDWPIPLGLSNFNRRQLK

SEQ ID NO: 968425 - protein, 67 aa, Homo sapiens
INQDIYQQLLNGGSVLLYTVSATADVSTVLASWLDRFVEGVCPFSGLEEARGDQCDKVCATLINEDR

SEQ ID NO: 968426 - protein, 87 aa, Homo sapiens
MAVLLKYLSALELSPQVVLIVKVLMISEVYLLIVTGILLNGDAIHKRSPSHKDMAASIPGDLYPFTRKPLYLIVDSTNSVAYKNFTN

SEQ ID NO: 968427 - protein, 47 aa, Homo sapiens
REPGVIPFTPQSIRSHFQHVFVIVKVHNPCTENVCYRVGVSTDLKMC

SEQ ID NO: 968428 - protein, 95 aa, Homo sapiens
GPDRSIAATIPKRKCSSDVSPAIILLSTLLISGSFNLATLIMTKNTSDNTCHHDPVGINMIHLHTSIEHPNPLRPWPKGSPNYVSDYHILQVYLL

SEQ ID NO: 968429 - protein, 98 aa, Homo sapiens
MLAAKLPVLRYAARPQAVRRGRTPMAPWSLTRDNIRQETLHPRPRGFTWDALDLGDRGVLKELYTLLNENYVEDDDNMFRFDYSPEYDIVGSPATRLN

SEQ ID NO: 968430 - protein, 75 aa, Homo sapiens
RASSRVDLTQVEFWWSLIAYDIQQPASSRSHTGSASRFWSGTPPDLRLHDGHNAILLADTGITGQNIGIFHDGEG

SEQ ID NO: 968431 - protein, 86 aa, Homo sapiens
SQLRSDSPSYSPTSPSYSPTSPSYSPTSPERTHPLSPSLLARRSPSYDATVSQSTRPTSPMLLANFTHAIAHFSQSTHLPGLRVYL

SEQ ID NO: 968432 - protein, 55 aa, Homo sapiens
EPGPPLEELFCNRYNPINLTTSCSAYIPAIFSKTLMNGYKCNAASTHVNDVSVYL

SEQ ID NO: 968433 - protein, 76 aa, Homo sapiens
YHRYKLLTILLLLSSHVLLFTFLLLILVLLVFHYLSIFIILLLILILLLTPPGPPRCPQHPSPGPPCCPGHSRRVM

SEQ ID NO: 968434 - protein, 108 aa, Homo sapiens
MMTMLTSVSGTEFRKELLLVPYIRPGYITAMIILTNPMDGMCSIELVLLHFWLGKVTVCIKCSLNYVISNSVKKEFKLDPVVGACSLAATVTTQEAEIGASLEPRSLR

SEQ ID NO: 968435 - protein, 123 aa, Homo sapiens
DVPYTTLEDETSRLSLGSLSHCIATTNLLGLLASLIYSQPPNYLYSLAMAIPSMTRAQVIIGVSRLRLKKCKTHVAYQQGDTIHPYIPDTRLYINTISHTQFKPIALDRTPNRLTLLQATYSC

SEQ ID NO: 968436 - protein, 121 aa, Homo sapiens
MGRYVKAQMILLLLDGTGDVQASDSATDPLASVFGNELIGGGFADFNTLSKVFLEYPFRSATSSVFSNVVITKNVFEETSVKSEDESHKHCHQRSELQQDPALYHLGKDPSTYWILLIPLN

SEQ ID NO: 968437 - protein, 54 aa, Homo sapiens
VLCASSVLTPSWAAFALGVLMVRYCDWVLVNARGQPSTTLTTPIAACPGETLID

SEQ ID NO: 968438 - protein, 65 aa, Homo sapiens
ETPRITPDSTKSTTASLELILDLHATVVRVKDDNKFYSGLSHHHFLVYVLLIPLYSLDDSRVGFQ

SEQ ID NO: 968439 - protein, 47 aa, Homo sapiens
SRQPADVPSLSALTSWDACWLWIWVLVSGKLLLRDETSPVFIYTREA

SEQ ID NO: 968440 - protein, 45 aa, Homo sapiens
MRVSIDKRTIEKLEKEAAEMGKGSIQVCLCDLGLYCIAEPCNVDI

SEQ ID NO: 968441 - protein, 45 aa, Homo sapiens
YISWSNPVSDYAEYRCNVENLPTIAVKPGSPTCKCAWSQLYTEGD

SEQ ID NO: 968442 - protein, 52 aa, Homo sapiens
VGTPGRILSLVQNRSFSLKNVKHCGLDERDKMLEQLDMRRDVREIFRLTPHE

SEQ ID NO: 968443 - protein, 56 aa, Homo sapiens
IAVAQQKVIQTLTFARQHASFPTAKHIAFLPHLLVPPQSLLLVVGCVSPHGAPVAR

SEQ ID NO: 968444 - protein, 37 aa, Homo sapiens
TVAQADRQRGIQPSPLARSSELPGDFFNLTAEEIKRE

SEQ ID NO: 968445 - protein, 54 aa, Homo sapiens
CCGSEKVITSELLPGACLFSHRNNIAFLPHLLVPPQSLLLVVGWCLLMEHQWLV

SEQ ID NO: 968446 - protein, 77 aa, Homo sapiens
RSTGGTPSHKDNHLDELDITRGSWFHVNECISSVNHLFLNVFFTLLNLLSFQSIHQDDTLIKSFEIYLLLCFCKYFP

SEQ ID NO: 968447 - protein, 47 aa, Homo sapiens
IYHGFEDEYSGIHHQDHCYALIQNLHCPFEHLLIIITGSQSGNGYQP

SEQ ID NO: 968448 - protein, 37 aa, Homo sapiens
VTRWRTGKYPDKVNSRYLGINRQSISNLHVLLLQTEV

SEQ ID NO: 968449 - protein, 60 aa, Homo sapiens
RPRIQYDELNVEDKKRSVKCDILLPLYNTCDWEEVSGNSIMMKNLSYKVMEDNTWGHIDG

SEQ ID NO: 968450 - protein, 46 aa, Homo sapiens
GPHSYDEHMAAMTGNFSSQQCMAQNKDLTTIYEHCTATSRYVSIPE

SEQ ID NO: 968451 - protein, 54 aa, Homo sapiens
MLKLQLKKICNSYRPMTDRYKEYCIVKKMIKKLHTLTRYTRDTDARVSVIIGSY

SEQ ID NO: 968452 - protein, 55 aa, Homo sapiens
REEQKKQKSVAIGRSTDTSITIDSCDDKHNCSKLSTVSTESVSGTSPCDILSCIT

SEQ ID NO: 968453 - protein, 67 aa, Homo sapiens
LLFKERSHGGHGRMSTCPMHPRAGMTENVPNLHVMKGHCRSLKIPKCYREANKFACAVTFLQDTYTN

SEQ ID NO: 968454 - protein, 55 aa, Homo sapiens
TRHDRFWGLRGLMSISIESSIGWRHALVVGEKADGDYRPLLQITTAVVPSRFRNR

SEQ ID NO: 968455 - protein, 34 aa, Homo sapiens
MSQQNSSNSIAVPAGCEAGGYDLRLISSMVFYHI

SEQ ID NO: 968456 - protein, 45 aa, Homo sapiens
IGIRSLCWGAYKPSTRSTPFSSEDQPPEVKETAGYSRIPNQVASI

SEQ ID NO: 968457 - protein, 55 aa, Homo sapiens
MVTSQIKGHQWIPDFSVILILATMSNDNSCITVCITSVWILHRDLTLHVHAMLVH

SEQ ID NO: 968458 - protein, 49 aa, Homo sapiens
DQCRLSGSTGWIIHDQLTDMEYQIVFEVSDGKGRSGEIAIDDNCEMNQA

SEQ ID NO: 968459 - protein, 127 aa, Homo sapiens
NAAYDNRFSYANVAWIDIWLLTRGITTGLWVIYSTEASTGNMCRISTLNDTTLQVLKHLRIPSSYKPSASNAFMVCGVLYATRTMNTRTEEIFYYYDTNTGKEGKLDIVMHKMQEKVQSINYNPFDQ

SEQ ID NO: 968460 - protein, 55 aa, Homo sapiens
MNYGTLGFNDACGPIPHFILVSAGQVEVHLLYINVKPHGVGGFNFLRIPNGDRRL

SEQ ID NO: 968461 - protein, 47 aa, Homo sapiens
SARVTVTVGGLQLVSPDKVISELIHYAEGIGVSPCYIMLWFPTDDRR

SEQ ID NO: 968462 - protein, 57 aa, Homo sapiens
ALAPGSVMPPDLSICLEDQHWDDLMSTNGMSDAHESVAQTVHVHYGRVDVHTCPVCP

SEQ ID NO: 968463 - protein, 53 aa, Homo sapiens
LGLAVEDTDEVIDPSLTSKQLSTTWYLNLLSTPDYVWTNLQLLHTSPNGERRL

SEQ ID NO: 968464 - protein, 51 aa, Homo sapiens
QRKQIVVVSSTNREKRTKKTLHHLRMNTFTGVPANRFQLNASNSPTVTGDF

SEQ ID NO: 968465 - protein, 48 aa, Homo sapiens
MGLVNIRCQTTAVTLINPKRLTLATFCGDPSRMSDAAWRQQCYVHLVP

SEQ ID NO: 968466 - protein, 39 aa, Homo sapiens
AGPISPQQSCRCLPRHRGSAHLVSFRNLHLSAPKSPLND

SEQ ID NO: 968467 - protein, 117 aa, Homo sapiens
SGPGCVIYPPTQIAQLRQVLAGRSGCQTSSIPKYARCISDQLLLEPPFSTTETRLLHRVPQSHVNSSVVANTSNTDNWVHAPARCSQLQTTSSLYRTSSTRINTAAESQQSITTDPG

SEQ ID NO: 968468 - protein, 93 aa, Homo sapiens
SLILCEGGEASKIMETHWPCERDTSRCAAGYEKELGDGLRCWARMQKELDEYQELLDIKLALDMEIHAYRKLLEVRGGEATPVPQPYLAAQPG

SEQ ID NO: 968469 - protein, 81 aa, Homo sapiens
MEGAEAEELYSEWPGGLGSGTVLKCSSHIIDRLTPPEQSPRLPSPTDPARALPSSAPMTIREQPPAPPQPMTLWTMHNHVV

SEQ ID NO: 968470 - protein, 48 aa, Homo sapiens
LGAEIIGLRKLHLWGQNMPRLRGALYLGSSESQTACLVLHTWLCSVQN

SEQ ID NO: 968471 - protein, 53 aa, Homo sapiens
MAQEAKSVYGERFPDENFKLKYYGVLAVVSMATRRRPTPDVLPDSFIYRQIND

SEQ ID NO: 968472 - protein, 35 aa, Homo sapiens
MTLAVEGIQKTIPRATANLPHVYISLDESLAGYLS

SEQ ID NO: 968473 - protein, 49 aa, Homo sapiens
MTEIDKPSLHDDDEERTSPNFLTCAVTNKGTDLPSPDALCRNKDRERRI

SEQ ID NO: 968474 - protein, 39 aa, Homo sapiens
MSSKFVTCPICKHSFITITSTLSQSMHVHPANHCLAVIM

SEQ ID NO: 968475 - protein, 109 aa, Homo sapiens
MLKSLIIWQTIKISDMQFIPTSLQTPPESSTVDQAKRAGRNQSPPVGYMSQPKSLQLLKPSILSSLVPPPVSESSPSRTPTCKKSPIITTCNSAKLQPTSSQTNLANNQ

SEQ ID NO: 968476 - protein, 57 aa, Homo sapiens
TEIYLEESPDPGGNKNHTIQHDKDTRHVPSHKLFGSLSKYSRHRYTNTPSDMLPRGS

SEQ ID NO: 968477 - protein, 37 aa, Homo sapiens
MTIVIHGDEMYDIDVLLTVQVGFYRRSARPPQLHALS

SEQ ID NO: 968478 - protein, 95 aa, Homo sapiens
SCGDLEYPQCHGSRTIGLAFVYDLSISCRFDDERACPLLRERERVVIFEEYFEIYYGCSSGFLHYRERLLDRAPGSASRVSIAWGCSNSIWFGGS

SEQ ID NO: 968479 - protein, 39 aa, Homo sapiens
SQLQKVRLEAVGNIANKPTYFDIYMAVAGVVDIGVEVED

SEQ ID NO: 968480 - protein, 148 aa, Homo sapiens
MAVFIEMLSFVLNWLGIPQHHVEVIDDVMRMAASRLQATDWAVPRISLRVPESSLAKNRCRICRARLTISSKVIFPLCSMLFCYFLSLGGSLRGFDDQGRGRRHHLNLGLSVLNGQFHCNPQALPVTQLPWQCHHQLFWETDPGGRSW

SEQ ID NO: 968481 - protein, 175 aa, Homo sapiens
GPGTPGGACDGEKVVQIGHLRTTEKLWYMSSAWHQRCAAAQKWAGASAICRGYRSVQAGRQGRPWRSEPVQGKMCEIGWCRPSPQFHCTPSVMDYAVMAWASAMMWMWSLSLHMVSISCWQNSLTCPSSLDELLEELALALQVARGEQPQVDHKVLGGALVIEGGHKSATEVCFS

SEQ ID NO: 968482 - protein, 33 aa, Homo sapiens
DSGPAKVASKNVILPWNWWSPLRMHEVQQSLMF

SEQ ID NO: 968483 - protein, 43 aa, Homo sapiens
EDPRYNAKGIMKSANANSLRLIRKLIKDVADRPARPVTVHSLG

SEQ ID NO: 968484 - protein, 46 aa, Homo sapiens
SRVSRYKAKEILTSEVLACRNTIIETAGETCPSCWGKRRAPGLMRG

SEQ ID NO: 968485 - protein, 33 aa, Homo sapiens
SRVSPSLRNLNVELRFYLDNQLSPGSVGFVAIY

SEQ ID NO: 968486 - protein, 53 aa, Homo sapiens
SRGSRWPHSEHECTEGPKLYNGLVAGLSAKLSFASVRIVLYDSVKQFYTKGSE

SEQ ID NO: 968487 - protein, 37 aa, Homo sapiens
RWFYSSENISNFNHALEIKDCCQLGLEVISSTLDHAT

SEQ ID NO: 968488 - protein, 108 aa, Homo sapiens
SRCSEYLSLALGSQQKQDRIEGLKRHIEKHRYTHVRIVKTILAHAWTSDSPRSAIRKDQGTTVDCTMFDSLPVTPTFEGELSFSYDGPVTSEDISTGRLVANLTPPSH

SEQ ID NO: 968489 - protein, 62 aa, Homo sapiens
RDSVTTCREILSVDCSTNNPSQAKLRRDVDWNPFQVAERVDHGNTTELLKVLTMWKDAQHLP

SEQ ID NO: 968490 - protein, 74 aa, Homo sapiens
SLRQYGGRNSIFKFFTVVKLRSRVLWVSTSRTEHVGIGGAPFYYHLQDSRLGIHGLLEQQNPSFYQLLYQRTWI

SEQ ID NO: 968491 - protein, 111 aa, Homo sapiens
QESYWIAVGCRYFDPAKEVSKKPPARMVTLPRPFCQLILDPIFRVLDAIMIFRKEETAKLIEESGHSNLDSEDRDKEGNPLLKVVMRLLCACRKNPLWQMITIHPPSSVYP

SEQ ID NO: 968492 - protein, 138 aa, Homo sapiens
PAKSTLELSPSLRKSEDGMSPTWQCLPFRPPYDHTNNQLPITISLLPFLSVRLGVGPSGCYLCHLAVLTWKYAHLDCRSLSLIDMISFKISSHLVSHFAHWPCLWFSMGMLITSHFLFAVSLLSGMFFLTTLRSLFFP

SEQ ID NO: 968493 - protein, 157 aa, Homo sapiens
MLVLESRNRQFSYLIENSGPVTELEVAHTRYFRGGMLTNARLLLGPTVRLPDLIIFLHTLNNIFEPHVAVRDAAKMNIPTVGIVDTNCNPCLITYPVPGNDDSPLLLHLYCRLFQTAITRAKEKRQQVEALYRLQGQKEPGDQGPAHPPGADMSHSL

SEQ ID NO: 968494 - protein, 48 aa, Homo sapiens
VRSMMRSRVSFRNQSFDMDSDVLKTFSGKSIKVSFGTRRADFNRGGGN

SEQ ID NO: 968495 - protein, 69 aa, Homo sapiens
HEVIFFGDHYPRPNPACPVPVITRNLQRVTKELLGKGERRNERKVEEEIVEALVLEAEEEGGSPMDHRA

SEQ ID NO: 968496 - protein, 47 aa, Homo sapiens
SKISLTTSVRKCLIEHVSEAENTHEFTILVTLKQTHLKSRSNSLKFT

SEQ ID NO: 968497 - protein, 59 aa, Homo sapiens
LYEDLQLFQGYSAECNMKIISSIELVAVLTLVGQGTHEGPGRCVAAVHAIVNKGEELVS

SEQ ID NO: 968498 - protein, 53 aa, Homo sapiens
DERDVILRQYISTSCAQPSLPLQLSECEHTCCRWVSCPHGALMPHHNGGSHVL

SEQ ID NO: 968499 - protein, 44 aa, Homo sapiens
RPILSIPDSATTSYTSYEKTSYHSPFALFFIAEYTNIIIINTLT

SEQ ID NO: 968500 - protein, 57 aa, Homo sapiens
MIITLNSIHCPLPRRSGSRYSGYWTIWAIIERITKNNSLIISTIIATITLHANSHSS

SEQ ID NO: 968501 - protein, 61 aa, Homo sapiens
GIETAGGVMTKLIPMEQLVVPTKKSQIFPTASDTQPTVTIKVYEGERALTKDNHLLGTWAL

SEQ ID NO: 968502 - protein, 131 aa, Homo sapiens
PLLIIFAFVGCHTLHFRLVRMTMEVHGFHYQHFQILNVDGVSLKSHQRCLPSSPAWEVSVGDCPKGAASNPVAWVFLCCFPILQCGHGQGLFHASILCIIANLTLEQNVNHKAVHLIPSPLHNSTKHALKP

SEQ ID NO: 968503 - protein, 183 aa, Homo sapiens
ELEFVLVKELSIELLEEDPSWSSASHYDTARLIVLQRAGGVAHYLKHVIAGACQIGVGLANVVLGLHVVIEQVSRHVDAPAESPRSPPPSWIAPELKSCSSRRRSMGLSPSCRKPNPFSSVSLSVLSLSFSRYGIRSFSVQCKNLCRWMSAAQVVRMSMAVRRVCLRDGTKTMTGFLGECLVI

SEQ ID NO: 968504 - protein, 45 aa, Homo sapiens
ELAPVGILFARTVVLVTGFYNLQVGKAVRGVTAMPCGSTNGQCDI

SEQ ID NO: 968505 - protein, 145 aa, Homo sapiens
MTQRSSSSCKELVGVDHHLKHVIALAERLGEGHAIVELGLHYDQQVELTPEMPQKRVRKVTTGWIAPELKSLLQEASLHGAEPFMQEPIPFSSVSLSVLTLSFSRYGIRSFSVQCKNLCRRMSAAQVVRMSMAERRVCLRDGPKT

SEQ ID NO: 968506 - protein, 35 aa, Homo sapiens
ALTKTRAGRPNRLTLLAGHLLMHLMGSATLANSNS

SEQ ID NO: 968507 - protein, 49 aa, Homo sapiens
YPGQLLAFWNRIMVGPGICILMDPNEILDVETCLRGKDLMDFFQTYGAI

SEQ ID NO: 968508 - protein, 47 aa, Homo sapiens
RDRLCEHALIEFFHVARRGEYGRGCIHSVHSFLIEQVLLPAEVVLLV

SEQ ID NO: 968509 - protein, 79 aa, Homo sapiens
MWTRHQPRKKACHNALCYAHTPMVNSSDYTFSNKRKFNYAILTPGLVNFVPASALTRLTQVNRSRRKECFRSPPPPVHA

SEQ ID NO: 968510 - protein, 46 aa, Homo sapiens
VTATLWWEDADKFDGSTQLNIIVILIKVHNIIRTSNGDLMLVLVVV

SEQ ID NO: 968511 - protein, 35 aa, Homo sapiens
MYRGAEADGVDKSAVGFDYQGKTEKHESQRDYSKG

SEQ ID NO: 968512 - protein, 66 aa, Homo sapiens
PSSVPLSSLNLCRGHTYCAARGEILVTGALMDQMRTHIANECYINHDTKVGVFEDDQIPSQFLTIN

SEQ ID NO: 968513 - protein, 140 aa, Homo sapiens
ISNQETKKKLTKEFDEKHCTQEENISSKVLLKCGLLSSRSAPSARKYRLLRITSSQHGQLLDELAGVAQATALHKADLHGKARPRLLHKLVVMGPLQAVRLLVVESLDGETGEHLVYQQRPGVRVVQCGGLDEDGVPGVT

SEQ ID NO: 968514 - protein, 73 aa, Homo sapiens
DPRRSRVNEGSMLLMWRASEPHCVDVNMYRECTAVTPMSSPVSQRAIFDHENVDTSTESSPNLIVGGTARLAR

SEQ ID NO: 968515 - protein, 71 aa, Homo sapiens
GSFLSNIEVVNPIVDMDSRIGLNKKIETDLDYSGLLRLHQSKRTLITRSFNNWCNGTRYPINIEVVNPIVD

SEQ ID NO: 968516 - protein, 82 aa, Homo sapiens
GRGGKPLGLCERINRDNQYIFESIFQAVVEVRLIQQNLSKSIILRFITTPRIDFVANIHSILLYQRSRREETFDLSGKAKCT

SEQ ID NO: 968517 - protein, 80 aa, Homo sapiens
DRALNAWSVHYIWNKNVNSDHYWKLHKHDQLTKNDPQFVMTSIETITMNEQVKAIKELGDHVTNLRKMGAPESGYGGISL

SEQ ID NO: 968518 - protein, 132 aa, Homo sapiens
SAVLRTVLSDCAAEAQTRVAMPQVHLSLPVTAAHHLNPVLPPGRLNGEAALESWNHYHRLTMLDHQWLSQFLCHIWSNGRGILDGQGGLALLVTSYKGVPPNLGPLHMRDEEAVHDTVLLKDDSILGGELDA

SEQ ID NO: 968519 - protein, 81 aa, Homo sapiens
RTGEKLEDGPKFLKTGYAGNDDMVPGKPMYVDSFLDYPTLGRFADCDMTQTDGEGFIKTLDNKAGGSGKVTNSAQKAQKAK

SEQ ID NO: 968520 - protein, 109 aa, Homo sapiens
CHTRRVLPHYTHKRHAEFEKSHSLLIFRQRADSQSVRSQRTEYGTHFMGPTPLTKKWLRCPKINQTPKACATLDCFENSWLVVKKVNALQNVLKTLKKKQHFLKKKSLL

SEQ ID NO: 968521 - protein, 39 aa, Homo sapiens
LCDATMEDVNDWLTDLEYCVRDSVIKTLPSCLCASSSSS

SEQ ID NO: 968522 - protein, 57 aa, Homo sapiens
QDSTRRLPHNKHSWRQQLKSMKNQSVHAKQSRELTQEGTEGYVHNWVFGSVTGSYYE

SEQ ID NO: 968523 - protein, 61 aa, Homo sapiens
RRSYKVHDRNATVYQLRETIINNMYQCLGVLCILMIKRGVTEDDGRPIYALVNLATTSSSS

SEQ ID NO: 968524 - protein, 66 aa, Homo sapiens
MEMPFFYSNGLLRRSPYKKLTEGQLMNLIERAVTYAQIARKTCESNMVEHSAPPHVPRNLYPAGIN

SEQ ID NO: 968525 - protein, 41 aa, Homo sapiens
GCHEEDVSVTVITMGREENDQECHLHELLGSHMSLPSPIAT

SEQ ID NO: 968526 - protein, 40 aa, Homo sapiens
LRGYGIIRLTLILNPLTKHIVSLYPELLHEALFLPATDTY

SEQ ID NO: 968527 - protein, 66 aa, Homo sapiens
LPASHVQLASISIFGDVLPPPRPAMSGSYGQKAVLQAKQTALGWNEPYLNALFDFATICHVSWANW

SEQ ID NO: 968528 - protein, 72 aa, Homo sapiens
EGPNMKETQTDSISRYETSSTSAGDRYDSSAVSLWIITYLEERKPYSSRLKKDDSTDFKKLYEQILAENEKL

SEQ ID NO: 968529 - protein, 47 aa, Homo sapiens
PVPSIATSNLCLAIHDWFSIEFQLLPPLGLMCGCLGGLLFFTLWYCY

SEQ ID NO: 968530 - protein, 35 aa, Homo sapiens
MTMVLCIFILVTTAIEDPTSNGHMCGDCAFLVNVG

SEQ ID NO: 968531 - protein, 63 aa, Homo sapiens
LLGPDKLSGFKMYPIDFEKDDDSNFHMDWGGVVSNLRAKNYDIPSADRIMSKLIARKIVPAIA

SEQ ID NO: 968532 - protein, 51 aa, Homo sapiens
RSRSAYLSEASRSVVPQLVRDSLKDHPTRRQPVPGPPPRPGKPVRITFTRR

SEQ ID NO: 968533 - protein, 34 aa, Homo sapiens
MGPSNDCLSSDHPNKEASSNNGPPSSSGKATRRL

SEQ ID NO: 968534 - protein, 51 aa, Homo sapiens
MDSGGIDSSDSESDILLGILDNLDPVMFFKCPSPEPASLEELPEVYPEGPS

SEQ ID NO: 968535 - protein, 40 aa, Homo sapiens
VNYYKFFTCCVQGFLISCLAARSASPSWLLVSDVRLYGPM

SEQ ID NO: 968536 - protein, 83 aa, Homo sapiens
IIHPALIQLESGLQSAMKSFYFLHGEKRDSLFTVLHLYPINLDNAVSLIGCAHPLAAMLVRVNLTVYKSLCRLHRPSSAPGIR

SEQ ID NO: 968537 - protein, 57 aa, Homo sapiens
MYSRIGPLYLTRRNTVIYELISSLWRSHIIEELNVRKVTLSTDQNKEAHSAKVWLTV

SEQ ID NO: 968538 - protein, 121 aa, Homo sapiens
GRSGGGDIHLSHPSSYVDRRTRRCTFGPVTARSMAGDSLDGHRLELLAAYEEVIREESAADWALYTYEDDTPMSSSWQLSGEGGLQGLSGHFENQKVMYGFCSVKVSLAALPKYVLINWVG

SEQ ID NO: 968539 - protein, 68 aa, Homo sapiens
MSARWTPIIHASSCMNQKLSACASINAGDEAGTLERDRARGRRAVEHDAAGESLRVMNLTDLLNLSCG

SEQ ID NO: 968540 - protein, 78 aa, Homo sapiens
MRLVAIDSVESLWWHDPGGRMLSACARHHGTGALRSSMNGEGVVTCEHVVAVSVTCEGDSQTHTCELQIQVSWWFTVA

SEQ ID NO: 968541 - protein, 58 aa, Homo sapiens
CRTAISSSAGDGNRMMALSSVPPQQGGQQQQGPPPPQGKPQGPPQQVGHPPPPQGGAT

SEQ ID NO: 968542 - protein, 33 aa, Homo sapiens
LVRYFGASFRIIRRYSGIEAQLGDVLSDSELQN

SEQ ID NO: 968543 - protein, 47 aa, Homo sapiens
TEISSSAGDWNQNYGPQQGPPQQWSASSNKVHHLLSESHKDQPNKEV

SEQ ID NO: 968544 - protein, 106 aa, Homo sapiens
MEAVNVSCPLHMVSQAGVACRDAVYCSDKGCWTLESVFVGGNSPGSSSSNRRRVVPECLYSVWERFQTGRCQSSLAGGNEGDQRSIAKRPGTQTQLEPDGEELDKA

SEQ ID NO: 968545 - protein, 58 aa, Homo sapiens
MKASGALSIVKVVTSQLLAPKRHTPPLYRMRIFAPSHVVAKSRFWYFVSQLKKMKKSS

SEQ ID NO: 968546 - protein, 71 aa, Homo sapiens
MVKISIKPTCTPGAGKAWNRQVLMYDARARTRLARRFQDIHAGRHCGDATSRVTYQATCVSYEYLAHYEGQ

SEQ ID NO: 968547 - protein, 59 aa, Homo sapiens
VNISMMNSTGGSSSGGGIRADPRGEPWATMYVLEWYCQGFLLEVFIGFKVYHFNVFNTI

SEQ ID NO: 968548 - protein, 42 aa, Homo sapiens
MGLHDVPAIGSVCSTYHSNMDPGGPGKPLERQPKGCPSVPVR

SEQ ID NO: 968549 - protein, 77 aa, Homo sapiens
MLSSCLNHAVATLGLRHSLGLLTINASPSLSVCLYISSLPQDCWVASSNVFQGSQEIWLHLAACVLDTGLKYGYGVS

SEQ ID NO: 968550 - protein, 38 aa, Homo sapiens
VKSSSCCWSHLRSGMRTKPSEGSRVLENNPDRFRPILS

SEQ ID NO: 968551 - protein, 51 aa, Homo sapiens
VVLYSKYSKIGEHVILKAKTGTNTFLSGAGSLSIVRDIPQLQLQQVALQQQ

SEQ ID NO: 968552 - protein, 43 aa, Homo sapiens
YHQLTIDTPGKVIHDNFGYRESDSGPQSMPSLHTQKTVDSPSG

SEQ ID NO: 968553 - protein, 44 aa, Homo sapiens
EEHRDTVLGQLDTVSCRTSSPLSSLVQDGGRDDLAAGTARDTAT

SEQ ID NO: 968554 - protein, 34 aa, Homo sapiens
SLGRTSGLELFTRGGDLFGWNFSSSSSSSTTNSP

SEQ ID NO: 968555 - protein, 53 aa, Homo sapiens
PLLPGCVTLSLRALIFWNHGQHIHHHQEPQQQPPGFQCQTQPWLPVGQPALAS

SEQ ID NO: 968556 - protein, 33 aa, Homo sapiens
MAHLGHIAGSRGAGLLGRGGWMALRVLALLACV

SEQ ID NO: 968557 - protein, 69 aa, Homo sapiens
MRTSHRWLPTITGSRYGVLQRGGLGSRALVSDVESSYIVVVVKSNSLHRFTVIICSEAELSQKDPCRAG

SEQ ID NO: 968558 - protein, 37 aa, Homo sapiens
EWKLHLELNSESPGGEEDSGGGAGRTEKGSARQELYA

SEQ ID NO: 968559 - protein, 66 aa, Homo sapiens
ESDTKITANTKDEPHHTNHQRSTAVKPSSKPPNQLASSQEILLPSPLLGPSAQELLLSDLTWRVIQ

SEQ ID NO: 968560 - protein, 57 aa, Homo sapiens
TWLKRFCLSYVQSLEHSSDEIAAHEGLSEFFSKSTQEVDSLEKLSAHMGLPGTISTM

SEQ ID NO: 968561 - protein, 56 aa, Homo sapiens
MATRYEGGLWSRGEAAYSSATIRECAGLRLLDVTPLSLGIETAGGVMTPLIYSSTT

SEQ ID NO: 968562 - protein, 53 aa, Homo sapiens
RPPPPHEHERLHGMLSPCSLLVLQHSQVHFFCTSPSVQIHKHGQLRVAEQYED

SEQ ID NO: 968563 - protein, 65 aa, Homo sapiens
SVGCVRLGGCEAMELTSRLDRNAGQDEDHFITVDAVGCFAGAEEEAEDDEDEEEIEVEEELCKQV

SEQ ID NO: 968564 - protein, 45 aa, Homo sapiens
MGLVPPDQPPSQCLGYPKYQKSVASYVSSEQQRGAAPDSSSMQHL

SEQ ID NO: 968565 - protein, 86 aa, Homo sapiens
RPHTSVYLPSYGRPDTSASWWCMGQKDSYVGDDGPDAMRGILTLKYPIEHGIVTKLVTTPPRRNDDDEFRHHDDEFRHDHDEFRHD

SEQ ID NO: 968566 - protein, 73 aa, Homo sapiens
LSNKQPDFTPLNTISAYGNSFNLTGECNQQTRIISIVQSGLTEELERVKKWTFIPLGVDSERSQSFLASQFRL

SEQ ID NO: 968567 - protein, 38 aa, Homo sapiens
SQSDVLSSSCALAGVVVHGVLLLGGHVGHEVHDHDEFL

SEQ ID NO: 968568 - protein, 60 aa, Homo sapiens
LAYVTSHSHDSTLSLAAFHNDELLLEGRSCATHYTHVWYYQVVPDALNYCNTLCHMLVYL

SEQ ID NO: 968569 - protein, 62 aa, Homo sapiens
WCGRKLELQSWRLWGWREGEKEGNVTWVNDLCTEGSTAPLLLPLPLLLLLLLPLLPLLLPLP

SEQ ID NO: 968570 - protein, 51 aa, Homo sapiens
RSQDQWNGLRIRFFLQEIKATRAATMAATAVAMTTATMIPIGEDQHDEFHD

SEQ ID NO: 968571 - protein, 43 aa, Homo sapiens
SIRVCACLLLLVRRSGKIKEPLLLPEDDTLYKRLLLFGYLSSN

SEQ ID NO: 968572 - protein, 47 aa, Homo sapiens
SRDPPPLYGTYIALWARGMEVVLFYRELIHCVLQFVILSVAQEKFML

SEQ ID NO: 968573 - protein, 81 aa, Homo sapiens
MGLTESKTFVFKPAKRKPVVKGFACWHCRLQAGRARARRWDMHEVLGGAWLNPSTSTCESALFSAGSQVNLELCLFSQLSC

SEQ ID NO: 968574 - protein, 51 aa, Homo sapiens
MRLSSHQVDASLGLRSDSHRCRGVIHQVVANILLEKRTGYQPTTRIEAAGR

SEQ ID NO: 968575 - protein, 62 aa, Homo sapiens
MSRTENDHEGSRHMMRADYLEIHDLPEPLKEIRRISQTYQQQYGRSLEDYIRSDTSFMFQLS

SEQ ID NO: 968576 - protein, 46 aa, Homo sapiens
SGKPHDSPTGRHPPPPQGRPQGPPQQGGHPRPPRVRPQGSPPEIFR

SEQ ID NO: 968577 - protein, 51 aa, Homo sapiens
MALEMIEYTTENRFLMLTGAWNQAVEEKIEWLESHHDADIEDFKAKKKEEE

SEQ ID NO: 968578 - protein, 96 aa, Homo sapiens
KILVVMTEPTPNVEMRGQQDCGSSLWCPQCPRPLSTAWACTLRATLLISMPRCGIQCYHFAHQGPAAMDAHETHASVAKTPMLLTLCAPRAMVLPR

SEQ ID NO: 968579 - protein, 63 aa, Homo sapiens
DLDSDHEKERDTGSQCKWQTGQLGGFTLQLPKVGLNFFFFFFFTIINLLDDQISRPIFYDHHQ

SEQ ID NO: 968580 - protein, 47 aa, Homo sapiens
ILYTTPPNGGNSKEINLELLRISLLLIESVAGALCVFLTEYVRTRTV

SEQ ID NO: 968581 - protein, 150 aa, Homo sapiens
HCAECAPVMASQVLGLRAPMYRVLQVFNGETNVHRYSSDHDSSCDVSSNDWITFMPLFKSCICSMSSALRLLNFSEDTFSELKDVHLCRVCVIAAAQQCTEVRDSEEETLCLLTTLSRYLPSMVMASPSSLQPSSCSMLAPMTDRATCRI

SEQ ID NO: 968582 - protein, 45 aa, Homo sapiens
MANILLRNRTGSSHDSMSSREMRSSSRLDFCYVTSMSAGVGIESE

SEQ ID NO: 968583 - protein, 48 aa, Homo sapiens
RTSHASEAGEGSWGYSPDAMKAGMALEKKLNQLPFWIFMPVVFCPLRY

SEQ ID NO: 968584 - protein, 60 aa, Homo sapiens
AYCTKANKLVEKQNPAEDCTLWGLNMQCGLGCGNQLPKTDGGSETNKQRSKRHTEDGCER

SEQ ID NO: 968585 - protein, 60 aa, Homo sapiens
MQQKSNLELLRSNCCSSSRGWSPVLDPQEMFANKLVYDNSGQQMTHHLPKRKLKARPSNK

SEQ ID NO: 968586 - protein, 67 aa, Homo sapiens
RRGPQVYRPRHARKRREERLQAKKEEIINATLSKAGRDQEIKPPTLSVHTGLCDYIDQPLKYNNALS

SEQ ID NO: 968587 - protein, 160 aa, Homo sapiens
THRSSETGTDIQVAFIPCCHLNQESFTLELPRDVAPRIGYPKTSLVHSTFFPALQGCPRPKMKASDPHSSIFLTDTAKQIKTKVTKHAFSGGRETIEEHRQLGGNCDVDVSFMYLTFFLEDDDKLEQIRKDYTSGAMLTGELKKALIEVLQPLNRRAPGP

SEQ ID NO: 968588 - protein, 68 aa, Homo sapiens
GPGEIGRKKLLAVKAEARMSKANEARMRREERLRSKKEEIINVLYLRSEENKKENLPLCLYILASVIT

SEQ ID NO: 968589 - protein, 37 aa, Homo sapiens
PGSSESWCCSGIMVLLGETGKEKLPRYYKNIGLGFKT

SEQ ID NO: 968590 - protein, 99 aa, Homo sapiens
NKLDLNNSLAGGLKLRSLFKQASTNSLRGLLEFPSSTPEVLMKHAPSTAEAVIPVRGPAKDCIPAHSIMAQTNHYQCSGYPGSHGITAIDWSIYPGQAS

SEQ ID NO: 968591 - protein, 60 aa, Homo sapiens
LAIRRRRVVSVASVTRALLGWADIPQSGDKTLSWSACKSVLKSIDTHFIFGDHHDEFRHD

SEQ ID NO: 968592 - protein, 66 aa, Homo sapiens
MSHNLGMTLGSDDYAPPKGLEEASKRCWGGWKDGSRRTGQILKQTYSKFDTNSHNHDDTTTTNSER

SEQ ID NO: 968593 - protein, 90 aa, Homo sapiens
SIYSLIFRIPMALLTRCGVTKLFFIFLVIHLSIDITFYILLLSTRVLLFTFLLLILVLLVFHYLSIYIILLLILILLLIIQALHVALSIR

SEQ ID NO: 968594 - protein, 76 aa, Homo sapiens
HFQRVGGHNICFPLEQVLCLDGGDLSHSNEDESAVGCRPFHAVSGVDLPLPCFLVHDEALQDVVELHGTRTQVAPQ

SEQ ID NO: 968595 - protein, 62 aa, Homo sapiens
IIQDLIYLRKITVALLTSLQHLYSFGCDPISSSLFASNYTLCFAVPLTFFILFLRTFRWGTE

SEQ ID NO: 968596 - protein, 80 aa, Homo sapiens
EDLRNRRRGCAICVNLACEVCLRICQSGGCRFQPPHQRLDASSRSLGGDSHRCPRLSYTRLFGNILLRNRTVSSQDHDES

SEQ ID NO: 968597 - protein, 72 aa, Homo sapiens
TRAGALWERRGSGGFFVPRVLHIDINFNAQRAKSSCHTLPNCSSVKFTLVILLMDQNADSCLWVPVSGLPVH

SEQ ID NO: 968598 - protein, 62 aa, Homo sapiens
AQPDIELSILNILIQWVYGSKCSDYYEFCGVDEKQTMRSLVNSRSRMCNSRRLFLISSPYLR

SEQ ID NO: 968599 - protein, 48 aa, Homo sapiens
ILRITLSGAGAKIRVCDWEQSYSPVAVQQRLSDGTQESIITLSPAQPD

SEQ ID NO: 968600 - protein, 52 aa, Homo sapiens
LRILTVYHSMPTAHAQQSQPATLPTGSQPQSQHAAPVLSSIRRGRPHTWAVD

SEQ ID NO: 968601 - protein, 69 aa, Homo sapiens
SARPMFRYCRKKLLADQADGPQVYRSRKHASPVNSASRPGMEDIIKTLSKEEETKKENLPLCLYILCLV

SEQ ID NO: 968602 - protein, 35 aa, Homo sapiens
VLNCSGSGFKEAPLYLKVADSGVTLFGRGAQHQHG

SEQ ID NO: 968603 - protein, 111 aa, Homo sapiens
YSPHITSGANPTIGWSFFLPKKKSTRGISIQQQHSDLPATVTERVQALGVPGGQALPTESQEQPWPPSALIDAPPEGTVNHFAHTHVTTALSNATDNSHCSTPFSGWDRRD

SEQ ID NO: 968604 - protein, 59 aa, Homo sapiens
MRLLIYDAVTSASCSVGLVLPSLRFREDAFGGLGYFGIGSHYGPFGNDVVFPRRTITSW

SEQ ID NO: 968605 - protein, 58 aa, Homo sapiens
MSIVDKEEKASSGLRWILFRIEEVELANSKVRGHYGTSVLSMISAPCALWSLLTITVD

SEQ ID NO: 968606 - protein, 55 aa, Homo sapiens
CDVSQELPKSAVIHSHEFHSHEDMLVVDPKSKEEDETPEILVFLMNLDMCIYQSV

SEQ ID NO: 968607 - protein, 45 aa, Homo sapiens
AYGHSCPEYLVILNSQEKLLGILAHSFTPSHPTIYKPSHGHPLIE

SEQ ID NO: 968608 - protein, 157 aa, Homo sapiens
ELIAILTENYGGKWPFMLSPRQVMCSSSGITPVMNMPKRYDTNSTMPNSWQTYDTGSRLYLEYSTRYEMHSKPQSSLHTIVVGENRETSVGTVYIIRTRDNKVHGELHQFTETIERLTSNSKEFREQQQAEEDCTLPKLPQTWTMETRRTSVSVKID

SEQ ID NO: 968609 - protein, 52 aa, Homo sapiens
ILYEEGTQVASVQDHDKNLQDLVETMSEVATTKFGKLQIFDQVPCESWLQTE

SEQ ID NO: 968610 - protein, 48 aa, Homo sapiens
MAPKGAQVLQVKRGWKRQVSYDGRAPNNFTIQNQYPRLSIPNLEDHST

SEQ ID NO: 968611 - protein, 39 aa, Homo sapiens
LPGLKTRNLTPLLVIGNQNDGLQQDHPNKDASSNKVHHL

SEQ ID NO: 968612 - protein, 84 aa, Homo sapiens
FGVTLEVPGKYSITALSRRPSGGDSLISNYKAGKVVMVHQGHPVIVLSVDKIRRVGKGKHFYRHRDAHPRSLNILVHIDLGQST

SEQ ID NO: 968613 - protein, 119 aa, Homo sapiens
LQDLQTRNLNPLLVKGTRMMALSSDHPNTGGTQQQGPPPPQAKHKDHPNSEGIPHPPQGRPQGPPHTGRPSPYSSSKATRTTPTWRPSARSSLISSWKGPVTTSPRGRPQGPPQRQSPQ

SEQ ID NO: 968614 - protein, 108 aa, Homo sapiens
MMASAGPPQQGGSSNKSTTYSEKATRTTPTVRPSPTSSRKATRTTPTGRPSPVLLEEGHKDHPNREAISKVLPQRRPEKPQGPPPQGGRPQRTSTRRQSPTVIKDSND

SEQ ID NO: 968615 - protein, 76 aa, Homo sapiens
YRISNTALSMVDVTFADVAQPDQTDCGLNATPSCVMEDTFVISKANCIDSTASAEAVCLRKETRCKQENMKPAGSS

SEQ ID NO: 968616 - protein, 95 aa, Homo sapiens
GVSRGSQHASGLDCIIAEVTPNMRRFSEEQAEAESGYPDKVRGGLQVTAGQTLGDRTLRAKTKAGELLKFNRMIQKAESEIDHVKKQCRQTCRAA

SEQ ID NO: 968617 - protein, 33 aa, Homo sapiens
PVLERSLGWSGREIERASRLPNPCEAHFIIGAM

SEQ ID NO: 968618 - protein, 136 aa, Homo sapiens
MSDISSDMTMGTAQEQFTSQVREDTEVSEDAILRIVGELEQMVSEDVPLDHRVHACIIVCRGEAIRKIMDEFKVDIRFPQSGAPDPNCVTVTGLPENVEEAIDHILNLEEEYLADVVDSEALQVYMKTPAHEECKA

SEQ ID NO: 968619 - protein, 68 aa, Homo sapiens
RKTTPRESELLLYVTPRKKNAPLMPEFLMQGVRENNRTKNSCLIAFSSINAALSSSSLIIYMCGWMFC

SEQ ID NO: 968620 - protein, 50 aa, Homo sapiens
MTYRLLKKGYKAPPGPWSLKLVARSGSGEQFVWIKLVKVKGLSIVGVSNP

SEQ ID NO: 968621 - protein, 77 aa, Homo sapiens
SARFERDLEVALLGGGDTERACEGGAGSGELERDCLLDLDFDFISPFPCSLGDRDRDLLRDFSYSALDRLGEGEGEM

SEQ ID NO: 968622 - protein, 45 aa, Homo sapiens
VLVQQVQFIQKRVAKLRQALSRITSDVRQKGLEENAACISPDLRA

SEQ ID NO: 968623 - protein, 39 aa, Homo sapiens
LRIGGPVVLSIRGLPYLIVRFSKTNTEQTKQVTIYVLTI

SEQ ID NO: 968624 - protein, 40 aa, Homo sapiens
LRGESSSSFMVCCLFSVSTRRTVSSWSCSLDSSRRYSAPI

SEQ ID NO: 968625 - protein, 82 aa, Homo sapiens
MGTRFFQERNDSYEPYDAEIIKGAKKFQLIDNLLFVLDTDNVLSLWDIYILTPVWNWPSLHVEEFLLTTEADSPSSVTWQGI

SEQ ID NO: 968626 - protein, 74 aa, Homo sapiens
RQHLLQLVKVPISLSIDRLEFDLLYPAIEGHLSTERLTNLPRITRKASPGKKQKAEEHQEEIGPLGRVPSVSIF

SEQ ID NO: 968627 - protein, 89 aa, Homo sapiens
SFLICYRSGSNSELVQSSRSEVTELRRVLQVLEIELQSQLSMKCIPVRTAWMETKVPLLRCMLSQNPWDCIGTCGWSMLAQLLGYLSSE

SEQ ID NO: 968628 - protein, 68 aa, Homo sapiens
IIEPEIHTDTCHLIPRAVMWKKLYTVGNGSLKSGTKPFECSAVTRSVLASSTDGLNCGDIVAKHSVGI

SEQ ID NO: 968629 - protein, 105 aa, Homo sapiens
NPEYTIDRQSLNGLSLMNCRRRMKYPGRLGIRIVCYIQRLCEVFEEYAMNDFRSVCRRQIELVIIMPHRDSYKGGVGYVFCQGVENECEAYYTIAASVVRVLRQV

SEQ ID NO: 968630 - protein, 38 aa, Homo sapiens
REFVVLLCPPVLVAEGWRLTAGVAKQVNFAKDHQTVSQ

SEQ ID NO: 968631 - protein, 74 aa, Homo sapiens
PDSLGYGTYGVGKVGQEHLKIRDAYHLRHFTVMKTEKTVCSVNYSHRQITDPEHFKNSSNSSISLFDCVHRYRE

SEQ ID NO: 968632 - protein, 137 aa, Homo sapiens
MGPVIWVFPSNLLAHSSRSSITLKGIPRGRQVGPELKMAGQLAGGDKSWWCTHRSRSKSFFPRSWDKRAPRPSKLGPGLSPGALEGLFRGVGLSREVTDFKRGYKGGNTFTASDLGNNLVSFKGSMVGAGGHIDLRM

SEQ ID NO: 968633 - protein, 109 aa, Homo sapiens
MISRLLVSVDPPVVRGPQKSIFKSKFHEHVKNTFPVGVTWNRMRIRFQIKLVVWAYLRTIEKSIIVLAVQRDEGRCSANVTRYYVIPRYRTGDAVSPSTGRGGEKQELG

SEQ ID NO: 968634 - protein, 124 aa, Homo sapiens
DISPEWMTNPMQSGLHVKVSVKRHRHSLHIWWTTISPDTTTDEQSGARIDYFHCSGLLLGGHPHSISSELHIGWCPLGAQACGCDLSELQVSWCRHRGSCSLHQRLTLSAWILSIDTTHILHCG

SEQ ID NO: 968635 - protein, 37 aa, Homo sapiens
MHKRNLWWRDVLVGLRRDVDSSLGISQVYIPWIWPRD

SEQ ID NO: 968636 - protein, 130 aa, Homo sapiens
RSTDRHARLQQIGTVYQTQDMSITLREGRYKSINGEPRGDGAGGNSDSDNLDSTDCNRESSSGGKSQELNKGMDVNSSKYPSPLLHSQEEKTSTATSKTQTRLEGEVTPNSLSTSYKTVSLPLSSPNIKL

SEQ ID NO: 968637 - protein, 52 aa, Homo sapiens
LQVGMDKVETFLRMVQSRSVEGSMWLHKCPSSILGPLPRCLSMDPERCHIQM

SEQ ID NO: 968638 - protein, 38 aa, Homo sapiens
MLSLLSSQIVAPKDSERLVCMPLPLQALQAYRIIACPA

SEQ ID NO: 968639 - protein, 52 aa, Homo sapiens
LVTNTDTNNEVAAQIHYCPLNQELYKPSEEASYTDNPYSQANTLDQTYAKIH

SEQ ID NO: 968640 - protein, 49 aa, Homo sapiens
RQWDEGCATDILTTIVNDVILVFDPKELSKDSTKSASPLFAYSGLNRIL

SEQ ID NO: 968641 - protein, 53 aa, Homo sapiens
VCPLRAPSKVDINTEDLEDGTSRVTYCPTEPGSYIINIKGGDQHVPGRRLSEK

SEQ ID NO: 968642 - protein, 67 aa, Homo sapiens
LGCAAFMTFLGGKDDLLNPLQGATEPRIAKAGSVWRRPSVADSILVSVESASWCEKLIYYHLKLHYA

SEQ ID NO: 968643 - protein, 52 aa, Homo sapiens
LMRKKKATVCQIILKYRNDITAAIMDYGQEDVLYLQEQQTLTVLDLEITMPV

SEQ ID NO: 968644 - protein, 48 aa, Homo sapiens
IVLCAVCAAIAIWLQLAMSYRSLRCLNQHAGGHGPLELHHDFLKLESP

SEQ ID NO: 968645 - protein, 127 aa, Homo sapiens
HYSVDNILGSSSYQDRQLFSPPALLLSIAGSILALVPLLEATAYVEGSKSMTVKVSDSFRNRYIFLALIHYSRRDVVNVCQEDWQTVAYILPQSIYHQLQSKIAYEYKEIYEKTLTRTLEYEFLIDK

SEQ ID NO: 968646 - protein, 88 aa, Homo sapiens
GSITRRIPVIIISTVILGHYWEVQVIRTISSLSPSIDLLSIAGLYAFTVRDSAHMPIGAPKSITVIVSAPSGTVHLPGLNPLYARVMS

SEQ ID NO: 968647 - protein, 87 aa, Homo sapiens
MMRKSRHRSDPKATFLLRIAFRKQVIPVVTLLTPPAENPRGQKDREAPLSRSVFVLKIKIKRAYALLLHGRFLSSLSSPEDTCVTVC

SEQ ID NO: 968648 - protein, 112 aa, Homo sapiens
GQYWEVISYQDKQLLSPRLTTKHSVLYSFTVPISATAMYKLLIHNSHSLCSFRNSTSSWPSSIIAPVMSITACQGRLADSCFHSSSKYLPSATVQNCFLFKEIYEKTLTRTL

SEQ ID NO: 968649 - protein, 74 aa, Homo sapiens
SLVYQELVYKSPFHSLFHKLSWPVFLEIQKVTSRRATIVDYRKAKVPNPGGAMTLIVKDVELASPVAELRAEQA

SEQ ID NO: 968650 - protein, 63 aa, Homo sapiens
RIFCGQIIGEYQSIQDNKALNPPDYLQSIAGSMLAQVVTQTLLVESSKSMTVKVSAPSGTGHL

SEQ ID NO: 968651 - protein, 37 aa, Homo sapiens
YQQNILGQLLGSFSYQGQQLFSPPALLLSIAGSDACS

SEQ ID NO: 968652 - protein, 76 aa, Homo sapiens
SCLCLSSQDFREDLPNKSPRHRAQYNTYPIMLFYTSNIHIILQAALDPNLYVISHMLSARFRVILLLSLLCTWSNT

SEQ ID NO: 968653 - protein, 59 aa, Homo sapiens
QGAFPFNDAADIIGVDHGLSIDADWDVVFLETTSFCWGIRNYFNYIHSKEITLGGWDER

SEQ ID NO: 968654 - protein, 107 aa, Homo sapiens
MQHISKAISYKKSHTLNHSILPNILQKRHKNCLHLRSLSPYPASQLDVFVHNGDSLSVNGTQVEYLRNRPTRYAIASLLTAHRWLRSETSGSETDHPATIIPHQTLE

SEQ ID NO: 968655 - protein, 66 aa, Homo sapiens
RISLQIVDGEDDDAQIILLIGNARMAVDDFNLKYENEHSFKKDLEIEVEGLRRTLDNLTMVTTDLE

SEQ ID NO: 968656 - protein, 53 aa, Homo sapiens
QAVCLLVELNAVCCAISPTVLHWKHLHKLLLEDMTCSVKWWVILYDVDRAVHC

SEQ ID NO: 968657 - protein, 146 aa, Homo sapiens
IRTETENRMMRRIILSRLTRTRRLLLCSTLEEENASNVNKHILEMNGMSREGKTGLQSISTHKETEEKTVSEALLMEPTDDGNTTPRNHGVDDDGDDDGDDGGTDGPRHSASDDYFIPSQAFLEAERAQSIAYHLKIEEQRPQKGY

SEQ ID NO: 968658 - protein, 78 aa, Homo sapiens
MPTPPLFYPYHASFSQTPSAYEKETSDRSLPPLRSSPITLAAKHALLVQSPAEASPGAVILIIAQRTYILITILPSKP

SEQ ID NO: 968659 - protein, 54 aa, Homo sapiens
INTLDCGEVVSGNVYSKRSSHSGEAAPRTVSSCELTNVESSDQEWKETHMCFRG

SEQ ID NO: 968660 - protein, 33 aa, Homo sapiens
EVLEQLRQESEQALHHYMLSEHTESDSAVVLLL

SEQ ID NO: 968661 - protein, 70 aa, Homo sapiens
ISPSSYCIRALVLADSSCASTISRSAVLCTLTLGLFSLIGCENMSGTGYLFSCLCLICSLCLGLPSHLRM

SEQ ID NO: 968662 - protein, 39 aa, Homo sapiens
LFQPLKYPYSLSKSLSTVWAQSVILGCPILNGIQLMVVS

SEQ ID NO: 968663 - protein, 89 aa, Homo sapiens
HVDYYGSASEWGDEADGGQQEDDSGEGEDDAEVQQRMPAEHFPTRSLYHVNPPIFNHSARVYFHGRQGLHENVIQTLIMKTTPRVAQHL

SEQ ID NO: 968664 - protein, 36 aa, Homo sapiens
NVQFEDIWQKLHNAANANQKEKYEADLKKEIKKLQR

SEQ ID NO: 968665 - protein, 79 aa, Homo sapiens
EDPHYARDDVKARPSELALPREWTVQKTMDGAQGEHLYSMDPHTGAAVWRPYRNHEWTTYRGQSYNKIQSATYMPTDHT

SEQ ID NO: 968666 - protein, 44 aa, Homo sapiens
MYAKTVRQHSAVLMAPSCTLALPDRMSKEITALDPSTMKIQESL

SEQ ID NO: 968667 - protein, 65 aa, Homo sapiens
YFSWLTLEDPHYGSVGHRKDLYANTVLSWLATPCTLCIADSDAEWRSLALCTHAQVNDAMIICSY

SEQ ID NO: 968668 - protein, 38 aa, Homo sapiens
MDWSLACTLRLLFDTDGKIQWLLVEHTAKKQTELSTSI

SEQ ID NO: 968669 - protein, 53 aa, Homo sapiens
NHLSEGLRQPLMLYMACVSLLYSRRHHHSCPLLGMFYLTADLGLHEALVSMSY

SEQ ID NO: 968670 - protein, 171 aa, Homo sapiens
ERKATRGPEVDIKGPKVDIDVAAVDVQGPDWHLKMPKVNMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDFKGPKVDIDAPDVDVHGPDCEPAGRVAHSDRC

SEQ ID NO: 968671 - protein, 52 aa, Homo sapiens
LVGELSSSRELILNIFFFRRSMAWSGFVAYSYLDDTLCMAEIFIFMSSMLMV

SEQ ID NO: 968672 - protein, 48 aa, Homo sapiens
AYAEEYGMWRNRRLNNLDKNHTDVRVLIPCSGIFNFSQCANCKPMTQS

SEQ ID NO: 968673 - protein, 74 aa, Homo sapiens
ANITAGSTSVHLMGSATVAISSINLPSTLIMLHNSNSTDYPSKSLSPLIQDLSFSQLLDKPSTVRRHCALGIRS

SEQ ID NO: 968674 - protein, 103 aa, Homo sapiens
SRVSLGVSTERGAPCAQCGPSTTLTENEVVRPEDLAEGPRAHGVHGGGLQIHEHGAGHVLAASVGLIVVHVDAFQLQVCCPRGRCPWGSMPVLIADHLPKTTL

SEQ ID NO: 968675 - protein, 44 aa, Homo sapiens
MSLRIPGVGNGREFRYDDVLHGLIQFHKVFSLLVNTNWLGCDRQ

SEQ ID NO: 968676 - protein, 80 aa, Homo sapiens
ESISKYQKRQHIADHTDEYKPTQISPDGLRNNGMLIQDPLSTTPDRLLRVVARPIQAANFITTLHSLIPGILAPSFTSKS

SEQ ID NO: 968677 - protein, 223 aa, Homo sapiens
SSSYRSKKEEEKQYEQELDSGIILGWNSTQKLRAFRGHDGRRLISQTQRTKYDRRFKVCKGELTSSTPKVLVLYSDEKKSNRVPEEGPGERRPESENRDRTDLVGLRYLPEEDDIIILHEQEYDSVLESVFKTEFLSLLAKRYEEKTQKQLPLKFSNTLELKLKKENWGPWSAGGSRQVQFHQGFGDLAVLKPSNKVLQVSIGPGRAKNSLSYQKEHTQNTVI

SEQ ID NO: 968678 - protein, 130 aa, Homo sapiens
MTQITEIISDVSLAIKSEYFKHSRGCTEISPVERPTTSTAVLGTVTANPSYSLPKRTREEEEDSTIEASDQVSDDTVEMPLPKKLKSVTPDGTEEEVMAEESTDGEVETQVYNQDSQDSIGEGVTQADYT

SEQ ID NO: 968679 - protein, 72 aa, Homo sapiens
AKVTEEKRRDARNITKKRQAYREDQTTVENTLMSTIWATCDKFTHLVLINLPYYKLNYIILLNTTDFTESIR

SEQ ID NO: 968680 - protein, 77 aa, Homo sapiens
ERQMTYRVERMGKERREGKHLEQLTSGHPGVSKQVYPWGSRRKSSRWNLKMLQRNIEWITKNEENRSLETGSLHFGL

SEQ ID NO: 968681 - protein, 79 aa, Homo sapiens
QADLPGSLNTKAGNTKAVPAYATAIATWDLSHVCDLHHSSRQRRILNALSKSRDRTRNLMDSTRIHEPLGHDGNSAKGS

SEQ ID NO: 968682 - protein, 75 aa, Homo sapiens
DLVNTKAGGILSLCLQLHHSSWQRRIVNPLSKGSDLNLQLIVPSRIVNHCATTGTPIISFNLLEAGPQLANRHIN

SEQ ID NO: 968683 - protein, 68 aa, Homo sapiens
RYDELRYDELLGVINWRIPGNCGYSLPQYLIQVIGFLGCAGSQLAQVKSLRKRLPVKEPRWSPSGALS

SEQ ID NO: 968684 - protein, 46 aa, Homo sapiens
YRILRVKRVEYKRLFSKKFDEEYTARQEAQAELQNRDEKIKELEAE

SEQ ID NO: 968685 - protein, 62 aa, Homo sapiens
MRGEKWRKKRMRSVKRKRRKMRQRSNVNRQLVCTVECRMEHENMWMAMTLVRCCVQGCVDLH

SEQ ID NO: 968686 - protein, 38 aa, Homo sapiens
CWGDSTGSCEFKRVAQAFREGENTRLQSLRPVIRLYGS

SEQ ID NO: 968687 - protein, 131 aa, Homo sapiens
DLVADWRGLSSFCDREVRTRWRYCPEQQDKKGRVELTGLVGDINGPGALKLFSGSCPASGANTAAVPFPVAALGVIAHSDKNRMTPHKLGIVFGPNPCFWQSRRHLTQQPMLSTQGSLVQLMLTNFTSLFP

SEQ ID NO: 968688 - protein, 36 aa, Homo sapiens
MPPDSDPLCPHSPYRYLWTEATRAKQALAFNTDTRL

SEQ ID NO: 968689 - protein, 81 aa, Homo sapiens
VTLQDLRVSGVFSNGGPAWALDRLNLCARRRTRVSGYRQAFELPWNCGQDLRRDEQPFRGSVETGDGAVFGLVVPVPQRGE

SEQ ID NO: 968690 - protein, 100 aa, Homo sapiens
TIMKSCDWKSPRFHSVRMRPPTETLAWKHKLPQTSATQKHQHVCSPFHQSQTSIYSKHPVTKTMASSQEQQGRLLTHDEPARINPEKENCILKFRIVIHE

SEQ ID NO: 968691 - protein, 84 aa, Homo sapiens
PSLDDDNDVILGAKSRLRAPEEHMRGGFSDSGMEPQTNANQCYPEAPTRVFSIPPITDQYLLQTSSNENYGISPGTARQASYSR

SEQ ID NO: 968692 - protein, 104 aa, Homo sapiens
LPKRWMQNSDMTQVFKFIIKNWCSVQMYVGSNKGPIIGLMVGGVVIATVIVITLVMLKKKQYTSIHHGVVEVDAAVTPEERHLSKMQQNGYENPTYKFFEQMQN

SEQ ID NO: 968693 - protein, 91 aa, Homo sapiens
RDLRVTMLLLTLVKWIKYAINDPFIDLTYMVYMYTKYDIHTMDKYPWTPIKDYDERGSYVNHMEIPYTILPRSADPIQESMWGDSWRLKYV

SEQ ID NO: 968694 - protein, 36 aa, Homo sapiens
PFPPAQSPSSADGTQESVSPQTYGPYITKPQSWNDN

SEQ ID NO: 968695 - protein, 89 aa, Homo sapiens
MARIRDKVSSLLGSVGISGRRESSKALGRERLAPEGSPFSRCRLVMPGSVMVASRALMEEEEDIGRLGGPGGSWGRARELKAVALYGSA

SEQ ID NO: 968696 - protein, 33 aa, Homo sapiens
VLLEDPQRCAIPCIWGGGPSTGHGDQILPSQQH

SEQ ID NO: 968697 - protein, 33 aa, Homo sapiens
QCVCFIFLQYGLMGKSLDEGDTTSLWKLQRYSA

SEQ ID NO: 968698 - protein, 77 aa, Homo sapiens
MYTGTSTLPKLGVGNVCKSDRACWLTPFGILWLNLLVALRLALHSLVHVHSLALCIVWPASSLVPFFVVVLLMRWVP

SEQ ID NO: 968699 - protein, 91 aa, Homo sapiens
CTYMQFIEGGRRFQCCICSCINDVPPQYFQQLDHTGVVGERGFTVCSGPWGIWPFARAKRCKAYMCPFMQYKKEGGVSSAVLADVYNDVPP

SEQ ID NO: 968700 - protein, 40 aa, Homo sapiens
AHYEGEFSITYKPVKHGLARHRGTHSSRFIPPKYCSAGYR

SEQ ID NO: 968701 - protein, 39 aa, Homo sapiens
PHALSIEEAEPLLCVAIGLENAEDDCFQLEVKDCSIVQR

SEQ ID NO: 968702 - protein, 52 aa, Homo sapiens
MLKLFGSSSFFPSLIWSFSISRAIRVISDAGKSSPGSKIFPMIFRYGSALGT

SEQ ID NO: 968703 - protein, 60 aa, Homo sapiens
PRDPGILSLVLKVKAKWGYVKGFPCSCGASYYLATLYAKGIGVPQVYKPFYQKYAVWLSA

SEQ ID NO: 968704 - protein, 91 aa, Homo sapiens
ITKIGGRSSDQGEDFPASEITGIARLMEKNRMSDGKKEELQKSLTILTAFQKKGAEKEELKRAVCDFPGLGGGREGRCNLVVVSPLWNIGG

SEQ ID NO: 968705 - protein, 98 aa, Homo sapiens
CPFMQCMEGGRGFQWLFWQRINDVPPRIFSTGIIRGWWGREAPPYVVDQGESGPWRCTGGNAYLCPFMQFMEGGRRLQCCVGSCIIDVPPQYGSARVR

SEQ ID NO: 968706 - protein, 161 aa, Homo sapiens
GLPFGIVGMSTVRRIKTKNELSLKDKTFFLSKISKVTVTRIPSHKKNRGESKDLCLMAHLIAPVINTEPPGGYVQDNNDMDHEGSIQNGVQASRAHSLGICGEGGIDKRPILRGIKADGLKGSQDNNQAESHRAKEHDHMLGAIFQGQLLIFFLIWLNHRR

SEQ ID NO: 968707 - protein, 49 aa, Homo sapiens
MMLGHTVKVNLLQQGSVGLMALLLWLQMEDLPQTRLALRAVMAQARGYR

SEQ ID NO: 968708 - protein, 103 aa, Homo sapiens
MYVYLGEDLRPGGGLPSIRDDTDRRADLRDKMSEGKKEELQKSLNILTSFQKRGAEKEELKKAVCDFQGWVGVGRGELTVLLESLVEYKGVGGKVVLTHDSEP

SEQ ID NO: 968709 - protein, 37 aa, Homo sapiens
HRILFFNTPKKMTDYAKKRGWVLGPQQLLQLLLQRWG

SEQ ID NO: 968710 - protein, 118 aa, Homo sapiens
EDPSAEQSRAEEERTFRKVTYRGVDLDQLLDLSYEQLMQLYSARQRWRLNGGLRWKQHSLLRRRRRAKREARPMEKREVGEDAPCGTLIILPEIGGQQVGVYKWQDLSTQGGDSGRSL

SEQ ID NO: 968711 - protein, 100 aa, Homo sapiens
SEGPSSCDEGPEPHGNSDGIDGQQAGLIPGCSVIVSPDCHVGDSHTTSAQMPSYRSPSHSASKEHNLPQRVWTQDNGLRVREELTVSEVVRVKSPCGSQT

SEQ ID NO: 968712 - protein, 90 aa, Homo sapiens
KKEAPAMADAKVVMMHLREHDHATRNWWSSSVVVYVGKELHPGGDQARDDRARPWSESPFTYKSVKDGLPALGVAHSSGFISLKYSSGPG

SEQ ID NO: 968713 - protein, 152 aa, Homo sapiens
MKRRESFSGFVNITKYDSSWYLRNTLNRRMYHRLKGFSGGIKNRCHGWQGLQGFSLYHITTLFQGGRQIQQIGLTDAYGSEVKASTTWDFKDSISAVSGERVSPSKSRSLSPSPPSPLEKTPRGERSVNFSLRPIEIKVSAEAEEARVSLEV

SEQ ID NO: 968714 - protein, 151 aa, Homo sapiens
TPIRDYHTIPTITSTITELGLRDSSHREMRSGAALPLLSSRSTNVRRPKLTLDDSVHKADYNMQEAKKLKHKADARSEKFGKAVNNADAALSFTECGNARERDPRKAKSPYTMYSETVELLRYAMRLKNLASPWASEGAKQLAVLMLRMLI

SEQ ID NO: 968715 - protein, 113 aa, Homo sapiens
NKLLYPIGLQPVIENSGHFRITSGPRCKAMRRFHGKTFLRYPEEVLAVFTSYNLDDTQASRKKREDGNQEETMFIWQNFYQVKSGGIYNWSDSSFRRHIRWQYLILSQYLEGC

SEQ ID NO: 968716 - protein, 35 aa, Homo sapiens
GHMVGVYKGKTFNQVEIKPEMIGQYRGEFSITYKP

SEQ ID NO: 968717 - protein, 62 aa, Homo sapiens
YPFERLCALATVLAIPMSCLVTAQDTVCTARGTQQVEHCRKVSGLVISGDSIRVSIQYSASL

SEQ ID NO: 968718 - protein, 34 aa, Homo sapiens
VGVPTSRGRSSSGSQEESIKPKNLVEKDGLLTSV

SEQ ID NO: 968719 - protein, 46 aa, Homo sapiens
MGVLREKITEETSGFNGLYKAGQYYNPVTQWKAVIFEHFPSPNSHP

SEQ ID NO: 968720 - protein, 135 aa, Homo sapiens
FQGYVKFNLDEPAYNEQFLKEANMTGGVRISLMRNKTGHQRQNIKWGKSFLPLPPDYIQHISFQDYNFHHGLFRSHNLKPCEVIWRETNIKKGKLISEMRKMGSVYNTPPEHLNIPGTVQSSVRLQPIDNYGQLE

SEQ ID NO: 968721 - protein, 44 aa, Homo sapiens
SAQLTLNGSSVMVIEFRKIKPKNAKQPERNEKRVLGSGYGQRCG

SEQ ID NO: 968722 - protein, 103 aa, Homo sapiens
MGARRASGRLFSSFDQNEENKGGEDKLKLIRDFRQWFETELKLFCGDILNVLDKHLHFQQLTLASSKFFYNKMKGDYQQVFWQNFATEKRQDRRLAENSLVGL

SEQ ID NO: 968723 - protein, 193 aa, Homo sapiens
EGAVSTWAKDSYLLLGHCLLTELRAPLHLVYAIGQLKYLATLINQHACRWLQSGGFPIHDNRLAVSKCQLTEWYGSALALSIPKELKIMDYYERKENQMELAEETPDVHLDESGEIQGPQSKEMTLSQTYYIEANQRLSRWVKDTPRSQVRLDGLVLQGLYQLLEPRMIVRGRKQDFPLVRAAVQTAFPMYKM

SEQ ID NO: 968724 - protein, 82 aa, Homo sapiens
AEQYRADMIILPENGGQQWLGVYNGKTFNQVGRSSPENDRATTGGEFSITLQARYSMAGPGIRGHPLPPGFIPSQVMAQRRV

SEQ ID NO: 968725 - protein, 47 aa, Homo sapiens
MDTNGSTEFQPAAHQADTTHMASWYFSHTSEIGGGNGPGGKVGYELE

SEQ ID NO: 968726 - protein, 56 aa, Homo sapiens
MDAFEEPLSLSMLENSCSPKVQEPGPHKNMAPLLRLGKRPLNSVLGSDPGTGMAQR

SEQ ID NO: 968727 - protein, 46 aa, Homo sapiens
LLVMGDSGHVIGPFRTKGSYPSQWAKTLPWDFLPVLQHLLAKAGYR

SEQ ID NO: 968728 - protein, 56 aa, Homo sapiens
QDLENHYKKNSLWWKVLRTGDRFQYENSKRLMDWHSPSEMVKQITSISMEPGVEVE

SEQ ID NO: 968729 - protein, 82 aa, Homo sapiens
LSNTQQDSVLGEVPQLTEGDSGVYAGGGGLTTDGGKTQKVTLIVHSDYEPSGEEQPRPETPKGFLRPYWSQMPAYASSGYRA

SEQ ID NO: 968730 - protein, 40 aa, Homo sapiens
SSDASSSFNYIKSSYELSRNIELRIGRPTGWGLETRGKSR

SEQ ID NO: 968731 - protein, 75 aa, Homo sapiens
ARALAAEQYLQPLTIEFIQEGHERRDATRVLAGKQKLTMKKNSGVSSDNEDDDDEEEGNNPSSLSLCLQEVYPFE

SEQ ID NO: 968732 - protein, 44 aa, Homo sapiens
WAYAGLLEQLGAAETIWESQALACSSHDGSYSPLGTDSCVGMAQ

SEQ ID NO: 968733 - protein, 47 aa, Homo sapiens
QIAASVGSLSFLSPHDVHNFKKVSYFQNANLNGQRKAKRASPVWLSA

SEQ ID NO: 968734 - protein, 35 aa, Homo sapiens
NVETDVATERNSRLLKQVHDFTFSDSCLLMNNNIA

SEQ ID NO: 968735 - protein, 48 aa, Homo sapiens
EESLIAVHLKYDGRERRRTCLYTCPPASVNVQIGDIVTVGECRPLSKT

SEQ ID NO: 968736 - protein, 39 aa, Homo sapiens
WTQADWSGTLVEMEEEAIGMALGISSMVVVGDQLHLSRL

SEQ ID NO: 968737 - protein, 135 aa, Homo sapiens
PTVATSTATAKPTTTGSQMWSRRIHQTLGGKSSHRVTRDLTSTRVEHRRTPHPTSPLSPGHPISRLLGATQTSSGHAHLMKISSSTSTVVIPGYTFTSRGMTTTLIETVYRHVSQAGLELLTSVDLPPGAPKVRE

SEQ ID NO: 968738 - protein, 34 aa, Homo sapiens
MIPNFLSTPHWQRYRDNPPFGSPRIIQELIQNFP

SEQ ID NO: 968739 - protein, 105 aa, Homo sapiens
MRQKPTGGGAWTGRGLWIHYGYFTSSISICKRSATESGRHSFRGVMNSSTNLILVNSLLRGLGATAGSRRGRTSKECLSGAHRVSYGSARCNPSWIWLRAGRPSS

SEQ ID NO: 968740 - protein, 71 aa, Homo sapiens
GTPIRDPDETDLQHSRILEYSSLTGGMYDGDLDSRKTDKNVHQLRNNILEYSGVVIWHINPKGQQAPRATT

SEQ ID NO: 968741 - protein, 33 aa, Homo sapiens
LTPIAVMVLPVRVFTKICIPPLKKGAPECKVAL

SEQ ID NO: 968742 - protein, 75 aa, Homo sapiens
PRGSRIWVSHCGRKEHTTLYNKRTVVQIFPSIKTNQTWLCFNPKVNQNREKTEPGEQSGSQTLPAGPLPGRLPTG

SEQ ID NO: 968743 - protein, 62 aa, Homo sapiens
MGIKGDTGNRMCRRKLRSLSGKSISFSLVKNLAKYTCSPPVFISSIFFLEAGVSSEFITLKN

SEQ ID NO: 968744 - protein, 34 aa, Homo sapiens
TPIERVGLQIASGQSGVTWHREALHSTGYSGVMS

SEQ ID NO: 968745 - protein, 72 aa, Homo sapiens
HQAVSWEHPGGGIRKIMDRVRGEHTCPWHLSCSLTSLPSRASLQILNRAKAELLKLVKELQCRAERPGGTEL

SEQ ID NO: 968746 - protein, 31 aa, Homo sapiens
MILCLFAYAILRSVPNKLGGVLALLLSILIL

SEQ ID NO: 968747 - protein, 37 aa, Homo sapiens
GSRVETDVSGIISQIPKLKRMRKKFLLAQVFLTLSVM

SEQ ID NO: 968748 - protein, 153 aa, Homo sapiens
AVLEDPGHWQRMSEGLSETFVLRRYICVLISYTIVVHNATLEVTLCKISDLNHVVLCMSNYLPCLVEVFPSLLHVSGNPRLPLSVTQAPSRESNPDSPSPVFTSGRHGDYHRELVVQTFEWVVAVTGDVRSGRGYLEAPKQPGPAPGRGRRGA

SEQ ID NO: 968749 - protein, 65 aa, Homo sapiens
MLLSIVARWRWAIHSAIHTMLRHSCSLSFTKAEKTPKWNWFRKANLFSFTSCSKNRSSSVLSGVV

SEQ ID NO: 968750 - protein, 89 aa, Homo sapiens
RRPRLIKKDREVSHAGASMSSASSDTGMSPSSSSPPEKVLACKNVGDTHLLVPSQKVCCHGHKSPNPELQPQKALNWIDIAQYILYTFP

SEQ ID NO: 968751 - protein, 78 aa, Homo sapiens
GVLKDKMCRHLFQLLSIERVKLYAASLRVCVLRYERMREHLTFQREMYIKKLMDIISVENPKMPYEMKEMALEAIVQL

SEQ ID NO: 968752 - protein, 57 aa, Homo sapiens
MGYEDEERTRRLWVEGSIAEKWKDRLGKKVKRWDMKLRHLGLSKSDSSNSDSTQSQK

SEQ ID NO: 968753 - protein, 71 aa, Homo sapiens
QEGQRKGEEEKVMNLIQGKLRVHWCLRDGTQRDDNVPEMGYQKGVFSCTMRGSEFEDLDSPHLKDEHKTAA

SEQ ID NO: 968754 - protein, 102 aa, Homo sapiens
CPDKALGHTPRTEAGFSSPDQSTPGCQVPLPSSLFAHLIPHAGCSSPRPSLTFSVHLDKPAVLPVRDARRSPNLEPNSGDETAGTKELVLPPPHQVNTYFIF

SEQ ID NO: 968755 - protein, 43 aa, Homo sapiens
VLGAEQLRAKEPTNAGRLSTRLSWESCGCGSINSPGNSCPGCE

SEQ ID NO: 968756 - protein, 42 aa, Homo sapiens
PLSTVGWWRQIAHRLFLGLHGASLSWMLWVLLCFSDVWRPES

SEQ ID NO: 968757 - protein, 38 aa, Homo sapiens
QLGPHKHWEVDELYGTWRKAASLKSNYNLPSASEPSAS

SEQ ID NO: 968758 - protein, 52 aa, Homo sapiens
PLYLLWLDDERDSLAAAQPDCSECTFLDMAMAVGHDSLDMLLLRSLQVLLLP

SEQ ID NO: 968759 - protein, 104 aa, Homo sapiens
LEGPPLPSAYNGLIHLQDCGRGSGCRRQEVSWWSLSGDPASVKPASSYVRTTINKNARATLSSIIHLIRNNKLPTLPAHGSHPQGQCHPAQAEACDGEEEADPP

SEQ ID NO: 968760 - protein, 47 aa, Homo sapiens
SARVSLHLTEKKNKTEETRLFNSPSYPGPMTCGYSPAPAALAHSLQP

SEQ ID NO: 968761 - protein, 81 aa, Homo sapiens
LSSSGSALSNGLNVRKCRLTSACAQQPDGLVHTCAVVVTHPQPVCLTVPGAPMCFMSPRGILSDVDRAVHCNAMCTVPVCS

SEQ ID NO: 968762 - protein, 63 aa, Homo sapiens
MHGRLWAWSQQPTAKVSVVVIKLEILASWNACHLLQCGPPLTQECSAPRYSSITTHRSSKNKY

SEQ ID NO: 968763 - protein, 69 aa, Homo sapiens
RSGQLEACHLLCAGPPSTMNALLPLLSSIRHMILQEQCTCPDLRMAAILQWPAPSCAARSLVIGEEEAG

SEQ ID NO: 968764 - protein, 34 aa, Homo sapiens
YWQACKLLLVGLQPSLLPQALQPLLLVLAPASES

SEQ ID NO: 968765 - protein, 89 aa, Homo sapiens
GPCLFVMCGILVKVCGVGRYQKVMSSSYSDSSSSDWSSLPSSAHRCAAVKRMPVPAGPCTFNICREHVAECYVEEQAGGHCQKPEAPIE

SEQ ID NO: 968766 - protein, 103 aa, Homo sapiens
SCYNGLIHSKTVLRGVGSQMEKCVCGGHKAEILASGKPATSYCGTTINKNARAKLSSIRHMIRKNKYRPDLRMAAIRMGQAILRSQKPEMVKRKRDPTHTKSS

SEQ ID NO: 968767 - protein, 47 aa, Homo sapiens
LFNTGEGAWPDANVLPDGTVWVRVFPVSPSRFSDGSLACAWLCDGID

SEQ ID NO: 968768 - protein, 136 aa, Homo sapiens
RTLITITNDKGRMSKEDIERMVQDAEKYKAEDEKQRDTAVHPRIRLHSYAFNMPQHTVEACRTLQGTALTHAGTTQQDAGQVYCNNQLACIRLSTAEKEASEHQQKAAGAKLANPIITKLYQSAGCMPGGLPGVGG

SEQ ID NO: 968769 - protein, 56 aa, Homo sapiens
RAMIEEEEEEEEAEEEEEEEDSEVQVEQPLPSIQIKRVMTYRDLDNDLMKYSAIQP

SEQ ID NO: 968770 - protein, 96 aa, Homo sapiens
PGSRLNGTVGKTTGTAYRPGPFTNSGNRHRPRQMIIADTDTATTVQQQSTQHQKSPDVWWYLDSRPDRLTEFFLSDIWGCGVSTYELRLDYNAQSA

SEQ ID NO: 968771 - protein, 95 aa, Homo sapiens
GCSRGSHSVYTTSAETTLRNKFRKWHYTRLGVSSTQTTKPMQGCMCCGKSDVFSAISLQCVQTSQNSPPKKMKAFLDKYSNSRVYYVSLFMCQLI

SEQ ID NO: 968772 - protein, 57 aa, Homo sapiens
VCKLGMRAAHRISRWVRDFRRALVSFVATNTTGLGGISCCLCFLTACACMACDAMQP

SEQ ID NO: 968773 - protein, 37 aa, Homo sapiens
NLNHRFHMYTCKLTNLTLSKKDSFYTLTKTTRKKQQL

SEQ ID NO: 968774 - protein, 49 aa, Homo sapiens
RIPIAGHAQQQTHDPRTGHGDGTGREPHCTPSVMCLMVLVLSPAHYGAQ

SEQ ID NO: 968775 - protein, 96 aa, Homo sapiens
GRPVGTAAWAVGGSSPILVPLTVSPVFHLSQLDGFACDLAKCLVNQTMIAASSPAVDLVTSPSELSFSYGDSEDLTARIYMFFFSTNGVIPVWYLN

SEQ ID NO: 968776 - protein, 44 aa, Homo sapiens
RPFQLVLMKLMRLDEKFGALTSGSKRSCAPPAAPFYPRSTTLQS

SEQ ID NO: 968777 - protein, 34 aa, Homo sapiens
THSGLVVVTLPSGAMRTLYMFRSDAPSPGMMREH

SEQ ID NO: 968778 - protein, 60 aa, Homo sapiens
LRRQEEIDDEEIERRRDMMRQEHRREKMKRWKSWQVEDEGSFVERSQNQESDDMKEYTAQ

SEQ ID NO: 968779 - protein, 47 aa, Homo sapiens
GHIITPPGKAWVSIGANDRTVPGVLLRNAPDNLFSNSLPPAVVGLPS

SEQ ID NO: 968780 - protein, 144 aa, Homo sapiens
EEEEIDDEEIERRRGMMRQDAQERKNGGDGSHVECGNMRVALRERVRIKSLMYERVHSTVEDEKWSLAYKPSLPFGREGTELTRFQETLKARSFGKREGALGAREAKNAIGLREKGAMYRTSNTMRERGLKHKAGRGGYPGSEF

SEQ ID NO: 968781 - protein, 108 aa, Homo sapiens
NDPKTAWPRVVRTGEPQDASLQAPLLGFLPLCNDLQQPATMMSPLLHLSAPASTKLRGRLPRVHHGVLPPPSPCFHGGTAPVTPSEVALAIPPQPLVSLPSSLVFGSF

SEQ ID NO: 968782 - protein, 58 aa, Homo sapiens
MKWAQRAVGFTQLLRIFEDSHLLQRRTCAFSPQFWLQLNNVTQTQSLLKQQAGGTRAR

SEQ ID NO: 968783 - protein, 81 aa, Homo sapiens
SLFSCVRGKGAGNRLRLRWLLNVGSAGEEERTLGAPGSLQKLEEAEKAADESERGMKVIENRALKDEEKMELQEIQIGYEL

SEQ ID NO: 968784 - protein, 45 aa, Homo sapiens
LGFVDHKQARRLSIWFKRVLVRRQPPTSRFLFTEEKLIQFPETKS

SEQ ID NO: 968785 - protein, 78 aa, Homo sapiens
TEWRSEIQCLWLQMLSMTGVAPEAGIAGVACLMMPSAGAYYWEGARFRLVSAGDLIGVHLSPVCKMSYPRMPVMLPVP

SEQ ID NO: 968786 - protein, 39 aa, Homo sapiens
MPVWYQDCGMLGTVCIINYSHRVFSSCCVMPLFTGGQFH

SEQ ID NO: 968787 - protein, 54 aa, Homo sapiens
DPDIIADTIADTSTDRIQHETGSDNPLGITSHTDKITFHPILHKSKTPIGLLSL

SEQ ID NO: 968788 - protein, 148 aa, Homo sapiens
TTDSSRSHTGRNKPITMTGCPCAGTLLDNRIHIKTDVSSNNSSRGCTWSSSIGYPLPGGMITCTTNSNNGSSSSLTSVNLTFRSSISSKSSDDSFRNIFSFSFTENLAKSFIDPCLSLIYLRHWFSKGLNPGDTKIILLQRYGLGAAE

SEQ ID NO: 968789 - protein, 37 aa, Homo sapiens
MVLCVARHTWFADSAQVLLSRAGGQQGQDQPQHAERS

SEQ ID NO: 968790 - protein, 48 aa, Homo sapiens
EEADMTQQDEKTLGAINNITARQYLTHPQVLRLPNPALKISGSGRPRE

SEQ ID NO: 968791 - protein, 65 aa, Homo sapiens
SIVVFDEGHIYYQPVTSQMSGDDPVPSFLVSVEYLYVKGLPDGLPFEKAIYLRAFLAWDTVVITM

SEQ ID NO: 968792 - protein, 33 aa, Homo sapiens
VQHVAKIAEIEAEMARTQKNKATAHHLGLLKAR

SEQ ID NO: 968793 - protein, 56 aa, Homo sapiens
AETTNNTPPNTNELTAAPSQSWQANANNPVNHYQKKTLTLYTKLTYKISLNDDIHR

SEQ ID NO: 968794 - protein, 48 aa, Homo sapiens
GGAGPTKTITAGPDQTEMTIEGVQAQRGVWWLGLCSESKRRESASGSD

SEQ ID NO: 968795 - protein, 97 aa, Homo sapiens
RGRRGGIPGPCKHAHHCHKLPHQCLVCSAFLDEANMSSKLQQARSCGMMTMEGHLCVPGSADWLQRAHEICGEPRVKAPFGKCGRSAMDHCHEWKSQ

SEQ ID NO: 968796 - protein, 79 aa, Homo sapiens
DDRTVCREIRHNSTGCLWMNGPVCQCAWEILSCGLFHQATPPRLELAAWSSHGIPPGSAEMVDHGKYKLSLLNVTTMWE

SEQ ID NO: 968797 - protein, 178 aa, Homo sapiens
QGVMWNSRYYHPYTYSHLLLLVSPAALLGVLSLRQHGFTLCVERVVAPSMPPRKDLPDSQQQHQSSKKGKLSEQLQHSNGIYEGVTLYEAMLPMLGLSIHQWMLLHLDCMTTMTSFSTPWTSAHVKRKMENRDYLWMHRSIAADVRLMYSNCYKYNPPDHDVVAMAESYQDVFEIRYA

SEQ ID NO: 968798 - protein, 50 aa, Homo sapiens
RVIKQHRHRDVERAYSYPFQVLHVRPKPGQGMHKSLTDVALEHHEECDYV

SEQ ID NO: 968799 - protein, 70 aa, Homo sapiens
SISWLEAPSRGMGEDESSSHQQYLKEQESYDNRLLMGDERVKNGLNFMYEAPPGAKKENKEKEETDGSKT

SEQ ID NO: 968800 - protein, 44 aa, Homo sapiens
VPQSSPISVMLQGYTVFPLCHYLFQETVMFLLLRKSMSLMGRRC

SEQ ID NO: 968801 - protein, 183 aa, Homo sapiens
RSSQAILQQEGMSAIQPIAADLEDIPRQDKKGLLGKSYFLARSERDSKNDLTSQLQLTKPQSLLGKVICPLAGFPPELWPSGHVEIHLIFLLIVFSVYNITDCQTSSALLYQYLLAVRLKSFWTGTAKIRELYTAACGLYVCWLTIRAVTVMVAWMPQARRVIFQKVKEWSLMIMKTLIVAVL

SEQ ID NO: 968802 - protein, 149 aa, Homo sapiens
SRILEKDKRSQQMRMQLVEGEAADAIPERGVQGADQAAMLGGAPDSDQADGRGDLKYCTRQAPEIPWEEQLSRAARQDAPGNLSLDVEQAPLGQHSSVPSSQVSSRGSWPSSSAACSLTSLPLAQHLLVVHHGQRQKRKLLTLDMYTAV

SEQ ID NO: 968803 - protein, 55 aa, Homo sapiens
MTASLMAPCPLEAFSDFHQMSASLQLCVGPGSSACRKMNDHDLNMAGAPLLDSPM

SEQ ID NO: 968804 - protein, 145 aa, Homo sapiens
PYSRRGEWQRLLRIVAGGGDCNVTYACRRLHLMHAEVSGNLYGMCKVSVCMCVQAMNRICVLGLGPAGLCGTSRPPICGPIYISVQPPSLHVLEQRLRAAQTLKPRKSLVKRLAALPQADMESSKEPGLYDVVIIKRQPGTRPYA

SEQ ID NO: 968805 - protein, 88 aa, Homo sapiens
RGLLLVFRIGIDLVVEILCFVVWMCVVWALKLDENPRPDIEAPKQHTSSETCKRTAHPEIFNIESVQTEETDGPTHSLCKLWGWRSSR

SEQ ID NO: 968806 - protein, 70 aa, Homo sapiens
SSGLQHTQSNCTIKSTTWSKKVFGVPCRDAVVNESDYGTMRLRFRSLALTSGLTIRRCLSCGVGSRRGSD

SEQ ID NO: 968807 - protein, 99 aa, Homo sapiens
ARYSDKITEVGGTTFCQTKAECTSYEGIKSKVEASKGAALQAQNSAKTLERLCETAEHDCQRSALPKPLEVPFVTAGAPAAAGERRDLKAASCHLTEYR

SEQ ID NO: 968808 - protein, 113 aa, Homo sapiens
ASSDPAEQYLYVADLSWKDKRVLREMYQIYFWNIATIAVFYALPVVQLEITYQTVVNVTGNQDICYYNFLCAHPLGNLSAFNNILSNLGILLGLLFLLIILQREINHNRALLR

SEQ ID NO: 968809 - protein, 51 aa, Homo sapiens
LPRIVAQLTPPSSVKNSVRPEPCCCSPAGSLGSYSYLESPLGQHLLRDQRM

SEQ ID NO: 968810 - protein, 33 aa, Homo sapiens
PRGYAGVKREVVSPSSRLLASGSILQEDEAYTL

SEQ ID NO: 968811 - protein, 33 aa, Homo sapiens
MSVQPFRLAAWDVHDSCDNRLADVASCRVLCTQ

SEQ ID NO: 968812 - protein, 73 aa, Homo sapiens
HCDTEEGGEIGPFTTTEKALYMSSAWQRGAAGQQGAEAGPICRGYRSVQAGEEKVDLGARSPQGMMCGLVVPP

SEQ ID NO: 968813 - protein, 60 aa, Homo sapiens
MRGTCRGVPCVGTPMFVVKAYLPVNEFFGFTLTEANTGGRVPQCVFDHWQILPLETPLNS

SEQ ID NO: 968814 - protein, 88 aa, Homo sapiens
RTKPPHTVRTRCDSELQREGVSHIQAHSQSPGASLISKYTLRELHLSFCHKGFLEGPRLLGGPTPYLAGPPYPGYKLREYRGSEYRNT

SEQ ID NO: 968815 - protein, 71 aa, Homo sapiens
SVTLPLSCTLRRTGKQEAGCPQCRGGELLRRKLAPHNESTSCSSARLSQVSALGGEQCALADSACSRLNSG

SEQ ID NO: 968816 - protein, 80 aa, Homo sapiens
AEKGKNERTTTNLTCSHKVNRSSVPSYLLAFSVNHFFVKVYTQQSLLICEHIDWRSEVLINSTHAYLPSVRAPVTPLCIP

SEQ ID NO: 968817 - protein, 71 aa, Homo sapiens
WRPQYTELFRIHRTEHAQDHLEDHDHSEHDGGPAYEVQLPGDEDIDLLDGSPPMKRYARCGFLYTGIPELE

SEQ ID NO: 968818 - protein, 38 aa, Homo sapiens
IISCRVFSNLVPFSLSLSGIPCLLSTPTLFGFTDWFFI

SEQ ID NO: 968819 - protein, 34 aa, Homo sapiens
MKLVESPAIPRIPCPMPETVVIRSEEQEQHHEFA

SEQ ID NO: 968820 - protein, 75 aa, Homo sapiens
KCVAWGRCIMAVPLRALRAGSAYIQVATHRLGILGEEAMDWWSTEVHYTLEKNCESRHYVDTAQSCATVQNMTHV

SEQ ID NO: 968821 - protein, 111 aa, Homo sapiens
CVSVCGGGEALDHFLSSSYRTAEGAPHAPQDVGPRTLEEGLAPLISDRSSVQLVVRCPVYMTVSSCCARDCIIMLPPHRCEAGRTPRLATDRHGSARSSTLTTTYDHDVIP

SEQ ID NO: 968822 - protein, 91 aa, Homo sapiens
RYQSTVTEKPIMSNKHYIMYLMALLNAVHTYGIFDLWRYKYDICRNHAWDSWYNIDIIYKHWPLLTDRKLNTTFFDPAGGGDPILYHHHEL

SEQ ID NO: 968823 - protein, 104 aa, Homo sapiens
VCRAGIVVVVDPWPAEIDSLWEISNADRMAIRFVLWVTGPPGLCRVCSCHVSAWSSEERDAAGEPKQHHGPGMAASLAHLHDDDRIPGWGLLLMSDPARTCNAL

SEQ ID NO: 968824 - protein, 71 aa, Homo sapiens
VCTAPWLIWLLMAVPLSPGGSSWRTCELDAVVMAATKGEAAAAGEFLAPPRRIPVHHDDEFQRLTTNSLRC

SEQ ID NO: 968825 - protein, 93 aa, Homo sapiens
TYQVVSVTGALVNQDDGDQHQHLMPRCPVKGQRAAVWLRTRSVDDGRGRSPWSMVPLHRVLAGGRPPVFRFSSVELMSRPPARRNSVTTDDRI

SEQ ID NO: 968826 - protein, 39 aa, Homo sapiens
GQGYGCMVEGFYWRGAQSMRGISTLSIPIEHGIVTNWDD

SEQ ID NO: 968827 - protein, 87 aa, Homo sapiens
LNWGAVWTQRDQEDYESAAVTRPTRKQTSFWICFSLVSPGSFENVRAKRYPEVRHHCPHTPILLVGTKLDLRDEHDEEFRQTTTNSP

SEQ ID NO: 968828 - protein, 49 aa, Homo sapiens
LGNLCWCGIVLVLEIIFIIVVALDEELLFWKEVSSSKATTMSENDFKHQ

SEQ ID NO: 968829 - protein, 44 aa, Homo sapiens
ADLLRATAYAGKRAHQAVGGCASARTTEPNMVATGGVGAGDGDP

SEQ ID NO: 968830 - protein, 48 aa, Homo sapiens
MEAVAGCEALNGQSDFPYLRRFPYQPSASFIHDPEKCVFRGLRCCCCT

SEQ ID NO: 968831 - protein, 97 aa, Homo sapiens
TLQLVHERWLWQRPLLRHHSAYEGIIYVLGSSILYAEELQTPTQDIDSLTVTPMQTRPQPISETGKCRSGGFAGKCFRLYTAWDYQHELEENTVPAI

SEQ ID NO: 968832 - protein, 71 aa, Homo sapiens
EKTSTICGSHGGYPHFCLRTFLSGVTEVVVKLFDSDPITVTVPVDRLQRRTLKYIGDRGETKRCSEYAQQS

SEQ ID NO: 968833 - protein, 40 aa, Homo sapiens
MDIYQWARAQTVFTGFATDPVSYSRRLIILVTCRWKLLLG

SEQ ID NO: 968834 - protein, 88 aa, Homo sapiens
SADLCHNTLEATSVPAVQAMSFRKTGIPARLSAAASCTLEASGVYLQPWSTRRSYAHLSVRCNYCIRVERGLTLHLRFLEPFVLDHQQ

SEQ ID NO: 968835 - protein, 53 aa, Homo sapiens
MAGKLSIEMSFRFPPCTVGGFLPFSAISRGAVYYICATVWGREQYTWYGILFF

SEQ ID NO: 968836 - protein, 81 aa, Homo sapiens
ESTTAKKITPEGYVLRDETAKERENALATALLFRTAGFHLACVDYSIYYRTSSFPIASWKTVHQYRRAQQKIRAISEFREF

SEQ ID NO: 968837 - protein, 51 aa, Homo sapiens
MSSASPHDCMEASCLTVPSSVELYYIFATVWVSGAVHFVRHPLLFINTRNF

SEQ ID NO: 968838 - protein, 54 aa, Homo sapiens
GSTVRLSVFPDVNLSEWNEEPTLSTFFTELNDCSCLASQRHPDWVYCSKEKAPT

SEQ ID NO: 968839 - protein, 63 aa, Homo sapiens
MVIMVNKERKMGQADKKNETLKGIRSAEKKTPDDKVRILPPCKEPSSLPNPALTPLLMALAEA

SEQ ID NO: 968840 - protein, 36 aa, Homo sapiens
VVVEAAPVCLVALAAEATVFPVAPAVGPWSRKSRLS

SEQ ID NO: 968841 - protein, 47 aa, Homo sapiens
LCAFDALGLPNCSPLLQPVLRLSPSVEPSSTVVSLAVVWMFSHAIGD

SEQ ID NO: 968842 - protein, 145 aa, Homo sapiens
MWSEHLSAHAMERLSTSRLPNTLPSVPTTTVCIPVIVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHS

SEQ ID NO: 968843 - protein, 107 aa, Homo sapiens
MRLAEEEHLVASLMKEEGGLLVWTSDENGQRLLRMVLAGDQVFVGKMVSTMYSLKFLGISPLMSTSTRVSLGWNRVDENWTRVREDKLSMICLKRGCMLHKKAEKRR

SEQ ID NO: 968844 - protein, 65 aa, Homo sapiens
LSPSSSYSAIISKYYHRPFGFHYSYQHEVYEICGAVFPDYDVSCGSVENHLVEDINYLTHKFIIF

SEQ ID NO: 968845 - protein, 39 aa, Homo sapiens
LDSLERGSWGVGTVISFLLSSPFSAAFPILRRLLDVEHV

SEQ ID NO: 968846 - protein, 142 aa, Homo sapiens
MLDTIAGCCLMRIRHVSVNSSTSKTLIIYFFFGSKIPWKSWVSVSEKLRDFSFFFLLDSEVFLLAALVSSSSRQYLTRSRKSRKEAGLGTTKEEITRDAEGRDEMDHAERELARRPDPRVRGPERYTATKKKIWSSLWGAPL

SEQ ID NO: 968847 - protein, 94 aa, Homo sapiens
RIKVDILFPQSGNPDPNCVTVTGAPRECGGSHLTTSSSGVRNTYADVMDSEAAAVYTWNPQHTKRPMAPSRGFVVRDAPWTASSSEKDPDMSML

SEQ ID NO: 968848 - protein, 148 aa, Homo sapiens
MIFTVGIDVDTRAYFTSDYHEIIVYPTPDVKRIYADSPHIHVKQYDHDTAARALEPSGFIYSCSPVEWPALDIVYSNTHHYEHRYYTDTYYSCTLTYHYVLLNSELYLPSEEASFTDFPYFSGYTLDQTYAKIHFTIIFIGVNLTFFP

SEQ ID NO: 968849 - protein, 74 aa, Homo sapiens
MPEPTFLHKAHQHPVFPHTSYDRNRSAYSFNQVARAVRLTGNITAGQPYSCTVIGSATLCSINALTCTLYTIRR

SEQ ID NO: 968850 - protein, 210 aa, Homo sapiens
MVDQIELAPQDRDRNPASCGRKHRVCYFYPWSYLDGAEGRLDIEAPENKGCQLMDTATLKRNSGACLWVAVKRLILCYEIQRTKPFHREFTEIVWSRQLQGLAVLMGQALCRLPFWVLAAEHRRRRGSLKTVVNPNDPSLAFLSRLSFDALCAVELESEEYLLCFRLVGLYVDPQGRRARAQELMWPAAPVACSMYMFSVAYPCCCFPTD

SEQ ID NO: 968851 - protein, 198 aa, Homo sapiens
MCTSILWSVSYDGAGRSALTSMLPGNQMAASIMATATLNEVHSGTMPVLWPVKLADPFAMMIQMNEAIHRKFNEIVAPGSVQCLAVLRDRLCVGYSSGFCLLSIQGDGQPLKLVNPNDPSLRSSHNSLLMPFVLVELESEEYLLCVQPHGTVRGPRNAGGHARRSSCGLRLLSPEYVYVYCGISLLLIYHTKTGVDGI

SEQ ID NO: 968852 - protein, 78 aa, Homo sapiens
MAMQPTVYASNGHVAARYPFITYATGHTILPELHKNAMRATMESQLRRSYNVPDVVIQPSPTNAVDLDHTGSQTVMKE

SEQ ID NO: 968853 - protein, 154 aa, Homo sapiens
MTYGRIIMSSTLTNYRLMRRGGDLATRLYEHKYGAAPRVRLSGHVAARCPIIAMPLDYILADLRTNAMRATMDSHLDAPYNVPDVVITQSPSNDVDLIIRISERECRIPHEDLERVCGLPFHYCVRASTQDPRLRPIFGRLDIIVGAPVRDLDG

SEQ ID NO: 968854 - protein, 31 aa, Homo sapiens
MPIKKGLSYMQLPGDSVANMRIQAYEVRDLI

SEQ ID NO: 968855 - protein, 71 aa, Homo sapiens
MRTFSARPIIDELFQAGLTRSPELHYCLELPTGASLLLSKSRIRPQLDAPSLLYEAHNFHAMCQPFLEMIH

SEQ ID NO: 968856 - protein, 31 aa, Homo sapiens
MRQQLMEKFKKKFISCYDRGQFPSGGLYLMT

SEQ ID NO: 968857 - protein, 33 aa, Homo sapiens
MYLLGGLGPAPRSPNRNFNAGLEVKDLWDRKEL

SEQ ID NO: 968858 - protein, 71 aa, Homo sapiens
TRGPIEMCSARGVSKTPESTLHIRAREDEGLRARSGVAGPRRTVLDKCQEVISWLDANTLAEKDEFEHILN

SEQ ID NO: 968859 - protein, 62 aa, Homo sapiens
MRTVRRGELDHTLNILTENAFVTRDCGSSAVALVRNCRLCACSARSGACWQSLNGMGLVAVR

SEQ ID NO: 968860 - protein, 87 aa, Homo sapiens
RAGRGTMSLRTPGPQCDHTHADAWSWFPLLNRNTIPMVSSTLGRWAVGHVCPVTSESRALWACLSAVLEALSDAEETLRGPAAMDYH

SEQ ID NO: 968861 - protein, 45 aa, Homo sapiens
MISREVSITTSWTGTSPAGGGGPYQGNARALFILPSEGKMQQVKW

SEQ ID NO: 968862 - protein, 72 aa, Homo sapiens
DDEEDKEDDMRNMSRQARTSLYDDACLQWLDCRPERSCRRAVPRHIMSFVTLNIFAFFSRLVRIWGGFWFCS

SEQ ID NO: 968863 - protein, 96 aa, Homo sapiens
MRGGVICEEECSLTRRIARRFEAAWIGILGIDDRMFIVPGFIQPADSTLHHEDIESLLLFSHAFFPAMANLSGFSKHLLVQVDVVTMSFMVAEETI

SEQ ID NO: 968864 - protein, 63 aa, Homo sapiens
EDPRLVCSLAPAVPSATWLRCMISWLVMSLFWGHRPPRLPEGQDLPLQTLLVKRQHTEAMQGP

SEQ ID NO: 968865 - protein, 36 aa, Homo sapiens
SGSCTLWGSSGQAVSWRCRPRARVSTSSTLSFIVSV

SEQ ID NO: 968866 - protein, 152 aa, Homo sapiens
IEGLSCSGFCSSWRVFCHSGHCLQCSDCPTPVADCPTAVNCSSYFDACLITKAGLHSCMTSVGHFEHCNFNDVTIRLRSNELSYYCCKKDLCYFNDQSSSWWDILIREDSSSGGDSFSGSSLEPSSLCRHQESFSQTPRSCVFRFLLLPHSI

SEQ ID NO: 968867 - protein, 141 aa, Homo sapiens
MIGVPGRGLPGSHRRERPDAFDIIPGFQFLAEHSSFVGLLVPFHFIFDYQRQCTNSSISIPYIVPVLCGLRQPGQNMMVYSFLGCVHSIDCPRRPGFGLVQTFGLHCHMFPHKHPGQSGESHHLELWEFEPQLCQYPKTQR

SEQ ID NO: 968868 - protein, 128 aa, Homo sapiens
MRSGAGWFSFVEKTEEDGKSTTTEYAVLSEGRDQALACLTELILTNNSLVEVGDLDPLASLKSRTYLSILRNPVTNKKHYGWSVIYKVPQVIVLDFQKVILKERQEAEKMFKGKRGAQLCKGYCQGQM

SEQ ID NO: 968869 - protein, 118 aa, Homo sapiens
HRQLTFERHRSAKGFLCPLSSPVAQCSFLGCSLAVGDAEAALRCTCVTDQCKCSLSFPPNVLRWLGKSSTLSHCLRVSTLNNIKFLSARKSNERLTIGYTWSFQGWSAQSLLMSEFRR

SEQ ID NO: 968870 - protein, 40 aa, Homo sapiens
PNPRYSSPPGPAALAICVWALDDIESRNRLQLIQGCLLMC

SEQ ID NO: 968871 - protein, 33 aa, Homo sapiens
GDNALGSGADQDLSHPRITHRDTHSKQQPGKRT

SEQ ID NO: 968872 - protein, 58 aa, Homo sapiens
NCHEEDAVGPILHRQNKTNSILFYSRVLIPVDAISLSLHLEDVHLRDVLVKLLAGNNK

SEQ ID NO: 968873 - protein, 101 aa, Homo sapiens
LEDPDVDMSGSNSVYWISRYLFSVGLYEFPLNNVDKSSTWNHFLAKHVIFSSQPDSAVGVNERNGTLRGKTGLLNTENEDMHGSRPHESYHPVRPGNNANN

SEQ ID NO: 968874 - protein, 52 aa, Homo sapiens
LVSSLDLWSLELWYAADDMEKEELRVEQGESYSKAELERQMPRDTESHRLVK

SEQ ID NO: 968875 - protein, 54 aa, Homo sapiens
LENQSFARGPRRSAPPSALPSADFNQLAELDRQIYRASCVASNPYTWFTMEGPR

SEQ ID NO: 968876 - protein, 83 aa, Homo sapiens
GGERSTMIDKNCGGGEKSGAGSDVLLLGAGESRKSTIVKQIKIIHENSYSEKECRQYRAGESTCNTIQSIMDHCQSHGEPAES

SEQ ID NO: 968877 - protein, 65 aa, Homo sapiens
MLLRCGSALSTAHEVSPCSRLIALLVFFLLLRDPSAADETNTGPTVTVTVSFDLRVEDEDIGRVI

SEQ ID NO: 968878 - protein, 102 aa, Homo sapiens
MTTLVWGVLPSGPCPRVQLYAHELPVDAGDEALGQAVGPVAAHDIGLHLGAVRGNSHQYTMNSDRLHHFQTSTLLIMSAKACPHRGRLSNMPISLQPTALGH

SEQ ID NO: 968879 - protein, 68 aa, Homo sapiens
MLLYSLCRRVLEEPGTGAQLREGSSILGLYSDDALTLWTKALSVPGLNLELIEAVLTRIHILGVPSSK

SEQ ID NO: 968880 - protein, 72 aa, Homo sapiens
ADSRFLSARASEESWGPMTLCALVLQVSDFRLAVCWPVPGLEAERVVELSCCHVIPPPSILPLVIWIGVSNQ

SEQ ID NO: 968881 - protein, 56 aa, Homo sapiens
REFQADQDDGGEGTRYSSSLSIDVAGNLDYKEHSYVISSRGGEGGDDDPAWVNKPV

SEQ ID NO: 968882 - protein, 33 aa, Homo sapiens
RQKYIQMDSILSTTVSDLRSISLKFQTTTYCSR

SEQ ID NO: 968883 - protein, 54 aa, Homo sapiens
ARPPDSSSSYRITRQIAPPTKTACTSRLIPGSRRRGYTELTRQIAPPTKNGHAP

SEQ ID NO: 968884 - protein, 46 aa, Homo sapiens
GLVGGAICLINSYHDDIRPDTEVIVASKSEEHQGHSNSSPRHSEAT

SEQ ID NO: 968885 - protein, 71 aa, Homo sapiens
MKWLIYVSQSAICTGQSGRLYFLVSSSLDKVLMISSFLCLEAAFTALACFLGLRPASLSVVSQELLAGLIC

SEQ ID NO: 968886 - protein, 42 aa, Homo sapiens
MALDYSAEAVGLRPRKHASAEERLQAKKEEIIKTLYQGDPSR

SEQ ID NO: 968887 - protein, 34 aa, Homo sapiens
PVLIMYVAGFLEGYLTAPHINYHYTNLYPQLIMK

SEQ ID NO: 968888 - protein, 182 aa, Homo sapiens
MLEKLYCICKAQGDSYDLEDFVNLSAASRFGVTASDRPYDRKWCHMCLLIEDQDAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRALDKKRNELGLPKMEVFQEYYGL

SEQ ID NO: 968889 - protein, 105 aa, Homo sapiens
MADGKAAGRMKPEKYAASWMPSEYLMKKQKNLWNNIDGLSSSEMEEVIVPVAAHEKQISVKKKLAETPQNMSLHRISKSDLALGSQTDERKRSAISINTCTPSHA

SEQ ID NO: 968890 - protein, 69 aa, Homo sapiens
AKVVREIGGRAGSHGSGAMSGCDAREGDCVPGDAGRKTRSIEDTCSENCAKSYSSFEAGSLGTGGGMKS

SEQ ID NO: 968891 - protein, 274 aa, Homo sapiens
MGVSMGTLCISVPDIGYLVLDAPLSTKRDFSQIWRSTNNLVDAPFIRVTGVRVDTTLGTSGWVNASAYLVFPCTSQYRATPGRLTTAREHKNFVVLLGHHTSRKEAWVRQPRSWPKQMCQKRGLVPPLVAGSFNPLGPPLTRAIIAPRGRARHSILIEWTTYLPAVHNLLRIWMLSSVAPHEILVRPHTEYKNGNPSSRSPPVFPLRDLSFRGHLCCFFPYAANLFKDVPHIQLSARMSPHSIHAAADTRHICNCTAIGGWDHRPPPYAPISPT

SEQ ID NO: 968892 - protein, 436 aa, Homo sapiens
LISFIISSIPLHSFYSHHILIPSSHHHDIIHIPSSFIFISILFSSSSSFHYYHFTIHIHSYSTSSSSSPSSPHHSVYQRYSTTINQSGHYHATRQKQSDNTRQSHETRPPNQHTTQQAQHKQCRKEPKTKTPKTKQTKKTRKTHNKHKRAYEPSQEEGAKHRTPNTTSERHTRTQKNKNHASMKTTQTQTDYRPDHKQPERHTNRGAPRDTQHDKTQTETQMEYDRQRNTGRQRARHDRGSRAREEHADHRRHRSRKTQAYTEHVTETRNARPSERKQDNTAGTKATTQASSKETTGARKTRAEDGKRRRDDKKANIRRRRQDRKARRRTDKRPGDKQHERANERRRNRAAKREEAQAQGEEQRKIAGREEQTAADSEEEGDKRLNGHNNRVEEKKKTAEKQKREQQQKKKNKTKKEEQGREQTQTNKRGSLPEAN

SEQ ID NO: 968893 - protein, 58 aa, Homo sapiens
MALLVRWFLCSVVHHRVLAQEDGLGRRSRSHFWFVTLEVKTHCSPEHVSSSQHFSEYQ

SEQ ID NO: 968894 - protein, 300 aa, Homo sapiens
RLVTSMVQISTPNLKNGVTDLLSLKPIVAERRGHLAGTLFLMILTLRPRQERCFASVHELCQGCSFLLTFPWLNKQLCMTHSPPRTKLWQQLRKRTRYVAIYTCCYDRGHQRFGPLHSSDPAIDKYSVTVSDPLHCPAWRSYMHSHPPETFQQNACPTAQSYAHPTATWVTARTHGRHGLRPGQPAHGHHDVLHHHATCSEHLAPRRCPETPLPLRYFFHSCHTNHRCATHDNPGKRMLLPVEAHGFHIVLHESTLTLKYTPFIYSIPICHPPATALHHQGQREPPTPFCAYGLIPTLYA

SEQ ID NO: 968895 - protein, 119 aa, Homo sapiens
PLPYSPNNVYQLSVWVGKPPTSNPLLPCIQGPLVPAYSFTNSTNEHSISPLGSDSGTSRHRQSSQSVPYSLPIQPQGTSSTQYSALGCTYSHRPAQHTSLGKAYIGSTVRSASSPHYHP

SEQ ID NO: 968896 - protein, 142 aa, Homo sapiens
SYLNAVQMETGSRMGNAVVPEQYDYVGRVLNQEKNHQSIQYGGKIATGITNISRIELRKQIKVRGLQNCKSYSLYTDCPAVLGLIQLLRKTFSRCVQDESQSHYEDVLVTETLLYAATRSVVAVVVDVKWGFIILEKKETGY

SEQ ID NO: 968897 - protein, 79 aa, Homo sapiens
GSPKLTRFRMIGWQLCSENLPSKIKLPCVDPGYPAPYFPGCTIQDFRKQVNYQVDGGFHREFPKFFTFRARDKFEEDRI

SEQ ID NO: 968898 - protein, 89 aa, Homo sapiens
AKTCTYTVLSGGHTMYPGIADRMQKEITVPWHHSTMKIKIIAPPERKYSDVDRAAPSIGLSSPPFQTACGSSTAETYDRRPAPSIRPRS

SEQ ID NO: 968899 - protein, 124 aa, Homo sapiens
RRGHPPGVTQNRGKPGAPENPGEKSRAIGRPKKGKTLRRNPPPLPGKRSDPPNEMSGLLQPIKANYGKPSASNTSWPILYAFAHKLRKEDKGCLFVVISNNTVLEVLPELISRDNKDIQIAQKP

SEQ ID NO: 968900 - protein, 103 aa, Homo sapiens
CRPQARRLHYNVVANRFVEFRCGSRLLAYTEFRKRGGAYVTEKRKRSDYKWDQMFASEGVESTLYRARPTDQSAGHTGVILIEALSRWWLLRSKRLPMNHGTT

SEQ ID NO: 968901 - protein, 297 aa, Homo sapiens
RPPPAPKNLVGLDFHIPRISPLVYTPARSINVSPPPLHGVRDEGNRLAVALRCNIISSLRADVSRDTFRCPTPTYCCWCGDITPCRIPARHHHLSAHSIFSRISSRAAITRAPTQYRSRARGVLLPPPTLSRLGGALLSSIFCPNLRGDRSVSSPHRRPPLVLLPPPRGGELPLPTACLLWVGVPDRGGSVAPRRSYCPLGAHLCRSPLSSLSSGSSCLQSPPLFCIWVDTPREFTPRPSFLHKVRALTSLFYFLSGRLGWRGLLWPPLLASAGLSRACAYLSPARHSPLWAPPRPQ

SEQ ID NO: 968902 - protein, 133 aa, Homo sapiens
NSIGRDACTLVSGQLQPSQCNTPTKGKITTMRIAMICYLSPRASPGAISVYTGWFWEVLIDNRRAIYNKNTQMTVAHMAEACSHLRRQNLLVPDRMVMSSEETSELKRQETLPCKSNDKAVKHMVDMDDLRSE

SEQ ID NO: 968903 - protein, 273 aa, Homo sapiens
LVCVWTHLVSSVARRDLLMSARPPTCVGARVCAPPWGVFPPSVKMVRPAHCVFPPAPPPAGGSFSRLVPPPREGTIFRSRGAIDEFHCERQSAQFLEASSEVACRILLVPSAWLTQTTGFSPSSCWHHPGGLHWGVTHQTVHFSPSGPAQPVSRPLRLGCSHPPGGDSLRLLMLLRLFIRGRIPSAMPVTPPPSLRIHSSCDAYILYTRGSHHSFVWRPPSRTFLPTLCVSSMPPHSAPFIYLPRDPLSTPHYFFHPPLHINPLFLIPPKFIS

SEQ ID NO: 968904 - protein, 56 aa, Homo sapiens
MHETLVRKCSDVILPDCGAIKKHESSKSDVTVEVCESWVKEVTKLIDNNKTEKEIL

SEQ ID NO: 968905 - protein, 170 aa, Homo sapiens
SSLFVRVCDVVNFQDLNCACRSEEGKLFGGEGSTYKTDEQAGRRALQQVSDLSLRWSCQGSGDSVVQGAVSSTSASQEHASVAMRAMKREQSLDGRADPCGLMAGHSLARGTRGGGLWPMGVVDMDTLVVVGTMVMGVAGIYDQSNLVGYGYGYGSVPETIMEVELEGGI

SEQ ID NO: 968906 - protein, 120 aa, Homo sapiens
ALPTASCELRPGCGVMMQPDDCLLWSSLPAFGTRFLNLSGAGALQASLRAEQSLASIERALSYQVWKVVRLTTEDLLLSNFDDGSFSDNLYPEDIVSQDCLQFGPPAEGEVVQVRWTGRA

SEQ ID NO: 968907 - protein, 139 aa, Homo sapiens
MCLCHTSLAACEAAVGLALLVSISNTYGLDYVHNPKPTPMLKLIVPTNYITTTEMTFQKTHNGINTSTRQPELLASSLYYFLTESTTTYVAVPQAFLRPPNNAAPNINYLRSYPHNQWQPTPLYPVNHYQRKKFYALLY

SEQ ID NO: 968908 - protein, 102 aa, Homo sapiens
MRNKQLQTRCLRAVTLTAKVCSFTPEASETTNPSGGRTIQTRRLKSCNTHREGPSFTPEPARPRTHQKEETPDTSKHQKEQTPDTPPLRTVTLTAKVHGFIL

SEQ ID NO: 968909 - protein, 240 aa, Homo sapiens
MPVGWGVHQGAAQRGPSLLTRGTESVRRFALLAKRAKYVGVSLWPGDFASPFLILRDEKPDALETNSCEPPTHRRWTPPMCLSHRRRFITRGISITRVLSRNEQRLFGSAVPAVSPHLRWFLPAPSLGGDRHGRIRITEGHARQLRTTLPRPPQGWENPSLPARGSRLIYFAAGSCEGLHDQIAASEVTTMSQEGGRIHRRSITMLNPRDNEEGPHRGERGATPVHTPPAGDQQGPSPTK

SEQ ID NO: 968910 - protein, 244 aa, Homo sapiens
MDYCMSRVTNVQAASPNASRSGMGTGSHKKESTAINSPRRSNALTCMRVYAEIKGGEMAWGTRILEVENDESNNSRMHMIISPLGIGDLLHFALISSLQGNYESPVHQFLEGVDSPRGVPPGGDTGTSSDYGITFFTYMRIRTNYLPQSNRPLGVLADAERRYSMWGQAVGQQRRRPHRMTDEQYCEHAPKGYGICGASGIKEIPNEGGKGLQNGERAKERQMDRKRGRKRTEEHTKNRIYTKQ

SEQ ID NO: 968911 - protein, 177 aa, Homo sapiens
MVRSMIEGAPLQNSNEAWSLFDRDGDGIITTEEEGTCNEISWAESSQETELQDMINEVDADGHGTIEFPWIADNDGKKNERQDSDEDIREAIRVLIRSGLGIVKGCKNFASVMTKAWVEKCNRVTVSDENDQGSRYDGDGQVDYEEFVTNDECIVKTLCSMVLNFLFNSVLPCFGCN

SEQ ID NO: 968912 - protein, 285 aa, Homo sapiens
PGLLRLVTPLSLKPALGARAPPPQRPEVRCQKSSPHALSPHRTRPPRAMAAPGSARRVLLLLLLLLLLRPHALCVKAMFMVKNENGTACIMANFSAAFSVNYETKSGPKKMNFDLPSDATVVLNRSSCGKKNTFEPSLVIAFGRGHKLTLNFTRNATRYSVQLMSFVYNLSDTHLFPNASSKEIKTVESITEIWADIDKKYRCVSGTQVHMNNVPVTLHDATIQAYLSNSSFSRGETRCEQDRPPPNTAPPVPPSPSASAVPKSPSVDKYNVSGTNGTCLLASMG

SEQ ID NO: 968913 - protein, 201 aa, Homo sapiens
AKEVCLRGVYARVPLGPRGISENGCYFGHKWGGDKLTEGFPLEPSHVAPPQGANCVCPKVDVPLLWFDTISSKGLASFSVGLQWIPPLVDTLTRDMPPTRGEPPPVRSGQCGRWINTPWCVVTPARQRYKSPRLVRSKPGEKINYTPCAALYSKTITGSLSPNIVGQLLLGARSPFFRIQWLSCRQPSPPVSSLFEGSWSL

SEQ ID NO: 968914 - protein, 171 aa, Homo sapiens
MYGARPAFRRYSPPSSQSVISRQCCTSAGPLASLGTLPGDTEGKVEVTMATGWQEEGLPAGGASQGSQQGHHLWFTTYLVQGQYIYEAPSYCDIHSLIHSFIFETESCSVAQAGVQWHDHSSLQPLTPGLRLSSHLSLRSSWDCRCPSPHPAFCVFIVFFNFCGYIVSVYM

SEQ ID NO: 968915 - protein, 147 aa, Homo sapiens
MCYIEMLAEAFGNVIDRELGEKLGRVKKSTEIDQGKEEFAMVDGQVNTDEECSTDVMTVNVAYRVSRMCLHILCTTKGHQAFPYLHVTLSVQGASQRGGNICRFRHYGISPPGGCHPYCICLQAFETVSARWMGAGNITVTVLRADS

SEQ ID NO: 968916 - protein, 55 aa, Homo sapiens
MPKSRGVVYLGYVVASFTIVSITDHICCHWERSRFSCLNAVGMSLRTDIARKLSL

SEQ ID NO: 968917 - protein, 89 aa, Homo sapiens
RTVVGAAVAACSYGLFRKVGPQLVPALEKHTWDWPHSPSFFAPQEIAGDHIQGGFLNHDYGALNNLFRRNPGTRFPEDPCWGCAPCPPA

SEQ ID NO: 968918 - protein, 97 aa, Homo sapiens
CALPGAPSDRVESRLVANLMRFSLSFFSGGLCALDGLVQGLLGDGCIGWNHKMREEFLELLLLQIFGLEKVPGDLYLSPINFCTSDFMALRTAFPEF

SEQ ID NO: 968919 - protein, 113 aa, Homo sapiens
PFGVFATEGLVSRGSAEMLAPLAVGSLNADLHKMGPAGPVQALPSAALHQGPLQKPYAGDQPPGGPPSPDVSSEMALALTSCLQPLRFCCDFRPYFTIHDSEFKKFTTRTQSP

SEQ ID NO: 968920 - protein, 114 aa, Homo sapiens
HSCVVLLRAILMLRLVVGAVARSVGGRVPAMCPFLLWDPPPFVRSPTLPSSVASPARRPRLRSDRRCSAPRSGHSPATASGHHSWGVLVPRRSSLFPGSVRFDLLAATNRFSPS

SEQ ID NO: 968921 - protein, 44 aa, Homo sapiens
PRGSPSTAILHFRLLSEHGSTTQGIQEANSKKWNNIFKVIQVGS

SEQ ID NO: 968922 - protein, 359 aa, Homo sapiens
MPTTLKHKYETLTPILHYCTYYSTHRNWLTTSLLPLQLHTTASSHYSCSTTAPLLTYPNCAYSALPHNAYYSPDDKTTTHYAHYTLPLPRRRTPTLTTALPAHHSCTMLLPTPNSLTLSGHYCIHHTHPLYLFPQTRSTTFPTNIFRENHFWHSAHFSQGVTQRHRYPLLFQRTNTDLRHASHQLIHTLPYLNIVLRLAYASHISLDGSYPTHTALTVVPTMELNPRLSTARLACGTPYNNNPCAVSGAKQITMRAHRYDTPHAGTANLPPLSKPVAAQTHNPTTVPRPKPLVPTRPTHNKPGKNQLGNSTSDYLQPYLADASVTPLASKRRLSTSAIRSPRHRHTNNLGATTARRTPY

SEQ ID NO: 968923 - protein, 485 aa, Homo sapiens
MAYRTHATDANYRLCSLYCTVHCVTNIPEAALLHTPTISVNPPVYPKPSQLAFQCAPTASALSPDEHNLSDPVSAPSLARGDCPPQQATLNIRIEQVQNRRDPSGNQPLTPLGNWRPPRPSQLRYRDKATRPETMHNPRPLHATTRPLPPPSPTRHSLARRNPPDFPTPHQPTRRPPPPRAPKTRNRHANRRRALTTDRKHKGNGPWTQYGPRGTSRQASPRPSTHRPPPGLTRSPRRPRHTGPGARPRRRLTSKQPGTNTASHTPGQRPCPSTYRTTPAPSHPNHTPRTRWAAQQWNHGITTHTTRAQACIHHIPHTSRQTHTLAETANTSESPRQQTGKSHTQTTNNRTRPSQSNRTSRDPPHDSPHNAHHANRYLGHTQHITRQEAQSLTLPSTTHTPRTRAHANPNNPATTPHRTHSHTATNPTTPPSAPTTTTEQTRPHTPGTPQPHPPPRTPPTPPTRPHHITHPPHHPPPPQHTHPAH

SEQ ID NO: 968924 - protein, 198 aa, Homo sapiens
LDIPGHVAALSVALCPIAGITSPEQCMLGYRSWLGTSCMGRSRFRRPYLVPRAQFVAPLGATDLSASLPQGLCLSPGARSGVCRLSPWCRGVHHPVWSGLALPRVCHKGLVVAPHNGGSLPRGVPPVSSRAAPLGPHDLRRQTHCSNVAISPMAALNCTCLCRPQHERVCLAASLRAGCALSACISGRRSPREPYAPS

SEQ ID NO: 968925 - protein, 296 aa, Homo sapiens
MSAVSCCGGAWQLLCRRSEAPRGTLQVRPSRTRGSGDNRPRKTTRQSRPQKLRELAPRRKVPNVGNWTEYREADELLETTLRANTLHRSPWTKGTASKPTARPAAPAAAERQHSLGAPRTPRRPPQPPSWTPSPWNAAPRHPKAPEHAKGLRPGHPAATNPATGQGRCPKETPYTHGASRTDLPLIGAQDHKRATPPMDATGATPEDEDNAKGAPKLTQAPRDWTTAHPSQRKSHHDGTREATTPHERNERGAHRTAHLVRDSGTPKGANVKYGAHENSRRQVQAHPDRPPNDGNR

SEQ ID NO: 968926 - protein, 104 aa, Homo sapiens
MLAVRRSLYLPVEQMTQQTASVLEQTEIIRMSGTPMSSSFWQLVSGTFCKEHLRENQISQRAASFHERPNCATCRRTHWADTLRGDTHHTRSSPQIAASGPRVR

SEQ ID NO: 968927 - protein, 116 aa, Homo sapiens
MMSNIECVLCQQMDTNWLCALGIIHCNDGDMLIPGNDLTPDLTVIASVHHGLMMARTGMSSNVQREYYQSPIKCVKKDVGIDTPPMESLWQTIVCVVQVHAVCRHVRLHDVCVERI

SEQ ID NO: 968928 - protein, 69 aa, Homo sapiens
WVYGPVVHAQLKIFCLLEVETVFKHDSPVMRNSHLLIVVIRPTRIRKFLGVTGVMPRDPERTFYLSRSL

SEQ ID NO: 968929 - protein, 182 aa, Homo sapiens
MSTHNRVPRGLLLIPSPPTSILNPLYTENPLGNHPCPRFNFRTRPHRGHILRVPLPHKVWSAHTWRRREHPWAPKARKPFQMPHTCWGNNMLRTTRMCADILPGLGPTFGEPEARHVSPPEKRDGDICWDNPPGKHKRTPTSRVLYATRVPPSCTLLSEVFCAARPPLGSPPQGDVAWLRDF

SEQ ID NO: 968930 - protein, 195 aa, Homo sapiens
MSPIHTCAVRVRAVLSPQTRARGVREQIPWPRRPQNLVHTGVGNSCPPRPAHMRFAPPLRFRGQATTSVSWCPWRRPPPALLGGPPRAGTRLEMSEPCDKKACNPKMWAPTTPHSVGAWVTPHRTISGACRKHSRGAAGTTELYTTLGGNLPPGARNTGGKICVQGLQWAHPFSPRPQGGDLSPGINQSGNLGSS

SEQ ID NO: 968931 - protein, 113 aa, Homo sapiens
MSNTVKLGSVHNMIHMQSNRYSCEGAYQSVMSRQPTIAVIYPQSRLGVANGKRVDETDRTAMSATRMVDHRNDALKNNLLVTTTSMWRHENTTLGTGTCHETGLCQLTGTYHA

SEQ ID NO: 968932 - protein, 110 aa, Homo sapiens
TVGPAATQVVCTGRLVLFFLPQPLVCTPDGAGIAKIVGYSLVPLLLASQPASPCSLPRTVRSGGGSPPLDPSFMASSPPLIRLRCTCPHALALVACVKPLSVLCAIDLCN

SEQ ID NO: 968933 - protein, 116 aa, Homo sapiens
MQMGKEDDDHRSVPKCQTVEKGRLSKAKVHGPEISMVIFGRNDEVRPLCYVLHSLPNQETMGYLSMGRGYTVWSIWMNLQEDTSRGTKMSLRRALSEEGSNGQSLSSLSQESYLNE

SEQ ID NO: 968934 - protein, 226 aa, Homo sapiens
MADFPYARCPCTRVFRRDKFLAFGPSVKNGGILWVIVARPASPGLFPWNITAWGLPDRCRRALYLKRVVSPAHRQFLSNPKFLVNFMNPPCCVLKDPETPCGEPPFGSPHLIRPPLYFETRPQSKKPPKSVARHPHDIPTPLVLTRHINNYYRANSCPCRPPSNLKPSLSPFNCNLTHFENSRHKNSVTPLKSPHYFFTYNFIQTPYLVAKPFKSFMTTAPEPVPR

SEQ ID NO: 968935 - protein, 135 aa, Homo sapiens
PVNSGSLPTTRMLKEEQEVAMLWAAPYPCSPDVHRDPHPERDLSLSDHVVWSLFKTLFMNTCCLGFIAIRLLREVLADREDVVGDSDRGQDYASIGKCLNQSGPMIVGHLHDQFCIIIIPVLVGQAQRIDQRGIS

SEQ ID NO: 968936 - protein, 174 aa, Homo sapiens
PDDCGGTGGVVELRAKGGCTCGVPSCPGFACWGGRAGMPYVLVGAAWEGLVSGASVVGMAPRRPGSGCGESAGGPVGVVTRSCVNPRFLWGAHVLSAHEIVACGGGVGSPPSICSRGDVSALLVGGVCPRSVEARWVRVVRAAWWETPTGGVSVVDCSRAASRGRVLFRPRARV

SEQ ID NO: 968937 - protein, 285 aa, Homo sapiens
PVNSGQAPNYEMLKEERGSGYAGGAPETCSLDVHRDPQPHARPPWPDHVSPGVTVQTTLFMNTCCLGCIAVTPTPVKSRDRKDGEADVTGDRALCLQATSALNTLGPDRGIYMTMLIIIITSVGQSGPRDRSGGIHGGTRSSAVNLLPGDSIYPFLAMPQRKGALPLTGIPLHELPFLDHGPKGRGTGHAGTFIMHTQLLTVGLATQSVMCWGLRVKLNDKNKHHNKDNHHTTTTQTGTRGTQQNNTTRTTAPERTRTYPTGQYRAHNNNTRDRTKKKSQHKAKT

SEQ ID NO: 968938 - protein, 188 aa, Homo sapiens
MGRPMSVREYVAVRRGWGLVVRTGQCRHVTVSWVGGVRRGFRVGETGVEAAVIPPDCAGGGAPRSGCSSRLGRTHKAPACPFCLGTAETVAHLWEAGVRRKWLDTQIRRVFWEVLNRFSCHRSGDDSPGMQLPPLVGAALNFGVVPVPPHSLDNRAGLLFSMQDKSMGPGFSHKQYRAFPMQKLTAHI

SEQ ID NO: 968939 - protein, 245 aa, Homo sapiens
MVMAGHRFGGWRGCEVDALPYFDQGYEAPGVLVKLDVVAGGGGNSQIPTLTKNYLSYLTGPDYCCLGNMDIMRNMNLIDWLLDKQLNAQYGNDHRASSPPPLVEKNDINAWLKKCVDTIHMAQLEHQAVRIDNSGNNVQRMDVIDLESINENLVHTDGSTDTEGTSSRGKKNHIQDAEVAQKKNMELTGGIYIEKTVEVLMGILVQYEFEHDGLLFTLEDELFHLACTMAGTHETSGKSLTDIAV

SEQ ID NO: 968940 - protein, 307 aa, Homo sapiens
MGINERPSPAPNVDYPLDWTRQIPTLSLDQSRRFSCRNILLPNKIMNEQSACHFNYRIPVIPLSDRHQRQQLNRDIRVSSPGWPLSTARPAHSSHTTALPATYSVSATNNTQHISHKHLGHLHDTFPNFTTYQPWPKRLNPPLTPATRSRAALPRNPSPRHTHLSSPGLNHTRLLTHPNAPRIPCTGRTHTNPNPQGQRPRSDGAGKSPPTHLSTGTPAREKWKPCAQQSPVPHTKILQQRYANVTPREASSVTRTSGARHAIGPTAQQITYDVHLRGPHHRLAQSSPAKQDAEQQQQPAQHKAQTS

SEQ ID NO: 968941 - protein, 169 aa, Homo sapiens
MRGEKVQNLQGDSKTAGEFLRAPAEGANHIRGESPAVAVPHVRATSFPEPGFCSSTPQGTLFLLKAPSAGYAAPAFRKRGCSCPTGEPLLLPPYWEDFFPRARATQGLSQIFSATLGSNAFSSNNNCRTHNAVKNVPALIGARSLVTRVACWASPFFNAEGVTVSLFLL

SEQ ID NO: 968942 - protein, 107 aa, Homo sapiens
MQRGWIANAQSCRAVKRHFPRVAGYPDTKGTWRNLGRYMDCKLGIAGKPFRPKMQHLDKHPIWEERNRFQPTNLEDDKGFELADIGLAGGNIPGLTSGLELELACNG

SEQ ID NO: 968943 - protein, 169 aa, Homo sapiens
MELCAASPNGGGTSVSTRARPCHFFWGPKLVQTLSPPEVRAECSAGPFARDAWEFVALIKDARSLLVRVEVLRGSMYIAAPLMGVMCDHHPPQVSWNVRSGYLRPLLDPCGMVDKKARNILRSPPIDVLGASRGQYGVRPPCQQLRPNVLYLLRPPSLVVRPDPTPFLC

SEQ ID NO: 968944 - protein, 53 aa, Homo sapiens
MGGGGDVTALTIRPLVCRMPGALSHPPCAGPYSYKYGCHLKAIIEQEKNGDID

SEQ ID NO: 968945 - protein, 276 aa, Homo sapiens
PHRSADVTTSPYADTQNSYGCATSTPYSTSRLMCEICQAATSDSEFPIGTTGGYWTHQKSYLLGSPIYGVWYDHSSQLLLEMSQPGILVTTLKPGKRLWVTTWRVCTRGIPSGNPKKHSLSSSPTLLILDDYCAHFTPPGTVTPPRKVRSSSSAIPLPRQSDSLVSLTCKPNYARENSDLTSAHGLRLQTYSEKWTYTSMLSKVCICRTLGWSQNHCLGRKLSGGNPGRVQPTSHECNSRTLGTENHTPAPKGADRDKQDHTNKTPGRTPPHPPNT

SEQ ID NO: 968946 - protein, 135 aa, Homo sapiens
MKPNKGRLNTMRVCLNYLRRYYIVWWTANRESPINSSVVSEQLNILNRTPEDEKLNRVTDGGTTRTQDSPLRNRDARHNKPLIALQPSREQLISLLNATIWGKKQHNLGKDEFKFFSTGTTNTRGEKFDWVSVVQ

SEQ ID NO: 968947 - protein, 121 aa, Homo sapiens
MMLRLYLCSHKLTPPSHISGYNKAKRYPPCPKISSCNPPPFFPAKFFSTHRPCHNPCVSSPKGLSHKYRLVTLAPYPPVYYSICVTTTPPAARSCGLLYTTPQGVFGVASVHPHTLAPHHI

SEQ ID NO: 968948 - protein, 198 aa, Homo sapiens
EAEAAAAALRRVRWDQSRGGAAVSGAGAPLFLHPAPVPPITCDALMRCAVLWPTLPAGHGMTVEAAPHARALPAVGPSAWPGFCPPLPGAVANKWPAQCCFVGGPLRRRFLPVRASPPGGAPGSPKHMTCARIPDDDARIQAEHDRAPNHGTTPRRRARQGHNLFRQFKDIGPRAAIIHLCCMSHPPFRNYFNPNVGD

SEQ ID NO: 968949 - protein, 167 aa, Homo sapiens
VYSLGFFAWRALVPGLGLCPGVCGLARRVLPGRSSASSFTGPPPGVFHDTGLPWLRAPSGSRILAWGSHPRAVLRAPRIAVGIRHVSLSLGRSLCAHAPKCAFGLRIFAPPPLASHGFPAPSLLVPLLKGPPIGCPRTRPLPPRSALVWIPFHAVALLSGVPRPLVC

SEQ ID NO: 968950 - protein, 284 aa, Homo sapiens
SVSRHVPSFLSKCRTVQPKSCVKSQALEGEALYDHRKVQYGLRVKRPYNYELFDALAGCFCNIETAIRTKGVGSEVTVVKILTNRRQCIETGYSLRFQRRSQAGKLASDSGRQALSGHLETVIRAYVIERPARIVTLLSLKASMMGLRTDEDLLIAIICCRTKQEVGEINGVYRGNVCCEVIWSEDLIRETICDFRTAGRLPCAKGENSRGMVCHDYDPVGTDGRDLYVTLHVNTGKGLAVHTWVSLMTERTCPLQKVLTGHELPPLHCDAHESNGARKLRTAS

SEQ ID NO: 968951 - protein, 102 aa, Homo sapiens
MFSPSMQWQGCSVFGQTRIMSLDRDFYSEEAQLTRKVEVGPQANSREKQRLAIRVLTGGIKFHSADLHETLRQMEDSIKSIQLQELMEMKTIECAHVKSRFE

SEQ ID NO: 968952 - protein, 109 aa, Homo sapiens
MVLVPYEDASPLCSHRCIRPSLARPLCERAPPWGSRSPSFNSQINPPAFFVTPQVPVFSFYKLFCTPNDLYNPQMCSKILVNTSFVHHTEAGIKIFLTCNTLLTSNNIV

SEQ ID NO: 968953 - protein, 121 aa, Homo sapiens
MGFPWSQPKGPESRSWRDLRSRNVRQLTLREGVQPGKVAYGALAGEWDTGAQELNAWLKEKQTRRVDCRETALRLTGPPHGRKRHGAAPRWQPGRKAEEERVSRGPGRNSTRRRPRHKGPA

SEQ ID NO: 968954 - protein, 70 aa, Homo sapiens
FGDTSACCASISRMFAAGCSGFLLARQTFGAPPMIGLRAGLVCCDHDVVLSYYRCFPAVCLRAAVEVSCG

SEQ ID NO: 968955 - protein, 283 aa, Homo sapiens
PVYLASCAVVGPFVHIIPAHMRIPPGFLGPKPGPAPPPLPGVLPPAHVSSPGAPRQVALAPGRHATTVIVPLCPPLCHSLIVPALSFVSTLRVAPDFLPHDYLCTGVGPQHGVPYIRQRGPTRFKVYLGPYPNGSLCYVGACTLVQPHAQGGSLLVTPTDPGYRPGSPQGRICLPQSSRPPTCRSHQYGQHFRLEAPARQGRNFQSPAAPTRRSQLSLRTGGADTSSPREPRLQHTGCGEKAGSDTQGHPCGRRQDPGCAPLRTSSRAPTPTGGAPPMATPPF

SEQ ID NO: 968956 - protein, 119 aa, Homo sapiens
SQKCAVTTNEEDDDREMRFQQAVTKGAQWVPSRLMDTSRGGPPSPGRGPPSAGSSPFGGTTLEGPISTNTWGPTAPVGRKEKTVFGTWPNQAIWPGHNPFLTLKEPPLPLFKRAPPRYY

SEQ ID NO: 968957 - protein, 284 aa, Homo sapiens
MPPPMEIVSKQEGVKEPQASNRKRAAQHAWGPRRTSSGGTNRLTSPGFSVCIGPCRASHTPARCARPTPPRGPQAPRLLGYRAGVPRFGDLVTARVSRRPRLHHQQGPSFLGTKFGQNTGLARAPGQFLPRSPSARSVVVRPLYGKLGGLLRSPPHPSCVCGAAIPQRSSIGGRRNQPRATGGRAIKASPHYARDRPPPGPRKETHQVHPRGVWGGPTQETLFLGGCAKAGVHPPKKTRGEPSSGIPEVGILRAPHPTAPGAHEKEHRFKKKKPTNLLLGGKPH

SEQ ID NO: 968958 - protein, 126 aa, Homo sapiens
SVLVPRFVVGVPVSHVPPVFVCSTPGFLGVPPRPWLFEPLPGIPTWVRSTRAMASPRAVGVLFVRPACARGPETVSAGVIPPETSSTRFVLWQVVERSLGKVPCCGRPPLLPALLSPAEVPECRSF

SEQ ID NO: 968959 - protein, 112 aa, Homo sapiens
MKQGAHPLCRRVINFTPGAKLTSAARFRCPPPMTSRVRLFHPPLSPREWAPTFVLMDRQHRCVFTSINRFTLLEREKNTHVQTVIISRKKGGQLVDPSLHKGPHIYLSSMFD

SEQ ID NO: 968960 - protein, 225 aa, Homo sapiens
GLLVDSVSPPPPPACVGYDKYVYLSPARRFFLCPRDLARSICLFLSAAEELCGCGASTPPLPPLLLCVLLLPWMISFFCWWMISHCCCLLLRSSPTSGCVFVALVLLARRGLVAHPAAVGYHRRRGFSFPSGPSPVELLPAQGSAHLLFFLTRLVSRYMCFCACRVFSCAACTQSYAFRVPPRRRACGKTTRRFSTRCFLRVGSYVLPIATPPRGVLAAPGYSLD

SEQ ID NO: 968961 - protein, 225 aa, Homo sapiens
LYADSVSPLFAASVPFWRISLSGPPPVHGYHCRVIRGSRKLLGKHGAPLRCGTGNPHGRASQAYQSWAPADSGPPRAAGVLIFPIRAHNKVGHTRNLPSLAGNVVSARFPKRQWGSSGWPTPEGFPRGGPSPLQKNNGAHPNTHGRTFKCFPTHKMGKISQREGQTNVCVRAKRPNHDGCRVHRCACLFFPGAECKIRETSLVHNKKRPAPHMCTPPCFFLKKRH

SEQ ID NO: 968962 - protein, 406 aa, Homo sapiens
GGAERGQSHHPAAGAAIVDEKIFCCHGGLSPDLQLYGARFGRIMRPTDVPDTGPLCAIRVCVCIPPSRHVPRLAAAHNAIAGAIHFYLFGTLMLVQSHISIAIIRPCILSILHLARPAPIPALAVGTRMRIMPILSLASRTAPSAALPPRSTAFPMPSRHTSHPGCAGTPLSQFTLDLGLAQPWHSQLVRAPCTHPSLTLGYGSPNSRTHDPYSSGTHTSTSVGHTNRDTEAYNPVTTHTLTFAHRRTPSATFLLATSTSPLGYHTLTHTPYAHTLGLLKPSPGFPDNRKKHTAGLVTGNTTRHNVFPVRYQPCIPDLQLSLQAPTYGTYTRWHLHATLCTGYDAYPSLYSQLFVVRQPLATSKHPAIVATAPKLIDGQTTRHFYIGYTASYPTRPGYLTTLLHMR

SEQ ID NO: 968963 - protein, 153 aa, Homo sapiens
MFITCATRASSRYPYAAYPLHTPLPLTLHYTRYARYTTTLCTHAFPGSTRAPCNNYITLPLHNWLLSGYFNTPWQTSVSLYSTGPLTPNIVTPLTTCLAPFATLRPPLCLKTYPLATPRTNWLTSLAPALFGHVPHHLVAHFRPLQLPSNQTT

SEQ ID NO: 968964 - protein, 219 aa, Homo sapiens
RCHVVSSTTAAEVGSDERQPNTSCCRAAEWARAKPHSGIRDFGKDPQLETTGPLDKNHRAGPAPGERRPPRKQAVALSTGDRPTSQGPAPCRAAATPTGTRRHTSPHKGEHTRGTRPTVAPRREPAPSITKTLVQMAQTTPSPSSGTRGHARRPRRDPEWNAPTCASGRHTVHRIGRAESASKGRVLLHTDPAEENTRLVPSSNGSVTRREAVGRGYSR

SEQ ID NO: 968965 - protein, 109 aa, Homo sapiens
MNPQFSARTGDTSSGGVAPGGPATPPPPPRYVLLPTSQTDRGPVSSFAIVFPQGDSPTKNGTYSSEGFVVVRYSLFRVVDTTRSSLGAWRSQHPEEGYNRNWTFSNKQN

SEQ ID NO: 968966 - protein, 259 aa, Homo sapiens
RYRYLGRSHRYPYRGTPDTESHTPSTGLPAPGPPYRPPLGAPMQRVQSGRYRQYREDEEHAVTRTYERAQPHTRYPTHPTVSRVDFIAYRYCDCPVTMLPTPSRCLPRTATAATPQRNTLTPQPCHSTPARLAPTQPTMNIPEDTHLATEQRDPRTPPKTTTSHSAARHAPHPTGNTPDRTTLQQHSTTGHQAIQLPPMDRPTHSHRSTYYDYRPMENYPNRTYAPRTTPYDPHCPPHFKVLRHFNHSPHVLANKSLLP

SEQ ID NO: 968967 - protein, 171 aa, Homo sapiens
LVAFRVSQVSSRKRCLVCFCPNGFFPRCRGTMIVQAPFIHAGRPPPDSLDRPRVPPVTGGTHKNRGNGDPGKILSGPGSIPFCPTPPFSLNRAVYSLQGNREMLEIIGPLIQNQWSPPSEVDKAVNESLWIPEESRPSPPGRHYTSRQDTLGRLTPENVLQRKPAGGEIAL

SEQ ID NO: 968968 - protein, 263 aa, Homo sapiens
MGGTNPGNNREASQDPRCCRGIRAPRRPGTGGGPTPRRAADTLVETRASPPTTSGVINSRPRCTPQNGRVGIKPGALRPSENNPASVPPPGPRRTKTAATFRRQKYLPALTNPVLAAARYTQRLPTREDFRREATPTLLSPGTPASGDNPTSRHAPARAPHNAVPTLLKGTSPKHQIRSPPPHRQQDSILRHYTPASWGAPTRENTTANKSRHPLYTVPRKSTRALTLLWGAHTTNTLRDCRPPPGVPRRAGAPPNSVTPPTK

SEQ ID NO: 968969 - protein, 261 aa, Homo sapiens
IYPPKTTHTLISTRTVTMHSRPLTKTNFHTTINTLLSNISTPLNSFQYNILNNHLTGTLYSSTHTQSYIASQLTYHIPYPHPIHHTLNRVLDTTFYATLIPTITITYPSTIYTQLTHLTLTLTETLNTMISLLLTNTHIEYHRFQTHANTKNLHHPLLHKTQHTPYTTSHTTYTRHHLSTPPLSPQLNTTQSHNQSTPLLLRLTTPPHANSITTPQQHPSSDTTPTLPSIISELPYSHQSPTLSTPIPTINHPIQYTLPPS

SEQ ID NO: 968970 - protein, 312 aa, Homo sapiens
KVFRDAEYCWWPVCSAITPRRGASCSARLIPPVLSSPPGSFPAEGCYVHGANLGGVDKNIRAVHTCGRPSGAPPRRRQTLAANGPSPSFGNHSSEHGFSLLFPNLRACCISGASSSPPLLPAFLERVVRPKALLVGETLAPGKNHSHGRIFLREIFNTPSAHHSNTRGGIGSPKRGTHFLRVNPSSSKDTFLFREPRHHHVLSKSGRVRQYISRGSIGPSSPKLCLNAPLFSPAEVITTRAIPHTIVNWFHRVLFRPKQMFLFLYNVPAINSSKPPLSNPLLRTPKSALHKPPRPTRNNSVPQKPNHLFPTK

SEQ ID NO: 968971 - protein, 143 aa, Homo sapiens
MPARVMAPPFCPPGPVLVNGGGPLSPQGAFDAPGVAEHAPGISFCGHPPPADMFVSTRVSPIHPLRRAPILVWFFSPPRCCAIFEEKYSCTPAECLPTETLAALAGLIHFFFPPTQQARLCFFPHPPISTIFLQVTNMVPLIL

SEQ ID NO: 968972 - protein, 224 aa, Homo sapiens
LVSYIEVFDTGTHASNGPRATSISELCKFPGDKCVCVRPPNVAPWDIVPGSPCPVEGTPPTWEKLDTQGAGRTFAGATPAVLPVTKEQQGVVVDTQESQVVGAATNKGATVLPRKYLGTRLVHVLCKNAKNDSRVSPRSNTVGVFAPPQPRYILVPPVVGGVALPVDQPGNKKNPCLSCERQPYMSLMRRSPQPAVVLIFVRIYQIHLLTAPSNHHPIFYLSHK

SEQ ID NO: 968973 - protein, 140 aa, Homo sapiens
MLANCPPKHGLSFYQEVILSASNDFPQQKFSSDIFLINYDPAPYGKFLPPPPPPLIKVSLCATKIGYNLIDHSYMRLILYIFLDPTHTSGPQTSLSPPASRNEVIYISSHHLFAKIYLAPATCCLYNQYRAFISKWLNHL

SEQ ID NO: 968974 - protein, 115 aa, Homo sapiens
MRIRPLLCVVNKPTLFSPVRQKLHLSILTMAIHPNIVPHPLITPSCPKILPTHRHGGSHIIPQPPMYTTTSRHHPISHHDGTQPLSCSIQHLSPHFLFPNLPPNPDHINIPGFPR

SEQ ID NO: 968975 - protein, 223 aa, Homo sapiens
MPSGPHQTQYALPKDPGVRLVCNPRRGDVGCHAPRGVSAAPPSPPRFVGAVSLDVLLAALPGNYGGPPTGPPAAELRWVGTSPPSAGESEEAVFLLRKKIIIYVPGDFNEFGKNVGRPITGPPPGLPHVNAGVRALTTPVATRPSDYYAWFSPLAAFLSVSRATNPEGGCTTTHFAPVVTDAWPDAELGTGLGFYVWGAYDVYVLWGDKMRSGRSNDQPPKKN

SEQ ID NO: 968976 - protein, 100 aa, Homo sapiens
CRVYKTPPSRILSRTSQGVSHQHNGCSLNTRAFKGAPPHDNALGNVFKPPLIFSLCLPRVMHSSNNPRGPSLSPFRRISPPPTRQKTWVVNHARPTTWGA

SEQ ID NO: 968977 - protein, 248 aa, Homo sapiens
LGQPRCFIYDPAVYRFLWLLQGDVFSMQASPSLFRGLPGVPRLFALPLCATGGNFFPGPFLIIKGRAFSRPIGARYCPCVFYKTLGWLRPNPGSAGGSHTACGQELTPRGPLWAPCPNMGANKIGPLRRLQRSRSEKPHKCGPAPSGRHSTKGSPVLKQVISYSKTPRAMAILRSNHQGVLFFLKSNHSISECSLPPPVVSRSKAPRPPPHCKSTPSPPHICFYAATLLLVCSLFGWEERDPHFEAPY

SEQ ID NO: 968978 - protein, 242 aa, Homo sapiens
QSSNRPGRKKGEKQANNCEQRKAPGSAWERDVVKKRGNRAKHRTAGEPPTGVDNNARIAPQLVVLPRVDSLRAVIRLLLAPSTPEENIIGRGRTKPPSAGIALILQQKSPNARVTVPPPKNEVIHVLLDAHTRVRGAALNPHQSTTEERYVPLRMNKGVPAPVRRICSTDAEDTDTSITQMNGTDADETSHLNRATRRIERVATQWRPQRLMRLMRKGFSLEEYASTDVENIPRRGRCPQTQ

SEQ ID NO: 968979 - protein, 108 aa, Homo sapiens
DVIFFQESTPPGFFTQGALLAHTQMFGERYIKTALAPTYIVSQTPSHSRWQRKNNSPPPPRVFLYSTHQLHIHYPRVILSRRVPSFYQCLFYPRFLYQTTPFVRSSFL

SEQ ID NO: 968980 - protein, 112 aa, Homo sapiens
PRGEISQLDPPIGRYIPFPLYYSTTGAKFKRQLATHVESIAAPSSRFRYTYVCRRNGWPPPLFWTPHVYICRPPLRGDRGDTNNIIMAEGNFSINKYRGHRTPMIPSKGIHI

SEQ ID NO: 968981 - protein, 437 aa, Homo sapiens
AELSRPGPAVPSPCAPERILPGRGLKHKRHEGTHISRREENVYPENKEGRTNARANVKVSPHRELVTKPRRGKCRAPPRKNCSVVCLFSPGENRARPPLRHMRCKHQMKKPLGAEINSSCRQRDRYTGWFVTHKRGNPKCRGRPWIREDDPPQPRSVPLSADSLHKLECDPISSKKRRAGDRKLCLPHPRGDTGAMGGPTRPSMNPPTSLSGIPVRVGTEEETYLGPDRLFATNISELSKRKDENGSRRAAPNCEKYPPVVNPPTVGIVMTYYYRGKDHNSLGLVPRRPEYSIVYENPSDNRFHRKIIECSVSNTGRICKSKVTDNNTCMRGQPLYRCNIPLGTTGLVVCCSDVLTHTSLPRTHGSQNIMLCHHVRLCFTPTPPRTCQRLSSRNDPHPKGANKSCDRHKLEVLQNLITDISFLQSNTTNGERGPPTY

SEQ ID NO: 968982 - protein, 172 aa, Homo sapiens
MFPPTVPLAPLLPNARPPGGKFFGPQMPPNWVLTHRHTWGTYYTVLCMVAILIRARTLGVCPPWAPPFPSRSTNTMFVSLYKKISLHLPGTFSLPNRIIFSVRRKLGPPPSLYFPSGGGRETHPPDMTPPYLSLKKINSHVPHTPPFALTVSKGHGTHTYRRNTPVLTIYLG

SEQ ID NO: 968983 - protein, 57 aa, Homo sapiens
MISRKIFRGTPRVLCRRCGTMSTVTGCSNKAQHSGSRARQPPAKSRPKLGNPKTRLH

SEQ ID NO: 968984 - protein, 105 aa, Homo sapiens
MAKDPVTPPRGTHHPRSKVRKPNVGEPKRGLLALLCSEKKGVPKNFVAPAPYIQTLLENISRCSVAPLSRSQNTLSFNSKAIEYWLSAPQVDPSIIFFVHTHQTH

SEQ ID NO: 968985 - protein, 116 aa, Homo sapiens
MVTTYRRMHSRPSLCTHKALFDNHAPVPHIKDHLPLSRGVAKFDLVTPLLCYFLATTLSSLIKITTSLTKSHLSLVNTISHSPKNRVGTPSRRENPPSIAPHHCPHPAPPFFRPTA

SEQ ID NO: 968986 - protein, 193 aa, Homo sapiens
MISLPLGPSYGQHAPLFVREDLDNSACRESFPTNSPPPALGSYGRFPTTEDFPRATCRPLERREELVAPPTHPRAPPNSGPPALSLYGVWHLDAWVTRAMGVDPSARVSFHPLHPHVVVVPTPVPRSEASHEPFPELYPGSCHYRLPLFPGPPRRGRLLGCDAPPRLSPPRVPPSTGPLHRCTPIFLSGKQNT

SEQ ID NO: 968987 - protein, 284 aa, Homo sapiens
PKVVGPSSRGASPKFWDLPAPQSLGLPSPPGVALPFRFPGATRRVCQRCLFFWGAKVLQRRSIGATLGETPVLLCARSFGGEDIGSPFPPPKGSLINWVFFDLPRPAACVAVVDLTNARLSERLVKKNRLLLVNAPRVENSFRLRRTTLLLGDIPPPRSVPAFDNVPSRVQYPAFHLARNIKETTNPLYGGRRPPVGLRDPGSLSTTQSVCAPHCPPNRGVTPAPCSGRGYQKCECGRHTLSPKRLQIGKNWDPDNRQIQGGERDLGATPSSWRPTASNSSNKT

SEQ ID NO: 968988 - protein, 239 aa, Homo sapiens
TRGGPPQPLSPGGNTPALCKKRTCPHARGKISPPRDSSGSTNTAGKTYLRHPSSPTYKPARAEVIISRGEMQHATVRYMRASRDREQTVSGVDIYLPTPQRGAPPSTVTELSSTSGTHDYIVGKEENTKERGSPHDAQDLLSGVILTQKYSASAHATHTPPYAWHRGRPPRFAARPQRGTPPPGAERTKKYGGHPPFPSTEEILDTHANNTRPHQNISSRNPLLSSLQYTHCVKNHPLR

SEQ ID NO: 968989 - protein, 132 aa, Homo sapiens
DKEGPPLGISPPPRSRAKLAKKISPAVLGRRDTPPPGGRKTPPTPSSLGHARTQQALYRAPLSLPAVPPNAEICIAIKHRARVEICPRNTSGALPRAGTRKFWFPPLSDTLTRRHTLSLISFRSGPPHNLDA

SEQ ID NO: 968990 - protein, 131 aa, Homo sapiens
SLLTVDNCGSFEKRKFPECPPRFQGWGFCAGFCAHPVPPVGPMVPRPRVVVRMFPKWGGLFPGRPVYAASKMFGPSSLVAEHRCPPCSCLPSITSFLGNCFLRREICSGSIMVPGFEQVAAPHQRCLPMES

SEQ ID NO: 968991 - protein, 223 aa, Homo sapiens
ISWPMWPPKYGPVDPGSSLVVILAHPALFPSGFPPIRGSPRATFEMKSSLGCAERNCVSSSWLLTWRECPQNFCDILGEARPICVNRVSAANPTHRLLGNHFPASYATVGAPLSPGRRITTDPTTPVPARWGVLLATHHKGQHNKGRSLMSSARNASPNVLPPQQELSQETRADSNDMSTPLTHAAPTAPLLRHHSGAEEDTAPSQQTLICVSNTGATFELYD

SEQ ID NO: 968992 - protein, 255 aa, Homo sapiens
MVREPHPSFTHPPGGGPPSDPLSYRHHASAVSQTSLPSREWLSPGGDSPTLLVICSRRLFYPPRRVSHVATCSSLVGPTPARHLLQQRRRPSLPPATPHRQGRPPLLTTRSTARSRGPKAPNHLWRVEHPQQIKRTPPPDDTHLPARLKPPPGTHSHPLNQADDVRRPNHSVPERKRPACQHTPRGLVQSTSARRTPTQMGPLGAETSPHPDREDRMQDSTRRLDARDARMSDSMTSEYGPCTATKNTFPPFPPK

SEQ ID NO: 968993 - protein, 136 aa, Homo sapiens
LGKTVAEKVGGRRDEGVGGWLGREARFSQEVVAWSPPGVPVRCVEKSRGGTFSRGPPVGACVMSAGRSSTNGWGYTDAARHAARASVWRGLMAAAPGVWIICGAGVDTDAVWGPKRLVMGNPPANYGALHTQGEPL

SEQ ID NO: 968994 - protein, 294 aa, Homo sapiens
GVSWLRPPLSHLSRVRVYLAPELVRSIFALAVMREFLPYTDPGVVASHPRPPGGPPIPGPGILSLSAQGLIMSRALGGEHLLEEGGPPLFYRGVAPHSAESGGPFQLSLPQAPIIHDLTAPFVFQRTHSAAAFTFRPRVIPPRSFFFLLGDLPAVFFPALLSAVCSPREYFIITGGPLSPNPRAPRVPHCCPPGGVGHHASLPKSGATSVSPPVLGTLKAAQNAFRERQSVCLQSLLVERSASPASPCCLIGLRPLFRSRGVLGAQLLHVGPASVPPIPEPRARVPPQPTPSHK

SEQ ID NO: 968995 - protein, 187 aa, Homo sapiens
GSEQHADGDYSVSSRGRSKFSDNIGASLINFVFGMYVPAHAITTATLPIMASRVLELRGPFGGPPRRWIQRTYLLAGQGIPALGRVDFISGPRHCHSEGFESSPAVLLLRGHLFAPGGQPTHVLETGGRQPAGAHSSFPHPAGEVEKAHVATLLMRRESQQTLLGLRIGALPPPGSMVKGVSCFPPG

SEQ ID NO: 968996 - protein, 219 aa, Homo sapiens
MSLNSVFRVSPPLGPETHLVLFRSNLCIPWATIVQFCPRPNLSFQVSLGELFPRPLPRHMPGSTGRPPVVVLFSYRASGSFVVTGGRGEPRRAHFRGHTQHNLLCFQRRLERMLYAAPAPPAVNCPGVYAGRPPSHLAAAFLSIILSHDGRVLPPDLPRARPVFTISSSTPDHPHAPASPTRGGRNKPPYDPQQLPRNMFFFSSHYLMNTFISTSHTRV

SEQ ID NO: 968997 - protein, 206 aa, Homo sapiens
ACGDPRQPTGGHPTETGGWRPANPRWSRCPALFSALRLWHLTNAFPHRRSLKPRQRVSPPPAPLTSALGPTPSWSSLSQQGSRPSPVTTPCASLGGMFPPLGSPKSGANCTSLYRPPSASLPRANFSAQHPFAAWLTTTYDLWCPTHGAPCQEGLRLSRAHGGVPLSSPQESALVLPPAISPACGPLEVSCPRLLFRAAPPESSDM

SEQ ID NO: 968998 - protein, 300 aa, Homo sapiens
LVVAAVCPPLGVFICSWLERSMGLFLFRSCWFSGAHSLCLNPRLSNWAAARVTFAAGSSPQRAISRSSMAPFYVSPGQRLVLLPAGLPLVPHWRGSCPSLYGSAPLGRLIFSAMRDRDVLATPWVLVGPTAALLNSAWGVPHALWPSSRARALLGFLPRLQSDLFYPRVFPNVGSRRGTTLFFLTGISTPPLFLEVHLLSPKGVSPSIWFPEPPHWVDPSSILAHGVGYPRTLNDWLWFSSRGYNTAGVFTAITEILLPPDRRYHDEPKVPSIPTAAVAPLNQSTPPPALPPPPPRPGFT

SEQ ID NO: 968999 - protein, 205 aa, Homo sapiens
MRLETTLSLDMWNQSARVLPHILYQYLAGIIPENCFTASGTNLGFPHFRKVTPSPRFLFNPRRSNYYRQVLSSPPALSGVVHRTLGRKFPPGSPTPMVKPKVWDILPALNFVNLKEYLPPQGHRLFANTNYLVGRPPTTKHTRWEPRAPVPASCDPAPFLPSRKRFAETLSCPVQYPPPPPLSWINTMYVPTSSFNSQRVYHRVC

SEQ ID NO: 969000 - protein, 138 aa, Homo sapiens
MWVTRFSQVPRDATPAPMYNRALTRHCLGHTHSWPPKLLTRRSVKQAVNPECASHPSWEDREKPTIWKGCESPILTFERRTKRPRTSDPLASRHSFRRLLIRSSPGICSLRCVVPSGFRKGYAEREPLKPKHSVFPHP

SEQ ID NO: 969001 - protein, 184 aa, Homo sapiens
MCLNPPSLIFIRSSCCYYSKPLFFSFLRHPTPLCEIWPPSNWPQPCCPPPNYGASPPNNKNGPLFLKPPPNRESSLTRVFIYHQLDIAEHEHHVETLQENLFCRKNFQRITLGRSHTTICYKQESFYPPRASVTTVFSSPTSILHISRRQKIGHGQLIQYFFPVKNIHHDHFNPRSIADGPPKT

SEQ ID NO: 969002 - protein, 264 aa, Homo sapiens
VEDAEGGRPPVFDPLRPLVVKTGLTGVAIYVALLIFRYRIFWPRLSEALYVPKAMLRDPTDLLFHERSLKAVFAHTAVCLFVLPLPQDASSGHPGRAFIGAEQTTAVSIRLGSDRSTYPLVLAGYLQVAFFRQQPIALGSNTQFISAVWEQPIIRQESAPWRHKAMCVHSSPGRQTSAVETPRWGTLFSRDASSRRRTLPQEHTALENAVHKCIQTGHLPGGRHKHLGTPTCSPINMPQAIVTQRRFLADTRCGRLFIYELNRG

SEQ ID NO: 969003 - protein, 235 aa, Homo sapiens
KDCFPPPLLTMTIGLRPPLPLFSFRVYLSNSRHLRDYAPRTLSRVATTHKSSGHMTSARATHFPCDTTRHITDNTSHTPLCCSIINHPRTRGSICLWRPTSITTSFPSIFTSLIYTYDTPLFPHTALFIKNFFCSTLFIIYNSERVLSPQPTVGETLLCNRSYDTPLHGDSKKVPPQDDGVREVSPIAALCFENGERAAPRSGRPFPRVITAPSAPFESNSPTSSSTRHLKEFQP

SEQ ID NO: 969004 - protein, 76 aa, Homo sapiens
GIAYLLGYHVYPSAKRLGVPLSQGFVRAFQRRPFKHTGVVAAPIGFCPPCVWAKPAIYLSRAPPHDDICGERCCQL

SEQ ID NO: 969005 - protein, 125 aa, Homo sapiens
MADWAPPPTPRLGPADHFARAWKGNPPSLGKKLFARRNAPPLSRKNNSSGGPRNNSKCFKKNFRESFLQPKTLDSLSEQHVSPPPWEKKSEHKTVTHFNLPQQIGPPAPIEPSRNHAKFPMVCFT

SEQ ID NO: 969006 - protein, 178 aa, Homo sapiens
VSSSRVIHEQRRKQTVSVYITNIGPPGPFIPLHAPNAAFSGTHRTPSLNSVVVHNKWFPVSNARSNTPCNHEVSQPHRNRGSTTAALLYRVMRPPPAKYKSGKSPLWTISFARRPYFSNTMCFLICENMGPNCLDHYNSPPERQNCFPTPTGPSTSQQCERRASYEIPTFLKALMRYM

SEQ ID NO: 969007 - protein, 147 aa, Homo sapiens
WGETSRPEARRGRKRQGSRGRGSRKIWWDAILCVPPLRTLRNSFLGTRPRDVPRQDPGSFGRTLSDLGIPQRPARELLVGLTIRVQTRTFAFSAPFIVYQLPPVFSPTNMFQELLVVGTPLKEGSHPRNPWDRKGAKKICARPLITQ

SEQ ID NO: 969008 - protein, 333 aa, Homo sapiens
VCPVTQTQERTQRTEQLPCVRRLVCVLDHICVLTKCPVAGRRRRLLSPGSHHGTEVPHVGGSRRHSGGPRDVLTHYLVQNSRVASCQRSPSHAWPVWYTLFALVFSGHPPKGGSQHQRSRTSFGRVSQKPAPRVVLNPESRGYRGSAPPVSSGAFPGPPPCLLVTRLWDHTSFAEDMRFAGTGSLLSCHPRGRSATVILATSRPCSLVGNTSVFSVNPWGRLPDVASFQRANAVLCALSSMVGLPPPHTGGRFFHGAPCILAPLSARATTASPLTICEAPPCSGANAARRMPSEISTGLGGPIDGVRLLSEPRPPPFGVAFAGPPKTPPASTN

SEQ ID NO: 969009 - protein, 126 aa, Homo sapiens
FFLREVEIDDEAEEGGGGEREEVISLVLCGRLVNTSVWSSLLLCGKEGANPKSGASSQPKGGAHLIPAAQLVQNPLCVKQHSGSPPTACCVERVLVWPGNAPPSAWSGGPKPCFFPRFILMTTSCS

SEQ ID NO: 969010 - protein, 285 aa, Homo sapiens
FSAKEEKRGEERDQDNKIRESEIGVMLYMSRPQFCWPNEITCSVNPGLFTGPSTGCDVLDEDRLWPLYNNWGPPLINAFPMGTHFWETPEVSMNPSGASPVTTPLPSPRPPFFGPPRPEIPLAIIYQNSPSCKKTQCPVARFCNIMLPRATSVKNACPPPLLTDSSAFQNQKLGTGTSSQNVPISTVIRVSDGKRYYDKMTASSKKTPTTLGEHCIMDDPVESLRTLGSCFVHCTLLHTDANCEPNYPKPPNTVFQNRLTENHQKKVHTICIYAFFPPPPLENPL

SEQ ID NO: 969011 - protein, 235 aa, Homo sapiens
STRSVTSGAVSGTLMTQLGCGNTTGRVWTDMGHNKRGVSHQGVVTGVYGPLDYTGGDRSVRDVLLPYGGVPLPTRHGRPTRRGGQLVPRARVWLLGPSCPTIVSTTPAALFFLAGSGQPIFSGDQPPGAHPRQGQLRALPPPPRAKGAPPPERTAPHEVVPPRIRRRQIVHASRPEAVLCEPMQERWLVKSFRSLTAFFCGELRLKVQRPSGDTPQIGEPFHSGDHPPRTCSTSR

SEQ ID NO: 969012 - protein, 65 aa, Homo sapiens
MCPLYVGGISPPNGYKIGPDTTWGDIDQIQNDRIRMLPTPAYFLTARQNVFSQTKFFFKKILNHT

SEQ ID NO: 969013 - protein, 146 aa, Homo sapiens
MVRCFAILLSGPCCMQHTASAGAFSMQDIKSPAPSSLKNRVSHVAPNGGQHVSETPANQLIFSNYGKASSSSLFRINGCVVSFHCVGAQSLALPPLQVLVKLSPALPPPEGTFTQCSGPTNSCLSVECWPQESMHFLGCAIPFGLL

SEQ ID NO: 969014 - protein, 130 aa, Homo sapiens
SPCRVPQIPSAPPQIFCFPTKKRYSPHRLETLWVGPPHKTHAPVVVLPTYPTPRVYSFKRTPHEFFIFKPPTFFSQNICVEHTLSSSNKLFSRKNVGHTQTPLPLYNGSPMRQPLVHTPPGQITIIRWFF

SEQ ID NO: 969015 - protein, 226 aa, Homo sapiens
VFVPRRVRARPFVEVLAAVLLLVMPGGGPAESPPLFLGGTRTLRSTFLCRPRHLVCVFSARSRTNCAPWWALLNTPPAVASGLCSALHVGAILGPPPSLRSTTGPPPRLSVNRLCEGIPPPLSAPDLFWDPLPLGEHHTHPRFHNLKDWNMGEPRIILLREKKRGVYKHSLVTPHYLAAYFILQYWRDILLNASSSLPPHYLLRTHGGHLHNAFFKLPLRNPEFFY

SEQ ID NO: 969016 - protein, 138 aa, Homo sapiens
MREPAVGVENPRRHHTQINPAKTPGAHRNKDRKGAVKIGDVWLSRKAQLPKKAPQVGQEETKIPPEMHSIRGRGKQQRPLINNAYKAPPLDLGKPRRGQNMLRVGVSNSPQIPPARTKRVVNINIVDAPEIIPGVGPH

SEQ ID NO: 969017 - protein, 267 aa, Homo sapiens
MYAPAPKVCLLLSQTGVSDGSFVVCNNSTWSKRGSPPPCEANIYAASVQYIQRVSSVRPHKVSCPHLITVRLCASNTLFFQDSLLPTENNAATATGVYTLANKLLAPVPDHIMQTITEVLSSKKGGTFFWCLHPFYKEIGYSLGHGYHHTVVLYERGTMTNIRRGATKSTVPQHRGFLKYALFREMGGLQARGVLSPRIIRLSITRARVPQKTTILLFFVRTAVIIDLAVTPASNHWLAKPPNGCCPRPPHPHVGQLSSPKQKDPPP

SEQ ID NO: 969018 - protein, 152 aa, Homo sapiens
QVSGRGGGDTQAWWYKFATCLLTDIYAIVADISCIACHIWVFARPRIGAFMTSGFSIFCDPATYIRIHYRGCIKLLYAGPNLTPNLATSVGESGSERRVFRFIPRRGFVRGILKPKCGFPIVPPSLPLEKTISAAERPPFAYLNGRAGPKKT

SEQ ID NO: 969019 - protein, 102 aa, Homo sapiens
MCERPRCCFLPDEDVYRRAPLLSTLTAPPPFTPLGPFPLPKLVLVGKHKGVLFIWIVTCAHTRGVPNHASDAAVATSAEFTTSRLLYTFRQYKYNALLQKFG

SEQ ID NO: 969020 - protein, 281 aa, Homo sapiens
VPANVSTRAVSADAWWAPDTGTGSRIDGGNTQRVGLSPQMAPGPKASPRMETQPSVEGGEHTGACGAPAERMGRHQVRRDADGRAPRSVMRRLRPGEAVYSPGCLRERGGVPPDVLWREIGAPTTVGESTGGVLPVVPTMLFPGSTSRMFAPTRLRNPRGVPLPGLKSNFPFEICQGRGISPLLRSCRARKCPPHKEKPIPGRPWCHNAVPLGITEWNETPGLIRSCWRPTRGRNVPSAYAPPPPGGRPRSVITGRGRKLAWWQKTQNPPVVVNRKSLRTH

SEQ ID NO: 969021 - protein, 193 aa, Homo sapiens
MEEKTPACHDSCQRGTRTKQGAPGVGEQFRGKLSRPRPQTSVLPGLLGRIQRTQVGDICARPPKSEQEEAPPRNKGGPASSLPSASLQGCPFLYNALRCQNPCGGFNTRYVEEKTLSETNTVMREDLDHHAVVCCPPHQHGAYTPILDRIVIATIRVLLPSKTLVSPGRIFRNEKAVLTLRKKIRKNQNKHRQ

SEQ ID NO: 969022 - protein, 259 aa, Homo sapiens
MSMAIKVPRISAWHNRWLPPTQCQCRTKSGGTLYQISGDRCASGPLCKLSGSTSQCVWRAPRRKSDGEPPRSPFRAKAEETVGHQRSGGKTSDFSAPGVDDDQTSSCVVKQGNTSFCGKHQHHIGAPRRKVWAAQSPQVNENPVGVVIPENVPPPKIFPPCEHRRGALVPAPRRNRRPPTIQELVADKEASGNVFRGNCTAVLYGGQMIIRTRRIVSPWSGIGVPAVRTVVGKYRGVTCLTGRLPPQNEKPPFDTPNNN

SEQ ID NO: 969023 - protein, 257 aa, Homo sapiens
FAEDTKGLSLRECEGTNRAKMVRKTKGHIAKQQVAEDTDGDKIRPQLGEHPRGAVDAPRRGATPACPLFHGKPHKGGARGRAQFWERDLYTRRAGPANTRYDQRDVNTAGEETIVLRKATLASKARLLKSPLVPGLLLSSRTHTGSHRPCHEESAEVNTEGHKRTLLRESTPDLTEVVSSTVRRAHRRGTTPGAILLESMGARARPQMVLSRGQQGATTWHRALERTEPPTGPSVHSLYVAVLDEKKKKQHGHNNAR

SEQ ID NO: 969024 - protein, 103 aa, Homo sapiens
MLAAPCVSVASYLTGEPFGEKTSFGEAILSNNRSVPPFEKSPFRVQDILRWAKKPRPGSYPRCSSPSSLALPSIGSKIEGRVVKIFHQVEYRKDSSCDAIHLR

SEQ ID NO: 969025 - protein, 136 aa, Homo sapiens
SLCGVDVDMKYSYAAASGFFIIFSQMGSWRNGDIKILRPSDCLNRGSCHPEFRGFLTFWETHVVPNPRVVSRNLSGPPPLLLVVFDDAPECAPAKSGLCLPKLFPGPSVGESCAAPFEAQSRLSDASFRRSLGPVS

SEQ ID NO: 969026 - protein, 187 aa, Homo sapiens
MVLRERNLERGLQRGVLGAAKGRRNSPPYIGPCCVSPQVPRTSEGPGGTISGPKKGPPKLSPGNILCVVCRETQEATSLLSLIAAHHFSGGTLPLKNEDISFLQQASLLLRLLLLEKPPHTCRRRPQLLNHREYSKTKRASTTSARTLYGVIHHKSMRQENDRIEDQYMIQPPPPGQAPQWSPAAGK

SEQ ID NO: 969027 - protein, 118 aa, Homo sapiens
GGARKCAALCRKRCRHTLWVRREIRWATSSGGGQTQTWRAPTPPRGGMRSAVGRQTYQRGSAHTGITHNRSAGAAHTGWGKTPCCLAEKKDKRAPPGDTGGAVSRRPSGNWRSPPNIV

SEQ ID NO: 969028 - protein, 151 aa, Homo sapiens
MGAALCRPTTDFSGKNAPCALAPPHPRVHFNVNRHAHQRNFGGGPPTRTRALCVEGGKPGVLQTAPPRVCVPMPPPGDLFLFYHARQGECTTPVSLLSQGAADFSLRYPGYIAGRLRRPRLYQTCTAPPDAYFYEEVFRFKKKNPVPPPQD

SEQ ID NO: 969029 - protein, 142 aa, Homo sapiens
LCCDIVLFWAGVVLTSPFVMVSARLWSMFNYWVVANPVASRILWSPPAGVGRFPGPGAPGFFPTSCCMPWRWVLLLSLVTGGGPSFHVLRTPPLGVMVAPASPGYMPWFMAVASGRVCVSWGQYPLRGRLIFGCGLPVGVYI

SEQ ID NO: 969030 - protein, 125 aa, Homo sapiens
MWISCRKQAKKFLTLWIPTGYIRSEIAHTLEGFFLRNMHYFKLSPGEMNIVNDSAARTCRITAGACWDRMLQFMAVVVSALKTRGACRGRKVSGNTDNKSNRMLLTQQRRFFGGQKTKTFSTNMT

SEQ ID NO: 969031 - protein, 234 aa, Homo sapiens
LPSIASRVLAPIISLGEPVFFMRDVVSPVKAFRWDLLSLSTRNVLFLVVVWSCSAPPDQRKHPSPRRASYIDGARHIYHVCGETQRHMKVLYASRIIEAHTACPVCIYDIAGTWVHSLSSRSCVCISQNTCSCLSVRYSGHTMWAHTTVNVNLVVIKESYPSHAHIASLTRGHAHRASLLVGFSLWGRPRRTALTLVRYIPGGTLLHSPETELLFEYNQAPWELVDHKRANIVA

SEQ ID NO: 969032 - protein, 112 aa, Homo sapiens
MGAPAREYCFPERPHYVDEGGPVSLPLMCLFPRRGFGLQCRAFWGRAVSARPRACLPCWDVSSRFYEYRHCWLHLMGEFSLHISAALSLDSSHILWGAHFGNTAGRLQSPTL

SEQ ID NO: 969033 - protein, 303 aa, Homo sapiens
QSYGHAGVRDVRWGRMQMGRPTAVRGKTRSKGGVGHPSPFGRQTASVAAKFISCPTVLGRGNYDTRIKDGGQHQSTGGPWAQTNSHGSNNGRRPAQDMWASKAVYSDLSKGALSPMDKGAPCRRPPAIKPLPARTTPWAEPLEQSLSPQGILRQGNTGRRAATGAGELPALVAPTDREYSHRKPRINFPTHESGGRWAGSCNRPDTPGGQPQGGNHNAVGKWFAQDTTQAPEVRRTAESLHKRALFQTAGGDNPPVAHAVDETARGSGLAGTRNRRLTKQANSRGPPPETVQAMGQKTEAPQN

SEQ ID NO: 969034 - protein, 260 aa, Homo sapiens
MPKGSRRLRALREQFVALSPISVVSNPQCSRVPPLWVARSVYSRIAGWAGTPVLVYAAFINCLVVSGQKTHQLCITAGAPPPMIGGEPLRPLPSFSPNRRRCAMDQLCHPQSRPSGANSTGGAPNLQMPRSSPGRPLATAGLNEVEGSPSPRARDTWPTTSDTWDSRGSPTTSSPPDERPDKSVAITRLLLLPEDDFTTTTAYTTSGRHTRNCVAHPGRLPMATTERSRSTRVSHHPERRGDNKGAYTKNSHRGGPTRRI

SEQ ID NO: 969035 - protein, 275 aa, Homo sapiens
GLPLRPLCLRPGLCFLARNHTRLCWLASHHRTAGHLFMSSYTSSWLIYGRSFHRRESDLSLLPGVELSRVCPAVASTCAGYTPRSTLAGFAGVVYPPLQHAPTTHRVEPGARHQPSLCAGTHCVVWGDAAIFSPPCERTRFATVLPGNSPPSHSFCFRETCCVIYYIAPLARARFVLRGQRDRSSHRSYWVLSHHTQEGFSHREVLHLSLRRERPQGGTLVESARHTMRGDLHRTPGRFASEPTTQGSQGSEPPGVTPAQSPRLPLRSPAHPPKT

SEQ ID NO: 969036 - protein, 168 aa, Homo sapiens
MLAPPLDKGSPRCPPSMREVSSCGNRNTLLVSRTKFSPQHGVYPREDMARSPLVGVLNTDPMAPEGPRTILSRTPAVYSLGGSYMINRRGVFPLSPVARYSPGVLPGTHHKSWLAVPASAIVHGLVPVGREDSEEHCISARCYNRRRGIIIFMWPMVCVIYSSRARGS

SEQ ID NO: 969037 - protein, 133 aa, Homo sapiens
MGGRGGPRVGSGGRAGPVVGGGEERRRGEVCGKDRERTGWRYQAEEECWSRLGGRGRRGGGRVGVRCQGGVSSCRGGGAVACRWLGGRARERSCSPRWQHCGSCFLPTRCCVQMCGVVDEEYARPDNYHLVGR

SEQ ID NO: 969038 - protein, 216 aa, Homo sapiens
MSAPLVGGVPPMGRRHDFRPWHKFYRGRGPQLVGRPIDMRFRNGGAELPLLARTPPALVFCHTREVMLVTHTRGCHQRSAPTLIDIRPADLNTGSGPLLFWARARHGAAVPTAQSMGTRRQPCGGHHTSQRGRDPTPPCEAHPRERAMQHTRFLDGCSTDAAKRDKRREEFAGYTTPEEGHSIACPLVCSTKGRRTGRPTAGGDTSRLRPDAAKKL

SEQ ID NO: 969039 - protein, 300 aa, Homo sapiens
CAELPGVARPPVSGLVVPMGRLYFLGVVILPPMWYSAGPDFIPVPVTRDRFRPTGWFVQECLPARYCNSSRSVFQIPRVHVHRSRCAPHATWCLTCAYLGGSTRGNTLRYRPHSCWSHATALRRSERRLHFTGSPLSWATVDLGFPRYCPEHFVPPRTIFGDYSSINCRPPTLGNYRVEPPTPCGCEVSFSASNTPSAISHAHPPGDRTHLHVVSPHAVLAEVCPIIGASPTTRPRATASEYYMFQSEDSRCHFPDVAFSYPRACAYYNSSIAHSATGGSLIAHKSRLYANPLTTHKPTR

SEQ ID NO: 969040 - protein, 236 aa, Homo sapiens
ASSPPSMVAILANIVPLGPFFKGVSPLGAPLRVFVSYQSKKLCGQFITLDRMNGKDVESPRLLMVHATWGCADSPRICRAANDRLGRNRLEQLRGLSPRGEVSHTHIGVVPTTHHNRRVKHRRAWSWYAPHGVPRYKQTHAVGPTRTVMGPHTHTEVGGTPFWVTYKGGPPRDILPHMSAPLLYDTVVTPSATPHRIHRAYSSPGSTKPWSHQDIRREMLAKKNTHWGACIPSKHY

SEQ ID NO: 969041 - protein, 107 aa, Homo sapiens
MSTGAYRMSSCAAPWVFPETCGWPPAFVGRYLGTRDSAGSSTLPHRDHLGAHCLLADTDVASLCVRYYPPPITMRRLLTTTRSFPRVMQREFSHSGVHSGAPPVGGV

SEQ ID NO: 969042 - protein, 156 aa, Homo sapiens
MSSYTRGAPSGPFCHWDPGQGAPPGPWGRGVPRHPTPTATAWGKQRPPPGASQRRDPTPRVDTGRKGVKRGPPTPRPMESEQRLAEPREPCTRHMSPPFHGRPGPLRPASNLEAAGRQLRRALHAPGRMRHNRRGRGRDPGVGLGSTPTTRPPRPR

SEQ ID NO: 969043 - protein, 311 aa, Homo sapiens
MLWLSCKCVACCRYGGIHNHHIPGVITPTYVGVLNATTAVFPHSTLLGGAPPKEVGARYYVVKRKLLRGPMRPDVVCLPDTPFWGPAAQCPPHIGGEHQRHADINELGEKWWTTPAIFAQVLKEEHGAANFLLAGKKEMWQAVYNSGMTVWRDTHRGRVFVRSLPTALVFYIKRVGPPRNTFCAQNGWSPRGDMRRTIGVRAAADDSIIKKGPPPPAAHTHGGEPPVCTRKETPHKQFVPATSGGGHTTPVEPAQLLPARVRRKNRKCIAPVKRHRARRGTQSQTLPLDLPPRAGLPEEPRFQQTTYQTNI

SEQ ID NO: 969044 - protein, 149 aa, Homo sapiens
MSPRSPKKGEPSSCHTRPRPSTLLVWDADRIGMEHMCVGTPRRVINTGGTRKSSPAPTSSTMSWAIQCDHAPGTLWGKHPHGGRTPLVGNNPQDARRTPQMRPQRGRNTPVEAFSEKTEGSYRTEKWCMSRNKTPHHWQPKHRKFAQKN

SEQ ID NO: 969045 - protein, 141 aa, Homo sapiens
MVHAPAEYSAPFVEDVNTFVFDTIGGMRFDMNTHGAFILLLLTGVWMNPIMGAINKGVGFSTHVVLEVVKEREMKLFQMDEVLYSARSCTDQRVRILPNMSTGGVHHFVEHIDEDSHGPPHSLTIPHFVPCGTQNKPSKPD

SEQ ID NO: 969046 - protein, 207 aa, Homo sapiens
MYTLWPALRLTALLFLALSIFPGAPVDIGHLPSPGAPLRKWVPGVTLIGSPWAFPPRPQVSQRVWLQGRTPLYWRSRNHPRGSPYRACTRTLVGPSHDCEQTPCGGKKPELAPYEDREGQHSPQTISRAPQPTGQRLGRNQGTLVPPLSVDAVTSANTKFKGRPPGRNTRKAHCLPCSPRMTHFSLPGDPRPNFSRGIKNKKKPPHN

SEQ ID NO: 969047 - protein, 272 aa, Homo sapiens
FRFAACASNVGETAGGGPKNVPGVWPLSEGAFLDRGFVPTTAGDPLLCGPVGWGENPGPRSWGPSSCSDDRARIRHPPLRVRSPAGFLCAHRRVVVFSPRYGIPSLVFFGGHKTGAPHDVFCGGFHSEEHQTSIHPGKVGETIYSPAGRRLVVHRPVARVLTSVCRTTTDPALTFTKFGAYYEQGEEIHVQGTPEPRSVSSANPTRRVEPPTRRPRQGPGAAVQAQQSVLRVSTGDHNGAATWAQGAQGASPYEQFRADRLPKDKKKLPHIT

SEQ ID NO: 969048 - protein, 108 aa, Homo sapiens
MAQRSGCRVEFGEDTPGTTGGWCPGDGGTPQWGYNPGEAAGGRSGCVSDRNSKVARPFLADTFSVVVTLCPPGEDQPVGCVYALMAGCSLRIIVYSMGRQTPPLVPSS

SEQ ID NO: 969049 - protein, 181 aa, Homo sapiens
MYIRPRVLFNLEACPISAPPRCLLRPRRCIKVHVRCLSTTPGLSVALCLRAFDTILRHARGVYLSGQLNYVAPVATPAMSKPITGEMLLPIKWAGELLVGQTAPLFKRKYDGFLLYGGKVYHHGGIWFRMLMCAGEPRYKHKCVRVCNIECTRLPPTKHAGAFIKVTLHLVCPQRGACMLS

SEQ ID NO: 969050 - protein, 222 aa, Homo sapiens
RVCERGKPSSVLPPHHAGVASPKGDPAVNAPKAACVLDRPKLLLSPCAGRPPTVGGTATTRWGNGPQMGVVADEFARMSPLGAPDRSVVGQDTEKHQRGQDSRAHRRRASPHSLVSFDKQHDTTAARVEGVVGWKHTPHRLEPAQVRCKLTGNLAVRKKPPPRCPPKWRDTGSPSQPFLICPDRISPATRFLGGTHALAVTPRKRRTRPPLIQYPGQPWVHM

SEQ ID NO: 969051 - protein, 225 aa, Homo sapiens
MGPNGNGPGDNATGSPNGHNAKQFGQPKGEKLLPQGAPEFGNGINSPTLVARNSPKSAYATEAHNREPQNATSRGRENNLWRPRPCARGCMQQVQATPWAKYRENLFGKLQGHLRCNGYTAASTGRAIKGPPGGGPERRHRVKKLVYTAGATKALRKRGLTPGSFETGHRPHTDRDKLGRLPFALQRSTCVYKGKMFPRGSTYGRRFCLKTPSVARRMTKETNHD

SEQ ID NO: 969052 - protein, 122 aa, Homo sapiens
NSVPMFVCDAVLSLFVVIGLASWTYGFLLARFERPRSLGSNIELAREILLTSAAGLCLCVTEPDGCVSSTSCGEDTLMCARVVLLANAPSGGPSYCILKILLSLVSTLLWTDYSIAFTGIIC

SEQ ID NO: 969053 - protein, 240 aa, Homo sapiens
MGIFLVTKKVVLPRVPLSLPVQRAAPSRFCWPRSPRRVSRLHTSYEESFFRRAPTMCVSYAVIVLQMGPNIRQALLVVLADILAGTSGFLAPVIVVVVRALFVPPPRTPFICPRVCPRLLPPPVCLLLPQGFLGFTVHACLCARVGAPPYQFWAQEAVLALATRVSALGAPHGVKLAPLPPPLFGNITKGLAYPDVPPLQCAPQPLAHYPFKHGFLPSSWILGLGFFLSETPEKKMFQRK

SEQ ID NO: 969054 - protein, 108 aa, Homo sapiens
MYFDSFSSACSRERRVDTLDSIPHISVCSEVSDSLTRRYLYSQLLQTRSRTRSCLLYVQHDVSWRFVSLPREYGTHESRLRRLVKARPPPFMVSPRILYPAGPSLIQK

SEQ ID NO: 969055 - protein, 118 aa, Homo sapiens
MSGIIHEVEDTPVRPPQNDGDISWERHVHFSPCARHLMFLFSHRYPRSLISIPTNRVRYYIPVRSTLFFLALPQTFVKSCSSCSPNDSGPTKPKKYKFSFSSTTPPLLTRTSSTHNIT

SEQ ID NO: 969056 - protein, 118 aa, Homo sapiens
MFLRCRVPHPKLYAYTVTLAPPSSRPLPSRRQLNLLTPSDSFLGAKTMFVSQLTSSLPIFFLLAPRRSPSCIQYPLLCDFELYTYEQRMNISTRLHTYVGGHLREARAGPARSRPSRG

SEQ ID NO: 969057 - protein, 164 aa, Homo sapiens
MNVPRGIVVAPLLWGGLMNPFLIQWARPLGTNHRSGLLGRSWSFLYAHMDGVASWSALPALFSSLARPPPVVPRLPDDFVPHRGSLALLENLVDPPAAMFSHLPASLRSPRLGRRTSALPLTALVCILHPELGALLLFMDSLPPVTPCWRHFDAPTLRCPLPPL

SEQ ID NO: 969058 - protein, 103 aa, Homo sapiens
EVRLVPPGGGGLPYVGGPRTAPLRVCGPTRRHNSGFSLLILYSLAPRGLIHASRPGYRSSARTRLSRHRLAIMARVGARNCARSAHALYILCALSLPKEAHLS

SEQ ID NO: 969059 - protein, 275 aa, Homo sapiens
MATTMVAPLAPCVAVNQPPGYRYPRECQPFIWSGTTSGTSEIVGRPKSAICKPRQGNLHDNIGSRLYSAAAEDWQYTWETHNYKDCPPLGPPFFGETISTKYGIGEPKTLGYLELASFSIQSVFKPSGALFCWNVNNSFGYHPTLFWTTTRYFPSHKMARVLQRDVVAGEDITRLTNSLVLGYHSLQGAPPYWWHQQTLNTERLLCCNEFIIFTRGSARVIHLVFSLWPTTRGRDAPGRSCRPTLPSFRYWLIVPFAPTGSVVTEGVDIMLLGER

SEQ ID NO: 969060 - protein, 149 aa, Homo sapiens
EGRTGAPTAVDGASRSATAVRVCSALVVSPTVVVSPRRSLQERAFLLRPHCLKAGFGARSPNKGWPPLLETMCLVGRHPPPLWVDCVHPPPGNLPPGGLFEPGFPPKEKGPALSPLAPQFGTQWAAHARGGPHQSILRLVWDATQPPQR

SEQ ID NO: 969061 - protein, 181 aa, Homo sapiens
MSFHHSPLSPQYWWGRSHSPSGSTLLLWLGDHSSDLVNDFSGRPHASAVTFHGYNPPTHLECAIENYHWGVLPPSLRGLPPIRGYPHHSCSYKNAFAGSFFSELLPHEYFFIAPPPWFLPHIIFQISVSHSSVYHACPISNGRRIKAPFSPLPPPSLRRAINMKQTTHLKGGIFFSQKTPT

SEQ ID NO: 969062 - protein, 282 aa, Homo sapiens
GPLGVEPVSSGTHLVVEQNFVVLVLCPCVEPTSSVWARPPYFSAAARFCIYGALWVPPGVYLVVIVFLFLSYGISLFKESLVVMLAPFCVITPGDGSPAARRWCALGVVRLIVPLSHPRCRPTLCVGNLTTVMSPVPPSVCRGVSCSFSSRCGPHTVSLSLFRRGGGPRICAARGGAQFASCLTPLWPVHSLVISLSSARGDPPERWFSRSNVLLSGKEAPLARTHWGAKRLFSFLGGTNSLHSGNILVVATARLLSGSAPPLPLHGTMWGSFKEKLAPVLS

SEQ ID NO: 969063 - protein, 107 aa, Homo sapiens
MIVSLALDADGGVFARALWSRVFARFECSSSLGRHLPASAPSFSCVKEWSVVDVANDLLCFSSLGVVSVSFCLCCSTSESRDNRKRVCSNHFNDCTASFFLLKAGGH

SEQ ID NO: 969064 - protein, 279 aa, Homo sapiens
GFPPVMGPRSRYLRCNNLPLGLSASSHGCSPPPPDVMARRHRWWRIEPIEGSSLIPPTECTIFLARTSFSPLGCTDLVYVATRAPAVLNCGPLLLSPGNCAFPSYVTHLLWVGRDSTSPTNRRFDSLRFGRACPEKVGVGVAHSTWLFAPGRTHVCVMKNTTRLVVHIDSAAPRGGLLIALVCGGVCAQYARCISPHATPPFVTCSRHLFAMARASPCMASVSSAYAPQGLRPPALRTSVSHLESLHIGGEPPSAPALGARGFHDAQGGKNPWIFPPHN

SEQ ID NO: 969065 - protein, 96 aa, Homo sapiens
KAVVILFPNATASPPTSGSRPRGGSSAPPPYLLVEEEEEQHHNTTVVVDAPPPHHELHKKDRVSFPTREESVVMTLRRDNTTVGRLLCCELSFSCL

SEQ ID NO: 969066 - protein, 246 aa, Homo sapiens
TASLGARGTLLSKLADSCVVEHQRGLTWALIGTGFTKPQSRTVPNGNHRWPPQVCRAPRTFRAGPPFPGVGSLIFRGTESRDIRGSQWAQRAPGNPCAYEGRISPRPIAGLIPTTQWTNYSANLNSTQDGLQSTKGDPCPPYPVPGGRADATLPPRVRLSTQKRRATPPLCDPQAPPLSNATGGTTPESPAPLLVEATGVTPPPPASQSSKPLFIMTAYFLSSGVEPTGVCATPNGEISDHQDSPP

SEQ ID NO: 969067 - protein, 51 aa, Homo sapiens
MVEVRSCGIFTKLLRKEFLGDPQSSTARLQPSGKFFFTAPRENPFPKPNQN

SEQ ID NO: 969068 - protein, 131 aa, Homo sapiens
MLRGTLPRSFTISFLCAIRYCRFPYNFRGIPLDSPQQVLDTFLIYPLLHIWFLKISPHEAIIILSAFPSAKFFIMTAHSFNDPKRLLRHPFDAPLLVARCLYMRDHQPLSLSGDNYISITPPEDLPLLSAS

SEQ ID NO: 969069 - protein, 117 aa, Homo sapiens
ESLRENCCVVPPHELVGWLCFWVLAPSRVGHLFSNVSVSVLQEMIVPSASLSPRSGGACVVSAGTPLETTSVPVVSDFPCVSSSVSLPPVRSVTLLTPSGLPSDKFPGVPLTAWSER

SEQ ID NO: 969070 - protein, 217 aa, Homo sapiens
RNSFRVPTVCPLLLEPRSVNTPDVTLGKRHVFGPRADLFAHVDERKVPPSVKHRVQILGNAAPTPVRREQMCGPPLSSGGPALILYCARVRCYSRSARDSTLRPGGHDITVGLNSEVQQNRGISLPPAAPWGSSPNSVADFGGTTTPARTFSGKIRGSPPVFATTGQITMTVVRLQCCAPGLAQPGGSVSLRTSLARFGFSCPTSHLITTPIKFVGF

SEQ ID NO: 969071 - protein, 205 aa, Homo sapiens
LGLCLPPCLGATSGPTTGAAPGCAYSAMSRPEVAIAPLLRCPLGRALLGPNQVRGGRRSMRALALLVRGIAGGGCIPRWALTRVLSTSCTGVLNLRATCSLVQLDHISVPRLLARIPQGGSLFPRSFMADAVVYYVCPGVLHSPPLVVARHTAPLSPFVDPPGGPKTFPLNAPGRSCATFPRGARTVRGGRTSGRPAPGGERPGL

SEQ ID NO: 969072 - protein, 331 aa, Homo sapiens
PGHTVSFVCSVDWRVLPLCSKRLRLVPQPGHCCEVYLCIARWPAPCGLRESTWRWKDLPAPLVACRLLLKGPRAFCKHYNPGVVSLAQEQRVRRFQQKVTRTRFGKNVSRKVHAWGRHKCLCMLSQRCSKILFPSRYLTGIVTSVASPLLYHYDDKIGRPSPLFNIGFYMTVCGARSHSEDCLSHTERGLVTFVRPHTLGGLLLALSEEITEQSCLPSDASFEDPGIVYEQFKILCGRFWLTSFVLHGVIPPDFKWDTPLSVQTINADADPSSFHAHALASITDFNVEAPPHDLRADRPERGARRHVEVQVEVDVFSTPHNNRYKQYFTRS

SEQ ID NO: 969073 - protein, 214 aa, Homo sapiens
MGRLTTLGAACWPTRARVCQAAAWALSLGLLLGTNPVEQLWRDVTNTGGSRGGMIEVSPPPDPGVLSVKAALFRGISFSAAKVDYNLSHGKIRVGLYTLFVHKTSVRNIQYAFEENDSLPPPQGSPPTTKLPFSEASLLGPDRTIVSYSLFTHTPVVLLGFSAFSPPTPGGFTPAPDSLRSKNPRLGLSDGRDPAEDGGSTLYSSTQVRRLIPV

SEQ ID NO: 969074 - protein, 32 aa, Homo sapiens
MWGSLSFLNSYPRYQHVLPHPKGFPPQTTGHK

SEQ ID NO: 969075 - protein, 113 aa, Homo sapiens
MSRVITLFENTEGAPPVRMLPRSFGIVLGTTFSLWFVGPRPPEVPEVCPLRGTPLCRKAPYVPNPSECISLPSGAPRSLQGGLPFLLAPRIEFMETARAAAKYFSEEIPPAPR

SEQ ID NO: 969076 - protein, 105 aa, Homo sapiens
NSHACNTCGGTLLIVSDVYPGSPFALVPRAWVPARTYVLSQVTLVPCEFRAHKESRRGTKGPARSRPRGPAALNSPTVLWCPTCVCSPPPGPHLFSWAVAPPVVC

SEQ ID NO: 969077 - protein, 134 aa, Homo sapiens
TGKGVERMHILGATPMVHRVVVRSVAQAEHAYIGETTRLVGATGLLMCFFARSTKAGGRSFIGEYFFFACTNCFALGERRRLCVCMKRAVPERCSSSVWHQSYGYSAPPTALFERCFFETNRLACYGTICPTSV

SEQ ID NO: 969078 - protein, 55 aa, Homo sapiens
MTHTIDRFYLFFGYSCNSILSSTAANPCGQPFNTEQDNNFFPIPHPPPAFPPSLD

SEQ ID NO: 969079 - protein, 154 aa, Homo sapiens
FNTCPPIIAGAKMLLGEPVVEPTLIAPNYWVDLLNASSNSPLRRKNVLQRRCYLMSDTDGARNNPVGVKERPSHPPQRDGGFFREALKTPKKGLCRKIQLQGGIVLPPVRRKLLAVENNNRSTSQYLTPRDTKRVVTKTISCRTRTRTFLFIFF

SEQ ID NO: 969080 - protein, 180 aa, Homo sapiens
MSFPVPCRRPRNSNFLTEPFFQGLFFKQPGGKVYSAKSFAVPLGKEHWFNPPKGAYIPVTPRGVGVNKQESCFETAFPVVPPSSETPHLWANPSAKPPKSGGPTKQISSTLSRSNMRKFETAAALGLSLMKSPPSCVTPRQTGMVFQHLVVNSPRGLQYVTNWSIRQGGRSCTAPASNTL

SEQ ID NO: 969081 - protein, 133 aa, Homo sapiens
WAPITIVVGAPLWFSLPDIGLPAVCERCFKVLPVAALVKRRPNSQVLRLPWRCIVRRVLAAPGSFVALTPPLGPRDWVCETWALGFPADFFVWYTTQGLFHSHCLGKKQLLGITTTGLEKNSSYTVDPRSSSL

SEQ ID NO: 969082 - protein, 215 aa, Homo sapiens
PARTLLCVWSWNLFASPTLLPPRSVLSFCDPLCVDHPLVCCRRGAVFYRSGVVGDDRDQKMFVLWDESPPFGRRLVTSDPSPSPLVFVGRDGWASRPPARTRPLSSTKRCVIGAPHRILLSLGLIKEMRFSLPPPADPPPACMRRGLLLKFFSSSISGRIASTAFVENDYVARDITKLLVYVRTLTRHSPAGQGLAPLVTLPVALVRASMGCLRA

SEQ ID NO: 969083 - protein, 198 aa, Homo sapiens
VSNVSQLYVICALLVAAHLLRSGPCHVSSGVAPSVRSQCDTLVAAERVRLCEAGHGFCLGPRTHDVLSFLVMCRWDNFPPWGRHNLGLSVGAFHPATQLFKSNTPLAGKITRRHFLLGSKQMCAIGKGGYSTATCGLIAVAAQFVVATKPSGVFNSVYSRCDGQSHYEEDIPTRCVSINFQALINKRVWNTIALRLQT

SEQ ID NO: 969084 - protein, 291 aa, Homo sapiens
ARVVDAKPRGQARPVNHDRGSGPTRVVGRVEARTAPDKINDGHASQTLTGKQATPPTADETDPTFRQTLDNPRRHTCSGAHPWPNMSRGSPHERDFAHPCPREHRRWPQKHIRRHQGPSKASYFVPGRNVASRYRALAPRHRPVGPATHTLAGYPPVGEPPSARHSSACYSTAARRPEALTDHTISTRRGRTVRHVGPTAREGYTTVLKSFYRKHIGTSERTQVRQTPTVSLGSLEVVEHHSTKVLCPLDLAPHRLKEVERDAGSTSDGGRPPVQMIPGVRVPTKSPRPHI

SEQ ID NO: 969085 - protein, 312 aa, Homo sapiens
APGVTQKGAPKEPWSPARALKGPPAGSQEAAGEIRSSCKTTGPPNLGMWRQDSPWVTSPARSGSTIHGAPPHWQPSVGVWGRARHRWTRQANEAQQGVQYTHTCQRLRLLSGLAPQGPTKPNSADSTRGRKTGQSTQRPVTGAGKRFPQRDEFPGAKSLNHHSVLVRPPPGVATPAPHQKSRATTSLDPTHTVPRPQEPPWEQPPPEEVTPVLRARISSMVRILLLSFGEEWFTSRMEEGRPMCTTNPYQEGNASRHNDRSLLARPSVHVGEGILPRLVGGRRPPESTVLLTRLPPIPPLRQKNVFFSPKQN

SEQ ID NO: 969086 - protein, 42 aa, Homo sapiens
MRPPPEEMFVRGPPRPLGGALARVFKPYPRGFAPKKGGGPKK

SEQ ID NO: 969087 - protein, 107 aa, Homo sapiens
VPSRKKVGLPRLFPGPVKRVDSLPPHPMVPRAHRLETRARVFTPCDKLGRAQIMCWDVLGTLLFDGGAPTLRRAIVGTRKALEKMGCRTIRCAAEGGFSSKKDPCVL

SEQ ID NO: 969088 - protein, 250 aa, Homo sapiens
YCGESLTGGVAALMKFVEEFISYKFSIGRQCVGPLTRWFPTRVYAPPRVCVPSCWFRRSQPFGGRTFSEACEPASLVGNRAGPSVNSSLEAYFYTPPVAAQQGLLASSEMGEEPDGRCVERRLCVATAPTGFRGALICLIVAPGFKPPSIGFVARSPNAYGWCPGPVARLDILLVHNEVRSYVPPQIIRFCGKLFHKGLDLVPVPPLCFINLVGDSFVVGDTGVVSVGPQQFVPPHYHGALTPPMSRRPA

SEQ ID NO: 969089 - protein, 52 aa, Homo sapiens
MRTFCSLLTITVRTKSLGTYTKRKRVSGKTLVEHQKIGPLGKKNPPSFFKHN

SEQ ID NO: 969090 - protein, 157 aa, Homo sapiens
MRDVLLLTGRVSVPSWTGTTQRGPPGGGTLYGCTRVSLRDLFSQVPTHRSRPVFLGHTRPLENPSVPWATEVCFSRWEPPLCEKIYVRLTRRVLFDSLGCPPHNGCVSHGAIFPGAVYTTPTFFPPHPDAGGYYRAQIFENFWKTNSPPFLYRRRCA

SEQ ID NO: 969091 - protein, 146 aa, Homo sapiens
LLVYERIVSGPGGPRWRVRSVIGEPPVVCTAPVHTPGPVCAASLYFERPFISQSVWFKARAHFLRGHNHGKEARDIIAESTALWSAFRFQMWGIPPRLYFPQYGGKELFLPAVVEAGPPTRAPKNGRSYYEQDVEGPRRIVPEKSS

SEQ ID NO: 969092 - protein, 282 aa, Homo sapiens
MTYVVRGLVWFRPLLVDYVCVVWCLLLLWWGAAIVVYVVYDCVASITCPYPLGDRSPLGLPRPGCFAPLWRFFPHRMSRPRILLVGSRRLNFRFAHPFTSFPPGPEIIAAGFAHFSAGSFLGGTNQALNEYRGVLWVSPPGGKPLGAPCLRKGFEAPGRLCADAGLPHARLPRVYTPCPGEEHLECSPPPSQERMARLRGAHSSWPRKHTTTRWAPHPRATKQPGQPNAWESHLRGQATLLPRDKMFARPDIPLMLSVSRTSLPPGGGKGGPWLPRVPPPGS

SEQ ID NO: 969093 - protein, 55 aa, Homo sapiens
MSAAILLLGEKRGSGLYECRTPHGWVKQVCKTHISFFGLQFLNVVFILQYKKSAA

SEQ ID NO: 969094 - protein, 299 aa, Homo sapiens
SPGRRGEEERRQGDVENTGRGRGRDGGWTPPVGSAAPLWWRPRGGQTTEEGVRTNGAVGAQAKGGCVERRSARGGMRGAPQGGGEEHTAAEWSPRASRLAWRGARRRRREDETLGGGSPRGGRGVASARGGRAERGEERPRWGARREEGREGMRSAVRRATAGRCLGGRQRAASDGVRESSTRRGRQALGEKERQRGGRRAQAWQGAAAEECLCMVVRVLLSLRRARGCRSSLGHRVRRGTRCGHCIAGLRRTLGPCPGGDGGRSHRRGCRAFHEAPSWCAPGPPPTAGRAGASPLPQI

SEQ ID NO: 969095 - protein, 120 aa, Homo sapiens
GNKSQGGHYSRGRPREGAGRPKIQGYKTQAGLLSRMGLQGPPAQREEKPRPIREQKAVSPPPLGLVTPRPSYTSGSVRAVQPPRSGCRTLPPLLAPQLHDLPLPLETQRPTKPFFRTQQL

SEQ ID NO: 969096 - protein, 217 aa, Homo sapiens
YMKKVEKSERSETQCHVGTRPPWRARRVSNGEAPLASAHMPLVYPHLWEAPCRPKSVARVKNGPQYLPTGANPKSAPGRRPESTTLGSQRGKPMAGETPSLGNNGESHCVGKYNITRQGATIKSRVANISKQGEVKELACTIVGGPGHPNELKVVCAPPPPARGTREAERPLAPEQNIKNETDRGNMKYSDVSENKCKSPCARQIHGCVVRRTHLNK

SEQ ID NO: 969097 - protein, 121 aa, Homo sapiens
TPDVGIDKIREGSLLAVFLLIDGWSTGIGDPFSMAPPNMARSPYTVLGWHCGYVMFRFQEYREFSLVIPQVCFPWHVYGPPAKCRRPLRPLVTSPSRGHSEIHGPSLRGEYKTVGISGIRN

SEQ ID NO: 969098 - protein, 67 aa, Homo sapiens
LIFSQSGKVVARQFLLWTPGLPLVQTSRIGVRTPGLDSPVWSAPLGIYCLSPQVFANSMEWLPPIGL

SEQ ID NO: 969099 - protein, 167 aa, Homo sapiens
MADEAAYTRSDPSGFGTGLRLRTWDTWEPKPPSGGPAPGSRPRQWRRSRFGATRGQYTSRLGRRRAWPACVKPGRCANSCSWEPPPDKGARPKPNECESLPEPTNTHAATLLAQIRQETPPGGGYPQRPRGHKKWAPAMTTAPHQAGPDTYKQHEENSLPLTRARPV

SEQ ID NO: 969100 - protein, 165 aa, Homo sapiens
MGFTSVTNNGLFAYTRLSASWSNTSTGPNFVSLGQAHRGKVRATPHPVGELFQATSTPLGAPLPLSVDKYTHRVAPGGLTHAPDDPQGCRGPGTSGTPTFPPTGTRSAPQQTSMPLFPPTPPSQTQRCEKDRLPRPSHSHNSPTTIIHFEQPLQYQQAILNLHQR

SEQ ID NO: 969101 - protein, 186 aa, Homo sapiens
NRGAFLMVCYTEIECLLSGKREPFPPQGRFSEESVAGPPRWAVRGSKQNTSRDSLDAAEKSWVPVYKAPWLRVGATRPTIAPLWCRKISPPPPCERYAKFSSSGGTPRSLGGDSNTTRLGGGHPFSGNNRGDQTHKGNVVNAQSSPPEGGFPHANTRQGSQIQCRGPDPVPEKHTTGKKGAPRVAK

SEQ ID NO: 969102 - protein, 292 aa, Homo sapiens
RTNRRGDLFREALHPHVGARRGHIRPGELALGKGTPLDRASHRGASEHVKVWYTKEDTCETAPTPLQDLGALPPGLHGTGTAVRHNCPGPRMTIKGSSVEQQIKQRGTPPGANARGRVPGDNTDKLGVVEQQKAPRGANSSKRSPQQPPPQSDLARPNLSLRPHSFKNAPPRSYRVQTWSPKNTGGDVGTPPPEDCPGLPPVALRRNKLARCTNSATGISVLASPRHVNNGYSSQVRGKACSLQIYIRGEAPYIWFGETPLLMLSQRWRVPPPHFGPSFFARVKSPYFSPKK

SEQ ID NO: 969103 - protein, 313 aa, Homo sapiens
RSLLRGGATTKKGKGPPNKVSTRVPDHEKVALTFVTETANRGILSRDGPPPTNGFETALTSRMRLDKVCRAGTTTAKKRFAVHLSGPGGAKPPRETQHGGGRPHHRSAVIARALGASGSYVYSEVPPSMAIGWYMVVGPPRERSKGYHPVPPACLNGDRRSLNRQRGVDFSSPSEASRCLLQVPTLPQVFPRSSRAHATGYTTLSAPVGERLHSFTAALNHVLSTAVLPPTSWSSPAMHAVMRALVLRDAQFFGGALAQAPPDGGPPASPAKSRVFAWHSCVPLSGVGAARPRFYPRAPVWAVKKIRIFPFHM

SEQ ID NO: 969104 - protein, 115 aa, Homo sapiens
MLGPPFVRPVLVDHSPRHMEKAFFGISSKTPIKGAISAQIIRVVHTPPPVVRVIQGPPPCLTNSGAESCSHSLCSFLHASHAPNQTDNDIRGCLFSTPNSGTQSSTSVSYLSGNW

SEQ ID NO: 969105 - protein, 75 aa, Homo sapiens
FSRDRHHTSNSYVSCEAPPEHPLFSNSPPVPTLVDVYADNKYLVFPPRPKIHFPSYLPPPPSFLVGGPPPSSCCI

SEQ ID NO: 969106 - protein, 137 aa, Homo sapiens
PPLVGRAAPARLFSPARQPAGETPPLWRRHVFRPQLGEPLCVRGHNDSFPVTCFRLMCGTRWSRSPHLLWTQLLQRMSFFGPAQCRPLRATRAARGGSSPPCSQPRPSCGPLPCSARAALGGVLNVREKLSAAAADE

SEQ ID NO: 969107 - protein, 243 aa, Homo sapiens
ACQKRWDACVSSSQPAAARTTAWDHPFRGAGVHPGKTRPAINGGAKLWLSGISRRRTPTAAEWVRQRRVSVQMFGAHMRAARVLSNKNGGRCVQKNAGPVEMCEPGESTKQCSNRSGSPKASDSLLSQVTCKPPLLSGEPQSDGGSSSAHNGARGDLCAGLAHHAVIKGSPGPLWSRANKKLREFGSSDTGEEGSHRQEQKRQCDSPAPERRPHVSRAHLGHQTYSCIGCVLCLQEGFLVLVS

SEQ ID NO: 969108 - protein, 162 aa, Homo sapiens
APPTRTAGGGQRRHTAGYASLAGPHIVGHRAAPAQTNTHGKQTERCAAAPTTNGEAPLPNDEEWDQQTTGSLPAWGRHSPPLDGAICGEHKLFARPPPRRGCFWRPPPKEQRVSKGHQHNRVNCPSLNALVCPHHTSPTEDTTTCALMGWSWVKKGLSLSPT

SEQ ID NO: 969109 - protein, 299 aa, Homo sapiens
ALWGPLRTVGNWGPKSGGRSSRLSGDPSPSGAGPRHYLSDTRGKKPPWVHRPARPRGCWRPPLGPRPPTNLPEDHEKGGETRAIQRPKFGKAYNSGAPLYRPTPPGGYRLLPPPPRAVKKACPRGVPDRAVTTEVHHDGPPPLASDNWRGGSPHYRNPASPPHTEGPLLRQVNPPMAEDFLHSNEMLANGRRQPPHKRGQAQGATTSANTQQHGRITCQRRNPSILKVRAPEELPFISWRLVRTDESALSLFLESIEFTRGLLLQQVTPPTRSKNGVGEHKKTGISRGHPKQTQTFSST

SEQ ID NO: 969110 - protein, 114 aa, Homo sapiens
CTLKWTCGVKTLVIIFSPRRFTPLEYSVAPITLVPPTALRIIIFTPRPRVFAEWCVATTHRSPHLFFYQHLLGVYPICWVSHTYVSQHLVRNFTKSSPPFFSHTSSHHTIIFSF

SEQ ID NO: 969111 - protein, 143 aa, Homo sapiens
MSAPRNSASSGYVFFTGKSVSREDVLLEKVCPQPQWLLGIVVNTRRAPNGVDIGTTQSYLMMRSPCCFKVWEKPIMNGCSVTTKRGGIISLAPQMIDLATCTPPQVFNCTLSVQSPPPMLVLAVCRLIPRIASCSNKLNRREC

SEQ ID NO: 969112 - protein, 204 aa, Homo sapiens
MLGFCVPQDTRMSPFPQDPLPKGCCIYNTNFSEAQNNAGNPRQTHDLSPTLLQQRRDVLTLIKQSNRVVLFNTPQKSTFCFHGISKYPRSYRPLHKVLSCTQTNTDLYACRLLPPEVNNSLRGTACSIKGFTTLLRELHLLVVSPEHRRPLPQVHVRSPPRRRTPMIPKRPFSVWAPLYNTPHSECERVRESQRFSGERICPGL

SEQ ID NO: 969113 - protein, 97 aa, Homo sapiens
LKPRGGSNAGGTLSGDRKPVGKNDTADTSNAPGPPSPSYCGVPRPTTPLWGEQASFVIISPSVNHASPDKHGSSCHRKQEVLTTVNKNVPHTQCFAR

SEQ ID NO: 969114 - protein, 155 aa, Homo sapiens
TTVAKAEIAWGGERTTHQPIIGGSQPEEHRVSCGFPTRLMPPTNAEKVDEVVLPPPAFSGMGRAPSPINARPLLADWALSSATNAGAPTPASGEKQLRFDLASLKNVSSPLLCLTYMSRRPDTSLALLLTKLCSCKPSPKETSSMSTPIARYRSI

SEQ ID NO: 969115 - protein, 173 aa, Homo sapiens
MSDRLVWRGRRTKLFLLLQRITTFWCFPGRMIITDMLFEHTSQFRLGECGQICPHGPVWCAASSARARPRFSPRARIFFIFGPAGGYTSTGWCGAVPSLVAVWGLVSPVSAVLVSSSLQKWSQWVFLLSPVIWALFGRRRFFSHGALCVDTALRGIPRSSCLLMLGGRTSSSW

SEQ ID NO: 969116 - protein, 78 aa, Homo sapiens
ANSSKVSHGSVPFVARLNPMGVTHHVFGRPISSGPPSEMLCQRRQNFDVGPHLSALPKHICSVLSPAAPLFIPPWIEQ

SEQ ID NO: 969117 - protein, 105 aa, Homo sapiens
MFYTALVCNSSQLPRVSAAPLKENNLGWASSPGCQHTRSLHVMVSTGPESSLLSILGSPPITFRHVWHAPPPLGIPSLLQGCFVVTSSLRSAPPPLVGRPRAVVL

SEQ ID NO: 969118 - protein, 47 aa, Homo sapiens
MALLGSAPHLLLRDGPSPHGLDRRWSHEGINVIWSSAKKLKNPSPTK

SEQ ID NO: 969119 - protein, 111 aa, Homo sapiens
MGSKTTRRHKCDPRFGVGDTAYIFGSPPQIAPYEVLVHPGPHDMVSQISCIPRPSVNNSRRVMIWPSSYAAETLPGVAYWVLRIPKIVLSSYYDNTSRSLARKRSIARNNG

SEQ ID NO: 969120 - protein, 155 aa, Homo sapiens
VTLKRNATTAPRLSGGCAPPPPYGPPRATHTRGCLTKRTETFTIKETQLGGPPPEHALSPPTCGDFEISHPLLPQQTMSGLDHSSPPGGWRPTSDPPTGAPPHKNREPPSPLPPKNMWGEIRAPRLSNQPPIGRPPPHTYSLQQQRGGTHRSRRP

SEQ ID NO: 969121 - protein, 267 aa, Homo sapiens
MGATPEQLASITCSAVRKRMWPPLVVKHRRGVPPYLLQLCSGPPPRMANQGLAPRDPPDFQGAFFTLHPTLGGPPMPVCGYNTRNARHPCVSAVFYPENNAGPTHNMVAKSNDYEAHTNLLPHITIYYKRRQYYSYCPHLTLPRHRPHSLTPTLGVGETTLIYQDMVGASYTRCPSQTLTFSKRNSVNCLYSNDRPPHFTTIKKKQYLVDHALSDSILVRVRRPMLDMSRFPKTQKCVLLGRARLCPDQHCVSRRLGPPEKIQTDID

SEQ ID NO: 969122 - protein, 162 aa, Homo sapiens
METHLLYDLSGRIMPFLNKTWAARVYFLADNSTDVVLGPAIVQQEPENIHRKCLRLLFPGAPFKYAAGVYNPRRVIVARTTPFGINLPTFCETHRAPTIGKAYSMVLSPKMMAAGFHPAHSVHAHTDGLPLRLSAHRLLSNYVRQKISWFRPPEINWGKAHI

SEQ ID NO: 969123 - protein, 162 aa, Homo sapiens
MELVESPLAGLVHLLYTISWGPPPTYCGPPTLLPAVATPYGRSITLGRPTWYHTVVVDARPALLFVYKTLGSLVDAHKQKEKKRDSLDARLEVIKYELCLRAFLSKCSFEATLLCQRGSQLYKNSSHPTGIFPGKLVAVEDLLRILVIYIEPKMPPPPAHKT

SEQ ID NO: 969124 - protein, 170 aa, Homo sapiens
ASWWWSSLSVGWFVFGYFGLSLVRGVRGGAQWDGVVSQLCVGDDLIAAGGTAILYGSPLLRVSVMSPVGLFFCFSAVPVLYTRPRLVITSFGRCLQVWTLLGFSVRGVCMVAFSGRSDFLGVLIVLISTVVFVAPPPRSAASHVGPPRAPADLTVGPPGSVWVFFSSPLQ

SEQ ID NO: 969125 - protein, 136 aa, Homo sapiens
MVSKASFFRPPPQFPARRIFWNQTSPRINPITYYALGEIFPTHTGQKNQPQNNRGSQTKARYETPFPTTSSLCHHHPPTIILVFFQTTVSRCTPFPDIFAAGPSFHSPPIIEPKSVAHFFIKRRLSYKMALYKARC

SEQ ID NO: 969126 - protein, 182 aa, Homo sapiens
SPVFNLWASYQRLPHLRRDALSPAAEFGEETLLLAEGNPSSAMRGSPHYTTRRMGPCLPPRGITNRFTVGRPPKSYSPCAEKFCPPNGDQQCVFSRRYPKKKRFDTTGFGNQWAMGPRLPPPKFLIWPPPPPGRLEEEEEQEGRDPKCNIDPPWGQPDLLKQRLTRSNLPGGLTWAKAASSL

SEQ ID NO: 969127 - protein, 90 aa, Homo sapiens
MAHKHPLANRKVLCSKDNKKRHPKFSPITPWFRIFGGRFIRQPDTRAPREPQHSYSLKELLWLCPSSPRFFLLTFNFFPHKNSPWNKPNK

SEQ ID NO: 969128 - protein, 50 aa, Homo sapiens
MALRSLLYAHSLEGRSHACLVFKVTSYARRLLVQFSHPPKLTTGLPFYKT

SEQ ID NO: 969129 - protein, 142 aa, Homo sapiens
MGDLPLFYTQTWTVLTPPLLPREIYPPYGIIERSRPPRHVPMGCTINLEGPSDLAIRVLQTHGQTFLFGGGYFLKTNFGGTKKFRAHYTVAIHCPPDYCPPKMDVPPNFSSLYLREVEPLPHFLERSSRLLGRTSLGKHKPG

SEQ ID NO: 969130 - protein, 128 aa, Homo sapiens
MCFCLRSALSREVSAPSCLLEQGMSRVVVCCRVGRRVTARFFCLVGRRRGLVVFLPRPLFLCAAHILVVVGRGCLVGRRHRPAVGRRGCRLSLYEVGTPRCRLCGTPACGVVCVRAPPPCVVPPIFGW

SEQ ID NO: 969131 - protein, 205 aa, Homo sapiens
MGRFPGYARVLDPLVCSLHRRPDLCRTRPIWVRTLTRFHCGPDISRGSAYISAGGPARMCFSTHHRGSSGAFLPNMPKVLREQPSATRALLPEGLLPGDNPPQGAMPPPKAPHQKYRGTMVSRTHTYGSFRRSPEHAWRCKPPHQHSPKIWRGLEHARLQAELLGWPLSAEPPASIPPPTSGYHSTVEPMDAAPIGVESKNPPSP

SEQ ID NO: 969132 - protein, 121 aa, Homo sapiens
MFVLGVPPPPPDVTPVVCRPAKRRPDYFLFLFVGEKFRGGLETIFCGGQLCRSPSLGVAPPRGAPLGALIARACLTTGVGCSPMAEVLLFCEGIFWALPPAPPPQKRFQTLCSHIHLAGNI

SEQ ID NO: 969133 - protein, 269 aa, Homo sapiens
MFVSLDADGGAAAETFSGTAWGTVSASVCTPPECVFTLPNGPCSPPSVSHRAADLLWWGPPPNLLVLQATFSRVLLSWSGIIPAGFSLLCPGEHHRGGVKLQPRRDQCCARGLLRGCPRRPNLGGSAAFRSPHLWGTPPSCCSSPRKKKCVFVPLYWEVLEPVKMILFPTGATKDSKKKMFAEWAKIGATNNVVAPLFTHFNIGGWNYYKKISRERYNHLIAQDEMFRWDHHIRAVAHVSVKKKNPLIFWAKPPLGVFSNQKIFFGGPP

SEQ ID NO: 969134 - protein, 160 aa, Homo sapiens
ECGSFARRPCVEPFPRAPPWVLMKRCAPYWAPGPPCWGVCTPSVAPRRWSPSMGGTRWTFVEVCPPRVWAPSLLGLGWCEIVPPSDPGAWVPESVASAAPPWARPGGPPIGPTGGPPARGFSGAPAPPPPAAFWSPPRGTTRVLLRRVCEPHDGVGPLFL

SEQ ID NO: 969135 - protein, 276 aa, Homo sapiens
RFVSHSKGARIRLAMCPLLFTGAHVALIGVRKKGSPLIRLVSPEEFLAFPRAGSFLKKVGVPPLRSPGRMNGVTPPVYDETTVCSGKKEEKIWPSGKTMRAGGFNPTSALAKTTHITCNQTVVLVSMPKPTSVRVNIFKGLFHCMSDNNIFPQKVWMGGPLLYRSALLVVAPENDWSHNGSGTCEKLMVTPRRRASYPPLYIEQERTAVDTLIEAWGNCVIMGAYSPRLDSRPTLPLYGKTIVLWGAKVSRTHSPTTDSGGNYSFSDDAPQIVVQS

SEQ ID NO: 969136 - protein, 215 aa, Homo sapiens
MAFSTQVFRGGLAHRGGTRYFPRGTPGSPHVGFLPPRRICRRSPFLWVPTGPTQHEVLLPIERHCPRSVCKHAADAPHFQTPCGEDHPTVINLVPPEEPPTFVGEALSQFRTPLCGAPFVRCLEFEDNRTANAMGGSIQKQRGFTHKIRSEPGSHGAQLTHSSLPGKTIPIGAHRVSFVPSLQLGTPPVGTQCGWQEPGLPRVGCIIDRRHQLLW

SEQ ID NO: 969137 - protein, 109 aa, Homo sapiens
RPLYVPCGTRGFIPNGVPPWPALVLRGAATCLHPNQYLCRPCKFSWFSLFARPGSPLLSAPPLAPLPGKVANLHKSVVPALTFSLPLGGKTIFREIFPPRESPPPIPFF

SEQ ID NO: 969138 - protein, 86 aa, Homo sapiens
AGFHPGVFFRGVFFWQFAFSLLFSCAFFVVMGGHIMWGRLFAAVLTFPFMSRRAFQVKILVLERVFCGVFSGGVAALLFRGARSHS

SEQ ID NO: 969139 - protein, 129 aa, Homo sapiens
RPVGRKAGGGRSVEAAATRQAGKRKEVGGWRRLEGKQPPPAAQEEAAPAGRWFFLLRGGEAVGHHDDDYYYFVGGALVAPLLSSRRLVRGCEEIESARRDSLSALSHTQNRNRNIKYILSPTTHTQYNK

SEQ ID NO: 969140 - protein, 348 aa, Homo sapiens
MVMLAAPLRFVLCFAAASFVGRGLYPVVPRCSYEAIIVSSRVVFRAPHYYPPRGGTTHFVSPNRPACLPPRRRTTVGGFCASRPRPPSLPAGGEKYILCASAWCWFPVVAVSRAPPQRGTPGAPPFCVVAMSVFLWTRPASADTNGGAPVDCPIVASRACATPLSLLLGGGALRIVPLSPSSPRLVLPPPFGGAPTFIGRAPRAAPFRCLEIVGLPPFFSVPTLVLAGGSQHPPLVAPMGGATNLGGAAPNRLAPLPPFWPPAPPCVSPWRRSLDTLFVPPASLSVPTAPSGARNRGLAPPAPQRCRPRGHLPHNLAFLPPLSIRLLFYPARSLKSPLSFLAPQYQKT

SEQ ID NO: 969141 - protein, 242 aa, Homo sapiens
SLSGTNLFRRAHGFGQPRRSVTITHSVWGGGVPQGRMTLVLGGETPHEWGACITTTWLFAVAAAPIRDVPNSASSHRGPPPRLFTYSFVGLTRGPYCAGATIFFIVRAHHIRPVNRAGFSHPQSMVHTHELPSRPVPRSSFLCRAPGENLAECVTPPQGTHRLSCLRGVSNFNCSTINAPSLGWTRVLIDLVLLLIESKTRICGRRRQSTSVFDLLTLFDNKFFIKKLGRPQECHPYYVRAI

SEQ ID NO: 969142 - protein, 34 aa, Homo sapiens
MGSRRISHIARVRILSISVASLLLFPSNTPPPGH

SEQ ID NO: 969143 - protein, 72 aa, Homo sapiens
LLCLCPPAIIGSNHAAAKRFPSLYPSTSLPNWVKLHLPPERPIYHRHEGLTPSPIAVYPEEIHHGGCTQYRL

SEQ ID NO: 969144 - protein, 104 aa, Homo sapiens
MEHTSYCSLGQNYINTPGTISLLHFTPLVTQIILPPRITDSCKHFALLLTGLVLYSNVSNYSQDFFPQHLASSAPPQIFYKKLKVFFQKSLNTNIGIIVPKILI

SEQ ID NO: 969145 - protein, 114 aa, Homo sapiens
MWGELRYTRVGELFFAPAKLFGPAHPPHYKKGLLICIHFPRVPSTPRESPFCQGVFTHIVERAGAFSQYIVRRNLGAPAPTRPQLSPRVMSTGEVTPPAWANPFGLYPNCQTTS

SEQ ID NO: 969146 - protein, 192 aa, Homo sapiens
ATRLPTAESMSRPFEMVFSEFPVLSCPECPRLVFSGKCFSDVEIVGTVGRNAPARASAVFRAPPLYAPASSGLGSTRLNDKQAFVAEDSRAPPLVNTWMAPHSECWRDPPAYRVPWPTNCCDPPPGPPPWGAFRPSVNKQDQPTPGGSHQTPGHTQTSVCDVGQRATKLVPRSILRAVERGYLFPVLRPPPS

SEQ ID NO: 969147 - protein, 247 aa, Homo sapiens
MRRLPGCGSARVRKPARGPVPPVGLPPRQVLLCPPLGACFPNPKCLGPRVSLLGVSARPNFRFATPFCFPARSPNKIPRGFRRFPPGVSFSHKTEVGAPRFRGSGTRTARGLFLSKWRAPHHTPGEIPPLVSPRPRFVYPVPPAGSPLPAPRDPLPRRPGVDFPNNPPEVFYARFLFEAPAPSLIGRERPPGRRWCAAAHKCRFVDTVGDFAPMYPAPPVGFQKGPPPPRGPNFPCPRKIKKNFVNP

SEQ ID NO: 969148 - protein, 170 aa, Homo sapiens
CAHGDIGDAPPCAKLCAHPLPRRGKHFFQGGAPPSFPNSWGIRPCAIALLPRFAAPGCARQFLLGTYAVAAENPVLRHNLAPAVTPCRDVMCTRTGRLVLLVPKQKLLRLFLSAESHSERFSRRRHLYHRRNTADRPPPAWPLNIKGVLGTLYMLRLKATFSHKVCFQYT

SEQ ID NO: 969149 - protein, 246 aa, Homo sapiens
SFSPLRMWFAWLCTNPCCVASRGVRATIWRRYYRSPRVAKAHRVTVVTAVGHTAYTLGETPWGSPDPRGGRHLASRLPGPLCIFRGVGAPPVGIYSPHVSPWCAPAILVGAFLPKPDPCFCASPSSQTWRPREGCSQTPPARKKGGWRRAPTREVVRSTRTSTRVYRTPTTEPGATRRSLKTRVGRERYSPHPLGGVRENIIGPRRLNRHTYATTTASFIPHVGHPALRCKYPVRLVFAHTCERGL

SEQ ID NO: 969150 - protein, 73 aa, Homo sapiens
AVRDVSRAPKLLPQMMLGVHTHVICGRPGLFVYDHNILEEGKPICGPHFFYNRVVWFLKSKKRLTHTIGYTHL

SEQ ID NO: 969151 - protein, 225 aa, Homo sapiens
MLAKPPLRAFPLWPAWPFARLRTPASPSVLPVPPPGVYFRTLRLTVDKIAVFRGVSPGFQNFADKRPTPASDIDNAPAQRLKYIVSATVVHGTRVVPPHTPRKFPPGSFNRASYPALINGRPSVGSSLTVGQLFPVPRGWRPPRGAPLGEVAARPPFMHRWEESVFPGIIAETITTRPVICKRALLPTRLELIFLLLRPREVLHNTFGAHKLLFQIPVTLVYQSL

SEQ ID NO: 969152 - protein, 247 aa, Homo sapiens
HTSPASLFSSAPRIPPRPSSPHVRAYLGPPPPLLKPVVVSFQVATRGTTADCIPLVCPPHDGFPDSARVAHPLADMRGDSCWRCALLPLARENNVGSEPLPPPDQGVAALPSAMLFWDPVAPLRRERELPPLLATRCLASPRRRAALHHTFLGSNIVHRCARHMPRGSLFACPAGDIVVSPRPPVRKERGAPQSYWPAPQPSPGEAEEVGPVATHDIQDAFVRGPTKNMVGRRKFKPQQPSNQTNKP

SEQ ID NO: 969153 - protein, 107 aa, Homo sapiens
ARCFAAWCRLRGPRLSPRSLSAFPLLFSPGLVCSVVEGTGDNTGAVCLNPLGTSRFSVFPSGSRCFSPKDGGDFPRWAWAVGPLRLPTGFRCQEGQPSFPIRWIGHL

SEQ ID NO: 969154 - protein, 298 aa, Homo sapiens
RGGFFAPPGCFSPPPSPVSVIGGSPSLHQQSGSLLLGTTHVNKHGTHKSILSWGVLPLTGGIQPFRGSFYKESQSGMLESCDCQQIARPPHYAAARTRLAPRTKSPRLEEGFFSRIPLHGGEHYHQDTTQAQRSVRATRAPIADHLVVARGRRNPPGNIPLGATPLRTHPTTTRSESPQFLRQSLPLPWGGGGVECSERTPVRVLITRGLGLRLLANVFCTFVHATACLRGAPRCFITPPAPPPSSRSFYTQGACGVWCVPPNIQSPYISSPTPGPPGGPPPPLQTTPPPPIAPPPNI

SEQ ID NO: 969155 - protein, 303 aa, Homo sapiens
RARRAGRTEIPKHKKTRNPRLSPDDVLWSSVFSPQVRGPMREASQPREGGNSKGASPTPRVSHDGKRRNSVVTQGHKGGKTISRWEETVLSRRQECFSGREHTPPHGAPFDRALLFWRPVAFRFVRGPSIGGPTALGGTPRALPPRRRFWDNWPPPPCKVLLTILSAVIGPPGRSPPPGPLVNEPLSSAPCRGRFPRRSARELPTDGNTLVRPSAKISEELCRARLAEHAGPHTGNTSRPPKITRSHTRHPEGGHSSIHSSSETGTNPGWDAPRRVPNSLVTKPPGRGSPVMSRGESPQPHHN

SEQ ID NO: 969156 - protein, 136 aa, Homo sapiens
GVPPTRWGGNYAAPPIKLVCRGINRGAAVVIRVSNNSFFVFSVGVSIIRRHHFVAPAVRHKSQLCSAPTQYTSRLVWSCRQKGAAPGVCSLQKIAPDREMTDELHDTRPATHASHITAVRRRPPRDTLSLVTATAD

SEQ ID NO: 969157 - protein, 75 aa, Homo sapiens
GVRLVAHCTNVGPPSGGALILRARPPKVRPSALVKHFPAPRGFRARPWGPRLLRVFPQTRSEIAARSFGSAFVRL

SEQ ID NO: 969158 - protein, 139 aa, Homo sapiens
SPEGPEGTTQQTRVTPSTHKILGEGHKTWTGDYQTRGMGDKQCTVLKGDPCSTLRGPSPDCGPVGTKTGARSNAHHGGKNKRSIWRNNMSPSIGASPRGVFPQRAQLTTKAVFHASHRGYTPRGLKKRESPIIHCVLWP

SEQ ID NO: 969159 - protein, 301 aa, Homo sapiens
VVVLLVCRGPPEFCFCRWIRVPPKILCRLAHHPFCPMFALSVARLTRAKNFVPAGFLRPHTFGPPRGGNPGSPLWSPPGGALSGGRYNYCPPLFRSARAFFFLAVCWVRSAAPFFDKMNAGAVVPTLRGFPLSVTRGLGGREAPRTSTTAAAVWAGGPTLSAAPRLLDAGVPAPHWVPELPAAFFPTRSFSTRGSSQVCLLRESSAARFALRLQEKGCGGTHLLLITGSTPAPGDAHSDKYSGASPPRWRARNRLASRVIEDAYDAPPRVTNSRPVMNFPHTRSAPYHKRAPPAPQNASSN

SEQ ID NO: 969160 - protein, 121 aa, Homo sapiens
MGGAALVRPHTLEVRTTNFSLELVLAAKEHFLYSDRTLSTVLENRVRTKTTPGSPPLIIPVDLNMLQQQPMPASRTYEIGLSPGKGKHNRPPVGNILFYTRSSSYLYPLYTLAPFIIKISS

SEQ ID NO: 969161 - protein, 320 aa, Homo sapiens
SPLLLRPQREPPPVLPVCSTRWFPTWGETPCVVAPPCGKSSSAACRVFHVCQFRSRCDAPEELSFGAWLAPHFRGSPPTWCRKFSVAAAPTMGPLAPRHMVSVGQRPCCVPTRVPLVSILSRGASFYVAARLHTGGLPYLFARPPLQSFLSVFYEPDTSERESPTTVYERERHVGRPPIPGTNTTKDEEERYLLSFMSLSDISGGGTPSFCHAYMTDILLLRRRAPPSLIIGAVLQIRDSRLVATYESRVPSFSRSAPWQPSSTAPTNVGTPYCGFQSAGQPTSESALGTGGFLRLHINEYTAVLSHDLPIKHKHPPPAN

SEQ ID NO: 969162 - protein, 311 aa, Homo sapiens
PTTMVVVAPRGSPPCFPPRFGCSSAVTICRRRAPLFKIRRVIAAARAYFSRAAIIGWSLGTLPPLSGNNGLAHFLRRPVSSMGMVYTSPPGGLCTTRRHICRCHAPVVRAFVYVHPQRGVSPPPLCARCPSVQVGYARRTLFARTRLAVVAAGKVVRAAEHHSLVLGQHADTPRTCLGLTYSLSGVHAPLGVLASWSFMRWSRYYTPPFSATLVCTISARGASWSGLTLAFPVLWECSPPRSWLRSPPPHWSGVLCCSRPPLDAVPDSHGRTCAGPPVRGSTGDCRPFRPNAPHHPPLVSPFFFPNTRKKK

SEQ ID NO: 969163 - protein, 110 aa, Homo sapiens
SDLPASLSATTQHEELILTYLLDRHVLFLLLLLDDVVIESTTTCSWSTLLQQLSSRARRDVRRRRRVYSPHPRPPPPCRDTLLLLWCRRLLCSLSPPSRLLVYSRAEYTL

SEQ ID NO: 969164 - protein, 285 aa, Homo sapiens
PIAGVFSRASTSFIQAGDFPALTTRDSCASCVTPPLLGVVGARTPAPSYRWVTHAPFYPRGSRVVAPVLTTPPRVWSRSRTPSEFERSVLTPLSPLYALRRLNPWLLANRSTLWGKTPSCRPPQPSGAHSGYRPPPPAATAWGEQQEQRPASTHKEDRGGAHHEDKQYTHICVVGPHPHKEESLSPTNRHMRKKQGWRVMLTHNGESPTMHISGGARPPLLSSLILSLNGDKTIFLTMRHPFNNRWVFPANPHNIHTTSVLFQEHHYERHKLSNLQSARGVFSPM

SEQ ID NO: 969165 - protein, 234 aa, Homo sapiens
AFISPPALIVAFFGPRVEHPFFRGNWRPLMKCGRGGSFASVLLPDWCLLSPTPFVGVRRGPFFFCPGALNHTSRSLSGHIQGLGRLFTSPPFGPAFGTVRRPPASRSGEENIGLHPPRRPLCREHFSLPASGVFFAPRPTKTAPLSLFVRQLSPAKALPPLPLTNDSETDQETSHIHKQNRGGEHPPGPAKLLAPQPEVGASPPERRLGDRARGDNISSWETIGPLFSHDHARY

SEQ ID NO: 969166 - protein, 204 aa, Homo sapiens
ALLLLAAAPASVVVDAASSTYTGVQVDCTHTPAVAGGGSAGGALVGRHATHGARRCAHSFVFSSRRGGVPPTLYSLFAQRSRTRGECDSHRLTTLCLVCLCQRRECFTFTETLWEVGGADRLRRCHTHIRESYENRIAPSLSSCVVLFVGIFCATIRRGCNYSCAEPPPCLTLSPTGDVVCALTSTRHAAHIIEYEQYTRKHTR

SEQ ID NO: 969167 - protein, 47 aa, Homo sapiens
PTPHYINPYFTQQLGEVLFPPRGGGPPPWEKTPRPASASIYPPIMNT

SEQ ID NO: 969168 - protein, 214 aa, Homo sapiens
ARLFSHTAGAPWNSGNPPRAPTKPGAKTASFTVKKWRSHLMHPFGPGIILGVNQLCHSLARTPPFCEVPFNMKIWSQANLLVVVPYCHNKKYVDCFSKWGAYLYNHWFLTLPPQYLSWRSTNTTRRCATWRNHQGVGNSTNIRRTISKRCFSSTTGISVWSATIIKNLCRAVSTITTPQIRSGDALFFCACLFVTPLLFFKPIFFFVQKNPLGS

SEQ ID NO: 969169 - protein, 144 aa, Homo sapiens
MGRVIKWLIPPGSPTLCLKVPKRVFDVSTVISCASFGSPCPKCWEFFARNQTGSSSQGTPHRALFCTGIRPQKLFLGGGGNVVPTVVCVQLLWPSRAVPIAAPPVTSGLRQNHTHCLAHAWPPRAPPPRVFFPCPKKKFFLSPK

SEQ ID NO: 969170 - protein, 259 aa, Homo sapiens
WPPAPRYNALCELGPRFAPSWEHSLEGFLPRVSNMAFPMGPHPGWYRPPVAPGPPLWGWAPRGVPPPRRDGGTPWCLAHPFALGAPPSGPPLRKWGRNYAGPHILSSLVHTRMPPLTPPRALLAPALVEDTNATYSLCFSGRTHTITVRGCCLVLPARYTSPAGSQPGALPLVPRLFLRRRVHSPARRVIMTSGLPALSPRGGLLLFPGAPLVAPPLRPPRCGGRSHPSFLGETPGTPTLVRYHPDPPDYTPVLSGQQN

SEQ ID NO: 969171 - protein, 132 aa, Homo sapiens
MDRWQAIMWENALVCRKPRYANLYGPPPGNATGEGPPVNMLLLDPYAKKMNKARGHSVLISNHLFETSPPSFTLHREPFPNKFEKKATHPVILGDYPAVSICAPIYKTPPVAKLAHIAVKCVITVLVLNFSL

SEQ ID NO: 969172 - protein, 137 aa, Homo sapiens
MGVPSFVDVVFHAFVVSPCVVVISWFPARITPVFVGGYSGLFARLYGRGLTAVPPLIPRLSAPLYWARLFFSHIRDKRPGVAAAMLTGGRAGNRRAPIIFFGVGTTLYYRSVFHFAAVSRIQYFSRDFSPPFRPRGV

SEQ ID NO: 969173 - protein, 120 aa, Homo sapiens
HGGCAPVAGLGKRLSEGAPCGGKRPQDSPRLCFVRSVVPHTRGLVIPGELKLAGEEFGFFENKWRSRVTAAVLVPQRQKWDNRLFSIYKTTSVRVRPLPKKEYDDTHVSVGTAHKISITC

SEQ ID NO: 969174 - protein, 236 aa, Homo sapiens
TKKNCISIHIRCVVRRGVFSMLSYRALSARTISGENLILCIRGNPLFEGDVLYTTGCPPPPARVYVPPPVCSVVIISGSRVISLSGTIVLRLSSAPALLENSLGGGSILSVQCSQVADPGGGSKGGRPADHLINIGGPIDVVKIALEVRCLPPPSVNTHILLDPLSLLAELTYWLTTHNLSTVRNICASNLTIPFSLRTISDYIIGTPLLSSDPLLWSTPPYCTPNHPPIHFSGDD

SEQ ID NO: 969175 - protein, 247 aa, Homo sapiens
MARGPPHFFLCGCTRGRKTFVSQRRLLEVFLAAGPRQICPGFSPPFPGGAFHTGVEMAGCPRFAACFCVKSACRPADSFPECLGSLLRLQVSGDPLLVPRALAVMSPVPPGGQTAKGVCLPPGGWKRCYNTHDWVSHPARPTARPPGEFAWGVGPKTHNIFGAYSIHACPYSRLRFLRGVFLQNLEAPRRLSSQTPWRGGYTMSGQGPHMVRPPYLTPRRRQKVVSDSSSSCTVCPPHKPLAPPPWG

SEQ ID NO: 969176 - protein, 150 aa, Homo sapiens
MGFWAQARCAERNTRMLLCPHKLLVPRRLDAGLRGNAPVGLPPTWGSWIIPRTVSPGRIVCPAVTAGSFLTALTLVGGLQGTFFFDAPLTLGPPLGVENNLLFGRQRRQNNFFWTIPDGMSLFIHSLVSSRFLTKNLSSGRPEHHSNSPP

SEQ ID NO: 969177 - protein, 341 aa, Homo sapiens
SPPWSARPRQAGGRELGLSHRCVCCVVLVFGSSCFGCCPLFCSLLCLGACSLLVMLCTFFFMSGVVHYCVLVCSGVRARTLFVPPRVLVVVWLPSFVLSRSGSFCFLGLSLRVRLCACFLLFLVFVVPTQSRSRGAVVWPSSVARASPSVCVLAARGCFLLLVFLSPPRDWFSRLAPGVICCVFAALGVLPLCAMVAFARGSCVLPGWYFLRLVWGVVLFGSVFPSLALFGFLVECQFSTVRYVVMITLSVDPPPPLLSIRQVGFYALSLCAYALRVSYLCVPPRLPFSVSRCRGSLLSLSFFRPRPAPNDRAPRSLLRPPPPRRGTRALRLLSTGITAAV

SEQ ID NO: 969178 - protein, 194 aa, Homo sapiens
LLYVRVERVGDVFCRSCRFACALFGVPLSYPVGPPLGLVRPVVAVLRAGLGTTCAARFNNCAALVFLGCRARGFPKAGGRCNRGRGSRCVDVPGEAPGAAFFPKRVSPPACSLHPLGGPCSAYPGGSHVLGLEVVPAHTGVTRCVGVLAEDLPPLPLLGGPVPPRWCPPYRGSCPRRIFFDNTPHRVAYSLVYI

SEQ ID NO: 969179 - protein, 203 aa, Homo sapiens
CPRGWGPAFFSGCSFCPSFFRRIGRVKPPRPPCLIPAPAPPWGVKWPDRRAPLWWSVSRNPRGVFSPPRGPPSLLCGASPGGSPPLFIMGGMSGRSFPQDKVGSAPPAAPPAPPPWGSPGPVWLWARGYSLLVKALRLPRPPRFMAPPLGAPPRLFLKAPPLRHSLNMGVLAAIALSPSPALLAPSLFYYSLFPPLGAPRGTI

SEQ ID NO: 969180 - protein, 127 aa, Homo sapiens
MRYVCHAGAFFSACPQYAPYVVHRWGRTFSGCVTRGCLASSRSAVSPFAGGAAYLGPDPLISPFQIVFPATPMGVPMTSPQLTQLSSTFLTPSSSRRADTPRRLHTTHPPISPFPSPPQPSGFSLNI

SEQ ID NO: 969181 - protein, 78 aa, Homo sapiens
RSRDLAPGFGALPFYSRRGVSFPHCPVRSLLLGSPRWPISPWGPPRCDLYTLDHILWGSASSPLGRTLFDKFENTPHS

SEQ ID NO: 969182 - protein, 144 aa, Homo sapiens
MKKSAFYSPPQTPALREPYCRSSIMQNTSGLLPLTKQRQSQCPAPPPPYPLFPLNSNTSSHSSGKPPPPRILDPSAMTPPIYCLKNPPPPQFFRKKIAITLLYNTSRALTVQKTTGNLFPTHIFLNSFSRSDSLITRDQQSGSN

SEQ ID NO: 969183 - protein, 186 aa, Homo sapiens
MPQANHLFVLHKTIQDWSSFRPLQELACFLPTRSTQSKPHSFCRPGSSTPSQCWGLYTPRKPMPWQPSFPGQAFPGHSHCRCVACPPRTVLLSPRLSSCGNPPRVSWCACTSSMTPSGILSPPGKHFTNDSHLLAPKISSIINNLSPRLPPAFLLQDSTLSCHSVSHSMRYEPPAVLFTHAAAPFP

SEQ ID NO: 969184 - protein, 107 aa, Homo sapiens
MPSSIYQNSPGAVICNAVVATQRHFSRRSSRHLPPDSGNCGLPAGSAYAPPGTILIHSLGPPHYTFSEHARDNDSKISTEILENPFVFRRRKYSLNIKKSPPPLTLG

SEQ ID NO: 969185 - protein, 215 aa, Homo sapiens
SPRGATVRLKASWHCPVFRLVSPLLGRPCVISLAQARRCNVLPPRGAPWSRGPLLGCGAGRSLFFKVPTPVHLPVSVCPPRYCVCTRGDCIRSGQNPDPSVHYGAPLCALPDAPPWFGHKCGYRPPAEIGGSPKLGEHKEFQARAQTHETMETEAPLLEHGFYKRAPNIRQLFSSLHNSVCLQDNNLYDDVCRQDHGVCRTLRPMVVYERQLPST

SEQ ID NO: 969186 - protein, 177 aa, Homo sapiens
MLARCRLCVWRESPFCFVGEGVQVPPFILPSLWLRGGVTAEKACASGCLFFPGPKCVGHSVCSCRGAIFYYLVPRLPGGVLLFSPARRTTLAAALACHIVCEARLVGTTHHFLRLPAIFACSIPRFGGSPLVQLARARWQGWCFFSQDRGALRCIAAVVAPQGVSLTLRPNFGETQS

SEQ ID NO: 969187 - protein, 140 aa, Homo sapiens
GQDTLHARVYRVVSPMALFGALFRGSPSFGAPRGSVPKVLSRRVWRCEAFLIDLKLLMELEHRPPDSFGFSRSGPPIPFDWLVPPVCSRRLRGPDSFRQTRLSSLTPQGLCLVKPYPLLPPRFEKQGLLPQGKPHLHPFI

SEQ ID NO: 969188 - protein, 134 aa, Homo sapiens
YALRGPYHDHDLSPDTWVPFLLSGQLYTVPIWAFRTLPQGFRPFIRGGNTSERCYSAPNHTRRTNISPLPSLSRAPPWCMWGNRALTQGVPHPLGEKMLYASPPLLWRAHQLAPLAHKGAPPLGEPSLRPPYPV

SEQ ID NO: 969189 - protein, 256 aa, Homo sapiens
MVRPKRVLARAPLVPSASMFCAANAFLCGPPPFLCAPLSCGLPLSSPPVWFCPSAPSIWAVPTLTLSCGRCNPGGTLTGLRPTRGQALLRDILVLTQKLLLCDELFGSPYYTIRAAVLSPPFGAAGPPQESPPFGSPCGPRRFVAHPCRCCPPGVLTSPGGAPSVYYGLAPARPPSVQAPAVATIYRVAFYSRLYAVLGALGCPRTHFLPILLGANTLLVDHHQLPEDCLSLFGAATFPYYRAGIRPAIDVFRLET

SEQ ID NO: 969190 - protein, 115 aa, Homo sapiens
GSFIFRPPGHFQLVRIKPGGHTGLIEPGGAPLFQLPPVVLCSRALSQPQRLSPPRGAPTEKFSNPGCYPREQCGPPRPVYCRARGTHPTGSVVGSSGAGPCDPSCCHYVPLENTR

SEQ ID NO: 969191 - protein, 107 aa, Homo sapiens
MRKYSVLLGYVVSCALQKGCCPGVSMPCFHQTCVNLVHPYTVLVRGWRFMISMQCVVSMRRGQLYIMGLCATMFSLLSSMNHRVSAPGRRTAPPPFYRGLILKSKEL

SEQ ID NO: 969192 - protein, 180 aa, Homo sapiens
MRYNVDAKRRKIEANHTLVAFLCEARRLGKSDIKRPVNREYRPTRRPKTRRQSDTHVQRAQETTQSSGSKGPALDPGAEGPMGHPPAVLWLCGPPANPARSLAERRFSQAPVNGVELATGLDQGIWCPRPGTMDTARMTHSGLSDRSMGHAPGHNPAWMQPHREIKRQKPRWPPYGEKKP

SEQ ID NO: 969193 - protein, 238 aa, Homo sapiens
TKNKENKKEETRLAVSVSFLLYHVLACVMVHEFIRFHYMCFPASVLCGSPPVCVSLFSGVVFVFVYRSVFLQGCVHIYCAPVLALIFHTTCVWNPRGVVFYTLCGMLFPAPLGAIFGGVITPCFHSFGLLYLGSISLVEILVAGHNFPRKVGFVSPAFLCGGHFVRSTRPLRGLIFSLCSLTLFWASHDPVCCEPLCATNMRVCMWLSTSLVGLVCRHTFPWGPSRWVPASFFSWSAI

SEQ ID NO: 969194 - protein, 129 aa, Homo sapiens
DFPPQRDSRSRASNGVFRSFRPLCGAHVPPGNAGSSPGFPSPPRSYCPAVPPLVVPPAPHMHIFLRVYKKCGPPFLVEKPGQRPILLRDVCRPARPTAYYEAPPAHTPHDMVEDLVRRITTLGAPVLSL

SEQ ID NO: 969195 - protein, 219 aa, Homo sapiens
RGFMCAGLYVVDSVFAVLCAGGTLWTGVGTGSVWSSGCVGVPCLPGGKVSEPAVREPVGVAPGSRAGVFPRGRPRRVFSPGGGSVAPILGGGAPWGPPCVHITALRVGAPRQRMTFPVSWPTGRVCISRVDPQTVLLSGYFGCSLNVGARLCLASQGRAPPYVGEANIIVKTLPLGEARSRPQQRFQALQEPPPKEAVFVLESVGNKTAPIVSGQTRRC

SEQ ID NO: 969196 - protein, 191 aa, Homo sapiens
FREARQEEADRLASCLLRYFRSKETGGQCGSPTGARVRSLSAKQTRCGKTEMVSLFEKCVLPLTFYKAQGPHQRWPRARLDTDVTRAPASASAPKRKFWRNISNSVTFGPPSKQSGSILPPGKPQVGSPPTDLFWKNPNAGLVNPPSETSLILTPRAYDHSEDLSITAPSNMGSKHHPQIEHWPGAFFPPG

SEQ ID NO: 969197 - protein, 182 aa, Homo sapiens
MRIPFLPPRVGPLCASYPHASCRVQPRANASNVLGNATAIFSGHYVIKHSPRCHPPSFFFLHRYPPPPFKGALKGCNHEVLLHSRPLCQNVWVYRKAVPPQFIKHERCGPYRVASPTSACSGLERPPRSCVPLFFSPPPLWLLSYTQGTRPMYLKWVGPGASTMGRSTFLLASHSPSLLGLG

SEQ ID NO: 969198 - protein, 191 aa, Homo sapiens
KLRCLGPCLGIKGVYMPPGVATNAFGSDRVKVCEVVSCLVGLYTPSTFPVSRRAPCTSMRSLGPCAPPAQRLSSQDGVTLFVPPKPNLREPTTPSPPTITKAVFLHHGTQPLCFYYEQMLSQGVSPHKAYSKFSCHQGETFLRRNNFVTNCAKKLPIVQLQSLCNQANMGVPLLKDHEVSQFFPPPSLEKS

SEQ ID NO: 969199 - protein, 70 aa, Homo sapiens
LRREEMSARRKKNGRQSVVTRSFCVAPLFSGKEPLISPSFKGLIFPGARGTWGLQRDVVIAGPNLGWSKP

SEQ ID NO: 969200 - protein, 260 aa, Homo sapiens
PRTGGPLRCRVCLCDSVCCVRFELACLSVVLTLCEWFVRSFCLVCCRACVRSLCLLSLSLVVRYWWCGAARHFSADPPLLGGRRSPPLRGFPPPPVFVYAPPYGLFFPSRGPGAPYLLVAADRRDNFLVARHPLPKVPFVRSRDNFPGLLRPFCRRPLSPWVSICVPRAPLGVVSSPGSCSPRSAPPFGQASPEGLPSGNGARCTLITKGGDPPQRTADPGRGAPTPGLAEQISFRRSISNQPVQKPLLGPRRSFHWPPP

SEQ ID NO: 969201 - protein, 179 aa, Homo sapiens
MDKPCAARALVTTRGIPHPLGKGRWGLLPCGPRSLAPPFGSTPAITPVLLIRVGRTSPSFGPYMREPCPVCPYLLTGWAPGIPPSPGSVGFPPMFSDGDPSFHSAGPLTCIVVLRLSTSRVMSHFRSCSPLRQPHNERYRYDRSLLPSAIGPLLAPPSAVPTPRALREPVPPTRTYIIG

SEQ ID NO: 969202 - protein, 259 aa, Homo sapiens
ACVLSQVKCGPFAHSLGSDNCNKTVGSPVICLDKEFSLPKGPLILRHVVERKFRGAATGGPPRLNNYLAKFIVDGPPAACCLKSRNGRTLSTPPSRPANGPPGTHWGPAKIFQGRIVGGPPQLMVYDMLVCPGEQGGPAGLHLPHFIGGCWRVLFPGSPPGLSCQHNKAPFWRGPLFRPGALFGGRRRRPPGVWSGYPPPLATAQAVCERYFATTNEFGEGVSTLDKGPRGTIFAPQESKKGSFKPTMPPKKLAGVRPH

SEQ ID NO: 969203 - protein, 212 aa, Homo sapiens
MSPPPVVFLRPLLCCLERPLLWFRRSPRLCRWLVHRVGNPVGGHDALPLGVGIAPLALPRAYGCLPSGGDLRWPAVVSTWRTHGVWKSAGIRRRLLSGLIWWVVPPLPPGGSQRPRRLEKCFFRGPPRWGGEMVPVLRPMMFFTPGVITSTTPPSKRGVFNYSTGAELGLDAPIFGNVSTLGGDTHSPGLSGRPQLTPVRRKFFRNITSEAV

SEQ ID NO: 969204 - protein, 169 aa, Homo sapiens
TLVSRNSRMCCPPSYGHKGPPETGSCPENPEFFSPPPMDVLRDPRCGPRKNFPLGDAPLFSWAGFHPFFQRTLQFQSNFREPGGGPPAGADVGQPSSPPAQLGRLGFFFAEKCELTPFPHGQHTRLWKNQVCTSAGTLVMPHLLPPPWGYFKNNRFTPPHVNYMRQHLV

SEQ ID NO: 969205 - protein, 86 aa, Homo sapiens
LFRAKSSAALFQKCETPKRSYHYLSPGETPYHAHAPPMYWAPPAHPTTVMKSQNPSPLRSFPKGAQKCFLFSITPPFGDQGPKAPD

SEQ ID NO: 969206 - protein, 72 aa, Homo sapiens
WEALVYSYVGHVDVVTSFFHVPTECGTCRKRLLNAMALRHWGAQNMCGAKNNNWGRGSPPPQCRVTVRAQYM

SEQ ID NO: 969207 - protein, 104 aa, Homo sapiens
TAVVHTVCWNRCMSRRLVRCFPPSVVPARCLNLGAFFVYAPDEIRGKTLTCDVGMFQEQAAPVVAPVVVPPMCVVAQTLREKTAVCAKTPQGEEGLEAKGRPKG

SEQ ID NO: 969208 - protein, 237 aa, Homo sapiens
APRGCLAALAPLLLVIPVSRGFLLCAVCHCDTSSVGCSPAVSFGVTTFFVVCLLSPSSFRCRRGFSSTRCGGRLPSRHRPRQATGSYEVRGFFPHQGYFWFASVLTVGGDITEALSLVGWFAPPATFGDSSPPWSLPGVLGAPASSGSAAAGAAPPPRVIVDIWRHSYDGAARLVPSALYMSRGRPQRSDFSPSAGFIRCAAVHFARIVLYIRRAEFSPTWLTTHQLNTIPIAATIQ

SEQ ID NO: 969209 - protein, 34 aa, Homo sapiens
MVQFLSGTHTGCPPTIANRYLEDPSIKATPTNDK

SEQ ID NO: 969210 - protein, 50 aa, Homo sapiens
MRGAPRPRGDTTRPLGATLTAPPPPRGDGTHNHAGSAQNSPPQRRHHMKR

SEQ ID NO: 969211 - protein, 112 aa, Homo sapiens
MTVGCYSLWDVLWGACVVCAGIFGEFPCGCRRNSCVFVEAGLVHRDVPVGRGVPPRPSPRESSVCAVGVYPPLFWGTTGDNTTSPLIHNGPPRDIELILVNCSPPNVNCSCS

SEQ ID NO: 969212 - protein, 132 aa, Homo sapiens
SRRAVGSSFAPRRCMLPSALWFFSFVGSLCEGGAWGGSGAYGGFPHCVEEPFFSARCGDLSLVAAESSSNGRWEWAPPTCYGMLGCGRAKSCGVGSRLVLTEGEFRLMHSSCLWFPQKMKGRLFLAPTIRHR

SEQ ID NO: 969213 - protein, 160 aa, Homo sapiens
YPGSTSRGLLQRCSPPYGRCFSPPFRLCWLLWICAGSTVCENPKGVRLTSQYARWCPLLPPSDLCHTRIAPCHRLFAHICSVFTAAPTEIGNRSPHIVGSRRNNCGEGKKWGGGPPLAVTFRAETPPTARPYISSSRHFTSACLYQGSTLFFIFLAKESF

SEQ ID NO: 969214 - protein, 108 aa, Homo sapiens
MLLACVWVPPPPLLRKTPLCGFKTHTNIGLGCPLASNSSNQLCSAYTHTPTGAPSINKIYFFNPSFCWSTLKIYLICKTHISDIQPECGAEKLYCSTAEGLPLCFYES

SEQ ID NO: 969215 - protein, 211 aa, Homo sapiens
AVLPGASSLRCFFRGVPPPYGLARFPARLLLCDRVLNGATLCRRDPKGPWLQVLSRRVGLRPRCRARRGETFPGAPTRARALLHFHHSVLYLSFCLLHRGKAKKAVHTRWVRESEKTMGRVKKNVWWWDAPPRDNFLVRVNTPTTSRRTQGYSSRRAVNPLDYYLLVLPIFYSFVSHTCDLCISVLENPPYFFFIYTPKHKKFSNPPKSKQ

SEQ ID NO: 969216 - protein, 113 aa, Homo sapiens
MCCGPPSCRALFRWPGPPHRRGHTFSESPCLGELHCGRFSHARTYTRSLTSKQDNFLCERPHPLPVGLRHTLGASVSTPPSVAPLTLHYCSCVHHESSRPCMCIYSHVSPHKI

SEQ ID NO: 969217 - protein, 78 aa, Homo sapiens
ALLVPATPLVAPHPYFGNAWQAPGAVSSVRYPLVGPRGVSPRSALVLSPASRPFYSPCGDTADEGAARCAPHMSKTTT

SEQ ID NO: 969218 - protein, 139 aa, Homo sapiens
ARLRCAGALLGVARSPVGLVSVFLVFVFGAPSVDCRGVVVVFERPRAYVAAGDLQCVWVATLPVLCKGRYFPVVAHDPPTFRLQQYVSNVVTKNVYFLFMHKSTPCSRKCGVLTPLFVITCAIIMWGRTYIDEELSSSF

SEQ ID NO: 969219 - protein, 115 aa, Homo sapiens
MVSLSNGVPFRHSYYPRCSCLWCFFPRRRRGLVTPRRAMGWSIIPPIRALMWRAARFPRFVWRRRIGSCLPPHTPRPPRLLYTLALVCICAQPVLRTCMRSPRVEIVRCALSRTM

SEQ ID NO: 969220 - protein, 64 aa, Homo sapiens
MRVHALLEPRLLNEEDDSGAILMPPVGRLFIYLAKQAIFYACNKMISVHNKIGEEETDTTIDQE

SEQ ID NO: 969221 - protein, 238 aa, Homo sapiens
FLEGSLVREQRSAPSTILWGSPLAPPFSVVNGLCSSTHRRGLFDHTVAPHQIVALYLALTQAWFVFTHRGPLMVIARGGSSRTRFFGPPHGGGPLREGSMVERAWGPYITHEPRLQQLQVRCTSDIMAPTPASRERRTSCGRSTPPLAVSTHAPGSHSSWCGSPVTCAALLAGSYLFKGVIYKGAPDGPPGKQMAPAPHDDTHPRVSPDHARRYGLLLDERGQEREQESYIFQNKRQT

SEQ ID NO: 969222 - protein, 125 aa, Homo sapiens
SKQTGGIRPPEMGCANAAPVPHLGGVRTPNLGWPRSPPVWAPPTIFGWAHTRDAFPPFIYFWGSIIILVSYRYDMRLCGLQIVAPLRTRLVLLADGPSRARRRAPTPSCCCAHARLERCGTTTPA

SEQ ID NO: 969223 - protein, 106 aa, Homo sapiens
WGKILAIESFPSNQTGPGQSCPEAPRWAPPPKGSPVFYVTPTPPDPVRLVGTTPSACLRPTHKIGPDNFFGGPSDPAFGARDLATASPQEYPLWSSRGTHTLEKNF

SEQ ID NO: 969224 - protein, 223 aa, Homo sapiens
RTTNCQPVGISPGSARDKKRGSLGKNRPKLCGRPGYTGDDIQPAHKGPKQPRRLRSFRRPPLGRSLNKPPPGELSLPRPNHHMFLGDPPPAWAPYSFTCRCPSLSPEGHPNLWVIPRDSRYPVCEASCQSCVLVGVASPPFFSRAQLCVYAGSPDTIPRKLRLLNKKSLGIPPRFLLFESPYITLFSHHRKSCLLTPQVLRGVVIDPPIEQTSILPPPNKEQT

SEQ ID NO: 969225 - protein, 228 aa, Homo sapiens
GRSRAGSGPTPPVRSPLVPQFPWGEAPPVRHNTWGLFMSIGPDLWPVTGVTLHAGRDHPCGRTRGRPLYKHDRTRRRIAHTRLLHRCPGQDTKRHVPPQQPARAGASPLRPSREKRVVVLPGAFLWRARPLSAPLSWGVPPPSRRYMSLYRGASTLPRAFIAESPGGPPGRLRLVGPLPAEHAPRPPTFFLMDSPWRSKGSHLRGAILPHVCALLLLSLYATTPPCYA

SEQ ID NO: 969226 - protein, 134 aa, Homo sapiens
MLFSPSGAPLSARVRYRGCSRSPGSALAPFRVAALPLYAPCLGCLPPQVPSAPVWSPPSGRPNLAGQHDFLRGALGTPSSPGGAPTRGATPEGWAPHPPTSGTTERAPAGPPRAPPGPTRHPMPLATTWRGTDN

SEQ ID NO: 969227 - protein, 141 aa, Homo sapiens
RAVLGRYFGCGPSFFVLCPSCRVVGRRCLGTSVGWMWPPPQRLFFGTVPRRAFVCGFPTVSSSEWSSDAPSRLGCLRTMVPRLLPLPLSCSPFGSRPFRLPRHRIVTSKAGRVVSPADRSCCCLSGVCVGSSLMCVAPHRT

SEQ ID NO: 969228 - protein, 126 aa, Homo sapiens
RNFCPAPPRPSVEGERCPVYPNGRGGNKSVCGQARHHHSDGGSPPHQAKEVNHKRGAMVLLRWDLYIKKPAFPPRHWGRSPLLRKLLVITKTEPLVLTKKEHTTPILVLRSPPSLIKHSLLETPLS

SEQ ID NO: 969229 - protein, 75 aa, Homo sapiens
MVLSRGRGWMVERDLLGTPRFVTDLSRPLDLLPGERRRRHRHDVFDVSCYSVKVFEPSLPPKNQVIFPPEQTETQ

SEQ ID NO: 969230 - protein, 145 aa, Homo sapiens
LSLSPTHTLSHTRGPPAGLYGYSGAPPRAPLGESVSVDPTLSSLSERTLLVSLRTRTLPHLLSPLLGGGPPSLGQRLLPRAGCGPAPRLVGVYHVGRPTHCPCLCFFFAPPVCPPPQSVLWEGLSLGETSRVCYISLRGGVAHPA

SEQ ID NO: 969231 - protein, 114 aa, Homo sapiens
MGYVGCNISTRVKAPLYLCVHVIRTTGVDTYITPRRTIESQFFLMFIIEERYGSSCAPSPLVESNFPPVLGCGLPPSTRRVRSYGLCPSLRYARRERGLNKGEKKFLFRTETKH

SEQ ID NO: 969232 - protein, 109 aa, Homo sapiens
ARPLVWSPPAPLCAGILVGRRLRGSLSLRRPLADTAHHPSHVAGGSFWAWRPPPPALVGGLVCFCRGKIAAGPTTLRHAYLSRRDNPPTGAIPPPLHLPFLSISYSSIG

SEQ ID NO: 969233 - protein, 167 aa, Homo sapiens
MGKASFLSGEYLPPWGIILPGPHMVSAPTTNWRLVNGAGTFVCPRPHYFPPGSLIKSEELNMDASFPRGPPSLLKTRNYWRASRWRPRADLLSRTTRIDRPPPTISPRHGWEQNPTGSPPGQDPATRAAADHTETNSSGSVECPPPMKRAIRHFVWRKAYYLPLLPI

SEQ ID NO: 969234 - protein, 183 aa, Homo sapiens
TRGAGNHPPWWTKGAPPGGPNGKGGPCRSPENTPVGIGHRTNPAITTEKPCTGDQALVATEGQKISGAPPQRLQTGVKRDEDPAPTPPRRPAHPFLPRACESPAAHLLRAAGARRSVSPVCPPGHPRPPSASPVLAGREHDLSSLRPFRPPRPCPLFLCGVVLCHSSLWGGKKREPFLNSPTK

SEQ ID NO: 969235 - protein, 225 aa, Homo sapiens
MSSNDCSQPEIHHALYYIVDSQKYSTRNQFYDSCKKLLLLIRVLTPQWLVLYKNFSLFNKNRGNFVWYHYCLYRTSNTTAAPINPPQAIWRANHAMKPSHIRARWSTSSLLVYMLLINKPDYFSPSDSLSTHPNSFLVRSRSRFPLAVALQPVLPGLSAIQVQNIRDAGNFVKTRDHWRRIAGQRQKCRYAKPKHRALYTARPARCRGQTSPRSHNSPKSNPHKT

SEQ ID NO: 969236 - protein, 287 aa, Homo sapiens
SGVFVRRPENNSLVFCGGGPPPPPTCGGALASPTSMRVGEIGRPPLSSCVSRCAPHTSSRRLDALSLCSPPACTPPHSGAKTILETPSSSPRFGIIFLGRALPPHKMVDAHPVVPSHTRRKDTHRGEKPLRDNVRICEEGASNQHPMGRRINPPGQGATPPTKCREGPPPLESLFCSSTRGCFTARDNRRTHSATHTVASPLAGSHHTVRLLSAQADAAPETLSSPEDKGCLSPSPRTDANNKTAPNILAGPPTTPLWVNNGRPEGNTCASIVFTNCQKLGPGKTHK

SEQ ID NO: 969237 - protein, 281 aa, Homo sapiens
CLRRRYGLSPLVGLEALGSVVAPQLLLEWVGRRTPPRGRANGGRRGWTPAQLVIARDLAIDEVYPHPLGGPPCYSVCAGYICFGQRHSFRRARGAELPTKPPGAPKRRGASVREVATGRTPTHVEAPRDGTADAAPNGSTALPCRDGAGHAPPACKMRAAREREGGVSEQTVAFGGPPGARRESPGRDIALAVIETTCADDTPLHKCKRDNILRAAPHGQVYHFLWRREERERLVNSIVGFDKSSSRCLCGQSHSMNAHIRYSPDRRESAPRKIQNERQHN

SEQ ID NO: 969238 - protein, 195 aa, Homo sapiens
FIKRALCLSPLFGEVLFNQASPRCSPRGSTLLPAAPPLKRWSSHGWCPLCPSRYGAHLSLVGVALLTTAPLFHPRARWSACSLPRHVSLPQRVYHTLPPPPCAGTSLRLCGIFSPLPPGLPCNNYLLSHRSPHAPFHYSTYELLSPSPTTLFISTLYKRPPCRLLLNLSLYYLPLFEIYHLRAFPSYDCPYIVVA

SEQ ID NO: 969239 - protein, 166 aa, Homo sapiens
GFFPPRFAPWCGPPVPLTSPSFCPPPAGFRPPGGAPPLFYLGHPPRPPCYCSAPGFLCHLCFGGVSIVYRPLRARVPPRWIFTGSPPLSHLFSRRTFGRGATHTFCCSTPAVFPADLRPPLFGLTPVPPHYVRCPSSRPPLICSSLSCSLPTSARTLWWFGTPAAL

SEQ ID NO: 969240 - protein, 68 aa, Homo sapiens
MNAPPTNFFPPPLKEENNPLFMVPKSSVVCFKLGENFCVVGYILFCVGVEQNLLFLLVRAVVRQKNRK

SEQ ID NO: 969241 - protein, 147 aa, Homo sapiens
RFLWYTFAPRRRMMWRRSSGKPAVMDPPFEALISPQARGATGGSQWKLSNQEPICGEGHITQGGVTMFAAKCALPQWRTFRGERSSSPVGWNTIPVKGFLPPGPKIRAPFRCGVPSPTGVCPQLSTVIGPQTPFLRKLLQEHSSTRA

SEQ ID NO: 969242 - protein, 279 aa, Homo sapiens
MGWQKLCKNGPFRHMVRQPPGGHNPVLGRIFPRSVPGVYYPGRLWAGLMSPHAGARTTVLLRPPPRHVVSVSVPPQQVSCYGSPLPFNVYGGHPQPHRSFVSASSRFWWRHKHSRAWAWGPNKKVHAARPGVMASSTGGSTWRHEEAALLYRLDQSVVCFSPNPQSRRLFFVVRQACECRHHKTDIGLHWEASKAKIYITLESYETRGRVIAPPAAPPSSFHKAIYGPKGPGNEKKSSTGAARSNVCNFSHKKGKLARREGHPTIIACRFTFLPPPPQH

SEQ ID NO: 969243 - protein, 56 aa, Homo sapiens
MTSAIHHNRPYNTSKRITPYHPTPEHTGYSLKGPHDRQNTHPMRSLELARQNLTNT

SEQ ID NO: 969244 - protein, 114 aa, Homo sapiens
MTASTATTASAVDTPPPVMSPPRVGINALRGGKTSWPLCDKKRTPRLLIRGCTDRQVRSFRILHSEAHSTIHVSGHNASVISTLGKNRFCSPPTQHLVGGLHTTPRRLVLRPYK

SEQ ID NO: 969245 - protein, 149 aa, Homo sapiens
MRTYATCVCPIHPPVILGLCGRLNNGVVLRLPRDAICRFVHGFTHGPRGQSFHVSLGCRRYPGVLSRLRKSRCERLAWKPRYLWTPLFLCTSSLMNFTNGFPTPLRLGEAPLSGSLEVMFPRLSYFGDLCSAIQYRINALGSRYTILCA

SEQ ID NO: 969246 - protein, 174 aa, Homo sapiens
KETDSSSASAATPSKKKSLIDQFFGVEFETTMTTVQNLNEEEVSQQERNHHTSSLCCFINQASHTYLVHRTLKLRLQEEITKTVSKRLQQKCLVYQKSSKISRLPAYLTIQMVRLLFIQTKESVNAKVLNEMLNFPLMSRYVLNCCTPATFKRQTRALFDPTFKDLEDTPRDSA

SEQ ID NO: 969247 - protein, 44 aa, Homo sapiens
MSDTREGEESTSDYLEKEKDGSRREAEPPPPPPGGTKKFSPKHD

SEQ ID NO: 969248 - protein, 108 aa, Homo sapiens
MFKPERAGEAFGPQHDPYASARLWVHQGFMRAMSVIREPLVVSNVNQNDYSVWCGMYYTSSSKMLQRESTEDVRYYRHKVKLNCGLMVSAKRKAAAGVTIGKLVVKWV

SEQ ID NO: 969249 - protein, 412 aa, Homo sapiens
PGTLHRARTLRPRRGWLQTRGHARAPGQSRRDLEGEGTAARNAPSLPSRTDTWHSPAHARAVSDGRPRRTPRPEPKKTLQLAGEQAGAALPSLLPHETEGHRDASETRVNPVPLKNQTALGTNPLLITPGTQAWKSRKGSGLQTPIQDTSENPDTSFLFPGTFPESSSQGWITPRDSNQSRPTPREQETSDRSRHTGRGSTNLANPGPWHSIHTRQELENPGATPQQAAHPVTQTYTRTHSSSSHNSCTTDPPLFQAGIDSLDFSGRPRTPNPTLWGPPPTTNATSLRWAPTLPMSFPCNLCHRNGPHTRTKRPLSKRKGKARTQHTTPTETPQKPVQSPRRQQPAAPGANERHPADTAIAQGDRTTHPVATAPCSSITDLTAGHPLLPRRRVRRHTAHSTTPTQTAPTHYP

SEQ ID NO: 969250 - protein, 184 aa, Homo sapiens
TSWAYGEDERVRRRKRINGLYGATGAPWTLPPEGFIFRHSWVFWEQHCGTGTYFLRQDYYVQRVLDYTRPSIGTPQNKNHLVVEVVVIAPENTPPGRCPTYTTIGKDGMQRLKEEVGYLMECLGIHTGGTPHVAHNSLRAHKILVGSHKERTHTLWGGEHLVAANIILENTYSGGSCGRLTHDG

SEQ ID NO: 969251 - protein, 178 aa, Homo sapiens
VFPWRLHLLRGCMRCPNGFVYKGPRLASPGLFSHPGVPRYVFLSAFSWSGIISLWPSGPQQCCWFSRPRAYKGGFRPPRSASLGHRTLGGCPAGLAVVLPKKGECPFKPGPRPKKGWSEPFTRCHPGRTFRYHGDTKEARRGFLRIRGRPPCSCLENKSPTSIVNDLSIGPFHCRTII

SEQ ID NO: 969252 - protein, 43 aa, Homo sapiens
MLNIYARFPTRTIIYNSLLITCTPKNEMQHILWRTKPKKFLKN

SEQ ID NO: 969253 - protein, 192 aa, Homo sapiens
MAKTENMIRSTTDGRKRLPGPHNADKNTPGKQKPITQTPTQHPKSTGPSHRTHNTTIHSTTTITQDHPPAPNIPAQQPHSHNTSINTTGHTAVHKPTKNRPPQTQTNDRTRTTNDKRSQKHTGQHHDKHQTSPNRDHHHRHAKATHTIEPGHTANKSPQTTKATPTNTKTHRYPLKMEHPQTRAGSTRKRDK

SEQ ID NO: 969254 - protein, 224 aa, Homo sapiens
MAYRIGNCFTLRGYIGYHTMQYKRIKRTSYEAIDSEGHRLYEGGKESKWDETVLVQCRWNFIKVLKIFQMTDPCECDQNTLLNLLLEDAEMKREDSRCKAEELSETFCAFHKVGDELSSLLLYQTGSETSIKIRDRHLNLLIQKCLAQWAVYVGQSSHTPYNNEEPMLDKSAMNARHTQDDSAVELAAPVQGLQQRRQRTFTPEHTMRKNQQEQAEPTQPQHQT

SEQ ID NO: 969255 - protein, 400 aa, Homo sapiens
MGHTHRAATSKATLAATSPNLRTRGRRTSGWYLKMHNVAHCRKSIIRHKMCQSHHWHALAQVCGNIEVEGQLEQCIPIGPSKMPQNVCQAAHNSPSQHKSSQPPIQAIHQLPAQHQCSTIPQHTSAGSSAVPERPIETPQPQTYIPRPSTKDMGKEDWPRQTGRMAATERQRTFNQNDTHLHITGTSSQRAPWRTPGQIRGTRNNPRSPHRARLLGRQPPPHRKRRQTPHPREGATTQQRRPHILTPRHAQETPKQETANTHGAQQNPPQRKRREHTQNDSSRHPLRTPEGHPKGRDKPTDHTQANTANCLALHNTRQAQTHTKQIQGTQLPTPHTEVQERHNNTADTPNHHTTPNTLTTRPHTATQNSRDQKKRNEQNPAKAKKSNRTQAPQKKEDKKE

SEQ ID NO: 969256 - protein, 101 aa, Homo sapiens
RKDLVFDDRCTVEQILARVYRKLGALGSVRKLERREVIRMKSSSVGQRGCWHGSSHAGVKIQGCNITQGLYSPQTKEKPTWKVEYKQTTSERRVSLLGKRS

SEQ ID NO: 969257 - protein, 49 aa, Homo sapiens
MTRHVSSSCSYTASSESNPVKDKSLLQSSDHHFKDPAPRASDTHTRPTR

SEQ ID NO: 969258 - protein, 120 aa, Homo sapiens
VATMSLARDVAGLSDLGACAAAMDSTIRIYGQSSEDITRETNRSINKASRKVTKSMKMVAVGKICPSSERAETSSNMWMGSLALYEKADIKGPEDQEETTSLWVCPQIEDCVVLFSSSIA

SEQ ID NO: 969259 - protein, 159 aa, Homo sapiens
LRAVRKEPPAGPAPAGPPQGKPRQQTSLNRVAPIPGKNYRNPPQGLSPRAEHNSSCGAKGGRKRENPSIQPPTQRNRKGKSPPEFCGSSGIAPLAANRFAALSCGFSKSLPRKSVYIFHDEFPRRWTIITPLCFLKQQPPSNNLFPNRQADYRTTLANL

SEQ ID NO: 969260 - protein, 182 aa, Homo sapiens
LLQKMEIAKPPNSFGKAKPKAPAPSLTDCIGTVDSRAESIDKKISRLAAELVKYKGNFRALQEDERGSCKEYGQAESLASFKAKEDVMSSSGTILPNSHSTMEPMPNYTIQSLKDIKTTVDAMQTLEKYKEMKKAYKQVKIEQQFCTGILQEQLEDMMEDANEIQEALSRSLWNPELDEAWI

SEQ ID NO: 969261 - protein, 95 aa, Homo sapiens
MGVDRDSHRECFHATRGSISAEHVVSSPLGHQLVVVDPSGRKKRYSTMTAGKILEYTTSTRQAALITRSGLATLFLADKDLEPVGDNTLFPVPQN

SEQ ID NO: 969262 - protein, 118 aa, Homo sapiens
MTNTEDRKREARRNNREPPVERCPLRDSTSSIRTNITRPELDTGGQANQGSGVSKIHGTQKIVQPSIRTISYTELGKTARPFGIQSTRKRPSLMGFKKGKHEKLHGRFQGGRRGTSYR

SEQ ID NO: 969263 - protein, 105 aa, Homo sapiens
MEIYYRNHAVYTLHLNVPSACKTVDIISPLRYVDEGCHVFRRGAVFIIVREVLWFIMVSRHGDSGPAKSAVVVVEKAWNNLTYWIHRKSWSYLAKRTCRHAPGEW

SEQ ID NO: 969264 - protein, 110 aa, Homo sapiens
VHVETLACGRCTEYAYKLRVNGTSITKMKDNVAQSIYMEPKNEVPWLMPLAALVAVTWESCCPVGQDGGADDIFHVKARKVRECSSQPRTLVYVRHFARRSIDGIQNTSS

SEQ ID NO: 969265 - protein, 102 aa, Homo sapiens
MGEEGIAAGACKCGRYSYDCCISKEGCLHNDMRQSLADVVVTLGDDGKGSADRLGQTALYEQAAQGPNRWCCLTLTKLVTSLCMSSRCRPYGLNYQTSEAYS

SEQ ID NO: 969266 - protein, 147 aa, Homo sapiens
MLHRDAVVSTTVFNHHAGFEAPTFFFANKKPFVSPTGCLNLCPPAFIKPCEHLLAPKIPSPAQEICRPLCKTVFPPPCVVLYSINCNNNWLLKRFRGNVFAPFNHNRGLSTLLGAEAPEEPTHLFVGKLHGEHLCGGEATNCQPPLG

SEQ ID NO: 969267 - protein, 67 aa, Homo sapiens
VGCRVEWFLSDPCFLFLWLVWDEMSSGSYLGSAARPRDRQLSSGSRKCDETRPECLKNFILVEQSDR

SEQ ID NO: 969268 - protein, 250 aa, Homo sapiens
RAPVSPLWGSSGGVGVLNCGVVAEGALLAGWQTGYNAEIVLCCTCGFDTPCGMNSPKPECKLDMDRLLEPPPASSLDDRIVKQHRKRWAVGRGRYHQLTDTPRGPPTNILRYCSRLTTTSNCQHTNEYPVTFDNCAWQKGAFNDNDESTGSVSSHTVSLGYTPVIRHSDYPQIIERATDWDPLRIAPTSHFAGTRNPHGDLPATYYPHKASHGPSLLANTTQNTFGSHIVLTHNSRSLRSTRIYLHPSLQ

SEQ ID NO: 969269 - protein, 188 aa, Homo sapiens
MCPGCFPAKGIGVSHDSPVVLCGRRTCLCESLPRPRCMGPGWRDKRGPRAGAARSSRGSCACRDATSFGRVGLLAKPVVMRYEWRLAPAVHKGFSGSPPFWNFAGSRRAPPCIWVGRARTRREWCHANRAPRTYIVEHTDMCAGRTESILSRTPWSLQYSPLYLWGNTYGGNPLIVCRCEEPAEPQCL

SEQ ID NO: 969270 - protein, 132 aa, Homo sapiens
IPENPKFSVPPITPRKKKKKKKKKKLGADRSPTGNNLQTHNPKRGPRGPRSAHAKHGPKTGTPEKKNGLRQRERRNSYTKKIEKTAHGRATRERPSEDKTNTQGEAIERPHNAGQTNTQAEDTQKTNNEKTK

SEQ ID NO: 969271 - protein, 62 aa, Homo sapiens
MTPKREHNKREQRNTRNENNNDREEKTTEPTKKNTNKDKRKDKNNTDASNAEQQRKEAETHT

SEQ ID NO: 969272 - protein, 156 aa, Homo sapiens
GETLRRGLRCVVGTHKTDVKMMLSRAKPAVGRGVQHTDKRKKKGRKIPKLEELLSKRDFTGAITHVEFKRHGERRTRILNLWDLGLLVALFNLGCDYRKKPRGGIQEIVLAKRATPGKFVKSWVNLAGTYFFLWDDINKLKQLDLKLQKADSKTRS

SEQ ID NO: 969273 - protein, 42 aa, Homo sapiens
LFLLWDKPQQGEESPPAGVIQQTGETTILSVYSLFLINRTRN

SEQ ID NO: 969274 - protein, 305 aa, Homo sapiens
EFFARYVSGTSRVTAYYQIALPAVRLVAMGPPILQLKISLLPENPMCHSPGVHYKFLQTVLLPPSPPSSWSGRGVTTRSPGTRTGFDHPCASSMRGWSPYIAPLVGDAPPAATVNYRRATGAPQGRQAPWSPAHYGTVLMGCCPPSDLNSLSDNPWSGLFRCEEAISPHEKGGRKQITHQHSSGALPEIESKKRGADYYPQRWHRPGNVSPPGVAPAVRQKRWGSSGPQGKSREIYNSGARRKPTLHTQFRRPQQVMMRDINSGRTLLVVSTRHCGCPLKVKCWFRRTNFYVLLMRQNKRCTNNR

SEQ ID NO: 969275 - protein, 547 aa, Homo sapiens
MIFKGPPRTNYIAGQPPHQKPKKCTLTPSLTNTPITSLTSEDLLEVSAHQCNLGLFYTLETRDPKVHSKRHNHAHHTHALTYYMTTSDPSPHNSRNHYTDTPLLKRALVLNLNPPIKTGIPPTTHSINQPNAMHPSQYRLARLTNSITDLTTIIISSTPKLSYHIQPTEATLTQTSHQNTTVTHTPTPFRQAASPRHIQAHPIPYIQREHLTNRAKTALHINTSPQRITMIIPNKKNDHIPPYKHRGEITQHTKRQVVTTPTSNNDHTPNIHSQPKPRAHAPPDDQQRPFTYTQQNTTNTTAEHTHWEPNTHTISHQKNYRRSIAPPRHSQPPIHIIDTAPIHHSTRSTKTNQQTPDEPILTKLTCSPNTKVNPQIVHPHTREADDENQETRIHSAQTTEETTQHKPDQPKHDTMHTTMTNYYARPAQSHKHTHHHSKHTNSDANKREAQNKQRVTKQTDETQTRKTNTHRNLHHLQKLCTTLTIIAEDTSLLSQNHNNQNRKDKHTEIDENSTTKHTNRKTKIKYSALLELKQHHNSPLHTIINTT

SEQ ID NO: 969276 - protein, 204 aa, Homo sapiens
MCAATELKQFPRMSGVRPLGYWGLVVICFLVSIDVGISCLHSTLAIVAVCHSFYQLAIVRVDGVLFSMFLLYDTQNSNQGVHEVSPMMEFKTYDPIQLDAEYLRGYIKYIMRSSQLCVVNYVGTPAKENDSALSVAGFSATSNIFVDWGTICLTSTSVQADFVGGYQRYRQLSHLNVLYVSPDRVVLDDNWRSLSKKTQLNLTE

SEQ ID NO: 969277 - protein, 106 aa, Homo sapiens
MTKRQYSSSKYTFSDYLFHSILVSDQHELNRLLCLYQYDYGGLQLGLPTMHRFDSPESIISSNQKSQDDPNPDWVDLLGKPRRNFRFLTCSDHSWGERTMKSLATL

SEQ ID NO: 969278 - protein, 296 aa, Homo sapiens
HSYVMVNAKFEEESQEPVADEARGTTVTDWLLEAILLTFYDSAAYVITSAAADGKLFTCTLLRNCHGPMPFPDSLQRMQRTLTHCTYALRRNATTALLRTATLQPQAPRAEHSAYIFYHRLLHRTATLFPVLSSHEHGPHVSPPGTTHSTTRAQLPFSVQASCCTPCLHAYYTTCALRAIHGHPAHALPTVHEAHSTRTALRAPEHCAAHLPPPNRNHRLRSCCLCPPPRIVSPLPPPSPSHPPASSPRPRPPPTSRRPPFPPPPRPPALRPAPPRTNTIHLQPRLGKRVFYHLGI

SEQ ID NO: 969279 - protein, 157 aa, Homo sapiens
MGSHLVWACVRTGVLANDPVGLPRTIPRLHGGGPGIMCVSLGWPSATETGMREGLYPLQETPFGGGRDPNLTWCRAAVNHGDNPLALHNWKRVLIVLDANACIYSVFVVFCFATVGCDSSEIARIDDSPQNRKLAEDWQGLFTRRNGKPEQSPGPIG

SEQ ID NO: 969280 - protein, 128 aa, Homo sapiens
MGAPPGAPPTAGLSPCVLCIPRPPPPKCGSVRGPSTKKCGCVLGFTTPPPWGAHTVQPLPWSPPPSAATFVVAPSLAPPLSPSLSPPTAAMRCRHDTLGGPGVVFLAPLGRPFAGPPNPPQGPPPHIT

SEQ ID NO: 969281 - protein, 533 aa, Homo sapiens
MYVYKDGIHSPLIDKQSFIRPFTMIRWPLINTFHSLYQLSLSYLDIAHLYAYHTTTTNRAKLKLLENILRDVLQALQYELYNAISANRHILDSRSHYHTREYTLSLAARYAQMRPNRARYSICNQGNTRGNLALMLRKNVVTALPTLITVEIHRGLRNLGKRATTLTENGGYSRLIGTPNATDGNNTTQNPRSIRKDARAKVADTTSISEFLQQSFPARETHNYTPYYHFRLACMGTICTTVQQHKLRRSGSQDALWAAVNALIHTIFLPDSLDLRGKSKYGYSRHSQFTELIKCPFILPSNGSLLNTTVDPARRNKQYAAANRRLLTTFITPRITRKNIHNPPHSTGPPSCAPLLGMHTAHLTRLDHTSGSQGRATPTPTRTHGTTLNQRTGTPARHQERDTTALHSKNTSDLNANTDAPHNYGESETTDTSAYRHTAGQHNSGPHRHADKDVVSQTDTGGSRHTLKYAMQARQSTTCQQVRRKTVADTSHNIRRHYKQPAAGRLTLHDNMNRLRQHPDGPTRHSVHHHGGT

SEQ ID NO: 969282 - protein, 320 aa, Homo sapiens
TPYTPTTFTGNPFLPPVSISLDQNSPASWFRVPVSHLWDMHSGRRSFPPSLLPGSASSRRYELYFVPPGLYPSCCRSASGTHLHGLGTARRHSYTPYFLLAPHRALSVQLSYYHWAYTPKCLLRHTSSYRWVPNAYIYAYITNSMTPALCMRTSQALALVAISKPLRPYIGPFTLSRTEVLNDFYAQAPHPQSQQSWQGPSFRAPAFSHEMRSSACAPRGTRSIYIVPWAHTPPPRALLRLTQPSSLCPQNTPLFEPTRGHFPSRRTAPHGDQQRTLLEQPPLGHPLSTPIVELVAPRAIPSTRTLLRQPQPFRITTLNR

SEQ ID NO: 969283 - protein, 303 aa, Homo sapiens
ALSFPIAPASVLGATTCGGLLKTGLLRRPRGAVVCHKTPFLRGHPSLGVPPRASGDFRAFIPQGADLGAPPPPVGCSGTCRLSLMRTPGIHPRRFLPEAGSVDGAWAYLLRVGPPLVTLPGALALTSGGTTFSSLFSHGRPPRFGFLGAPALWSLFPPRSILLQPARLGPNRLSNGGALSSRLRCAREALVIAARPSTPCGLSLRNNYSRLFHIPLSEITENILGNTTPQLVDPPSSFQPSVIHWEAPPPPHKRYLSLSFFHSSPPPPHIDQSPPSPTQRKDSPHNQESTAPYPDCHLVSRPK

SEQ ID NO: 969284 - protein, 114 aa, Homo sapiens
FGRHKWYNKISPLQRNCKVPQCPLYTYKWGTKLSQRFVKRPYFNNMVFPGPIVITRVHIPGQKYSHSTTSCSTPPPLHVVQPPKFSCFTPIAPFKYCSHLLMCATPPLVLLSNC

SEQ ID NO: 969285 - protein, 206 aa, Homo sapiens
MTQTKYQFDNGTLPLGAPERNHQQASRRDTRILHKKGRIKIYTKIGEHRTTERPNHKLQSKHDRRRVQRMERRQRTRHYEEQDKKETRQDDNTHTTGEAGGKDTPPQAANPPYQNKEGYTKTTNPHDRIEEKKEQRGGEATDEMRGKNERDTKKVQTHNRRGNARDDERRQKRGKREDRRVEAVARHATQQQNKKGTRGGKTTPET

SEQ ID NO: 969286 - protein, 205 aa, Homo sapiens
MRFAALAKRCWAPPPEGTWCPPTPRARTPLPPPGQGVNNSQNPPKRAYIGPHALAPTVEGQYPGRASIGDPRTGTPSGFWRHATFPLGQSGPQQITQQAMRPTRLQNDKVFCAHFCQKKIRPPLLPGSLPTILSSLRGVAILHTTPVCPTPSACPSLVISHNEPSLSKRLCVAPKRDQEVLVRNTASFPKAPGSPKSSLGQPLCF

SEQ ID NO: 969287 - protein, 227 aa, Homo sapiens
MAPMVPKAPASTHIFCCISQPTWQQHTVHSRVHTRCFHSVIPRSTFISQVAFHRVTRAALNFNHCPSHGHLVAARSILIGARTHSDRTQATLHPSQAITVAVTVAVICSHMVIKLHREPAHIKTCVPRVNNTSLPPVTTGTRTLAYRTSRHDNGRAGPGAQTTVADRRNAAIAPPSRSSTGPNRAPRPNGGVPRGTLGQGPQTNTTKTSHTNLACTRYRQHSETHSS

SEQ ID NO: 969288 - protein, 75 aa, Homo sapiens
MHVTPACGAPPGCSRQDIAARGDGSSLSIFSLVLHVHNTGWSTHCEQLGALAFPPRGSPPYNRGPKKKTPPNTQN

SEQ ID NO: 969289 - protein, 169 aa, Homo sapiens
DYLKFLCTVLLKRSSMESLWQQNRGPNSRGHPQKGSRRVSSPCDVLQTIFKSRRCCFTRRELLFGRGQREFSGPRFASPRERMSCALSGIPWRTSRLVGGLWKILALFAQTQKLEGYCRALKMLSCAPTTTLRKIGLWPPPTVGAKRWRTRQCVVAPGIASYNVTKKVE

SEQ ID NO: 969290 - protein, 317 aa, Homo sapiens
YKIATHDDRLMIVQVPAPQCLADWPYACQPSVRWTATHFQWGAYNTCVWENLEDAYSIGPRNILLVGRRLLLSYGRPGTGHWAVDPGPVAPTGLGTPSVAPHRGPPLFPLTCEMLLIQPCFESFGADPPRWSNYVPRRKGVRSMVLPPQNVLLLLMEDVRVLKTRPLACSDARNSVPPESLQGNKGSCVGHCLQKEDLPLCRPVAPWWTPPREVHPPTLGGPWRKCSFTTVHRGFHTQPSATISGTHACCVEKNGIVCTSRAYPQAPPYLAPTLTGESMATENIVHNPSDRTRGPETHQHIALVSPPGAQTGLRPQN

SEQ ID NO: 969291 - protein, 210 aa, Homo sapiens
MVASHSLFTTGVTRLVLTTAVEQESAVTSSQEVAAPENQGTAQAHPVSTEETTHGPYIQETALFNYPSGASSPTCEASHALNLICADFLGLHTVMLHNTRGTKVVRAKQRDKKTVVDQTEPRNAWGKSGKHSCMLTDPGGYSSPPHARAPPGSGVTSPQSRTPPGGARTQTRLSLKTHSGMEKPQVADTNLSRVITPAGHPTDTQGCPRK

SEQ ID NO: 969292 - protein, 262 aa, Homo sapiens
ERTRKEKGTRTKKRVVLCADRETSVERAAGDKHVGRLVQRHTTCEASWVCPPPAIVALGQQSRVPLQGGHPVSGPTGQAKGRVQRGADRIVDGAPPRFSHGGFNRCGCRSTFGAKFNARVSRQGNHRGQLFVERPAPGAWAKKIINYYGPHQNEVTISFAGEPPAVIVSFFRRANSFCPEKPAKICPRNAVGPPWSTFVSCSLLSVRRSRGRSVKQASRGKTTPEEVYGKRVANECFKCSKKGVVQTCAKSQDTTTVADTYP

SEQ ID NO: 969293 - protein, 241 aa, Homo sapiens
VDKKKRWETVTPLDRGISGLPRSHRGRFAHPELSTTKGTSPDRDQTKPPRVSRNPLGTEAPPGELLAARPGVPRPPRCIAPGCPLIGVPRGPQLNKAQLRGQEKSVGPAFRDKTWNGPTFSSASAPPPMRNGVPGDKHQLGEQFLRPNHPPGGGLHALFAKQANPSPRGVISQQPRATTNSSGSRQQDHPTCRATMLQQGRQHNVLPRKRLHPPAFKHRGGRHGFSDPWCDLQRGSISESA

SEQ ID NO: 969294 - protein, 208 aa, Homo sapiens
MVVPSIPLDRPSYSSGCQMISPPTVFETSAPPLRGLIRQFNVAVFRGTSLSYVGVWCSSNPPVCVYLDPARRRIVESRCRVCLIPQTVRIRWPPRPPIDWLSLIEPLRAAFLYMRRTKRASQQYPLHIDCCLRAIIPQKCSRGGSPHCATLLRRPCHTNCVPRGVWLDTDLDESRRLAPLDSLGRRALAGDVLCDDPISETIRIPPKK

SEQ ID NO: 969295 - protein, 192 aa, Homo sapiens
VNTKALRPTKASAPEEPNSGPETASPNDPFGGGQRRATSPEVVRNKNSPRRASGTHMTRPEAPTGEPGIPQGLRGAPGRPPTPTMDPPRRAQIPKWPRSSSAGVHANKRSRSPTRVTRREMLPCRKETPPQRLCIQYSPAQVAPGQPSVGHQSTRGELRPKDPRERMSGPSREARGGTPPPQQTIFGRPNND

SEQ ID NO: 969296 - protein, 112 aa, Homo sapiens
MRAGGPTLRPRYSGHKYRCQDVDVLLERCQHKKGVAQISCNRRDQSCWAVFPPAKCLVSLDPRAVNIIFWTSYKQSGNIAVLSKENILPGAICCTNAPGRPGLFGSNGQSRY

SEQ ID NO: 969297 - protein, 204 aa, Homo sapiens
MPSPCVVGGSGHALLVVLVCAARLRVLCSAGFPFRPIWGVYLRRRRLCGALEVIASRALSELSLSLSTHFACSGVCSPSHTDVVLALCKTGVSMPRSFVGRRPGLRPRARLPVRWAGGGAHRSPPCGEKRFGASPSLRPDSKVKAPVAPAPSSQEVAFSPAGAHAASGERIRPHYCFASPHWHSEAFQHPPTRCSPPSIRASTV

SEQ ID NO: 969298 - protein, 122 aa, Homo sapiens
RLWPKKFSPRVRPTVSLWGTTTIYGALCEQHSSLCFRETPNLLVWGEAKRFFQDEFPVRYWVFNNKTECLTVPVMKLRKYMRAEQSARRAPHSLGVLENRTGLSAMQRDARKQKYVMWRALN

SEQ ID NO: 969299 - protein, 111 aa, Homo sapiens
LLTGTIFVVGGPAVAEQHVRGYNLQRVFVSVVYHAGAPLVWSGSTPPGIISSGNISSLRASPPGDRSPVYTLLVEKQKRAKPHKSASLKVFPPPRSYVLCAYERSRGGYTK

SEQ ID NO: 969300 - protein, 288 aa, Homo sapiens
RVLWKHTFAVGCGGFPALGPPEAGSSPQYWALCGCGTWGGSCLGVGVYEHPHVCCCAMALVGPLSQEWYGAIRRGARHRKPRTNDGVAKPHCPPRFERGSIPPGHHRRAFVRVPLGHRPRGSRRSPLLQRMYSPARLLVSMQSGVSSPSRYHMLAQPCLRSLSSARDRGGGAFGDINRRLASDPCYKCYDHVSSAALLLQCFPLVSTHIAIYSHSIQGLYTSAVSGEVHGRPPVEQTGGIVGALDTGIKDCCRRPYSPPLSNEPPCTRLILGQQLLRNPGTQYAPTTC

SEQ ID NO: 969301 - protein, 56 aa, Homo sapiens
MDQRIAVCALSCVLFCRCSLLLHACAGAPRASCRRPLHSRVSATPPLIFVEARSPL

SEQ ID NO: 969302 - protein, 233 aa, Homo sapiens
GYGSPESQGLGPGGPRIAPRGCVVSLRGLVLPSRVCPAGPPCGGAPRCQLKPMLGGGRSRCSPPRWVTQLLLGSPPTSLRLRWAAPLSWCVAPSPAPPSWGARRRLQRLARRLGAGLSLCRTCRSRRWLPTGGSLPSTRWVPRVCRGNYVIRAPAVVPRRGSIERVSSQCFIRRGSRPPPLLLIPRGVTRPGASPTTPSLSISAVFTSSKGNNIGSYESPPVCSDILLENVHQ

SEQ ID NO: 969303 - protein, 164 aa, Homo sapiens
KNSVKPIISALAVTLDSNKRLLIPEQSVVGLTNCRGLPMTRQAGPAQMGNLLRKGNACFVVYNTSSSKGLLPRVCSKITALFAVVDLFNLSPQPCYARRHMSSGLIAAPETPLVLAKLCPPQETIQHDGSNLSEKIIMTPLLPPQSEPSSGGLSSQYGGNLLCV

SEQ ID NO: 969304 - protein, 198 aa, Homo sapiens
ASGADFCVAPRGCPTPSGLSVWPISLPALAPLVYLRCGRVPPGSPTGSPPPGITWVTEAPWIWAPTGPPIPRPPWEPLPWLQLYKEPPAHEVQKSNPGVLLQTSTSPSGYLSGCIVAAPPARRVVLQVHPCRMGCTPECLINRAQQGITSTSYHPHISTYKASLPHSSPRKLPLRSILPPLSPHEFMLGAPPLFLCLC

SEQ ID NO: 969305 - protein, 286 aa, Homo sapiens
GGCVGVCGFVFVLLCRVCRGSPVGGCHAGATVPDCVFAGRHTGCSAACGQNRRGGWPPILERLGRQGRPLWFGKEFRWLSTPVSEARLVHEVGFPHLGVGHSLLRALKCNNHHGIPRAMLSQNALATPKKGSPQGPVPHETLAQLFRLTEILAEMLDNEFLFTPLGCLPPPLYYIRSRRNPAFYGWSVYVRMRPSLTVDQLENRSSRQITLDAHVGRHSVHTEYGTIRWRRPTRSFIFFSSVGTVLCMESVIITDPEDFFLGGIHSWAPTNLCPPGVSTPIKRPHN

SEQ ID NO: 969306 - protein, 169 aa, Homo sapiens
VARRPNGSPRQLPSRWFDKKPPRNLRAPHRWWGIIRPPPSPGGQQCLQTSAPRSCGVTRLRTPPLRPPGPVMVHNTPVVTRGAPDLFQLAPQTDTRWARGGQPPARDYPAPHLAERNPGPSLRDNHTSCSRGPTLRRQHHQQRTPRACSHEKLRTNIIISAPQRQDDVA

SEQ ID NO: 969307 - protein, 267 aa, Homo sapiens
RPFFQGQENTQAGEPNNTRGAHPGVNRRGKYCSARTVPPVYYASQGGAQPRHNVLTAHAPRSVKKQQPAGHSEQRRRTPPGNTTWGQLPRLANERNQPTNLRGAKPPSSLLMCRTYRGTRTLARGENLLATIFLAKDRVIPRKGVFHNIATRVFAKHYTPVLRAVQTRPYTFVHNNTPPPDARRQAGRLLKPRLGHSNAHGGYSAWCENIESRGALQLDKVTLRWLFSPVTVTLNMSVRQLVAKLLKFLLWARTTTSRAQILIKDNL

SEQ ID NO: 969308 - protein, 142 aa, Homo sapiens
MVAECADRGGRGRSHSKRQNPETAPCHDALREKRDVHVFPNTWRTTVTRGENSGSHGRAQDHPLTRHPTKAPFNLDVTDDVEARRAPPPKQAGISPLLILPQAGALRTTGEYTGPAGAERPGCARSAPTGPKGTHHFNQTKT

SEQ ID NO: 969309 - protein, 174 aa, Homo sapiens
MARQHGLANVVKHMELTGLPCAVFYKEAPPIIFFRALLREHLWHTVDCPRQFQRRPSAPPGTCGVHNRSPLPRGSSGRQCTPQGTELKKRGVVTKAARTQELWPRVTPEGTPPRRSWAVSPLHKGKLSWALLEQGKNIPRKEREHANKICPETRVSGSQTTPAAPPQGRPTEYA

SEQ ID NO: 969310 - protein, 159 aa, Homo sapiens
MGAQHHEWARDAVSPPQQGGCRLVARGPPRPRGWGPVAPLEPPDRRATRRRGPKFPPENVLVRKAVHFLHRAEVLPWRAPAPMRGIHFLELPRSTETKYSKYEGKQAPTELLTRNFRGFPPTCFRQRPNSNSLHVSRGEASKRSRCFLGRDMKILLLEP

SEQ ID NO: 969311 - protein, 443 aa, Homo sapiens
ALLALVSWLHSPFVALSFPLAAPLHSRWFAPPMRSPGRPVSHLSGIFPSQPRGPGITRFSPPPAHPSFLPPFSPSNFWAAHCYEDTKDGGPRRSRRVGVPGSPGIFPGDFWFGPPSGSPGPKGAPPRAPLCGQPHWRPHAPGIGQWVLWKPPTVVHPRDLGKPGPPVGHTVGCQNTNAPGTPGEESPQDAYKGPPGHNLTRGGSPQILLHSGPPADFGGVPTFRGTTFAWRACPPTRVFRVSTHHEKCCRAHRPPRLFHALCERRVSHAVGPAHISHQGEGVPPRSTHLAHFSGGDPRGEARRTHRSTGRVPCTGHKPCTAGLKGEYPRFPNSILLSPGKALGPPKKGRDQFLPERELKTGHPTLRPEPVQCPLRKRLIRKEERLEVTHLRERERNFQSLRYFSVWPVPNARLFGKRAKRAQENPQNRMLKRKNKAPLGTWDP

SEQ ID NO: 969312 - protein, 106 aa, Homo sapiens
RQDGGVRVRGGGGGGGSGVRGVGRNPGAGVQPKTAERSGSLQVGKPFMASPAEERFSPLPTHLSPRCLLKMVRGNAKRPGSRFCPVDHDECPSGEVPCTGTPAHLP

SEQ ID NO: 969313 - protein, 104 aa, Homo sapiens
MVCIDIVLFPRPMCYNRCRSRRYLYALFFDEGPLGWHHKRCSIDRIDVGRAYTKIVANNIMREQCELLVSPIPSLRCCAPNLKCRKKLGKNGPEKKKINNPDKN

SEQ ID NO: 969314 - protein, 276 aa, Homo sapiens
MSDKVNYWTVTIPLAPCILHDPLLPPWRLCLCLLRMRVSSPYRYSPVSETSLFVQPAGLFFLGALPPPGSTTLGGKFLSPRVFLPPPGGFSQSGTPLSTLSPLVITQMFFSGATRIPGAKVLQDFLFPYMDTGPLWPQETLGRYGPTEPEKDQSLEMEKPRGTPSGSIPRSSPWRSLHALQTMKKPPLFERLGNFSKAKDLNRLRDQHQEIFWNKVVNRNYTTWALIKNTELAGERKNICNNPTGKKTGEKFSNTPSIHPNCYPEMPGRPYPRGEE

SEQ ID NO: 969315 - protein, 134 aa, Homo sapiens
MIILHMRRTIDRSRWTHTIVAHRYIFKYILERYILTFRSLTQRISWLGRIFSHTIIGTVSSPRVASVCVLSTTRARSSPRERQSQRHSLSCEVTPAVGTALAFSHTPCSLLRDRSSSPNKLKHTAHQVEDKQRN

SEQ ID NO: 969316 - protein, 231 aa, Homo sapiens
HLLRVVRSSIFYCVGRPSSVVDDVLQHLSVSVSSPLFLRCGRAPPPSFFCGIFFLGRHLVGHPHVGGIYNPPLGCGKEERPPPLSCRWSAPPYVLFVSRQGCFSSKTSPLGPQEENFCATHAVLLSEGTPPPLYFNEERRGCRPSPLAGGITPLSCRKKTLTVVWRRGAPPPLLPPPLHQKSWEGDTSPPRRDTHRQTWWVARQQRVATSSSREPHTHRRWAPFREKRRVN

SEQ ID NO: 969317 - protein, 210 aa, Homo sapiens
LCEGPPGAAVLTPLGWCISPHSSRGVSNRLLRARCPAKQSVEATPSFLREPRPPFVFSFDGTCLVADTYPVADSLVLRSLGPPRHLLGPSWGAEHMSGRALPPRLVVVDPEHRVPSPPLGAAELFRNLFIKKAGGGYHHQLGNRRRGHLDKTGPPAGWHPPLGAPPPQTPPGRRHIKRRASPLENVLIHAPLEKDKNRIIPRVSKKGETT

SEQ ID NO: 969318 - protein, 113 aa, Homo sapiens
MKCNGPLRLQQHIFICCGHHMLHPARVSSPPAAPLHSWRSPPQMVIAARRRRERKSWRDCVYLFRSGYHLSERQQRGFNTWGPLQYDEVVSPPVVPPMGSQNFPPWPPRSRRG

SEQ ID NO: 969319 - protein, 133 aa, Homo sapiens
DSSLFWRSRGNNTLSGSPKRLTQVMWFFQPQQWGRARAVRCCPKKGTPWSCHETGEPSPSWRTRHCCAVRSIPMKTTCCTVKQYLGSISPLRWKFHLLERPQVLSVLSGLYEGRVLPHITTSRLWRAILSVTI

SEQ ID NO: 969320 - protein, 108 aa, Homo sapiens
MCAHHSVRAPPQRCIETPLSDAHHPPPPSTQQSEKKESLSTPSAEVSLPHTHTHSSPPHTLLFFLLPLTTSLPTLKPPLYKGRGPLGTPPPFYCSPIPIKNPLLCLSH

SEQ ID NO: 969321 - protein, 282 aa, Homo sapiens
VVSPLLILSSHSIPSTVFCRLSDGGWWSWFFPGAFDAASVFMGSCCLFSCNRACGTFLCSLLTVSCVFFFVVSCPPPGKWAPWGHPLLLPSYCSLFRALWPHERVFPPRAPRVVGEHSVAPTPPSSVLLGNKNGNECVLGLFLNPSEGAPTGVSPPRHPTPVSPFHSALAECPPPTTPRLFCSSLLSEGALSQALSPHPQAPNAPHVPPVPRRYCPGGHISRGAHNTEGRHHHTTPERGMGETHTHDPLSPSFGPRTSHCPIARENGPLPATPRFATQKRRL

SEQ ID NO: 969322 - protein, 136 aa, Homo sapiens
RKQARNSRCHWAQTNWGAKTRGPGPGSTKWGSRTVDRGGLTGAGCTNAARTIWAARCTARIERPRTRGSPSCRRVGPPGRQPQGFRQTAARPPRVRAGGVPRRSCTRRGPPPQKCGKRLKQTLVLSRGAPQKRQRQ

SEQ ID NO: 969323 - protein, 118 aa, Homo sapiens
GAQTKSRLAARGSLLVTPPNEEWLKEGKPKGIASNHCGAQKLNKCAPPARESRPPEAVADGLFFQGETHISGDTWLQNRPEVGKSIGNFEARPLDYSFAQTLYFEMSLRRQKDKDFLL

SEQ ID NO: 969324 - protein, 521 aa, Homo sapiens
MVGVVSVTARFWSLSFVHLLALGCHITCCASCGGAPPRVRCSSLFCESTALPRWVYYFHKKTFAGELSESHGFSLVLHGGCAPPLFRRFFFIEGDAVRRPRGVRPIVFRFGTTHEDDEDPSPRILNGGELFEHKAERWGRPPNFVGILGSPVSLCPPLVPHHRPVFAADGVLRSCFLPPPKGALYFGAARPSVPPGPPLVPGPLFLRFAWGRLSCAPPPGRTSVAAKNTGGADRLRVFLLKSPTRGAPLWEKEPGGATTPHRATATVNLGKGGLIHKDTRLCERKKGGARTAPSWIPTTSHSSHGALLTLHLKAPPLFGPPPPLVDASHRVFGPTSGGRLSPQAPPRRPTHWSVSWAHANSSRGSSLASHTSQAGFSPRFTVKCVGPCGPAGVSASVLVSLGLSLVLPVATESALVEARGVSTSFEGGASSLHAWCFPTTSGGSGPSPLPLIPPFPSHGLEARMGWRLRVHGFPPRCFTPHLCPHLLRAREGTWGRGALVSRFLFPSGFWVFFLVCVLDSR

SEQ ID NO: 969325 - protein, 114 aa, Homo sapiens
MYCKPTASRRSRTRAPWQRTWGPVRLFPWRANPFEPLLAPCLEHLASPYTCPWGFQAVPLLCPDREGLWGIPTRGRPNPFNPTLPNHEPPTPLEFSFSLQSLDGFGLPQLLLIF

SEQ ID NO: 969326 - protein, 183 aa, Homo sapiens
MVFFPRTDDGTGPFSTAAITKCISLRGITPLMLLTAIDHANIHTSCDIQLSPRDITSNCARATLLVNKRLFFPAFFLSWGVDAPPPDCKVREIIMHRYFSLTPFLFASQFAVDHSSKRTLVKRFCWDNDNLWYLPTVGAVVLQTSSDIKCFSEVGHTPVACPARDVSPFHLHLVILSPHQTTK

SEQ ID NO: 969327 - protein, 218 aa, Homo sapiens
SESVIVYCCLLSVCLLLLSAVFLLSMFCSRHAWCCGLVVSVLSLSPCWLLSVGPFSLPSRPVGQPPVAGPRVLFGRCYVHAFDPGPSIAPVRCVIPCGFIAYWSSPVLFFVTGEFCLSLWARCAIGDLCLFLQNCPGLCGPTSQFLFVSAGPRGHAFTMSDLPHSAATLSLMVWEPGLKQGAFLSLWLHVKLKVLTFVGSQLFTHFLYRPFLAHTAGA

SEQ ID NO: 969328 - protein, 381 aa, Homo sapiens
WLHFPSYFPPFSVRFPVPLLLLVSRFAVVFACCCAACVCVSLLACCVLLRCRVVVFAVRFLFVFFVFFCFFCLFLCVIFSACLSFFRVAPIPLFFSSFGGCCWFFFLVLVVCVFSFFDCVCLVSPSPCLRLCFCVVSRARAGGVKINRKPLFFWDPPHIVSCVVIPQHHPSVFVTPLHVYLHRGCVVTHSPPGFFSIFPPAGWGYLFSPLRDTPCVHSWAPFFGSAHYYPPVLCAPHTHPPVGSSAREILSRAIFFAPHSVSLPRVVAAPTDGGVCCGAREVYFGGPPPPPHSHIFSIYHPPPPRACVVLYIEEGAPLSRGDTPVSLYEGAPPPLSERGVFLPPPAWGPPQEITSTTFFLHPAAGDNNNKKAAIVHTQRRR

SEQ ID NO: 969329 - protein, 289 aa, Homo sapiens
GGGKNPGVEPSQTGGVSNPQRLLLERAGPGKEGAGTLTGWWTRTSCLDEEEGRRQNPTVEEVPEASPARGMKQSPAKDIHVPRGEAFLCPSNHPPNLVAPGSKNDGLCATKKTRQSKLLPSKQMVFAEGNPPPPEQGALLPKEAVLARRYHAVACRNPQLGRGGRITNDLLLVKRICRFAPPLSLDDSRSKCAPAGKKTSLALTEHFLLATKKERWCYDKAVSSLPHTGGRHLHQAKQAFPPACSPKEAVRAPSRSSANKFVAPTHVGASSPPQRGFRWTLHHPVDWFP

SEQ ID NO: 969330 - protein, 312 aa, Homo sapiens
REHAPEAAPPPEGVGRHRVPRRTIVLRNSSHKDARTRGTHRKSLLKTKKPSNTFGRRRMHKVFRAPAKTGGLSVNTDGQKLTVPGGNGPEKACVHKGARGYLLETTLPCGAKTLDTRGHLRGQRGKYSPQPASRPPAAGGVPAPLRAPVIMGKTKVPGWAPTKKPVGTPCGGFSPSEPTRRHRLRYRRRGGTETSSWKEILVCEHKPLAREFPPKTGTPLARVPGGAVCTRVPCSPKPAPEEQRGTNKKVDTTPKEESGVKTRRSIRENRGKCFKKRVDNPRALLGPREGVTLHRYTKNDGHVTPKKKFRKK

SEQ ID NO: 969331 - protein, 84 aa, Homo sapiens
MKLTVELVSETRIVCKQQRSGDGWMHAPAHSFNVACGDILVGGVAHRQATLSLSMCEMKRHEVTKLMHHRERRVLLKRKPADKD

SEQ ID NO: 969332 - protein, 103 aa, Homo sapiens
SPPASSCFCIQRYFLYYPLLVLRPASLCLSRVVMYSLLRLLFPNNPLPSRYSMPGISFFTGLLLPCLWATFTTGCHKTRGSPSYSRIVQHTLSFPPFESYVIK

SEQ ID NO: 969333 - protein, 339 aa, Homo sapiens
PLHSMERGQTQAILISRSSLLSRAYYCVDYRGCWFVSSSSSSLLRWFDVPPLCISVLLYSGVSTILVFSARPSLCGHLLHAQYVSGCLHLALGCVRPGCVRPTLWVVFPGAVVFCALSPRYSGLLVYPALGYLRDFRSARRLRPLSPLVLCSVPQVCPTGLPFGQDIPWDAQLSPVLRNARWAKGRGIRVPLNQAQQRPYLGRIDVLQQPKAPPGSLSPKKWPCSHYVTPQDEVQLKTHLQPIPRAAQSLGSASPGPGQPPLSSPNEGKESQKVSQGLVVPPMDFGVSLRHLPSPSPLRLHPKGPTVAPFLPSRGSPPVHGHFFKPPFPEDEECFSKMQ

SEQ ID NO: 969334 - protein, 284 aa, Homo sapiens
MARDSSAWGRPESPFVNSRAPCAPAAKGPGRPNTPPSRRRRNRAPSQRGRDTAKRGSETQGKEPVVRIRPENTCCGEIIRRRRPPVGPPSGSTGPQFLRAPYATRTPRAPAGKPQGITCPGRISPGKDSTEPARYHPSWEGSPADSDQGIGREQPPPAATTLWGTTNELPGPASGLFGRTIRSPRAVASPDNTEAGQQRHRWLEDPGGKRCPRADKGDPKDRGWTKMVTLGRGAQARTQGAEAPPITAQTMRAGRSPAQLTSGERPNTPPGDMGAPQKKGPATK

SEQ ID NO: 969335 - protein, 146 aa, Homo sapiens
MFVCARPPLRLVPPPLFALFSPRLTIALLTYSRTPWSHTHVLLQAPHLHGETPESVQTPRSRKVAFVVFTSAAIVPWHTAWRHTPSGFPHALEALEEARRLCCSSALARGAELPRWFEAPFCFALSGGFFWSPTEGGWNTVDWNFF

SEQ ID NO: 969336 - protein, 238 aa, Homo sapiens
PGGTISASHRAGEFSVAPLGRKFSGTIPSNCWACIYRSARPPTGTFARSWTTSPPRGLFLIFPGSPACGGCFSPVELVTDPMFSRHRHFKKTRRIVGVSSCGNHTPSSPEAGASRPPNEGESKERVLTHEFEGRIRSTTSRASSHNYARGAPPATIDVLPAPGYPAPHSPVTSDEYAPRRGQRRLPLGGSNVEAAPHHADTYMCAEPRWRCHHAANIASRALTKQCRGGSEARPQQMN

SEQ ID NO: 969337 - protein, 158 aa, Homo sapiens
MVMHIRGVVLSLRWKGLRPPARLQGGVGLFVAMKRGVPTRVWGTPVHDEFTGVNRRSAPDFGRSFSGGKMGIQRQRRVFQRNFSGPTFAGDTPEWSPPWKPAWLHCSGGLSWTIHGHISPRLCPRIGLPPRLTCKQDLLSLKERIESPFLVTNWKDWP

SEQ ID NO: 969338 - protein, 217 aa, Homo sapiens
MDPNWAQDLPEEHRPCLAPWRQTASCRPRGFSEKAFINRAPVPPPSGAPVCTTMPPHLAPGIEGTSSAAREPPPLWRPHVPPPGLASPWCVFPPARSVLLLGRPTNARGSRPLPSLRMVVSSRRNTTLRSLSSTRCLLRQPACHPRPADVGAAPLRSALAERHTRLGGAPWGATRQAHTSARKQSRHCDDYERCCALRGARASSTNSMIVVPPTVDR

SEQ ID NO: 969339 - protein, 299 aa, Homo sapiens
GARSCPPLLCYVMLVASDIVLLCLSCVSRGCFSPSGFPWRAFPLFPPALGPWVPKPALPPMFGPKSLAIHLSRGSRFQSIGFNRTRFIPGSGPTLSKAHISFSQSWLFSSPQNLRNHTNGDTSVLLSVAELYWRSSSPTIALPMLLQALALSQEYRLPYLASETVLNLAFAPAHSLESPAQALSLSPTWPIEPHLGCRGYPGPRSVPIVLSGPVPGGFSQLPTIQPEETPEALELPIENLHEAQNYFAKVDSQERITGRSLYFHGHDSTTTLGKTPERNRCAMLFRQLHHGAALSLGYP

SEQ ID NO: 969340 - protein, 210 aa, Homo sapiens
VVFALAAGPPVAGSSLFLPQVGVFPSLGNDLFPGAPYPGGPPPGCSGPRVPPLALGEPLRKAAYKGPAIPVSDAVMAVLRTNARPVAVWASCNSPSKAQWVASSTRPDLKRRGALPPVAQDKCVKTGFCSSSRAILGGTVPADDGNYPGHALQGGLHQEQDFKSPPSVGQRNHRYNACPPAWERAPTQEGARHHTGRPRVAPGLLTPGVR

SEQ ID NO: 969341 - protein, 169 aa, Homo sapiens
GIPPPVHPTSGVPAPDRPPPPHRVENRSQGIARKTPWNQEARDGLSKTAPPVMPPPGHRRQIIRGAKTTSSNRSHPFRPQSQGGEATTVIGSTGPPRMSPVSLYPHHGASRITMARRNIACKRQNRQTRKAPQAPDWSPARHLEVYQAPPRPNREGPPTACGDPQSWVP

SEQ ID NO: 969342 - protein, 71 aa, Homo sapiens
RYNRYRAWLLPAHDYSPLMAIYGYSPGYRLPSGLVHNFRQSPATWVAHPEFTHQPYTEAGHPVAHPTDCTK

SEQ ID NO: 969343 - protein, 213 aa, Homo sapiens
MSLISAPVPQSPIRTSLLTHIPRHEGSQRFPLPVSTPNTNWPHPIGYWNTLRSYHRTYGRDLILSNILTITFPPILYSLGTPSGHCRTSLWTGWTTSEISTSPDWKPPISVINKYTIHQEQFCAHPWRLSPHHIGVIKPEANSPGQSYNPNPLSTRYNRPGGIHTGPMLLEILWSQTPPVSMPHLVLELIPLKIFVNRARIYPIAPPLPPLEP

SEQ ID NO: 969344 - protein, 75 aa, Homo sapiens
MMCSTMLPGFRGHLWYDHVMNARSDVSSTAPFPDPHIWWSQHLSHTHGTSWTLFMGSINDAPPTGIILVAAAHKD

SEQ ID NO: 969345 - protein, 131 aa, Homo sapiens
PIDVIALYPEIFGALLSRSRGPVGARSQNLGLSPVYTPGLSDTPFRVPALKELFRSDNSARSYRVPFPPRGIWDPIAQRLSNLLPITTYSMEGFAYPQLAPPPAGLLGKVVVPPVVLPASTFVPAFITTLS

SEQ ID NO: 969346 - protein, 380 aa, Homo sapiens
FGGRPNLCIASCCFAAAVSCYFRGSCSYSLFVGLLRCRNNCVLALCFFLLLGGPLVFLPVGALMGGPFFYRESFFPPGLREACGGHHQMGFFSSRGLFRGDVVMNMGRPLVSPVGAPSGGHHTPTCMVGSFWRGYFLSPPPCFVDTTSLLVGFFFVHTPRPPFFVLVGVASPPHYIVVLPATARRCCFLWAPIYHPPRRLGGFTQHQARVGNLFGGAHQMLFLSPARATLILRLLPWALPLFIVGGVIPPPPSLPLLGGRHPLLVLVVLLLAASTPPPRRYALVGRVVVARWWRSPPRHDIYLCARRPHYSTRGDVFSRDDDVYYIIHTDLYFLYTRVFFMWGTHIYIYVRDIPHTHTRGVICELVTHTPAREERYCEGI

SEQ ID NO: 969347 - protein, 102 aa, Homo sapiens
PPPTKASRAERARGSRTRLLWFLFSAVRVSPPLLVSSVVCCPTLLILFQSASPTLAGCVSPRSCCPPRGFLTGVFFPCASSLLCTSGGSYFLREGHPLWGAP

SEQ ID NO: 969348 - protein, 136 aa, Homo sapiens
MEPRRLDHLVVRSHFLEIPAEIATTEIISLLRVGHPTRLWRYSPFGRKIHPVPNRLEASEMYNATYDILDARPSSLYQPPRVISRARFYSKAVYQDYIWSNQNQPFQGKQKTLNGEHADVPSSDKQTKPHRKAKNK

SEQ ID NO: 969349 - protein, 290 aa, Homo sapiens
RRLSLFLPAGLRCVHPLGLFLVCALYGRTEWCVPPETEGRWVVIPPSAIFFPGGTFSASTPLKRLSPAPFFPPAAGLLFPGRYTPAPSPFFREFFSRGLPGVPTDTIGRARFGSCVVSRLLDGRPFHVSLFLPRGTLPIPSPPGLEENGFFPETMSYHRIPRGRIPPRNRGLCPPCGGWKRGKRLGSKLRGPTERSKNPLDEPRLSTCVGKNGPPRSERAPPRRGSHKVLSPQKAHPLKYTLGCSEIIVLHMENPLAHARHRGNTPVCPHTQRRKALTHTERVNTLTQRV

SEQ ID NO: 969350 - protein, 55 aa, Homo sapiens
MHNAGSFHCTRGFSPQDVFSLPPNDDSRSRVTVIFFGVHHEQSRTKKSSSPAPHD

SEQ ID NO: 969351 - protein, 130 aa, Homo sapiens
MARNYHRLSRGGHPKEVSFSWEQSFVPLRRQGVEKLGTTPKVNANSGEPLGFGPQPQKAHASPTYYKPQPRPSGEPTHGRSGIKSTQVWPHLKWTKNLNGPQYTGEHIHPHGHSLTTLLAPQRTYPTLEM

SEQ ID NO: 969352 - protein, 272 aa, Homo sapiens
LGFPPAFTGAGFPLSILTHHSVLAFSRVIPRGAPTPRCGPKSGKLYLGGPLREVPHHAGDLHFWLPTQRCCSPRVPPFSLIGVWSAPPHCLGDCLIETFRKNRYPRVVNKIMTTAVNTPGYSVYNVTGSRTTHKVRRTLQGGEASTPPESQAPPPPETDFVEAGVLPPQTKVPPWERTQSSPHPRQYPNNIWWRHVQKRDLTHSGRQLLLPAGENGCPPPTPPSTKQETPQIQAGPPAEEPGSQQRHDRGQTDDPDDVLLTRVKQFDPAPTS

SEQ ID NO: 969353 - protein, 114 aa, Homo sapiens
MLRLHPVQANYYDSIDPINLTHGTSYPRDNQPPIPILQSPIIPPIGFTTSDVGSRTIPDGASRVLKVLVCSRFKSYVDLSSDRSNPGRFLIYFKFLPVRKDQRNKAYFTKRLPP

SEQ ID NO: 969354 - protein, 149 aa, Homo sapiens
APGLKGFSAHYLPSQASSTYPGKVPTMTPPRDPHKQNRGAPYPNGVGPKPCSQKGNASDQMATTDLPGNQRDLFRNHRESINNDNPVTTGDLHDRASIEDNPPVLGQTTTPGPWLTPKIPRTLGAQWVDHTEGTEFKTRPAHKGGTPSP

SEQ ID NO: 969355 - protein, 219 aa, Homo sapiens
APASQEHTSLVAKKGFSGTEKVARKKGVSVGFRSRCRNSCEKEPFFGEVINAVVDWSLFLWSILSPRPRPQRLEGLPAWRCSTPPQWADTRDSRLVNIIVGALHCFLGLPYHVSRPLFRCVNKVFPQQCLRGVDHHAFVGVLLWGQSTFGHVFVAVMNFKQPSLGPAVDIQAVYVRSGRFPHAADEIIVSPLLAAQLRNNSRTGSDPLKNGGFNAPSMN

SEQ ID NO: 969356 - protein, 232 aa, Homo sapiens
GGFIGVFFPGAKRVATCFDPPPGEQHTRPPLSALAVLPIFGDFFEGHTCAPLLVPFALPPPFCVLCLRRFSASLEEVGPLMCTHNGRVFVRKMAAAPCRRKGAFFSPWCCLSLSLPHHVRSPPPVFVSPSLQPLCSPRSTESDLVGLTMPHPNPFPSPPGPWVSLLKALSLRFISVRSLPLLTLTRRSVCLYALSVCALLKSFQRGSSPRGVLVLMRALFLPQPLSVPARPS

SEQ ID NO: 969357 - protein, 297 aa, Homo sapiens
MVVRRGSVHLFGPWGAELSSSWCCMRLSPPRCPSVLIWLAVGWFDSLESSLADVPGGSAFRLLACHRGEFLSCTRPRGCRPCFCAEKPRCGALGMCRAPVLGNNGGLFPSAPMGCPPFSALPFLRRCVLPPEVSWAPEGASFLMNGWPHRWGSRFLLESEVCCFSHCLLVNSLVAPAGVGSRLLLHTPARYMMWASPRSLAAAPVGVAVAFLPHNCVNGALSPCSRGFPPHPPFACFNPTGPVDSVSADLTYSGGDGGSTPTLSRARRTPAGDAGARPPLNIRYWQTPPEFTNHHHA

SEQ ID NO: 969358 - protein, 98 aa, Homo sapiens
SLFLVCPHTLVSFISGVLTLVHSFFYAVSSFFRVSYLRCPLFQSVLRISPVESFSPRVFHEPLGPTPPGFPPFHQRPPSATNGVFPDPLATPPPGTCT

SEQ ID NO: 969359 - protein, 183 aa, Homo sapiens
SRVFGVACPGRPSFPANGMSVVHSFCVRVTRPCSWYGALWGPPRRGRPSLLVVSRRAAAFSLRARAPMAVASSGVTCSFLSVFSCSGTFCCRLVAQPVWVCPSRLFYVRADGPCLFCALLLIPVVVSPHPACVRRIPARYPFWRSPALVFIRCWLALLASRLGLRALSTPAGVALPPPAPLRN

SEQ ID NO: 969360 - protein, 372 aa, Homo sapiens
MLYVVSPRQALWFRLGNLALWGTWRCVPRKGVESPVFFIRDLRGRGILPVCMLVYPRANYLCAGAFLSGGRGPPATGGNSGGTPWCQTWEAEWAGIFHSPRLVETWGKRACAQREHKPRPVNNKGLPSWFSGTWDSHRKKAPWGKYKGAGGHTRAQMGVTTPVRGPTPTAGHTRAHGWQTLWHGLETGTRLELDTPGAPDGTLTTCGELHISPTGLPQSSSYSEYPFSASSTASTKVGSLGEGKNRGGTHLVGFYLRPHTLGGTKGFERHQRSLPASAQSLGPKAAVCAIILPRPCLLKESKRERRAFGASSREGGGAAGVWAVGPSGPPLLEGKPTGSEETLEKTQERVLKTEIVLPAPRVDFSVCNCVNE

SEQ ID NO: 969361 - protein, 139 aa, Homo sapiens
MSVTDSPLPPRRQHTICGDTPPCQPDAHILATPRVPSQSTRRPRRVPRRLPNWHGGHDRNPHGGKPESSPRDEDPEPRSKPALSLGWGPSRTNAGHTPTPGPRLFSGSQSCRPQTLSAGPTSPSPGNAGPQRAPATKQN

SEQ ID NO: 969362 - protein, 94 aa, Homo sapiens
NAHHEGVEEEPLSRGDKYGALTMTKKRGASHKESFLCGEEPLAGAPSHKVCAPPPGGRQTRGVSKRLPGEGDIPGEPILPGPIIIRPPRLNTPV

SEQ ID NO: 969363 - protein, 167 aa, Homo sapiens
MPTFRCAQLASLSCVGRRTQYLLYGQLGSSSSGRLILVRVHNPCWYIPPARFFAHSTARSLLLTRSGRSVHPHPLSVFIHRLVVGAPHTVSLAHTPRFFSPAHTALTAVGEMCPRRCGCNPCVVSECPAYFAAKQGSCVVSCGGASPVLACLVVPVRSLCGCWVITP

SEQ ID NO: 969364 - protein, 124 aa, Homo sapiens
MSSPPTICVVPLPPLWCPPPPQSRAPHLCGLLGGALSFRPPLFSVVGTSGADKIWAPPEDTPFRPPPGGDNGFFGKQYTQIRGVPHNRIRTTNDVGVVAHDDGCGGGVVHTRAHHTRNTLRPEI

SEQ ID NO: 969365 - protein, 102 aa, Homo sapiens
MGDNTRLVEVKVFPATTLCVLPEDATRCNPVFVCPPPLCRNRKFRKFSRCCAQNVLCVRAVIRETNIKWRMEGTPWQLRRKLRRMECRENATMQARFEGEIP

SEQ ID NO: 969366 - protein, 283 aa, Homo sapiens
MFVGVDDSILLCSIFLQCACCSAVWWLVYHCYMVLEDGWCSLSPVSTKGGNRDLPLCADGTSGSSPAPDKGDHPVAPPYIVYPRESLIFVSECPPETFGREALFPGTILASKVRKGSSKECSCGATLLGDTRRGPPPREALGFTSSGDVSWTHPRPNKPRLCPCIGLPHGSQLQAQFAELIGKDVIPLLVKSWKMAPKILESLVNAAHWLNNGSLAKPTCVLEEAFFTSYIHPSWVPLPVRDNEENQNQIARGCPSKASGTKKELAVETWHKSLTPTDLCAHE

SEQ ID NO: 969367 - protein, 154 aa, Homo sapiens
MGGRESAPTARAPRGEATAPACQKGRVKAPETVVQVTRRSLAPEGTPVSSAGRLLATPVKGVLLENGRESSAMRPLAAHAGEALSRQVQENGGEKRYIAVRWDATVNHCCRCVGEIGHHNPSFVLWGTAHLEHLRRLPQICPALLLRCPNRDPS

SEQ ID NO: 969368 - protein, 112 aa, Homo sapiens
PQTAFRPQRRFRFRDHNARSASQRALLEAPLFYIKALSSYKRLYTHMLQGNSPLSTVEVHTPLKIYPPESQKGTTQHFTAHARTMHASHKRLYSLSHTHPHTGRNTARELNL

SEQ ID NO: 969369 - protein, 111 aa, Homo sapiens
MSPGPLLSGFTLDPGVRYIFSPPGARCSSLGPFFGRPTSIGHRAGPHNDPAVCSPVSRDFPRGDYFCWQHPRRFPPPRVLLDNMSQNVASGPPYYDALGEPTATHFLVYPA

SEQ ID NO: 969370 - protein, 189 aa, Homo sapiens
PLTVVPPGGTLSLPLLGGAFFGALGKYFGAVGSTGIELMWLSGVFPCNNFLGEPPGGPTKTPFTGLSRGFLRIAPVRVCEGNTGGVTQQRVICRSSYPPPVSNSLVPPSSRAFWNPAQMWGGNNGVLFGVLPPRVLWLWAFPPVVPRGARVPTVTPRGIFMPPPRGRVVITHTHTRGLLFGGAVYCWGE

SEQ ID NO: 969371 - protein, 112 aa, Homo sapiens
MSQATRRLLNTHFILLVFLYVYTPPQHKPSQRVSLRRDLSPLRTHGLERATFIGRHNTFCCEPHRVPTEHSQCYVIGVNISSNIVRVIPAQLIIFHIYTYAKQSTLGFETPP

SEQ ID NO: 969372 - protein, 148 aa, Homo sapiens
WRPPIVGKTSGQMRACPKKTLPKSRAPTGRGYPPAGKAFLRTGIGLKRVSTTRGFCENDRVGAFQRCPSPCIPNVYIGEGLLRWNLGGQTRWQKGGLGAQEPTAPWYICGKWPFPSCLRVVLLFSPLNAPRDISRGRHCTSQLPHTTH

SEQ ID NO: 969373 - protein, 189 aa, Homo sapiens
GLSRAFLEGLFLSGPGISALRMLPDPRCRLFPQKSAPRVSSISRSPRAPPMCAPSHFLGTLSLYRRFQATLSGAAGFFCGFTCTPGVDPPTFSRRHFMLPPPVTHCPLGNNQISSSALMWDNCPIPKQQTRELPPQRALKSWLRISVLGRNFWRNDDGHPYSPRETTPMGRVYTPEILYISTRDLCRDC

SEQ ID NO: 969374 - protein, 109 aa, Homo sapiens
MRPCGGKGNPAGRRWKKRSPTWGKAWVAQTKQQCLWGKEKKKEGENLLRVLPLNLGGDRLAPPTNTLVPPLVTAPQNDVEARPPPLFCWVGNLLSHLVRRPTPVEPLVK

SEQ ID NO: 969375 - protein, 107 aa, Homo sapiens
MGPLNISGNYLGVVAAAHLYVDKRVFLWGQETIEVFVESLSPELDTNTSGVRHLCLCFVRIYSEHQNQHMSAWGVSYQTPDEDQEKSVLGSHGQEATTKSATQKDSR

SEQ ID NO: 969376 - protein, 83 aa, Homo sapiens
TGLGNTGPLLGSLGHNGLDRGAKGSVEPDSPARYVPALGPTVAKPGAPFRIELIEGFPGPFDAPLGIMGTLSHWGGEASFKKE

SEQ ID NO: 969377 - protein, 104 aa, Homo sapiens
SSVATLSPEMHSISSLMGGKLKCPYCPTGARTPADWDTHSYSDSYLGEEILLKRGSSHCERLLSPGKGVSNFHVELCVGFHERLGCRSFHLKGSTLEAALWHEG

SEQ ID NO: 969378 - protein, 137 aa, Homo sapiens
MPPTLYTAPRFPFELSRCQSFSPSTGNSGFACVLRLGFHTTMRAPPSVVFFAHDCALSGDKEVYTVAHAVCVYILPREMSSHENPHHVCEFTRSTPRSEKPLVSNLFLEVSTTPRTISRFLARRANAHGHHVKGVAH

SEQ ID NO: 969379 - protein, 112 aa, Homo sapiens
MRSPRCDEDVSFSPALLLCDGCCFCAAVSITRPGCPVLPPPPLPLVVALLGVCFLFGGPPTDEMGAPPPPLCVVEVMPRECCLSGSGCPPSCGRPPNENDIVLCKLGGLPPP

SEQ ID NO: 969380 - protein, 118 aa, Homo sapiens
MWLAPPAPLGELWAPRTHKDPAVSTGNRHIFVERGACVRPCEHSGSPVLERRPPRVLLSPRQLRVWRKEEFRHRRGSSFLVRGSTKTTALGSVEPLCSPLIIYGAIWPTSGTPRSLVP

SEQ ID NO: 969381 - protein, 162 aa, Homo sapiens
MGFSPWAQQAPHVGCVFERETLFSHRRRIVPTPSVGGLPLICPLCLRGRDKERHTDTQLFPAVWGRAHPHKHTLGSTQRDRASPRETPRAHTSATAHSVSRLTRDRLSQREGSYMESNLYPLYYTSATPPHSLYDHTVGCGEDTRCLHRDTRVCVFTIGHIL

SEQ ID NO: 969382 - protein, 114 aa, Homo sapiens
MGLPQGETLKETSTQKPWKEFEETPRRGKQKGGPISHKEFSPLGHVLDRPSCHKQWRKRQHSVFEKDLRENFSQKGPTEFYPEMRGPHTTRRIFWDNNSGYNEKIYLQIWGSEI

SEQ ID NO: 969383 - protein, 444 aa, Homo sapiens
VLLRSSIVIVRWCPRLFRSVLRDDRVARMGRLGGVVDCAAGCVGSVGRVCPPAGLCPRLLSPPFLSFFLFGFYVWVIPPPLFCVPESQPFFLGAGAPPHTVGEFVPPRVLSPLLVRCLVLSSVFHLVYMPLPAWIGGPRFFSRWFLRLLSLAGVGSCLSFGMPPLCGVYFDTVDSFGDVHKIRELECLYRGSFPSGRVPAPLVKQPFALGGSAPHGGGPPTAPTLLTVYTLGMNFFGEYTTWGLALVGVNTHTWLPTPNGCVSLPLLPYPPPTLFCPSLNRVSPNPSTRGLWITPTRYDVGRKFYLFSGARRFALTTLYSPPLGLSLPSLLSRGVPRVSPRVAPPRGIFYGPPLGGRSGYPPPTPAGVIVCGGARMFVGGGMLLVLPPLLCVGGVGVLLCAVCVSVTLLFPHGNVPPLVPTESPISLHHIYHETTLPGSFWGRG

SEQ ID NO: 969384 - protein, 152 aa, Homo sapiens
PGHHALPLLALPRLWARSSPELNGKLTGMAFRVPPAHSVSGGPDLPFYNNLPNMSDIKKVVKHGVGGPPQGHPGLHLSTPVVSSDFITATPTPPPLTPGAGIALNDPFVKLISWYDHAFGYSQHGWWTSLAHTGLQGVRPLDHPAPAQSTQR

SEQ ID NO: 969385 - protein, 88 aa, Homo sapiens
CFPLVNPWHPRTPGGKMGTSQKSPLTGEGPHHRCEVVEKRPCPKTQEKGLSGLYTPRPNKEGPKNGVFGKNFGWCRFSWKRWVFRVGK

SEQ ID NO: 969386 - protein, 105 aa, Homo sapiens
WWIAPCPRGATSGERWRVYCVVIVAILGGVLDPTWVPVLSHPCVCRAGCVSPASSWCRVPGCGGETLVWSAGSLGAFRFCPQPQPLFIGVLSLGLVVCLGGHRLG

SEQ ID NO: 969387 - protein, 105 aa, Homo sapiens
MLHEPPVGYNVVHSSVTHYGLGLIFASLSPVVHRPWGKGRKCMFGNWHYWRLMVFNLLIPTSIPPLTQGELEGTVVSWPLQSMQCHLEESDYHRHRREERGDLFL

SEQ ID NO: 969388 - protein, 123 aa, Homo sapiens
MRASLWSAPLGDGLSPIRGRYVPPYMRDAPCLEKNVLRIGVVQSPPLMEILLLSVPPADSGERMCGRGGGGDKGERQPPRVRQCVANTIISALIFRSPPPLFRHTEMMIIYYNRRYNIFFRGV

SEQ ID NO: 969389 - protein, 170 aa, Homo sapiens
AFSPDMFFRCVLVILWCTTFVEKVGRTIPRGRASLASYNEGVLGGGNFFFLGGGDIRFVHLVRPVVRPTIGGYPPLPKTALGVKGLVLLGNAPLVRLAPRTEQKCLGGLGGSKVKFVGPRRDCFSLWPFASCQKKNFIEIPWGNLSTVGNHNFLGEKKGETSPLVKSAPL

SEQ ID NO: 969390 - protein, 296 aa, Homo sapiens
NWGSLVEQNPFPPQSAMYSVEFCAIMLARVLLTPHCLARCVPPRVCALALCPTLGSSPMSTPPLCMSCLSLVLRSHCVCIPSSLGGRSTLLMWTPVCRTPLPRHFAWVPLPQRVPLRLAEKSSPSSPVWSLHCADLSPPIVVFARAHIRRCSHVVVFDTPVLPRRGHPHSIGLVASSPREALATGSAPLDVSNSQGSHSLTGTHRGVYTLCCDERPQFVLIGSECNTRTRRGYSLSGSHPDEHSVVRSQQCSPVTPHRENLPSPAVQMSSHRSSHSCLLRGRRTRMRLLLDPIITQ

SEQ ID NO: 969391 - protein, 76 aa, Homo sapiens
GDSEYTLHGVVHPHNTPQLAHSLCTIASELTVCGATKPPLCPAQMIKDIRLVYMYNWLNTPGAPTNRESNLVFPPN

SEQ ID NO: 969392 - protein, 205 aa, Homo sapiens
SFFALPSLVFRRSPLRRGGRWSFHSTVHCWLVGSVCRSHQPCASCGASSAATESLSIRPACLLCSSGGLTPVGRCGDLSRCGPPPVCLFGTYFSRRFVFLCIACRAKQHVWCVNTSFGRLSPPALPPSVVCRRVLALLIPSVCSSHPTGLRGISLLYSWRTNIDFFPRVFHVRTEYILYCAPFPPGGVSTKALCVAPRRCGKLLV

SEQ ID NO: 969393 - protein, 135 aa, Homo sapiens
MRPLLPLGLCARPFHYIYLCPSSSCLVMNERKYWGSANTSGEMSIFVCCLCCSLPVGRKKKNRPLLNTSGGGGSRRKSPPAVRQAIPPPSLRKAGRCVFGGKKDKSSNYLSLSPRGYYHCGVMVLQWLSLRWRGR

SEQ ID NO: 969394 - protein, 143 aa, Homo sapiens
GGEMMCGGSGGVRCVCAVCVGRVVVGVWRVVGVVRQDSYQWASAPPGGTRPIVQAPLGVFFRPSGARPRIPGGGVPPNFRWAPFKQVSPGPVRETYSRVLALSRGFSTDPGGAPTTGQILVLRFLPCGPPVWCRRETPHGPRC

SEQ ID NO: 969395 - protein, 258 aa, Homo sapiens
MALGNPPGQKGSIPSGNTFGGNLVRKGILFVATHGSNMRNQVWPTPPERTSVDMWAPLPGGKTCLGRVCRPSRGLFHTRQLQVSLVPSIMARLSKRPCWGTRFKSLEALNGKGFILGNGPFPGVPHRAHNRCHNGGSTETCAVFRRKNPGPPKYMRLKHFTRKCVCKAHGRSARGPPSQKGHSPGGYHLRGTHGWVLSFLRLFTHTARHTHTSFHPFRTPVGVGTWPSHTEPPLSKVNFLVMTHENLANKQTQGGGDL

SEQ ID NO: 969396 - protein, 105 aa, Homo sapiens
MPSAHIVHPLSYFLSTLAPLHDVEEPPRLVGVEITQGKVFNISNPGFQSHNEANSRVPLVDTHVRVELTANPESSLLGPVPPESGATTRPPGGEGEVYVPQVDDM

SEQ ID NO: 969397 - protein, 175 aa, Homo sapiens
MPPQSLVDKTWGYEQRVYLWGVIETVLSHIIRTGKGGTWGIFSHAAYRSFFGKEGAEIPPALFTNVHATNSFLQGTCAPCFPPLSATAFQHGEKVCSPHLILYLPPPVYTYLPPIPQASLHSLGKQIFLCAPHLSSVLTPCGKYSLPPLVPTLFTPLALSQSQRPLVSPLILSSE

SEQ ID NO: 969398 - protein, 267 aa, Homo sapiens
LVSEGSITKQMGGSILSDSSARCCTREWETRWGVYNQQPAQDSGVTHTTVGATGRYSRFTPRGEIKNFLWCAEWRPLIGEPFVEEKPLLFLGGGTQNMWGASSKEVAKEERGGPVCNRGKGLPRCRARPTRLLPCGVASRARKRKGAPPPPQSGGEAAKHLGLLFKHMGLHKRLGLLFRLGRPPCPDGAPPKNKNARPRRPLMVPRRGLICGGFCRQHHPTGVLNTTIGTNIWQQQVVFVLVKSLAENRGDITEVLDFPPRAVVFGL

SEQ ID NO: 969399 - protein, 112 aa, Homo sapiens
MALSLSVVPPLYLSLHCSSREASFSLVYVPGRSSTQPPWGHIYSPGAPFFMPQVSPVLLERLTPNISVEAGSYSLCVNAPPALLDTPLVPEPMQIRSCASPHPSFLRGAPPS

SEQ ID NO: 969400 - protein, 307 aa, Homo sapiens
LMITIHPRLDATRGPVLFSALSPVAPHHCAGKHPSHKILCPPGLFGPRTFLWPSFLRATCALGLPLYISRGTNTRHPWVGPRTHPGLTSHPFFQSYGLLELSRLFFRGPFPPTDKKGLSSASPLFSTPPLGAPPWGILTLFQVFSSACRAIVQIAIQQGDTLAPIRCGYTRPLEIHPEARESPKSDHIDCVSSRTDMCGTSWCLLSPPARVGPPGRTKSCSQIVVSPHEHNHRRPIVPPRHFVSVFKRDATLPTRGVSNPPLVSTVGTKWHAGVARHTVRAEQRCRITRIRQGATPPSFAVNNRPQK

SEQ ID NO: 969401 - protein, 202 aa, Homo sapiens
LRYVVCPIALCVLVFRSLVCCLAARASVPLSAVRLVIVGTPPVLHRQNLRFCMARLVFFCLGGAALCPPRVPSVEFFSALSPGKECGSPPPSLITPPPGVGGREILRPRKFLWPPIVRSFVVIWGEPFKNIISGNLQNSRLLPGMLPKCADISVVCPACFPRCWGKGRCLLPKEKGFFLGTINPRHKAFFIGEGPPLYRSPC

SEQ ID NO: 969402 - protein, 84 aa, Homo sapiens
QYVWFVTKHAYMRLDVRYFVENVVSAVSQAGVAPPCCVLRSSPLAAEKLSLQKGVSQHVPPTERVRFSIHSVGGVGEKQELSAY

SEQ ID NO: 969403 - protein, 200 aa, Homo sapiens
ADTGPSDSLAGRRRTRPSRPGENWRADSYPAHHLGQPPWGPPGAKKGVFPSHAIMRYTSGTGPLWSPSEVPFRNTPPAIVAAPLWPPCHVSATCIAPHISSSGFLPQEGPLGTPPPPGDGEHFRPRPYKNQFGTFRGRRPICPANPVSRPNVAPKNHHRFPPSPPGDPPATLAFLVSRCWDYLPPPTVVYPTRSYRRTRY

SEQ ID NO: 969404 - protein, 128 aa, Homo sapiens
GTSVALLGRHSLFMPPCGVGDVYVVGSTLIMWGTTGCSFFNLVLLRAFSLFSGGGWAAVWYHRHVCLSTVSDFLPRWWGSHPSPHVVVVLSLCTLFDPPLCFLTYTPPDVGFPPLIGVSLFCLTPHIV

SEQ ID NO: 969405 - protein, 88 aa, Homo sapiens
EEEKTTLLRRWFYQCRFISLLYVPLGLFSKSFSVTSAAPSYQFPVLYLQVTFDIVLYNCIVSCTIGGMCTTNGLFLVNPPARLLVFVH

SEQ ID NO: 969406 - protein, 263 aa, Homo sapiens
CLFAFFLPSEPPVTTLCFGPLLFFSPPVVCFRTCACFPRKGPSGDIGLLWAVCPWASLGVFSVVAPPIICPVGYMAVYPPGAECLLPSRVAALSSPRFSPPTGAVKGIVCPELSAHNPFTRICPFIGKCSFGRQQVASCRAPYGMSNSPFSCDTPLRGGAPWARGTVGNVAPELFSPLLWTCSGDSRPPETPVMCIRLFKAPTVFPHLLSPFPKYGALLILPTLLMEGFYFHLKFLPYFSQANTPLRAPNLIPPTNATFHTIT

SEQ ID NO: 969407 - protein, 296 aa, Homo sapiens
VVCVRVAQEGKDLGGLLGNPQSLYRVSNGSPPLRFLRICSPKTDHVLRGLPLSVGKPFALVGRPLPPRPGVFTTRPPAASSRPPEDLPARCRKQQPYLPVFAQRPVFITPFRLCGGGFINVAVAPLAVLLLCVAAPCEYFPALCVFQLPSGGTTAGYIRNLHVSGDAVTFVFQDTPALEEARSPRFCHVYPRGVYATDKAGVLMPPRVPKRGIFIFARRSPPSEARSPGRLSPAPPMLCIQQFCRAGLYTHPAFSHHAFSTRRPYHAGGLFNLSPVLPWPLTPPTPRKHSWHPPNK

SEQ ID NO: 969408 - protein, 128 aa, Homo sapiens
MQQLIDDSCLHLLWTPTSWVASRMKTRRCISLPRDCYNLHGGGIITFFNHGRSTVVYSLMALFFGGALTYIEHRCCILKKSTGGLDHRCLRELFLPGDCFRVRYTTERPFPLVLVMMIYSWETVSSLI

SEQ ID NO: 969409 - protein, 122 aa, Homo sapiens
MCPARSRPTMWRRKCPQKLDSRNIITQQYLYNYRNFAQTSVNMKKKNIFSPPKIFCDKSPHVLGGNSHSSPSETRLPKMVLFKNLRFLRSVFFSPRSRQSTQIYDNCLDVPAPKQTKILYYL

SEQ ID NO: 969410 - protein, 303 aa, Homo sapiens
GPGIPAGNSWAPHAVRGGATRGSVGHRRLAECSPRRTHREDPPKNMGPVPRGSNTIPIRGYEEPGGAPGGPFLANSSGPGRKNPPGPKDSIAGKSSLFEEPPPGEKAKKGRMMQRKKGKNRRGKTPHEKRGKKGDEIGPKGGQQRAGPHLRGHPVPVCPKQCLPEERPHGETTPPPGDSRNSQNFSPPARIRKGGEKPGETPTLGGHTRGKPPRFRHRGGHWTTKGFLKGLELGWETPRFTSLVLFGEPLETPLRFYTFALPFLAFGKVFLLGLLGESPRLLLVEMASGHTTPRGGYKELEHS

SEQ ID NO: 969411 - protein, 162 aa, Homo sapiens
DPWGEKGKRVLYSRPAFKSLCVGGPAGEHNRVAPKGSDAGVFPGDPPPPVGHHIVGCPKEIRRQGGYITPHRGGGVELGPPPHPPQEDRHRNHGVLWGVAPPPHHRVWASPGVPHRGPTTDFGATRREKGEKKRGRDTPGVPLSLGAHTHRGPLSILICELR

SEQ ID NO: 969412 - protein, 233 aa, Homo sapiens
MSKHRGHQQNSPEHGSYQPSPPSLDWPFFSDPGRRVIQRSTRRRSPLESQIRRLVTNGVSCKKPGRRSTFLGCRCKTTDDPARPGPHQEVSLSPRQKFRTFLLRQGDTYARPPYSALKQAASYRYSRDQESLSGPQTPPHVAAGSMGVQHHVVLTPHTPARYFCFSKTNLPPSPNKNNITVRPPQETSNHAWPHKRNNTMLIEEVPHVATIFRKKNPTDVFLFSRKLFLLCRM

SEQ ID NO: 969413 - protein, 153 aa, Homo sapiens
MRRDLFDFVDGFIPLVDIPVRSGKASPTPSPPPACLEKRLCVCPPVSVRSSSSPTGRGKTAPGCFLLSTTCFPPADRGPWGVAPPVPPPLPCVFLFTGSFFGPPHRGDVLCGHSPLGVARGGATPPGCAPAPRCAQTPHLAPHMIFPLGGPPV

SEQ ID NO: 969414 - protein, 287 aa, Homo sapiens
KGSVKGFRTEPPFGVPGGPGFAMGPAPPGVTGIVRQPYPKSRFCRGVPDAQIRNFDLGRKKAKVDEFPLCGHMVSDGYMSSCPSEALEGCPKFVAQEVTHGKKVVAQRMASTNPGVGVSPRSTRQSRNPTKNVVLCLGLNTGSHKHGTCRGWPFGESPTGTLWATGVLHTLANSYINVHIRTTSCRTKGGTCELRALRTGHKFKVSWPPQRRVHHISQEVGLHHSSNADEIVKNTGGCKSGSSHDGCGVKVQSPRRGPLEQDGGPCNHEGFQSAAPLLILTHKFYFL

SEQ ID NO: 969415 - protein, 201 aa, Homo sapiens
MSHQGLCSGGGTPAPSPGGNLLCLRQRWPQRSPPDPLAQPGPPGKVFFFSGRLQHARSPPEPGATRLGSPPVTKAPTVSRFLQGSVVSDQPVYQQGGSLRTTRAVSIRGFSHASTASSLRCPPSGARNSSQSSRSPGPHTLFINVPVFDPVIHQRTYKGPADGRKVLSLIAGVVIQGARGPFFKRSNRFSLGSVLAPHGAR

SEQ ID NO: 969416 - protein, 84 aa, Homo sapiens
FAALSPHFLGPLTMVPPRIKGSAPSFGVPALSARKRHSSLPVCGLVQFWLSPNAGCAPEPRFGEPPSCARRVTLPSRADGSPLV

SEQ ID NO: 969417 - protein, 281 aa, Homo sapiens
VCRMGHDGVKSSVSWGSCTVSCGVNSVLLSPSKCVGACTTLQIPVWGGQCCRGSLCDELSLTRRRPPLCPVGGTPRTPSGGFPPEECSRRRHACPVTRVMTHAGFPDVLFSTLFVETLRLEPCCTLEAHLFPRPGGDSTVLSGSPSCHGDFQPPVQGSPHELGPPRIPPRLGNFSMINEAIRTASRINGAPDESPRDFRYTPPLVMAAPPRVVSGHFPELGDTCDKRAYTVDSRVIEGRGASKTRNMQRALDTTAGAQKETQSMIEALINRFFYKTPPNHI

SEQ ID NO: 969418 - protein, 154 aa, Homo sapiens
MAWKPKTVGWKQAHRREPLGHEWGKPRLGRETQGPKSQLSHSGGIRPPHGFFPKSHLSAHTLGGENGLFYKMCANPRFSHTPLHAQNPVIHFSRVLIKKRFTRTWCLQTFVCFFILYPPRAHPTCATHHTKIVMGGASGTYTLWFHERLVVNNT

SEQ ID NO: 969419 - protein, 114 aa, Homo sapiens
PECGTAQGPPTWPATKFSLEQEGGTLVCHQKGSLTTLLHPSAPRGPPGSVFDTNTHTPRLFNGDPTPGGSSRKTTPRVSEDKVCRGMAAPLKKTLQWCPPTSSRVIKEFFRPSS

SEQ ID NO: 969420 - protein, 174 aa, Homo sapiens
MGPLTVLVRAPLSESAIVSLPQLYEDNGVCCSSAHSGAIPQSACHFDVVSNMPLPRGVCPPSMDHSTRFFWPHLERNFFFREQLVREPPLVLLDNLSTAVYRPSLLTPFKFCSSPSYKLPQLIHFPSPSLQKSGHPCLVPRCLVPDALLCVFRELDPPPLSGCYTYGLGRSHRT

SEQ ID NO: 969421 - protein, 154 aa, Homo sapiens
LHVYFAELNSGRNSAPGNLWDRTFFPGGDKMGPFKNSKRRYGVCPKGKFRSSVQTTCRPGVDTADKRGDPPPNGEKHALGLSKLAYRVGVYSRGSPLQGPQYIWPSRYIFAAARYIGNLRTTPGALNTLENGKSFVPEGPEKGEKEFEFRPLFG

SEQ ID NO: 969422 - protein, 275 aa, Homo sapiens
WGCGVPSAGCPSYSLTGFLHLVFLFRVFFGLLALPGSPDSSLATPWAPTLVGLSAPSWVPGRNTSARSCIMPPRGQLLALWPRACISSCCQPPARVKDHTVSSSPKRRTEHYLVQDFVRRITRGGLVAMIGPPRTKSLASPEGLSVRLSRASPPTVLSRSCPLGHLTPIARAVFVRSALKSMTPVQRAPHSPLLPRAAFAVSPPGVQLAPSAPPSQGGSVSPRSGTEPGRLATPQQFQARRVPAVGAPPTGGGEQKAFSLSWGGGGSAVAPTPVE

SEQ ID NO: 969423 - protein, 319 aa, Homo sapiens
RLFGGPGLSFRKKIYRGGPPYLGVFGSVPPEMPLEGVIYNNFGKKVESAGLPLGSFLLCSKFSPLSWWVKWVESLPVPVREAPYFGGGPPHGGIDPPRGSVLSDGKRNLHGSIRLYPPRGKGIPFPTCAPLFSGGVPPLFGRHPWDVNLRGNGSKTWDLTALQGPFLGGSSRLSPHILGGIPTGGALHWSPPLHETHGGFSWEIALCCYCEDRHMVVSHNGGVYCASHRTPPPVFNVNGLPHTSNRVYDNTTPKMEENKCFCLAFPPPLSLALGSPPCFYTRSHGPPRVHTTGEILARPPAGECLHNTHCLGYLFWRPC

SEQ ID NO: 969424 - protein, 146 aa, Homo sapiens
TFRVLGVSGKKRAPTPRLGGNRAHNWGQTHYILRTRGPQTGANSCGKRGTMGALPPLRRGHRFPLCHLTGTQRAPVGTSSTDVCGEGESPPQRDSLCPRGPSLSLCTFFWRCSLSVRSPAGPLFVFLGESPPPFLIFFFPHWGGKR

SEQ ID NO: 969425 - protein, 113 aa, Homo sapiens
SQPPLIKSWTPPRPQVGGKDQRHWGVFYNKGLSTEVGKYVIPLWDNHRIPHKRPPHKIYRGGAPRRRYNRPPPAGCIFWGDLRRPHHPGAVSTQRLWTTMAHKVVFCPWEKSL

SEQ ID NO: 969426 - protein, 111 aa, Homo sapiens
MEHTLVAPQIYVGGARLNNEREGVVNHRKSFCVGERPTPFKERTLSGGESHTWETTHPGGGVSLSLRHFCTQHGIHTHSTLFSLTHTVCIRPSWGVGRNFVPSPQRPPPFV

SEQ ID NO: 969427 - protein, 103 aa, Homo sapiens
MCLDDITHVLCVRSHMRTRRREREEITQVRATSLATSALSGDLFHKKGTGEESGKGNVHKEERKERRVGDLQRLRGMPRRDYGKDPCKENEGGRGEFFKRDKS

SEQ ID NO: 969428 - protein, 238 aa, Homo sapiens
RPLISGRYCAQKNYSHEYSQGPATLPPSPRDLLQCHQDRNAQRQEGAHGGCSTCQNRAGRKPAGKSLASEASIFRPSLNGGSPEGEWQSPEWRGPTIPGPCIDGRFMAQHRRMPVGSFSPSLYFSPDRLRVHPNSRGARAEDTTDSGEEEEEVHHCETRGPRDPELALGPPSRDRWPSPISSPVPPYALRRQSSLPGSSVAQTSLFEDAAPGETAEGQERQGQPASKEQQASGQQELP

SEQ ID NO: 969429 - protein, 206 aa, Homo sapiens
VVRAHNMVLARGVNFGGEPFIGAPFAGIPSHHHTHLASLLGENDYHKRAHFGGAFLRRVPSVSIVYNSSSRGAKRVVVISSPSFCICRGAHSLSQKRHVVLTETELKMSTRRYTPLFPSLLHEHTLGAWRTQREGPSGERSHNRGEGTPVILGERGPTEATGGSTAPLLFCETGGVYLACVSGVGRPPGTGGQRHLHVNYNGRNIK

SEQ ID NO: 969430 - protein, 210 aa, Homo sapiens
MGDTCPLRNIEGRIFVQRDKFCGEFSGCSPLCVSHKDIARCSPVDTPHGVSYRRQRGEWAGGVLTGDPPWRGRPTHPLFSSPEERPFFHTLLVAAPQGLWRGKENFSSLLDLWARYKKMCSFVLILIVSWPLGCKKSRGQEEPRLASLCRSFFLLSPTELRLFCPSDSAPTWPRPADRARRGSMHFAAPTPKVFPHHSPAHPLGKKNGLW

SEQ ID NO: 969431 - protein, 132 aa, Homo sapiens
LQDTETEGRRRDERRKQSERVANTAPPFGSLPGTRLVTTAPAFFVGPNSGPRPPGFNAGKVETPPVHPALYKESDLDESSQGFVHFPAKGTPAPPQRSCQAFITPPLNCNSRQITGHYNSPIEWGAKFLKSN

SEQ ID NO: 969432 - protein, 304 aa, Homo sapiens
TEFCPQHLGPPLVCPPGVFPPPGIFGSRWVAVFSTQPRGGGGHPCSLKSGQDRFLAHVAAAKPLPREGGAPCPRLARCVGPPPAVGWALSAPPPGRGIILPPANPWVVVARPHFLAALTIPAGGAGPALPRVSVLGSKACGYTRASFSVRPPRPGPAPPPRAWGEAHPGTPSREELVDSAPSSPPIAVTGTVLPPSSPRLGVVYFLFPASRMERQSPPHFLHGVPSSRNLACGPLAPGPAPRVGDVAMVSILDPVAAVHHPGPPGPHLPFAPYKTPLWRTPHQKLYEHTTTTFPLNKDGTRSQR

SEQ ID NO: 969433 - protein, 199 aa, Homo sapiens
RCLWPVCLRERWWKKKLGVTQNRGAFSHLWGGQNTTLARHTPHIGGGDISDLVWRYVIVDTTTWCDRHHIEIETPPSVLHTRGGTITDRSSCVYDGATLIVVLSVVCPQRDLASLPTEEIYIRKEGDTPRGVVSTHTQEKILPPGNQFVFGAGLSTSPGAKYFRWGVFFLTHCVVFLLGGPPLSNSSENNVEMHITSDS

SEQ ID NO: 969434 - protein, 277 aa, Homo sapiens
ALVRAWGRMVSADTCGGIAVAPTLLGAPRLFTHCGCLMCPSVSPPEFVGRHSVFPQGFVALCGAPRWGSQNGNGHLFGPRVGPRDQKLRARPFVGHNNVQALSTMGGPSPQGLPSRAKRPPKTPFWAHWSGPRKNTPAATVWVSPFPSTKPPVLKGKPLAKPPNTTNVDKGSPHTLANAAWEISGCASSESATVVLSREPWLQQSRPVFDADHKNGVPELLSYSPLLFVRGNNACKLCRVEQSPRCWHMSDDQLPLGTNFSTAILPLAPHQQFSRPH

SEQ ID NO: 969435 - protein, 122 aa, Homo sapiens
IQGPLRNSLPGVSSWGPSFGELGEPFFREIPQLHFSTLEWRHGRWPPLEKGDGPTVAWLVAVESFHGTARPHNASLRTFCWHMARMRYRVENYARLSHGPRPGATGPQKGGKGPLEFFNVTW

SEQ ID NO: 969436 - protein, 241 aa, Homo sapiens
CISNNQRCYVIVIFHVLIDALLHVRCDPHIDVLFIWGNPLSVAHVFKLPPVSLPPHNEENDPPGGGPPSPHTSFPGDLQPIGPHNRIGTQSLRGTGTHNSRGGPGETPRHQTVIRGHNPAHPRQFEDSPLPPPFKREEGKGRPPPLFSPEAGPGPREEPRLFLGGPPPRGHTRYAPHMPCALPRSCSIPRDVSPYTPPDSQTPQSFQGPAPPLHAFCPHISPPTEFPGIYIHTPIALSIDI

SEQ ID NO: 969437 - protein, 138 aa, Homo sapiens
MRCHPCPECSGPQKGRPPPFLRLRPLPPTITTAGTQHPVAPTEKESDNLVPLITRTAATPLVRPPKPKDGAVAPPHSQGPLISKRDGPLYPLLAHPFLAAHICPTATLCLGAPCNTTSIEERLAPTNRLGVVNSPLPH

SEQ ID NO: 969438 - protein, 112 aa, Homo sapiens
MTKSGNSSSGDALAAGWRRRTYYVAPRPARRGGTQATQLLHPTPTPSLCTSVLEIWQTLTLVGKHPQACGEARRPGMKHVALWGEGGGLPGNHPSVEMTTGKVFMCLFAFCI

SEQ ID NO: 969439 - protein, 216 aa, Homo sapiens
WSSCFLLSVVGVVRCVVWGGCAGGLLLVSCDRGLCVACFCSVSTWSAVRVVVLSFFGSSQWSSSVLYRVVSQWGVATARSHVVGVCVLAHWFLWGHSFGGLVGVGRVGVVPVCVVIMLWGWSRCLASCDGLYVAIQVPVLSLQWDTWRATDSQSVHAVSPGALLFRVLPRGVHWWSHDSRPVSSASVVVWSLEPVCFCSTDGPSSCFSPDSESPGL

SEQ ID NO: 969440 - protein, 172 aa, Homo sapiens
PQGANWVGKGGPRGDAEDRSGVPTESGSREGACAPPFGIRGFENLAPPESGTSNRRFCPADVPHRGPDEGENPLRTRQPRRRKRESPTCPPGFDLMMRQLTQGLLVAGDAPPGAHARSQKREGPPGQRLSDMKRHTEAGGGRILRTGRDLFSLETRRDPKPSPSPPLSILRE

SEQ ID NO: 969441 - protein, 245 aa, Homo sapiens
GHRGPQCSGGPPLAPPGELCPPDPLFRQPGPTHQARLGAERTTPPGSARRSKAGNKVGRPPSQRMEDGVHLGKTWSRGFIIQIGDRMQWGKWWDPFPPRLTKSAPLLVRKIPGESPEGPTSSAYSHVFMTPLSTGDAVRPQFELDLPPVQLHHSAKMILNEELDGLLDQPTQTVVMHRTEPTAPQRPRLCNWPRNWAASVENQNGGLTTQQGTYGGYFRDQKDRSRQNEGTAPRWYPQQQFQTAY

SEQ ID NO: 969442 - protein, 136 aa, Homo sapiens
CHTRILSSRGMTQTISPGGDEKTTTAACGRSYFARTTCLIAGCAPRRDLHPLVLLDPPWGFCPKPPAVTADSCGKIPGPHRAAIFSSVRWERPPPGWKRFTPKVPLAGKYPGGALFIHTGASTPGCSRVSTGHNQY

SEQ ID NO: 969443 - protein, 104 aa, Homo sapiens
MAHTVGKEAHTVVWGVLCWLAPFSHGGEDNTSVTENCVAHIREYKSTESTTPLFAKVKYRVLLVFLVSSCLFTSRRHRGLEGLSLYEHCSLLWVSSRVHSSPTS

SEQ ID NO: 969444 - protein, 458 aa, Homo sapiens
EHNVDQTGLLCWAPDRRPRVSKVFRCGHGHDGGDHHRGPHEQKKPSLQPGGRTTGATTPVCLVGPTPEEKWLGASSRTERPTPGGETHHRYQPWAKKHTKAPGGILLLRPEFSSKSPVPGVPKAKSRTQSPLFGEGKAPILTPHKGPRCEEEFRAAKKQLGPHHIAVLGRIAARKRDRVGDHKPHWRGKEDPPPGAPVEECPTPQRGGPPPLEISQRGGRNNATQGAQPAHYLGPVPPQTPGAGFPQQRAPPGRCPRREELVGAPPHHKRDFNKGGSPPASATAKYSLTWGFSGAEFVEHPPPLSWWENTHTHICGHAYMSCAALISRRPGGLFSRASLLRVFKASQPPHNLGAHYDTLFCIIRGEIWAASATRTHRRVSSSPTETPLSHPCSVITRARLLLERLVCTLCLSIRPLNSLSKMGRLRAPSLSRETFLLAHIPSWHTLEREDKVSPQAEA

SEQ ID NO: 969445 - protein, 183 aa, Homo sapiens
MLPLPFMKFFAHRRSLKTNEKPPRGGKSKTEVSEWPTRVSVAPLKREPSQLMLRTFLPEDGSFRGDRSHPLVVGWVITSERGAPKDSLPPGSPHHILAPLVGGPPRRAGSFGGGYPCGCFVMVPHPPPPFFVGSTSSTESPGFCRLSELAFATKKISRATTTYGPRKIVLAISRGPPEYVLFW

SEQ ID NO: 969446 - protein, 288 aa, Homo sapiens
EVRAPPPARVERTGENIASDGDNHPGYILRRTTRGARATSSRRTKLQKRGARSTKSPSAHGGFAHAKDTHGGVPQLSSPRGTPGVIPRGQKRAPVSPEMLPAEEIYMSRRPPPPGGEGPLHKDDGYTENNIEPRANSTRGMRLRKNPLPPRGETLSKKKEVTHKGQKALLKKPLGGLPKRRPPKLPRGDDLPQRGAAKMEGVSTPPTANNGKKVFPSERSLEREQNEKTRFHFPQKKEVPPGNVHSKYKAAPANMCTTTPHGGDNKKEGPPINRESLQNCPPLLATQN

SEQ ID NO: 969447 - protein, 117 aa, Homo sapiens
MHGCLSTRVVLPSLAAIITFFPKKHSDRRRSWPLFGSPPHEEAQGCRAPKTTRGGVTAPQYSPRGIIVRATTKSASVLFRRQNFSIETQVWCVPSGGIYHPNEEIVCRRLVRPRAQI

SEQ ID NO: 969448 - protein, 130 aa, Homo sapiens
MPRNTQAPQKMCGSPEKTIVGECPPAPRLRRRRGPQRAARGAQIRGRRARNDIAGLEDYPTRVGPSRWITLFHSPWAPLGNHFRQISASPPISHREKARLFVKGARRGEKDTRVWESFCGEDLHENTLGR

SEQ ID NO: 969449 - protein, 384 aa, Homo sapiens
YSFFYHRTSCVVPPSPSLWSHSMIERMCVSPKTHRCLNPSSPDFPPGGITFGTHYIASSRARCCATTNTNGRPYLEIWARRHKRGGPPEERKTWGDNHTRCYLRRKGVGKKKVGKTANSAYSGSQKKKGEYIVGEEKQAFSVPAPGGSSLGGHPQEMVHFSRSRFSQKGVSLWLFERWEVSFACEFFRHENWNWENVWHLFWRKFVLGPGFYSSKGECFSRGCKKTSPPGLKNFSPLGAHREFLYTPGGPQKMVGFPTWGHKENMGHRAHTGAVEMPFTRLEYGLQEPIPRNGGVYLWAFSLLVFSLVWGFLYYKNKRPHPHITEISGEDPLSNMRSQHTTHTGSRHTYLGRREEMRWRNSHETLEREGAQRHTMRPRKRGGSQ

SEQ ID NO: 969450 - protein, 266 aa, Homo sapiens
ATLLGWAPLCNPQGVYSPPRFNTRFWGVSSPNHSARLRLRALPCCEGVCPCHIGPLGGDFPWASSLLSCAYLGYNPCGRPRNHGVPVSPRGETLTSREGPAPTHYESWETPRHVLKVRENAERTRAVQPLPGEKPGPVSRPLGGSRVAKGCKKRNIGPFTTVKHGSEKYTGYSREWAPREETTEEGEENLIREAPGLGHRRSKSGPRAQRGTHMHSTPRLGESLGPQRNASRRGAQCLRWHRECGEHAFPRGSISAEVAHVGVVAR

SEQ ID NO: 969451 - protein, 121 aa, Homo sapiens
WVVLLSISLWLALLFFAVYILRSSFCVLTTGANFGVLPGGPFAPPSFCPALSCLFSFWVTPFFCGHRGLQLVSVCAHPLCPGVLCPTPVSCISKLSIISFGLIGPLIRSFELRTFPDGIVR

SEQ ID NO: 969452 - protein, 143 aa, Homo sapiens
MGCPQIFGETSYKDCCCGFPSASPPWVKKKGPTDGVFVVVFCPKHRPPFGENMVKPVLVLSTMFGFLGGYLLGPTPHKSFSTGAFGSISPCDYPRVAKGKKLFYLQEASFLGDPPLRGASVLGREKGPFSNSHSHRRSFEFAL

SEQ ID NO: 969453 - protein, 291 aa, Homo sapiens
MASVFRLLWALSSRCLVYGSQYVLPGGEFQTGVLFLYGVVKRVTGVFAVCEISPRAMLVNGALLWRSHNCGPLVENVRSHTQDPGILFMSTGGAHNIWFAPLGRRFVSLVRSPTFFLIEAASLWGLTKGLHQQPPRLVGKTLCELGECSHRACLDEGLGKHTPTFFGGTQRIWDIFTQQGSFAFLCGSLGTPCRNPSFPVLHLSHNNTRGFLTPGSVNLSCRYSSPLLCGGLTHLSRVLCALSHTCWKCRGGTQGSSLFTISCCLPHGRLCFSSLLFLGASCLLCLNFLVP

SEQ ID NO: 969454 - protein, 79 aa, Homo sapiens
DIILAGRSLPVLWIENSYCGLAARIPIHILTGDGEVNYFERIMTALRPPGSSYLLIDGKKLEYLRLVRYMIFWSARLFP

SEQ ID NO: 969455 - protein, 164 aa, Homo sapiens
MLLARPPGGQQIYSAHTPPQRCNMVLYGSPSFSGRKSSGGDIITPPSSRDRYKEQNFGVPSCERASLLYFPGDSFNATLWEFFKENHLVFCPRDGFETPSVNIGKMFKAWVCPPPGGKNSRKYKPPSGDTICLFLERCFTPAPLRLHACVASSGCHTFLAWGYK

SEQ ID NO: 969456 - protein, 205 aa, Homo sapiens
MPPVIWWKNPILRGFEWSPLQMGELCALPVPLILGEPTPTKKGPGPQPKSPHNPPTAATDNSFVPRNTHLGPWEDHRGEDITGNGETPTSPHITGFLPPRMFWKIWFVPLDDPRCEELGGPTVPQGDSVPGLQISPGPSSNCESLKRGPFLLKHPRIFPSTTHSKRPPSGPQRPLGARPHKGGRRNTHWVHMGRGHGLEAARVPS

SEQ ID NO: 969457 - protein, 136 aa, Homo sapiens
SFLLWPLCVAHPRFVSLCVGCYPLPRHIGGLWLDDLCSSRGFLSDGMLVPACVSPPGCGPSTSPFLAQCPGFSSFVVQFLIGHFVLKCNVANSGPTFGGGTKTKVPCATKGCPPSNCVAKSQSRAPWGLVRSPHKW

SEQ ID NO: 969458 - protein, 255 aa, Homo sapiens
MGRPPAVLFGSPPVRVIFVGEVCHHTQPGVVSPPMLPTVATSFLCWESSLERGETQNLRVSPPLFSGGNKNKVLGRENWGPPPKNFLLEKISRRERCLAPTSGLEYKMGFLSGTQAPTLGGVLREALSLTETYIPHPFLGLSHFLSCFLVNKWRDTQTTGCRGGGVCNTHKAHSGETHREGALARESLGSKRVHTTRVSPPRERLHREGAKWRILIPPRIYLGHTPHFFNTHVWWEKNPVSSRNSVFVLHNCGHS

SEQ ID NO: 969459 - protein, 220 aa, Homo sapiens
YVALVFVCGVVLSYPPSVVGVCLLSSFFPSPCVIFVAVLFRLHLDVARPLFLLCDSPSPFCCLVSFSAARSQGGAPPSVCVCISLFYLVIWGGVNFPWGVFYLLLALVCLSSREWTSLFLSSLRGVYFSPPCRALNKSVWLLVRPTRLAVGRRPTSFVVVVGLLLSSVPPSGVVWADLLCGGGRTVFFFPAPTLFVGPPLKVVCGAVFFPPGESSFIRSV

SEQ ID NO: 969460 - protein, 310 aa, Homo sapiens
ALVGVAFLVLSASATSFCEGPLVARSVWGPLSLLVLGGFFVWGHLLGGMFSSMVPLRGVFFLLPPRFVCWVRWSQHGRLYNACPPFRLIPGGARTVFSRRRGAHPISWALPAVFSKNTHAPPSGGALSPTPRALVGGDSHKGPFQPPKRAPVFGGHKNNRGGAKTCPAPLLGEAGAHYVFYNCPAPAASSRPQPFHPTYVNLRPPCLWVSTGHNKGPPGGVFEVWRLDPTHHGFPGRPGPRGWKVATHSLVAPWVRYTTRRGGPQHRLTGRHHNTQWASLPPTAPGGSPDTQWVVLRTPLGNEGALGPPG

SEQ ID NO: 969461 - protein, 223 aa, Homo sapiens
FFCTFVVDKQVPCPLVWSPLFFSTHSTVLAGTCVLLWVALRRLVPPHFVLLPRSEVWLPSLPHLGVANVPRCLYKRPVGDTPPWVLFPPPGPHTTLFGGGCSLSRRNCCCLHVRLVFSPPDCRCFAPPSVPLAVSHWLLPQVFFRQHIAKDDDMAPGGSGKKCPPKGERMRAPPTVAQKWSHNWAPQIPTRGPHKEFALAQSCLLAHNWRTSHNAPPNTGSFV

SEQ ID NO: 969462 - protein, 167 aa, Homo sapiens
MCPPVYNAARKEWDNTPGGPFAGTPDGSALLNQSHKGRFLEAVPHGQRGLDSSTWAQVPFEQILTLPELKANPFKDRIFRVFSTSPAQAPLSFEDFLDLLRVFSDTATPDIKSPYAFRIFDLDDDGTLDHEKSLSPAGETASPGEGLRNTTGLKCALKMKHAHIEQT

SEQ ID NO: 969463 - protein, 215 aa, Homo sapiens
RCVEWSSLGLITDAASAFIVSSPSYDVFIGWLYSPPTMCFCVLASYHTTGCCFVRGGAPPPPRVCSSLATYFFCMPRWLSFLVRGCSPSLSPLVDTPRLLPASWCGLLLADVSCGVLPSPPVGALPPICSSPRFVLEYLRPRLAPIIISLGVTLILGVPPPPFVLNSTRNSWGGYISSTTLPRVVFFSFMMVSSWGPPLPYFGVPPPGRTKGVFI

SEQ ID NO: 969464 - protein, 232 aa, Homo sapiens
MLVGLLTLSYNTDKLLVPLVLKSEKLFFSRILEWRTETHDEVSSGVEPKRHHKKKVEHPSPPPQWGDRNKDAWALLDKPLGSNQKRVEYKNVPVETPHMLHGPPRIITVAPGALNRPPPPSDFWGIFGPKNNRGLSNHMWGNKSHKMFARSEDLVYKAEKKGDCWYFPPRLLSRGCKKKRAWGKRRCGPASRKLVSRWRNFLWREVLTPAGRTTTWWDNIGVVSPPGQKAAH

SEQ ID NO: 969465 - protein, 321 aa, Homo sapiens
MAPPPPKVFLRGALLPPQNYHMAPRRQLSRGAHTNYCDPEVFGFRERNSPQRLGCLIYTTVSFGVLPQPRSFERIEGQPHPHLGVHPTQHTVSCLERFGRPRSMVPNALQPQRACKRNAKHSSHGSPLGGILEPLGDSPLERKILKGHASWRNTRPREGEVGRAPPYRPLPQSGGTGFKRGVPLLAPPESSQRAGDQETPGTEREQAATGPQEVNERPLLKHITRSKAGEAERVSPPYPPALLEQNVRGALNFGECLGARTQTPHAQPLHKEPPTPPGDIVEMAKVVFEETTMSTQDFEALSPPEAGYPLGSRRPNKKFRV

SEQ ID NO: 969466 - protein, 175 aa, Homo sapiens
LFNGLPLPEFPPGGNPPILNRCVCRPPPIGTPPGGSSPSAFAESLIPFMASAGSRRYTMFTHTRGTPPYWPPSRPPYFRGDHLYMNTHLVCTTKKHTRSGDTAFPRNSPRGDISGGTHTGFRRRTLTPQFSPLRKKRRAHETPQGAHIFSHTGGRRKETHTGEREIIFFLGVYTH

SEQ ID NO: 969467 - protein, 127 aa, Homo sapiens
HKPVGVVRALFRVVETPVGVVPPFLRGGSQHPVFLCLLWWVCLPPPLILGGAPTLVIQLRGGFAPPCVVGRTAAGFCRSPAEKAFFVGGENVPDQNPPPHWGTCVEHHRNWYTQARHNHQHVGFSFV

SEQ ID NO: 969468 - protein, 238 aa, Homo sapiens
MGGRGPPFDTPQRGGALQTIDKVDEPNVVLYHHGLSSSEEEEEPAPPMKPSDVYPPLGAFFLPLPLPIGGMRRCFLPSSPPLCGPPPSGGTSSKKRGLCRSVCFSPEARGGAPTCVFRCWIMRGCLLGSSPLLPAYPLLGGRRPLLPQPAGWSSTPLVESPRGVAPPPRRGETPHTGEGGALWPPLRARTTPPAFLLGKSLLPPRRRSVSTTTGEETTAPVGGETRRATPTSSVVALG

SEQ ID NO: 969469 - protein, 363 aa, Homo sapiens
AASLSVCITLCLSVLLFLLVLVLLSRFHTLPCEPGCKLVCPLCPASFPVYVPGARPVSIRGLFRVCRCSWVQFVPYVNFDFELISRVSHGYPGGTKLPSCEDRSHSRVSFRRNISGGYKTLVDVMVLSGPQRISSCYRGESFSPKERRPKMGFQSEPPHFPKGLPGPRYEVCKTHMNSASFPPLVHMANHAFLLTQDCKRNLVSGGTGVHKNFWVQTFWGYWETGAPGPRTCVLKTFFGEPHMRRPTTVPGPAPTVKGGCTTKSKFVKSPARSYTFPLPHVPTEPTVNGSPPEMLYLNLGEASRRPREAQGSTFTRHTVCLSPAGFSGSTKGPPACFLREFWEMCTEMTVLSPHIFCFFGRSG

SEQ ID NO: 969470 - protein, 105 aa, Homo sapiens
RDPGCPRVAEGVLVPSPAPCGLQSLCLSGRKLFPSWIRRVPFLARWVPASRADGDHTRRVFYVFRPLIVCPPKIVFLPPLLHLLGGYPPVLWAENLISLSPKTQD

SEQ ID NO: 969471 - protein, 109 aa, Homo sapiens
TGDGDNGPRPLPRGVTAGVQDVAPPVAPAKLFNGLSRSVAFPAGLIAEEKIAPANGTPPHASPPELGYSLRKKLAPEARYLDYPTWVVTDLFARFRPCIEGYVSPWDVG

SEQ ID NO: 969472 - protein, 143 aa, Homo sapiens
MGGGFLPTVPHATGGFSLGALWRRTFLARIGVLASRVAPRVWRSPDRGLFFQAVPKLAPRPHGFGGAFLGSPSLSGGELLEYPRSPAPRFWGFSPGPDQDWGPCRFERLAQYKRQLSPELKRTWAHQAKFPRPGTSKKPPGAK

SEQ ID NO: 969473 - protein, 127 aa, Homo sapiens
MVLQAPCTQSPRKSQAHPVEAKPGETPLITVWLPTPDERHPSPRGIVIHRGPGRRTPEWWIGPPLMEILVRQGGHSPVSNCANIYRCLNCYWTKHLHVMFPFRYWYPNSCHDNPFHETVCMATPTVL

SEQ ID NO: 969474 - protein, 201 aa, Homo sapiens
EARLNPSTEVKGFRKICCVSFGVVSRGRQTSVLGGKLQWVLVALVATLVVSGNRWPLGMAKTGIVIDGGYGEKRAGYFWRNPRLWKWCDRVMETRASGLWREWPAMNQRITNGGGAGLWPVVVEANFGGGVKLTNDFGGFPKQFQSFQIFGPHEGQEILEAEAVAPYGVEAHNFAEDPETQVAMRVPTSSRSYGQWPEDFN

SEQ ID NO: 969475 - protein, 140 aa, Homo sapiens
VVSSLCAFLCALFVRPPPLFRGSWRAYLIVPSGHMGFWITVLSSWLFVSARSRIYISVYWGTRAHPPFWDGSSGSPWAPVFLALPGFLCQLSPHPGLSPILFCPVLRPQCIRHWFLEIFWFKYTAGHLGHPRCPRFAPGF

SEQ ID NO: 969476 - protein, 256 aa, Homo sapiens
ESEPGDPLPASQLAAAILGGVDPRPTTNPGAKVFLPRGFLGHPGVPQVSDNRWSRSGLDLTPLEALPPAFWPAEAITYNLVPKEGAQHSTFPVNRGCLDTPPPNIRIMLTLPNGWNVNLCSNVGPTPTSHEPARLLAPEDAHHPSWRIWKDNFVSFSIIGPTALETPHSLTAEGRCLPPRVRKECHHRRNTVARHGDTVEPLRPHIEKRPMPLVRGKCNKAPPPGEETEIQQLSGLREICVDTVARVFFYLKTHPF

SEQ ID NO: 969477 - protein, 77 aa, Homo sapiens
QCLPLLAGPLPPVSPMVRRAKSSSGVMPARGGSMFTTVPLVPLGPLSRVPLGSRVVAYLSPGCVPRPAFVPGFSVRS

SEQ ID NO: 969478 - protein, 161 aa, Homo sapiens
SPPIPAYFDLSRRRTRYGASLGNRKEGPASPPSEERFGLGPAPPSPPAPPALSLLLLSSAVVPGPQLWRLHPRIQAWGLARGPTGLGPGVLSTRWHHPWAPGPGRGKLVDCRGSSLGTRSFPLLSPARTDGLSVYICLGRGGRPPLVRPQRGLRAPGCVPT

SEQ ID NO: 969479 - protein, 131 aa, Homo sapiens
MSTPWAVSYRPPRSPNCSQDACGPPSPEAFWEFKTTKGGTILAAFSNRFPRPDKSQTCVVPPMVKYLRNAWAWSVSLSPGILGTPDLAQTKKTVTEGSESVNPQYRLAFFTMITFDMELKDPRIYGVASES

SEQ ID NO: 969480 - protein, 121 aa, Homo sapiens
QIPGERKHTIGGATILVGARHNYPHRKRCGPHEMVPHKRGSLPRHPPPGVGVAPPLEGKRPPHEEINFGGGRRRTPPFLWMDCDAFHTESGPPHHRERLFFFCTVLLLARKPLFFGGEIFL

SEQ ID NO: 969481 - protein, 134 aa, Homo sapiens
WPLGVCPTRPPYILCAPPPPPIWGEDARRPVGLFLSVGSSNGWTFYSPLGDPLCPPGAPYILYGPPPGLILPPPSVYLGRFVAATHPRGFNPTVGDNKGPNRFFFPWEEPFRKKGGQTYRVSWNIPAPRVFLGV

SEQ ID NO: 969482 - protein, 104 aa, Homo sapiens
MHRGDFLGPFCVLHPQGMGPSLRDSREPHVSGPHIRVPTACLAPGCCGAPFAHPLLKFTLLARPREHRGFFGASVERLLPFVSPGFYGILPPVKKSVPQGAPHV

SEQ ID NO: 969483 - protein, 83 aa, Homo sapiens
PAVSTRLGGETPFVFPPRGIFLLRDGAVVWFCYREAFFIGGGVVITPTRGGALFLVGVSTPPFLYTVQIALWCSFYLWCEKRQ

SEQ ID NO: 969484 - protein, 128 aa, Homo sapiens
MRVPREGTPQLGPSRRIHLGFGLGPLVVPWVGGHSQVPTKTLCCFRREFFFLITPACFPWKKGLGTHSVVLPTRFEGNFWWKARYIDVAQKKKKVVANAPPTRGALFLPQVIFGASESFVRTKYCTTL

SEQ ID NO: 969485 - protein, 70 aa, Homo sapiens
RTAGTGSFFVAEFSPEDICPKGDQCLQEGEVAFNCSWEGVLGKPILFKPLEHVGSYHPTLGFGENLFCTL

SEQ ID NO: 969486 - protein, 81 aa, Homo sapiens
MLGLLPTSVKCVSEILRDTLCVSVEKRVFTSTRMGSLGFQSTLPHVRGTFWNKWRALQLMRASNVLPPFLILTHKFYFLST

SEQ ID NO: 969487 - protein, 170 aa, Homo sapiens
FSTLGVVIHKRGLFLSRCFFMEGGRLYTPCSMVLCTPSLCSELFPLILSPFSCVPWVFAPLFLCQQRFLISYTCTFYYFLKNFSINTLLRDINIWSPFVYIILLWRGRSLSSYGLSLVSRSSLQISVLGVFLFTSSPPEQRGALRRVCPPRFLHTLNIAQFVAHTHKGYS

SEQ ID NO: 969488 - protein, 102 aa, Homo sapiens
MCWVLGRWLVVHKVAHPYRGPRFSRRRKNLCVCATNGGSRRALFLAFHYYVVEKPFYHCLQGPRGFVGMGKKYRYLQPGASKMRGFSLPWKRFNPTVQPELK

SEQ ID NO: 969489 - protein, 268 aa, Homo sapiens
MLLWGRPLFSCVCGAGLMDRTTHGGGGYYCSPSFVDGGESRSLASFLDCCPPTAGLFVVAARPDEVMMCFVVPSFVELQQGGCASINCMFLVGSEEDCYVITFAVCGLSPRVLFIVCSVRLTPPPPRCWRCMFVVFAPPHHTSFVVVVFLVTTGRVSLLFVLSCPQSYCWCFESAPSYLLGGAAFSLSEGCEVMCASSEEEDIVAGGHHHRRVFIIDEIINVWGGDVLYSPRWLLQQQEVADNNKGGRYNKRQVFVDINYTGGAPTPR

SEQ ID NO: 969490 - protein, 115 aa, Homo sapiens
CLCCRPYCRWFVLVLFLFFLSLLAFVFLVSASAFVASPPCVVSALALALALPCAVSQLARVLIRVRSGSAIFPGLVGLCHFVYPWGLLLFSSLVSAARPDSCDFVLILNVPRGFT

SEQ ID NO: 969491 - protein, 103 aa, Homo sapiens
MPVWRVRSYTWWVTTPHQSDDHRVLALIHTGIIETALLFVHPNQLGPQNRPSTRGGADYPACRLPPAPPNYAGRFSVFGGRRIGETLLLVEEDVRPPSYVGDR

SEQ ID NO: 969492 - protein, 367 aa, Homo sapiens
MWGFYPNFFLGGNTTWRSHSDSNTNVPLVPFRGVTWFLNVAQRTPLIVPSPISDGTLGETNAHDFLGKICCPLYSGGNFGPFVFTHKGALLREISRGPIVVPHIEGCHNITLPPMAVGPHVPPNSRKSTLWPKAPEDNWFSRGPEERPPPFFPRPFRYRPPVKSSPGATPLESLSDVQPDPDLENQDGETQLIDHPLLNTASTSVPPFPLGWSIQPRCSTQWQHFTHPESALNITREGNFAHFRFLEGCPPMLPQCLSARIGYPTTVAHHVSPILFTHNGEHTTRVLALSVETELHPSHLAEKVRPFWLSPLCLCGCCPRGCCPHQLLLLLLQPPAKVEAQEESEESDEDMGFGLLLTNPPTKANPT

SEQ ID NO: 969493 - protein, 210 aa, Homo sapiens
SVLSFFGVRSAVFYDALRCPLVARGAFISELATSCRFGRLYHTVVHYTSGVARSRCFRVLFLYARRPRGGCFYCCASGHNFLWCIFTPLASMGPDAVFGPPSGGVYPPCWLPMSFVPLGSPFIPATCVLHSCCTVTSLLAFVCFDSPSVLFRAFWAPPLPDVPRNYRPGSNRCKRFWSLPYVSLTHLLGLTPFTPILLIQGEQSNSQLRP

SEQ ID NO: 969494 - protein, 80 aa, Homo sapiens
RQKHFHSTTAYILGLILKQFHVGYRNLRNFQITSVLVEDDKVGTRYAGGARSLLLRTMSSLDVAAFPPDFKSILDHGIYN

SEQ ID NO: 969495 - protein, 135 aa, Homo sapiens
MGTLSVGLCPGNGPHRPRRRGRITISPLPLPPSPFGTGRLPALCPSWLARHAKPPGTHGFSSQGLGSFTTLLATHRKATGTDTVGEDTRNPQVTGEGRPRGGPPTEHVKDPQATVDFLHMCPLLCFCQMSHDVSN

SEQ ID NO: 969496 - protein, 131 aa, Homo sapiens
MGPNRTLERKAFSYTVVKKGQHTGGTPHPCYVASPPPYPTVFPAKLEGEGIPKKGAFSRPIFLGCATGEYSTTFARFQQLTFKYPTSAPNFRGERPTTEFDTGEIFTKGDESFFLAPFPERQRSIGHTNSC

SEQ ID NO: 969497 - protein, 167 aa, Homo sapiens
MYTPAFFSVGPLPRCVLRPAPRAHSVATALLRLSLPAPGVSTQIALLSRRGHIVGTTEPRGFPTEKLAHTHTHSRGVHYRRLTGTPQGVVAPPRSQAHTCLTPRHYLTQRDLSAHTGAPHRRYRGSPCVRGALAHKISSIPRVSHEGVPLWAHHNPQPSFTLLPPRG

SEQ ID NO: 969498 - protein, 94 aa, Homo sapiens
HGSHMNDLPQCFLALGGHLFVSPLVARLALYEPTPHLEPRSSASTVTTLVAHLPLWPIHKGPVYLPIIRESFYSARFRPYFPGVHTLRPIHLTP

SEQ ID NO: 969499 - protein, 147 aa, Homo sapiens
RGSVATEGMRQGTGLLARAPTASTTVRLLCGKEDQLVTSSHQRPSRCEYLYGADDSQRACPEATALKQHPPKTAMSELLLDGRMRTSRRHEASALLVPCHPRPSGPDLWLLLPSYCGGRTFVGLRALLWGPGGAGPQSQAPTAFKDG

SEQ ID NO: 969500 - protein, 191 aa, Homo sapiens
PFPRPSPSHWFWTSLFFPMPAYAFRYIGSPHSAPSGAPPCHVALDRPVCPYHRHQSNSLAILESCRPNPSLRFHTSSKPLPARPHIKKDPGLITGTTSQKRASRARAHLTLSGKKRRKLLPQIRLAPKEKTALEVEAPSKPARTSEPQLQRPKKTKAPPDVEMKDPEDEELNLFPYEDFQLEPAFRLHVVV

SEQ ID NO: 969501 - protein, 107 aa, Homo sapiens
MRNLCLPLRGILDTGRTPHLSGTRLAFIPRAPQEKLGNGPHSLRVATTLVADCWLLLGLEELVGRSTLEFGISQVLCPSTPPPFWGHRKQCPRPELGPGFYGGSFAV

SEQ ID NO: 969502 - protein, 131 aa, Homo sapiens
QWAGLVPPTHRGATPVFLLVILLHPKSNVSLLGDAMKMNKTPCNIPLSVIKKRRLCIENNLGGEDTPPCCVSLTVEGSTCGGQKFAGRAQQEGSLAIFPPLIKGPPPIYLRWTGAHQRKWSPLVGKRGPKV

SEQ ID NO: 969503 - protein, 203 aa, Homo sapiens
MRVTTGVTSPQDSPELGWLMQVRNQRLIFGQGLAERRLLEPAYESHNRVQTTVMSANVTRSPTRKVLVVQVSIQQSPEFASFLLCILSGLYCLVLHECPRWGTPRYCFWGHYIGISKAQPSVHSLWCSLASWEYVLRARSCICISIDSAIGVALKHTESIITLKCWDLAGRKFAEKFRGAACFGQNGSRGGADEHAGPEPRLY

SEQ ID NO: 969504 - protein, 229 aa, Homo sapiens
EAHKGHREPPFCVSLAPHEVTRVSSGVEIYSGTVLANERSTPLHVGSCAIMFSGGTFDKGAAGSPVVNSRGICFPRERTHLRAFTEAAQSHSPGDCSTRAGDQAEERNASCHVSLLFWDHSHSSSTFSGDLGLSDGHGGLPFRLRSTNWHGGDYECNNTTGGETGVLAREGGTHERWFESTFPGRGPSSMWAKPSIRARSSSEHLLPSPSCLHLPFQGDGGHLKETEHL

SEQ ID NO: 969505 - protein, 176 aa, Homo sapiens
MRFRTKLLWKMYTEGGCFLKRTVAKGGLPNTPGSPEPHPEANLSKWLHQPLMWRKRHARLHLESTAAGDRPPELSDVLETAADTGSFHVSPGRHVCLGAHVPQAWSQNPTESEPFLGFFLATSLCTQPHGLFQALLMRHKPAASPTGVAAQTFSAPPWEFCQFVGAFRVKSMSFLS

SEQ ID NO: 969506 - protein, 105 aa, Homo sapiens
MYTPLTFSGPRTTGGFGETFPNSTFFSSNARETSCNLKLWGGAPKLIIRKAVLSAIRWSYRGRELSSRLGNTRSVGNLNYLRPHWEYTTRRQRNNVMASTFGGWE

SEQ ID NO: 969507 - protein, 77 aa, Homo sapiens
MPLFLRSLHKALICATLGGFTFLRSSRVTRVVRTFKTVKRVSLTECTLGQSSQGTRFIWAHRHKIGSSSVLVPVSCV

SEQ ID NO: 969508 - protein, 95 aa, Homo sapiens
RSAIQLRTLVRILLNHGGFMGESLGHGRVNATLILLLRKIYAGNGSDMYHPSRERAYMRRATHEKKEGEEEDGEYTEETTLKEEERRKALGNSRR

SEQ ID NO: 969509 - protein, 116 aa, Homo sapiens
MVISRLNPYSWVASVARVSRESSLVNMSGIMSERFRNERSVRSGDAHGGLGWRKGTLPYLCPPVLVHDAVEHLGHTHLQISDTPTPSLCTVTSWNLGTSTLVGKHRSMWGEQNVLE

SEQ ID NO: 969510 - protein, 101 aa, Homo sapiens
LFRGGVCSVQPLCRGAGIIGPPRLCGAPSFCWVVRPTMGVLSSWRTTHRFVAAERSTGGSMLLVFPRLSVGQTNLVRAWAPLDLSLVEICRVVRRPPQCAE

SEQ ID NO: 969511 - protein, 174 aa, Homo sapiens
SGVRARVVAVGGGVVVWCVGRRWGVRGYGPVGGRVRRTAWPGGFDADWRPGSQTGESVEFAGICVRGVMRCGVCGEEHGEGPWVVRCHEVIEGGVFCRRHRGGNFLFVEAGYGRFSWGVRDNCPVVFLPGGFHGGGTHFVGSPTGVWGGEASEGSWGRAVVKVVFVRPVCKAAG

SEQ ID NO: 969512 - protein, 269 aa, Homo sapiens
MESCVTDGLLLGVSPPPDDPLLGKAPFMTARGAPSPPGGGNNKPEQQAPRGLGVFLGHRSSIPQRGVHPASALFPGRSPRGTPPPGGKTTVWWGTNNKRGYYTPNVFYQGGDMMCPRGNTPERGTPREERRSHPLSLSRGGHLRGEPCWPPPPPRGPHTGCDKVSSRGGVCAERDLRGVSSLGAPCSGREWAFFPLLVAPSSKGRPQRLSHTHPSPCGEKLPEKNLTDAPRAGRGGFFVGGEEGGPALLLLLRAPVGGATHQSSLPPQG

SEQ ID NO: 969513 - protein, 141 aa, Homo sapiens
MLCTFLVAGPPPMGRVDIIRPLKFFRGGPPLLGWWIALFGWTPRVGPRRIFSRGARVFQERERIVPRQTGGVTHPRRPELLPEIVVDTGGPLLRKRPPECVARETSPFGGGNPGEISSSAAIINPRSSGDANTPRRNWGTL

SEQ ID NO: 969514 - protein, 359 aa, Homo sapiens
MICLCGEVSGGSQCWGLVASVFRLVSVLFLLRGLMLGVVRLCGAVEGRVVHARVGATLVARAGVFLGEVIIAVEAPPTKPFVRSLFLPGGTNMGAFEKGQEKRGFFHEDVFPVGGQRVVVWGVPPMKVWGSSLPIGSADAWGFSIGYTRVGVIFRLGTSCQRSRNYMGPPGVYVPPLVILEVCTPTGGLPKLRKCKGFGSEALIGEKEFVFSPPLSLGYKKKPLGEKELGPPYEIFSVRKFSRVRIAVAAPCGLRYMGCLSGRQAAHIGGCRLRESRVSLGGVVSHPLSCGGVLRVCLGVSVDIYGESARLRFVAACGVVYLYRTATVGEPPREWALALGELCVKRGHRTRSCAQERCV

SEQ ID NO: 969515 - protein, 163 aa, Homo sapiens
PGAPQEENHLGTWSRKGYTPKFSRRGTKKIRGREEPECSLPYMTKGRLWRPAKTRWTILGPRGTRKKRPKTCEDCRKQQGDTRGSTPRRYSPVSLLSAFHNGKSQPGCEDGGSFPRAAEIYRMRAPNTERILGQKNVNRKNNRNMGLIKRIQNCLEERGKNNL

SEQ ID NO: 969516 - protein, 298 aa, Homo sapiens
LCPPPPVQYDGGGKKPVAYQTAQLCFLQQGPPYSSGCCGSKTNRAGGFGFTHTDALASSPPPSHEGTRKAGDFLWVGPHAPQWVISSIGARAGRAAALLRRYSIDSAVVKKPRQSRRAFPRWGENHTPCWRPHHCCRHTADCGGSALLQEKNKQRGELKQIQHRIKNVNMNPHNPAHTERGRLSHARCRRKRSTTDGDKKSGGDPARSESPPPAGPRERPPAPTARRTRERTYSHRNPRGEVFSPPRPSVASTPRCGYMGEEEDTPPPEGGKARHHTNCVWKHGHTAARRTPRAGGFL

SEQ ID NO: 969517 - protein, 202 aa, Homo sapiens
RTLGPPGGRGHPSLPRGVGHIEHPEVRERGGAVCPQRKGEHAGTILGGTTREKNTPGGVSPAGETHPGGRPRDPATKRGVHPPREERPTLGGPTIKRRRTPREDRVALCAAPPHYNMWGSVDRHHDLGGDVAPISCDPPRRTGTRWWHVAHTLINTLGALYMFYITELSTRLIDRGSAQYYYRGEYLIYRVGIANTPTCMFF

SEQ ID NO: 969518 - protein, 159 aa, Homo sapiens
MVPPTLSTLAQHSTGPIHACWFQRRNFPSHSSPRQLFRPQRPFLATGKHGRRALDAGLEVHPEGRESTTHEMTLVSEVSTHVSTVPPAEEEGEFRARRLSERRWPRALQSTRGKPRETTCESLYSLPRLSCGLFPLCALAVFLATTMLYRHHPLKHFYS

SEQ ID NO: 969519 - protein, 188 aa, Homo sapiens
SYVVASHLVWGGIFFWSSLCARTLLGVLVVLSQTGRVGPLLFSDCIGSSVVCCCCASTSSSLSPGLVYITLLVSFAPSYSVMLIMYASPHLFGFVCCQPWCMLSRSRLFFFVASKDGMVLCGVLYPALCVHPLCFGCGSPLSLPVYSSTVVFVFPGTVYYLSLGRLLRGLSVSSLLPFVLPLFCSPHD

SEQ ID NO: 969520 - protein, 361 aa, Homo sapiens
IGCVPRATGGASGGPLVAPSELGGPPGWVSPREVSPPMGIIPEAPRGFLVPVDTGPRAAQKPPGSFSVRLKPLEVIKECGMPPSPPKGWAPLGFKRDKLKEILKLPLGGGNSKFSCSRACPQLIGDSRGIPLSVFPLGGPSSQRDMRFLKKFKPTSPESQTPVAGAQRATQGVLKAILLSNRGRQTNGRNVRSWGVISASPKGEVGPPAHIPLGGPHTHTPGHTQTLFHIWSPLVATQKAYPGGGTHRDLGTSPHHAGPPVAHRVNTEPPVRRLWCLVNRSVKSPVHTTTGGTHWRHLCSATHWWPYKRSCLYMRWAVYIEMRGNTPLRPGGVHTGHTRGHNFCPKATLLRATFLKAYTLT

SEQ ID NO: 969521 - protein, 108 aa, Homo sapiens
DVVVSRLRCCVMVCVLLCCCCLLCLRGALVLFVRCLVFSSSLVVVFTTSLFCAVFFRGERLIHPLVVRSLWYSPWSVLSLPGLLCLWARGVGLSHCCLLRVAHCFGPF

SEQ ID NO: 969522 - protein, 222 aa, Homo sapiens
LIYLTCFFSFCCLVFCAASLLCVWSGCAVSVWIISHCVCRAFLFSRIFAGGAPPFPFFWVRPVFSLPLRPRTLYGGGPTFPWYFQQLLGSRTLIFEIWGDILPGTSGIPVCELYPRGIAQNVTSSLSYWNEFLKLSHVKKLFLGGVSLSYQSPFRWENTVEVPLERRFGNITIRDILGGIPFYAVPMLGNKLSSQDVDPGCILPVQSDVHTHDTVNPHVFHA

SEQ ID NO: 969523 - protein, 120 aa, Homo sapiens
SSRPPCIVYLKKKQTAGERTSVPVSSSLNQAWYVRVSVAGCLCRAVRGSSIYDLYIVLLEEYSSRGGLLISALFFFVIARSVRGPYIRLCGSPTHYSSIFSLQRIFFVPAVVSFSTPYKW

SEQ ID NO: 969524 - protein, 168 aa, Homo sapiens
LSLPLWWLLSLSVSRSCCRRVFPRLFWFAVFFLFTAPLSCSAVFAALPLGGCFLLLFVVPRVSVLFGLRAPDCLAVYRFTAWAPLFVLFGVCTLSLRCVFCACASVTPIVACPCVYSRLVLLCVTRRFLYLWMPSSPLSPTPRGQPATWPPNYFTTFSLPVTQSSEQG

SEQ ID NO: 969525 - protein, 239 aa, Homo sapiens
SLSVFDRVCLLCWCCSPSSLLVVCLVLPVLLLSVVRLWSFFGASLFFRGVLPPYIYGGLVRCFDYALGCSFCVVLSHSSLRGLGGSYFSTGGAPTNGCQSISWRPPFCVGVPAPCLLTVGGCHPTVVSVLLMTPLCFRCVSFLSLIGLPSLVINTNHNSGVCEQSPPWATNRGHSPTIEDANLFVCYFPCVTGSFLLFTHPWFHLAPVFIFVALPPPIGNFVGEFGPPSPGGKLLLGGG

SEQ ID NO: 969526 - protein, 352 aa, Homo sapiens
MLLCVVIIVMLLLMGQTFVGRPSCTISGGTLIFTPLWGCFRGSNQTPFVSLEWSKAHNHKYPTGGDYTTTRRLFLWVCTHSCGCHVQIHATTCGVLSFPLIHPLCGGHSIFLGASFPGGAPPNKGGRDSLVALYRESHPVWHTTFCLACVLENTHFVCERECAPTTAPHFLGTIYVFEERKKVGISHRECYKHHTFFRATPRVGENFIPPWITPPHTPGVLGVSLGHTGVSHGHKMFIGGSCVGCAKNTHRDVGERKSPFHIVEKKPEVSPRHSLVAHTKVLSLCGGRLWEINFLPRERPRPHKGEGLLLERKIGGACRGEKIGAWCVSSTARPWKLLLFEGFGKLFLPAAF

SEQ ID NO: 969527 - protein, 76 aa, Homo sapiens
GFSTHTSSILVAQKKIYGNHWGDYKRPRHHTTRTPGNMAREKIFRVTESFIPEKSTQSPRVPQESKIREDPRFREQ

SEQ ID NO: 969528 - protein, 127 aa, Homo sapiens
MSFVGYSTHPRRERVLEERGEMPRQRAHKVESFSTTTHFPHVTFHETLGNAGGPGLPKEELTCIMEIIPGPWGTERDEARLWGGSRATGAGDLRGLLMLRLYQYHSRTHNLEEKLSNPKGEEKPFMY

SEQ ID NO: 969529 - protein, 283 aa, Homo sapiens
IRLVSAQYCSVVTVQLLVVSSSYGYSRGAVLRSCRVFCRRPLGAGWINSFLSSSYLCFSAPLWPLLFAAPPIGDPVLCAPPINLRGWVIPGFRWIFPPGEFFFADESPTARLPDMLNILMGVILPPTRPADGCSSYLTRGGAPLVFQSPRRPLVMVSPSLLRVPLSRPNVCENVFHNTCVPDKLRPNVKPRCSFFLIITLMAPPSTLFSSRYPTTAVCSPNIFAPANWKWGPPRCLVLIQPGDGDYGQTPSNPQQVGPPHTKTSNNHDTCGCPTQKAPAFFRK

SEQ ID NO: 969530 - protein, 115 aa, Homo sapiens
WHLLVSPGIYLNPFRGRHLSHPSRVSTPGIWLKCKKGNYWEYKGEIPAFFESPFPLVSRVPGLPKSGPTGKREGGHMGCGAKKGAPRPPVSRLIFAGTLNWCPELGGPQGHKATL

SEQ ID NO: 969531 - protein, 110 aa, Homo sapiens
MTTPVVEETSLVWWLWWHPGGGEEMVHGDAIMDLVMMEAILEVVEAQRFWGYNTSVFTNLDALKGGKFGGRSSGPYGGGGPYFAKPREPRWLWRFQAAASSYGQWPEDFK

SEQ ID NO: 969532 - protein, 360 aa, Homo sapiens
RSGANETETQRCPEELNSKECVSHSPFVESPHMLFSCPPLFVSLQNGPLVGTRNTYFYIELDIPFSSRGAPRRIIGTTFSYEFLSYYGSSCQKQKLFCDTRGDFVCSLPRRQPHLGGREIFSISPHPLGGPYKKQCHYFLNTWGSPEEMFTPTLMSVKALLDLCLTGNVPLYSSCRRKPPLLSHMAAVFLFCLGKMGGSPPHTRRSAQWTTPPRYVVKISARLLIGAIATEWDIFSTPCQIVPNLTHPAAFLWGILFHRDPVFLCIHGLTHGPPRCLIPRKEPFTFATLGNPPRRMRAHLEPIKWGFSHDRAEEVSLTETDLSFFMRDIHNLWHREFLHTHENMREDALSRDVWKGPHIR

SEQ ID NO: 969533 - protein, 255 aa, Homo sapiens
ERFQEARVPPHRSEAPAGPLLSLPSGGPHVGGPPFRRNVCYPPHLPPLFFGTKSLSGVCPPGVPRPMGPPKGEEPANTSWPQRYSGGPPRGPPARAIRRSPRPDGPAASALTRRGGSQTRRNLNKPGVLRRISGHHFAAPWRARGAPGESQHHISPPDRNFHRSRDPRNGLVEKITPAQAHEGGRHRNEAHGNNLPRGVQPRENTRCAPRCGAPTPVSLLPVPLRGTPGPGGPPHAPSYATRTSQRGVSHFHVTL

SEQ ID NO: 969534 - protein, 262 aa, Homo sapiens
VAPPFVSRFLCKRRFPHGSYSDLLAWAYNRCFWYDHFSEICLYLGFPPGKSPLLWTRVRPSAYWVPRYPRILPAFKTLPHAPEPPASQLLDCLDFLDGPSGDFPSISLPFWTPPQEVPWYTCLTFPCVPPPPAPIPDFQVFEPEGVPLDLSFIRPPGNPALLLITIPATHFFTRVMSPLSAARLLCPTGFHAAQLHGPPWEPTFPLGVAFLFTPRFFTDPHILPRPPCGYKLRLTYDHTFTPVGSRRIFEGEHNLPVEIAGT

SEQ ID NO: 969535 - protein, 103 aa, Homo sapiens
MPRQNSSPPLRSMSGFFNHRGGGGSNRGIIILLLSARKMLVGGPPPPAGGVFINHISSPHLLYIFFLLSAPYEAAQSFHTDLLRVVRPQRLFNTRVVAHLIIY

SEQ ID NO: 969536 - protein, 161 aa, Homo sapiens
MSKASFTLMSSWYSRSISDSSSLACAGQPPALRRYAVGINKAYLTIGPLCISHGDLKSHGTAFLMFSISCPQPVDHQVELRNYSLFGVLQVVTSDVVNGDLDLLDLGLVQGFSLSDAPLGNLLVLGTDLGNMLTQFQSRLLSMERTTDVSLTWVCIWDRIR

SEQ ID NO: 969537 - protein, 306 aa, Homo sapiens
MLPRGRRAMFCFGPRSITAPSLLPASFPGLSLPLAQRQLQKRVPPDPGFCPGPRCFRTPSRFLPGPAFNLRAILAPNEKLALGTRESPQQWMDLKAQAYFWHSILPGRHMQHVCSIPSLTTYDAHWKYKSFPDLGSAGVLSIGDSPMLGPGLCVGFDIDEDPLEIFNRNPEEFEFHQILHHGSNVKCALLSTPECPRSIPITVNYESLPFGHPKIIKGPDMAFLKTALEMARTTQYIPLPPNPPTREPCSKRKLPEWEIQIDYYSQNFDNDLPSIITSFHQKEIQWTIEVDLIRFSFLKPPQPKSF

SEQ ID NO: 969538 - protein, 145 aa, Homo sapiens
PCCLAVAIDKSTNREDTTEREQEARCRAPLDDRCEDWCPRPKARDALSYPSDGAATTPRDVFLLAKPTKRKGPMVTRRDGPNQRSKRGFPSESGDLIPWRLPPSWCAPAGGIDAQFVALWPHIPVLYRAGRASRSGTNPQEEIIV

SEQ ID NO: 969539 - protein, 117 aa, Homo sapiens
MGEAFGIDFYEVSQRVAPKVRCWFVFERILLRFPLESSALLAHCNVRLPGFNDFHASPSEYLGPQVYDIMTGYIFVNLIESGFHHVELLTSSDLPLLSLPKCWDYRCEPPCLALVCS

SEQ ID NO: 969540 - protein, 254 aa, Homo sapiens
MCATVCVWRACLAFYAPVGGCIHVSGFGQSFQAVSPLAGLPPPAPRAVLFLRGVSLHPPARGGPPAVPRKILEKGAPRDGPYVPRGPHPPPATEFRAGVPPGRPIGGPKPPGHTGHGGPPPGKKRLGAPPFEIPFLRNFGGAVFYGGHRAPPELSPTAPPLSVGRRSQWCYFAPRGAPYLRCHSNPLGPPKASKLQAHSPRKGEGGKGFNAPRPWIPTGGPPWVTPRGLGANSPPSFPGPGIGAPPRRLSVGLL

SEQ ID NO: 969541 - protein, 107 aa, Homo sapiens
MAGLHFCPGANTGLFKMGEDHFWSGPPDTYFVCSVAFLNPVSVGTWNSQTSGVNTPVSPFTRIFARDSPKGGTWKFRQTVGALVERTVRVSLSNISQLNASINKCWR

SEQ ID NO: 969542 - protein, 113 aa, Homo sapiens
SFVVCVRLSLLCRVGCASSASAARVAGDAVVVPRARTSTRVCPLIDGRADLRPRLYLIARGRDISFFHPRSRVAPFAPFFLGQPPLSGHTRCVHPKRHAVWVSPVVRGVSPRG

SEQ ID NO: 969543 - protein, 179 aa, Homo sapiens
MFAHLVYKTRSSFFCPGFILPVCPSFVPIRVLPKPGLSPHFPEFLNHRAVGRLFGAPDKLFAPLVCFSHGGPPFLVFCAPCFSTPPLVGPYGPMTLLSPSMCAPFTGEEQHQKLVCHTWCDPAFTQFLGGFLNRGPFLHTVCCPTTRGVGFYSVTTGDFSLGINGCCFFMGEGFSPLDG

SEQ ID NO: 969544 - protein, 199 aa, Homo sapiens
DAHHPAELKPGTNQVWTPTPSWEHGDDLRDTPNEISEMNRAITEAQAEIHHIQNQPATIGGPHSEAEEPGELALKDARAQPEELETALQRGHRIWHGNCVSYPELMSVKLAWTSRSPTYRKLLEGEENPLAGDGVGTLNNLCDEIPLVAVSWRWHWADPREETTGQQMTLSFSSSAGPGLLKAYSIRSRIRPVARSARD

SEQ ID NO: 969545 - protein, 231 aa, Homo sapiens
LSELLLPRCFLIRAFLFGAFFYDVFFSPCASHNMGVSLVLCVSTGSSPPWEVGFLFQGGTQGFIFCPPLVWAPPCRFMGLSPLGSVFAPSLSNFFVHSLPCAPPNGLANPWPQVYPQDQAWVFLERTSWTHQVQYHSLSPPRRTCGDGPPPGGNSWPWMGPGLLPGPSIPAFYWAAFPRLWGKSLSPELYREALHGTAPFPVSPPHATTWYTLRGASRPAAFYEENLAHKY

SEQ ID NO: 969546 - protein, 160 aa, Homo sapiens
MGILFSCVNTPPWGQDKKNLVGGGPTIVAAVNILLPLWRGPNDHSLCGEPPSLCGPPLARGEHIFGHKLSTHTLSLCGGFSQRLSPRMSRSHELARGGFVGEIPHTHRGERRTTSLLHPTVCHTPRALPHPRGDFSLCPLSLPSERVLRPSPTAWPFEIF

SEQ ID NO: 969547 - protein, 72 aa, Homo sapiens
MSLLFSGPLQEAGEVYRQFGKAPRDPAQPPPKPYVRSKGPEVRACPRPDRANRGYQKLNLDPTFLFKRFLLT

SEQ ID NO: 969548 - protein, 188 aa, Homo sapiens
MHASLGENRDELTLEGFNQFFRTTGEERGKLTLWCDLSDTLDHHSAVIFSNPQRKVDWLTEKMRESNFTCILKHGDMPPKDRESIMKECRSGANRVLNSTEVLGPGVGSPSTVSLIINYDLPNHHENCNKTPELGDPRFDTAPAKGLAHLNFVKNDDHSRIPPRDIRPRTIPHSRLNEMPHERLLILI

SEQ ID NO: 969549 - protein, 82 aa, Homo sapiens
DSTLWNNWEVPWHPAGVAWPTPGLPGGGTVRGSVAFPFMFRPFFAASFPLPPPPHSSEHLWVCPHFFYGFGLFSPRDIWGPL

SEQ ID NO: 969550 - protein, 145 aa, Homo sapiens
GLFPLPAWPRLSARRPFRFPPVQVTQPTGEHNHRLRKEERTGSLDHNSFRQRISRWRNLNTIILRTWGHTKPPGGTPEGILKELGVQNVKGIPHMGAEARVRHFPGEARVLRRLLTRMLVNDSSDAMPKALILEGLNTRMLIGVK

SEQ ID NO: 969551 - protein, 127 aa, Homo sapiens
MFVGDQTLCMVFPHCYSCAGPPPSVLCCNLISPRISAGVPLLCVRGRLFFEESVWGLPRFCPPRCCGPRVPCGVATLLSCVILGGVTTSIGAFDKIIGISGVSTAIFPPHACSLGPALFLSVCENGR

SEQ ID NO: 969552 - protein, 299 aa, Homo sapiens
RYPLLPLLVFCGLAVRGVVGGPVACGGGARVGQGRGAPWGGRPPVVLSFGAPPVVLALPCGVGWTRVSIVVAFVVLPQGLGGDSLGALGSWGYHRLGVTGNVQAKRTPGGRGNQDVSAPGQGEGRDGGAQGTLDEFGLPVCGVSFNLGVPLRGVPSNTPLGPTRPRGPRRRGRRPRPSVPDRVQHVVKVLLGVLELFFTEVGNELLFAFLGPPGAFSRSAFPKPSTSRSSFCPRGTLPPGDVLPKSVLSVPHGWEEANLGKGEKKAEAEYTPRSYGFANSALPGSLELGQMPVLGGEQG

SEQ ID NO: 969553 - protein, 123 aa, Homo sapiens
RPLGVQPKSGLSVAPGVLGFSTLVSLDLNPGTPIALFDPASTLQAASFGVCKQEFSAPWPSRYRWVATAHTEGLQTEWAQKDLETKWEKAPGRLPPVGKTHNPCVEKHPLHWGTTTCALCVCV

SEQ ID NO: 969554 - protein, 71 aa, Homo sapiens
MCPPPLRVVGVIRALFNTASSLSRTFSRHFACFLPQAGARSVCRFFPGFVTPGSQSGRSPGSWLWSDTFDL

SEQ ID NO: 969555 - protein, 287 aa, Homo sapiens
ALALFAVARVGVWAGRGGARSGVLVCVGGGGVVVVVCVVGGCARVVWGVHRPSSGGVALGCRVVWGVVVVWVGGVVCGVWALVGAGRVGGGGGVVGGGSYKPGFVLGGPVRVFPLVCGPLAPVCLSAAARDDSPGAEVHAFPELSMPYGPRGAGVTMLRRPGYTAIDPFVGLILRGARIREPVLVDPSKGRRGVSAFRGMCPAEYFVSRPTGVPGSARHGALVAEPLFYGKIESLSGNALCLRPHVVSSREKLELGGSRDTRYTFSPRHFPPTTLLGEGLVLRASLY

SEQ ID NO: 969556 - protein, 233 aa, Homo sapiens
MTLVLLCFCIFVAGCNYFARATLALRLSWPPIRSWVFKTPRWSSRRILPGFCCAHARLYYGPPVWLSWLGYSPPGGNRRFAPLSRTTWCNSCVVICMGHTTGLHPWCLFKKNGLDFWRNHIGKSGSVLFPRVEKWGVNPLEKPPFAGVHNVPAVLEWGTVEENSLGDRAHTARESKRGSPPESPFGDISHNRGKKGRKRGVKNGVLRPRAPRVWPWVKYRGWEDLFPTSLYKK

SEQ ID NO: 969557 - protein, 312 aa, Homo sapiens
CTLPGRLLAACVSISIWRCVASLSVGWVAIVYAAPWYAVSHSRTLVVVGEPCRRRWDLACVRRAHCVPGELAPALFGGTPRLSRLGVTLSRWVSRPCVACVACLLLPAWVRLGCFGAVCILVVFYPPVCAGATRLGQRLLVVGSPSVPRSTRRPPVSDPDGPPAPLGGGVPLVYSVGVSFGPTHSGGTVAQFSVREWPLFRRPLFRREATRLPQEVSWGSPRGPASRGSRRFPASGSPRGGDHAVISTLLFGGGDPPPRGSPLVCFLVTPWALFGLPAGHAPVRTGGALPACAPPRGFHPLCVPPHTHCACL

SEQ ID NO: 969558 - protein, 254 aa, Homo sapiens
MSEPPACCPDIVRGLSSRFSYSAAGLPFLTRIPFSPWPFWGPHMTQVVPKATAVSVSGFSPELFWSQRRSGPPLRAPDVAAQLCCNFWPLALLTLPWANLPWRDPLPTHLRGPEFQGSAKPLVHNKGAHPSAVDIRGNHAPPTGVSPGPRWGPTPPGLVYWTDWVFEGPFSRIFDTPFIVVTQLKPLGHPKPSEGPPQTHGPLRDCGPRTKEESFREACERRPANCELYLHWNVAVWAHTQAPGGEPPGGHRAP

SEQ ID NO: 969559 - protein, 341 aa, Homo sapiens
MVPCSYVCCARLSSLVRVGLSLLRVGCRFVSASVVYTCVACVLSSHPRLCGARVGVPPLLCRAALLLCVVSSPQVGVTVLCLQDRGVGGQSRSPRPCVVSSSFAPPGINTRPPAVVKIHMWHVRWRRALDVVCHNVWRVLSGGLFFFRVGATPTESWCSAYVCYEAGCAYTSGHIFWSPLCVSTCEVVRGFPPAGGFERYLLMRYLRANTLPPEGTHLLSKVSVLPVHAAAPCRPPLWEFETRVPLCHPAYGVGPLSPRALLVIVMPQTLRDAPLGHFRVLVLPSPPACLIPVGMAPTRSPPMCCLFPTNGAAVIFGPLSLNGGACSLFPLECSPPKFLHG

SEQ ID NO: 969560 - protein, 113 aa, Homo sapiens
MVYTKKTQRCGTPGLPEFSRRNSFVRNTIHGGPAHGRKKEICCWGENDLFSPPEFPKPKQHTLTFFALGLRKCNHEATELFGEELERNFTENVFVVKNSLRRVLARKCTSPVF

SEQ ID NO: 969561 - protein, 329 aa, Homo sapiens
FACARVVADFLVAKLCWECLFSSPTTLFVFMVMRSLPLCLSSHLAPRLFARGVSRLFSSGAAVAPCVIHRGGGPPEYTKALFCLGGMGCFSAQRAHAAGGLFPRCVEDGVGVVITGEQKASWGRWPPLYDAQGLLGSPTRVALAAVGGVKGSPAWPPLLGRLFVDLELFAFAALCERTALGHPYAHKRPFQEGGPLSSRVLALGSPPFFCGAPRNSVGDPIAPDVPALSVCPPYRPPACPQRTCRTLDLSLSWWHPMGPIGALEHTSRYKRGVFYAKAPPHIYSVPQGGALWRRTHIGYNSLCPAQDTHTTGYRISVPLCIGGIGRHHE

SEQ ID NO: 969562 - protein, 183 aa, Homo sapiens
MSRVGTQNARTAASCALFEVGIVFSQSGTCEIPARLSHAVCPKYMLEFLVATAWKTVLGVAHHVFKEASTGGTQCQCLRAFQGSPRRGVIREEPPSFAELPRSHRSRTLLIILCLGTEYHFPHRFWGHPQWRRLVARTGGSLIELNVPLLLWDVSRVRHHLSRTTHGITGPTIRLGVFLEYRF

SEQ ID NO: 969563 - protein, 220 aa, Homo sapiens
MSTNQVVWVHSLSCYEPRVLWTQCRSLLGTTRLGAAAVSAHTSLGMWVAPLVGGPRWVLGATRRRIESPHVFSLAASSRAVVFPDGVRPGHRQFGVCFSRGGVGYFNAGPASLVTLFGLEKMAFSVVPPVAPNRGCPRVEPPNAVRCEYGFLRGRPAFGAPAVLPVVCPGGAPGHQRPRVGAPQVVRSPRFSAPFFSPVGGRPLLELDSTHTARVVRFGG

SEQ ID NO: 969564 - protein, 450 aa, Homo sapiens
MCCRAPCRTSLGVVAAFCSWDPRGGVGSVGVCVVVCTRWTRGGKETPSRPVLLVDFSLRACGETHAPPLTVFSLPPSPIFVLVRRLLWERGGLQAGKVVEKGRPWAVLGTPAWWFLVCSPWVHVSVRTLCLVQRGGVVGVSLRPRPEPCCLWALRVAPRPQRAGGACRGDSFPPWGGRTPRESARKNPLGTVVFRPPLVGENTSHTKEGAPELKPRASGVSETLLRRKILFEHSSTHKGVEATLPSESVPPQCALTFASPRAQDPQRDITRSVKDTTVAPTKNTRRLPQNARHSTQWGEKRERAPQRRYVPPSRSRSDLVARRSPHAPPPPHMSFVRAPHVSPRVTPLCFLLGERGLLHGHMGPLWGTPNRAQGPTWEREREHNRAHPLGAQPVAPSSLSTLNSSSAFHPSLFSQRLLPMEWNRVLGAQLHVHTPPTVFPGPCVLFSRDT

SEQ ID NO: 969565 - protein, 511 aa, Homo sapiens
RCVLPRGFLSLTTAAGLARRSASLPPGLSARPPNSVALVFVWQLAPVPSQCGGVVSLRQPPTWCTTVAPFPGLERERGRRVVVALCRHWSRRPPPPWYISVGAAFLKPSPPLLDVFSAPQGLFLVGNLRALFLPRRDPGPRPGCVTEVSWEKGAALIFRPLFFFPRRQQVTPPACFVPRGTPPRRRDFQFSGGVAPLLGGELWGSGHHFPKTPNMPPPMWRNSLLPTGGKEVSSRCAQICPKVERPLVGPPPKDIPEKGTLWKIPQSAPKCANSALPHRGDTHRGAPFCVSHRREDSVEQHSVSCRTHSPGVIETESPPGEAPTEISCLPFLYPAPTHVAHTCRHWENVHATCTPLGVLVHIFWSSLLRTRHRGYIHTRRTVLCARHITYSAIPPHATYSVRGTSPCTERSLGPYMFTQRGAHKHTHMVSTNRGRLVRPTPAVRMGEKELSLEIPLTQHSLDPPLSDLSPRPTRKGTEEPHTWGHFCGWRATSVYTPACSGRRRPLLPESF

SEQ ID NO: 969566 - protein, 140 aa, Homo sapiens
RLTVQSRRGLRGGCGWCGRTVTCLLLRCLQAMVRVHRVDSTWLPCYNCRLLCSVNRSVSNIVTVSSVVCPPAASVAAMLFSDVWPPPVTPEGTRGVETDKYMSAAPLSSLKVLPHYSVPGPLFKWCNVSTPVAQPRQVMV

SEQ ID NO: 969567 - protein, 138 aa, Homo sapiens
LDYNTLKIARTQTSFGGYQTNFLIRLQNGARIGFPRCWTRFCPPNSGEDSSHETWGDPETLQELVDHPAYQRGNQRGILTIPLRSALFPRVLSLGPTRDIEQIGVCPKFFYGFGFFPKRYMDHVSHPVGDQLKFHHKR

SEQ ID NO: 969568 - protein, 81 aa, Homo sapiens
GDTLLYDERLPSLMVEQLYNSCRFVSAVRKLSLAERGDGCRKISLLGGTTTDPRTLFPSWGRGFHLLPSAAGEVILLENSF

SEQ ID NO: 969569 - protein, 153 aa, Homo sapiens
PYPPPGQTSNLVLPIILPPFSLAGLVNPLIRVSIKLKYALIRRTASSSPEQISYEVTLAIILTIDIYYYVGSFNLSALITTQDTSDYSPLKSSRTIHDGSYYPHLCQMSPSANPTSQPVRTGQSETYVVQRIPTLAEYCSGSAPSALVFKSRN

SEQ ID NO: 969570 - protein, 216 aa, Homo sapiens
RARGALYNGGILTRANDFPFGRQADVPILENQLSDNGYSGKGEKHISWMAFLLNKMDWFQNAPEWISPSWTIVGDLGNNHTLYSAVFPPLNSGYVSVPSEHTWGPVTKEVSDYIPPLSPGPRHSPRTNQPAQKWPSQRYQQPFYPSSPRLPNGGKQDTLLNSQVEEMEVDDFYDGIQRLYNEDYVSENVGSVCGTDLSDKRDMLPPVHPLQPVSVK

SEQ ID NO: 969571 - protein, 75 aa, Homo sapiens
SGVSSVVGGMISELLGDEVVRCVESEEESGGGADELVGSVARVGRELRYGVQPGREQRGVVCEVMLQGQFVDAYV

SEQ ID NO: 969572 - protein, 460 aa, Homo sapiens
SSALRPGMSPGGCVLPTLCSVSAPPLGPQEGLEYSGPRARFWAPRGPTSGVYPARGPSFWGASCSWGPPLLMSPRGPAVGLPPPPMIPRRCSGDILLVTHLSWFPGRFVKKRGSAKNTPSTPTGGGGGTGQISVRTGANVANDGGCPRATTGSPKSTNSRGVTRGALKIGAPLPAGSRTPPTIGANKGAGNSPTRRGRSERGAGGATPRARGSPPAGLALARGTAPAWRGPHTREMGARYRGSQENLATHTAHHTVSRCRPRLCPHTHTHARGGEGRSLGEKNARRGGSAACVEPLVAHTVALSSGNSHTVGEPGEAVLLARFPDTQGGHPLCVCFLCHDSRGWSTRYGEAPHPGGTPQERSTRAQPTGPQHTPTQTLEKATWRRHIFLHHKPYGVESPLAQGLSSELLRVFGDGDGWRWRGWHRWGALHRATLLAQKNLWGFYRGPQDAFVIKKKIGLW

SEQ ID NO: 969573 - protein, 111 aa, Homo sapiens
MGADENREKLWGMSLHGQYIEGLIKGATTAWDPTNTTRVIPTRDIFSARKGYRDYFYRDILHADILLWVSLTHVVYRDMFVEQISGERYTRRHCGGIKKMRTHREIVTPTL

SEQ ID NO: 969574 - protein, 189 aa, Homo sapiens
LGTHKVCVTTPKKYTHRSGVVKHPLSPGENFSPPGGINFVLRRNLPKGLVFILPHSGSLTQMSMNPVVGCVAPPIQWGRFTLGEKPGLTTQSVFVDQKGGHTPHQSVFEAFALKPQGEIGVCSACDRLLGPPLGPVFLLSGLLFSLGDPPPLVAATHELVSTPQGESYFIPPHRRVVKPTYCSGESSPF

SEQ ID NO: 969575 - protein, 145 aa, Homo sapiens
MATRSCREKAHEADEQHPLILSQLLREEDHKYCADCEAQGPRWASWNIGVFICIRCAGIHRNLGVHNIQGPNPVQPRPMDSQDKITSACQIWGILKHRLLYEDPFSRGLSKTTDRSQQWNFSSEINMKEEILRLKCHSYYQLRKG

SEQ ID NO: 969576 - protein, 146 aa, Homo sapiens
VSRAASCVVSQDRVFVLSCSLLVCYVMRVAFMPVLFAGLGGSAFVSHSLVLVVVRPQGFVVLFASALCVVMFAALCCVCFLRAWVITLLWVNIQGGVCVSRWCDDRRRGSSHGVFVGGGPPDMVVTLVWLVVVWMSSRYFCSSCVR

SEQ ID NO: 969577 - protein, 101 aa, Homo sapiens
VACVRFALLLSVCCQFVLPLLRRLLSVLAFSSTFVWAGSSRALLWGLSLCPGIFPSRRDFGRPRLWCVCYLVKSRFRLLYTLLAERVCGWMICHVLRDSQY

SEQ ID NO: 969578 - protein, 242 aa, Homo sapiens
PPGPYVQPFSPGSFTLCAPAGREISLLGSPPAGPTLFVPPLGPLSFRGAHPVLDPTLLSPHKTPRVVSRVPRIFLPREFVLSPPARFRGLPPRVPPLRGPALLSPPQTLVRKRARPAVYIIHWKKCFQNAAPGGHRTLFTHREQQGACLRGREISPLFLSPPKRRSPHTHKNTAGLCSRHICVMKAKFLEERRPRKRGNSPPHSPTARERGERERKERERPHNKGSRGVHTPGDTQRERFLE

SEQ ID NO: 969579 - protein, 107 aa, Homo sapiens
FLVCRRVSRVRQVCVLSHSSLLRVWREGGRVVRGSFVLSIGRVFVLFFRAGLLIRGLFSLSFVGPLVCCFTTRRVFVRISAGFFSPPSPPSIGAIRGAPRSGVAPFF

SEQ ID NO: 969580 - protein, 137 aa, Homo sapiens
SLSAVLGDARGAHRRTDVVSCYVVFCRRLLMCCCPSPLLWFLSLVRLHYGCAYSLKRHTRCCGPHIISGFPAVPEVLSPSGLPSLCCRCFPSPWPDIPGVNSGATIGRPLGPLPQMGFPAGCPAVRAPRCVPPPMAL

SEQ ID NO: 969581 - protein, 279 aa, Homo sapiens
PLFSDERSRRTEETSCVDDLVCVSLDVYDGVIVSLELIVCLCFASESTSFLPHEPFCPPPCLVCVTALCVYNVFPQLYGGPRVVPPHRVPRSSKSGPPYFSGGPAPATLVFRGAPPPPPFGAFDPFSGLLDTQELRPQVAGVRVPSANPDLLPGESPLLGNRRFEDYFPEFARYTTPGGCLLPSPVEDPPRDPGPKYFNSEDEFFSRIHDPATLEGAVHTTGYTLHLSPSAPRGAPRGDHRPLCVHNELSAENSHFTAHMHPLRHVTRLLLKKGDPPQC

SEQ ID NO: 969582 - protein, 111 aa, Homo sapiens
MSPCRGSAAGEYMDAVTAQRPSVYSPLTHVAPPIFVTHTHTRTLLTLRFDVIQLPPLPLMAPLGFACPPPWAPEYGTPDTAHRWKSLSEYGVGHWKLILFVHLERERTGYR

SEQ ID NO: 969583 - protein, 183 aa, Homo sapiens
TPPCRTRHDSTCRDGTATRSPRNLFDHRRVIISLSCFSDSLLVEVASPEWGGDIVIHVCLVSPIRHIRSCADFVSPLVTSLAVFISGGNLSWGDHSTKWFLPPVCGGHASGFPHLGKQGLFATAHRFISGVPHFGGKPLLPRGGFSGPIFGGHLLPLAWCGGKVYCRDDILLCPVPLCRGPPS

SEQ ID NO: 969584 - protein, 109 aa, Homo sapiens
ESSHVGVCGVYAVTGFLFRFIVSCLCPFFTASVCPVLVAPLPVLGNTCCGPPMCMPVQFGNPALAPYGPFTLFAFGLAIGFTSSPYSSVILGLLTIPRVPMPMMAPCYP

SEQ ID NO: 969585 - protein, 180 aa, Homo sapiens
MSQQLFFGILLLLGRCYVFIRMMLLVPPPTRRGCWWVHLHTASHITTLWGRTTYLYLLMWRYTVCYSLHYTVCYSHRWWHNREGRYSSGGGDTTQEITRRIISLLHHTQLVLLTLVSSRVEYYTGRFSLSAVSLLCVCGEITHLLLLFSLVRRHTQRGTTLCGVLICVSPHPHYSVGVFT

SEQ ID NO: 969586 - protein, 228 aa, Homo sapiens
MCLTGVLPAVGGPPHIIFSGGPPRQWYHTVVLPRGGPLPRSPSSPLSQGRPFDTSFSKKTFWGNKQEDGLCDTPVFGRESRVSPQNQGQDSCLPLERKDPLAWGKIRKGLWRELTFPENFRLPSPYSLRDAYSPGPREGGTPPRVNPGPQILSLREMEIFSRIHGPRPVEDLGRSTNWVTPPLVTLAPRGRPSRRTLSARCGFPDELRGALHFHAQCHPSVQYRDLLL

SEQ ID NO: 969587 - protein, 121 aa, Homo sapiens
MGGPAHPAYNRLFCPHNMGHLYRKRIHHTKTTISLIHIPTHTQYSHTTSHPSLNPLTFYLTPKFTFTLNHHLTPQYSNTTYKNINDTRLKHTTNPPPLPPHTHRPYHATPTYLPFYTNNLI

SEQ ID NO: 969588 - protein, 253 aa, Homo sapiens
SPFLISCILMGLSFCIWVVGCMVRGSFPYRFFVFAGVLSPALALLWHHEAGPKTGALGLRFLTRVPGFIFERQNLMDFPGHWASNQNGLSRFSSGHLAGDGRWPPPWEAPGFTLQGIIPGPSRPHLAPAMPLYWIAPRLTLQARFAELKEKIDPRSGKAEKMALKFLGSSRWIARPLVDNRFPRHRPIVWLRDFLQTIPPLGSLCSFVDMRPDQFPVGVYPKPVAPEGLLELARSHPDLAPESSQKALMNIIP

SEQ ID NO: 969589 - protein, 343 aa, Homo sapiens
KLGLLALIAGDDIGLLVLFHVGVIPSSSHTYVLWPHTFLVMVRIPFVARTRWVLILKSRFSSSTRGAPNTKLILLLGGKVNTTRWWRSFVVVSHPQTSCDVTTPGRFLSIRQQTVVYKYMVWRRRYYRLHYIGGGCLHKYGDRFFFIEERPSCLGEKRVPPVWRGVCVGNKHPPEKYLVVSIKYISSLFANRVYYPPTMRVFHTHRLLLVVSQMVGSDTTGFLVGGGGALGRPHAQQRKSYTPVAKKRRAADTGYCASPGGVEVLATTEGATTGGELVLPLVGAHTHTQCADNYVCCPICHIMCGGSHQHNDTTSYHISLVALVFVSIRVCLICCVYTKRAPL

SEQ ID NO: 969590 - protein, 144 aa, Homo sapiens
MGCPPTFSILHLAHKSLKLVLDWHTHTLVVLAQSGKEKALGYCLGRPLGGALGCPRDGPRARPRRFTPWLEIVGANSQIKFETLWLLFLTTHESLPSVAHGEHPLHPHFARTYPRDSLCFSLHVPSWVPLFSLFPPTCLAGLQS

SEQ ID NO: 969591 - protein, 172 aa, Homo sapiens
NLFFPQGARCCVSFAPFFGGGPPSVETSWCWFPHQNEAGVFPLAPVDIFSRASIFSLSHTLTSSLALPTSMWCARSLSPNYDSYRKVFFSSHKKMLFFSPLPPLINGYFLPYEEYIYIEWAPPLHKYIRRCMFIYILRFLFSTKDEIHSHHPPPLSIFLHREENHPPPHNNK

SEQ ID NO: 969592 - protein, 254 aa, Homo sapiens
RVVVVSSVPRASEVGGGERTSFYKECAARFCRGYFSAQFARLVGRLMSVKKRVAPLFSGVLCPPAPPPPRGVTPRGFSGGGALPPPVGGESPLSWLPGWGPHPAVLFFFVTGTHPRTRGGVPPYGATVWCLPPPACGVLEESSPLPVGVVLFVGGYHLGPSLLWLHSLGGGGLVLLVVATPCVAGVLPSLARPLLYQWAFLCGCILCGAPRFRRRTRHRRQHPKKLWGSLPLVLCPPCEVPPRSAPPRGGAPLV

SEQ ID NO: 969593 - protein, 122 aa, Homo sapiens
MGDIPGGLCYTPHSGALPPFTHTEYERCLCGIKALSHSVPPTVTTRCCESPTGERYGVSLSFREILEKIFLWGEKKYTHLATEFLEMRETTAVCLSCVVHRYISHKAHRERDENYNPVEKEK

SEQ ID NO: 969594 - protein, 231 aa, Homo sapiens
MGVRVVSTLVPPGWCSSPPLGDSICRTSPQGGGSHTFFFCGCPPLFKKPPLSVEKLAFTGHSNGLMATIFARNYAPPPSIFCKKELVPHSLHTRNTRLGGDPPFSRNAGKTTMGCEILRTGVLRHRAPTATLGALEAHNRVRVGRPQKRGVLEYFFAPHTQEFYKTPRGCYILENLKRFIDSKIFFLVHLRHNSHIGPQAPLELPRPRAYTEVSLGPEFNPQTQRLFPATT

SEQ ID NO: 969595 - protein, 102 aa, Homo sapiens
TRGYAKLARPEPWKESLMGRRMPQRRGHNCTSVGRRGRMSGGNAAADGPPWSAESGVYGDGVNSGGKGGVLTLLVHKVCSFGAPMWLQPLGGSGHRCVRDLG

SEQ ID NO: 969596 - protein, 273 aa, Homo sapiens
MSRSCPPGVLSEVPLCPRQSWGELLHGMFPTPVPADSPGDSGDVFSPMGPLCLRRVFSPKGSWCTVGALSWRRFALSLRSKGPTPRNLGLPVGPGVSFFSRAGATRVGPPGAPIWFWGPLHSGVFSIRVPGGGDLVEEVTPWHVALAPPRFSGRLLAPLGHRFHKSWVAPPLGPQFFDAALLGPHGSHPLPAFPFPEICGREGASGGPPKGFSNFLPGTETFHGKPPPWAPSISFCWAQGTKPLFGCHTPCRTHHRDALSPLSCFTQLSQAQL

SEQ ID NO: 969597 - protein, 288 aa, Homo sapiens
PLWGVFPTGAISTGATLCPQRGGCWGVLSPVVLSCKMVWGQPRGSVSTQQGVLPPPADISRQMSCRSSLWGPHNSSLRKKELGVVRHTKGCGERVFWCRPKERPVPTIGAHPRNMVGAPPHMYLPGCTPIIVAHPQYLFGGGKPLPLKKTQRGKGGHIRTWVVPSERKCETESFSTVPGHRILATGELRFPPIVENGLVRTHIRCHCECHSLKRKSREERPNTERGQAHNSDTARLAHMKRRVTPLRRKHTRLAKRHTVRVSPAYVFENIACHPAIVTTAIYTYSSSR

SEQ ID NO: 969598 - protein, 395 aa, Homo sapiens
FVFVGLVWCDVGVLFVCSSMFCCRLVVGVSVSWLCLLVCRGVFWLVCWLVCCVCVCAVASVVRVLGRVRGGLVERIVFVPPLSPWKPLPPGGCAPADRARGALSPSAGFFGSLGPRGGVITCFSPPAALVVCPPCGSSSCWGPPPYCRARTGAAPTETRARWGWSPVPCGFLPPRGCFCVVTPLTVVSPACFMGAFFWGAPPRFFWAPSTPVGAQGVPHVGVPLSVVAAAAPSCLPRSWGARTDKWGFSPGAPPRVSATGVSRGVFSLIKGGGEHPPRVLFWEHISACCPHRECRPPQDRGAFIIMSFSRRPHSYVAQGRTLSVAHTFLSEGCFSQARFFLEAPPERGVYSPPTECPHTQRGVYTPAHRVCVCVDVLRAHSYVRAPPHTLLWEHA

SEQ ID NO: 969599 - protein, 115 aa, Homo sapiens
IVCAKVFLTGVYPTKALLVNTIVRESDYLRGDDSPGGFPPENLIVISPLGGQRSLKGKLISVPRWFFIKHEGDKKHLIRGAQRNFLLAPQDTPTHVGAPQKVLLQPGGGNPNAPL

SEQ ID NO: 969600 - protein, 119 aa, Homo sapiens
MGPRISGNILTPEFGTCDHATRLVTRFEHGAPIPPHAFHLKGIPHGFAARTFAESFFRVVPPFVVFYLIYTTGGLERVSRDPKRRESTLPMRNEPMRPRIPDDGSLFLKDLFLEEESAL

SEQ ID NO: 969601 - protein, 123 aa, Homo sapiens
LPPPARVSRMRLLGGARTHTPPHRRAWESKYHSTLSPPASLFFPPCFFPRASAALLLSCLSSRLFHSSCRASLASRGDVCPPLFCVYASVCSSSPVSTDMILFRRALPRAHSRVVERARQLSR

SEQ ID NO: 969602 - protein, 391 aa, Homo sapiens
GFCLYSRSPRFSPCQKFSLGEFTACRMGSRGRLAPPDHSCGYPLGLFLCYTPGGLFFSLQDPGGALCGPSFAPGDPFWAVCVGAPPRSIVGRPPRVFFCVPADFLLGVFIPQLVFFARWGALPHAAFVAPQFPPTGTFHSGGGPSLGGGCFIWPSPPLPPSFGGAPPPHPTAVFISVLYLLHTSSREASLFGRIFPLCPSGHCVPQFCHGPSASPRPLFCLVALEPHSFMRHTSQDTRVCPPRPLVWGGPPVPLATIPRFGDKWLHHAQTCGFLQIYLTLLARPNVTHPRGFGITRPPVRSSWFHPPRVSLVRRIHPTREIGQFARYTSPTLAPMGLPFILPPHAPDTPGFSPSGPTPDYNFSHPPPPPPILWVRGFPVGFPGPIKFSLPP

SEQ ID NO: 969603 - protein, 161 aa, Homo sapiens
SASSGEILAHAGEQTCEVCPPHLPRRYNTGGTHSNNKHSGARENIGAGGTVDNMRRGGTCAPKIGDPVARPNVPGANDKVTRPHKMAAIFPQKVPQRFPSGGKKGRKLGGNYPLGAAPRGGSSPREKRGKVSNCVDPLCRALARGIPLEMLRALRRPPNCG

SEQ ID NO: 969604 - protein, 251 aa, Homo sapiens
WESPVCVEGCCFSLPGGGACLFVVAVSSTHLWCWHPVVGCAPCRGSSFFVGSCGVMGWWSSPPCSYLSLWCVCGCMRSQNAPHVWWFGVGGPTKKVVVLSHAAHSSLLSVEIICVGRRCGGLGILVVARALLYVFCPASVPCLHVAHLAWYTTLGGVFSRRSAPLCFSLLWATPTPRGGEDPSWREWWAPAVITPRCCLPPLSLRERDRVCAPLPLPHTRSPHTTQGVAPPRDSVGRPHACCTPQFFSRSV

SEQ ID NO: 969605 - protein, 428 aa, Homo sapiens
MIWVASVLRAVSCCCAWHSHACIFAAVVVIVYSRRARLPRVWEFVISALLVLLVCSSVGPVPSVVFAPPESYPCGGGHDSTLSLWVCLPTLIGCGAPLWGAGSPPLVSMVGGHKLVSTHEWGPPYLAPPCCWIHSTARWWVVSGPRGTFSRGNIPCGSLFGVFCDPRFPHCRVLPLGVEHLQTVGAALVVVGDPPCWALGRVLTAESPCGITTGGEPPHRRAALLRPPGFGAVTSGASIAPGRILIMEVTPYAQSVSYGSTLCVISRVPCGPSPPVCPQPTGPPLELLPDPVMTPLAHIEMISLSHPLCHECPTATPLRNLGRKGSSANYVLTAFNNRISPPRPLRPYFLQIARITPNHLVNTLIPPLYPPTHRSYGTTTLCDRTSPLRLYTTYCCHPDPTSNLPVLYEFVPAYPRFRYDPTRYHLLM

SEQ ID NO: 969606 - protein, 107 aa, Homo sapiens
MGARFSPQMLLPGKALRTQLDLPRFRIYSHPSALESLALIPITGPLKTLLPDWGDSPIAPMSGPGLGSQIPTTSGHQHLCIEVVTNPAGFLTIGADLPFAQGLREVI

SEQ ID NO: 969607 - protein, 282 aa, Homo sapiens
MSDGRYHVLWAFSGVLLDVRYLSCCMYIVFDRASVCAGRCCCFDHCRLLVLCVCCYIAAVSRQCRGSPSPVVCRSDGKLGVHSSSRCFYAVPPGAVIPCVPPGAPAGPPVDLFVGATLIEDPLVVDTRKYRRWVAPVSRRSFRPGVFCVGDLTRGFLSLSRQWLLTMIEGGPSFHRPLSLCCRSSARLYAPCVGGCYPSLPPLPLCLQPLRLTQVLRAPSFLLCCDDPAAVLSPRWCRPHLSWAPPQLCHTTPRVCMGHSSLSSQGAHVRKQAETRHLGFSP

SEQ ID NO: 969608 - protein, 264 aa, Homo sapiens
TLSLGSVVDGGEWRSICVCVLSHGATTVLRVYTMVVLSFLHLERPNGRGNVCSSRRCRHGSWTRPFREFTGRKRTGVRNRSCEPPCDWPRAAAVWPCPPHRWRYSGPGRHWPNPLGTISAGQGDLEPGNMYRGYSPRFPQGPPRPKLPLRGRQCKKIKKIKEMRPQVSSHLNVWYRRNFHYRRRRPGTLNPQMAKRPKQPIPPAENSSAPEAEPGAGLSKCPALPISTHHPGLVIPPEEIWNSPPLRNGPKIGAEDLKCLLFAP

SEQ ID NO: 969609 - protein, 228 aa, Homo sapiens
LATCTLFVVLIIVVVRPCVRSSPSVREMGRLLLLVCSPVAHTLVFFPRPLGYASYRAYCPVTASPSAYLATCLGHPSRTRYTLCGVPPPPGSRGGCPRGRSHSVKRAPPSRCGQPYPVDTCQHGPNPSHSPPFTSSSFLGHPGSEVFLVRKVKVIIWIDWTSALLRGPYWLRDCEFRFKQLLSPEVLLSVTGEPYGRPISGPKEVHGMAPATVRTTTGKLEGIFHEAP

SEQ ID NO: 969610 - protein, 301 aa, Homo sapiens
PRLSLSGSVLAWLSVLCFWAPFFFPCLLCLVFSVSRCFFLWCVRCSFCLARVLLLLRCGSFLFRLLLLCLGFCFFFVRLGVVLCCLFLVLFLFSLVCSFFFLCLVCVVGLPRCLCVFFLLCLVCCLPCLFSSLSAVSVPVLFSLLLFLFVVCLCFFFLLFVLVFVLLFVAFCCVFGVCAFLCCFVVFAFLFSVVFWFVLFFSVAFVFCLCRFFRLFVFSPPVGRSNYLSPGLSFLVGPRSRFPPGGTPPFPPLFFAPPPPEVLLTRGQRTSVFSSEPFHAFGPPGEPRDSTAWCFRTVPLG

SEQ ID NO: 969611 - protein, 102 aa, Homo sapiens
MQRPFCGVSTHSVALSLVRYGRDLPLCVTLGGKSLSREECSLESSVGVEKRVNPSGHCHCLIRTLSRGLFVGPETTVPCGSRGLSTSLYMSPGLCVIFLGLP

SEQ ID NO: 969612 - protein, 167 aa, Homo sapiens
MFLVLWFLFLSGPTCFFSPLAPLLVAPCLVFLALTPADSPSASHVFPRPVCPLKPGPLVVSGPRVWDIPGDHGLFVPHLRHFFVQPTLPESRVTWPSMAPFANGTSMPVKSRFTVLPGPHALIILAHGGAAWMERIMAPQLYVLFEKGRYPFPVSISVAQIRVYGTL

SEQ ID NO: 969613 - protein, 485 aa, Homo sapiens
MSLVLVVFSAPLLPGGAPKQSVCFVRVFPGGGLYFLRDISVVERVSPPCWLPTLCAGHKLCRRGGSFRPREGVPPSFSDGWGGPHNIGWCCRLAPFRVAFFCPSALRCVVAPAHPQVWLCGASLVVVSPPPSVGEWFSGRVVPSIHLVGRRTCMSRVCGGRRPPCVFHEYVGCVLFGVVGGRSCFCDQQIMIDYLRDWGGDRHPPTQIRVGLLRIVVVRRKSVHPNEECWGAARSWFVIIISESWAADSGWLSSHCCNASECGCAAVAHSSVRDCSRLGVFSPRVWGRIVCAARRALLCLGESSVCLRATVLLPARGGLSLSSVLFVESVCVSPPTVVMRSGARYLASSPQICLRCGAARYLSLSVGAPPAPVLPVSRHSRLDAPVLCATLAAHRARPFAHLLSLSRPRESLWAAGGGALCLSVRSSCVLPHREACLLRGGARRLFFSERGPRRVLSASHYVCLPPLSSRAHPGPPDKFPHTMFF

SEQ ID NO: 969614 - protein, 199 aa, Homo sapiens
LVGAGRPGLPPGRGRKGILSDIPAPSRCLGPHRYGGVPGAASRGASCPDFRGLCVRLAADLATLGALEQQREAGAEVLSAGDGPGAEEDFLRQLGSLLRELHCPDRAAAGGGDGLRLRFGNPIPNFTFFSFSSQISKPPPLLCLPLSAGAESSGHPFLKGYWRDPACSNNWTLPSKPWGCPDLHQGPPPASCCRSCMLT

SEQ ID NO: 969615 - protein, 111 aa, Homo sapiens
MLMIVVFVLYVRHTEEKFSVELILLLGGYITVILALVVGIYDVCLIMIWGSVSILSYIWGENLASSSFGVHCFFYVWWRSSQYGVYEFYIVSVRGGEPQLCIIRGSSHYMC

SEQ ID NO: 969616 - protein, 97 aa, Homo sapiens
GGVVVVLAPVVGSARWWCVWCRRYVVPRCWVCVVLQLLCVRGCVVVVDGVVFYQRLFVLWVVLVSMLCNVVLLVCCVLLSTSYWGGWCSEVDGLVGE

SEQ ID NO: 969617 - protein, 135 aa, Homo sapiens
MVFVVAPNLPPKAMNSSWRVYQKIPYRKGSFLFRERAPALCVVASPVSYHMEEVVGPKGPAIGFLWCFLWKNFSTGTRRGYKSTESVGMWPRDEFHHGGGNPRVKLYLYALRTWAVARHTLVVLTTTEFCWALTR

SEQ ID NO: 969618 - protein, 102 aa, Homo sapiens
MIKGPWESHTRFLATCPWTLGFNGHEECPVAGPQGSQRKTGLAQGCQCPCSCPLPQLPGAEAASRPLVRKGFRTPAYGMCSPSALFPSEGTWFCPPSLCLHC

SEQ ID NO: 969619 - protein, 196 aa, Homo sapiens
IFCDRSVSSISVINPKYNVGAGEKAGYTSRASFFIFWGEKTPSAWNEKKCVTQKKGGGVFCLVKYCWDETFGFFLGRTGSILGFQTPTPVECRTRFLSTNKRGEIVCRQKRFFGAPPFGAFNCGPNPPPQKKGGVVLEGITKGDVNTTCLVVVHNTNKGGAYERHFHTRDKTTLLGLEKFAVFGVFSSDNSVVPVL

SEQ ID NO: 969620 - protein, 132 aa, Homo sapiens
MGALVPTPPERVRTPKRGRLFEGAPLPRAAPATDCPPPVFENSLALPGASWAETPPPPRGGRCGAHPPAVVASPKRAPLQQAMPQEKVGGGLSHKRPPTEVGPPERGGGGPPPPRCFCPCVGGPPSGPLLFF

SEQ ID NO: 969621 - protein, 119 aa, Homo sapiens
MRDTQNAGSHTLAPHAEGVSTLWSVFCVCFHASSSRHPTRALSSLNYREVETTCVTPLSWCPLEENTVTHVKGATLPQEFVHMCRFIVETFTGPRETSWFLCLAQVAQQFTHKFVFTES

SEQ ID NO: 969622 - protein, 291 aa, Homo sapiens
KFGNPRERFHGQNNIAGLQAYLGNPILQGPGTGGHFQRTSGFPGTWEYNKRRKGKGEPHMGPNTPNPGPTPEATKGPRCVNHGVQKGPPPFQTAAHEFNGFKKRAKRPLGGHMAHSLELGASHTGLPCLHIPWRPLKWVVEREWRDYNCRPISPQMDPRTSNMRIPENKNDPTGVKRREYFPLLIENFGWVESGTTFHGRCPHINHKRSSVLRWGIYSQVPESRFLHIFFKMRLSCVDSGAHTWRQRRSCLENIFGHSATSPDICVRSQPTSDIAFPKGIPKISLKREVLC

SEQ ID NO: 969623 - protein, 138 aa, Homo sapiens
FSGTRSQIRPLGGLAHSPRAACWDRSPFWDESTPGARDWHRALFEEFSLALRAPPGARGFNPRWSTTTGVTSRYGRPPYGRLILKGLGPPLYKKATRFLATHMEYALAFGVNPGFPGESCPPGGVNFVRGPQTRLSRL

SEQ ID NO: 969624 - protein, 194 aa, Homo sapiens
GYGVMGKSSLLLSTPHQACAKTHSRVARDTHTTHTRPGAAPLLGGEVIYYRGEFAGWCSHRREKERPHLLGWWKIPPALFLSPRRGVGEKTPGEKKIIKKSIFVVARPEDETPTHRRVVCISPLWNSVVCVRRYNSSWAAAPHPGGRVVSPRRAGESWGGRLTPTTLPPGSRRPLLSCCDYFCVIASQQFFSSG

SEQ ID NO: 969625 - protein, 306 aa, Homo sapiens
VARSRRSVELTARALLCGRVLFIARDWLVGCWRLVAVLHRSGGFGRCPGVACPPRSTLLWGNPSGGAVGSFFIFIGPRGFLHEWVPRWLRSRRCWARGPPRWLLCPARTLFLRGSSSVALYITLAAWCAPTNGGGYEPLFSTGVHKRGLFHGYPNGGGSHMSEPPHNAGPRRDPTKGATKEPRTFLGGTPREHNYATWCRLRVPDAWPDRAALNPVKEEVSLPSGKRCPVSGGSRFKVGKSPPHVGRVVKSHGGSLRRILKTSQETVDSCAAHHRVYILRGSILSRGFIVGAHTEGAHPQGSREAV

SEQ ID NO: 969626 - protein, 114 aa, Homo sapiens
MALLPLKLFLSGHVFFSRVYSAEFSLTERHASPLSHLVGNRREHGHEHPTAHPHENPPLNCAFHAFPGTVLGSKGTEAESLVSLFTGGPTLVSHLWEIFSWHHAILNIKPILSN

SEQ ID NO: 969627 - protein, 71 aa, Homo sapiens
FFEQVPRLLSKFFPNPAPRYGLFGTWQTQLIEDSHRSFMVVFLGTHCHEIRTSFAKRRRQILKALYSQRSA

SEQ ID NO: 969628 - protein, 421 aa, Homo sapiens
MLAEMRVSFVVVCRDLLLLSARSFVDAAVRMLGDHSMRIVFACFGEWLVLVDVVFFLFVAGLFLVPIQYCASPLSCWSVRLALLLACSCVVVLLMWVGVVLSFSSAAAVCACNITREPSCFRGNPVPGFRPGGGTPQFTTAVCFETLPIRKRSHARGDAECPGPSRGPFLGPYGPLGGPRNYNPGVSTQPRGEHTLYVNATFRGPYDLKVVHTYIGDDTGFGDAQIMHTGWGIPAFRGNSPRGIYIVSETHTRRSREPRVLSRCALSAELLISSEYSYSIKGFLGKPHKFMKCLQYRDHTMWICEREERKHPIWVALLKRSPSNAHMIMCHKLNNTILRWPTENFILYKKRRTHALKHSRHRDKKPHVEVAHGHVVLRNRKPHMRVNFRENTFNNGLSKVMQCILRTKGSLHLTAPPERDS

SEQ ID NO: 969629 - protein, 138 aa, Homo sapiens
MPGGEKLHIPHGRVHTARLTHGGRPLRRRLIMMVTPRESCMLLRSPRQPREDGRYPRAAVREGPSMEQPTSPRQSSFRAPMGVMTRWQTERSSKLSFLTHGSIGVGGRTALKYVLYTHTHTHTHTHTHDAFNKDELVF

SEQ ID NO: 969630 - protein, 78 aa, Homo sapiens
PRRSPRVAPTKAYTVGGNTRDLGTAAHTHWSPLQKVEHRPPAGSCCWVTPSNPCDTPQGHTWRHLFLAHLVRYRKLSH

SEQ ID NO: 969631 - protein, 296 aa, Homo sapiens
MEEGRLVSSPNKRVAARLCDIVWGGRLVGREYTLRGFCGGYQAALFCCFVVGGTTRARGGGERGEERCRYCVDGCSPRCTAVERMMLYDTAEERRMLYYSREDCGGTQGGRNTLWIAQRERGQHKSGESHRGNTNMRSSPPVRLVYERSIVCCHTSGERLSRSTLSAAVGSVLCVAHYIMCVRKCGRTLGVFLCHMGCEKKVSVCVVWGRLRTQERSRGVVYHTLSPLSHIVSFVLWCVTRAEIVAGGALCERKRLSPYKVYFEHPPSHKFVPHGALFTSHMEREREEKHIYMGAT

SEQ ID NO: 969632 - protein, 150 aa, Homo sapiens
APDVLQTSLPEGVFCLLCGSSPGGFRGDIPHSVLTHTHGGYPRCYLRPTFIGAPLFFYRVGHHPLFVGHPQECLVDPRDISPESVGGDTRVSLRRNFPPPGEKILVLRHPQTGGSSGGEPRPTMCVPHVRIFFAATKVVAREHHTTRGEI

SEQ ID NO: 969633 - protein, 118 aa, Homo sapiens
MSHPPHSESPHHLAQQHRDPSGFWHSLCRTEYVWGHSPRCEETTPRHGVFVDHTHSTGTPTRGHNISESHEGTAIRTKTRANNCAAGGYPPRKHSFKTAYLRLSTFCFPPGPSNLEVL

SEQ ID NO: 969634 - protein, 104 aa, Homo sapiens
MLYVRLNILLFLSSSSPILGNPLRPPIQIYTLLICHHTMMCDQPLGSFTAHIKYLFLASSVLSLEADALYRTMTSAPFHGQKIATGLMCRTTSTLHFLMALRTL

SEQ ID NO: 969635 - protein, 79 aa, Homo sapiens
DLANKGGNRYGPGNSACIPLCMPRDDLGTGAQRGPTPPEGKGGPQGNSGQGSRARCPFAENSTGPKEVDAPPRLGNGWK

SEQ ID NO: 969636 - protein, 145 aa, Homo sapiens
MLCLLLLKPSPLPLNSVLLPFPISPPFSSPPTHQAHEGMWMLWTKVMKEAMTRMETGKVDFHGVMWCLWLLSHVACNKFLLGEHVEQTATTLGSALPLHPSQSLPFPPASTSPHLSLSITPPLPTPPPPPPRAQEYGPSLQIIFH

SEQ ID NO: 969637 - protein, 234 aa, Homo sapiens
FRGRTNHLGQRLAPPPRGVPGEAHRHRRQRVAAATRATPGRFKAPSGEREPPTGVWPRANIHPKGEGWRPEPQNLGELFLSVEIIDGKARGNNSPTARCPSHEPQRGTRAEKEVTACHKLTPPVPPQEKPSGPPRKGRDHSFCLRETENWANPAEPEPVTARSGTSIRKEESSRSSPRGERRISQAFAKFSVWPVPQRPASSAYGPKEPQEAAEQDVEKKKLSPPGDLGSVGQS

SEQ ID NO: 969638 - protein, 274 aa, Homo sapiens
PPTGAYRGKNWGPADSVTNGCPWWGLCPIRAPFSIRESFNHPVKTLFVATGRIHKFVADTRDNWLFLPASVFATSFSLVDRWCFSPSLCGVSHVPCDTPLVGGPRVWHPGLSRLCLLVPHDVFCRGCLNLHDDSVANLTSNPLSNTGDTGEPPVGSHGGGNFSDGCPEGVLTVQIAAQPLHGGRAHPPSNLTKRSHTHERFLLPWIEGAGSWRATPLHSARVGKRAFPRREVSKPHSCVGGPTHTLRPRTGRGFKAPHGLGLHSATGGRGKGLN

SEQ ID NO: 969639 - protein, 141 aa, Homo sapiens
ACHKFLYDEDGMPSPPPRKVLSSQTRGPTHGRVPRGDPLLESLLENQEWDGSSRSKRKGHTCAQGGNHIGRTPHPQRATSHPLGVPGPSAYTGPRGIAAGASLLKMWNCTTLFPRRPRRPTRQKSFEMLFSHTDLHSWRHE

SEQ ID NO: 969640 - protein, 219 aa, Homo sapiens
KVWTPSAYDPALRGLSSCFCRDTRAWTNSKAVLVVPMGLLSPHLTMGPHSQLISPSQAAQSSFGNSLQCTYLFQATKPPSPNAVNGHTFSPHSDTGVPPQPGGALSLAQSRWNNANHADWLLRLILFAPHAPPRLCIHAPGAPCLPPSFPVQNAASTEKSGFAANQPTWPSAPLHPTQPEPAILPHSDHQIIFSTPHPPPHSWVRVSPVCPRPIKSTCH

SEQ ID NO: 969641 - protein, 117 aa, Homo sapiens
MAPFPRVHQDPPGERTGGEKGKGGEKSPVFPWGVRPYSGGIAPNISERVFFPNILGGIYGWTEKRRRGEKEDIFSLGDSDLGYTLTQWPRPPRAPPNEESFRPRVYRRNICVQILSL

SEQ ID NO: 969642 - protein, 134 aa, Homo sapiens
SPRRGRGVVVACPPRRRVGRPACAPGGVSLCPWELPLFVCGSAPAVSRAWRARRSPPPARAWAGCRGGFCVFCVFDGCGGAEERWLWFLSCSSPPPPRRRWGVAALSLSFLSPSLSIFALARALVSADAHRSRL

SEQ ID NO: 969643 - protein, 71 aa, Homo sapiens
APKKGRPPKGGFLLPSVLREIVITPTERGAPKQKWPPPNSSTHNLVVIIDAPFGECNSAYLLLGRVMTISL

SEQ ID NO: 969644 - protein, 312 aa, Homo sapiens
MSHVSCVGIIVVTCTVCCPGSCGLFIPRGATRVWGCATPGGVPRPVWWLFSSVFVVPRATECLFSVLSRWSVSFVVGVVSVRTPWCFLGLLVCVSVSSVCCAAVVCLALLLLCSAHVALGLSLGGFVSLVLLVQGLIIDVCVWSSHRLSHYSTCHSFAGVIVLLSRVPHTEWCGIVVSLAAHIMVYRRGEVEIVSDLRYVCYTPGVSLTLFRVAVPTPPAKEPHAGRLTVEHSGAGGPVSLTSIQALVRPTGGMRVLKGALVPSLSSSQGAWKPTSTHHECDGFTRGRLYYPSLMVCLKSIIELLYEKKDKK

SEQ ID NO: 969645 - protein, 82 aa, Homo sapiens
GASCSRFVVSFCVSITCSASRDDGCAWGSCASLKGWSRWVWFVVTPSTVSWFGFFCLMFFGDPVDETPLVFFDDGLSLSRMF

SEQ ID NO: 969646 - protein, 86 aa, Homo sapiens
RDTGGGHRDPAVLYSRVFIIVRGGDTFVTRETFVPFGLLGAPLLETGGDTRTRLVYPFRVFPGILRNHPAFRGVFVLFWESRPPPF

SEQ ID NO: 969647 - protein, 187 aa, Homo sapiens
MTRSVDIPRSSVTSVSLPSAVGLRGDTQRLRVLKRVNLGDTLGASELGHKGSDIESLTPHTLGATHTQALFSRDTPACETVVSLSTRIGVSPLSVCLFSERGPHSEFGLTGHIVYIGEFSLHRREGHKTHLLNTRAISCVETLITSHTRPLVGCSQAAIHRAISRALCGLAHTQGAHSTSQEFWEIL

SEQ ID NO: 969648 - protein, 80 aa, Homo sapiens
PGILSHEEGQGHTTFPQFRGPRALFEATHPDLYKDGADLLTQAGCTFEGRKSESPQEESALNIHFVSSRLGESGNPPQTS

SEQ ID NO: 969649 - protein, 223 aa, Homo sapiens
VVLLQLCDHIFRPGTQDTWVGFSASGNHKSAVPLFMTIEELSPPHEWGGFYIIRQSRTSSSFLCPTTRRVFLLVGEQAPVCPPQKKVFLHHRRTIVGPHSGKFHTGSNVARRRNMIFSFATQVRAPQSPPAKCEGVSCPPQRAAAWENRRGRVFLSGREKAPSPPWRSHKKGSHNPAGMWGPSASVEPPKESCRCATEAACAKTPWGAPKRAPQMGFGGPLTH

SEQ ID NO: 969650 - protein, 166 aa, Homo sapiens
MAVPEWIDARGLVGFCCRLFGSDCAGVGAVAGVVSVVVVGVSSLVCVFLLLRPSVFCFAAHQGSFVGGCATGGGGVGHGFGGVCRMSLSHVVGSFSLFNMHLSVGGVVAAAVGVSCILVWGSLHVECVCERVFARVVRVLRRVFVRAHCVCTLLARRLGVTHRSVL

SEQ ID NO: 969651 - protein, 162 aa, Homo sapiens
MCVCLVWGCDNTRGGSTRRDPTHPLSEAHADTTSVYDRKRFYNTHLAKARAIIYHIYISHICVGAHHIICVGHTRGSTHALFSLVGDIHTRAHISSHIFSGGGTHISHTHIRVYTQHPAQMLWERHERHISRSGGGTPRAYIYKGCFVVFLHTQSYKGLLHA

SEQ ID NO: 969652 - protein, 99 aa, Homo sapiens
ACDEMPSFGEGLFPASLLKKEVSPQRDEPGGEEVATRAPPKRGPPRVFPFGAPQRKKRRPPPLIGEDSPGGGPAGAHPRGAPERSLGTWGPPGEGAFVV

SEQ ID NO: 969653 - protein, 75 aa, Homo sapiens
RDKSTPRRSPPQEIWRGKGCVPPPAQHEVWSRGGERRNFEKISAAPDTKGEGIGRSVKKGKGIFCKMAKRGVFQV

SEQ ID NO: 969654 - protein, 124 aa, Homo sapiens
RRLLWCCSAAVVIGARPRDCWGVGGRPHVGSRVSFAALRRGPALFLFWVLCGPRCFALWGVVCPSVWLLLSVAWFMGSLVASFLLLMLVWGCLYSLWVFPLFPQFRIGGGLLGGANLVVADRGK

SEQ ID NO: 969655 - protein, 103 aa, Homo sapiens
RPLQAHSSPNGGSPGAGLPGHSLWPPMGMKCTRFGGNDQVKKARIPLGGGKFVIVAGLAGLGSLLLVWPLRVVTDFYNPLSALPTLSMSLALPLFNWLGTGLP

SEQ ID NO: 969656 - protein, 319 aa, Homo sapiens
MPGCPPITARSERVKRLMPRFNEQGGVSPGDFSLRAFMCGGLPRGAKEEDVRFLGENLGECTRLTIPRGTQKVKSRNVGTPNGPRGPLPPYPDKAFLEALGSLGTLGEPLEWRGNLRKDTTPRSPGGEPLSLEHGTPRNVFLWELIPTGPAYNPVIHNPGHLAQNVWEKGSHARETFWVYLGPSRWCELVKNPRPQWLSHIGPLQNISHGETHWVKASKLAPKGALESVNTTPQCTSRDTHFTHRMAPNFRDLGFPLQQAFHMGQSRGIRPKEEPAKPRLCPQAFNGFKEIHIRMAYATAAAPKPPRKLQEAHVKSEIR

SEQ ID NO: 969657 - protein, 86 aa, Homo sapiens
NGVGMLQEENHSTQGTGWKPPPQSWLTQGGTAGPQSATMGKGQHKGIENCRGPAVDGLFNLRGFKHAGKLTVKATVCPRCYTTSPR

SEQ ID NO: 969658 - protein, 253 aa, Homo sapiens
LPPAVSAGYPHTFFSPPRGGTRSLLCPPSFVALIFLYGDPTLSYVGTNHTAVFDSPHTYTTSRRGVDPPLLLLQQFFSRDEMFFFSGDHTTRALSRRVYISAPLSSLCVHSPSLSQLFSLSLFSRGGATHLSLLVFLVSFSVAHTHTAVSLSLCRHTPRVCLSLFVLSEYSLSRERRSSLSRGAPPSLSVCGDFCGAHTQGRHTLRLFFLFWPAVFSPSPLSLGERWSPSLSLRPHSLFGVFFFPLFFFLLFI

SEQ ID NO: 969659 - protein, 135 aa, Homo sapiens
ARPSWTWVAGTPGTLYGFGPRCSTPSLPHVLCGDVSSPLKNSHGGGGVLYKAQDWPHKPFCWATWVWLGASFFGGRFLPSPDLNWGLGVGESKQPWATGPDSISTKKILKLGWQRWLTPVIPATLRGFKGKVESP

SEQ ID NO: 969660 - protein, 291 aa, Homo sapiens
LGVRASSSLFSLLVVSQRAPPGGPRGEHTRGFRHMKRPLCEYYFMMRALFLLLIGMNPPGGGLPTRAETRPSFWGEGGNICSLRHSRDAVGMMAARKAVAPHNPRGVCVWKNPHRRRVGPRGEGNHRVGQNTTVVIRAPPNMAPRKGAFSPSRAPDALLPAPPRGWGEFLAPQREWGPPPGGAHISRKGKKVGAPPIGLLLGWGSPRVGKVSPREVGPPWVEKQRRDGVSPSVEPPGAHGTERVGYLWWRGYNPRGGHPRGGAPPPGRPLEIGEHTHMGREKRQRERGESL

SEQ ID NO: 969661 - protein, 124 aa, Homo sapiens
MHGLLWLEVREAHSPAGGPSLGNFLSGCEFAPLFFFVAVLLPPQTLGGWLSRLSLVVFVSFSSFVLPHAPAVVVAPPHHMFVWRARSCSSLYTSPLPLLFFLRVPARHQEIFFQLCTENGRTVV

SEQ ID NO: 969662 - protein, 150 aa, Homo sapiens
WRPPPRPPPWANGPHPPRMDHSGLFPHPTSLIPNPMGGNNWRKHEGEGEEIGTPRDRFPRRPALVCSLEEDNTLCIKEEIYGVGNIFVHIPPHCIIFLGTKKCFRGPTPLFMKRILRGEDTPTPDLFAETLVFCVPNIFDHFTFGVVDTQ

SEQ ID NO: 969663 - protein, 122 aa, Homo sapiens
MAGLPWGAHAEHFGPQLRTAHWKWSVSLLLYSWWPFGTIVQLLVLGLSPFSVVLVPVCSYCAFWSVVVTVVLISLRGALGLCALDADTMSAASDGQQLLVRRVGASHRSLVAPLQSSLLCWS

SEQ ID NO: 969664 - protein, 114 aa, Homo sapiens
RPSHPELDRLPLWVGFPSQPRICGQSIHAHPWAPSIFPYTFLAQPGAIAAPEAPYTAPSPHKRFDGVYIAPSSSALIPQLYFSLSSFIILHPRNAVGAQATSLLPPVSIMCWRL

SEQ ID NO: 969665 - protein, 148 aa, Homo sapiens
VYSNPCIVVTSVAVFPEMERARVSAPLLLRYSCHRGNIGALFFSPIGAHEIFSRGEPPLVGPYPALCCCNLALTSPIHFVPGGEDYPLVLCPNFGGSHTRAVCSHSEEEVPPVNLPRTMCVPAVFFLGAPFLGGAFSPFAPPGVAVGI

SEQ ID NO: 969666 - protein, 259 aa, Homo sapiens
MGRIAWLSRMVPRRNVFGYVLSPSAPIVGPSAGVLTFSEPHVILSPGGPLRSRHVVHSTRWMSALSSLLLLHHDRLLFYWCLPLFSHMPHSPLVNFTLGLLSYSERPFSLSRFDVNPSDSGLSSQDSINALDRRTSEQVAPTMLIWSHPSHQSDVSRHVLISGLLCNLCQPGCTTPRTPLITPAIMTLGHNMIYLHTSRDPPYPLRPCRRGVRTSLRLQTSNTPQAPSPYFFIAEYTQTLIIINTPHPPTNSFLGNHNI

SEQ ID NO: 969667 - protein, 371 aa, Homo sapiens
ISTPPLVCPSCELLFAVFRLSPSVVTYAIISCSKDVPHNLVVYQPPVLWWPPVPVSPGGAARSSSCCLFSLGGAINPLVVLPHTPVWGSVLYPPRLAIYYPPRRCNPKIFWGDAPSYRMGGKGPPTNRGAAPPQTNGGALLKAPGPPRGLRPRHKSPTRVAKTCGDIWSHKWRGICLSERPPLVRGKSPIDHCGRSDLLVCFRPTRCPLFGTHFGVHTTLLSPHVFPTHTVTEFCRGWKRRPYRDVPRHTLVKTHLFSMGAHRRPWGVCRGHPLKPSCVCFPATHTRVSRGSLAHMVPSTPGHMCGGPLTTAKGACLDFPTVHGWYFLKCSLICEISQHTRIGNSLPATGTSGITRLFPSSCLRTVGCFKA

SEQ ID NO: 969668 - protein, 482 aa, Homo sapiens
TPPLQRHSRDVVTHNVLQDVFYLWDYNNQRSVFMTHNCCGCLVDYNTSLLVLMMEISSRGQSSIIDERFLLGNDRYTVAKHQLFVHHLVGRHYTRFERTSFVSSGVGKINRRGVSATRAFNGPSFGLFFGEVRTLCGERGLHAVEWIKTWWHGEAPSVVNRGRHLPPAEKRKGVSTRGKRECQEGPQGLCLRKGKGGKKGRGLPPGLPLREGELERKMWEQGRLGLFLEPPQGPKGSTPFGVPPLGPPGVNPLCCLGNEIFYRRSQVNFPIEGSTTSLLVGHTATNIFSGKTHSLIKGVAVGVPSWVNSRRYIALSPRERTSHFTSLFTGGSHILHAHLGKVFHAELGDKSLRGEEIALLPQWSNLFLENHTTEHGATFLGSSWVLSEGHGGLPLPPESSRVGTGGLTRSKQHWRKTGVLAREEEPTNAGFSNFSWEGGLPRNVGKAFKLRARSSSEHFLPSPSCLHLPFQGDGGHYRELNI

SEQ ID NO: 969669 - protein, 214 aa, Homo sapiens
PKGKFGVYCAHQRQETGKGAPRPGMGLPPGVTLCNRDPKRGKGTTEIWGKKTHDSVPFKEHRGSQVGHIASARTHAPRGPAQNIKRVKKDEETWGEFWAHWVAGDLYRLEWAPLEKNPPGEKPHLPRQWYVLNGHHEGRPFSPQRSLKMPTTFFPRVGDLPTQECLKYFGPHLHMGGLTWKLLNLVAFEKKSLWKIAKILCSSTLCLPHLQTPR

SEQ ID NO: 969670 - protein, 148 aa, Homo sapiens
MPQLSLHSMTTRYSTTDTPVFYRVDRLNQFHLMFPHSQMEACIFAHSNKEGLHIHLEFPPQFLTATHPYEPQTYTPQNPHFTYHIHRRKFNFLPTTHFSRPIRNAPHYNTTRMAHPLINPHNSLHYSSSPQLKILNHQLPPTSLTQAP

SEQ ID NO: 969671 - protein, 116 aa, Homo sapiens
QVQGVPLRGPPKKPREKRELVTRTRSGGPKVYQGSLRVLMVEGPAFVPKRAIPRGLFGGEHFPNLVVPQKTGELTGKEVFGHLGQKALNGTLNGKCTLGLSRMARMTCLYLHKRDF

SEQ ID NO: 969672 - protein, 126 aa, Homo sapiens
RGLPSAWSSFSGPLTTATADRSSSRVGCSRLTVLSGAAPSCLAWAFLHIYYPTVAPFPGYKWWCTPRSARIFSPPPGEMTPHYHCQARTVFFGAPLVPYVESTPPRGGLWYFTKALLPGGHFCRPF

SEQ ID NO: 969673 - protein, 328 aa, Homo sapiens
MKGAESLCVFVPPSLSWENPDWGFLPSRVGEAPPPRGTGLCALRAPLVLGAHPPAFFGLAATLLPPPPPLPRGGLSSRAYHLGRPPRRLGEPRGQNNSPLVSSTSTSVSLRELVFTAMATTECPTAVPPYLWWWCGTIKVVTPHRAVVNNNNSRAGAAAPRWGATLPPLCVSRSPQMALCVSAFCAPTSVLCVRVLIYGVHTCLYIDGGATTRGDLCVYLARFHKPSHERDQLPLSTAFGTHHRGGDLTIRATHAEGATHPSHHSPPQGHTCHTSRPRRESLCALPGRHVSLERSGFRSVGDTGGPLRPRNSTRPPTKPFPMPYSPSE

SEQ ID NO: 969674 - protein, 146 aa, Homo sapiens
VSSLSGSSPPCLCHQSFSLHEDLPGRARPQLVLYDPGLPPVTLIRGLGDPVAEALGRRSELVVCKYLTHILAWAVPLRPSQAPGTEYSILDSARAHPRARILTPGGALIMKVALGRGWCPVQYWPSLASLSPTWLVYRVPQKWEPR

SEQ ID NO: 969675 - protein, 175 aa, Homo sapiens
MVCDRTYFGDRESPVGHAQILFYYGSDLFPATLMGCPHSKMFRGPHWGRKPQRFFCGMNNRHNWGSVAPQSIVFLAFSLKNGINFVFLGFYRVASPPWEYSGIVCVKCRCYIPPERPENGPQKGMFFVHPWGILGLPTNWELTRLLPTVLNISPAPLRWFSRRSVSTLSAHSGRS

SEQ ID NO: 969676 - protein, 273 aa, Homo sapiens
MASSVGAALLFLLPPPPLLGLAVRVLQSQLDVWLSPLVGRTQFLVGGPPFFSLLLGCCLVPLFSHSLVGISPRMARPLRVSVVACALFLLVMCGRRCPSLVNGEGTLLRGIWVCKHTWGPLFIASLSSGYLTKSMSPLVPRVYYRIFGFSRVLFVAIFLTYLHFSGRDHTTECPTQEHHNGPRTLCVLSYLTVSLCAHITTPPPDTPFKARFWAPPALLTTGLHGCSHGLYLGPFPRAPRLHATSTTRDRACPRPYRPTLVSPRSVLPYHKMF

SEQ ID NO: 969677 - protein, 272 aa, Homo sapiens
MKKTSWAYFSPPNIHGEFSPISPLWGNLLSPRVLVKSRSFKTYEPPTGESLAVPPVAAPPFSRVGLFHALLFVGFIEAFTVYSACWAPREHTPLLSHTRVRAGLHVGPRVPFDPLLVGEELHHRCTHTKWGPRWYTRLCSRDPPFVSFLGVPPTCFGSYYKSLNLLMKGHTGPSCSNSKPSRDRSLDLIAPTTMELTLPTRSDAAIPPTTSLKSHFQAPYLVLCNSARASFWKRGLSRGIWRHSAGRSTRPPEASPSSSPGRTDRLFIAHRA

SEQ ID NO: 969678 - protein, 158 aa, Homo sapiens
MSSILPPCSSSLAGAFFRGDVTKMGGYVIVSPLATKGTSGCHHDPGVVVGTPRWPSRQHVYTPGMVKFPFCGNGRPPMEPFLDVEASSFSRGGTNMGGPFTKRPQRKGVPVQREMFSLGGQRGVRGVRPRPRRSGTPRPMGERPDLGLSNLGLQRVEY

SEQ ID NO: 969679 - protein, 66 aa, Homo sapiens
AQWAYPVGTRVRKGAERLFGASRIRTVIVSEYVYRNRFPDFSVWPLLSNVEKCGKKAVITLGFDRV

SEQ ID NO: 969680 - protein, 188 aa, Homo sapiens
ARQIWCVCVPPPIGELPSSFVAESRGLPYPGVCSPYEEGAASTQERRVVSDMFLLRAPPPNRAGGREFYYTTETTSVRVYYSARYGSVSGRTTLLFPGSPSAGPLGPRLVVVAAGGAASRPTSRPPVSLPDKMYPPPLLQVLWWAAVIPVPRHAVGFLVVRGALLTGYVLPWRSSFFMFFFFFVVALA

SEQ ID NO: 969681 - protein, 187 aa, Homo sapiens
MPDMDSRMTRLELQCVGKRITLYHFREKLGVLKGAPYAHKVHCYEKILYESKHTGHSSRRHRHWEIYPSTERQTTPGHTWIAQEVIGGGYSRWMCYAYNKEGGCGLKLAQSPDKVGCRRQHKSGETEARDLSECKVRRELSPTTELLTGDSKERIIEEELRRIKKAQTEDLEYRGLEYLEMGAVILL

SEQ ID NO: 969682 - protein, 173 aa, Homo sapiens
NGCSPHLVPAFFRPRAVCFLPVGVGPPRGVTIRRSRGSPPKSFGREDLFFRPGLAAPSPFFPRESFGGEPLDRMSKLDKYPLWPQNILFLSPCRGLPEKWGHRVGPPGDNIKGGIVLLEGGLLPLCWEKPEIFLGGGTRKLLLVSPTNSEDPGWCQITKEVNTRTHSGPPPGI

SEQ ID NO: 969683 - protein, 135 aa, Homo sapiens
KSEVAEKRESRERSRGRSRYEKAERDAQEGGARGREQRRRGGGGREREAAEGGRIVERRGVGGLGEGRGGRGRWGSGRSGRGRGREAKSREAREKRKWGEKERGEGGERQGRGERATGRRGRERGESAGGERGAR

SEQ ID NO: 969684 - protein, 76 aa, Homo sapiens
HPPLPKVREHTFPKREEEVFKPGGDHKKRVCTQQATVNTNARAGPQPHTERVTTAENDPNGRTMVCWVEKYTTRGE

SEQ ID NO: 969685 - protein, 107 aa, Homo sapiens
MEKGEGENFLGERQEKAFFGPPLYCARVRERAQITLFAQYPLRRTPTQGGPYIAPGCLHSTGHATLWLIWGHSVGHRERDCLTYMGENPHKAIAHSEREEREPHRER

SEQ ID NO: 969686 - protein, 91 aa, Homo sapiens
GGDLHYSSHESGSTKQHPGGAAIVEALLLGVTRRKLGHNEGLFFFMLKGESFSIGAGGSHTPTTVLPDPHLLVFKKGVSLSIRRRYLKRRN

SEQ ID NO: 969687 - protein, 238 aa, Homo sapiens
MTGGRLGGLFGGAPRLSCGDYGGPLFMSGALFYTGGLPLCWGYSYGAPCCSRAFVPPVAMMEPPPGVPPGGPPPHLGGDIPAGGLWEPPAIIRVGKGPNECNKGTPAGYKGGPPTPRPLEEGVTLTSVKGDNKERDQHVCPTKGENTKTWGERDEAHAPYEPPPRNGETQSTLGPPRKKGRAPLFWGSIFPRRDLVGKLGDKERTAFEVLKKFLPGEKFLVRNPPLMFLRGEGGRDPR

SEQ ID NO: 969688 - protein, 407 aa, Homo sapiens
RVALVGRHTGLAMHRGTQCVGRHRSFNVYLRHPFVKLLGRPPTGCFQRGFVHEPNLLGGRTRMAFFGCRGKGVGPLFVVDTLAKTAKVLALFPRQGLREMAPVGVKSVLGDHHSHRGQQNSSLFFPRDTRWGVPATLMDQRVLWGGFATIPRLRAVGPSTPGPVPPWGGPNSGEFPREESKTLSGKKENGGARKGGEDPQGHKRETNGAPQGQKNGRHNAVVPTRTATEVCGDTNPGLETGGKERGDNWPRAASGALAHMTRPVGSSAPNTTRWLDWSNPGHNSREEDPLKALSEEKPGNPPNALDLRRRAQRKRGPRCAFVVTPGEHPHTRGTFHTRAHAPSVLVCFLKAKKATQRKLLAYRIGVRAQRLKALLSLTPESGTFSSGSRTEPSHRPPLFLELSFGTT

SEQ ID NO: 969689 - protein, 400 aa, Homo sapiens
AVRRLPDMYSLLRVSRILFVRRATSLVGCLHCWVPPLARCLLWLSLVLASSLAFYPPAGSFSLFVGRPSPWWWDAGVPPSFLRGGLPPQWVICLPPWGYSLCGPSALFLCFAPWNFQLPWGGLFYRPLFFSEVFTPVRHHKGFFRVHTLCVIPPAECDEYVVAHFFDEKTRCFAAQIDQFFWLSNPPISLLYLEDDRGSLTAVGERHLLCGKALPRRAPLHGRGGRPKIFFLPLFMSDIFSTERTPTTPSCYDTCGEKTGAVCYTTHRGEMCTTSHTFCVEYIYIVDSHISLLLLCETCATITLCLALTPQIVSPPHFCVLYLSSCRHTHLFSLYMRDTGVYIATLHNREVCGGATPCAHTVCAHKMCESAPAIFWLVAENNIFLPTAHPLWRDHTEIYM

SEQ ID NO: 969690 - protein, 191 aa, Homo sapiens
LIKVFPSEVFSNGGGFAMLLGVPSVCVCAPAVVRPVCDKACGVLGRVVVAPVVVATYVVFQGSAVGSHVETWTDCWAVISTRASDEFPSGCLLLWPSCLAGAHCFAPLGGAATRWGFVCHDEAFVQTPPVDVEHACVLLYTGGGRICAPQIGRASRFRSAPFGAHERLLCRRGGSTKALCLMSGGAVRGAP

SEQ ID NO: 969691 - protein, 291 aa, Homo sapiens
NLPLLFVSLVWGISYVSIVLCLYHLTPAHKCLVCVWCSPPTTPPVILYASLFAFSLPLNLECCLFRPPSLGVSSEWIWHLSFLLSCWFEGSSTHSLCASVLCSASPSLLAHPFSWCASTSCYERSSGGGGVKIVWRADRKKYRVAISECVWSRCITPDGATVRTRVYFSVRLSVSASHARAVAVSLLVWIDDFRFLVDARGVAMRGSSPRSRARALVAVVFGFARAARPPPPLPLRCRLSPRRPLYVSPRLARSPSLSLSLRLALRLCASLFSLSSLSPREPPLSLVSCSN

SEQ ID NO: 969692 - protein, 123 aa, Homo sapiens
SDYFLTTTWGDFSRTWAFSTDVSQHVVLRRHVWWCQHTIAPSRMRARFSSSTSDCFLVTSPRARLIVAGLHSPSFLCGGSTASLRRRLKEVVRCRLTNRELGLRPPCCLIRPGVRDRRPPFFL

SEQ ID NO: 969693 - protein, 102 aa, Homo sapiens
LLVLPGVGLLAYCVCVLLRAYRTSLRAVGASPPLVVDQLLCVCWVASRLLICLVALSRAAGGALRSVRRMVVIILRGAICLVCRLIGRGYRASLVGFARVVY

SEQ ID NO: 969694 - protein, 88 aa, Homo sapiens
SQRVRERLLSVVFYNTRVGATSCSFRTVFVIQPPNKRGVEKVVGKVRPRKLFRSARQISQDQVGEERTHNAFLATHFFLWGVCPPSLG

SEQ ID NO: 969695 - protein, 369 aa, Homo sapiens
TPPAAAPVVAWGVVTKRTSRFLSVKTPVAGNVAPPGEEPPQLSPHSPRCCVEQPPPIKERNLPRGGAPRSSTAAFLRGKPFVSALLIRGRPRRAGDCPRNVTSDNLVFGHHPTGGEKQPVLYGAPTSEWAAPNIYKGGETTLKDIGETTTVVGTTTNIKEAPRGPGEVYNTGGLAGEKIFFAARRYISSSRKNNTHGAVSRASLFVGGDIWNTGLYGDTHKTKALCVRGETRLFSSGALFWVPPSGGSYTVFPPHHFLFVGPKLFCPRECSLSKPPRHSLRTDHTLVGRVSRVLCSTNWGFESSVSLLFRWGEISGRTLGQTTCTLTRGERWCSSLLSSSTAVERRPSLCNLYLSLHIHTELLFFESTY

SEQ ID NO: 969696 - protein, 144 aa, Homo sapiens
ARWCRNELAEMNDLYLERDEHHNNESGVSYTRQQRVVLGWGGPPRDSTPDGGCAGELTYNSPGGESGGVAKTHQTATIPRGFAGGSEWTPPARLIGGNTRVGPFFLRVRVGHLLFLDERARCWATKGSQLKERNTHQGPLWVEK

SEQ ID NO: 969697 - protein, 123 aa, Homo sapiens
ALSSQRDISTKRVTIRRGGAINNKARRQACNRVDDRTTLAAAHNRVVAAENNGCDEDHHLGGNNSPANGGDQKVMAPNNRHLFSSLHNMGANTPKKAFRPPPLDSSESVFARPLRNVVKNRVG

SEQ ID NO: 969698 - protein, 167 aa, Homo sapiens
MAPPRFSEIKGIISNVILIFIGPGPGELRGEEKANPPGHILVPTHCLLGPPVETTALHPFFCLFSQSRRNTFVRSKRGRTGARKDEEEGLDNPAHPVSQAHGHREGTHMAPQGSKGPQKCNSCHHGREVLGEMGTSTVALLGECNTPARNNIAAFLAFSGPHTCPVL

SEQ ID NO: 969699 - protein, 136 aa, Homo sapiens
YAVLVQSRCCSAVLKLAACDCCCPAPRWGGVLIYVPLPRNIPVVCNKDTRAILSPVYTVAPGAGNICFNRGNRLVALGLIFGNPNRRTGCEPKNTGCVHRVSGNFPGGIIVWDPTPVPQEHARAAIRGPALLGGSF

SEQ ID NO: 969700 - protein, 216 aa, Homo sapiens
VVVCSVSHDCWWLHSVILCDGSSLMVIGSVSCKVGITTTVLCLLYCFALFLQVVPNLRGVWCWFLVAHEWGFWVFYKTRVILGCATPLVAPGQPCLCGRENSGCGKAARDLLGVERLCPGGPNGCFSKAPREDGSVATECFRGGQTGGWGDSHEMGPAPHGESTLGCSNVGYTGVIIPWGPLPRGPYLASRAYGPPGIWECANTAAQHIGTGKILV

SEQ ID NO: 969701 - protein, 482 aa, Homo sapiens
MLTNGSYSLVVRRHDYILSKRRAYAVFTPSAVMDFLSRGGMYATCCSVLSRVVTMCVTSLLMTRRVGSSPSFPGGQQTVGAYAERSVEMASVSSPFLRGEAVVFLYWGAKDTPRYDWGESHKSRGGLTLGEKNTALVLLGEKRRCAAQKYPGGEKLWGLVGVSSHRGRGPPVEESRGTMFALGPQKKGCTKCGLTALVGLVVDPELPPATGGEGPPSAAHEPPQGNNAGVALEGARERKGAAAPRCVSHRAVYNGGISMPRPERVVSHGGGKPQGRKISLEGERRGNNRGIHKDPGEETHKWGGPTAERANGLGLENTWRAKKVRAPPLCSLVGGVGSNPHATEWFLNTMGTAILTQRPREVGLSNFTTRGETLAIFCAFSLGRGGPPNGCHSGSRSRTEFGVNPQLVCNPREPHLLVTQTGDTNEVLASVLWKTELSPFPTLLKKVQGLFLAECQSAFVAAAPRGCCHTTRCSLLLLHAPR

SEQ ID NO: 969702 - protein, 544 aa, Homo sapiens
MLVFMWGALFIGGAFCGVLFFVVAFGVGRCFYWGVCSLLLFPGPSSNYIEVSSVGAAHSLALSPHKISMVLPGGSRPRAGSHGCVPTITTRSLRGGSFLCSLLAQRTQGLSPIALPLVEVEGGSARMCVCKTPLCRITNGACWCYLSRRSPVGRNIWGGYSNTPVLLLCFVRESTCQPTGCFLGEGISPLCRGGISSWAAPSPQIFQRARVVSIKIPPAGEGGPPPLLLQHKHHSAARWVLHPLGGGLPAGENNRGDNNMGSTTHPPRRRRGSTAYPLRGGVSRREMFSHSGNTALPGELINRGNSGVVFLEGRHTTGVFSSEIKGAWGESSTRGRFSSLRSHLALLEEPQQLFVGGLHHNMGDPTGEEGGDMNSATFLSLTHSFSPRFIHGGLPSLVSSCCAMYPLGVSLWGGARLFTLYLWRHLGVCSLFHREIILWGFSRGASRLSERESSKGEKRDCVRCSRGCALFLSLTVFVVRRCGVFLPRVSDRTHSGDALTHRERGASLSTHTQRCTCGGAPTRPTLCCERSPRDRFNTVNLIIC

SEQ ID NO: 969703 - protein, 104 aa, Homo sapiens
FFPNKSTPFFPPWCETRGLSGGFSGGKNVLRRILSILPLVWDPPPVWEGGTKRVSPPRPQEGRTPQGHQMVRGGERPQTTPHAGGLFQEGGPRAQEPRRPRKEI

SEQ ID NO: 969704 - protein, 169 aa, Homo sapiens
RLPKCGVAHNSVRKPLEGGRSPCLGYNAINPSCETFLRPEGNFASRRLYTIWSMSTPLFVVPKSTGGAPTVCVQRKAVSPVWVSGELLPGGGRRLPKRLFPLSRVFFSWGLKKKSLPMPRLLFRALFFYMKVLTDVTTDGVNVKMLHITTGGENKLVKRLFFRGGVLVL

SEQ ID NO: 969705 - protein, 315 aa, Homo sapiens
MRGSPAGPRPGGNTGSLLWVLLIKGGGEARGGCFFRSFLKCWAYNPGGIRNNPPRAFVGPCGGPRHRPHNCDTQNLWVCVPRWVIKEAGGFPACFLPPPRGGPQTPLLSPARATKKSCLSQENSHRAAGRPFREGSPHPSGFYTVGPRGEPVEPNLCAHQMFLAGPPKTPGNLSGHNPWGTLGSHYPPYEDIESTFVATGATTSPSPQMRVAGRHNHFSATESLPQALVCSTPLFEAPSSEGECVSEHETRGTAVGAQLVHRSNICAPAFSCTVRLRAQVHSPHTGLHLHTLWRAPQPTSCLLRTPLKRTGNWNT

SEQ ID NO: 969706 - protein, 235 aa, Homo sapiens
MFYTAPPLSGVFLKRRYMRVLLYRTCPAQHSSGAVVWREIVSRGVYTSLPPLWALICNIFYSPHMLKGVDTHLCGHTKGGHILETPHLRGGAPPPWVEDLHKTHNMFHTQTQCVIKWALALFWREFLGCGLFTVALSHGEETHTGHSVPLSFTECPRKGECLLRGQGEECLWRVMERLSHFWTPAGLSLWETSGLPLSAGDLGAFRWWKHLSALSWAHYPPTAPRTPPGTTIIET

SEQ ID NO: 969707 - protein, 103 aa, Homo sapiens
MRDPTREEISLHIRSGETTAEPSEEKFSTLGRLFSHSPAFPRPRKMCPREWSSRKGGAYADADTNRQPASAGVLIHTGWRRERLGSTLDVGPTGVKTLPVPET

SEQ ID NO: 969708 - protein, 114 aa, Homo sapiens
MKDPPPVFLSSEEEMGFPIVRPQDYIKRGGNFFLCAPGGAPPLWRNTSNWTPQQAPPSVCCYNTIIGAYHRGGTTTKRWPANIGGGATTSSFGETTTGLIISGRGKLPLRRDIY

SEQ ID NO: 969709 - protein, 277 aa, Homo sapiens
KHHGGAASGGIPPPHDEGCITKRRVDTSPPSVASKPLLDLYNPVVARREEGGVANESIIGNSVFTTAVYTTHTSRRKGGENVAPPPPVPLTKVDFRHTRVCASAHEKKPLRPRAQREGDNRCVTQSPRCFLLPSLAARPMIGECCLVPPRRSSSPDTSVVYDRIARPLPLYERWFYEVVPPPRPARRTTMLGVRPGVLIHPIGGHTSPPLVSVLLSLKTSGFVSFAALCPQRGRVGGNATTILSPPADLFLYKSSKHLLFFLGKKNYFPSSGAKNKN

SEQ ID NO: 969710 - protein, 239 aa, Homo sapiens
MLGSFGGASLGPPLMLGFATLCPSRSLGRLHWGGHQQISLSPRIWPLGERLNCGRAPNSRPFLWWPSHLVAPWVGRTLWGCRPPCAFFSGGHCGGPPAPHMGGPPGPPCGAGFVGNMCEGCHTCGAPWATTWWVVAPGCGPRWGTTAPFWIPLLCPPHPEGILGESVWPQTFSVEREMSFFAHRVSPLSLGVGASLGGAPHYWSSHSGGGWCHRQGDRAASAPRSIVLCVREHFLATHV

SEQ ID NO: 969711 - protein, 350 aa, Homo sapiens
MITLLVGWAPSDDAFDIAESFVERPENFFVPPHGGIGGKLPPYPPLLGRLNIVLMIALGAIIHLWLWALVCLPHWGETFLWFPKLAALVKVLFLLLTLQLWEAPFGEDFFVGETIGGGYGRGPRLPSWSTQHPGLSRLVESCGKLPTHAYAHNAWLLMCNPLLPPCLLGSPLTGRSLTLHRVCPLFHCSHRPHCGSCGRVSDSEHRGATGQQCAHWSAQCHRCPHAGGERGPCGCFSALRVSVWRASTWASCLSHTAFGKLCCFEKDYTPQKGERGREPPSVNFCATPCLTLSRVLRMSTSPSHSFKGNSTLWCPSSFLTLLHMFLLESLRIMLTAFSRSSRPSGRRKGL

SEQ ID NO: 969712 - protein, 97 aa, Homo sapiens
CPLRGGAGSSSGGAGFPVAYDLEEVFIYAPAQPFSDLYVPALCCEAFRDGLAPRAPALLRPSGPFSGVPGGPSAGPPTGGNLLPNPMLVALAPPEHA

SEQ ID NO: 969713 - protein, 107 aa, Homo sapiens
LLCPVVCSGVPHRGCLVITPFVVHTTPPQMMGRGQHHICAERALHQRRAPRMRVVFLSGDATTPPPHMGSPVVHPQHFLRVRVAPPQHFGDTESPTTCLLWCVSMFA

SEQ ID NO: 969714 - protein, 184 aa, Homo sapiens
AGSLRNDLPFGWAVQSSSVHASAVDCLCFSDAPFRGRFDLRKVGGVVSRRVIIPTARRLSSSNVDLPVCSRLVSSPGPQVATSPGSSVPRVARVWFARFFVWIKGGCSAIGQGPRPNYPLGVGGVVGVSRGEIPLELVVCVLQRDTGGVLGPHGVWSVSYSRGCVAEVFVSHLGTFPSFPSPAV

SEQ ID NO: 969715 - protein, 231 aa, Homo sapiens
FDRKMGWVVAHRHKNWWCTSPFFHRVTICANEEDVILSCGHSTDTSSLDDRWWGGTLSPSPSVGCLCVGTSPPDEVSACFVGTPPLWRTTHNVWSLMGPLCSKIFGGKSVSSTKNYLFDVRGVVPCGPSGEAVLEKVFLVSGSSLYGPLPPVGGVLILSPPLVRSPVANTASSWAAVCLLDLPPSLSGVMAAAFPCLSLCDGRKPNASSKAGNFTPRETTPTIGREGLSLR

SEQ ID NO: 969716 - protein, 109 aa, Homo sapiens
CGAPPPGGAGFPPCSSPGDLFCASYGPRWGPRGMMPRRCCRPPRRGSPMPLMVPLLLAPPIIFKGVDTNPVYVRCDHTRCLVDPHIKERHGSLVLPTGLLRGKFSLPGE

SEQ ID NO: 969717 - protein, 294 aa, Homo sapiens
VGECTAFSHASWRSSEYSWWMTLLTATLMHRLAPHCSFARRLPCNGSLFRYKHPSEEEHRALAREGEAQRQERAGANGISEEKPLICAPRGPVPAGELPPHDSGCTGGLLLHSWDQQRRIKLLCIWCLHTVTKSIKMLKEKRLDFSAEEGGERSVSSNFALIFLLLDAGEVVREENLELGLEHEMASMIQNSEPLLKKLGWDWAPPVAKLATRLGLAVVGSVLGASLTTPRLRLAQTHRDALTMLEATPMLQFFLHTSILCTLSTLWLWTHPTARDSLHHPPFGGDAYFPAVRF

SEQ ID NO: 969718 - protein, 229 aa, Homo sapiens
MGQTRNQKEKLGGVLWTQNRVNPSSEIWGDHPLVGNLRRLLGVTPGHCPPLLNCLRARSVKCGLLAPKRAPFFTCDQKGTSTGGFSSRERLSSLLGVAAPPRAQLLVEAGGFSHHNQLLVEGEPAFGRGQRYGETFLPVEECTHMTPPDECGRLWIDTKSGKMRDCVEDTPTHEEGSKTTTFSIFLWETHWIFSPHHMDRGTNFFLLHLKMWDLPSGAVFYTQKVWIHL

SEQ ID NO: 969719 - protein, 196 aa, Homo sapiens
ESLVRFGSLLVVVRRAIAGVVGRGAPGGFVGVRTVVPSCDGGALRPTRGDDHVCAGSPRVVRGATQSGWGVGPAPQVGGQRGSPLVGGAERRAAKLAPPLLVGAPRGPYECAFVKLSGHWRFGYCGSPLAPVWEGVAQQGWEVVPHALCGGESGGRLGRGFWGAAFLGVGPLWRDHLPTRVCAHAHVDTLVWRDIV

SEQ ID NO: 969720 - protein, 482 aa, Homo sapiens
VCGGLPRPAVCCISPGAPFLACDPRGGAVPLMYIRVVGFVVLLLRPRSVVGARPSTCRPPALVEWEFPSQRDVFSVVCGSVLSLSSSLKGRGRHKDVIHFPGVCCLGDNFSRVLWVAVSPPIAALWGRLSLPMGSPPTPVGVSAEAAKEKYAWCVEYFYGRRRSAPEGGEVCDLCTLGDDFCGGPAPPMSLPSKIWVPPSPPRPPVILWPSFLVVDTPGESASVVRREEKSGPFIATTCVSLRHNCGGFYYIFEEMRVLEEKILWPPPSLVADTDIADTTHHALNMGVNRPFYFCGQYDFFGDIINSAPPLAEYKGEISGCSLLEKSALVDISRIDDVTAHTSRDLFMENTSRSALGGFLWRPPLRYYVEKAVVNLGVSPLSRVICIKRCVSQRGLERWFLSREMFFSLSERGSRAHRDTHSFVGCGCSVQRVARSHSGLETSFHTPADRRPTAVALFSYRLERVLFGPQRTPARRSLYSGS

SEQ ID NO: 969721 - protein, 213 aa, Homo sapiens
MVWPHSWSATKCQPGTGSHIIRGVEMEMSPHVSLSATLRPLSVCPHGRHLGDGPQAWAWCEGWCVCRTLLALLKSHTGICVCERTPALSVKRLHATWARLRRCHARRLSWPRTPSPRKARAPENHEGPRFFSLFWPLRRGTHPRPSRNLHVHALRARTTHLGREGPHLWPCLLSREKALLEVECLFPEATCVSCRLFSLVPTKLPTNNLYGNR

SEQ ID NO: 969722 - protein, 246 aa, Homo sapiens
MCRERISPGGGPPRVCPRTAFPAEDFSYGALWGAPPGVFPAEFVIRLVLHTHTGNTPPYMRPTFMGPQMFIAVTHRIYGTHTVFGDHTREAHASRVNPRFSRNFSPAGVYSRCRRLPHALLSAVSRCLCRPTKHILVCLSALTETHCLGPREYVSLGGGLSHQRHRRAPVGKSPGHRRGAHTSRALPQPPLWESTPPHLSLCVCENVKRLSVFPLTALAQGSAHFVHFAEKEHTLLTFFSLLYFEI

SEQ ID NO: 969723 - protein, 124 aa, Homo sapiens
MVLLAAWGCARCVGVAGCGGGAEVWGVALSGGPVVCAAVGGVRAAGGVPRSWPVAVKSRWRDGDGGRALLWGSRVAVPPGVVRHQVLVRAGEGERGGGVHWERGSEARGEQGGERCGESAKRGG

SEQ ID NO: 969724 - protein, 259 aa, Homo sapiens
MCRIGLGRLFCTRVGCYHGGGSVKFRPGEPPLRSRGARNICGVPGVLIGPPLVEDWGSWAHTNGGVTNHLWPTGPHECFAPWKVLVYRDDNRELVVDSPPACYLGVDYKRRALGKKELGRALRKCSPLEERFLGLEESRGAHILLRNNIGFSLVPQGGPTCVVALRERLFLHETICPPPLCGVARLWASCVARDNMREPQSHAFVARLGLCVTLNIIPTVWDPHRERPLSLESLWRTQVHTHTVLLPPQNIRLSQREAL

SEQ ID NO: 969725 - protein, 304 aa, Homo sapiens
PQVGVAERPRKKSGLTTGRACEHRRSGGVARIRRAKDARRSQRGRRTRAWGAAPKGGSAKCARRTQGYRAHGKVLEGPQMAPAPCEESKKRARGDGRTASKRAYRATGVLYRAPEGGAKGAPQLRRGVSCSCVGCKGGPQAGYVRHLRGLGTAGWPTSGRVPQRLLPCCHGWELFGFVGKRGAEWTKKNSAGAVIPTHGRPHQEREREVRYIHGEHPGNMVKEATERLENSGKDICRGASTNGETPSTPTEMTLVKYTVGEVWALPRRYVHTQGQRPLTRGRDRCHTVGGAQHTLCHRGHTCEH

SEQ ID NO: 969726 - protein, 243 aa, Homo sapiens
MTWRCPTVGGPPLVDGGAPRLVAVYPGSSQYVWVCALGVGPLSRGKCVFGAPLSPVARSVLIGLGPLPWLPWAPGFLAHRVPPVFAFPIRCKPLGPCPCCVRPPRVGPPPHNVGHVGPLQGAGMAPSKSPPNCVEAPGRVDSRLIYVNGVVLVPPPLYSPGVDFPTPGEEIEGLALSAGVLAWGPLRSHFPRLLPTTLNTRGDGRRGGRWASIPPMRGSFHGLLAHTTAVRHPTNILGCGLCV

SEQ ID NO: 969727 - protein, 108 aa, Homo sapiens
MAAYILAVPREFGPRRSKGSWVFTPPNNTHKLRATHRKENRTQNPWNLGPTSALRALARSGMKIGRIEECHPPLPSDTHTPRKGGPRWSPSVNKIPPKYFLLTTLPSS

SEQ ID NO: 969728 - protein, 115 aa, Homo sapiens
YAYTVCYHKYVCPRTQQQPRMWNEHYSVGGVLGSHYTHTVCDFTGLMCAHHPFLLIDPRRRRRAFFSCREKEFYPTQRGAFRYPHGGKIHERRKGVLKSYYPGFEIVAGVKCCRG

SEQ ID NO: 969729 - protein, 190 aa, Homo sapiens
MKRESPAGGFPRTVSHTPTHGVPREILAPHRRGPLSRGKSLKRFPTAQQGGHSLSPLYTLGLVDTHCWLGGLVPFWVSSERGYIGRDNIPPTKGVYNNPLGFCLHSTENHAPRHFHAQLKWGTPTPSLHGMKTPRYKFPRSVETWAQACGGPTATTATSRLGFHELLVVENKCGESLAHMVSHLAKKVPL

SEQ ID NO: 969730 - protein, 125 aa, Homo sapiens
MNTPTGGCYCCPTCPPKLGPFHNISNESAHYNPPRRKIFSSRLDPPCRTPPPLLCNIIENTFVFLGKKILSPTEKNPRVCLPQRNWGTAPGEEERGVPLSTSGKIPTRPPTFLFWKDNVPPTSVL

SEQ ID NO: 969731 - protein, 214 aa, Homo sapiens
CRCVFWGGMRLDAGLKELWGRQLFCGPRHFPPVLWSPPGTHPFGGGIPLYDVRTKTVWSPGSLCSGVSPLFSGIPGAPPTVGSVNRIGNVGYTLLARESDGHPGTTRDHTPVSVPFSALARYPSGDLLCVIMHETVLVRLVSCHPPEGGLAGSLFHGALPFLPVDGRALVENPVTVMIVARRHVQCPRQIVGGYLVKPRPLKLKTRPGLILILN

SEQ ID NO: 969732 - protein, 118 aa, Homo sapiens
EGAAGGVFSAVCGFALCGRPWPVVDRVRAVGGSGCGDVIRWPAVAWRTRRWAGGVRSSLVGSLGGQGVCNKGGSPQSRPCGRAAHKNSPSACVFVADRLALRLGTTVDVETPSVGRPE

SEQ ID NO: 969733 - protein, 428 aa, Homo sapiens
MAAPTGSVVFARAPRSRFWCPPNVPRGGLSCRSTEPPRIILPVGLVLLWTILVLAAASKGLFYSILRLRNSKCSVLQSCPPHHGETTHFCCGVAVVLLCGREIIPPPLSPPWLVPPRFYRPRSPAVFVPPPPAWFSPTRGGPAHLGVSQPVNRESAWWIWRAPTIWRVLKYGFPTTQHHIILLTPTALIICSCFLEDFVEISPFTPPHMVCRNHHRARRVSSVGEHFPAPAPSSRGGAYNIQICVPPPTRLCHIWGHRTRAPAPISSTRDPCVLKPPLSLRMPTLFLRAPLAFPRRPKGPCPRHTVLIHRGREVRTVTAGCVRIFLPARAPEEATPLNAPLVVSEVPPPQYPTESHHARRKEGPKFRRKEGLRGREVAYEAFTSLGKARENHVCTLYFTSHACPVACPPVCTLLFFPVHIPAVQTPPL

SEQ ID NO: 969734 - protein, 119 aa, Homo sapiens
MPPPLQLLGGLPFFQVEWEYQQFFRERTPPNCVKETLPPLRRWETPAAPPLCSNIYQGPKHSPNIRKGQFPPSYTAHATSLFFFWGTNLGEWAPPLLGHTQNPKKIPFAPWCPRFRGGF

SEQ ID NO: 969735 - protein, 136 aa, Homo sapiens
GARLLTTRRSIDSRRGCTPSLWVVSPPVWSTTLLVWCFRGYTSSVFRLLPPRFFMLLLGRPSLVLRALSAPPRCLVGGLLCSPLDVIVGAYYLGGGPSSFLLLYAFLCRHALLCVFSPPCRLCRRASWSAGPPRRS

SEQ ID NO: 969736 - protein, 220 aa, Homo sapiens
APPRKRRVHGREPEPQLTEGGEKGVCPAPEEEMDESDRRWLLAPGPGPRRVTCPRVTLVLDEIKRQYSHSGPTTSLWPCHYFLGDTFDKDGAGLVVLHEYRLSLKNSPHDLHWAAILTTHWNVSRDWTQLRKNAFARVTPLLETPPIAAPFSGVWVFRGHGACLSPESRLARWNYESYTTERKLDPGSEETPTPGFESTFPGRGPSSKWAKTFNQGQIFK

SEQ ID NO: 969737 - protein, 110 aa, Homo sapiens
MRTPSPSSPIFSYSPPWCVHHLCGVFFFSPSSHCLPAGICGGSSFPNFCCGAVVAALLPNFVLSHTGVSPRHFILLILVLPRTFLLLTSGFIRPPPSFFSFHTPPTTLWV

SEQ ID NO: 969738 - protein, 174 aa, Homo sapiens
MKLLLAVAASLIPDCLCMETYLLCRDLGRDSISTLGVIARLSLLWGCCVLARSLHAGWGVAPTHSSTCGGQSTSYCLETRMDWFPYDGLASSCRAPVVFCVVGGNNIHAVWPVSPPPCLSLLSFADVGISAAPLVLVFAGCWSDSPPLLSLGTPPRGLLRSVLFLSRATAGGFV

SEQ ID NO: 969739 - protein, 131 aa, Homo sapiens
ISDPLEPWRSVRIRIGQSIVGPTSTAGTGDDPHKPGLQYQPVCHPENVIPYFQPELIARFLASRKILFWLPIVLWDSHETKRWVDPDSPVLLEDPQSFVPWPKSTQRIPRPELPCATRCTRGVVVLAQSYP

SEQ ID NO: 969740 - protein, 253 aa, Homo sapiens
PRSCSRPPCRCVFWVDLDPPAPGAAGACQAPPFVAGCARQAGRALLSSSTARLVLCVPPPPLGGEHVGAHHTPTRLSSPPPHAAAAVSFDAAPAALPRARGSSHRRSPPPLVVLTQRRRRRRCGGWSASGRCVSVVKLMGRLAHALPRPATLVGGAPPGRPTYDVPLLSLGCGPHGDGLSPLVCFRQPREEPLWFFVLWPRRGARRWRPPVSHAWFFCWCPRDVARANVGARRPRRPAPRAPGWRCPLAGARC

SEQ ID NO: 969741 - protein, 87 aa, Homo sapiens
LGGVHCFQMKLDISSQPLAARNSLKWTMDAQLRTFYEKRMATTKLLLTLWVKNGRVMWSESRGGGRPNRFPPEATGVLNPWPCPPCY

SEQ ID NO: 969742 - protein, 163 aa, Homo sapiens
MVATHIYIGTPTVFGAPTNIHHGRVSVPRVPREISPPREYISVSSTPHARLRSIRDLPPPFSHKRRHRDPAPPGPALNLRPTAVAASGAPLTRDMSSLPRAGVPLWGGAPFPLPRHGCAALCTTLRALLTSCAKPHRSHSTTRVIPRAWLKCCVSKLVWSEET

SEQ ID NO: 969743 - protein, 154 aa, Homo sapiens
PGGSRVQVFWGSQGLGPDFSSGVVATPGVRSSPPGVTRVGPPFGRAPFCAQRGWGKTWRKNSRSSFRAPLFSLFSPRIQGFMGPQHTLLGGRPTQVNTYREGPPCAGVWSRCFPGTPGSLQPRCWASGEPQGPCTRAPEPPPFAGGIVCTPRTH

SEQ ID NO: 969744 - protein, 400 aa, Homo sapiens
MGRSPPSLTFYLSSLSCFPAWLFRYAGAASPHVVVSSSSVLGDLFLFVIRVASHACLCVVWGRPLFCGVSYSCGIPSCCFSLLSSLCLLTSVCLLSSVPQRAVVVPATSMGGMYAFAAVFVSSSSCALLSPVVVAFLPVVWSPSTYFFASNTLVRPARTMTVAPCGAGTVWVVPNLSFLVFRRGGNSAPASVGGPNSVRGVGQELFGCPSSLQDDALRPAMMYLSVECAEGVRGRLSLHLSDRLLFPARSLSLSLSVMSSQSIFVPLAPPSSLSVRRVCAQSECALSVRTTSSLPETPLLCVSSVWCVCLCVCALTTGAIPSLPPPSLPTLHRRAVVPSLVRRFLTRARSSRPLLRHRGGPLLLVYCVGSQRPRPAAGGWTFLLRGASLPRPRRLRWCSL

SEQ ID NO: 969745 - protein, 72 aa, Homo sapiens
ASPPSRLAPCRTFSPVPDEKTHFKSLAPEKSSPLTEGDLLEKVRVPCPVFDYVPPELLTLFISHLGGRLHPS

SEQ ID NO: 969746 - protein, 133 aa, Homo sapiens
FPPPGPSPKGRFLAVDVCAPRRLHPGDPHYFEKLDFSAGPRVASVGAPPEWGFSYIICSVGVLPPVDGVGRRCDTWGHFVYFSAKPSTSTLWSLSVESYPPEHPACSMRFGYEASHVSHPNMVPYVPHIERPR

SEQ ID NO: 969747 - protein, 179 aa, Homo sapiens
MPPPRLWIKGPPPEQWREKGLIPRDNAHTAEIHLRVCFGDIFGPTSRRPPVTPLVSREKTHTVVVTHTKRKASHLHGEVTHSRTGSVHTRGKIHTPTQREETPLEERDPRREPHADRESEKPPLLMNPRGAAHETHISQAPHLGYNSSHKHYSTRVSLYWGEKPHENTEMGTCGCRLYL

SEQ ID NO: 969748 - protein, 131 aa, Homo sapiens
TVMCTQARRPLAVDRSRDYCGFSRCSGRLGAPPPVCPAPGWPSPPCGGLMSPIRAIPLHQGRETWACIPALCPGVSPLPFPRVYQGLYFFRHELAVILRTGESPRPREPGVLNFAGCVGLGPPWVPCELPQ

SEQ ID NO: 969749 - protein, 93 aa, Homo sapiens
WRGVVSRPMAQLLSRPFFLRISGGSSPFSPEGIFIFPADILHTRLLFLFCWEPAAPPLCDTLLGSAHTGGNFGPQLGFGKLKLLAPEVRKGLK

SEQ ID NO: 969750 - protein, 214 aa, Homo sapiens
RFARPPRWGIAPHLGTAGGLYWVIELPFRGTSLYPRAPPAPHVARLRPMDDRELHIGGSHTPYEKGVFKLEVIIPEEVTHWTSSDAGGLPRFYHPSLDSAGRIFWMFSDCPPKVLGDPPSHRRCVDLYSAAHVRDPTLMTRSWLTYPPDFNIISPPSSRMPDRGQRSMPDQKPKADEEEMLDNLPEAGDSRVPPLHTRKGEAQSASRHRKEISS

SEQ ID NO: 969751 - protein, 104 aa, Homo sapiens
MSPYFNRSKLLDFCQSKDIVLVAYSALGSPRDQRWVDPNSPVLLEDPGSFVPWPKSTSEPPALIALRYPAAAWGCGPGPELTMSQRIQTRTCQVFEFPVDCRGP

SEQ ID NO: 969752 - protein, 225 aa, Homo sapiens
EHPGHPPRPYYSCWTPARRFRWLRNGYYTNPRATKGWKNIESYLQGMSLTGIEILVRVGETIPMCWVQTQVDIKGQESEGRIHCRSPEEESSVLTTFLPKYYHFESPSSGLLGSSLETLTWNLFHACSAPPEVVMDPALAAPYEPDLEVAPEPTALPDEDDDLLRMKLEPRVQKSSFIGQLSCDVQAVQRVCPLHYYLAKRNMCFICGMLKEMSGLRSECAQFKK

SEQ ID NO: 969753 - protein, 122 aa, Homo sapiens
MSTSTSVPVGVHPKPVDQKAAGAGKVTQSAPGSSRRLNEYYPLYLPTPTLNQWWKNGLQNCLFPIGPFKFSSKRLVNDHHAIVKPFQKERRMFCGPPWFSFLRVASFKLLVFKTPYFLMETT

SEQ ID NO: 969754 - protein, 133 aa, Homo sapiens
PHQPGHSLLFFIPGGYYFPRTVCTSAFLCALVAVGARDTAVFPCEFSAGVLSSPPSPRVFHWGAYTFLGRVLASVWGIIIFLCLWPQHTLLSLHPSGATRIFGGNPSRWGCWVKRTTTNEERIFFDWRIAEEN

SEQ ID NO: 969755 - protein, 127 aa, Homo sapiens
MVIPLPVVPSDEEDGQPRRAVDHEKEGVQYSYSLFHLMLCLASLYITDDPDPLVQALMPSFTSTDPPVARCVGPDQLPLGLPPALRLDPCGSTLSSPRRELHAETSELPRTPPGTPQGLLPRNPYTF

SEQ ID NO: 969756 - protein, 105 aa, Homo sapiens
CSANPGPFKLPATNVRGPLEGYSATHIVQRSRFQECLSLSSPTEEFHPEWPPQALGWSIIWEGNPGTEQLDHIDIILKGPLEIPREKVDNNSQCRPNSVTFSLNR

SEQ ID NO: 969757 - protein, 115 aa, Homo sapiens
CLSPPYVGPPGGLSLICDGLSNMLLRSRIFCPRIELRGSTPGFYSAQWVSRDSGFLLPLVVRSRCPHNGGMRGPVKLGSRSLGPKGGRVGPRTHGAPEGSGHTDQRRQDRGHWSR

SEQ ID NO: 969758 - protein, 201 aa, Homo sapiens
FARVAAGVNKPKRRPLFGPRPSFSPGERHPSHPVVLAAPHISVSPPGGALSPTSPRGFLSLYRPPRRRGITHFFYHHGTTTPFAPLQAPLLCGAHHTYRNRQMVVHQTRAPGACGSPGSSARFSPRVILFLQLNPVFAPTPAGGLATTIACSRRREHTSAGVCPRRGRGSPPLLSPPPQMLLPPKRYTRLLFPPFVGTHIY

SEQ ID NO: 969759 - protein, 290 aa, Homo sapiens
LPFLGAPLPPWRKNCFRPRVFLSWPKGGEKYQLVSLSLRGPLLWMSSQGGLAFFVQLLTRREVCPPPCEESVALDSLPLLVSCTPLGAFQCLLTASTSSFSEPPPVSLNLPSIPAPLLKFLGLWAEPPVEHEDTPPSSRARRYQLVLERSYPRPKARHFLVPSIVDSPMTVVPRGPVSLRGDRAHPIFGGHLHRTLEGFAPPDEWIRDIPDGATRLFMSLFVCNADKDPTGIWGSRTAGYRASGFFFFQFSPLPKSQKKIRAFFPKALPPLMKFFPLCFKPPPPPKQGFF

SEQ ID NO: 969760 - protein, 210 aa, Homo sapiens
RPCILLSPHDPPLPWVPIGHRSSRTSYPDAEEKLDPEPMTSRTGAHDQSDPPAHEELDRGPDKSDRGHDKSDKGRERGYDQVDRERERDRDGIGTPGMTRQTPEEGQERRPHQSPGRSWLPIPRAQKAVSRKDEELDPLDPSSYSDAPRGTWSTGLPQRNEAQTGADTTSSWAPLPAAAVSIPRGCAPGPSEAFRPSSRIEASASWPGLK

SEQ ID NO: 969761 - protein, 276 aa, Homo sapiens
WLFVSSSLLLFLPPFLRVVVFFLSCFPHLCCVSPELLFSFGGSLCCIALPFCCFAPLLVFFCAQLFLFFGEHDAATPPLLLFLCSNNYLVVGHSSFSRLLCSLLSLAPSFFSAPHPRGFLLVSTKYFLCRNLFRSLQVVGHILPFDDDFIRRFFFLSLFKFPLFVFVVRRHPSSSHHACSPLLLIYFFCLLNYLLWLGSLSPPAAVHLPLPYQGSMFVFSNSFSASFLRGLSSLFVIVFHFVSLPAVLLLYLMFFFFLPRDFSLPPTCGVFFSHRH

SEQ ID NO: 969762 - protein, 115 aa, Homo sapiens
SAKIPDLFCRQVSQGLLLSTPPSPWASTDRRTSVSRIGNSLLVLVVVLENDVLVNRRYGITRAYGPVCFPLCFKPRKSKGCQRPFSPIPKLRTPGIATLLDPRQTPLPVGPLYCA

SEQ ID NO: 969763 - protein, 108 aa, Homo sapiens
MGGNPTYLGTTTCLGLPTSNMPHGSGYPRVPRGIVPRGIILSRTPNSVFPGLLGVPQSRFSGGMTLLVVPLSSLPCTPRVFLGALVATLAHTSPKDTCVVPPLCPYLC

SEQ ID NO: 969764 - protein, 104 aa, Homo sapiens
MSHVALSVPKPQVSVKSVWICRAQYFRRAKCSTPLFFMGSTAHCCVPKVVATVITVWCPTDFVVIQECCNSRCPLSWNIYEIATEDNHLAHPSCTRNIGDSSFE

SEQ ID NO: 969765 - protein, 105 aa, Homo sapiens
AKSLMFAAHRFKSLLSFQRHQAYAGKEALTYILGENRMMMREEVEEEEDFISILGSVNANGDRDSGLRVTGPQGWASLTRPRLVVWPYEGTGAPPLPPHQCPEWP

SEQ ID NO: 969766 - protein, 144 aa, Homo sapiens
TLNTKGLMSFLKGDRSFDAPLRKLPLWGDINALRSPDGVPICCPQQLCLFCYPPPDKEVLGGLTPPSSHCDLVGCDISCSPVFCFETKFLLTLHDDGFVVAHSWLISLRAPRMCIHHMWVAASLFSPHLAAFYLDVLPLSLSST

SEQ ID NO: 969767 - protein, 128 aa, Homo sapiens
RGPAGGLREMPKGTRVFKKTKMGEYREGTGARMGRKPRSGRELVPPAPQQTSLVKGFRGSSLGPKRTKGSQLPPKRLTRKLENDQPGGGSVKSGSHFEKSFPVRHHKKVAPSLGPPRPGGNCLAREWC

SEQ ID NO: 969768 - protein, 287 aa, Homo sapiens
FGASFVGVRCVVRVETPNPPLVCRPSCVDTAGWIPGCVAVCLLVARGGETIVCTRAGRCAASARCWVPPILSAAVCVLEGSRGGVCTRAVISLAGMCFLDRQRLCAARRSVALCEGFGGRCRPPPIFEGGLVFMLCPPRGARLFMRLCGCHPVDLWGFFGREEEGASSRFVEGREIFVSLWRPSSSLGSRFFPREVLFLWCAPARGWCSPGALWVVLLSRRLGHNMWCAHYSRRRWCFPHLVGGTCMCPQCVLSISLLGSIFLPPPGGPLHEVVFPRGGVLGGPLGV

SEQ ID NO: 969769 - protein, 105 aa, Homo sapiens
MSERRVSPSRCAECPSWPLGGESRGRNGVLYCAFWSFPGVLLAFRLPSPWRFLMEVVPLLGTFLPTGKNFLLKLSKRYGLARGPTGERYPRHVQWKLPQRRPIKR

SEQ ID NO: 969770 - protein, 164 aa, Homo sapiens
VCLTPRPRVVAPRVQRTVGGQPARVCIPLWGAMIITSTAFMRALGGPSRSSVGFCCGVGVTVFSLVAANRALAVGGTRAPLVLSRPHPPVGGFFHAGGLLFFLFCSPAGDTNCRSCEVSFVPVTRQTLAIGLRTRPRSPRVSVRELDYSSSTGGPQTSLLRPPQ

SEQ ID NO: 969771 - protein, 158 aa, Homo sapiens
RGVVRSYAALRLITGPPPGRRVCRTTSLSLFGRPGRAPPLPQLQRSVVFATAVALQGVPPPLHDNCFGAILIFWCVSPPHPAHISVGGTPPARLCYFVGLTLRPPRIDGSLECLVRTFGVSHGRPLSCSVPRPHARRQHLARVGTEKGGWWFSLLRGA

SEQ ID NO: 969772 - protein, 127 aa, Homo sapiens
LCLRGVESFLPRRGVVKRVRSRPHLFSSLWQPLVWGGVDGYSAPMVRQQPRPALCGALPAPEGVFFFSSVLPSGGRSTVCWGVCPPSRQPLSSLSMITLVWVRLSPTRESTGGLVLSPRSHRGVFFL

SEQ ID NO: 969773 - protein, 119 aa, Homo sapiens
RCFIKEVSTAWARDAPPTTTRRCAERKFPSFPPPTKSVSPTRINSRRLFSRPLLLNARNFLKRSPTQERIISSSLTSLRKERRGKKGENTNIFLGRLLTPESRGDYFKIESPPHSRENP

SEQ ID NO: 969774 - protein, 160 aa, Homo sapiens
MLGATPRPIIISPPSIFLEQPPGHTYSCWGRQYDLGAASWGRTHPLSLVSALGPALRAPRSHTYTGSPSYVAAPPPLWCCTRLPPYEIFPEAPSFPGGTVGRLLPSSLSGDVAPHLVGFFLPPFPPNFRVKGAPCLFPGGPQGKPPGVFAPQKQNPLAPE

SEQ ID NO: 969775 - protein, 136 aa, Homo sapiens
MFVLPPFFLFVDAERRLALRILLCVATRGGGVFVRLSAPPAVVVCCSPLGVLSLSYCGGSPPIGVVNADGCFSRVVCTPTSVSCGHRPRGVVYRSLAAFEYFGGPPPFFPLFCFPPNFFIRALFSFSPPFSPFGPP

SEQ ID NO: 969776 - protein, 120 aa, Homo sapiens
LEKTRRPLEENPLPFPRKPIGTRENAYPGRFWLMEAVPPAHNAPVTIPTKPLPFLILPSFSLFNLCKNAKRLESSLNELCCPLSHSKRLSEPREARALPFPTLSILSRLAQGEEKDLHCW

SEQ ID NO: 969777 - protein, 136 aa, Homo sapiens
MGSAWRGAPLLPVGARGGFSIPHWGAVRRCTTSPRDGWFVMTTIVRFLGRPVVVNHGASPILRWFLSPLSRPREDLGVYSTRSAPFLCFAVWSPCFVPRVFGEGALFCFRRLRSPVVITRGVAPGSAVAWCFFQEV

SEQ ID NO: 969778 - protein, 204 aa, Homo sapiens
MVQRVFFAGRAQTFGPGEGLIQGRPLGHIAFDQRAPSLGRAPPFRTFQIDYDRRCWADQTISWAWYIGGEALPSKQGPSPPSIPRELKVSTGGPQKLWLVLDNGGGNSWPTLIGGTYPGAQPSPDCKGQDPLSGPLAPFLGAQSRVRIRLPGRKGVAEPTIPFFCTLNRLCVRHQPGGLPGSATVFLALPLPPLPTDSATCSTT

SEQ ID NO: 969779 - protein, 69 aa, Homo sapiens
VLSSTAQAQCPRAWQEAPGGPRRRTSSAKSQPSVPTASQKPAHYPSPISALCLSQIRRPQIPPGENPRP

SEQ ID NO: 969780 - protein, 189 aa, Homo sapiens
WCRPGCGGVKNGCGRVWRPLFPFSWPTFGGGVRPPPLCAGGHTQAVVPPTQKRVFVSAKPGEGPPTRGPWLQRTPPGLFAPPPRSLIPEQVVLQALPPFSAGVFESQGGDPLPPPSLLSPPTLFFAPAGPLWAIYLVPTAVVCVVLRHSGRGLGEPLVLHTRKTTILLLVCGMKTATAACQTTLVVLFL

SEQ ID NO: 969781 - protein, 191 aa, Homo sapiens
SQGRLRGTFGGVSFGVCTPPPGPCVAPPHVSSRGGAPPPTEIAGGVLSLLPDAVVVPPVLVLLRTPPSPSRPRVRFFFRQQVWVVKAPPLGWWRGYDCGEKHVSQPLSPRGVAPPVALTLVGGWGSPFLWARGCYSTTHALLRLVVSPGSPPPSSRAVGGSDYFLHPHSLDNCAPAVCFLSYIVFSLYTNT

SEQ ID NO: 969782 - protein, 175 aa, Homo sapiens
APLVPEPGYSFVVCWCSYTCPGPFLCPATLETVVGGSLPSGQDHRPSCCIHEPSCGGTPPRLSASPRSLWGASTAQVSYLLSVCGEGGTHSLFLRAQWCVFSLVAPPPVVVLAVPPYPRTHDRRGVVSCPPSLLTTSRCHSVCLYKRWRGEIAPLFSPLSVLSPKWGCTPPVGMS

SEQ ID NO: 969783 - protein, 122 aa, Homo sapiens
MILPYKSPRAPPTAAVISHVWDSNAFSQNRLLCSSQCGRSFESLLVRYNRDAGIDENTHKHVGDTFLTDRKRRKYFVVNPLGFFFLACGHVFNFFFLNPFFLGTTGPQIFPRVWGPLKKLIG

SEQ ID NO: 969784 - protein, 147 aa, Homo sapiens
RGPFFFAFFLFGCFCPLSPAPLFSVAFLFSASPRVCRLRDFGLGGGLFPFVEWACFPSLCSRVFGFRLPPCFLCASFALDGSFLPGFFFSSPPVFSFPIPSFGLKLASPVVGHCPFSRLLQPCYRASDYLGYSSHTECCKPLLVPDV

SEQ ID NO: 969785 - protein, 212 aa, Homo sapiens
GGSASGGVVGGGCVGGGAWILWPVGVDGVGQAGATLLLWVGEMLVVGLCATAWGVEGLFVVGWLPQYRIVGGGAALCVCGLLLAPSGVCGPLEVGCTSCVCVVHAAGVGWGGAVLWCVGRGSLVSRCWCASWRAGLVLSGGAGWSPVCGLLFRLRGSAVSCLAVEWGGGVLFARCVSRATIVVRVRRAFWRRMPVAAAESSFVSLDCFLLGG

SEQ ID NO: 969786 - protein, 205 aa, Homo sapiens
FRGGADLFRGHGSSALLASPVVPLLMLASGTIVTLLLVGHWGRLSPLVRRRAFPEFRLNCCAHLVRGTPLPPQRVTPTLSPRPRWVYPEFFPQRSFGYSPRSSPPRAPFWGAPPARRPPLARVPYRKGPPCENLVEISCLENAATPIVSQGPNVGPGTTPYFFCPAPGSHQTPGGIKRSWLQARRQRSSPIQDEQARGFTARSPW

SEQ ID NO: 969787 - protein, 122 aa, Homo sapiens
MRACLCPLSVKVPRSLLATRGEPPCCVLDEGRAPPSSGGGFFIYYKGLLGSRPPVLFPPRSLPSVNRPVFCDTTCLGTVFAMVVCGGWCSLIIKGWRVFAALSAEGTPGRSCPFCPVGPVLL

SEQ ID NO: 969788 - protein, 247 aa, Homo sapiens
RGEAPNRVNELLGSRKPCRNNRGPVENRVYKNFTTSYGRTGTPREDLFDRLTTAQPGQAPPGPMDGLTPTGVPDLQPSIHSAGAHSGPYAPEDTHSPKILSSTEPTDRAILGNHQRATPSTFEKSMQNLPTKIPAQKDRWLRPGQNLRRARAEHQAHRGWQVPECPGEEEAAPGELQEQLAQLSVQALDKEENQPVALGTSQLNYLDPRISLAWCKRFRVPVEKIYSQPSGRGSPGLSPLAGEDFEF

SEQ ID NO: 969789 - protein, 149 aa, Homo sapiens
STSVSALIFKGDAPLCRKPQSVVLPAEKEARERCGVTRGVPGGKFPAGGVVFCVWVTPPYRRCSPGPRTTHTRWGGFFPGGATLLWNKSPPSAPGPPPHRGGPPRQGSVNPWSGGIHKKGLQQILAKGGVNWWPQLTHNKTTNCVGANS

SEQ ID NO: 969790 - protein, 101 aa, Homo sapiens
RPPFLEVRPPAVQRTKEGCSTTPTTACTGPHKVGRPGGAQRTEPGARFFNRKNTHSQRSVWFLGNRVYDHPQQRHKLPEGGHKGDVSRVAAYFSPGRRVCW

SEQ ID NO: 969791 - protein, 103 aa, Homo sapiens
MVLALYDPCEKEAPDAIWASRQTRYGRYIHNHRVRSTHLAARCLRPAPLKVLGTWSPLPSKMPKKPKNETQWIHRSDSTKHHLCPYAHERPMEEDGEEKSPQP

SEQ ID NO: 969792 - protein, 232 aa, Homo sapiens
SGQRLPERDLYADMYSAWQALSHQGSASSRSASILYGQSIWHGVSPVDLASRYECSPVVLHSPLTSGMRVAFPDPQETFCFDAFPYLEKVSQITFPVLIIPGPEDEVIDFFARAGALRALPPGRWTPCGWRAPGTTRLSRLYTPVPGAPASRSSSQELPRPARLSAAPNRPDPQPIRRPPDPHPAPAPNHGAACGPPGRPTGDPAPNPRGCGRCTGHRATHSFPFGSPEENT

SEQ ID NO: 969793 - protein, 161 aa, Homo sapiens
LEISLLKSVLSLTKCHVGDFSCRCPIWVPPKIFCVAPWCPTTMWGRSHEFLRKNFLSGEILFRNSRGYVSISIRPPPYHTRGYWRLDLGAHKVVLNWGHPGSCPTCGFHCPPLHSLYGTFGAPHVPPGIFQGWKLLSGALVVGPLLCCRCRKPLEGGPSTF

SEQ ID NO: 969794 - protein, 279 aa, Homo sapiens
GFLFVLVLGPPPPPARLFIPYYPPVGFDALSVELVGGAAPRVGCSVSPGRPLLLCAYCAAVLLRAPSPPSVFTSRGVGVVPLVRRLLVQSRPLVLLWRGQLRSGGAIVVRPPHSIFLSLLWVVSAPPFPRTHASVVFDGPPLCCVGIKMVGAPPSKYTAVRARPLSFSPPPRCASPSLFVGLSSPSSLVRSLLGPPSIYVFFVFSPPHPLAREEGPRSQYPPSLSRPSSQREERRSATYYSLRWGSLLPLITTAPRALSLLPASLFIYYRDKTHPLLFI

SEQ ID NO: 969795 - protein, 323 aa, Homo sapiens
MMSGLFDDSHVRGCRRRDSRACWGGCHRGPPHIGGWGCLVYHSESCCYRVCGCVRVVLYFEWVEGGVLELYDGRLCEWDVFEIGAPLCQWEVGNVLGAARWELWWVRVLSPDGSFPGVDMGARLLVFVGLGIAERFFEGQLVPLVYPVVMLVCVCRCVCEHNLGVSMEGRGLVNGEEMSLSGVYSAALLLGRPWCGALGRRGRHGATFPVWVAPLHLVGRPFRPRLPRLIPREHPPCCRPLLPTAAREVFTREMSPLSLSMTTSRRVSHVCGPPPTLGLILRETLISRVTPPAELFARASTIYFCAQLSLYTYTFLPDSIFRL

SEQ ID NO: 969796 - protein, 174 aa, Homo sapiens
DVQLIKLETKWEPSEATLLNKLNISPFSFGLVIQQVFDQWQHPTTLKCLISQRKLCILASWRVSANSCPVSVCRLATPTVASVPPFYHQRVTKRVLALSVEERSYTLVSTHPVEKECKGLSLAEIHICLCGCCPCGCCHPPQLLLLLLQAPQLKVESQEESEESDEDMGFGLFD

SEQ ID NO: 969797 - protein, 138 aa, Homo sapiens
GGCCVVGGCVFSTLGAGLVLKGRCRWSRAVGGACSLGGALLRRRLCRGARGGGVARGRGLSRGGGGSRRAVCFRGSLLCSRGEFGSGVGMFARCVGGPVRPVRPVLNSLWVWRSRPVAPVGAGAKGVWRMYSSAGVAL

SEQ ID NO: 969798 - protein, 103 aa, Homo sapiens
MFYTLSLPPRTLSREFSSGVSLPSPPLSLRARVYFRRPTHILCATPTQVLPRVSHPLSFVGVHTFLSPHLCSIPPLIYFSLYTHPNTYPLGLETPPRIYWPFC

SEQ ID NO: 969799 - protein, 485 aa, Homo sapiens
PGGVRLPGCSLAHGGEANLSARGLAFCAPLAPLFVEATYLAPTVCVFPNTRRRGLPRVSPGFPRGEIVVRPPNVGSLINKGASSWPSRGVPNFRQYFVWAGRRSGDAPPLYRVKGPFPPPAGYPLTRWRSIFPCVATRGINHTSCVEKRMGTTKTLLVCRRLCHTTFSQQKRGLFVRPPETPPLGFPRAVSLVRKGVGVNSPPRDVRLLCDDGRPSRGPAGLMESALSPPPEEKVCEGRTQGETPPPPGKNIGGKQLRHKEVPTGRYNEKGNISPPSEPPRSQRGSYTMTAVGPQGHNRHSSREKELGPATLSVCLRVSIRHTLFSQREREFPSPLSPHLRVSLGLFSRERVWVIPAECSFLWRERAPLRPRATRDHSHTLSERECGRVPTVDGHPRLSEKICWERPPHRVSPQQSKEERGRLSPTPRHHTRESVSYFCQEPQTQTCGRIGRPDTSFFSVTITTHTLAEKERSGPPATAGSPAAL

SEQ ID NO: 969800 - protein, 299 aa, Homo sapiens
RRGWSAALGCVEHVVGHFVQRSVAALVGASCVSPLFSAVGYIAPPVVARRVCLPPLFYRRHTHFVGGLPTRGVSPRVVAWAHLCVSEAGFLSAGGFFAPALWGVRPPPPLCVKSGGAFCWEAQPFVGSCFKREAGCVIHSRVSRKRLPLCVGRICSPGEGCVTTRREEAPKMGVSPPGAVFARGLEWAPPHHRGGLYLVSAGAHCCEGELPPEGAQSVVCCVGPPTRFCVDVFVRHPPVRKVLFWGKGAGRRLYIPEGYVLFEPPLCFCVESWAYKIWGPLTHKRGPHSVYRPTGELEI

SEQ ID NO: 969801 - protein, 200 aa, Homo sapiens
QRLMLTRGSTEKLNGSELGGCYDVKKALFWGTIPRLRIQMSTTQECNCKERKLVFYEALKDDPGSQGEFVTTVPASVALLLIQARNYPVPCLLPKPSVTPSGTSGLETPEGEFVSLGVISDGHSYGVPDDLLYSFPVCNPDKTWKFVEGLPINDFSREKMDLTAKGLTEEKESAFGFLSSARLDHDVTKCFQAEESKCRL

SEQ ID NO: 969802 - protein, 105 aa, Homo sapiens
MSLCMLVPPPASSSLRREMLPLIKRLLYVGGFSRPVCTAEVYYSDIVLFSPHTRGEDTPRLIWAPPLLIGPPHLFNREGHTLHLMWSPPRCCGVVPAPKSARALA

SEQ ID NO: 969803 - protein, 193 aa, Homo sapiens
MIAASGVGPLRVVTLLLLLYYIYFCYVVIVVGVLLFCVVVLIHAIMCRAVSACSAVGCTNGWYCSFCLASGCAVFSPRVVVLSLFSTVCSYPRGVTSLRMAPHASFCGDLLSSGGHNVGLLLILTKVVGSPLRVVLRSRAEPLLVGGPPTRLCSSPPLVSYHGWGCFTFATNGVVFSPLVSPSPRRLIFAPRC

SEQ ID NO: 969804 - protein, 315 aa, Homo sapiens
MFCGGRPTFVPEPPLRSVFGDPPPHFVGENSLGNPALLLGGNYFSQKGYAPPFGAPLLERKRGKKPLGRLSEHTAGANNSVSLERGFTSREIREERSGALLKRWGAKVSRRRPHSRTRANTLCCLCELLRTRFVWAPTAMAVARSYRNACYTTRAHTSVEERAALIFVVAHKWHSALVCFPRVAALCSVCRSTSCLGVEIYTACALPTYRPVEKPRVCAEHFPPHTLHAALYARLSLLGERYREEVSSCFSLSRERDIPLYTLSLPSGRISRWRYCRRDGLSSASSPPLGNHVKVFMKTAAPRANPRAPRLGWVT

SEQ ID NO: 969805 - protein, 419 aa, Homo sapiens
VCSTTDSRALQSFRVFPRRVVLLSQLVLCWVLTLVDKRGGGRSRGRSLLVPPVGSWGGHPAGLFFPALGVFFADQCGNTSWRTTKRGFYHVAPVLVTGGPTWEVHSSGSPAGGLSSPGGGLTARRAEIINKREDGGDVPAASPAHEDVGGATRRCVVHKANRAWKRHFPKVPPLGGGEEFCESRCRVFVPAIAAPILEGEIASGRNSSVWERCRVSPSGGGAFLSLQTRDWRAVCCGKRIVNVPTVASEKTTDTPAGRAAHGRCTPRGVHQAHFVVCANFAVSLHQMGPTRCALLCVVFIDWPPHKGEVVGALRAHPLGAPSISLGHTACFALSVPPRCAHREAVSCGGGHTTEVSRNIAPHAHLSPLAQGVHTGPLSGVSCACVSAPLDPRATPTGRTPGTSRLLRTPVCAYMRSWLT

SEQ ID NO: 969806 - protein, 77 aa, Homo sapiens
LASFREVLQELSCGTVLGTADGPPMEQLGFSAQVIILDPPAHISARDAPVYWIAHTGLTLHAQFAELKGKSCVRPFW

SEQ ID NO: 969807 - protein, 118 aa, Homo sapiens
MIFMLTPPVCVGERYVLLLVRPARCSFCSLIVLPLLCCAAPLARASPFRQSPCYLRFSPHARGLPTGVSSLSPVSLVSQISQLCAPPQSVFCVHTFLWVSLPRCFCGVAYIFLFAHSL

SEQ ID NO: 969808 - protein, 138 aa, Homo sapiens
PSLVPEYSLFCGALFSSCCAHICHSFSQNSVLLPCLSPAGFSLAPPCSSSSLFRRQHGFVAAGFLALPRGSLALFKRTAPWSYTARVSHTQRGPPPERPRSFPSLRGPSVIGGTTPAHWLKRPSPLGVKTQGVTTFLV

SEQ ID NO: 969809 - protein, 119 aa, Homo sapiens
MALVQRSVHYEHLSNHRAPAGSESCRASPNTAAVDAFPSNETPKLGLLKVDDVPVKEDLFSQSMTQRGARHSRGTHDVPIRQSDLARRHQILGRSVPVLPCAGYHSRVTLEFRIPGSPL

SEQ ID NO: 969810 - protein, 281 aa, Homo sapiens
FRGLCPGAPDLVGGSALVRLEGLVSRPPWGIFGGGHADLSIREVPVSVDLVYPNGHVLGVPPPWFVCPGVPQEFARGPPPPALVLSFCVPSRVSIHAVYPSPLYMEYPRDELFSLFGAPIFKEGASEEEIPDCFQMVMQFWAQRLLRHGNPPGEGLPPCAQSTTRRGRVSADWAPHPGGSRNRLGPRSSFLDTPLCPEGRGEPPPSVHLELVDAESPRPLGSLEEPKNWGFFAKGFRFKRPFYPGWGIFFWWGPRDRGPEGPNFVIVTPTLGIKDFLQAPI

SEQ ID NO: 969811 - protein, 227 aa, Homo sapiens
WRDLSLLPSLLRIPGSLISSWGPLSKDELFKIISCPGISTPAGPAPPRFQRHLLLSGTTMSPSGLGWLSAPRRWPPPFRGAHHPGPALPICPPAPEATGGTRSASPPLSPCQVTRPLRLCAGTPHSCTHGALALVSAPCALESCSLMAGIEWLLHPQPGAALPTLGHFAQAPFDALFIDLHSYLSPRAFWKETVFPQSPYQEFPDPLVQTPPRVSLQRTPAPTVATT

SEQ ID NO: 969812 - protein, 211 aa, Homo sapiens
MGGHGFVCRLALVRCDRRACVVARPAPCFVFLLKRRRTRVSVCCLLGAPLVVFCGVVCVTRDGGGGFKSSLLLVSLCLLALVQRIVRSPFGVVGQARSSRSRLVAAARDTCSVYTARVYSASVVCVRPLLIGCLSLCWMLFWSRASRSVDTSDSYYPPTCLDHSSVRKTIFFCVMMRPPLCCSLYYRNTILAVALCYAGGFTNSVFLPTTL

SEQ ID NO: 969813 - protein, 39 aa, Homo sapiens
MTYTITLPRAPPPPPSGGGPPPPPPPFFLIIFPPGVSPP

SEQ ID NO: 969814 - protein, 179 aa, Homo sapiens
PRGYEVFWACALTMRPARCKSSSVAWQGTKKDPQDGQLSIREAMEAEFEGCKLRLQLKPQARAEIRARMGIGLGSENARGPINWDEADIGPWAQARIPAGARSYKPKPQRVASAQHWCPVPSSPYHVATCHVPAPRGGFTLLVPRLSRHSHTLGSSLALVETGATHHVARSGACGFSYQ

SEQ ID NO: 969815 - protein, 389 aa, Homo sapiens
VIVAGVGVLLLAAGVRVRFFSALLRFCFSFLSLFALTRGVVRSVSCSASSFVLAVHVSARRGGGGVPARLFFAPRSGAVVCGGPPLSCSVFFWLVVVRFLCASRRVFVFLFVLLSGRCRCLVPPLVSVAPAVWSLVWSRPAVRCLLSSVCFLLLVWFGPAAGLALVSVVVSSVLSSLFALWLVSASVFLCLSRSRCLFSSFFLLSRSLSALSFVCLSLYLRPPRLGGVGDLSRGGFSLPLPPFVRVYVLCLAPPRSQLFLPAPLFFLFAHRPGRGGGGRSLLSRACSPLALVFASSSGLATHLSSRLYSNITRLSTTLLLFLLLSRVVPPPLGAFSHTPPLSPARCAFHSPPSLSPPPPPRGGVISRAPLFLFNSFGAPPPFFPPSLFF

SEQ ID NO: 969816 - protein, 68 aa, Homo sapiens
SEIKHLYRQLDMILDGREDMSLSLTEEISRGGILGHMGTITPPELDTVVKTSPEILRPVNEMENSPWE

SEQ ID NO: 969817 - protein, 174 aa, Homo sapiens
PPVNRAVQLPHRVFVGSAHALLWSPSCGRTHKGNIIMHDPFATAALFCYNFGHYLGTLADALEGRTGGPAAPYLPMSTGSGVTRPGPSCGPGFGENARVLDWICRPVRGGGPCPRDHPLGWCPRKEPLDLSGLRAIDTPQLFSLPQDFWEPGGSDLRSYLNRAGQPGSAPRGVG

SEQ ID NO: 969818 - protein, 245 aa, Homo sapiens
ESPQSSRSLVAQRGAPSHNKEGCGGHAAHTDKTCAGRHHTGGGGTLNNRGAHIAGKHTRRVVNTGGTAHVCHTPREDDCSRPRCLSTKERSFPFSVCQPGVDTHLSHRGGAPPCCPHIQRVSFGAHRMGPLTHSFPTDQRGRRGTTPVPTSCGAWFPRMSLAPAPLPKPLLPRGYAPQGSHRGHLPPTGGRQPHPWGRQLGLPQKRWEDFLAVLVRAHLRRAIETPPDPQKRFSQATPSHQSTFA

SEQ ID NO: 969819 - protein, 74 aa, Homo sapiens
SFWVSTIILVGIHLTYHHLSPNETLLYYQGSFLLLLFSSPAERFIVFFHPKLLFFGHRFFPPILIHCALLLSPP

SEQ ID NO: 969820 - protein, 90 aa, Homo sapiens
HGVCALHDIGVRQPAWFLLAPPIPNGHPCEDPERAMWHPRRVGPGRPAFSQGMLPRSPLSARGLPPPGASVFAAPKVWFPASPHTPVFGR

SEQ ID NO: 969821 - protein, 155 aa, Homo sapiens
GSIINCVLIRDLYEWLHEGSTVSYLLTQWNSPAREEAGMTTSQTSKTLWSFNLCKANQYLTNPQVLYSQPALKFRLGRPRSRTPPPSQYMLRLHPVQANYYTPFDPDNLTHGTSYPRDNSANPILESHINHRVYDLDVGSGHPDGANPLLKVRLF

SEQ ID NO: 969822 - protein, 122 aa, Homo sapiens
MGAAPRSCLSRACAGCFLSHLWGVGCESRRAGTTRYEMRLRECNELSLWSLPHNDRRGGDFFLRERRAPSAADPDGCLHHTWWGFCPTVTHSTTQRSVGGGVYPTAAPHLHLCGFRTHHGGG

SEQ ID NO: 969823 - protein, 166 aa, Homo sapiens
APPMGTTWAFSLLQGDYSLGPLLRPSFCPRVSPLVLESPPPPSPLAKPRFAWAVKGRGWSPRFSGQKTWADARPQFFWNLGDAPPLVDMGPGPAPTGVLEELSHEQIHPLGVAFARSVNNEEHDHASRAGGVTSKAPWTAREGCLESWARVTPQSVPAKAHERLNG

SEQ ID NO: 969824 - protein, 205 aa, Homo sapiens
FLQSSCRSSFLLVFAFSGRRLLLPSLIVYAVFCFGGASCVGLFLPSPSGFSSCVPPSAVACPLLLPFPPFWDFSVRVFLPRGKGAAFHTGIPLFEHAPRGPLAAVSHPWAPSPSWAVKALWMSSPILVFPFRGDLSPGGDIHSGWVFCGIFEVLYSSWGYPSLRTQTFEEVIFVGNQAPESVFAQYWRLPKGPGFPGSLSRIKGP

SEQ ID NO: 969825 - protein, 187 aa, Homo sapiens
PPARCGALDRAWFWCSLLFVGCTTYSAVWCFAVLCFDACSSVSSLSWVFVLFVYFLRGGATSFFFFLLGARSGCFVLSVLCLSVFLWLLVLLPAVLVGVALFEPAGVVSVCSVFFLRRGFFVFVSVSLVILLCVAFWVVGPLSPLTLLCFFVLWLFFFLWLWCAPLFLARCWVCFLSLVVVFRLICY

SEQ ID NO: 969826 - protein, 133 aa, Homo sapiens
GEYQGHSPVWVLNAPRRCPPHTLGPIILAQLFPSVPPCRQRRTGEHQDSGQTPHHCPLATGDQAPSAPGAGYRPQSLHPQGPLAHLSSLAPLCPYESCSLMAGIDDCYTLTPAGCTCPPSGTTSPRPPLDALF

SEQ ID NO: 969827 - protein, 171 aa, Homo sapiens
PLLPGGCNQGPFCAASLLWRRTTPCWCAHSVNRGGVNPLWGVFLTPAGGIYFSPRGSRLVDQYGGLFFGCTTCKTTWLCGAQQNGGVVAPCARSILRRGYFSLAPRRRVCLSAPPQSVGFPAPIKPQLTGLVCAFDHPLSSVLSVGCVSFIFVGRAATRGTRLCRHFSPPF

SEQ ID NO: 969828 - protein, 233 aa, Homo sapiens
PLKSLCRHGPPPARCYRYCKDNRTPSLAFFRGVPDPPIRTFDLGGKRAKVDEFPLCGHMVSDDMSTVLLKPLEAARICAHKYMVKSCGQDGFHIRVRLHPFHVIRINQMLSCAGADPAPNRHARCLWKAPGHCGQGFTIGPVIMSIRTQLPDQEHVIEALRRAQFKFLAAQRDPNLQEVGLHTSSMLMNLKTLVAEKRLIPDGCGVKYIPHRGPLDTMAGPALMRASHVLPPS

SEQ ID NO: 969829 - protein, 121 aa, Homo sapiens
MIGKDFIEGETTLSSGPPLSPRGGFLPTGAAASCLVEQEVGEFGAPRCPHDESLGAPHCEPVYTLFVITACVVCFAASFSTTVLTHCAGKLSLLSLCSFCAHTDTLCVRHTLVSVCVTTLC

SEQ ID NO: 969830 - protein, 117 aa, Homo sapiens
LGSIFGLGPFSVWEAPTMCAPGVSPALPAGEKSQRVSFLVVHSTPSYRVVFAGVFSNHAFHICGESVWYTAVEGHVPKVFPAEFCARVDDGTLFSRTRRLLYGGAPLVRRPVGRSVV

SEQ ID NO: 969831 - protein, 107 aa, Homo sapiens
PFVRRCSWGGHSRCGATYKRGGDQLHRGFFIYPRAGYNFFSREKLLSDCWPLFGAAPARCRRCLPRKSDRLVLVRPLVVFSREDFCATNGRSRPLLGAEEFFSTPAM

SEQ ID NO: 969832 - protein, 104 aa, Homo sapiens
MRRTARGACQERGIFWATPPSQGRPFRRPSLWGSGLSPPLFLWDGPSSRLLLEFFLLWPPPARIWCETRGSTRRIIEALALYGEKTPVHTPTWAQRCLGVEPLS

SEQ ID NO: 969833 - protein, 182 aa, Homo sapiens
SLRWLAAASCFSPLWILLLLDLRLLLVVVLSVVGVSSVVRPFWPPLCVCALPCLVRALCPVVFLSWVGLSSWAPGSLVGYFFFASPFVAALLPPALSPFVVRPRRIPRSVASMWRPSTLPQQCRFIDSQSMLLLNCASPPLLRCFGPALESSPWGVSCERHYLDRPLGGFSHQWRLSSFPPP

SEQ ID NO: 969834 - protein, 153 aa, Homo sapiens
GHVGCPPPGGARYPLWGGRRGAPPGGAPCPPRRVVPPADVCLIILGGVSSAPRRRSAPRGGGGDTHRGVWGAPAVLVELGVCSWGPPPGLLPPPPACLFSQRVPLCGRRTAGGTLPGAPPVLLWWRSHHPPPRGRAGARRVVKRAPCPRRWGV

SEQ ID NO: 969835 - protein, 333 aa, Homo sapiens
MSLCSPFFLCAPPLLWLPPVFLGDTNMGPPQRCASPHAFSPRAFVLIWPTPPSARSPIPGPPWYTPPALGNCLLNPGIGLVFPRGPPWRFRTSFVPIRSPACAVPVSGAPCRHVKSPVSRPEHWSRPEETSLFPALGIPPEVSRGPLGILSDVHADPDWRTKWEPAEPLLLTLLHISPFSFGLVTPPGVRPWPHFTTLKCLISPRELCILASWRVSPMLPVSVCRLANPTCCTPYPPSITPPGTNEVLALSVETGLSPSPLLKRSRPFWLSPSAFVAAAPVAAAPPRCSCCCCTPPLRLSPGRVGGRSDRRIYGNLVSLTNPPKATHLARFIC

SEQ ID NO: 969836 - protein, 182 aa, Homo sapiens
MWDSPFKRPQRLIRLTRCQEIVFHNAHVFKKVEPIFPRESEPPLPSTGKLRISPRFSVLKRVITTGAFVPRVDHPPSGAKAACWLLTPSPQKIWEISWPLHALVFSLPPATVAGPTSALPMPPMSGPPTARLFFWGPPTLCALSRKLPLNCLRSALYTPLVASHENGELMFWREKGVFYKER

SEQ ID NO: 969837 - protein, 106 aa, Homo sapiens
SSTVPVSALARLMNSPEYPATWEIGFGASTALPLIGMTSPRDLILNLGLFSREFGWPGDLSDLDLMAPQPGVYPVDQWDPVLDPDLPKNRLPSVTPPRCALMAAEV

SEQ ID NO: 969838 - protein, 182 aa, Homo sapiens
ASRNWDKPSIRNCPLKLVSDIRYWIVELVADFDPVLKLTVPPGILFNTPDKSLSVHPLVPVALVTFVAYRLRRVPCWRDPSLVALVELSCVPTPRPSEFCCHAVFYAAPGLTVFLGIFFYEGLVPRDHACVLCLRGLVTGWKVPARYGAPFPLLSLMSFGPEPPLGCLPCFEVGEVCTLRLV

SEQ ID NO: 969839 - protein, 93 aa, Homo sapiens
MGSLGDHKNHATTYVGDKFEECLKKRSELFTLILPDLHVFLVFDHRVYPLVNVTVDPWGMDWVNGYYHGTLCIYLCHFSVNLVSIPKLKVYLI

SEQ ID NO: 969840 - protein, 75 aa, Homo sapiens
DQLGPQPHLTTGLDPLTVRPPVPAVWVLLTAGSPLEPPLSVVNPTPRSTPLAWVPCPAPAVALVPARRARDNPES

SEQ ID NO: 969841 - protein, 222 aa, Homo sapiens
MFSCVSPGVAFSGLPFRVLHLGRWRILWTRFSLPMYSAPFQGAQRSTLAPFVSPPFHLGGPRWSVYPPPLRFFSHSPSLPPPVWVSTPWPRFVPLTNCGDPVGGHSRAPHFQGPVTGPRPVRSCWDWPPPPGETRGPSYWPPRGLLPGSSNPRALFSWALSPMAFLGPRVTPLDGCIPGSVHLGPCALSRWFAPPGPTGGPHWVGNLEPRRFLCVTLVPNIE

SEQ ID NO: 969842 - protein, 195 aa, Homo sapiens
MKIFRPMRSCGITYRRKFASNVENVSGRTYANPADAFKQQEEAVLELEKRIEESSETCEKKSDIVLLLSPKTRPLEELNIQSSPSQLEMPLKPKFSSHQKEIYLDAKKSPAKLGKEPPPVVNYEEDAPISYIYGKKGEADPNLNLFVTSIAGIIRSPKSALGSSALSDMISISEKPLAEPDWYPGAIPQNRSSRT

SEQ ID NO: 969843 - protein, 142 aa, Homo sapiens
ILVACGVACCVGRLCLYDIASVVLVPPLFCVVRLQRLMSCVRCGEGTGLGCHGLVSSPLVFGNDMLRSVLLCVRCWFMFGHGVPPCSPRCGWVWSILCAVTMIILPTSLRGLQTTFFPRLSPPPWSVLGGHKQGAGTSFFFR

SEQ ID NO: 969844 - protein, 137 aa, Homo sapiens
MSPAVARCIKFFVGWGRDRSRERLRCSLHPLRGAPDTHLCYEVSPPTYPCRRSFIYSSLGGPPHYTFRTPPGPSHMLVCLREASDIHAAPSLLFFLVESAPITFPHHIERVVSTPPPALVVTGALPPVGGPTSPSVL

SEQ ID NO: 969845 - protein, 262 aa, Homo sapiens
MSTAWCAALPFVDVIFLVWSPLPCVGGDSSSPMDPRFCDTDLFFSVVSAHTRGVYSRFLAAPPPSRGIPPVEKVLILPAILLPPGGFPKCEPLVHMDPGVNPRFPWDQIPEKRTGSSPYCQRPFDPRNPLNVWSTKLEKSTTEDENQRDTGVIQNSLESYAFDLEAPVEDEKLHRPDVTDEVPPQISGPRCNEIIHWLDKNPTAEKDKNLDLPRKSLEKVCHPHLSPSCTRVQEAIPEESLGDFPGGGASLPLGGASPRPPH

SEQ ID NO: 969846 - protein, 141 aa, Homo sapiens
MSFCGRTPPSGHRGPLLAPHSCPRFSLGTTGLSVFHRHPPARCAHIAYPEAVVPSDDPPRFVAPGRPQGSRGDLWYPAKYEFPLCPARNPPAESLIEPPAGPPPPRVSSTPHAPPHESAHEQMGIPRATFVICPPYLGFIY

SEQ ID NO: 969847 - protein, 104 aa, Homo sapiens
MIDATHGLCPQKDRVLVPRVPGISLGDIFVYDDHALSSCPQHPLLPVWAKDTHAPPFPGRAAPTKMGAPPTGGKSVVVAPPELFVKEEELWVNENEVEKRPPRP

SEQ ID NO: 969848 - protein, 71 aa, Homo sapiens
LVRTREFFRDYTVRCLSMGPCESNCYGRVFPPPAAEGLERVFIFGPPPAPPPIVQRRAIRRRRRVVPPPPP

SEQ ID NO: 969849 - protein, 162 aa, Homo sapiens
VFPPTTLFDPPHRNHWRPSASWLNPPAGGMFLQTSLHLRSWGPTTSLMLVRRSCGLFLCSRQTHANDTRCRWVQDHLFVCTTTHRRGGVIPGGASTFVFQFAAPARLINSSSYEFVRPSRATLLCLVSALFSTRGSTSIDSLFFDEEFAILFVVYYTLNMIF

SEQ ID NO: 969850 - protein, 198 aa, Homo sapiens
RDEGGDNPTQCPESVTPIFVWPIPHQRVVGRTKWGAAFTTQVGFVSQKVLSAFSRPLLIDPLWARSIIWSHRGGSFALSPPTWYDLLRGPRWVGARTRFLLQHRPAVFLCRRRGRFIAPPRLFLRWAAELYSSRNIRGGATVLQSNKSPSSCFLSPLAHPAGGGVDTFCAREDTLLYGGVFYPQEPHTFVVDRPHIIL

SEQ ID NO: 969851 - protein, 152 aa, Homo sapiens
VFVGVCCAFLQAVVRAFTSLGGFRASAPSPPVEGVCLPQLPPAGVGGPNFRALRFRWGPPLGRPMGQILPPPDAKYFVWIRWLHPASLAPPARWWISTQGFTSRAPPSATPPMLLYGPQQMRSTLLHWVNLRIRNFAPGQCTHPHASPPELG

SEQ ID NO: 969852 - protein, 120 aa, Homo sapiens
MSNTPNNVCLFFCVKNVYIPTGDIYILEVLVEVVRYFVLTRTELFPTLKHLYLCPRRSYIIMWVPTTCVIDSFSHTFLRRIPPPRAIVICKIVPQRETLNEHSYQRVYSVFMKSAPLVSI

SEQ ID NO: 969853 - protein, 329 aa, Homo sapiens
CRVSCCCDVVAVVSLVLLFVVGWSPLLVVGVRDRLLVEFGCCGWLFRGPMMASAVMVQVSYVRMGRVTDGVFSRAGLWCPSLVCSRLGAFFSRAKGLFSSAPVWSGPPVTALCVCARGVWGDTVSCLRAPLSSLGLSPILIPPTPLGGSCFAPDRGGVSHAPPLCLVVRSPLVCVCVCWPSWWPRSIDTSWWGLVSPHRSPFGGDHSSVVVVTQRDESSHWMGWVRSHAWGGEHPFHEGTILCGEFLQEAYSPRRSFSPLGALGGRSFLDRLLNSFVHCVKTNFARPQGLAPGVMCLKSLTVLVPFGPPRGPQRGFKTLLFPGPLDTLR

SEQ ID NO: 969854 - protein, 69 aa, Homo sapiens
TRERAESRTAGVATAVSVSLCSLVLYSLQLIRYIVRPVISVVSSLCLHSVVSTLGVCGSRNYHVCSPYH

SEQ ID NO: 969855 - protein, 169 aa, Homo sapiens
RTGPLLQFLVDPMAGRPSDLLLSATTAHSLWDLGPRNTSSLLAVDFPCSWTPHPRDSKRFLPARGGDTPLWLGLSVVFWTPPLETPFTFYCFVVTRALPPVFLKTQAPFPPLFPGVRLEPEPGLPPVAPKDCLGEKPWPELLPGTGVAPGTSASQFWGKDPWIRLPGLP

SEQ ID NO: 969856 - protein, 147 aa, Homo sapiens
PFFVVVPPPWATSSICVGGPPVFSSTLDFPPFRTKLGKNPLFLPGYFLRGISSSCGSSLSAPFITTVLLCPFSTSYYLAPLPILFAPPLFGTSPVPPPFVFCASRITGGGIPQYPPLWGVAPPPLFSLFNILPLFPPPLFISPHSSI

SEQ ID NO: 969857 - protein, 105 aa, Homo sapiens
MDPSRALAQCGIVPHCPAFPFDGFRQYLGPTCAPPTPVPQYCPHDGRPSVHHGGNATNTPRPTPQQHHRWRQKGPFDYRGLKSPNVSYASTRVFCFPFRHREFFF

SEQ ID NO: 969858 - protein, 117 aa, Homo sapiens
MSLPVKILGKVAWLFEFPGLVLWTATRTPLVEYSWSRCPGETLVPTLYSRNRHGPRGSPPTLAAGTRATISLLTPSGMVKFSPRTERHSLEFFQPVSRTHHVFLYEKWENFLTRNSI

SEQ ID NO: 969859 - protein, 113 aa, Homo sapiens
TESWGDSVCGSSFCVITCCAVFFPWVTWALFPGCPLSLCAACKRCAASGFHGSPPCLTKWDPCDTRVRSHFLIKVRKAYFLKGCHPFEIPSSKNFFPWTSVNSQLGILLQHFY

SEQ ID NO: 969860 - protein, 104 aa, Homo sapiens
MCLVYLLLGGAAMLSWFVLAPPVSGDLFMCVGTPVGGSTIVVCWERRGIFGHLQSVWCPPGLPPGVLKSSCKTLGSPVKPTRVTNCLRNVFITPPAICDTPRYS

SEQ ID NO: 969861 - protein, 51 aa, Homo sapiens
MSLLPAGATQHQSYSSLESRVLKPQILDVHVHSLPVPYLLFLALYLKIFDP

SEQ ID NO: 969862 - protein, 106 aa, Homo sapiens
VSPLPLTTYLHGAGYWLNEYADGFDKELVNGDKGCRPIPLYTYCTATLAQLHPNWSAPLAKSTLNLPFTIIIFTNLILLAILGILSPLSQPTFHNFSKPLPARPTH

SEQ ID NO: 969863 - protein, 339 aa, Homo sapiens
MRRWSFFGGSVCCVAGCGLVALLLVGVHAVFSLPSMGLRVWGACLSWGAEGSVTDGAVWRTCGTARPDMLRFCPRVLAYPCQTLPRSGTTRCFLTLCFCPSAQNPLRGGVNFTAPFGGTLYVSAALGGSIEVPPQAPPRLVWGPTSALHAPLHWAQRPVYTHFPMTCPLHRFSQPLSPSSASSVLFSYTTLGFGGAILAPNPAFFFARLNLPEKRPQFPRTRESSSREDSSVSLTSRVSEGPGGSPTPAHPGCLTRRIGRRRPREIPPRDQKGQARPERGRTTLSPARPPEVGGHDGRPMMPEGPADGFRLLGKTPALLTREGPPCLLLLLAFCLLPLS

SEQ ID NO: 969864 - protein, 126 aa, Homo sapiens
RCVSGLGGAVNMVASSVVAGLSFPGRCPLAFVAVARVAKTRGGPCRLFSEFLVPPPVSLPFGPEVILPPGPILGCGASVSSFFALSGLIPPWCSHSVSPGFLFRVLFPRSTRNGENAVRSRPGNLP

SEQ ID NO: 969865 - protein, 162 aa, Homo sapiens
SRGSPLRIVPARGERGSPPPCPRSGWATGSGGTTGHRGAIPNARPVEWPPLPQCFFGPSLAQTPWFYGPRVLTQRYYRTCPTWEDTLWGRARDFPRAGSPGFLTCAVCSISIAVGIPRIGDPLVSPGNSREVSLQGPMGLLLGCHPPLPGGPPSGEAPGFGR

SEQ ID NO: 969866 - protein, 126 aa, Homo sapiens
PSYSSGGNGGRRLCSGRVVRLHRAPWLFPYRLFSSPAANRFGLPEGLTFSVGPILNSPHQEVPRKPRGWAINPVVPFRLAPPKLGAASTLRAPQCPFGWELCFPRGVPQDASRSAMCPRNYWPPGA

SEQ ID NO: 969867 - protein, 148 aa, Homo sapiens
MGFPPGHKAAPNGWFVLRESAVLSRSAISPPPSWGLAFWRWCLGEIYESTQRATFRPVGVFLSKRPGVTPTEKALSCESLWHTELSRPQVSVPRRKRSTEKGRIYMRDILFLPIISSPRPDTSYNPRWCERDRFSRELGLFSHIAPLL

SEQ ID NO: 969868 - protein, 136 aa, Homo sapiens
TKCVLVCRSSSQRCTRLCLDWSAARLFMGLAPVVKANEAGVGRPPPEVRPWAVPTIFGCDGCSTRTSVSFAVGKNIYGPRLPCYSGAKLYIDGALLDTLQVWAQNCSPRGDRCNPPFLARIPPAYHIWWTHNSPPI

SEQ ID NO: 969869 - protein, 149 aa, Homo sapiens
SLVCLRRPADVVGAPRPVLCAAPALVVVRATRPWCLSVPSSTPPSRVGTFSLPCARRAGVLFYVCVCGSHPREEVGSTLRSLLCDFVFVARSCGRRTLSSRLFLWMIATLSHTLRVALHENNSLSSHRGTFPPQLFVSPSTAKSRDVVV

SEQ ID NO: 969870 - protein, 229 aa, Homo sapiens
GCVSFVFFWFSGLTVWLFARMFGLLGVCVVFCLLRLFVFLFFVLLLFCFGVCWCLLFVVFRVFCLFFLFSGPAVSCRSSVFFLFLECGYAFHVSVGVVSVVLSSRVVSGCASGEGVSVSSFYFEFGFVWVVLVSGLGRWRVVCYEKKKSGARTAPVIIKKTAPRRLLFFFCLPSFVAVGGGGQSPPPPLCVVAPLSFVYYPRGGGVGYSPSGAGVVFIDCGFTAWGAWG

SEQ ID NO: 969871 - protein, 352 aa, Homo sapiens
MSSLILSCCLPPPAALLVRGMFSPKESRPRAGFSCFSLSGAAPLLSFLPAEVGMRWAFFCRRDGICSPPAALRLVCGVGIPPCCTRWPHCGPPHHMAGFNYEGGSACVCRPTPPGGAPNTWGAPPLLVLSFVGVLFFEMGSPPRRESGGPPPPPATHPRGGSAQLTSSTPGGRRTSLFSPPSSLSPPSRVAAHESFSSLCEGAHTEYLRATVARPPLSLSSSLSHRVRTRALSAARSLCVLCVCAPLSLLSPPHPRERSLGLFCFLPTPSAVRSHREISSLLPLFVRGLGILRCVRLVTPQLSPPRGGRPLPPPLGAPLSLHSSAPTLSESAPLFCRASPASLSLCAPASLS

SEQ ID NO: 969872 - protein, 242 aa, Homo sapiens
MGCPESLPPPPVSLQGLLAPPCFAQPLRKGIHGQLGYLWRTHDHIHASLPPRRLVDAPLRGSFGLMAAGALQNIIPASYWRLPRLWARVIPGLYGELTGIAFRVPPAHVSSGGPDLPSRNLPYEDLQKVVNTGLARAPSQGLLGTTEPPVVSSDFTSDTHLPPPFDAGAGTLPSTTTFVKLISWYDQNIGYSKHRVVDLNGPPLGLPGVRPLEPPRPRQSTQRKRRDPHCWGVPATLSPPPP

SEQ ID NO: 969873 - protein, 160 aa, Homo sapiens
PFLPANQPLPCDIWTLSCGSNCKLGSCYTTGPDPPHCRRCPALSSPTQTAQTTTSILPTRPALPPAIATPLASHPTRLLLLVIWNSPSEVFLAGHPSLDPVIPTRWPPPRDLSPSARPISSPPPRNLLCSCLGPGVPGTPNRVSHFSLVDPLVLPLNAVF

SEQ ID NO: 969874 - protein, 147 aa, Homo sapiens
CSPPCSRVKKKLGRRLGPPPNFLSKKFLWWEMPAPTHRVRVDRSFSLGAQSRHYCGCVLERELFFSQKISTPTPLWWCPSLALCSWEYIGERHRTHSVARWGGVSIFTQRNRGSTQKKAWLGERRRAHRVHHHSACPHESGAHRERR

SEQ ID NO: 969875 - protein, 209 aa, Homo sapiens
TGCVNVLRCLLGCRRRGCPYSNAGCSSGSWFFMPRCGCIMFFRPRAPVVPSAPLFGAPIVDDGVSHEDPSVWSPGPRNFPRDFSVGPPRAPPPPFRKSARHKRGATRKKSAVNPTFLKEKRIGKKMGTHTRLRVPIIREILGKTPSVHPTDPQRGPQQCATHDGFLTRVPCCFLKDGSCVNLCQTCECKIRTFYEKFPSLSYLREWFQG

SEQ ID NO: 969876 - protein, 324 aa, Homo sapiens
RESAVSCVGGAAQTDRRVFPEHHGLVGGVRRKRGSHLPPGVYRVEGEYIMRNQTLGSGRPPLRNMNEYHVLVAVFPDGENSLGVGPLLPPPSKTRGGGLERTRGIGCPSHATGGGANSPPDRRCLISKAGPRCSHGRVVSLGLRGAACGYLFLRHTGERRVLFTRRVVCVCGDDAAERCGRVCSLVAQTPPVGVADSSLVMWLFYHGRVFWPTGGATSFPLPRFSFSAPGGGLVSFSQQDALGGYPSSLSGDVFFSVLRGRGELFPPTNDIYSDGGVRLIHYMCARSPQKDDLLEECGRPPPPLEKKEEENCSPTLDEVCEAAT

SEQ ID NO: 969877 - protein, 143 aa, Homo sapiens
SEIPTMRFWEAYRDIYLSPDRTGSSFGKNSERRERMGPPRRLLPAGFGEGETLVPTHSYQRNGESQRKSSRPTAGRNLTHAPLQESGRAHPIHAETHEEENEGPPATGPPPGPGHRTGPDRTAGPPQPDPIPLGPESGREEVG

SEQ ID NO: 969878 - protein, 150 aa, Homo sapiens
MRVISAPPGVSRSAVLRNHKKGAQAGGKRDNQVRPLEAPTDIDPWPRKPAAPGSRGHRPSPYPGREPPKGTKGPRDPTGPVNGRRTFPVGNCLTAPDPYVAPPPRIEDSRNIKEGKGSSNLSGKTQDPRQKVKIGPLNHEDLPPPPRKLA

SEQ ID NO: 969879 - protein, 106 aa, Homo sapiens
YLTNPQGPKLPNLPFKISGWGDLGPRTPPPTQYMLRLPPVQADYYTPIDPNNLTHRDQYPRDNQRANPILESQIHTNRVYDPPMWIQDIPDGATPAIKGSRLFHTD

SEQ ID NO: 969880 - protein, 139 aa, Homo sapiens
MCARLRGGATCFWVIVEGCLCLSLPVARDRYRLGVHVGLYCRDWFMQDRRDELVGLHGGAVRGVWSMVVWYPPVTELCCLTPTLLLRDVVGSEKNKNREIDASVHNVLLAHTESIQNVKDLLSTRDQPLNNGSQPKSNR

SEQ ID NO: 969881 - protein, 152 aa, Homo sapiens
MSHHSPRAPSVGATQIFLPRAAHQRALFVVARERDSSADSVYLLRAPREFVSLAPTIDRSAWLVGSPPLSLFVRGARYIDEREEPPRSREGYFSLSHRHRRERRRKTEREKHNHIHSSVRVFPPPVIATKKIIIEEKDTSPHYMRKHFNNFV

SEQ ID NO: 969882 - protein, 128 aa, Homo sapiens
MIFLNLPGPPPIFSMATQSLHLSGAPTTPSQSHTSLALPLGPLGGHLANLVGFAQMLTPVHTRGFFFFSHDNPSFWVTLLRLGETAPPRAYNFKSIFLCLRLLLPLFHWIVPVIHGSWVPSNKEFPNW

SEQ ID NO: 969883 - protein, 209 aa, Homo sapiens
IQQQPPCPQKAFGYRDISPLLVLHEVFFLPTGFFLSLFNHSSTPYARYAPPIYRKGTLALPNTALTPPLIPPMEKSHLRVAPLRYLYSHYTGGIHIDPEGCTHIWCYNMRNHTRRPTYISQHLLILPQFTGSLFYPPTTPQSTSSLPSPLSERHLSAQHIFVATTASHRSFTSLIGSNFLTICFIRPLYFTLQPNITLGLNPPLILAFC

SEQ ID NO: 969884 - protein, 117 aa, Homo sapiens
MVLVVFTQAERINANGRRWVVVSPRRSVPLAGISILPPPGGWIYNFLVVLCETRLHYYGASFSARPPTYNRPVRAPSTTRFDRGFFLPTESRTGRFILCVSPPPWIPLSDRKKESPL

SEQ ID NO: 969885 - protein, 316 aa, Homo sapiens
MKKVGYYISPPQRWRHPALCAPFFFQGGLLLWVRIVGTPLAPSLLWGDVFSPKDRGPPTTPQRKAQNFFCWGPYITTPQRKMLLSLKRVWWRPRFFPPLLGPNPARRRIWFLLWRILSFGRYFFPLFPQSLWEYKPPRGCWSRPKETHPWVSPRIVRDPHRPPGDWGCFPLVVPAAFVSALYQLQSHPLYVMSLSLLLGPWGETQQLGVLTRDVLGGNSRLFNLVPTQLSRETPPPPPLLGAQHTTRLIFSRHTAAGELGVSLSHSSGESPLSRALSRESAPREFGPHARPLVLYGDSLTHEKGAHTTHTLYTPAL

SEQ ID NO: 969886 - protein, 106 aa, Homo sapiens
MFTQKRHRVSCSVVFAQPLSQRIVCVSLRISLTEETPLSCHTHALREFASLRTREREEKEGARISLPRGEKLYFPLSLFYILRIHPRERRCGKKCIQRIVKGGVHV

SEQ ID NO: 969887 - protein, 120 aa, Homo sapiens
MPGARYVLAFFALLSSLTQSYSTVRVLGESLGNLIRNPHWDHRAFVNCVVFHQSIPIDFCFCCSRQPPKKLGVKPAPVHHWFVLQIHQSRFPLHPGTRHHLYSSFHEMIGIIPIPLRIPL

SEQ ID NO: 969888 - protein, 196 aa, Homo sapiens
ACPPTALLPYQLPPDARMSWSRSMTWLRSYHKACSQAPVPRAAGSFCQDGLPPTWRDFRTLEAFPGQPAGTYAPTAGPTASEPHPTHPFPRHTPREPTTKAHSWCPHLPTNVYTLLLPFIKHAPHVCTRPPLERSTSSLCGCMGLINSPYATRSLKAQEDPFENLVERKAVHALLLVHMCVGQCWCLSFSAELLLE

SEQ ID NO: 969889 - protein, 139 aa, Homo sapiens
SRPGSWGCLLFGRKWVCDYCPKFRPFCVGVSPGTLFEGLWVLCARPLVWEEKLALPRPKKIFEFSRRLPWCSTEGVSLLVYRALLCPRVSCKGFTHLAGENLWGEICLFFIRSEIVAHGKGIWKFGGELCSRGDFSLTG

SEQ ID NO: 969890 - protein, 135 aa, Homo sapiens
LRGSTPTLRCRLSEDPGVLLSFPRFFSLPRGGCVYIFIQPERLLVSPSGLALFVGPSSLDPIVGSHSTTTAWVVCVVRLVSRRMCCFCSPPPSSCGRRSLLTNVWVGSTHHNKLFVGGVCCLLPSPPPSSLVVRE

SEQ ID NO: 969891 - protein, 241 aa, Homo sapiens
APFRFWRRTWEEGAHLMPKKCAETPPLKAPPREEKGSREENQKPHADRKEEQKALPLLLRRRWMKVRHALALSPKAQGPLRSPAPRVPLCWMNFSASTPMRTHSLWHCPYFWEHFDKDGWSPWYSEYRFPGGLPQTFMSCHLITGMFPRLDQLRKNAFAQCHPFWEPTIAAPISGDLGLPRPGACLSAESQIGQVDYESYTWRKLDPGQRGDPDAWFESTFPGRGPSSMWAKAFHQGQIFK

SEQ ID NO: 969892 - protein, 223 aa, Homo sapiens
LPTSLVVRRGAPPLPSLGPPKGVSHTKSGVFINPGPLLLPGWCDSPPLFSTPPRVSPTKKGCFMPQLRSPTLFWCSPFENLWGNPLVYLESWGPPPPREEFSNSLVLSCNTCLLKPHTGVENLCTTPPTRVKEAPRAPIGTHTRPGTRRRQPALLGRRFLKMCEMEKSPNTQLPLTPRHPTKVSSKAIPQTLAHCIKIFRVFGGEPLSELTRSHTLSEPRTTG

SEQ ID NO: 969893 - protein, 101 aa, Homo sapiens
RHYIITFPCVNWRPPPIVSHPSSSISRVAPRDRTSPVCLFIGEDVVLGPHHMLWFVCLLLFCSPPLCSAAIVPVCARLKSFVWSPTPHHAPCLVLGQNNCI

SEQ ID NO: 969894 - protein, 275 aa, Homo sapiens
LRTRKGDDDERKQRHGKQVALNRTQVCGILREKLFQGEAFHQSDTDTANNKGASGDLAKKKKYPTNWWLFRDGLLPEKKFIVGYNRSRLKKADNPKEKKPFFKATPKKKPKLEDFFARNSYVAGQYNNAASYQRLNKHINTLHLGSQTNHLFYLALPPTVYQAVTKKIHESCMSQIKGWNRIIVEKPFGRDLQSSDRLSNQSSSLFREDQIYRIDQYLGKEKVQKLMVLRCAKKIFGPIWNRDKKACVILTFKDPFGTEGRGGYFDEIGIIRDVM

SEQ ID NO: 969895 - protein, 314 aa, Homo sapiens
TFRGPLLWGTSVLDPKKRGVGLPFPGFFSGECFLRASKGGVAKCPFCNCMGVRPAAAPLAAPSLEPGGPRFSSAPLLVECWTPSPGPFSPQLWKLFQGVFATVRQCQRPCLRSSELKGPYPWSPAATPPLCAHVGAAASGVGAPPKMLNTARVMATSVPHKGPHRKHATTTRVPTKRALCDIRGLYFLSVYVPLHEDFFVSFRHGLFVLERLFRPTLPTPLWPPYVPPPIYGPHWAPPHTRALHTPRYNFPPQKCPHTPLKNTHSALLTVAHSTEGISQSPSRASPTYGSIYRETTPAEAPNKFTATWRYLPNV

SEQ ID NO: 969896 - protein, 134 aa, Homo sapiens
MLGPPGPTPPPDGVPPGALTNYWSLSSLPPVGGPYFFFLARTRGVPLFRHSLPPGAPLVCYPPGSLGLGHAVLYLVDFPFSSVLTTLAASFVEGGHGHNPKGRPLLPPPFFCPRGGKTLRPVYRNLFFQKNFKS

SEQ ID NO: 969897 - protein, 160 aa, Homo sapiens
RGVVFVWGTSGTPVSHLVCRAAAACGVLSPAQGGEKARGPSCAIPEVVLHTALSLRHSHEPRVAALRPRPRLTSTAPLVSCGRKVVPTPPHAPYWGREGRLNALSLASPPLLSRHTQVTGAHPHASPSPAAMSRRATVPPHEDHDLHPTATISDSALGRI

SEQ ID NO: 969898 - protein, 201 aa, Homo sapiens
APPRGCVIYSFVVPLLVFFGVCVVRLAPPPRVFLSLSYVTLLFGYAWRHFLFLSARRWSPSLFVLVLSHLSGRASLLCSLASALSGGGVVAPLFVASSPPFPPASCASSPSAFVCCRLSLSRGGFRSLLRFLCVVGSLLSLSPRRALALLYHSLSLCWVGILSRRGSLLFAPLSRARAPPRGARMALLVARTPAPSLFLSI

SEQ ID NO: 969899 - protein, 110 aa, Homo sapiens
MCFIHGADPCPRSLERLPQGGLKNPWARRDPRGFPGPSLWFPTRFSRVPLFLWCSLLIVSTHGFARIPRGTTRGCVVNTLGVFVLGKPPPRSPPRPPPAATPLLGPPNLF

SEQ ID NO: 969900 - protein, 74 aa, Homo sapiens
GKTPLGGLLREKRHTQGETKHYSVVLFETHRSGVATPNTVRSERKREILRRPFFCHTLTLSLVEIKPVLSLSAC

SEQ ID NO: 969901 - protein, 254 aa, Homo sapiens
RFFFVIDLSAGRAFCVPPRFFSRVCGSSLGTPSWGTPPPLTCVVVLSPPRGCFPSSATYFAALWYWLLLLLSLDSVPPSWLVPTTCVRARRPLFGERGFYHHGWWLLVPPPFSLLLLTQPCWWCVRTSNYVPLLGGHRLFLLPFLPPGTISVPPRGVCVAFSFCENNQLDAFLALRRSKKTAWLFFSPPTTRCVWCGFPPLLFCGGGVPPPWGPSSFSPPFCLAEVEILLPSPVLFFFFGGAPPLHDIVVADHL

SEQ ID NO: 969902 - protein, 123 aa, Homo sapiens
MGVDTPPYLVGEHPNGVGGDTQQNMHHRGLGVIPRGFPRGDFPPGREILSRLSKTPQHRAGFSAPHHARFPRFKKWRAHTFDHLVGDCVEKMEIGHFSQRTARVVTHTLIGGGTLVGGPLLFG

SEQ ID NO: 969903 - protein, 121 aa, Homo sapiens
MSPPPHFGPAFVLGDSSRFYGGLDTFSILDPSPPRGVHRSPEKVNLPLMKLLPIDDKRLLLNDEWMMKRFDDEEPEANAALVDILYEILPPECPQVSIRMEKTPTIIDPQIPRPRILPETG

SEQ ID NO: 969904 - protein, 162 aa, Homo sapiens
LCVRLSIVGRFCPTPVPPVFPQWGPPHCTPGGTRLIYDGAPLITTPQAGPRKGRLPDLPGGVISSFVFCSRPPPREVVFFFLPRRFFFLSTTPVFSPSAPRLLPFSPPHLILERAPFGASPLHGRFLPPPLCITSPCRGVLRPISAVNEHIAVVFVFCSLTE

SEQ ID NO: 969905 - protein, 201 aa, Homo sapiens
RRAAVRSLGPLARGPPWSLLAHHTPMFHLVTPPDSAPRPLPCPDRVPFPSFHPTHLAPGPPGQPPPGTSPGAPWSPDPASLALLAGLPADPVPRFFPACHQHPRQIGRRRQNPLLTTPAAVPRLLAEPPAATPAPALGLPLHYYDLNAGPCGLETTPPSPKSPPGTPACLRWLPPGDPPPACVLGPPPPTFWWGEITRLET

SEQ ID NO: 969906 - protein, 245 aa, Homo sapiens
MCRLCFPRVHTLRLPAGRGHFQTDYALFGPEHGPPAAVDTPGTDLAAGCLTVHGAAAPHRDPVFASRRRRASFPHCLTSSTLYAGPGWLRLNGPTWRRPTQLYQEAANGEPQMAVRHHAEPGSEAEVGWATHDAWPRRCFADLRGERTMYRAPTAWHRAWRECAARPTGHVRRLPLSCFLNRPGGWRPSKPCAALLHHPHENSDDLTATGGRGWPEGRGTRELGQGGATMASGSGPQGKTSLVNA

SEQ ID NO: 969907 - protein, 184 aa, Homo sapiens
MVNEARLSFPAPRNVDWVSHTGSEVLLPAPTHWVTSAHRSTIIHGKKVGPPPHRSPPELAQKDPGNRESWRQRSSPWGPRPAIPGGPLFEEVFPLHVPLLAPPGSNRASMMAQHHHPAIFSSASFLRGHPFLAHVLTQACAIHREALLLDTKFSAQGTNVPRTHTLNENGTPLHGRLCTHAHFE

SEQ ID NO: 969908 - protein, 307 aa, Homo sapiens
PPHAPRLFLVVEGECTPPPRRSVGPRSFLSSMHHRSRSSSLVVLLGEHPSSSSPSFGGGHPYLGGFGPPPVFVPTTMVGPPVRARSHTSMLCVVHTRRGVVRRPRVPRSRFIEDHLLGLFFLWRAPLLSRCSSKKGRLSSLCSPRSSLPSFLVGRSPPPRRTHSRVCYLSLTSLLLWMDVVRFNIFVIVRVNHPSWFFRLPPQPPSGAPPPSPPSCCVCLFSCGAHNTPPLLPPASLFFSLQTHPPSFPSLRRSTPGGGRRSPTPTPSLLSTCDPQGYTLLLPPPPSGFFPPPPPPPFSPPPPPLFS

SEQ ID NO: 969909 - protein, 126 aa, Homo sapiens
MAHTGSPTCARPGTHIFSPGPGISPDSRVDIRATLLSRPTATYQAPYPDEKGRAGSPDAQKDPLVGNEKDKRGVPVVCLQNARERAFLVGEKRPRQRSQRTHAPWKERPAREENPTHRGEERPAAI

SEQ ID NO: 969910 - protein, 69 aa, Homo sapiens
CVLSLSRCRGCRYSEFRVWQDMVVGCVIVYADGISSALYVVVVCLPRISRVYVVLVVRCAPQRSGCVRG

SEQ ID NO: 969911 - protein, 174 aa, Homo sapiens
ARRPFGFPFLGPPPGPGQQFLRPGTLTGPKVGNHRPGFPLLGTCDEWAPRGGSAGLLHFEPAGDVTLAPCERRALYPAQYGRDPFGAFKYYLIARTQCLASHRPPQGRVDTYPEHLAIVKIPGVGADLRGPETPPPPTSHVLMRIDIPHHVQARNVSIHSDWMPITLAHADQLH

SEQ ID NO: 969912 - protein, 147 aa, Homo sapiens
IKVGRGLPHPLVDFRPPHWGGTTKKNPPPCLKFLRGVVGETHTESSLGRHFFGGAHTVDVYKRRDTHVPPHNLCARGPHRRRSLFKSALRGLFGEGVERKRQTPPAVAPLVGAGPPPRGPATNARIFGDPFFFFLNFYNFGVSPSML

SEQ ID NO: 969913 - protein, 104 aa, Homo sapiens
PESARKKGDGVVRGRRPSVKERERKKGPTRTPRVLAQRGEEEKRCIHRAPRSFRGAKFFLPAKIYTRPRAMSFFGKQPPRGTTKKSYFFLDAKVVSREKRPLFF

SEQ ID NO: 969914 - protein, 188 aa, Homo sapiens
LLLSLSLWLLARAGYGTSAAVPRPVAVCCNSPGRWARPALVVCRRPFMVAAASEPPASFLLLLVAPRAALLYSLGRMSVSSVFCWAPRDGWPLFFGVFPSPAWCTAPVFVGGWCPRPLLLFPSPVPWVGIPCGGLFCLAALPVVLFAHRFLCSRGGVLFSASPCVNNYDAGAVVFGGGAPPPLGGGGV

SEQ ID NO: 969915 - protein, 331 aa, Homo sapiens
WVRASAGVLVLRLVARRAVLSSSLVCARVSGGGRWGLCCVRCSGLAFVSFGVGCVLCVVSLLRFASLLARRASFSRVVVLVSLLFVGLSAGWGWVFGLSGVLWLACVCVSSLVFPPSSFPSSPPFARPLFLSLRFLLSPLSLLSLSLLLLFFRLCFSSCSCRAASGLGSSLFLSLSLPRSLVSLCALAPSSPSFLLFALALAPLSPLRSGVACALFLSSRPPSRPSLSLFCRFLVIRVCVLAVVGPLPAPPSPPPSRPAPPRPASPPCPSPPPAALPLSSPPAGAPPPPPPFFFFVCACLSLSLLLFAPSRGPLSLSLSLFFFFSFFSSLD

SEQ ID NO: 969916 - protein, 160 aa, Homo sapiens
MSLSSAHIVESSCCCAATLLLSYVSLAPLCVFTRVASPALSGASPLSRSRPASLSLSVSLFIYVLCVVARERILYSLCVYSPDTHTLFCVRALSLARECTPAALSSLARSLPRAGASHTLPLSSHTLLFSLSLCVGRSLSLFCFSAPALSLYIIYFLLVL

SEQ ID NO: 969917 - protein, 144 aa, Homo sapiens
MNREERRNLKRKHQERGLKVKRELFLRPHIGDPHKRISPQNTLAHSCWATYVLSTSLSIELWRTPLGVNETTNMGEKLRRRWRSRSHFTATTGLMFSGAHFYNTSSTLGIPENYRKLHKYHVCMLKDDKSWNHDIAGGSTITCF

SEQ ID NO: 969918 - protein, 182 aa, Homo sapiens
SLCRSLFVGLAFWMFDSRVSVALLPCVTLVIFVLRCCPTLSVYRGFSRCVQHPVCLIQFYRRSAPAPGVPAVLAQLNPPASFLPPRVLPRVESLLTLSPHGTPQVSLVTRYGKEDQDYYPYAQQALLSHGDLDVWSRKLRKYQAEDENRGHQVSSQNSLGVLCPSTWNPLLKMRNFTGQINR

SEQ ID NO: 969919 - protein, 267 aa, Homo sapiens
SFDRSPRRRGEVGGPPAPPLVLSVGRSGSTRPRSVLPFFGRPAPHTYAPHQRAPTFFDIAPLFLAHTGAACRTPPPTHTHVVFVSVSPLRTSCSLSRVVHTPLLFLPPSAEYRRGGLHHTRWCSHTLFFCVKLGGPPAAPYDWDAPRWFSPHTTVVCSSVDLLWVILFINIVVNPLPHFSPTRACERDFFRTAQSISPPHKPFFVRELCAQAIAPSPARYYVWVLSHPPTTRVELYVWGRPFFCFPPPPQKPSFFFPHKKPPQFFWG

SEQ ID NO: 969920 - protein, 174 aa, Homo sapiens
MLFGQTCVTAPRCCPTCWRRVPERLVATKGVSPETPWRCIVHALVPPLAVGRCSQCGKNGSEIRGPTCCDAQRDSRGERKENFFPRCFGICFNSEAAPHTGGCTPLLACVRHLSVIFDTTRLLKRGEGPHQRYTPNSCLVSPHKVLRRRERIFLFLWWGATSQNGEIPPLYSLG

SEQ ID NO: 969921 - protein, 184 aa, Homo sapiens
RCVAPTSRSAAARYGGGDTAQPRLLCRLAQPPPPARVLGCPRARAQAIVLGLLVWSRRPPGARVEIHHCSLSWVYLCFARRRRSPARSLRYARGGRRARFSRALSLGPIAKIPLSALTRRTSLCHGLFSCPLAIVRIFGGASCFLCCDALRRMDGCAVSLPPPASLCDAPFSAGGVHLLCCVAW

SEQ ID NO: 969922 - protein, 171 aa, Homo sapiens
MLCVVFSCLVAPFVLSTSALWSLGAASISVPVVTLSPGGFRNVGLRNPRLGADGRRGLVAPPFLSACVARESGVFQPLTFHLEPPHGHLEFRPRVVEKPLERMPLEGSTKGLGHNSPRPITSILSTHFEFTFRRFFEAPWLPRSMPQAFRTQKLHRLRAPDLESSDLVDPD

SEQ ID NO: 969923 - protein, 104 aa, Homo sapiens
MVNPRRGLVILDLIKHVCSPVAPGNPVWDFTPFIYYGKNFVWSPSPPRVDDTTPNPTPWGGIKSLFKIEWENYLFDKKYDLATIEFPVHLTCKTPWVNLEKSLK

SEQ ID NO: 969924 - protein, 110 aa, Homo sapiens
GSIHITLRLTHIVLNMETHPEPQYIHSPAYYHILTGSLFYPPTSLTRYFEVSLPHFPTAFSAPHFFVAPRLPRASRPLLAQHFLTICFIPPTNNFHFTNPNIHFGFEAPP

SEQ ID NO: 969925 - protein, 79 aa, Homo sapiens
WSFPLELSPPERSNLSQFYRGTKILPPDHREALYRPEPDRKVFPQFFLNRRKYRNFRFSSVPQEEFSSGPVLNLWTCSS

SEQ ID NO: 969926 - protein, 377 aa, Homo sapiens
MSHACVSLCDVSYYVLWLSLPLLPCGGAWMEADFAPRWWTTHPVVAPYRTAGARHPPGFFTLPRGADHHSHARGPGCPCGPFFGAHLIGTGSATKKTAGLARSSPGFSPREFRLGPHGAPRQTPLGDVRRRPQRGWAAGVLCPKRTIVEESQQAPPFEEEGILYSLVSSPSRAYYLKGNSQERFSLDFPFPVGGAPLFSHKRLNGFSWKEFYAPKCAQEKPKTLRGPGLSAAHPRGFYRAHILFGLIPGGTIHTIGHVGFLWLLKMAPPKERWPHTATSHWGHNQSLGHKRLPTSVPTVRAQRERIHGGENTRDLRTSAHHTWWPSATRLTTAALRLLLPGDALHFPRTPTGHLGHFVLPPPSCLKKAGFTDGLVIE

SEQ ID NO: 969927 - protein, 102 aa, Homo sapiens
QFPAARSLLSITEDHQRFKVAGSPALQPVKSFPTPALSIPAMGRRVLGTAAHWPRASSWARLLGCPLEREPPDPQLEPRTWCPSFSSLGVVTLCVSFFLMII

SEQ ID NO: 969928 - protein, 311 aa, Homo sapiens
KNGGVPARVFPELCESTHRAAARRWGNKAPSHTLVCGRAAPHKRKGRLWLRRCARHHEETTRGSVGGEIRSDPSLPPLRRGRLSLEDQQGGLHRAEDREGLPRVLGEHTVFPEGGFLSRLPPPSHEARLVRPLCFLLFCWLGEVVVETHAGSEGHCLGVDARHPRASLCFILLLGGRLGTPSGHVFFSSLSLSGGGGFPAPCRRLNRGTETPRHHHQDMWGQRRTTLADVAQPGVGAPTTTCSFHRTPPFPTDVCGEEDCEEVLPENPHSKTCGKQQKTHGGVLGGPPPPFLKDPPFFLPCGPKPAVFVWG

SEQ ID NO: 969929 - protein, 233 aa, Homo sapiens
PKFGVFNKRIFYGGLRGRLWAPLEQEFLAPGEEMPQNYLLGGITPTRGFFLWGTVWETLASGGKERIWAAWAALHNLSVENLEGFFHIGRKEGKKKVVSQPHRSMNAIKGRLPNKERGGSFGQRKYAPTCRIVSVFVGGPSVDGSLLTWMWFPPIGAHLFRTPLAHMRDPLEGHTHVVLKRFFPSATRVKDFGAPHLCVGHPRVILKREQYQDQSDFLSDRCENNQCDKTFWR

SEQ ID NO: 969930 - protein, 91 aa, Homo sapiens
APPVMCPLGRGGDKESIKDEEWPVRLREKTRRGAPPPNEGEGNEPRGGGVSSLRSAAEERPPDRNDAEVDTTVSERRRKGEAPRPPQSVCR

SEQ ID NO: 969931 - protein, 126 aa, Homo sapiens
MVLLAPRHHSWASALTAIPAEAPLGHPGNRGVRDPAAGTPCAAGIEGRVPPVKDEEPGPQDPCPQSTTPWAPRDSGPGNGPGQAGSASLCCLPLLGTGQHPSGEKRSPLFMCTTPPSVIIINLLFL

SEQ ID NO: 969932 - protein, 103 aa, Homo sapiens
RTRGVTSGAASQLSKIRVVRESLARVLTSYYPDSERNLREFYKGQKYQPLAFGLRRHVPCAGRLHKHEENLKTQKQQRKERLYPLRKYRSRPEGRIVQLSTAG

SEQ ID NO: 969933 - protein, 151 aa, Homo sapiens
QKFFWGTNNQRRRCERVQRTRRGAPPRRNIRSFAPYKRGHNQAVKKRCAGRQTPRGRRVNVPPPHHLAKPHRETSLCLSLNERVATDTRRRGSHTSNTSGGFGHTSPPPGGDSCWAPPQGLSDRPQSFHPSFLPLCEKIFYFPPPSRCSLV

SEQ ID NO: 969934 - protein, 107 aa, Homo sapiens
LVRPDSGFVAPGSGSPFGELGAPGPRMARFRSLQFMGAPRSLGLPAAVLEQCLLSRLLCDPPPPRYACSHPRLYLPPPMAYPTYLRNRMVPVLPPLRANLISYTSDP

SEQ ID NO: 969935 - protein, 119 aa, Homo sapiens
PPVGWPPPIVEHPRGVAVYYLLRGFFALFPRGGGVPILSHNGGHWFLSHHGPYFLGGQPLIKTTTTGCVATRTKQRAVGDLARSAVIYPAGNFLLVTTTRGFGCYDTHSLHGGASSPGL

SEQ ID NO: 969936 - protein, 126 aa, Homo sapiens
MADAPHARIILFVLLRCCVSSLVQADRTQNFVSSTDRLSICARPTTTHDLLSHAVLTHPLLITHTLTTRTIQDAAELVFFNIYYATHTKLFWRLPLSTHTTIIGGESLCLILILLIFFSLRRLSHT

SEQ ID NO: 969937 - protein, 132 aa, Homo sapiens
MLSFRCVYYRDRVCRLGFDQRLFCAPYEKIGGRQHKELTTTAVGVSLWTHPLWGESPPSPVPRHNRGGQKPTCPEPTKAFPEKVHNGGTAQLVGPPQGGILQEEFYPQEFILVVFERHPAFGGSRRFPIPLG

SEQ ID NO: 969938 - protein, 205 aa, Homo sapiens
EAVAPESLVPREVEVGVDPRSCVHGTFPNLGLPEVRLFLKRRLIIIIKEEIETQVFPGWSNILALRMIPPHLRAVSQASPGLTRPNNPPMSQLSPSAFLILVLSSLPPETLLEGHVSPAPCQSAVHPAPLGPARWLCLPSSCGGTGPLWGFCALLLGPTGGAGPPHSHGPHSLQRWVKELALPGPPTLGELAPPTPHALFPATPS

SEQ ID NO: 969939 - protein, 134 aa, Homo sapiens
MHVSLVLCTDHCSGGGVAPAVWLRGPLLVVCCVCWRRQHTGCSCSSPCSESSARRGVFFVAVGRRCVVGASVVGGGPRQCLLTYRCRRLSPSIGRERLLCFSPPPLSRGGDVLFSCRLRSWVVVAPRSLCFVAG

SEQ ID NO: 969940 - protein, 76 aa, Homo sapiens
FLDRLPRLCRRLFPAFPCFWPLGRCPETVSVRSRDFSTTSGFFSHAVTSPFSPAASRGVFPNPTILSGTGQIARCW

SEQ ID NO: 969941 - protein, 142 aa, Homo sapiens
MPAGPCITVVHPGEPPLSPLVPFLGPSFEEKSVAHGDPRVGCRFGDFPRGFLVGRPRGSGGFSHGTPTGEIVRDGGKSLPFPRDGGPGETPGGPRGQGLNLGEGQPPPHNTGGKHLTPLNHTGWGEPPHQDPGNSEGVPCAR

SEQ ID NO: 969942 - protein, 314 aa, Homo sapiens
ASGIGVLIDGVCSDTAIECVGLRRQAVVDLVGRITQPHHRCRAAEDTTRFEATIVVVSRAPLMIVVLRALGEGVDVHPTDELCRSRTERIDTTAGEDKMRLRWWLGNATVGLLCCVAGVGSGGPPARVVVCPRVRKDEVEVVCGRHRVESCCFRSDSGLCNGCMVGVLLPPPAGRCCRVCLVVWVLGCGAPHLSPPAAVECAPTLCVVLLVFCGVGAYASFVYVDSADGRVFGQGWLVWFVPAPKGGWVDRVRWGPSVFVLCSPARGAAYVVVVKDKFVCGVMQLRLGQYGLCEWVVWWWPFALAAHIAVAVFS

SEQ ID NO: 969943 - protein, 139 aa, Homo sapiens
MRLLVAPRRLLLHMMLVVSLLTGRVVFGLPPSQYCGVPHHVRCGGALLCRPLYVALFSGGVPTYIIRGGSLRDRRLLSVPAVVSQAVWSDAFVEPAPLLVGEKIIRLVVRPTIGGVTPSCKMSGYSPPLIMYGDFVTAR

SEQ ID NO: 969944 - protein, 104 aa, Homo sapiens
MLAPREALIMFGGNKEGNHRKGSLLFLILGARGPCKLNPRGVAKKYKLCGCVEPPPNSGEASVSKAATACCLAQLIKIYIWRRSSISRCFVGYTAPARRCVLPL

SEQ ID NO: 969945 - protein, 210 aa, Homo sapiens
MFCPVTVACCSLWQTPACGFGCLHWCYVLRLLLVWLLRSSAPRERLVWGSLYTTLLGRVLLSRCRKHSCCLCFLGDFFAFLCMPPVRSLYTLRAGRDHSRGCGWEGRSMGVRRRPPELECGWRAPPCVGVVVVCASAAWCESAPVEVVHSSGALSRRGLDIIYRRSPSVGAQSPTAGPSFLIGSFLALRLVLKLPFWCPPRCPRPRWRAR

SEQ ID NO: 969946 - protein, 290 aa, Homo sapiens
VHYTVWVPGGGGRGAASLRLVCATVRAVAGAGSSTLPSAAACDFGAPPLCFGSARRCGGLGESARIVWLVAVPLPPPPAACLLLWALPPPLFLCVSTRGCREHRVVVWGARAPRCWWGGPLDRPRPPSVCFDVLGWGSRALSLRCGVWWPPPRFIFLMRRLASLVARRLLSPSLLIVFFSASCFSSVCCARGAPPRPRVCFVIFVLSARSKPCPPAGVASPRAGGRPLRCSLFSAAASLFFFPPVVGPSSPLLCRPLWWPPPPPRGSFFFFSFPPPQISPRPPPFLWWAP

SEQ ID NO: 969947 - protein, 314 aa, Homo sapiens
MLSMLSPPAQASEGPVVCAHLPPRPPSLLLLPHSHLGREVHTFSSHGDDSREEAALLAAPHCPRPQQVLNHQGLIPFHRGPPPILCASHPRLITERGAPRRLVFKKPFDDFVGCKETPHHVRGFPAVSPLSMGAPCSLFRRRPSGGPHVLRSTVPRWHAVSHRTARLPFFLAHTCDTQRCLFVFVVLKGFLERYIIYVVLYLLCGERENVVVCFVATGALRPQRLGTHREGVCTTTLLWRAWGRLSQGRPVCSAQESVVLCPLAPQFRPPSSSIPFVIRFLILVPDVYKNFVFVWHHFFLNLLFIIFFIFIVRK

SEQ ID NO: 969948 - protein, 153 aa, Homo sapiens
MVFAPFWSGFRTVIPSVGATLPAFSGSGIRAACARERNPPGGPRGMFPNGQLKMGSPVGGNSSGPLEVEEPPGPSSRRPFFRRHPVPGCSAVPLRTGLSVFDDVNPRRVVPGAHLPRAYPYVSHELKPCVYNSRLYARWLSTCAPISLSPMTW

SEQ ID NO: 969949 - protein, 141 aa, Homo sapiens
NFHDMEMERRYGERKIEELMEEKYDFGNGTETQVMDESIHLGWELAQISRTSELSEAPPKSLGPEVNELTSSRLLKLEMENPSLTKTVEELRTTVDSVEGHASQIPENGKRKSKAPVKRLRFFENEIVPRKRQVFPELSRI

SEQ ID NO: 969950 - protein, 155 aa, Homo sapiens
SCLWGPALVGLFRRAAGRLGADGVPRPAPFSRPAGWRTILVRRLTFPPGWHKGPFGGKGILASRKKNGGFIDPPPRGVPNVPCLLLRNYGVTKSSGIEEVDIVYQAQEHVIPVEATLKFQASLAADTFDPYTATAETQRRLTEMLPALCEPAWCG

SEQ ID NO: 969951 - protein, 175 aa, Homo sapiens
RFCSGVFGPPGVVAAVPRRGARAVVASCACGGAPSWLSRPRVRSRSFVAAGGRVWLWLAGSVFACGETSRGVAGGAGSFAGAPRGWVVSWSPPLCVYGWSGCVVFRSAGVHDLCAARRALTSRPDVWFSALGSIVLPRGGSVFFILRPRFPPPSGCLCCWAAHVAFRWLAWLWWW

SEQ ID NO: 969952 - protein, 308 aa, Homo sapiens
MGCAPATRETPLPDSALGVPPNIIMGPPSLRDLSPGGRCKLSPAVVFVFGPSRPRERCCVVLFLFFGRNEEGWFFVVEGGRVCVGDAHGVSSEDACSGWPPLLPPSPLLLFMLGGEAPPLAGPTTRSITAESSFHSSALRLVRFVPPPLRGGSVPPPLLRLVVTDTATSPLWCFITSPSTSSRERFIRYLHSRETCQRDRDWLYIERNHTLAVTPQYIYSQTRRRLYAHTYLYSGFSYIYHLSLPETPPGVLSGVFPLLTTCSRARRFIRRPHTYFVEPTQAFSTELSHPPLLASTFPPLICFLPPNL

SEQ ID NO: 969953 - protein, 261 aa, Homo sapiens
MVAVGGAVHIRLARARPPSLCVHGVVYINPGHVSALFQLGACCVGVPSRPLRMVASRLGGGKLFLSGAECCYDARAWLGVFSFLVGEWAPAEVLPPAAPTCVNEGPPHLSCPGASLVCPLMGGVSHCGPPLFYVVCHNGGPAWALGSVRLLGGPTTPHRWGVCDTQKCAHLHSVCPTVAPHTRAPTEWRHRVCDTQSPHGVQTCALCVSVPWGDFSCLPLSGVTRSPTVSPFTWESETSREVCGLCAPTSCVLHSELSVAL

SEQ ID NO: 969954 - protein, 127 aa, Homo sapiens
TDHHGKHVYWSLVGIPYFFGVYHAYLCTYPVDVVFNQIVTTRRCGFARVAPGRFYPAGGCLSGVRIPLTDSPRRRCFSCGCSRTIHGVRVCPGDAFSTRLCGACCSLEGPPLGAERRPPHFCLGGSN

SEQ ID NO: 969955 - protein, 141 aa, Homo sapiens
MGTPTPVNYRRLWKGPRSTSPRGPLCQSHSLAPHPNFLHTHTLAQRRGAWENHPHTQGGRFPVGYTSKSCFAFNVHNTSSRHPPPSTRPAKVMGTKKLSPSPPPEPTRPRPSLAQSLSAPLLSCPGMCKLVCTCNTPPGHM

SEQ ID NO: 969956 - protein, 229 aa, Homo sapiens
GQRAKLWLFPGLAVAVPLLFIEREALVRARVQVIHLPPFSESNVCPCTLAFPLRSPVIGAPLLSSKQSFPPTTIPLSFIYSKDIVQETPSHRKIMGNPLFLEIYILGTPPLTFPQSPLHFRPFPFPLSALPCNTYHDSRVLTRVPSPLLPTSTVPICAPPPLGFSCNLFFEVPPRAFRPGAISFPNLSYKYSSPPRLIFSYETPRRSTFRTLSLYRLSHNLASKYSPGL

SEQ ID NO: 969957 - protein, 105 aa, Homo sapiens
MVPGSPLCVESFSDYPPLGRFAVRDMRQTRCGGCHSKHVDKKAAGAGKVTQVCPGSSEGLMNIIPYPATPNFLIKWWKKRFSELFVSIGPLSVSSKRLVYDNHAS

SEQ ID NO: 969958 - protein, 219 aa, Homo sapiens
MCTPTPHFLPYPYNLAPLEKRLPTRRPKSHFLHKDFRPSPDILQSSHIHYISRALRQHPKSISQTPLFTTFRHSLNAFFSQETLPKLLTPTLIDFFVMNSSSHRPSPITSPYPPTYLTPIWEKLLLCYVTTAFPDSQIFTFPNLPRNSHTHIYVTRPILPLTYLPPNTHMGLNSPTHHLPHIKPLTSPPRKTPLNVHTPYPPFSSYPSTPTIITGFSSL

SEQ ID NO: 969959 - protein, 157 aa, Homo sapiens
VSSCRPRRSRLGCRSLFPFYSSAVSAVCVLVLFRSVRCSLLLLPGGERSSMSFSCSFPVRVSAGGGRLRSPLLSCVCVLVRFRACRCSGRSGWSSSSALFVCSSLFLFSPSLLRVSRGIPAAVARARPSASLVFLVRPGSLVVRSVLRSFAASSCVD

SEQ ID NO: 969960 - protein, 269 aa, Homo sapiens
GSRLLVLTRSAVFRLSFEGWCHPLSGVSALHECAVFRICAVLECARGGPLWSVRKAAAAQVTVLDVMGTVSRDALLGSLERARSVEFILSGRPPLHYSLCALAIGGPPQIPKGIARYTDEHTGRGGLNGSLRTRGRPQQKQQWAKPQRGALKQLIERLTPDFRRGTNILSKHFPRQKTFRPPVCFVSRPQRGRPVESPVAVGPIRVLVISRVSAPHSGDEEVRIDQDGFRHYEGVSPKQEGVKTRGVFSRKVVNTNNHGSTRYNTTRGG

SEQ ID NO: 969961 - protein, 148 aa, Homo sapiens
MSTYEELFNVGSPGVMRATTFCLPNYERNRGSFHALQAFLARRTPIVLPRNLCLPPLCSHDFLLPHPLFTPCPCDPAFFSVDVHQLRPIFLGPLSPPDRGPPPSVWGGYLAPQVYPITLALSVRGRDTHYSTLPSDLPLDPHIYYRVH

SEQ ID NO: 969962 - protein, 190 aa, Homo sapiens
MDTTHFVCAQTKHARGVVSLASRRYPPRRILFVRPARRPSLSLFCTHTPAVGLFSVLVPSGGASIHPPGASSPDCFVYLGAPPAPPPYFVLPRRAVYYQKFLLAGWCFLFLPLAPPVVRVFFELLPLSPIHCARRVFPAAQHNFFCGSPRVSLAASLAILGAASSLHLMVVCPPPRMFSLCTTPHNPLWF

SEQ ID NO: 969963 - protein, 261 aa, Homo sapiens
YGPPVLLVLLSFFGLPSSTCVFLPSTTFLYGGVIHQERSKNHSGAGSLHLVCSLSLVFPRHHPFLQLLFLYRGGHLLFFAPPRDVFFPQREIFCGSCCTTPCALVPSSPHLIGGGCCAPPLRELLPPLIPLYGLVPPLFNTYARCFFCYYRGVLHLLRGCAPSSLIDDHAPLSLYFCSRPCVDLNSFWVSFFFHSPLLQTLARGVFFGVPFTLMFVRVIFGAKPLCGGPPERSSSGFLLLFIGPNCSPTNCVFPPPIIFSF

SEQ ID NO: 969964 - protein, 139 aa, Homo sapiens
RYPITLVTRNHIGQTFSPVNNGPPPHYEMLQEDRNGYSGGAPQPASPDVPRDATSAARPPCLTQWSGPGNTLFKDTCCLGFIAIAYSLKSRDRKMVGDVTGAQAYASTAQCLNIWALILGIFMTLLLIIIPVLVVPAPR

SEQ ID NO: 969965 - protein, 127 aa, Homo sapiens
CFLLMLFFFLWVACCLWLMSPLLSRLWLVGLLVFLVIFLMPYVCALILGYAILIDPSFVWFLPGLRDCSFCPAFPYFVCSCSLSIVAPLPCLGSPRVFPPYGESAWPLAVLLSSNVSVFSFWFPARC

SEQ ID NO: 969966 - protein, 145 aa, Homo sapiens
GLFSRLFLLTFCLRGDAYYSLVWPLLFLMLLGAGSTLLGVFPLASPGLGCPHFAYQANHFIGLHFAFIFRGTHFLATNVCFPKNTMDLVLCLSDFLREFFFLTLTSCRQALAKCSPGRSTPANSPLRPPVWETPPQLFRSPWFSH

SEQ ID NO: 969967 - protein, 186 aa, Homo sapiens
LGPLEDMCHHIGRGPRLVDFLRIFVVTPAARMQPPVVSWFPRGPFVTGGYDSPKHPWIPGNKILPRVCFCSSLFHSHLGSRAAMLMGGVVLRPPSVPFFPEGDQNLVVMAPCPREYGQLKKDLSRRQTGFPFCKFLLGSKGCPRTLDVVYPDPALGSFHREEVTDRHLGPQDRGRMELFPRLGISN

SEQ ID NO: 969968 - protein, 204 aa, Homo sapiens
MLLRLLFAPACNWPLLERHLWPAERFLLRPSLFYEGREDTTLDDNAVGCAYHGNTHRVGPRNFPFSRSIPTYTPALVMVICGEHRRYVERPMRGAATHHIVERKCMDHHSSLHFVDDSTPTCAPVRRKGDTPTWGHSSETTQYLGWDQGGEHHPKRYGGTHRGTQLRARIGGGPGYGVGAELFSFDDKDHPGAPMDNERSASGR

SEQ ID NO: 969969 - protein, 198 aa, Homo sapiens
PPDKDWRPSRRSSSTSKPQSRSTTPTRSQLEIAPRELRHPRECGRRRACEPPPREIAPPAGGADPGAGLHGEEASAGPVRQDLQSSAPRTLKALGSPSPAEEEASVKDLGSWPWHFRGQPAVRVAGAGTGSRPGRIVSGDCSRCRRDTGLGGGSHLGLRSAPALTEGAWLPTPASSVASHHPREDLEVQLLSGLIVLC

SEQ ID NO: 969970 - protein, 71 aa, Homo sapiens
DVEIMEFLLPDYTAPWIQDSHFCPALSFWGFFEIGVSLCRPDWSPMVGSGSPATSTSPGSSRSPVVSLPRS

SEQ ID NO: 969971 - protein, 195 aa, Homo sapiens
RHITVVYMLLIATSMSLLYFLRVATSYYREQQLLCVVNTRNTHGAVGHPRVLSRDIFSRPGEINFCCCDTLPKRALPASRGNHALVAWEILSFVVKILWPRAFERNALRALVPPHSIGDLCLYVAAISHMGLCARVCVWLCYKKGRRHIFLKREIFVIFFAGILSWRRGSALLPPRRCLLVPTSDLGRCFNHYGV

SEQ ID NO: 969972 - protein, 138 aa, Homo sapiens
MRFLDPVCARVSDNIPDPTCMYSATSLRPLLGYLNPCVDIFCPPLLSFGLFGPLPNSLRDPLCYGPRPGVSPRTPSPLCHLGSEFGAPPMGAVTPSGYYPAFLCGGIYVSQHLLSKYFSSPIFVTVSTPGGHSDILDT

SEQ ID NO: 969973 - protein, 295 aa, Homo sapiens
LVSPPLVVPPFLEGFGLYVCRGSILSRLDQCFATIAPVVVRHTRPPGPALGEFQGPLFQMLFSGMCHPRHGPFDYPEAITIDLGAIPQKIEGQLFTSEEETPGRDCEEILDIPSETTPLSFPESKLLSRALENQSRPLNMPPPVPVSHQIVFPSLQPVMPGVGIYLGVLTKEDGEKETWKVSNKFHLEAHHQEDERQPKKTARLEEQNDQGETGSLPGQPEKEASASPDPAQKSFICKACDQSFPFYCRLKVHMKRCRVAKSQQVQCKECSETQDSKKELDQHQLEAPGAGGEPD

SEQ ID NO: 969974 - protein, 104 aa, Homo sapiens
MILFVRFFLAASRIFRTVCPKCFLPIFFSALTLPTLLLHNTLWRVGVRFVAHQATLFSCHSMVVAFFCSAVPSLCPTAYFNFVLYFSVSTWVRILWMSSSSCLW

SEQ ID NO: 969975 - protein, 155 aa, Homo sapiens
SPVPHYIIGIGRRCVFIGRGEDHIVRVSLTLTSVALIDDLFLTGGVPFCLGLAATRSCFFFFQRDIFLGAPLCPHSPSTRVGSALLPPPFGVGAFGAPLPGCSSLPPCSFFHCSCASPPSWYTPSTPVFIRPSHRAVCTTYTHPGGPSPSLVVYI

SEQ ID NO: 969976 - protein, 292 aa, Homo sapiens
MPQRPWLCFLLRRIFGVGEPRWGKCWGTPGSKEIVRTVHKHHGGWPHITTPPLIPQLLPTFCGARQRNGPARGANYFCAVVGDSPLAPLGVPAFFSVVQPPRGISPAQHVPFWRLLEEPTGPQPHENWAGKNVWEPPVSPTLGVIKNHMGLFVMATLGVNPLVVEPLGVCPPNIEMCSTKCLAPTIGATPTFVTILTSAGTRHIPTVFCEFCVAPPTHWAMYNTEFVATSTSLSSHVAFSHPLVWWCPLGVCEMSPLGTHRGTSQRGRSSVWCHTVSETRHYTLTHRRTLCL

SEQ ID NO: 969977 - protein, 187 aa, Homo sapiens
MAPANQGARIAPRPASGPIRPIVRCPTGSVPHEGAPGRGFSLEELKGGRQFTQKGGPEATRHFSVESEEADKCQESLQAHVQRLKEYRVPTHPLPPESPRPPRRETRSAEELKLANPADRPGHCPSRDVYKKEKARVITEEEKNFQAFASFRMARAHARLFGYGPKEPRKPPEPDVEKKKLSPPGDL

SEQ ID NO: 969978 - protein, 58 aa, Homo sapiens
MHLTWNAATLSHINHNTFPLHPIIFTDSNYLTISRIRVALIQAYVFTILVSLYLDDNT

SEQ ID NO: 969979 - protein, 245 aa, Homo sapiens
GLSPFYGLPPPAWGPVALASVVILGVFIKLRLYHLGAACYQGGAHFLGPAPPSRGPLRALSFIGGIHPCWFPPQKCFFCPRVFLSTVVNPPAVIRFSPPICGGPLFPPPRVFSSPFIFPPHVVSRLSDKNRSAVYFVPLPGEGSHFSPQGAPHFTVLFISNPPPGHHMSTPALVAHRFLGFLMFTTLPPDLSDVCWVVSLSPPFGRAIFAAHHYLLVTNHRGLPAASPSYFGVHFPSLFGVYSPP

SEQ ID NO: 969980 - protein, 122 aa, Homo sapiens
LGVNIKPTPFFFVKPPPHSSPLDVDGPPPPTPVWVMDPPPLWLDNTSRGRVVPYTPLPRSVFIPMCRRAGARVLTHTFAPPQRGARLICGHSCGTIFGGTHTHNEEPPHCWLPHTRRDAARG

SEQ ID NO: 969981 - protein, 99 aa, Homo sapiens
SPGVVYNRASFGVPPSVARGHATPPRGLASSLSVPRGLYLPSGAFFLLLRGGGYNCFSTGDRRLLPHCSPLVGGAHVETPVVCHQTPLVGAPAARIFPR

SEQ ID NO: 969982 - protein, 222 aa, Homo sapiens
MSVADLNEGFSETPLSGGAQHRVGESPLFLCAHTKRFSVVWWPRRRSGRDHTPLVLCPTHLVGIAFGGACACNTPQRFAGCVCAVTTFLVAATTGGSSPPFLSIRHTYSSNILFSARALVVFFGLVPAVVHHPRITVLRELVAREDILVCKHAGERPSFRVESARELLRWQREEVSTPPPFFAPRCPRTTRQNLSSKKKKKKKTKMDCGWSHQGINPRLLEK

SEQ ID NO: 969983 - protein, 81 aa, Homo sapiens
RFGPDRPWVQTPGPALPGDVLLTRRDALETYEGLSLLVIDLRAQPNGCRCRRLALLHYWPRFPQHDLDIPLCGRAFFHPEW

SEQ ID NO: 969984 - protein, 192 aa, Homo sapiens
MCAPVAPRQPTAIRWSPQPPAFLWAPRVAPPFCSFKEEGESPPALSRRPPEPLGPADQSELGPRPTGGRNWRELGRGTRWNPRAQRLRRHPDCQKVPEPPKGPFGPGKALQRPRPTPGQPASPWAWPGAPEAPPGSPSLRWSPTAGAQSLPQDPEEDPGRPGASEESFAPNGECSLRAGVACLPCACALSPN

SEQ ID NO: 969985 - protein, 265 aa, Homo sapiens
MLVSAVILYRRGGGGAHHRCVIVPSLVRLPSLDYFLRVDRHFNYDLFLGVVAPPPSLSCCHINNPSQRCCWWRPPPPSAFLLPPATTDVSPLVFARGGGCCYTINSESIFRLFLPLRIVCGDYFCSGEIFVFSLAGGGSSHTFVVVVYSSCCLYTHRGEVSLCRVLCVSLTQRHLSLFSQRACVVCVSPHRGPPSVCEENFVSLSVCLSSVATPHPPLPDTPRGAQRGLPTTMSRAVPPRARHTQREESHTPWTLLCEEKKRERV

SEQ ID NO: 969986 - protein, 121 aa, Homo sapiens
GVVLFFRSVFPFLPLKLMSFGGTLASSQTSWAPIWRIWKKWGQPFATISRAGPAAFLAPCPIQQRWATHSLCLRWACGSLSGAQHLLPLCTTCSVSTVPALRAQGLVLGAGGCPLFYILFR

SEQ ID NO: 969987 - protein, 121 aa, Homo sapiens
MCCEHVLAVICPPLLCCSAPSRHPSPAARACSGTERGVVTKPPPVWGALPFPPLRSDIVSASPPPLLERHFLETPLRGNDFLSRFFSPLGGVEQRMLFAPGAFFGRAPQPFFIPLGHHPPV

SEQ ID NO: 969988 - protein, 111 aa, Homo sapiens
CSEMCAPSGAHPKVDPTAWSVLRTLRPRMTTKGGRISVQQPTYGEGTTGGPHPPGGPDRGRKNQRLEVTQRCPQTHRDRFQYLTLKKFDAPQRGNPVLKWLTGMYNTAALH

SEQ ID NO: 969989 - protein, 174 aa, Homo sapiens
SRKVFLEKVLFIPPPSPVENIWSPVKGEGVFLGKSFPSAGSLPKDFIPPPPLLWGGGQTTCCRALAWTARPRGGAPKYFFYSPRPALFGSCYPPQESLFGLGFLWGNFFNPQPPSCGDTRGNFLLKRYCPPFPPALGYRTFFTSKKTPFVWGSSPHCAHSLRPRATVPSVTFIV

SEQ ID NO: 969990 - protein, 84 aa, Homo sapiens
KTSLPRPHSGIFGQKVTHPWQANAVDVRTQTHRGPGPGWMVMGCPTQMKVFSLTQGDQSSFAKGLLYLFNICLPNWDNLMYQID

SEQ ID NO: 969991 - protein, 174 aa, Homo sapiens
SVRWCAQCHVSVSLMPFVCRRGCSSRSGVHNSPASPFLAARGGPLLSPLWFVRFPVRCVLFIDSVWGFFSQCVLFISGKKTPLGIHRFWFWALSLHLAFLRGFLPCGATAPYMLSHYWTFVVFVSSSGHMCSSSPWRFAVVLPLCLSPPGRSQSFFCPGALPPPCPGGRPFSAN

SEQ ID NO: 969992 - protein, 59 aa, Homo sapiens
ATIVSPPRSVRRGDPTPEGRRGTSLARPPNPLGGKGGPPPPTEVWAPPPPGQAGGFSPT

SEQ ID NO: 969993 - protein, 186 aa, Homo sapiens
GFNKPAPSFAAALPWSPLRGPTPPTRWCGAPPEGRHPRGRVTPSSRILFTVMRRRGADDTQFFPTRVYTPLVPPGALIVGGTALCGDPTVVCSLSRTQSVVFARVSRSFSPGIFCCSCSPRLSSAVSTLSGRISPSRGLFGVRALVVSLPPAGLLVYNFQVSSVLCCTTKFVTKNRGGACLAPREV

SEQ ID NO: 969994 - protein, 231 aa, Homo sapiens
RGIFLPGCYFRVGTHPRCSSAVWEMKCHPTAEALVGGGEGVVFLLGGGPQICCGGALSPKSMTNRENMVVVSSHKRNGFLAVTPGGPTTLLLLWVGGTAPPRDVVSPPPPTWGESHTWGLFSTVVFTGWNLIPSWAPSPSRLSHFYVFPAVFIGPPSLILGKFGPTTRGFHTPVGAQGHRCVCLEGSRKRGELEVFVVSPPLCLGGGIEKNSGRKIWAPSQIFFSENYSLV

SEQ ID NO: 969995 - protein, 289 aa, Homo sapiens
VSPTKRPCADDERLIDHLVHDRGLPRACGRFPLPHAGDIFGGGGRPPCLVRPPTLCLFVIDEATFLWGGQKTSVARPTSDSVLWWAPALAPTSSVVLAVLLKTVGWIENPHQGGVWSPPPNNVEGGRDTPPGWCVKDPLFGGERRDEEEDPPWWGAPTNRSSAAPVCSPPHTTPHGGFYKCPLPPPTSAPLFYLTGSAPPTSGGDTSHRGGDTPLCCLCFSPPKRWTTLPRVNPTLSHPPPLTHKGSPPPCERIVGAQPPPLFFSLRAPPTYGGPPPPLSLCGFSLSAL

SEQ ID NO: 969996 - protein, 155 aa, Homo sapiens
MIRRAPSREDYSSLLPPPYDETRGFVRAGFFSPRGVVLLLLRAVAPPPLLIFCVVDCSLRPPRLVSLFSFSVFLLCPSCCTHSCVGRQTPSEVVVWRHAIIRVGFGLRALSRRTRKMSVVHHRAAPLSSSPSLCILSVAGRRERREKTNLPSVVW

SEQ ID NO: 969997 - protein, 171 aa, Homo sapiens
MWVVVCPPPVGRHTTERLSRACDCRSPSFFLSSTTLGVVAARQIWCRPTTRMNVGKNSWRQQRGDAQIFTEEGSDAHPTVDGSLLLRSLTKKRMFCSSSGGDAKRAAPPGDKTKRGRLLCISPPRRALVRRGVSTCRPEVIYIDHCPPIDAVTQDEHMVVYGAAPGRRAHV

SEQ ID NO: 969998 - protein, 72 aa, Homo sapiens
GTFLPNFPREVSREVTRQVQFSLDHGRKFFGPGSLKEGTTGEMPSPRYPGVLANHAQTQLFLPEGDFYPRPM

SEQ ID NO: 969999 - protein, 114 aa, Homo sapiens
LGWMFLVPLGRPLPIVVLLHLWGTFAVPEVPWPAFPGYPRLFGGVSEPPGVVPPPPFPTEAIFYGYTLTRYTLCAVVYTAQVFLSCAYLLGLICLIPMLTTPQGELLTSLQWGF

SEQ ID NO: 970000 - protein, 145 aa, Homo sapiens
GPSGGPTNYSAPLFPGRASPPAKICCALFCRGTFLSIWAICVPISGALLASRDFLENESLRPYVAFCLWRILGAKRPCCLRRSPPDFLGAPGAVFAVLPLYVSPDHFSEGRSSPAPRVYHYVFSAWLLLRYTGRPVLPFGVFVFF

SEQ ID NO: 970001 - protein, 306 aa, Homo sapiens
SLLGGGQRHTRFARVPSRCLCYTSSAAVPSSARPLFGCGGPCCYRRPPPLGGSLSAAVYGCRLSPTYGAGPPPVWVVVRSPSLPEWPLPLSPRRYSFGGDINLLPPFPGGDVFFRGCSLLHATQQRFSLFFLHRALAVLSIIAALAEWCFRSRTTRTKIIHLCEDVCGIPPRPPRLPSHSGAVPLYMMGHHSLPQGLSDAGPCMKENDFSPRVGPLYDESFRIYSACYSCLPHLARRVLQTGGPTLLINRSFFIYNKTKIIFSFAGRSIPPPVLLLFWGAPPPFAPPTNFAFFFFFFKGGVFFIFP

SEQ ID NO: 970002 - protein, 207 aa, Homo sapiens
MHRTGPQHERDMTPLQHPHHCRQLEPLCASGSPPPDELQPFAPEQIGGGPRLFHSVPVGSCPVRYPVRGGGLHPALEDPEMLSRLEKPAPARFALGSPVSEPPAIIKDFPQPGIPGARHPQGAAAHLRRGEIQHRISARFSTASSESRRLTGLMDSPTPRPSCRCLPLTMLLGPLPPHCSPRTSPAPSFLPHEEGAVVSCCLLGARL

SEQ ID NO: 970003 - protein, 131 aa, Homo sapiens
HRVWGILHGGVPFQCLSRGPLGVRPIICPPPPRHGSCSRSARPTFFRGLMEGFETLRSCAQPSQRREALLAPWTPQRGCPAIVWAPRDRPPLHQTMHPGGPYPQATAGGLPDLRRGLCPKKEGPPSESGNF

SEQ ID NO: 970004 - protein, 112 aa, Homo sapiens
GLVFAHMPFRGECAAPDVVTLIFAPVFWRQPAHVFRMWLLLGDPSRPFFFSVSSARSPPPTQLQQVGCSDLPSSHTLRLLSPSPLPHQPPPLGAPHFGPKAMPCRPTSACAP

SEQ ID NO: 970005 - protein, 138 aa, Homo sapiens
GFFLFGGGVLRGQFFVACDLSFVLFVVACSGLGSCWYALLGFFCLLRVCGGVCLLFSVRVSVGFLFFFWWCEMFVLVGIVAWLVLFWRLLGGCEVIGTCVVVVFFLDSALCSLGSVCLSLLCYLQFVVFPPLFVVFPR

SEQ ID NO: 970006 - protein, 298 aa, Homo sapiens
GFPNAGFSSISLGGLPPLFVVSPPPSYPAVSISGVRIVLAVWPPFCYARCAAHLAALLVSVHSLFLTAGLRAMYVDALLRDVLFPAARLTIICEEWLLMCGATRSHSLIAALSLFVDDAAQHGGVALIFLPPFIRTLPAMIRWWSRTPALGCEFSLSLEWSHRRLLSRVGLDIFYSYLALTYSVAPPYFSFVGTPRGRCGVSSSGAGSRSAVCCFSSAVVAPSSCVLKDSYDHHEDVLPFYGRCHPTKWGYQQEGHFRARLLITPRPSSPANRPRGFFFRGSYFLNFGAHPPLFSPFF

SEQ ID NO: 970007 - protein, 125 aa, Homo sapiens
MLLLPVWKSFSASYEFYRYFENSATQSSTPSVYPKLHQKSRELDNVLPTTPVRSLPAPICKPLLNEVIILEDELEKLVCTKETPELVSEAYPLLGQEILSGFSPTFKPATIAGKRPFFRSTNCYE

SEQ ID NO: 970008 - protein, 136 aa, Homo sapiens
MLLLPRGAQSCWSTSRGRSVVCGCPPSACTMVCVHQITGPPGLGSRSLARDFLSARVVLLPPTPRSRALVFLHHLDLFVSAPSSTHPCGCDARLLFLMMILGEASSHSVDDAAAPLPPGMFVVASSSLLCCRLALL

SEQ ID NO: 970009 - protein, 254 aa, Homo sapiens
MSGFVPRPDAWLLLLSYTAVSIPYYPAYPRCTTNLEFESLEHSAPSHEASCPRNLKEGHQLETGKEKGHLRCPACPTALLARGLCLCHTCPGGRGGTRGSIVAPETPDPMLSPTKWLPIVASTLLSFAVAWLGILGQFPPAPPCLLLPRSFPGPTRCSSCPLCCRATAALEPLTLSEPPALHVPLIAVSLPTPPWPRDPWTGWGWGVCPLCSSQEPQLRMTRVPIRQCFPHWTSFLVFFCHTLTDPFIHINHSN

SEQ ID NO: 970010 - protein, 133 aa, Homo sapiens
MEGKIYITLPRTIHSTALEPHPTVYMEMRRGDPPKFRDHRVCPQFMETLHTPIEKRGHAGVKEVVIFPLDRAKEMALLGEIEETTAEIYVALAHAPPRVGPFSHATTTEKNRETEGCLALTQPTCVEDHHPRR

SEQ ID NO: 970011 - protein, 136 aa, Homo sapiens
MWVVGFFPLSSPPGGWCQPPLLLPEIDIVCVGGSSTPAPRLVISLLLSCGRVMVRRKNFLRRKGRSPCTETFGSFHEHRKTVCSFMYNPSCVDHTPGVVFRPAPAVVEKGWGLYPPSPRGGNPTGDICGPPTPRRK

SEQ ID NO: 970012 - protein, 107 aa, Homo sapiens
MRGASSEELLAPCLSTSLLLEKEEDQRFEDPASSHGCLKTPEPFTGFNFPSPPIVPPDSSVSFSPLLTRDENICNYSPPSDLMREPLQLSEATRNVSRRTTISTWKG

SEQ ID NO: 970013 - protein, 107 aa, Homo sapiens
MRTYCQWAYSHATAISGHTTSSLRGYFHAATVTIKGAQKVINSEKPRWVTQNAHETTECEKHFCHALCYEKRKPHATQWRYKTTLETHTLWWVVHVAPFTRYLPSSL

SEQ ID NO: 970014 - protein, 393 aa, Homo sapiens
SRLAAPPPVCVLWRRQCVSRRASGFWSGGLPCLSYFSHIRLGVFPSGTLCVWLISPPYSPGQSGFFAGVVRPTCFVVAVFCLSPLLSLVIVSSLFVVYLLCSVLRVVLCSFIFGLVSFQYECFIFVVSAVLCCFFFLFVCLFLCLLLLVFARVSSPVCSLSCVGPLRCPLAVLFWVRAVPFFSAACASPSLLVVLPPLFALLLLAVSLSFSFFSSLRALSSPRPPSALPLFSLPSFLLPLLLSAPPPLSSRSLAVCSSEPRSSLARAPSLAPSSLPLLPLPSPSLSLCGSAGARPLLRAALPAPLFSSSALFLSPLPLPPSLSSSSPPSLPLPSLSLLSLALSLSLSLSLSVSVAAPASSLVFCCFFFFCATTHTHTHTRTPTSPTHLTTHTT

SEQ ID NO: 970015 - protein, 116 aa, Homo sapiens
MRALLSLTIDIRKYEKFAPTLQQRVGALAASDSPQGTTGGPGPRQGHGGGNLVAVYTPKTMMMTRMAKLAAWPRVHVMLARLDLVPWGWGRLPRRGNHGVRPQPAPFSRLNRSATV

SEQ ID NO: 970016 - protein, 112 aa, Homo sapiens
PSAWIFCLPMPQPPRVLLMSRGSILPSDFCLAPGGVYLSPSSACFPFAVFLCANTLSTLVCTKTHRWCVPCVRDFPPRAFSGDPHRRPLPRGCFFPFPFSCNAALPPGVFLL

SEQ ID NO: 970017 - protein, 319 aa, Homo sapiens
VSLSVSCCPSVTSVSCGVGATTGLTGTECVPYLWCDLLSLFVDIISPVALLRVYSVIVVRHVVLDHGIPFELAAAFRVLAGISAPPCSVIWCGLPGPLAFFLAPPRRGAPGVQLVMMLSPGAGGHLVPGPISPELFRGPRHLGFGAELRNCFMGYKCDFLRLMLPPSLKPPDSSPRGFVIVQALLSFVSPGTPCAYSVGFRYVSCARRSEAPPRGQQAMQQQCANGHVLLYSGRASGHVVPCFYLCQGILLFCLLTPFRAPPSGRASVPLHSGTSVVPPACTGSTWPGQPSGAGVGREGCCLFQLGRNPFNGPLKCLCI

SEQ ID NO: 970018 - protein, 115 aa, Homo sapiens
ARHVSRWWERSSSKRRLRPGVSSRARSVGSCPWVVVLPVSPRAPRSRFWCTPTRFFPPVTPSLMCLLRAAGLFFFCFPPDRGGYHLPSLCLSVVCGSLTNVVVSVRDVLLSAALR

SEQ ID NO: 970019 - protein, 424 aa, Homo sapiens
LVIFALIFSCCFCCSFSCIVSFLFVWSSVCFFSFFLSFFAVWLATACLILSVLLSFLSFSLVAPLLPSAWFVCFFSFSLCLVFVFVLLGAHCRRALSGVGYNQNFVLWDPLRFLSWWHALLPTPCFWPPPFEKNPPGSRVSSPSWIFTFGPRGRGVTEVATTRDPVVIAPFGRYFNVTTYEQPKLYPKNTVVGDPRPANFPRDFFPTPTAVPPRGTPRLAASPFAPRPPPGPLRPRGSPSRRVPFCLLRLLGNSSSLGPPRAAGPAPLAPFSAWVTTRWAHRTAGPHTLPREFLGFLRLCSRPRGSTPREPLSRVHTPHSPREWHLPHTPLYGDATRGVFRAELVSAGLRFRYEIWRIRPLKNVEPSQGFNVTILAPSPLLRLRGGLERRSPPTPPPSESTSAGFLYLLGGAHVSAPRGFGVPS

SEQ ID NO: 970020 - protein, 71 aa, Homo sapiens
MGPAWTLAPATLVLHPATEVLPPPLLLLPLRRRKWKAKKEESQESDDEHWALVFLTKPLYNHVPITKLNLL

SEQ ID NO: 970021 - protein, 173 aa, Homo sapiens
PAIHVHPGLARQQLLSCLNWPHKYQTRDQAREETRDSLAPGREEGCWPRGRPHEETPCPSSRSYTVTPLVENQKAQLVVIAPDVDPHRAGCLSLPAPVSVKWGSPYCIIKGKARLGRLVPPEDLHPLSPSHQVNSGRPRRFGLSLVEAIQDPITNDQITIEIPPHWGGHSPGS

SEQ ID NO: 970022 - protein, 217 aa, Homo sapiens
PLSAFWAPHSSERSVPPTTPAGCPASPDFPPEFCPATTAVPGRPSLFPLSPPPLWCALLSGRGGPPPPNSAAQGYRAARYIAHTARLLALLERPCALALPPFVRRAPMIITDRAALLVGPPLVGGRAVVGETVPLTFCCCAIFGHRLAALPVGDDIPLSPAPSSSTNMSPAQSRISPPPASCRDRSALLLGETFVVPTPAYFTPPPGGADHLIVGCH

SEQ ID NO: 970023 - protein, 101 aa, Homo sapiens
ELPWRLFLPGMRYDHIMGGCLCLCCLRRRSSTIYDRGGCSAVAFSFVHRAASASPGETPFFFARVPHSFVFVLLLMYNGGGRPSPQKVVSTSRVFSNRVVV

SEQ ID NO: 970024 - protein, 189 aa, Homo sapiens
VLPSVSRVLCVPVVPFCSLSVRVFLPVLRVGLVGSLLLWCCSVVLCLVGVVAPFVRGVVWPAASVAPALCRRCRLGGCFGASVWSRSPHVSRSLVARSLVVLVVFVVVLAGGGGVLITQEVPCFRWTPFPGCPPGGNPRHSPPVVLDPPPFRKTPRGPRCPSLSGGLFKPFRPRRGARELNESGSNSTG

SEQ ID NO: 970025 - protein, 106 aa, Homo sapiens
SSWLLVLQSSRVALLVEVQSSLVVRATEVVVVLSVAACCGRDVSFLPPAGVLCLFSALLCFEEASLTYFAHERRGSFSIIVGTTRGRSCPLGEIVCAPLCVWWGRR

SEQ ID NO: 970026 - protein, 167 aa, Homo sapiens
MRMMLSETLMVVAEPDDVCKWRPTGSPMALYHQGGSSLYLVTYSPLGPPSSPDLKKGAPDLPSGLRSISRSFLEEPEEALCSHHIPVARSWLHGKLRNRMREALRPPPTLPYRVTRPWLKDGETRLIGHTSCSPIILVSEGEADYPDPWPHFPPLPFEYTSEGFWHG

SEQ ID NO: 970027 - protein, 182 aa, Homo sapiens
MPLPAPDEAKDMRGEKKEKRHVVCKSGHLRTGQMSSQEAGLLSQKISFRPLTHFPKEERRKKGIIPFRRVREEEIEVGFTSCGPLPLIPARCQPGDWGERAHQVLKFTQGQSFRHEKPRRSGASYPGGSISVPGPILIKVDSEDLRPIFGEARVMIGDYLLSPVDLGTLRSLGEGLDEDQKF

SEQ ID NO: 970028 - protein, 226 aa, Homo sapiens
PQFLPATSCSTAPSPPTGQLMPTPEFYRRRLGSHSQQQLLQPVPSAPGKPIPPPPQVLPQADPGHWWARFFFGKSHPPVHGTTVLESPEHSGPPPASSSMTACGLARDAPREQPGGQSSTPALGPRPDLSGYHQPQAFGGASPPEPLLRPSSPLAHPSAPLPTSHPPPLLTEAAASKQTLLHQPQQDNPKPVRAPLFTARPQHCSFPDTWNCAPGTKREINSQQPS

SEQ ID NO: 970029 - protein, 357 aa, Homo sapiens
LRPFRLSRCFVFFSCVRHRAPGVSRSRPVFAPAARCFCSLVVLRSACSGRLCLLRCCLAVFASRPPAACGGVLWFVLGGAVRVMFVVRFSLSVGLVCRLSSRPVRLGRCCRLPPRGCPALACRLSAFSLSPASCSLFSAGLALPFFSRVPFLCFGSPCLCLSCLFALVACAVVSPWGGAIIFNAQRLLFMVGTAVQASPPLGGLPNSPPPWCVGAPSPPIVKTPPGRRVPQAFPRGFFCAMGPPGTRIFPNFLTTQGVPALLAPFMALYFMVTPRSMAPSVVHTKTPRPGTPVSRRFLPAEYSRLTPTAVSAPPPEDPKDWPCRRILGPLSPPGMPWGHRRPRAGPCPFCLSGALRL

SEQ ID NO: 970030 - protein, 302 aa, Homo sapiens
GERFVRVSCCLRCALFLLSYLPVVFGAAVLVFAFLSVFLRMCSFVLLCPSVSVFVFRLIFCLLLLCSLRFLFVRCVPPRTVRCFGRPLLCLSLVLRHLSRFPLALSLSVSGVAVLFPWLWVVVVVLCAFALSPGCLCVVCELRRLALVCLCVFLDVCGVFSVYRFFCLWFGVLLFLVAALVGDCCAPVVMGCVVYVVVFLWCMRAWVDSASISVLGAVCLWPWLSPVSSVVFVRLVRLWSGLVVFDFFAWCTRVWFVCRVLGGGGVFVLSCWCCVAVGGLGCWCPSPRGSLPKRLVLVSFLS

SEQ ID NO: 970031 - protein, 119 aa, Homo sapiens
MVAELNPPRGRDTLVYNYSNAGTHCTVVRPHAVLAHDHAVFLGTQSADRVTCLTLGTHNWYKNGPYREAHCLSHTLRHIVGEPHKNEDDLPTPPPTSQNTKGGNPRYRLPMPHATSPPA

SEQ ID NO: 970032 - protein, 194 aa, Homo sapiens
NSSHQPTRETEKDRERERQRRNIVSCLSIFCDDYHCLFSLCVSSTILLVVVFLTIFYRWDSSAHSLSFGYGFSHIIIVFVCVFPPEEGLLSLLFIHKGRHTRLAGVVVRRRAHAVRRGRASQQSVFVFCCTPPSSSFLLVGTLHNLCFFSSRKHDQSQLWGRKFFSDVVLIVARGRIQCAICDNSLKWAFIIVL

SEQ ID NO: 970033 - protein, 170 aa, Homo sapiens
LARARGRTYLACCVMLIVRRLLIKSPLVSPVFYSASFVFWLRILSQRWLPAIPVSTPPAGIFFPQYAPPCSACAVARTAPAILSGTPKAPISHMRTYIRVKFVESLVDPRDNHVARKPKCPLLPPLEADKNTQECTGVTPVRGLFPGYHQVPFVSHGPSIGMSQGSFPGP

SEQ ID NO: 970034 - protein, 178 aa, Homo sapiens
RPCVFPRLVGSIAVCCRCLPVWGVCLCPLVMRMVVLPSSIWGGWGNKGDGPVPFRQAALHTRGLLGGSLPPFVGDTLRWGPGPQRYRLALLTPPEKGGISRREGMVLSPLTLLPSLCEPDEKCGRRCTQGFFQTFLKGEHPSWRHKNGLSVANSGVKDVCVPLLGEVYAPRSSYRELC

SEQ ID NO: 970035 - protein, 105 aa, Homo sapiens
LWFPFFCPIPLFPPSSVVSWGLEGPVVFHCVFSAPWSPPAFCQPPCGPQPCWPGRVPPPTYWAYSWVGPVTPWGTISCLPNRGPRNVVPGSVSNPKEYLPPRLAK

SEQ ID NO: 970036 - protein, 184 aa, Homo sapiens
MENLYALYGARSTLRALHHICRSLPCGDVFSRRTWGHKTRSGSNSPFCPGGLYPFFGTHRTNIHQTSHILCGSLGSFSQAQEPFPFSPESQNWPGVTHRSLIPPWPGIPGIPGQRQCRPTNSMVREYLCPGKGAFHSNVAPSPSNTQGTRILHSEQSPCHHPYACPATWPLQGDGGHLRKLNPC

SEQ ID NO: 970037 - protein, 401 aa, Homo sapiens
RGCESVPVAVCGALWFSLFSAPPVAVFVVLFALFPQEISGVLVPPVFVLELAQLAALCALLQPAVLVRDARLGGYPPRLRFFSCQNCTCLLIVGALGLWGPPLGGSPLYCCPTVDRQGVLLFSGGPFLIVFGGLGNVFPTLTTHRVFVWWVGFTRLSGGDHPLGLPCVCAPPTLSQSPLVGEQPNLSREGYWGAPMVSRPCCPGCLVASRVFSPPFRTRPCRVRRGDTFLPPRGDPPGGPRPPSGGHLWLPGEDSLDSCVPVPPSLCSTTICPPVPTSVTPQRVFPPLVGPSTVVFYKCTTPYAHPGHAHVALVPQCVCRLFVLVEWLTGSVPEVLKNSLCRAPTRLSYFPWSHRSSLCFSCVGARSPLPASPRPLFPRHRHGPLPSVIVGRPGLDTLLHE

SEQ ID NO: 970038 - protein, 140 aa, Homo sapiens
MTTYPFPRPSLSTHSSGPLVSYPRLVFTDFSLYRVVLPHAVGCKGVQSGRAGAHDTSPFKSCLPGLLSVNTLLSGGRHASLWKIPPTWGVFVSFDPRSRTPLFTRYILFFGHHTTDSCTCPNALYDVFLEILSPPSLSTR

SEQ ID NO: 970039 - protein, 234 aa, Homo sapiens
YCPLSAYFMVPPICTRRCGPQKHRGLGLPASRNFPGIIWLGPPRFSRSKLCSLAGPPLARLGRPQCMPSIILEDPSRAPGRALPCWSRLLRRCQIPPRPLLICDAAICSLKTIPEVYPPWPRRLFCPDTQVARETHDHPAHGCERERAIEIGPHRGHSGQALLPSAHFAQARPLAGRPSGRPEFFYCDIDTLALRWLRWRGFPLVQTRVPARFLVQTILSFPGTTNSSVKIFFQ

SEQ ID NO: 970040 - protein, 176 aa, Homo sapiens
FSALRLALFSLPVRHHLEVPGSPPVVDPRSGPPWGPLWPPPPPPREFPLGRGNIHGVANFFQRTYSVLPVFLSEFTEGAFTSSSAPLRGFSSLPVPGYSDAPTPLLRPMLDCGAALYIEIPGGALPQGTQDQLSPVSLEFFWGPCEPEPMSFSFAFPQNPGDRAPLALRTLSVFGL

SEQ ID NO: 970041 - protein, 155 aa, Homo sapiens
SHKRSFPARPAPNWSVNPAPRVSPGKLDNQMRTSKWIPPAQCGLALPGTALPCVLRHSRGRCPHPAGDRPLKPLFMPGTAPTGPCSCLGQAPGPPLAAVSSGRLVGEGMDPPWAGAGRTRPIIGHLVALATPPGCLRLKSVGFTELPLLHLAESP

SEQ ID NO: 970042 - protein, 84 aa, Homo sapiens
FPPPSSLTVPQCVTGVCHLGTPGPTVATVLTRGRLLRGLPEGRLGTARAGILASSDFVCLDRWKLFLGVGQRERPWLTRGLLTL

SEQ ID NO: 970043 - protein, 282 aa, Homo sapiens
GSPPPFVPPFPYGLFSLWAPRTWVALPRSRSFYGRGRRPRDKITHRGACFLLGALISGRPPPPPVPQELPFFSREDFLFFSAPPRGFFFPNKNLWAVSTARRSPPRPLLLGGRCRPPTSVCPPRYSPLRVAPLSLTTPAVFLRSSGGVSYLPRGSSPCVLKKPPPPPLMFYAALLSHTFLRCFFVLLLPSLRAESFGGSPSPSFAAGVVRVDPLSFWDDQRCSPAFSYLTIWVGHRFPAHVSFLRAPFSPLTPNTPLFNPPPFRPFLNGFFFFFFSPFFWGV

SEQ ID NO: 970044 - protein, 203 aa, Homo sapiens
MAPPRVQLSLTFNPVKLTCPCKARALPPPDDEDPYGAFNLLIPHQYLTKPPRSPITIPKPSPFKNFPVWGRPPDARDPNLRTPVTIAEDFPPSPKPNITITPIDPNNLTHGTSYPRDNRAILILESHNPHQLGFTDLDSWIQDHPQWSQPAIKGSFVQRLKSYVICVQTRSNPGPVSILLPNSSLYRKDQRNKAYFTKRLPPL

SEQ ID NO: 970045 - protein, 284 aa, Homo sapiens
CFPRRGGPRFFRTPLFPGPEVGAILVPWTTGVNFKSRTLGPLARRRFGLYGNRGATQHLLWDPGSFVAPLERFSARHPCVSTAAASFETLVGGASGWLSCCFTRNILCLAKYPPLFPPGVFKEGEVLSRHTPVCFPTGQSVFLLHPPRFPSFRPGSLTSGTPHYDRGLLFVREGDPPADPEGAWGCYSHGENSAEDVERTHAPFLHGYPGVGEPLLGPRASAPALLCAPHLSSAGHTSVVHNFRRSEFSPRGAPPPEPAPSKAAPLQPRGRATFLEFEFLARGF

SEQ ID NO: 970046 - protein, 211 aa, Homo sapiens
PRRVRWGPPRRLRGEVIICWTDRSILFSRTVARGGGVCLRLWAEHWVCAWVSRAARLVGRSLRGTRVLGGERVAQTALLPTRLWDRGRARPPAFFFCGRKRTAVSARDHRGGCAPLVILPSVNNCTASWGGGTAATPAGGVVVFFCDDGEKWFVQRRLFFWGERPPTGGPPCCVCVVARSHPSPRQHWCGGRRPPPCVVGGGVLPLPPAWW

SEQ ID NO: 970047 - protein, 157 aa, Homo sapiens
MQLPARITEFQESKRRSPNPVSRFVDEDFQELEENFSASRTPYCRRRSTYEEIPDIRILIPPKVPVYQLKYVPPNKLGSLITGAICLDILKIHGPAAMTLPPRYYCPLPATIGQLQSPDDPPDAVVANPVTQPKSPECSKPDQLDFGHQVYSGATRF

SEQ ID NO: 970048 - protein, 362 aa, Homo sapiens
CPLCPVRVGGRCLLRASGFKVVHVRGVPRCSQPRRVCCGGPLPGGCTDRLLCSCEAPRRTYWVVDGHFPLLSAFSRLFVSLVAGAPSFAIMPRVGVLAHEPLCPALLSLFWAAPASCCFVCVVPPRELFFSLGVGRVKPPVLSQSSLVCHKWGAHSTEHHHAVVVCTLSRVKNGLVFPAASLHRLLVSPSSRLPRVSHLFRAPRVSPRSVLWSPHRCSLRARDPRSVSVSLAREMFSLYCGLRFNSLVTTGSPRGPVAPRGAPRTLISGRRLDCAPFSLPPYPPGSPPPLCGSPVFGPDSCLPPATFSHSPRAFSPPAVRQPHFVGEPRPPLGIFSSLWGPFYFLSMDLLRGPCPPPKKGFF

SEQ ID NO: 970049 - protein, 406 aa, Homo sapiens
FFGLCHRCVSHNVGHSCPGDGPTRCRLREGSPDLAPGGFFVAHLPSGPPKGTVLSSRPIRGGPGPSLGCAFQPFAAVVSAHPRRALSHLLFEPRVSHTWAPDPYESCRTWIWGNRCSSHLGPPFLGLDAFLTELRCKTSVVPSPAGGTPASLLLLKDGSAPAALSVEVGSSPQDLCASRTSGGEPNLSQHSAVTTDPTHGNSETTVEFKSIFEVVPLCCYPQYTAGSWATVHHSPPSLFYLRTLFTNSPPRPSYRWSLHFVGPQKLTHVKFLFFGVLTPYWEMIVALVCCFVQQVSRPRAQLLDTSDTTFPAGYTRHTRASNVNSYYHPPTFHSHMVASPLDTRWTGDPVARHGTLENPRDDAQCPGRNSPGTPRACTLTVLLFWLFFVVCFFCVDFVPGQIFPSE

SEQ ID NO: 970050 - protein, 153 aa, Homo sapiens
EHLNLHDWLVEEFLVARRVLSHALISGAKKLPLECGPHPRYVEKITTAGSLYREMRFQSFARSTLLMGTNRFNFWKFRKGGSVVWCVWCAPLFRVSSTGVFVSWCHTIFGAGAPHIGAPRKGRSWKKVPREPQFEVPHNRLPLPHPRVILGFL

SEQ ID NO: 970051 - protein, 310 aa, Homo sapiens
QTVCPALFGPWTDVRRTGWPSSDPRILVPGSLSEESSPRCPAPAPFFVLRGAADGDPLAVCPRVHAFLHSLLGVPRSRGELGSPVFCAPHTVPGLYGGPPVPPSLPFVVGPPLGVPRLSTGGGSYRANLTDGVLPGIPAPCRDPLGPCPLGWSAPLPRAAGVARVPGPPDVSCVVDIPRPALQVARPRAEHWVTFLRCFTRDTRCPPGVGPPPEFSAPGFPEGDPCRGGAPCSQLWHPVPRGLPLSRRPFEFRGPLGGPTKLAQIPWVPPIKPFPGTTPCPPGCASPPPRGFFLEKIIFFFFPKKFQATP

SEQ ID NO: 970052 - protein, 232 aa, Homo sapiens
VVSTIFSGPPWMADAPVFSRLEGGPLSAPFAPRADSAPAVFLPQRVAPAPVSRGVFVQPSALCVVRPPALFLLRGTLLFIPHTGVYTDSLSHTGGVFPSPARGPPLAPSWRTDCSTFCPPPPLLMPACSLPPRPHSTFSGRSCRHYFRRLFCVAAESAAVLPRSGRSFLRRGRDISYSFHYREGAPPNQALLLEEGKTAPPPFCGVFLVCRFFSPWQPPTMQCGGSHATPRL

SEQ ID NO: 970053 - protein, 190 aa, Homo sapiens
ILRATLLCVSDLVDVRGRLGLAAIRWAVSRPLYLRASFPLDAPSSARFPMPPIDPRAIPPWPVGIFQVVPPRLGTFYQRTVCFEVHPSIMRRHRRSLALSPAGVHGAISAHCNLRLLGSRPFSCLPLLSELNYRKLSLAFEENDPATIQDYPPWYITDFVELLGEPARDNIPLSNSVPTTSDENFTRYTD

SEQ ID NO: 970054 - protein, 207 aa, Homo sapiens
PDFFPAQQFPRPFSLAFLGPIGKVCQDRRGPAPGLRGIFSLPPLWENSGLLHGSPANARGFDPAFPRTFRIPPRQLWWPPSWNATLLRGVTPPLGFSSSSLRREEPPLPSCVTMPAPLAEEKGRETPVCYPILRTLPSARITLSGAPLVGGPATLPVVVRRAPYIPAPASFGAPPFFGPPKPSLLLAVCLGFPSPDRHLVSSFRVPL

SEQ ID NO: 970055 - protein, 89 aa, Homo sapiens
NPSGAILPAIDPSLSSPVAIPSSDPFTIDQDGGSDDPLPLPIQNPIGPPHGYWNLQKYPDFGGHNFRTSVRYFSPIIPRNPATCKLLDA

SEQ ID NO: 970056 - protein, 126 aa, Homo sapiens
RILVANDTGFTVSQPGKEKALMESSRHCGAHLPCYGSRPYRPSQFSPIKAIYFEPRLQPAKTWIMVFWWLATALKDANSNHQPVLARPKPAGVPRMGLEWLCKNSPRPEPTPVESPTSSQLPPCVS

SEQ ID NO: 970057 - protein, 105 aa, Homo sapiens
MGVPGPPRSFFGGKGVPLGAIPGGVDVPVLEKSVLLLGGWFLPYGPCGSPSPPVFAHEGHPAPSFLPGVPVFTESGLWVCWPHALFPRYPKFLPLSPNPGFHLTL

SEQ ID NO: 970058 - protein, 114 aa, Homo sapiens
ERRAYSRKPSDATNMGAETGGRTGACETRNPHMGTISGTQPGSDEKKCFRRETLERQQQCPVSNSEKAPSTSTRGNQNGCPEISEKVVDPRANTATMVVSGVAGLKMERTLSVI

SEQ ID NO: 970059 - protein, 169 aa, Homo sapiens
QSQTPRLVTVCGPPERPPTRAPELQGLQSDGEENQPRPGDGAALCSSDERVLKDNPEPPLEGDPREPANWRSPSSPPGVPASSQWRNQSEWLSVPGCADEPPPLLTDGPFGGPCAPPERPGAPGPPRGFGGIPGFPHSSCSWASGEERPPFPWAALSPGLVLFLGAFGQ

SEQ ID NO: 970060 - protein, 212 aa, Homo sapiens
FSVSLVVVSCARFLSAVLLLTVSCRGCGVSVWGCALRWCARVVLVFCSPRLVGGGVFLNRNLVFLCGPLRMLPLGWAPLISPTPGVVGPLPDCGETSPRGVPDVPSLSPASFCTLYGPPGGAGVHPNGVPTHTGTQRFVAAPCSRPHFFRGEPPFFCGQPTRVFVHPPINSSPGRGVIHPGVPRGDFSPRGGFILVPGTAPHVPVFSGGAPI

SEQ ID NO: 970061 - protein, 529 aa, Homo sapiens
FVFSPPRPPLLFVLLTRLVCVCLRFLCWAPLVCCALDLSTHVCCCVLSVSPCTSVSLSFLRCVAAPPCVCWSCVSSLSVVVGGVGSSRSTPVGGWRCVLTCVAVFLFSLVWLTLDCCGFLPVLFSLCIDWRSCFSLLDLFSVPLLVVPCVLYVSVFSSYSCWLSICHLVSARRPPCVFCWLFWGALSVSVCLVGARCRWQIIVALCFVQCLALSAGNIRCMFGGRLLCRFAFFCLWSLAVTCLRMGVLLLAASCSNSAFPWLFFFLLSTLRSRLRWSFAPPHRVVCVLSHALRLCFLCLCFVFFRCSSTSRRGSSRSVVFFFSFSSLSRSLRACVADCCCLPHSLPSCVVFSSLFSLRSTSHTPPSLLSLLYLYDTSFCFCLCVYTHIYPPRASSLCLLCCVVGFCCSLFLSSLSTLSFARAWSSECVSLYTRSLVSLCLSLSRAARSTLISLLLSPYTPPRARARALSSSVLSLCSPRRPPRSDILLSFFSSLSLSAFLSSRSARAQPIFLFSLLSLGGVSPRARARV

SEQ ID NO: 970062 - protein, 334 aa, Homo sapiens
MLCWGRRKEAVLTPGAAPSGGGDRPLGARHVLGECGWGILLAADMIMEVRMEWDDGNKSVDVCSGAHSLPLVICGDSIGAFFICEGAALCPRTHHVGRLLDVERLSPRGRRALFSKAAEVARCALGENMGERTPPPFVYHLPVLERRLEGVGTGDVRRNSWNGEEAPKHVAPRGYSLEHTTLSAGQCVWSQHVVRVSPHAGYGVVLTAPTLVFGSGGRPLRYSGSFTPAHPLLYLSPLVSPALNLDAPAEIGSPARSPRRVLRPKVVVTIGAPSGAPFEKSASRERPREIPSSWAHLVASTQMYCQGESHISVSRERHATAALHGIERRKEPPR

SEQ ID NO: 970063 - protein, 113 aa, Homo sapiens
MRLVNLLPANILCVPPIQVSPFFVEPSSGAPPHGWGTLCALVVGLPPLPWFGKKCCGSLFAPAILVPTRCCFGSQAPLSPPYLWRPQTPLMGEDHGKCLPNVVVENQRWCRQN

SEQ ID NO: 970064 - protein, 231 aa, Homo sapiens
GSVPPPLHTVWWGTEMWAPTGDTPFLLRGGTERAALVAGRDHPRLACPPSSDPAFCFGPPPCPPAAFFLSVVVHLAQPFVVSAGVSTEECLVPQVPRGGSIPEKTLAQDCARFDSGLYPFILLLRGPSCFVIVLCRLSPRGIHSLHPASVAGPVFPRFGAVAPSSAADAYNIVPNVSGRPPRATPQGRPTPAPDMYNPRKRDFTRGSAAHEELMELLREHQGVGGTPDPRS

SEQ ID NO: 970065 - protein, 438 aa, Homo sapiens
CPPAVLGRGYCLLSGVLVADRARRFLGTLGGHHTYVGPLLLGPTTGGQQLCRCVPPASPVSVHSSTILTRGGRPLVYTFRGRRPLLAQCVHPLRGPLSIRLRVAAPLGGQPPTRGSSVHRPHEEFPGGKDKIKIRCRKVFSPGIADPFSGVFVWVPWCEPPGVCLPPAENFSVVPLFYRCPREYFIGGTPQTPHMGRRPPPRFPGAREFFVVGVFQKVFVGGHPRSLNNWAGISPPGGFLFLSVGRGVPHPETASRYSPPTKRGGPQNILGESCVFWALFESTPFFTHESALPRGLREGVSESATLRKPSHLSPRYGHTKIFLALSPSMSTNPTAPPRVGSTPVGAPRVFPQWPPTVPLVALSLTGIYHLGCLKMCVVFISSGVTIATPANRVPLFPRRDSSSSLDILDSLPPQPSLGLGEHIYLKEPLFPSPVKHPC

SEQ ID NO: 970066 - protein, 209 aa, Homo sapiens
PPGAEEGLNTRVFRATTGGLRAQRCTRILSARLRPGPPPKAPPGASRVTPGSVAVPDPPPVPLPPSHTGRTDRGLPPLMTGVSPLQRAPRRGFGCDPVGAPAGLWPPGARLLLVPRNRGISLLRTKSSRSVTLPKALTASPEPPGPGPSQGPPLPLGRNPLLPFPLKTETIIKIDYNFAGNEEPRKFHGEGPRSFPGLAFRTTPVPHCR

SEQ ID NO: 970067 - protein, 87 aa, Homo sapiens
GLDGGLHTGGEAAIWVETFFAGSFARSCAASPVKFAGFRWETTLLVSLPDPGASPECAEHFMGGFPQVSPWRKPWVPRRGTHKGALG

SEQ ID NO: 970068 - protein, 547 aa, Homo sapiens
PAATCCGALLARVASAWRVCGYSGLLFTPHLTSPALPQLLLGHTRLCSAPRRWHCCLRRTMVLSVWCVAASSRRGGVSSRCTLWAHIASCLLVGSPGGCTPHHDGAAVCIYTNLLVCGSSSDRMFVLLRGANVWCGGAALCGGGFLVFPPAGAARSFSLWRATCVPREVVLVAFSTVGGRPDGRVMPGGRPPRVIDVVVALRSRCRSQEGGSPRSVLLGETVWVAELGAPSCFAPSPHGGSLSHAGGGVGTPPCSPPFPCSRRLWGDHWGWCGLTHPPPAGHSVGVYSPRAPPAHARVWRMCPRCVRCSPHSFLYGAHTLLFDTTQVFCAARGTRVLARETPRAHSVGALWGATHSCVRHICVDTPRVCLVDTHACYLQSETHTAPTERYVSPTYRGDTFSPHTPTAGHTPVRVHTLCHMRCRVSTHRSKGVTLLYMSTLPSPLEGWFLGTPSRTTHEREYMPPPPARHSAGPRGTTHTSESPLSRTSILRPNPRLYLTGPAPMEAPYGLALWPLFGLPPLEFSPSPPPRPPRPPWYPDPRIKHLFP

SEQ ID NO: 970069 - protein, 266 aa, Homo sapiens
SGVVPLSPRLRSRVVLRGEVQPCVLSPSVPGFTVTPSLGYFLANGLHPRVFFQNFVAEISGAQNGPHGRHGLPSPVFFLPSPAPLFLRVFPPFCGVRPPPLPVLRANCSLPCVAKCSSPSWLRTLVDVGPPSFFLLFWILPTSFLVFSPRRPPFVVLVAFSERMPPLCGSLLSLFLCICSRTPPSLAGGFPLHPVAPQEAPLCRVLRVPHHCAPRESSPGGALSGIFFSLHSLRPPPPSYPLVGESRVLSGQCLFFSKWPAFECVE

SEQ ID NO: 970070 - protein, 108 aa, Homo sapiens
SPSAVRWCIITTAFRFLVGPGSTTRRLGVPPNSPRRGVLGRPPTYGRDSPRGPGFPRLLRDFLIAFMGPPRAPEFTTLCSPTTGGTTSYLSPPFMGPLHFLGVQPPPN

SEQ ID NO: 970071 - protein, 70 aa, Homo sapiens
SVPSGLGDPSSTRFLGFPRGAFPFGEALRSPSPAVRPLGCGLPPVCTLGNPGFRPLCCAADDTWVNFHAL

SEQ ID NO: 970072 - protein, 206 aa, Homo sapiens
HRRLPPSGTRSKCFAPTHGGAPPAQMPWSTHTPRGFPHRVAHTPGFGGPRKARLPSPIIPPPALSPLGSSPAALGKSPPLVLFPGPLVFGAHAHVEYMVMNQRRNAQKGKSEEEKASSLKEECRPKRPPPYSARPTQGGPHTRQWAQAKFPARLVAVACAVVSPGQWNILERCGYTRAPWGPRSPSKVLSTHDIFACFAPSQDFPE

SEQ ID NO: 970073 - protein, 427 aa, Homo sapiens
SRVVYIVRYSLVLSRRHPFLWWYFVSPFCSVRAAPCTQERFSCVPPWPFVSLGPDAFGAQPMLWELCAGGTWGHEGAPLFYRLPDFPGVFPPWAKSRFLAPVISVFPAVFFLFGCPYFLFSPVFPSGVTPFSVGPLSLEMSLVWSSLLWAYLGRPLHVAHVGPVEFPRAEIFVCPPPSYHLGFSSLVERPFQTPLRHRVSPPVGPHCALCSTRVLTTWGATPRPPYPTGARPPWKWGDSTKFFGGTHSHGSPENAWRWTHCFSRVSPPAPRRGISHFGGSPSGDWGHPSAGVPLSHTVRPPPGPPGQHFMRLGLPPPVSPQTVTPRSIFLPERCPPKVCTFLVANTPPGSWALPNSFRGFLEGAQTRGSFGELVSLELSQWPPPRAALLPSVRTSAHALGPATPTHSFSGFGAQKDDEPREASGLGP

SEQ ID NO: 970074 - protein, 65 aa, Homo sapiens
MAELDPGSEETPTLVREYFSWEGAFQHVGKSLPSGPDFQVTSLAITCCLHLPFREMGVIKGNWTL

SEQ ID NO: 970075 - protein, 135 aa, Homo sapiens
VGVSCVLCREWCFLVCLSFSVHHCVLWWVAAALRFCLLVVWVSFWHPFVLSTLPVLCFPFDSLSFVSLLVITCDRCSAFFAILFFKVFWSVFLTCACVSLAGSFFFYITPWFGVFVPLPFVVYTMVFCHCVGKPF

SEQ ID NO: 970076 - protein, 222 aa, Homo sapiens
AGTPWVAHGAGSHRRFFLLEGVPRPRLATKYEARRKIVGAPFPPSVHRYSAAALETSETTRCLETHVPIRATPECTPVPRWRRPHRARRAETAGAFAPEARHTLPSLKGALGAPGPQKEGPAPWRRSRRSGERTHPAGNTESILTRKNGGHPLVGVYHTGQTLLTQVEIKTRDDRPTTLGEIFPSHYKPVKHGRPGIGAHTTILPLLSLSSNGSANKGAHDS

SEQ ID NO: 970077 - protein, 242 aa, Homo sapiens
VSLRTLSLGVLLGVGVAFLSTPPASLVVCLLSSVAVFFLVLLCWVALTASVFYSYALSVVVPSFRPWWSSLRCGLLCCEIPTVGGASRLFFVTPRVFCPRHCVSSVNMWVPPLAGVLFVVRPPLLGGAPTYGPLPGGGPTIAPSRRYLADIPPVGARLLSGDGTHVWCLPTGVVAFPFPLPLVLQEMWLFVVNIGATTRVYDHLVDVWWLFVDGFCAEEDVPHAPGAINILVPTGSCIIRRC

SEQ ID NO: 970078 - protein, 112 aa, Homo sapiens
WAPYVCSRALLSPLWELFLLVPGASSDYFSCDGISWGGVLAGPQAVPPPGGPFLLGESSPWGEIFLRGDPLWVLMSLVPPLGEVSTCRSAAPKLFSHITRCVFLETTPPLGL

SEQ ID NO: 970079 - protein, 132 aa, Homo sapiens
MGHAPTGSFLHTLMSRAWHKTTGKRDMLPAPGGMRPLLNIRGQTWRAEESPPTTPRCRGKSAREHFNLLGNALGAAANSHAQTIPKAPTPRILDGKMVLRPRQPKILGHLTTRTRVNLWGTRGPIKSSEFIG

SEQ ID NO: 970080 - protein, 198 aa, Homo sapiens
VSSPATIVICSGPNCVAPACASHGLGMDSLGPHTHCASPEGQLSLVPASGQAPGFPQHPECVPSPHLQRPPTSAPPAWPCLQTINYNPSSTPVCRPRRLEPPPGSGRPPGWERLCPPAPKPTPPLSFPGPAADPGGCPACGRSAFPPSLLFYISDFKGDSSGTCVLVMGVPRHLGLGWGGPLFHIEEPPIIKGPPSGP

SEQ ID NO: 970081 - protein, 81 aa, Homo sapiens
GLNARRADKKFLRALLVPQMTRHGSTAHAQGYPEPSGPNSARLAPVCGLPTRVTLQASLAELKAKIDRRSGKKLGRWPLNC

SEQ ID NO: 970082 - protein, 289 aa, Homo sapiens
LPLSVVDWSLLDSPALVSYVCFHFFWSGFRVAWASSFALLVGCCDVFFFCGFLPPFRRVSLPPWVPPGGGASRIEQPFSLAWSPARDLFRGPYVSALLNLGFPAWPWWVPRFAPFWFPPAPGPPSIGVPTRGCSKPGVCPRWRYLGGTVLAPEGGSGWKMGSAYCSLSPPWYPPPGIHCQSQRVSPMLSVGSPFCRPPFGGNWSGPTSKGYCNNIGSPSRVFSEKKCAPLSTEPVVGTLFRTLPNGGNLCPVCPRPTPLGLGAPTVRWPPKEVAEIFAAPMLIKPPERC

SEQ ID NO: 970083 - protein, 263 aa, Homo sapiens
MSSPFVVPACQSRGSPLCGVAAEYRHWRPWLSSPLAWWKWCGRPLLLRALYSGVVGPVGSPTPEVARVENCGRKRGTPVFCRPLFEDLCSLLLLSRRAPPFCVVPRLLFPLGDVCRILSRGVICENREGGNEGAFCANTFVGGDSPPKEPSAFRQNVLKGSGAPLLGRTSVRGVLRPPTLYAQGEVFCSFVREASRVREATGKFFLSRPSLCPQRTLVSLAPRDTLREGENTIISRECPHSALSRVVEIYPHLLTDKGDTLCL

SEQ ID NO: 970084 - protein, 218 aa, Homo sapiens
LTTALMLCGLLGYDSTFFKMRSLLRRFSGVVQHPRAPASGPRYFCCSWSFIVRLHSILSLCRPWGLIPRVSLPQKLVRGYALPRCSSPARGYGGNVPQGVPRRKIAAEMVFLGGFSYTPLPGTICRGWALVPWKKLGETKKFGKKSGDHNPRHVVRCQNPGTLGPLSKYFRCERTPLGMFSPPPPWVKEVEVIAPAAWLGSAQRWNILVHPRPPQNMV

SEQ ID NO: 970085 - protein, 168 aa, Homo sapiens
MGTGGLYKKRLKSFELACSALHEMPLTRVMSKWTFEEATATGGPPPGQSLVFNGSRPPERVPCGALGAVTWTTTRTPELWSQMAAISAPLGKLYRHQTCNPFDAATLGCSPALATGTGLPEAMGAPSLLQRSAEAAHEVQRDYSLPTDTFFFPRPVYSICFISLTFPG

SEQ ID NO: 970086 - protein, 199 aa, Homo sapiens
MPGGTFHRAVSIALLGTLGSCPKPGGPSDFPGFVTTPPPDTATACGEEFVPPTGPPPNVCAFTPGTFSLADPGTFRGTPASLWLLTPGVTPQPLRRHFMLPTYPCAVLTPDSPLRYWTIALPMHHQGAHSVGLIGGCWLGKFCAMRGHPFPWHTPGGSLPDLYILTRDPEEIVKEEPGFFLRRPVTQEEFQGEWTAPRS

SEQ ID NO: 970087 - protein, 117 aa, Homo sapiens
MIHSQQTAPTWPSPSWEISQGRPELGSGSLPIPGRPILDAPGWDSGSNPANLSQLSAPGWTTPTHPKRLEAVPPETIPVSPATHQGHIEGKALSTLCPMPPGPRAGSKKQGQSLAVS

SEQ ID NO: 970088 - protein, 102 aa, Homo sapiens
MFPTLLGCFSLLYSVLCSSNERHTDPQLLCRRGVCSTTTNAHSWDTHEKGLCSRESLLAHTGVTPTQCLGPTEKSLSQSRGLYNLDDLIAPHNIARPPAHTS

SEQ ID NO: 970089 - protein, 150 aa, Homo sapiens
MNPIFLHPGDHLCPPWRSFWGHPPYKDRPSVSPQERSVGPVRGYSRGEIFLATHVPLLDVPLFPVHRGELTKMCCAKVFTSPAGARVLPTITTRVSLPYKKAGEATPQASKGTLWVPAPRGPPRPPFLRGPLEPKGVFLGPPPVFKKKGF

SEQ ID NO: 970090 - protein, 112 aa, Homo sapiens
MSRCGVRGRTRSYYRSFSHSGVPDREVSSVPQGDLSPMFAVSPVNVWLCQPRLGFPRCDPQVAPPSPRFLFPFLSVFFFCGDAALGHTSETLTPKENFAAPRLEVNLMLPTG

SEQ ID NO: 970091 - protein, 162 aa, Homo sapiens
LGRGRPALALSLFLSPGSLSAGSTTCALLHRVLVHAKCCRLFAVPFYLRFLAVGFSPAGSPPLAYAAHSMNSFLFHWLGPLLCLRPGPPSLSSPCASQCRPLQRPVCAGPAYVPSPPGWQGPVLGAGSLLASSSAPPVDYPPQPTEQKNVTRSIRHIPYMML

SEQ ID NO: 970092 - protein, 147 aa, Homo sapiens
MSFSTSAVWALFMILLCPARVSGAIAFARFLPGARCGMNFFSFDRNPARSPLGHLVPPSCVTPGSSDTSLDCNPRSDVPVLDLATGFYIARPLTLLVLLARLHTLTSVIPVASAIDTAGYRESAAFGQAASDHIGPEDAKRPALGTR

SEQ ID NO: 970093 - protein, 113 aa, Homo sapiens
MTPNSCSATYQVQPSCTDGDLRGILRFLGASRQAFWETKGRAPQICPTLLAQSCCPPNCERPGLFHHFAFYFPVKDHPGSFTPGQLLFFWVCDIPCLSQGECACQVWSNIPES

SEQ ID NO: 970094 - protein, 243 aa, Homo sapiens
PPRVYTNPGLLSAAALREETPPFVVCPTYIATHVRGGTSSALPLSFFSFGPAGYWFFSQPVGEAMYTPARKHYFVGASRHTLVCVLILNSARVAPSRNDLPERSFLFQTTCSPPHVLVLVALRGVCVFPILSLCWSLRRESAPPTHHVVLVFFFFLSSSPPRVRVFATFLLSDFSSHATPPPAGLGYPPTPRRPPLFLRPVFSFSHRPVVLCATHASAPLPCLVLVGFSLPECPSASPPPPRR

SEQ ID NO: 970095 - protein, 203 aa, Homo sapiens
LVGAVAASPIVLSPIGAPHRGAPAHVAAPPRIFPPESGVDRPRLRSAIAGGGFLPCSARLITAPVVLSHPEPALVGACFPPPPPACGGATLLRVRPCRVRSSHHIAWVCLLLPRVSSCWGGYQPPWFVHRTPSFPCRLVRPPPVRPYRVVGHRGGSPLSSGRSCVGMDRISVLSSLILMVRPAGVGVRGKITPRRPSVGGAWQ

SEQ ID NO: 970096 - protein, 211 aa, Homo sapiens
ALLLPEVINLRPASCQSSPGPRGLRKPERGVSLNRFAQEFHEEAQDLKEGIPLPTQILVKPDRTFEIKIGPAPCFLLPEGQPTGIEKGAPANQGKRCQPGDPGSMCMRLPAIQAPDEAICPARMYPSSSVVRSIIGSARSLGIRVVKDLRSEELAAFPKDEPSSWLLRRRQIWLPQKKLPRSDPCPPQLPDFKGGSCQSCAHQGRKEVTPI

SEQ ID NO: 970097 - protein, 111 aa, Homo sapiens
GVHPHFLSNNFSSFTTRNPPPKRRLHKKKLPPPSVAPPAHLRADPPASRGPLHPFASPVAHHADRVCLSRHTILPTCVVSPTPIESLAESWGSPLTPPPLVVRSVLSPTSF

SEQ ID NO: 970098 - protein, 168 aa, Homo sapiens
MVPTDSRLEHPLGAPHPRCLDMLQHLPLLLWLVIPPVFDHGSIYHPGVLDIPEELCTSRFLEGVPHVARVCLPIGYPTGASVPPSYHQRVPSESLALFCGERDYTSPTLLERSQAFSGVIQSALCGLLPLWVLPPPAAPAAAAAPRYWLYPQEESEESDEDMGFGLFD

SEQ ID NO: 970099 - protein, 233 aa, Homo sapiens
SVPHPHILPPGGPQQSPVRALHPTMRPIRSKTPRFSSALTLDELTLLHLREFAQKKLISVETDIVVDPLPGGEHLRTGPPTAEGLSEKEDGGASWPRMRNVARGRAVTQREGDPPTGQPNPANGHPLPGDGGLPPTLPAHSNTLAQRPRRSAHSSCSPRWRSTPGHALIQKLNQLRAHTKPRPRLSSAGGVRYTSTTLIAAGLVDDPRALVGRLNDCFQGPGAHTDSQGGQKD

SEQ ID NO: 970100 - protein, 150 aa, Homo sapiens
MHQGISRHPGWLLSARRRSSENGVYVAVSVSCMASLGHWASDSLPPPEQGGPLPPPPGETVYCCRLALVFAPSQDFEGMSGQRHGPRPCGLPRLDVTWRAGLGGGGPPHPRPEMLHFPSRNPTLENCSFHQALFLNGLLLRASREICLFV

SEQ ID NO: 970101 - protein, 126 aa, Homo sapiens
MIFIGVNLTFFPTTLSRPIRDAPTLSRSYPDAYTHHWNILSSVGSLHFSNTPYILIIFMILRSLRFKRESPNSRENPPLNLEVTIWMPPTLPHIEEPVYIKFRPKRKESNPPKLVSSPPPGLHDFF

SEQ ID NO: 970102 - protein, 177 aa, Homo sapiens
PLARRVGLRCPGPIPADRTCFAVLSLGQPPDSLRGPIPKSFLVSADHGPSGIPDYPDKHEENPRPLFPKGPVIQVTASHAMLPTAVSEALIREVAHQVKVPLPDRHGPGMTTPPWDPPWTFLAFRLGLRVLDLGPPPTGPCHSIPGDGLHPRSPPDPHPLQGFFELFPSLSPNLLVD

SEQ ID NO: 970103 - protein, 155 aa, Homo sapiens
MAPRAQRGCINTLHPLGARRGVAGFSAHTHTGRTQGLRGCDPHPLRSSCVRLSHTHRRYLIVAPFHTQGPTAGALPEMRPPSTHMGEPQETHERLLPRSHKEISRHRDATKSPYENLEHWRSPHTTWNPRPSKTAAGPSTTPGIFAIGENGPFCP

SEQ ID NO: 970104 - protein, 104 aa, Homo sapiens
MDKQAGPPTGIDSWRGDLPDGGRNHTPSEFLEKQRLLPDVPITTAVPLADGTGPFLKLAYIISAADGKAWKRGTNATPDIPAGPITVLFQKSSQELRDMSQIER

SEQ ID NO: 970105 - protein, 223 aa, Homo sapiens
NVGTVFCVDLLTRTRASFEASLGWFRRRTLVGFGCDPLSTTVACVVFDGGPQPLVVPPRGEHPVGCFCPPPSLEGGVPPPPTHARRSPLRCVVAEWVTAVVRPLLAPALLCCVRVVFLPPWLVEPTAAPLFSQQDPPGGRAPLRFCMAHPSACSSLVGQGPLPVGEGTSSALHPSRDSCYHHHHHYIPPPRGVRVYYLDILNNNRLGGPAAGGCRFFFAPPRP

SEQ ID NO: 970106 - protein, 201 aa, Homo sapiens
AHNFGGGPPPCAGVGVLPRSQGGWCPRGRSSFLQTRRVCLFSPPPRGVVVGAIPGGPPQGGLLKRVSPRWGWRRGNYTSGVGGFVRAEVVQLVHMRCVVYGCAPRALGSINPAWVAAALSFVAATTDVRCGRARHKLSVFLSSLSVCAPPPARRGVLFVPLSSLLSRRRGEPLSLRRGGVICWGEIIVGARPPMKKMFSGG

SEQ ID NO: 970107 - protein, 151 aa, Homo sapiens
EFSGAALSSRGERPRGDAAHPGSGLKFCPPGVGRGPPDAAGGGRTVVAVSFLGVTAREWVPAEECLLPGAYSSPPVDEYRVRLCVACCGMGGVVTGTEPPQLGALSPTLGGKVVLSSHALPPPLCRSCRESPRAPLVVKAGRPLFAARRPR

SEQ ID NO: 970108 - protein, 197 aa, Homo sapiens
AGPGFDTIFVGRPPGGRGVLASRGWVVPPLVSYGGLCPPPRGVGAHTRGPMQACFIGPSLGCLYTRGGAFAAQCQSAECVLGPHRGDPLGWGAAVRPRRRGSPVQLMVPLLPPPPRDGFFPPRSLAPSAPFVGEVAVGKIYWPPPIVCFCGGVCYTPCVGGVTLVSPCAPPHCVSATGFLEDDNTTLVFHRRGRPGR

SEQ ID NO: 970109 - protein, 289 aa, Homo sapiens
LGPCECQSGGRLDSGILPRPPVWDRVPFSVLMRHESGEFAQTPAGPISRGLRVPNAAAHPGGCQDRAPATPKVALSPPPPGGETSFRVARERNLWGIPAAAPLSLPPPEGFLGSPRRAPASPLPTPGYSPTARSFTKGRDPPIRVVVKRLGPRTACLPHAPDCIMGGLECISIPAAPPFHTPASPPGRLGSCVWERRPALGPDLKPQLPWDPVNAPRQSSPEYACLEIPPPLRESFPPYTMAFACTPHWKWVCPQNKTLHFLQKGNYRGNPGLGPNFVLRKLIFVPPFY

SEQ ID NO: 970110 - protein, 276 aa, Homo sapiens
LASGRVQTGGDRCRRYSCLLVCARLLLGQFHALVVSYPALCVRSPHCCVARPPAPVCHELPACGQVARRYSRGFGSRSDGALRPLYELLTGFSGPPQAVFRVCAARLCRGLPAIGCSPASWRPCLRGRDPWGKTPLLSCKCGVHEENVLVPPEEGGRPRATWVAERGAHPEGPPPDGKGRPWYYGPFGKRMNHFPEVIQYLGLPTWDTRVPRGTFSFRSPYASWRFSLKEETTAPRASHGSRFSARGDPLEDSGHYWPNGVDLETLRRLRLRKSPR

SEQ ID NO: 970111 - protein, 299 aa, Homo sapiens
GRTASSSDQGVAALPCLWCSQCVSCAVVFRVLLLVVVYGGALFHSACSHARVCGFMVASGVFPRSCSVVCTSVRPRAAGPPVNARGPGHPGASFQGAHSRALWCPFVFSGGPLPPLRLSSLEPIGDPPVGSDPLEEDTPVSPALVELEIEALPLDTPSSVETDLSSSRKPSEEPFTPVLENGAGLVSSTSFNGGVSPHHWGDSGPPCQKFSEGEEANPDHGPLGNTLCGKAKVLCTEKNGKKICTLPSPPSPLASLAPVADSSPRVALPRPGLVTRSLCIPFPRPAVPNPPLHHASSAW

SEQ ID NO: 970112 - protein, 116 aa, Homo sapiens
GGGCLSVPIVRALSLSWGLPLLFQRECFCLCPHSLWLICWCVWRTLSFFGVSARARFVVFCVVVCSVLLPICVTHATVFILFLFLLESQHARSPHTPPLVEGETRRVIYDGPTRAF

SEQ ID NO: 970113 - protein, 72 aa, Homo sapiens
CPRNLPPRRHHRDYFKVGEEFEDQTVDGSPSKTLVKWESENKMVCDQKLLKGEGPQTSWTQRTDRHDGEHDP

SEQ ID NO: 970114 - protein, 143 aa, Homo sapiens
MLETRGPQRTHRVLITNHRALFSRDPRRRELVCEFSGPPHTLGHAGHTHQRSTAPHTRHMFSSVWARLTHTLWLGLALSREGESRRCLSSENSQGSYSPHHAIERDGEGPRRSTTRCPLVFVTTPPHGLNLESTTARGPREKV

SEQ ID NO: 970115 - protein, 109 aa, Homo sapiens
MLALFGGLLVGGGQTRRLEVVQPSGGGSHTHTARLWVVVADRDRTDVVDVSSLSHSAPFVEGGGPYIGGNNVSPHEEGAFVEIFLTRSALRPEIVSPSSWGKFSRSLEG

SEQ ID NO: 970116 - protein, 121 aa, Homo sapiens
SRYYSAIQEYPITLRLTNSLNRETTGTQYIHSTCLLPFYWVSILPSYQPQSTSSLPSPFPGGIYGSTFFVATRLPPKLHVNYWVNFPHYLVHPPTNISLYNLNITLGLKPPPENWHFVELV

SEQ ID NO: 970117 - protein, 237 aa, Homo sapiens
MRARRQVCVCGRPLPAGGCVVRYGPPPLGWFVGLWSSLAVRLYFWSFGLGLGVPLAPAWCGVFSVAQSAARGVCFVCSCTGPLVTLCFVLVGGGLSLAGERVSVFSLSLRMLLTLARGVLSLAACFLFPAPLLAPPPHTHPSSVPPPCFSPPHTRDRGARARAVKHLERVWVLLSLLLVPPLFLFLLQRGPPSREEAPRPLILSPPPARARPTRAASPARARLCGRARTASLLSLCV

SEQ ID NO: 970118 - protein, 222 aa, Homo sapiens
VRRVPPRSWWCLLCVVAGRASALCLPPRSSGYVCVLSFCVAGVCVLLFLGGASLWLFVCPLRVWCLRRVSFWVLLFSSVLRFLWAAPSPSSCVGRRPCLCACVPPFVLFSLPAGEVLVPGLRTKFVLFFCLVRFVCCSSCVCPRSRLGGVPRPSLWGPPRPFCSDAVRPPSLSPVGGRSSPFEIVVWSRPPRAPTVCFSCSLSSGSSPPSHSFARLFCGGCR

SEQ ID NO: 970119 - protein, 84 aa, Homo sapiens
VALCHIAMLADGTTRKHIPGPPRPPPVHKGLRYGKSYVITLRSFFLRRIFLSLYPSRLAPTPPFGGHWPPTGITPRYIPLESHS

SEQ ID NO: 970120 - protein, 292 aa, Homo sapiens
WEAVPPRLRPVFSTRVQTAVVWCETPLALLVAPRRAPLVGPRFTTGVSGCVSPERHPVVFPPAGERPAFMLLPPEQWRVLRDPPPRMCSPPPPLGGAGHLLCSCVCASTPPGGRSHFFFRGSFCTPAAVYLWWARGRTITHAGGRLNPIGAKKWIDPPPPVGAPTAWARSSTQGTPPCCVLLCDPAVARCDGGGHPISNRWGAAAPPSPRGWGPPIFCCGGIFFGRPPPAGRRFLYISPSAVFPPTARGVSPSVPPGGRHAFGVSPLPFFKAPKHPPFFFFSPPPPKKSGAP

SEQ ID NO: 970121 - protein, 106 aa, Homo sapiens
MFHAHPRCTRLVRDFVGRFHTSYCGRYPPCHVFAAPSGASVGSHPSRGKHSPPPLCCVFTHGDLSPLGDTPLCSRGPIGQPLCRSHVYRRGSCFLTRERGNPPHRL

SEQ ID NO: 970122 - protein, 237 aa, Homo sapiens
TACCTPVSRSATPGGAPLGTPCRSSFGIFPCPGAGLPIFPPGHAMYPFALFWGTHRNKRLSKGKTGDGFPAPGILPRRIFSPPHGSAPGPRVVWRPDAQSSLGVPPLEAVPAHDFVGRTRTTPQISGLAAGKLSLFPTPPLLRGWAPRYDLHLWWVVGQHHHHCAPPPREGRERLPSRDGRGNTRRSTPNEKIPPPARNPPRVIFVTQQKEIFKRMVKIPPPASYPQCLGTAPRPPV

SEQ ID NO: 970123 - protein, 323 aa, Homo sapiens
LNAQLVTPRHAQGSPRVPGSTHVCALILATTSFFGIKARVVPPPQWSPRGTASSPGGHLVKRRPLCVGRLPEPPQGRNVVFPSPQGGPLPFFSVRRTYGCCCPPTAGRLVFGGRNTPAAPRRGLDRLHAPQCCSPFWVWPTTRLAELLSLAAPPLFFVPQQRGGTPQTGERMQMEGSGPPPRVLRHSAGVADRHTKGGSPCVEGGVPHWAIIREEDMHCGKKYIPAWETPFFHLVPPRGAEREFFVGPAPPADGNGWPTQRYTSMQPPSRPFRVHEDAPPTTLPPRGPAQISPRESSAGGPKVFPPPPGPAWKKKGFPPPGGV

SEQ ID NO: 970124 - protein, 260 aa, Homo sapiens
MQHAHSRRDSFGDVLWLRHPLLLSWLLGGRADAPPPTLCVLLLLRRIKQEGGTHHLLFVWVLLILAPPQIATLFIPLVCCFLLVGEGRDYRALQRSSCWVDKHTIIVMAGHDLDFFLSYLALLLYRLHLARENPCSPPRWWCVYIESTQPRAVADTAAQRDTHLSTSCFVSLCSSVSPPRSSLSLAGRGVGARALPLSLRLALLSLLARARARASLCSFSLFLSTHRRERERRARALALCGCLSLSLSRARSIARTRTYI

SEQ ID NO: 970125 - protein, 219 aa, Homo sapiens
MSLFCPHRQGCALFGCKTRLFLPGGLHGRRSTHSALGSHAGVRGACLPRSSVVEKFVPPVSLVGCLLDDPRGFLPQTLARGKGVVPHPFGPRALPSGWKAFVPPPVVEGTRCRICDHCVQQSRSGLSVVALSLITCAPGTFFGLNLEDFPEFLFRVSPPLPGRGAWWLSSHWGPRHKPWALPPFHSSPGSLLLSWASIVTPGPLLIQHRPCGLFNGRYP

SEQ ID NO: 970126 - protein, 126 aa, Homo sapiens
MYYVSTGCFSTPPWGEWGLLFRVRHAECVSGVSHKRVPPVCVVSAEKTRPLFHTGVLFCWGVIPAGGVDTTPSVVVMSGKHPVFNTCLGRHSAPLVVSPFPGLYKSLVGMYSPPGVGVGLFLVKSG

SEQ ID NO: 970127 - protein, 69 aa, Homo sapiens
VVRLLARSTSCGISTLSARPVAHTCDPGPLGGRGSGLPELRRSRFRLGHTMNSVSTEDPRLSRHGGVRL

SEQ ID NO: 970128 - protein, 97 aa, Homo sapiens
GFLWYFPDVRFDVLRASCVGFSRPRQVRESLGSGLSRCTTGRDKCWRPSIGIFVNSAGIPVLPIAVYHKACCWPNLAGHRYTGDLKEIVVGMNSGKI

SEQ ID NO: 970129 - protein, 149 aa, Homo sapiens
MHLDHDRDMDWVSNPAPRPQANVHQSAFNDWFKWTPPTSQIEHHLFPTMPRHHYPQVAPLVQSLCAQHGKSTQSQPLLSAFADIIHSTKGVRAALARCLSSPIPQPTLPRLEEEEEDFWSPSRGELEGPCPYSLILRGGWVWGHKASDS

SEQ ID NO: 970130 - protein, 258 aa, Homo sapiens
PVTRGAVVEKSPRPPWRKPKMATACAGPLRHPFGAKTTSIKMLHQGPGQPPSNSGRKEGRPLEGGLEARSRPMTGFENDLGPPPSAGPPNTQSQPRPRDGRGFIWTRDDASSHTGPQTAHKANDLRCQGVAQHSRKPGGLWVETTKGTPWKATQIYWAIGVIHSEDVHATGPGLHISISDRGPSERAGAQTARGLAPQPHSCHGRPFPGPTNQTTSGRGPHSLQELLFSHGGELTEDTRRLMTSLEADRRCFVMIPST

SEQ ID NO: 970131 - protein, 188 aa, Homo sapiens
SLCRVLVPRDSPELSCSCDPLRTPTHLELITNPGPPKAGVSPGGLVGETYPCTVALSRKRMFAPLLVFWALRNPLLPRGACSENPRMKVVTHAESAGSPQGEVPLYKESRRPREIVRKEFWALGAVMREGARTTGATGHTEDSDPDHPVSPRRHKRPRPRLSKIHPHPAFLERAPCLLHLLYVTLIHR

SEQ ID NO: 970132 - protein, 90 aa, Homo sapiens
KVHNTVFLNRDRYDGSTRVHCLLLLTRGIDLPVKRRALPRQDEKTLWSFNLVNANRVLTNPPGPIDFPTCIKISVGATSEQNPTSEPSTC

SEQ ID NO: 970133 - protein, 209 aa, Homo sapiens
RQVVSVVFPLSLVASSVFSLCYPVPPPPLILFLFLFFLSLSPVLVRSPLTLRLRGLGVARLPLSSLRARSLFLVVSFSLLSWIMPSLLRSCTLLLCVVFPLAARWTGVVVSPLPARRWVIHLLFSSPLHAASLPPPPSRVVPFSLPPPVLAFLLGCPFLPPSASLCPPPLSFRSPLSLFSVSLPSFFCVACPCRASVPPPLLSCAGIQY

SEQ ID NO: 970134 - protein, 108 aa, Homo sapiens
MYRMSGLPPPPFFLGGATPTCFYEVLPPLHVRGWGHTHISPPFVLVVGARRGNQALCLSATAKACFSLRRREAALSLLCGRLPLFSAPATILFVVARRRPAWGCGRDI

SEQ ID NO: 970135 - protein, 200 aa, Homo sapiens
MGGVSVLSVRCFCLLSPSCRGSRWYCERCFCLWSVVRVVLSLQLRVAAVCCSLGGLWSCVSRSCPLFVCLCLQLSCSCVGFCCRVCVSVPLGVLALLFVLGVLVVVIDFVWVALVPTGHTVVACGPIVCPHPVGGPVIGVVRCAGVMCGRLWIFSVEIFFMLSMVGSILVGPPLLVGLSMCGAPLGYFNKGVPQMSVENS

SEQ ID NO: 970136 - protein, 179 aa, Homo sapiens
TDAVPGGFNARGVGSCAPPPPPWGGATPSPVLSVWDTQGPYRGRPHAVVVPPPEFSPATGQVYPPPPEGGAPRSSSCEPPFQWALEAPWPRKSVRAFWPKWGLPPWGHKRPVPPWRKGVTQRCLEGHLPGERPPLVGFVSATEMHTIGSAFPAPCDRCTRGFSFGEVATTCYEAPAASR

SEQ ID NO: 970137 - protein, 110 aa, Homo sapiens
MVPPASPRVGTSLRPGSSLWPLKKSLEESRVTFGPFNPVLPSLLMAKMLHSLGGEDGYVRNPLLRAPRTSNLSVEAYRSWISCRGVVAHACNPPTFFFKARRSHPEVTGV

SEQ ID NO: 970138 - protein, 151 aa, Homo sapiens
MTLLTRLDRVFCVAALLLPSFSGCSFLTLLRSRRFRVFHPSQAFLSSCGCRPTTVLQVFLAVPAGFDAPPGLTLGCACPPSPGPRNLLRPPLADCTLKRVTTYSRHGTEDYTSILRIQLTVVMKTLTTVQGIADDYDQKKLVRSFLKEICL

SEQ ID NO: 970139 - protein, 141 aa, Homo sapiens
ARVLSVCLRPSLLRRARGGGARAHALFSLVCVVRSSRASPAAHTRGLLSRSPLAAPSPLSFWVWLAALSLLPTTFVFFLVVHVSPLSAPHLSLVVAPLPPGWGGVPPPLPLHTPPPLSSFLLPLSLLFISPLTSAPLSLLC

SEQ ID NO: 970140 - protein, 180 aa, Homo sapiens
SGYFAWSLFVGWPRGSPRTRVGETLGPAPFWSGIYAMMLLLPFLTQEGARGVPPRTHLVPSPLPLGCLTTPQVVFHCSEVPSRPPPSQAQAPMCLVPGLPGPSEGPNRGRPPTNLTAGGPTPAPLPSLLPRLTCPCPEMAPTSTPLFTQRTELANRAPLNRTPSHQPRPCFVWPHVFQIF

SEQ ID NO: 970141 - protein, 215 aa, Homo sapiens
MFFRFFVWSSSLFSFWCCCVCALLGCLFVLARLCLFVGWLIRADWPRSFAVLCFAGGGVVAALYLLSVVAALFFAWLLFFLLAAVCAVSLGFFCCFWWGWSLRVFFVFWWAPLRPVSVFLVVRSISCAALFGCWWVVSAEMVFVVLRRLFLSFDARCLFSCWLVRRVCRGCWLVGGGAPPAGPLCWGDLFPPPPPFFFFFFFPPPRPFPPSPPPH

SEQ ID NO: 970142 - protein, 110 aa, Homo sapiens
LDNKFCTMGVCARLLLEDLLFLVTEPSICVEVSQCKMFVHFFPGVRVYPVGFVPYCVFPTMFLCERDQLYWVICCIAPLSTVTVAGMFVLAEILCKFPNIGVGMEVVLLY

SEQ ID NO: 970143 - protein, 198 aa, Homo sapiens
MCRGVFASRVRPWVMWAPPAVVRPWKPRDGRSARVSNLVLRQNILSYTTFFATDTALPTGGIFMYNHPLFCKHLIFAWAPPTLSLSSRGSSPLSPPRSPTSPLIRPLSPVEYTFDSPAFGMGFPHAEVAPLGPRCCPLPQSVRTCVAPPPTWVILESPCSRQRYATPEALSRAAEPICVVHTLSLTHKTFPPHSIFSL

SEQ ID NO: 970144 - protein, 125 aa, Homo sapiens
SCVTSLSLRSPVFAASLAGTVLRGPCLVERVRRFRFCPASNCLPLVWWFALFARVCLDIVGSLSSLLQSTAVFPHASLGPTLSVYGPPNVYRGPPMIPVVIIEGSPPLLGQNLLDGSSPIMYAPL

SEQ ID NO: 970145 - protein, 204 aa, Homo sapiens
RPYTVSARETSFFQAVGITPEISRGTLGILSDVQLIQTGDQVGAREATLLTAHISPFSFGLVIPPVFDHGQPSTNPEVLDITEETLHSRFLEGVPQCCPVSVCQIGYPTVASSDPHSIIHRVPNESWPLSCGGPEFTTLSPTCVKRVKALLWLIPSALCGVLPPVACCPPTSMLLLLLCQPPAKVEAQEESEESDEDMGFGLFD

SEQ ID NO: 970146 - protein, 155 aa, Homo sapiens
MKDISCGGLQRFGQDSPPTCSPLSSVYKCQLSSFLLLVTPSNPESHSGATWQSVFQQPCCTLESCSLMAGIDDCYTSALGLHLPPWANFGQGHTLKQCCGDLDSYLTPDLLEWRLYSPSLPIRSSLTPRQDPHQSLPHRTQAPAVVQNRVFKQEN

SEQ ID NO: 970147 - protein, 152 aa, Homo sapiens
VPGLCPPANPPYLARRDPPWLSSRLQEKPSDPPRVTLMDVVEYFTEAGFPEPATAFPEPEIDGQSLLLMQPPDVLTGLSIRLGPSPGNLRATHIQVLQHRPPLRMSDPEWLLMADAPRLNRCPRPFPAPTLTPRVPPEVHGGWTGDTPHALQ

SEQ ID NO: 970148 - protein, 181 aa, Homo sapiens
FTAFTRRRKTSLASVPFPPLLRAHDYRQSNQKNGDHQPRGAPAECAEEYRLEPWDYPLPHRSTKERAQGHPPSYGCPEPAGGPYGAGEALGTLIDERNPSFALHPESASRSRELTLPRRVSEGLHLRGEGWGQSATLCLFLLCPRCAPPPPTPRAHPWGKREALAPFPPIVLSLPGSRPKL

SEQ ID NO: 970149 - protein, 110 aa, Homo sapiens
MTLLLRATVRISLVDSILTPVLTVLLYCPPVRSRTSGPLALSRADVITTFSSGCCSLLTTFRSLGCRVYSLLGPHDFGSVLAHVPGARSREIFPAALLLLRRSIVCFRFS

SEQ ID NO: 970150 - protein, 166 aa, Homo sapiens
GVCGGSFVAVEMLCLCWLLRSRSVALLGSLVTFAMRWSSRSCFYDVHHTCSGCRYVFQTHIVYLVVCLIHSVCWCACCLVGPIHVVLRCSPVPKWFMVSPVFPASHLLTWLWGTFPVRALGFLVAPPQNCSSRLLGRYFWWSLLPTLRLLDVSPGGYLLSLCNCGT

SEQ ID NO: 970151 - protein, 152 aa, Homo sapiens
LCPDDVALKNFAHTFFTHLMRRGNTAEKLMKLAETHEVAESSFRISRNPTVMTGRDGLVIAMGVVPLPFGKKIVESSHLLGTATKLAHCTKNDTPICGDIPLSTTFLNEPVKALQELGDPSDPLAPDGSARIWLGRNISLTSTPWETSDNES

SEQ ID NO: 970152 - protein, 174 aa, Homo sapiens
CWLSISTGGCSVVHVPSRLLPSFVCELCPIAGVVGLRFLAALCFIGVRLPPCGRQLLPYLLSGFCFTTSLVSVCGAPFLCRFRQVFPTRICMRLSCVYVYVVGATPTRVPCSPSAGCVIVPVCLLFTIMVGEAPKISLVWLSVCGCLTTGSPVLAVCPWCFSLPAGFGGMLTAT

SEQ ID NO: 970153 - protein, 70 aa, Homo sapiens
SGLISLPNSGSLNWSRCAIAPPGYLGVATTGVNKCDCESLFVEAYTGGKAIVFSPVLVVKKDLGSTGSPC

SEQ ID NO: 970154 - protein, 53 aa, Homo sapiens
RTRGLVPLGLLCSDGKRGLWVLVSLPLKNGAALRETLSAAFIQMLIKVIAIPD

SEQ ID NO: 970155 - protein, 321 aa, Homo sapiens
SRSRFPSFADSVLPAVSLYTVRVASSGLLSAPVLWRSAAAARLSSRSRLVRLSVLHARHLCPSEASLVRAPSLCFSPPVLFRHSAVLPSLRRLSSPSWPSRAAGSASALPALAPVPLVRGHCPPPRRCSSALGLPPPASPSARASGLGTRRSAAVVWSRGARALRLAEGTRRGVTRRRLSSPSAAASCSLLFLGRVLAVRPSRRGARRPVSLLVFAFSPRPPAVPSLWFRSLALLSVLSVRLVCSALPFVAAVLPLAWRLACGAPCSSWLRSAGAFCRLPRLFFPRPVCPLLCFFFWCLSGAYRAERVPTSSDLMNLPKLK

SEQ ID NO: 970156 - protein, 180 aa, Homo sapiens
SPAPFQCGCPPQRFRVVGSLLWCPPPPRGGGRNTFPSSCVQILCLDVFRARILFDSGAPVPRGIRLQCDWRHMVVGAVLSHICYSPCPNVGVPQYPLVPPCVGGAHPSLRKGCLIVPPCSRGRPAELSPLSTPPRGVCGPKGLSPPHFVPTFRPLLFTVLPHSCCPCVAPLPRVFTVGAL

SEQ ID NO: 970157 - protein, 86 aa, Homo sapiens
MEVRPVRQGFRQGDLINHVNGEPCAWHWCTRRWWSMILKSGNKVAISDNSPGDTSIRWATRKGSYKAKMALKEQEDPGKDGQKKIK

SEQ ID NO: 970158 - protein, 144 aa, Homo sapiens
MGPGLRTPVVLDHFGRPANPANGSSIQVNGRPLEMIEPPPRSQYQLLEARSASSGQEPICWCRPPVSRVKGGGHVAPDLCYPSVHLPSPGGLITQKYVDEASQKEIQDILIPYDRTLLVADPRRCESQKFGGPGARARYQKSYR

SEQ ID NO: 970159 - protein, 134 aa, Homo sapiens
MTRARTGKGPDPRIPRFPDLELEKEFPLPTGYLTPRRRIEIAPRHSACLERPDPDAGSQNRRHEVEEGPTQLKSMSPGYQLAAPFSPEPAPRSPAAPEPVPPPAWPLPSSPLCRRPAWGPVPPSLPRLVLRYFV

SEQ ID NO: 970160 - protein, 100 aa, Homo sapiens
VPFAFCYLWFASLPPGGCFAVLTQPIRASLRGTLRGRLALLCPRGPTGPGGAGEACSSPRELCSPWRSLFPALLFEACLRLVAPHPWARKTGNSCLSRGF

SEQ ID NO: 970161 - protein, 183 aa, Homo sapiens
PAPEEEMDGLTALAAEPQAQDPFAHLPQSTLVLDGFKRQYSHEDTLSVALPYFWEHFDKDGWSLWYSEIASLRTHSDLHELPSHHWMFPRLDQLRKMPSPVSSLLGPHHSRSLSGVWVFRGPGACPSAESTNWHGGLRVIHHWRKLESWHARRPTTPGSRVLFLGGGLPAQWAKPSIRAQIFK

SEQ ID NO: 970162 - protein, 148 aa, Homo sapiens
MFLVCLSPRIFLSLCLRSLSLSLVVEQLTLHKDGVAFRLIPQRGGRSQHLSSSKCGRWRRAPLRARRLLVVISVRDLAASPVCVFSASSPHAHSHLIFLVLFLINSFWSERIDNVALGRAPKMRFVRAAFSPSLVRCVPVFSALLAGR

SEQ ID NO: 970163 - protein, 198 aa, Homo sapiens
CLSCSRASAALSLLSFVSFRFFVLLRAWLQCSLAFCVCFLFSCSCVALRVDGSSSAVAYCGGRLALLLGRSLLVFLCLSCRGGGSRSSVRSLFCSLVLSLCLTFVILFFLPLLFSCRFSLLFLCSFLSVFLLCCFALFCVFPVCSVFVMLLVAALCVTCTALAVRCVVVLLSAFPDRHCCRLRPGRRVPAWVRFPYNI

SEQ ID NO: 970164 - protein, 287 aa, Homo sapiens
MPAECGFVYCCGVEATPTATRWGSPSAVVVCFRLDAARKAGGCCFSRLQKRGVFIATHTAATVGRADQKERRPAGGRGGSPSPPALDDFSRAGGHTQRGGVSLRSTTRRLLRICGSPLLAGRGALTTRRGHDAASAAPALFAHTRGRTHTHFVARTHIFARAARAHEGALVCSFTRTHSVVFVGGAHSCCAHAARPLRAHSTLSRHRGFTHPHTFLSHTHVHRARHTVVDVSPNPPLCSYKTPREPTACFAVWLHPRYPPTHWFFMAPPPPTPFCWGKNKRVIKLKQ

SEQ ID NO: 970165 - protein, 194 aa, Homo sapiens
GAAGWARHRAGGVRRRLWVPGRGGGWCSRVRVLVVSGALWVFVILRARGVDGAYRRGRSVVWGSLLARAWCLFVCSGQRVGGGPCPAVWCRLGCVGAGVVSAPSAVLCVVVWGCGGWCVGVGGAGRFFGWKKSSSMRSTNMSAKSSARLGDSPFEMDAPVFVWQTVRKRSVIHGATSEHYAFVSRPLTAEITGG

SEQ ID NO: 970166 - protein, 180 aa, Homo sapiens
FGWWEWRGRGGRRGVCCRCVRGGGGKMVGGGLVWGPGRARVAAARPVWCLAPGEPGAAMACVVGGRCCGHVFFGGAVGARSPCGPRRVGSGRWGVHSGVFGHVLWDGPRECGVPGGTQGTPWASGPGAWSAGPEVAPVARRGARVCRPAAERNLVRHCFKSYPSLQPIEVDLTQPRYAES

SEQ ID NO: 970167 - protein, 293 aa, Homo sapiens
GGRHEGGVTRTQLSVCPRGMWVCDTPDWCDALPAPRRGEYAWEIFCPRSGGAAAAVWRRVLPLMRRAGGGLAVPRRGWGACGEPAGAPRREGGAGCPSGEPLRGPRGRRGGGSGASPRDGGGWPTRAIVSRGRCPRGLSMETSRPVGHTHGGGHVPVSRAPRVFFSRVGCFTNPPCGASMVPHDRGASHHDCVWAHQHCAHWCIGAARTVEMNLCWAKDVRAESTLGRDLTTRSVEGDPLSQGVPHSVAPLWEGDSRVCVPLSTALDAVLGETPREKRASRGRALYVCCACAL

SEQ ID NO: 970168 - protein, 127 aa, Homo sapiens
MSGGGDHTQEKRPQGRGGVPPRGSSRGEFSLPAGGRYISRVLEDLPHGGVSHGENILWGFIGWPPAARVWRWPFSCGLERCFMRDPRVSRRTQHTHCGTPGRGRRAPPQRRWPLIRPRILPWGEISL

SEQ ID NO: 970169 - protein, 292 aa, Homo sapiens
APRGWEYVCCDARSQWVCVVLPRPPCTLLLLHDECVCGVFFRVGCSPATAVVCGARVSQRGGGKRPLVRAPAMITGGWLFLVSVVLVKPPPGCRRTPRPGRGAPRGASYKKGGLLLHKKGGRPPFDPAGDYVCAPHKGGKRGEPREHTQGCCIFLEKGGKTGKREMWERGHTALSRNCGRCSPPSEGCHPPHKEGGRKKPPCPWRGFPLGEIVPSAALQGPNFNLLCTPGYRTRKGHVRTPSASPDISVCGYRDLSPLSHVPPLSVLSEKEAPAHTHPLWQRSGGEKRERHM

SEQ ID NO: 970170 - protein, 286 aa, Homo sapiens
MSSGEGRPPLSDAGWGARSPRMCVRAAARFFAGGDQQMVFSGGCRRDLFELVAVAGRKNVHPTLEGGFFKEVVVARQLGTNPTPNCVPPVISSSFCGAQHWVLGGNTMEAFRAHGCEPCQNPEGPPVSLPTGHKAPGAFGDTPPQNQGLAFGAFGLTHVVLQHRVIAPGRFEESDIKAENCHLLHSVSTREKVLVNHCPPPWGSVPSTTPPLVPPLSREVVPRVPRAPRRPEAPPRASPLVALFLEWGTRPRVTLGLHPLEAHPLHNGPLLLKRPNRRYFPRWPSC

SEQ ID NO: 970171 - protein, 125 aa, Homo sapiens
PRNGCARGEEDPPPPPWGTPRPRHPCRVKEGMKSGEILAFKSLLPAFGPMQWDLIPWVSGHSLVLIQTLNPGRNPRLSVAQWSIIPPIGCLPASWWAFLGCFRGPQGELLSVKIHLCPYFPSLDT

SEQ ID NO: 970172 - protein, 221 aa, Homo sapiens
MIGPRKPARREFSGTPRLCPIAHHKPLVAPAVFTPPLTKDPQLFSPPPSHSSGPTAPRVGAREDISTHKRLSREPTLSPSEEPPRRRVSHTAQRHTAGALKCAHGHSAREFTLKTHPTARGRTLCPRRSLSLAERASREPTREREGVSGDSGETGRTAHTLHRPARNPQGLLPGATQINSHTGWATTAWRTRLLSLWKLELRECPSGEHRHSCVEGTPLPR

SEQ ID NO: 970173 - protein, 148 aa, Homo sapiens
MWHHPCGCVRVYHPPEGGLQPPPNPGARCCNCLPMCWGNTPPGPPKKIPWDCEKDCASYKHQPPTGAPQKKGVGSEQSEGYRDPRNGPKRGPIGESWNGGVWKTSPPELWLVWAHTEVGVLKAHGESESARMPTVCLPPAKKEFFPVS

SEQ ID NO: 970174 - protein, 135 aa, Homo sapiens
MPAIQTYNLYFRLCQTSFPGDPGIWRKSRSPVPNPPSSKYPEFDSCYPGPVYHQDSLHASSPEVSLHQHLVNFVDTYPRSPHALPRGHTPTMDLEMATFDFLSLFTRWHFTPRGVFLSQNAPRSSPTPLSLVPPY

SEQ ID NO: 970175 - protein, 108 aa, Homo sapiens
MAHPLMGFHQSHQLPSSAKPACDPAGHHFRPRSPTLQDAVQGHLTTKLGVKGHFTVRSQLGEWTRVWERHLEGPLDIELTLKNNKNKARLDILRPATYQLSLYKRGGI

SEQ ID NO: 970176 - protein, 207 aa, Homo sapiens
GRVRGFYYIFGLVVGGVGVVAAGLRVWRYVFDVVVAHCLSPRWGPPVYHTCCGLGATRVWVVGSRHGVAEWSPRCEALLPPGQEPPFGSQNGVLGLRRMVSQWGFLRGFMCGGGTTGRVCPLGDCYVMAPGGQFFDRPRAHECFRLSPPRGCLEYFSWRCPPRPPGEPLSANGSCWPSALWGPLGSIDLCSVFSRPLGCALDMASVI

SEQ ID NO: 970177 - protein, 282 aa, Homo sapiens
CTNLFTTGGPTWRCMLVCPGACVKAFVGTHNRRCPNVCAERRYFFLRGTSAVSFHGFPCAHNGGGVFKGSITPFPPVFFTRAHRLFQRQGCCAPKPPASGTHWGGPHPAERLRLFALLVHRTLGAVVLGQFNLGHLVCFRGGFGGPGPLGGPVSPPTHTGPTPPSACGCPQRSRKRRDTLGEGLASAPCCPKLAPVGLVREKGESVRRGAPLGGPHTPTPRGDPPRGVAPRESPHSGLERLFAHHSGPRDHPPTVVSATHSLPAPREPHSRVSQRPQLVPEE

SEQ ID NO: 970178 - protein, 114 aa, Homo sapiens
MRSPGNGNSVEEEGAVKGVWCPCERVWDTGIVRLGLRRRRKGRESTKEPCVCRRMNDAHGGRTPVLGADKRNVGSPTVSGVGAPPLVFGGVLEKWVDICLYDRRGGIAHGGRLW

SEQ ID NO: 970179 - protein, 65 aa, Homo sapiens
KGTAKLFARGVLRPTMATPQREPQEVFGVPQFVRTAQLTHFTACTVHSGIAPLHRTVFGAHNNNM

SEQ ID NO: 970180 - protein, 370 aa, Homo sapiens
LSRRRVLLSVCVRRRGRMLLTPRRRFGRLWRLLGSTVRRGVCPKRAVVPPFAGFPGGMSCRPHRLPGLFAALRGGVFHHRRLWVYNPAGVHSLGGDFVAPPSLVASTDELSPTARCVVGQKCVLAERDSDSRSARCHRERLVARTPGLISGGKCGGHGARPVGARGAIIKGGVVSRLGEDLLRGVDNTTKEVGRHHPSCPSVRASAGESTALSVCDSLSSWRRRMFGGCVEQRTSAARGGAKHNWVVRKRGPPPGQLAAFFRGARVLAPVVSRPPIIIEGRTHRGPVSCFVRGGFGVCVVCRTKGGVGDASSWGAFFGPLHLGAGVVCCVENKVWGEETVFHGEGTPLLWERTHPVLGRPLLVTRLCVST

SEQ ID NO: 970181 - protein, 140 aa, Homo sapiens
GVAVDHDGVVTRWVEAGMIEGCVFRGCGGGKLPLGCDVNGSYKWGGLPIEDVAPLGMLPVVTWAENPGLLDRYEAEREDGALPSCCVAVEPRGFCCARVVQRGGKRYFVVFQAVEGVFLRGSVSPLMSLYFRGRDIGISC

SEQ ID NO: 970182 - protein, 104 aa, Homo sapiens
MLWELGWARLLLWWLGPCGHVALFIVWDAVLMVFVSAHWCGGCYACLFVSRREELGGYPASGAEVWCVSRAVSVVLPVMSDEESCVSICSSPLSTVVDSVLTRE

SEQ ID NO: 970183 - protein, 105 aa, Homo sapiens
FHAAVFVPLWPFFGRLIGRVCPQKTGGGPGSGVSRGKCRWAPGGARKCGVTPSPLAPFARGARFWPPPVCALPGLHQGECERPGRGYGSFSARPFCPSPLARMAR

SEQ ID NO: 970184 - protein, 184 aa, Homo sapiens
MDLHSSEETAHAFQGHAAHLRFILQGSQQGPTEVCPTQPGKKADIQTKWAATRWAQKIEPEKGKPRGPDFDRFKVMKAKKMRDQRYSRNEVKKLPKAALLKASPPKHLVLRVLLLLLLLLLLLLLKFHAKKSHRREEKGSSPRRFLPTEATTATKARACSQSSEGSKSSTPKKAPAPKASGQKA

SEQ ID NO: 970185 - protein, 232 aa, Homo sapiens
MCLPLRRSGVTPPSSYKWVVGVWVCVLATALVVSLPSRPLLADPTRVAGVGWCSSSLVWVDGWRTRHGACADRRAFVVLLARSGGFPPPWAEWARSHAPRRGGGPVTRRGGGFCVGALPALRRLFFFPSLVAGAPSLSAAVFGVGLPQRRGPPAPRPRSVWGVCVALAARRVALRSSCALPLASRWVVGASHTCRSRPPPVLSLTRPACPRLRVAAWCRPTRRTRRSSAIFV

SEQ ID NO: 970186 - protein, 131 aa, Homo sapiens
TLKFLAAFPLIQILHPAHLAPPPIRSVLGTGLTDVPNIQRVERVSILEIPLHGLPIPCLQNTVGIHLEMTVTPAQDFLSDQFVWSSASTYPASHSPRIRCGPQPTTAERMISALSASCGQSTPAYYKDTHF

SEQ ID NO: 970187 - protein, 326 aa, Homo sapiens
RCTRCCGSSPLWGSHPAGGPRPVTPRSRRSGASWPQRGFTNISGVPVSCFKKPGRWAGRRTSPGPGPPGAALGPTREKPRDPGPEGEVPRPVPPRGSEDHADGRRDWEGGGGGACHHAPGRSQLFLEFPVEEGLATVTHVRGNREDHLTTTPTLDHVHSKLDHARLGTFCEGPSVAILFPDHCHGGPREQTTPTTGMGTQGPPPKGARNAQATPAAPGRHRVGIGTPKTPRHPERLSRDQTPDAREDESEDTTSSDWGKRRHSHTPTPTATPPPLPTFHEPPDTPSCPSPLLCPCPQRPRAPQHLMKRTKKITTPSPFCPPDHSPF

SEQ ID NO: 970188 - protein, 359 aa, Homo sapiens
SLFFVDHQVPSPQIVCPQKVDRFLESHLGGNKRSSKRKGGRGSHPARSLFWAPRPRSGDPLATQGGATGRTSVRPNPSLGRCQTKLCCRNFGKRLGFSWRLPPPHTEGLLGKSWAPPGGIFLHEGPNHWCPTNTPTKARIYFLAGPKKSPGGAPPHFSCHRPRWFSHSVWPLFFEGSFPPPPPHSPTVICLHILVPPLSLLGGALKVWGFAFPTGTEKHRPQELQFSHGDTLSREAQIETRGRFNELFSLGPLLSMAHASRGRSSLFWRPPLGEGHPREEKGTKGPLSLLVLGPRATREKERPRGHVVAHHFNKPACTAPERKPPAHTPFPASRNALPSREGCARREERGPRHWGFWVL

SEQ ID NO: 970189 - protein, 60 aa, Homo sapiens
MLLPPLTFTTYFRHYSNTREKENDHVLKHTQTHPHFLPHHLHRPYHATPTYFPFYSLIIL

SEQ ID NO: 970190 - protein, 195 aa, Homo sapiens
MCFSASRGTTTLCGGRYPRSVCRRRICGFVSFLSTQAKICCCRFVSVDGTHDPSLCSWGVDHTAPLISLCAPPPPILGKNHYCSWGVLFNARVLLQGVGCLCACVGNHNVPPGAPLYVIGSAPPRLNIGPPPSVYISGGRLWTNTNTGGVTTQMFGPHTTQEFFVPWERACRKVRKKGGFLYILAPRFLWGYIKI

SEQ ID NO: 970191 - protein, 343 aa, Homo sapiens
VPMCEGGRRMGCCASCVHVSLTMVWAPRDALWDARHHKSSLMSLCETTMNDSACRSVYSDTLMCVAAPRGGDAHTSPLARSSAFFDSKTVGGVSRLLSGGKRKEHKCGAPSLRGFVARGRSPGGLPTVPVARAPLRMVRVVCVPRRSVRAAFVSRRYPPVVVRSRGWCVKSFGEDISPPRPPGVFPQTRLLCAPPRLPRRPHGGRGRVRPFCRVGIASSGAPAWGGRAPNVIRWILLLGPPGQMCVGVPPRCCGWGDVAGERPPFETCLGGEPPPAARGHPQWRQHTRTPLARPQAVCAPPDGGRRPLFFQKALFAPTEREEARTLLLYMGQFFSTGVPLCWR

SEQ ID NO: 970192 - protein, 356 aa, Homo sapiens
GRPLVVPLVVLEGRVFFFSGGGDTTHSGGSFHTDVFKKKIVCVGVSQEEEFFVASDGGHTTTFVVGGGYHSPSQVCGVALPPPSVGGRRHTRLGGVLCHHGAAVTRAVWEFFFSLLLRGASLCLPAWGPPLNIFVPRLPAGVFVAPPPLCVYLCGRVLCPNTTPAGVVTPTGWGNIGPQQGVGGLSVESFRSMRVIKYDVVCCFPRPACLCGVYKMLLRRNEYGGRASSKYCLLKTVFSAVMIIVSSPHSPVLRIEYGCFPLAHTAPHSRVCSLEELFLHRAYFPPLSRGFASFVSVVCEIIWDARPHFSACGVCVYSHTHHAGRHKREGVPGESLRTQSLSHMCLSPRNSLSEKG

SEQ ID NO: 970193 - protein, 332 aa, Homo sapiens
RGEQSDDVLRGGSVRVVSGPPQMSLVGAPLGSISSVCGGQREIKLEGSVHTKCVVHRRGEHTFGGVVWLEGVVCRNTSVQTPLLLEWGLFCREERTVFVQTLAAREEKTSCLFKRPLTPLHPPEGGNLYRTRVLKIITWLPVSVPPVGDFNVFLFPCLLKPNVRTLGRNRRGPSTPVSLLAPGPGPGEGGQRRPGLTLPGPPDCPPPRGTTFMASHFAEARSPQDALGEHPTLRGARLSERTPALRFPGSCVPGDCVLYTGHKFLDNRTHPRGLCVCELRSRFSIIPPHPLVWPALTFPAFESDNRGEYPPGPKYSSPEALPGWLSHKPVES

SEQ ID NO: 970194 - protein, 104 aa, Homo sapiens
MRRGVIPPPSAFSRLCEEIPQRDSSPRVAHTPTGVVKREFFNGRGSHGLERPRRRAGKTGPHQFLREVVTWRAREEVWPHPKRWPGRGKRNPRPPGSVAPPERQ

SEQ ID NO: 970195 - protein, 131 aa, Homo sapiens
KVRGGGPPHNFGGNDASRTEPHRVVRQNKGVGPTRGNTTNRHWGANRGETQHSPPWCAEGDTPSPEGGFSPQQKRGETNPLTSGLHTRAAAPTGGGDKCIHIPGDQVCCPPPSPPGGLAGPPPLGFVLTPL

SEQ ID NO: 970196 - protein, 293 aa, Homo sapiens
WSSSCILGWVCVLAVVVFVLRSFSFVGVYVVCGGPARWLCRTVFPPYCVMWGQKHGGCPEGGCLEAPAAPIIVVGLFPPGAGVSPPPVVEPLRGPAFLALLCTPTRLSPRPPFLGPTGKNVEWERGPVTKPKGLQGKVTKVEEPHVSSQELIVNTGAYIKTPRMFAPEGPPPRRANECMPYVGGPRRNERYIYRENSRGRLRTPRGLNSRTSIRLGTARERLRCDRTASTPPGDTPLEPTKSAPKRHLNATPSPARVRISVPLSRRLDARRRGLRKNGPAFYHIFVTHPYPVF

SEQ ID NO: 970197 - protein, 302 aa, Homo sapiens
MGPPSRVPPRNVVSPAAMTPNYRGVAPGTPVGGYHTHEGLVVGLGAVPARTALFPRGHPQIGGRRFLVDPQKIEEGALIRSRKKGLSLSEPIIWVKISCGERHTLKSVICRHSSHMAAHMGLEDFLLGVHTRKRKGDFEIPPQSLVCVTQVYVARAPRVRTKEVTHLGGHIHTQRKFPRTDVPPHFGEFFGIRGPKIGTVESRVYIKGRYCLCHTPCPSALPTERPPLTPYTHVPINHGCSTRGFAGTDPPRHKPHGSPRTPPRLPTHHAHNHPRDLNSDSERVCTPLTPYPLSHHGLWSTF

SEQ ID NO: 970198 - protein, 141 aa, Homo sapiens
MSPPVGLNQWNKSGCFFGERARPFVCFAVGRPVGPWPPQRHFSAGVRPHRGDPPSPPPRSPLRGLLKTPSFYSAHDNFIFRGARKFFSLSREGGDTQKYFWGLKMFFLGEREEIITRAKPAPLGVLSSGAPHALRVKWRTH

SEQ ID NO: 970199 - protein, 164 aa, Homo sapiens
MTSVVCSAPASYIYCPRGGVSFFTRDTVVAALRLFGAPHGGQQCVAPKTACVVPVPGFPRDIMLGPPHGVAVPDPREVRTVVTELALILPYKGGILIIPPPRVIATTLTAPQIIGLKVGPPPNYASPPYCNVHFLLAPPRLSSQLGFGHGAKILLKAPHMGGDW

SEQ ID NO: 970200 - protein, 88 aa, Homo sapiens
RWGVQIRWNSRSYSQKLLECFTRCGEVGGRASDDKIISARHCSCGGEDIILYTSLGVEPHTGFLISILLAVVGYRVIAASRRLPPFLG

SEQ ID NO: 970201 - protein, 135 aa, Homo sapiens
PFIERITFMSPLIIMVLICFLVLYALSCHSDQLTDTTSQTLRNRNPLTILPPIILVLIALPSLRILYITDEVHDPSLTHPIHWPPMVTETYEYTDYGGLIFPLLHTSPLIPRPGDLRLLDVDHRVVLPIGAPPFV

SEQ ID NO: 970202 - protein, 159 aa, Homo sapiens
RAPSPKVGAPAGGFGCPPSWFPRHECFVGRISCWRRTPTFFGRRPILWRGDAQGGLRDAAFIVSSSLVLLCGVFFLGERPRGFYNLVPPCSEGHPQRRGGQEHSPPPVFYNWRAGRWLVTTPGVLFYNKSRPPYSSVGRLFLRRCFLFPSLNSPPLFFS

SEQ ID NO: 970203 - protein, 44 aa, Homo sapiens
MFFYKVEFEGFLKISAGANTNTSEERVGKLLEIVHPRDTGNGRF

SEQ ID NO: 970204 - protein, 137 aa, Homo sapiens
MLLDLTWYKHQSLEWVSTEVTFAVKLTMGYGSLAANGCIEDKFWPRHGGGGTKDLVTEATRELAIIAPDTGIRKHTYDHLASISKDELDFFRPIHECPHTARGTRLVPVLGVEQTGSDVLCPPVDNHIPIASIEDAW

SEQ ID NO: 970205 - protein, 327 aa, Homo sapiens
RLVCSWWHVMVCFGCVSPVSCVVFSLCVVSVFAWWFVTSVPALMWCALSSWWSAFLAVPSGPEGGSVPRGVSASTLTVCFCVATWPALWRFCGVHWLSLPIFRVVTHAYAVPSVSKPVAPWGKAQDSGSQGASGCSGLLVVPACGLSIVIGDLLRQIPLAVLFGIFLDMGVTSLYGIPFYERLHLLLMPPQPPPDVTYSQKVRTLRMHPVHRPCKLLCLALLWAVNVHHAASLAFPFILILTLPLRTGGAHPVSSPDPRDENVWSANEGTKPVFEEAGGVLDRVHMRMPTACVTATRGTRRGTDGRGDTAGGIGVPPPTAPPSFLFK

SEQ ID NO: 970206 - protein, 173 aa, Homo sapiens
MPATAPRRKLLERGNPQEPSHFRVELKRKSGPPKPKLRCFGKLSLFGKDLGKEIFRRGGSKGLFPKGWNSQHAMATKEGSTMGNAFGETEYNVRVETLGVWRPIMKRGIREFSEDVYKNCWGKNYMCCERTWLAIAPHVFKGVWHSTVCPFAHAQSLYFAHGTQYFILLQWRF

SEQ ID NO: 970207 - protein, 69 aa, Homo sapiens
LSRLLVMVNPPVTACFPPMFWCVSCFVFLPPPRLFCCVCSFRCLFAPVSLVVLLVLGYLRAPFEPRLVF

SEQ ID NO: 970208 - protein, 159 aa, Homo sapiens
MFSLICLCPLVHFSLWGVCLLCLCHVCGLVPLPLWVRSCHVAVCSYNPGVSCSGDVSLDVVLATEGAVRRRVGARLVYDLSVPGVGEALVSRRWSPRGRSVRRARVQQQLRPVSAPALVPPPAGVCVLLPMLGVWEPVLAQWIRHDVSVVLGDMTTRCL

SEQ ID NO: 970209 - protein, 123 aa, Homo sapiens
LFFSVCVVVVCCVSSAVVVCAVSVLSFCSHGCCSWLRDCVCVLLVRGRRSFSVVVCFGWVLCSRAAVRCVALSSCPVFVGCRLSRRWFCCFPVLLRCLLCCYLCGGRFSFLFDCSSLVCVLVV

SEQ ID NO: 970210 - protein, 365 aa, Homo sapiens
FVGSRCLCYASFSPLRFSLLCVVAVVFSFGVDVFLVSLVFRSLGLAVPPRVRVCLRVAGCALVHDLLMSPPAGMCSLAVNSFPLAPVAAMPLGGPYTGGPDPPCARCGLCIPARSLKVLELGVPGHFGPERLALPVEDLGPLVLPVGSTMQSRWLNNLGNFASTVRQPFIVSASSFDVLPLVEFYLEEGITYEDPISLIDLEVLRPQRDAPAQLEIRQPPAPQILAAEVETQDSLGDEDPVPQLKLSFDARWLQSSVPRGGDPGWFCRSLSPRDVLIQRWPPPLRWPYFRSTAACRLPYPVPLLLPRCSLLEDYELSGASSLAAAPTAPRCQDDPGPMTRHPGDGLPPSAPLGVCWAVKENKEFN

SEQ ID NO: 970211 - protein, 138 aa, Homo sapiens
MKSLLGLLAGKAPNRCRTRSPNHLGDFFGMSHSYAECYPAPMDDMAVDSDEEVDYSQMDPGDQKGPLGPWDFDTPEDNTRVYDHQEALPQAALPVMVSKCLKGGETRRFKENPGPSTSLSRPWKKISAILEKTEEDGS

SEQ ID NO: 970212 - protein, 122 aa, Homo sapiens
SRPWEPSEMNLDPFQELYLGTSSVDELREKLSESSGIPLDDIEFAKGRGTVPRDISVPDIHPDLDWNPKVSTLNVWPLYICDDGPVIFYRDEPEELMELTDEPRNELMKKETRRLPKTWTLV

SEQ ID NO: 970213 - protein, 326 aa, Homo sapiens
FAVVSFAFVCGGLLFDSPCFAFLYWVVRAWIWAGYFLSSFSYGSSGEVALFASCWRIFGATVCARRWCAYGVSHRVATFVWGSGVYPRGIFLSVCRGGPWVLGCSCVSSCLPAFRGEWTRGGVVAHWCECPVEVSVLALAPVGAQWLNSRRLFVLLCLCYVSCSTCRVQSDHSEICWYRSVAEDPSDCGLCDSLVPLYRGEGLLGFFPGLVPRPFMVALPFFVAGVTPWPNLVHILVHLDPLGLFIPRSENEEVISPKLVHPDFFGEVLLTLMPSVWLCSSHSFWLVPPTSLVLLCGMPSLYLPHYIRFLEYDSVGALATHKEGEY

SEQ ID NO: 970214 - protein, 74 aa, Homo sapiens
GRCCVLFASVPVAEVLLTVLVVRWGRVRVTRQCDRGRSGGLVWVAPPSLAVASENPSVLMSAPRSHYLSGTLIP

SEQ ID NO: 970215 - protein, 114 aa, Homo sapiens
CLYVFYSVHRCVSLDACLSVCLLCLIRRLSVLVCFYVCVLAVRVASWSVVRRVDSCRSVFSCLCSSLSCVLFSFFCSYLSLLSLFVLDPSAVLLTWIPPTGLGGWVPECTIIAV

SEQ ID NO: 970216 - protein, 115 aa, Homo sapiens
MTVVVFVVISYSESQQYGDRLCVVLMEGVLYCFHSSYSCSLLCSWFGCVIFASSSSCLAFVSSLLRSLVCCVDASTSLATNPLPLGFFAYIHLLWVVGGGGLLPMVGSLCDIPGS

SEQ ID NO: 970217 - protein, 127 aa, Homo sapiens
MFGSFTYKCSLLVVWSLLVCLCSAVCLVLVLRVLRYHFVLCLVGVNPSSAGLVLCVLGAVCSPRGFVCQPRCAPPPPRGPLSVQCWGTPPRLGFRGWRALCFPTRGAAVRVGCNIGGFLLRNVPTWQ

SEQ ID NO: 970218 - protein, 74 aa, Homo sapiens
SVCGYVTCCFFASRVCWCCVSVYVCVVPSAYHWAGGGAGVLMIDVANVPRSPSEPVQSRAHAILGLPSPWPDIL

SEQ ID NO: 970219 - protein, 178 aa, Homo sapiens
VVVVGGVTDGWFVLLCCGRVVGRVCVCRVWVLLSVRSSVVCALVCVVVMCYVWCLWQLFFVQFLFAFQVVGMVVTVGYSFKKFLLIVFCGCGVRGSQVLGPARACGGDAGVLGTACLRFLVRDVCRKFSLGETFFWPRGPPLGRGEPCSCAFFGGEMVHVGGSPWGVFLWVVIMGACF

SEQ ID NO: 970220 - protein, 160 aa, Homo sapiens
MLSGALPTVVALWVVLRVDQTPYAPPLILFCRLNDHADCPLLVPPPWLRSSLCFGGEGKLLGGKFLLMWTHILWWGGFPLFVCCSSHNSPVFVGSPHRDFLRLPPLCVVGESVSRDCECSYVGGGCPRAPGAGDRCYAIVLLPPHCGFMGGAYPGVLGFI

SEQ ID NO: 970221 - protein, 133 aa, Homo sapiens
MWFLCEAPSESAGGALAVRAIIVSARWFLATYDPCGKRKPLDSYLGHFRPDQPTGRIIHHQEMRQPQPCGSLPSAQLHKVLGMDPLPSQMPQKPKNENPVDYPQFQIPTQHPPMPLTPLKRPMEEDAGGEVAP

SEQ ID NO: 970222 - protein, 254 aa, Homo sapiens
MFDARLCSPLGVFCSLLACAPPCCCPPRGNLMKCAQYFLWDCGPMPREEEFSKRAPFIPVPRLSGHTYVCQPRPHLGRWKKLCGTPQCGPSAQESGTGEEFWCWNEPDLYSLISSGVGTLLPSDYSYRGATMDVHSVNEMGPLLLPLMPPLGVNEERLFGSSKICWFPRWGVLLDTQPPLPMITLVKSIAHPALGVLREPPPCRVATSFAQEFPFSVNFPHYHLCHAYNVSPHGDFPPTNSRFATQIIRGLFSL

SEQ ID NO: 970223 - protein, 105 aa, Homo sapiens
LVFGPFAGCDGRVMFCVWLAGLARGVGWPPLACPGLFSPRFLGGWYFCGSLSPRFSACASLNSSTHTFLVLPFFSLGLVWRRSRGLGGLSIHALAPPVCGESPPL

SEQ ID NO: 970224 - protein, 101 aa, Homo sapiens
WTLEGRFRGHVGLNAQRMFLLKKFFLANVGGARRIDPPMEAPGVHVLQGIIPGTIRPYYARAIPPVLDFPHRRQHCTSQVCLRLEGERLIARSGKKLGRWP

SEQ ID NO: 970225 - protein, 161 aa, Homo sapiens
MSRRGCRPPRLCCAVRPPNLRGGDQRLCVVCAYVCWARRRCVRLVFSSPPPPPVWLQCYAPPSWGGCLSKTCGTRLVVVRGGFLLVVRLVRCPTNIVGAVFATPLCIDDIFPGRVWAPQYQRTHPHGLFVCRARDNEVCLPPARDPPHILAGISPGGLFAL

SEQ ID NO: 970226 - protein, 132 aa, Homo sapiens
SPSVWMCLSLFVSGLCRWIPPKFMPSCFFRKLGEPTALCVIPGVVFQAIAVLGAPLLWPLALVSATFPAVGRIPSCLCRRFLGIMALSPGVLSNIGRFSQESNVCVCGRTHVSFLVVVPRGALFPRFFFQFG

SEQ ID NO: 970227 - protein, 207 aa, Homo sapiens
RHDSSFRTGLCLPTAPAHTMGLDLTVKICGPRIPGVPEQLHFGVRLKAPIYPEDRRARLPAASWLSHPSGVAAAGPGSPLPARAWAPAARSCWWWTNATTSEHPGEDYQGRRQHLRGAADADRGPPESRQLSGLEGVPDDLFWLIFEGKPLEDPLPLGEYGLKPLSTVFMNLRLRGGGTEPGGRSSGPPPSIRAGSKGPEIKAVVKR

SEQ ID NO: 970228 - protein, 113 aa, Homo sapiens
PGVDLWVLVVCESSFLVYWCVGLPLVLVLGPLSAGVWLSLLPACRRRSPGGALVPPVLFSISGPVSLHVVALRPLFSLGPAARAFWGFGPRTRTLGPPTAGWPPAMGWAPPGS

SEQ ID NO: 970229 - protein, 122 aa, Homo sapiens
ACLVIVAHLEVVGRSVRLSTSVVSTPACCGDTRCAPFDVFLADFMCFVRYLASWVCWSRAFFWGGNIGEFFRLFQELVAFLQGVFSVLLVLTMFSWVSLCWLVVVPALSCWEIHPLVFSSWV

SEQ ID NO: 970230 - protein, 156 aa, Homo sapiens
RFFFAFVYSCVVSGLGHIGSVWWFRVSLGGRRGAFLLWLSPVGRPVVWVLAGLFFVVNPALGVVRIVVVRLPSLCIVDLSVGGGRFGTMSPGVEGPTVLVIRGGRRGLTLELCARALIGLMLGFVVGLLIVCGDHGVLGSALWGFTMIGAVVVIPS

SEQ ID NO: 970231 - protein, 152 aa, Homo sapiens
MLLPSPKVVTLLRRGPFELEAFYSDPPGVPYPRSQNRPLCSSECVLHQKDGEKSRVKSQVRSPQPTGIFTISTASMVEKVPTEENEMLLKLTLECLNQRPPETQTLIKMSSKTTVKLGHSPRYQLMLNQPHSFPLHLDLPQKKTKSPMLTKP

SEQ ID NO: 970232 - protein, 181 aa, Homo sapiens
MSQMGGRSPPGPVTVLLFGVVRAHVCWWRPVPLSVGPGPVSGDPPVPCPRCGPTRPWDPLPSHLQVVVLMFSPLPIVPTPSLAIARCPDPRSPTWFMGSQESPRPWGLGLSAPLCTGLSPPVFLQTTPPEGGPRFSAAAFLLLHPQPIGQAPPDQPFVLLLAEGWETPPGHSPPSPLSAQL

SEQ ID NO: 970233 - protein, 373 aa, Homo sapiens
RWGDQWGRSLCSSCDLRAAPSRWYTRRVYSFAPGPRCPIAPFFGPTYSHGFALNSGLFPCWCFPPGFWSSTRVSPHRVPTVPGAFLWGSWPPRCALAGTHVASFRGRPALVRGFQARSFPPRTIHGAPWVNLGPSTRGFVVHPSPTWPPREASPEVTHLSSSNLHVPIRLRFGFRILAFPCIPVRETTEPRGVYRERIHTEFRPRGYTRSNFDNSFSPRFSALNRGDVRPTPLWEIGLKIPNPQGTGHFLWENSPLTSWRTFRPSFLHSTQNGCVVKRYRSPLEGAPGDEEKDLPHLFLAPHTSVWPRPRPLPTALGGLPPGTSLTACLHNLLVGHDPEIHACTPARREGPLACWAWLGAPNPWLPCGNKQTN

SEQ ID NO: 970234 - protein, 187 aa, Homo sapiens
HYPEEKVYGIEQNPGYRKEEKKRLPLLLEEEMDVFEQALASEAQAKDPFGVTCPQSTFVLDEFKRQYSHEDTLSVAGHIFWEHFDKDGWSLWYSEYRFPVRTHSDLHELPSSSRGMFPRLDQTEEECLRPVSSLLGPTHSRSHFWSSGSSEARSVAFPLSPRLAGGLRVITHGGNWILAARRPQTLV

SEQ ID NO: 970235 - protein, 134 aa, Homo sapiens
YAVLPLLGNWLVTTRCLCYLPVLFTAPGFPPRLVAHWAQLCCRDVNPRRKAPCNCWVKLFPGAPLGLQVQEVCLSRLFLRATFLVAAYVPPPWEHLGFMGQVIILTLPGPISLRLIAPVLDCQHGSQLQASLLS

SEQ ID NO: 970236 - protein, 71 aa, Homo sapiens
HGVWSRINEGDYTPFVGGRRRRFVTVCVETPSSSVFPRLVYRTPSVCWNGDVSQAGAQQIVADGIDMGEMR

SEQ ID NO: 970237 - protein, 178 aa, Homo sapiens
PTWFVTYAYICVEWFFFLVGCFDYNFFITVRPLRALTPFFCVVPAIAFSAVASSFIVFFSSPPRVISFSFFWSHADVVFSSFSLFFRPPCIVLWHTTCFDYKRYNTGGVLLFLERGTTLGGPPLFIIHTHSGGVPFSFIITHSSLVGFVVLISTPVEVFFFVRVCSRRVYMCLSARVF

SEQ ID NO: 970238 - protein, 255 aa, Homo sapiens
MENGKHGGTLFMAQMYENFCGGSGYLVDINGISPVGTGGSLDMPCPASLSARVARLYSYLVPLPVPDPEAGFKRANGSGSRGVFAEIRFLPTQLAANPGLGGKGTLPSDSKVEPTMERILETGEKGAMSLEGASLPPWKFGLSPPQWPLFFVIYHLSHGWTRGEYHVCAPGGPTSLPKPAAPATRPLAGFSGRGPGATVTWESLAAFSVHMHSRRSIGRSPRNPQEGCLEALARATPWPSAHTSHQFPSLIKPSI

SEQ ID NO: 970239 - protein, 112 aa, Homo sapiens
VLLVLLLAVSNYGVSGVECVVSVFTIEMVGLDLIAFYSMVCYLCLIFVWEAVLFCVPVSTDVGGVALRITSLFNGVFFSDTVCVVFASLSTTLCCRPSAPLVVCFLPQWGGL

SEQ ID NO: 970240 - protein, 189 aa, Homo sapiens
YFLFFTALRTLGWSQMLVKCLTCMMLARGSVHLYRGLSVSLLAFLAPYAIVFVLTDSLVCSRARSPLVFVQHLPVSCCSTWQIQFGSSRRVTPAAYSSLRPVGLLAPSTRYLLSSCLAWEIRTFGGFVLFVGLVGWCTVLFVRHVSAAGLVSGCCFSGALRRVFWVLTLFSSGGPALSCNFFVSSSTHY

SEQ ID NO: 970241 - protein, 413 aa, Homo sapiens
SYLVFLLLFSPLVVVFCCVGRVVIVPSPACVGLLSCFLDICCTMLLFALHKVFSLHVTGLLTGSFLPRGSRRPAVFLSLVPSCCGSPCGPLPDFPLAWSLLVPFGPFLMGLSTRGSPRCEPFFFPDFSPFWNWMYPRSSALGVGFTGAFILVPFSPRLWKGPGLYPGLVKNEVSSLGPHAGSTGPPPHGPLCIGVLLHLRPHIWEAPPRPLDYPPSLLPTPEEECTERMYAPYGPLFLAQMSPIGGRVGTKREPGTQPFRGRGTGLTGTVYSRRKEWAPRMPLHPVVAQVSSTPCFGNFTKPLGMNEDPEHWAHAGGLCCAFIPRLEAAGSGGLPNLVPAGAIQVFRESYTNSRVWWKDDHGGDTNLLEEGGSPQFEGGTRAQRCRISHAFHTRILKPEVCVRARVREALSPI

SEQ ID NO: 970242 - protein, 110 aa, Homo sapiens
FCFSLFAFLFSLCRLTSLLTRLFFFFFFSWSTTPWFLRRAFLLMFLCLLATHPVSSLLVVLPPDLPHPNVLLGNRRCSILAICTLFPSRPCFGENFKALYLLGPTHFAYS

SEQ ID NO: 970243 - protein, 140 aa, Homo sapiens
MSSFLYGPSCGSSPMFLVASGVCFIPIDLSPGLPYGPLFCGCSPMVSPAGPISVGIFRLGLVFLAPLLFPLGPIRTHFYRSLYSSVFRPPRPRVISGHLSGSPFGLLVFLLGMLRRFCYRRHGGKNWLPKICHPASRNTL

SEQ ID NO: 970244 - protein, 126 aa, Homo sapiens
CFLCVVKKLPPPPLGGGQGGEPLFVKPQKAPQVWEGVNTSLLPLGNMGVCVEIGTICVCAPICLCGGHSCDRPHATHHEASYNSGLRERVVFHKRENEKPHSLGTHCGARHAHSGRFPLTLSTPSP

SEQ ID NO: 970245 - protein, 93 aa, Homo sapiens
IAYRDISLAVYVDVEARMVFSATPPWFGSRIDGLGPPGAQQWGRATGGLEYRARCEHALWRRPFTLKVFLYREFSSKALGRVGSGDVKVVMKW

SEQ ID NO: 970246 - protein, 224 aa, Homo sapiens
FSPQGPPRPTHALGSRPSCAYSALSYSLFSCAPSGKRPPSQFPLKAHTFATGALFWRDPLGPPKRGEAPPTGPPESAPPSGRGEEPRFTRERFLCGARRAPGVAPLSPTPRGSWGRAPPPPRGVRPIPLLPLLLLLPLGRPSLPLFPTWLFTNSLPWTTWPRAFPLPGPLGLAQGWLEGTPPFFCTPLARRAGLAFPHASTSHCPLGGFGLLQALPPGGWTVSV

SEQ ID NO: 970247 - protein, 220 aa, Homo sapiens
VSVRLSRLLASVAIGTVSSLLAGVVECLFLCCSVCLSRLVLGSWDGLRSPLLVCCKRLLCLCKSCRCALLPLCFMLLSLSRHLFLWGVVCLIPVGARRLCSSLCSSLPTFVGVCLCGAVLCVALFHFGFGNLLAVPSSGLWCWGQCVLVSPRGLIRVRFVLPGGGLGVLFGGRAPCARLVCVCSPAARLVAVFGGPASAGFCTAWDLCVALWSYIVRPVV

SEQ ID NO: 970248 - protein, 354 aa, Homo sapiens
MTACAGRGGWTWLELVVVLAVFGSLGVGAGCCSVSRRVLVGVLRSAGGGRGASLRLRLASRLERFVGAGARCGVFPGGSAGGAVGLTGLCQGVSILVAELFFTPGGRPDCGHFRVVSGREQSPGVSPVRLRRVRGRYRTLPPYGLASTPQGAPGPRECVHPPASQVAPSAVLAPTFAIGKGVTLGEGVRLRESICPPWSPFAGAHVFLHSIVGWGSPVGPWARVEGTPREPLPPQIPEPALDRESLFQDGKLLPAIPLLGCRVRIPAEVLILKLDCSATPRRLSRSFTNPITPLSRAATKAPSSYPPPLEAAACLASLCPERNQRKPRLDRHNAGEPMWMAWGTPGFFPSRLPN

SEQ ID NO: 970249 - protein, 134 aa, Homo sapiens
MDLFWLVRCVGLSCLVRRSMYAAALFALVVYVLLLQTVWCCPAPGFCTALLVAVVFPALEEGGGASPGPLCFGESLSCFAVPGILGSQGSMSQTGDVVVLGQSLWGVIGLDGGGWADLLVGTYVFLASLVMYCN

SEQ ID NO: 970250 - protein, 114 aa, Homo sapiens
SVLTCSCCRCCVCCCMSVLRLLSGARCCLLCRTFASGVCCGRIQFDRGAVLVGGAFSSLPSCVLRHACPLLVPAVGLVSLVSPFPSPFRSSPVRAPLGRTTCVWHPGRWGRLLV

SEQ ID NO: 970251 - protein, 131 aa, Homo sapiens
MVPLPEPLENQEFPELKFFPVKKFAHKMLRKPKRNFIYGKLTPVPGYLPCTELDSNARMPESCHFYVPAGPPLAFVIRIRGIHGVSPKVRKVFRFFAFVQIFHGTLVKLHQASINMLRIVEPYIALGVPPF

SEQ ID NO: 970252 - protein, 137 aa, Homo sapiens
MCTGFLRRVHPQPEKVMLPPAALTPARAPHSRIPPQGQGAQDSSTFSRPQLGPLDFPSKGLLALCSSLLPVPRKGPKKVYRHFRPRPHGTPHHTTTPTLTSAPRAGKFRACPEGRTGPPRLPKLNLDPTPFYLKDFC

SEQ ID NO: 970253 - protein, 154 aa, Homo sapiens
VGLELYQSVLSIFSSSCVVDLMSPLLWRACVSRTRGLCVFRLSAEVSLSVLVICMSLAAISAGDWLERAALDQTEFGGRQLFGHELNSVFAASLPMVCFDCVLLEFLFCGISRPVCVGALQFVLRVRTVSCVAVAVRPFSVPLLLVLTTLAYAA

SEQ ID NO: 970254 - protein, 242 aa, Homo sapiens
MARAVALVGLGADSSLCAALSHGCVAPFGGVYKLSAERCEGVRGGCAAAGRLWASACLLRRGQGVPPCRGGPDFDRTLVRQVPVCFRRFPEQIREASATIIEPAGESDNPLRFTSWVVWLPWMVMPPWSTVHGFLQRHLLRSRSYIPMARLTMIPPQPADFRNPGPGRHPAHSPPRCYSSRHHPPWTTRHCPRVESEAAAGLPTSQCVCHSHKCPWMEGGEMSTPRWKPSHRGPPFPFQPSL

SEQ ID NO: 970255 - protein, 228 aa, Homo sapiens
MVVRARRVGVMSVVCGGGLLPLRRYLSGVTAALLVFGRQTTAVVGWLTSPAGVGTYDGDRVAVCDRCSLLPPCHMRRAGRKGDAPVLERLAPDVCATILAAHNTFMYVCGGTTPLIFRIVEGAAGRRPPVSATVVCREIGYDMYIIGVGAPPSCGGKQTSYGGLLPFCVWVVFVVPTQTSVVHRRKGCQNEGGASCERRGVVVHEQDDLLGSRVVTAKTKDFGGTPMR

SEQ ID NO: 970256 - protein, 118 aa, Homo sapiens
MARPFHETLLYARVSIGTLGWYTPPPAAHVSPRVSYPALFRAPQPGALERVLCCPRRSETRGPYSRELHAHEPTDREEGKESTTTLFLESLEGTFLVGMRKVVPTQAFHWNAELLWFL

SEQ ID NO: 970257 - protein, 392 aa, Homo sapiens
RVSLVGRRSVGRCRLVFGGELFTGAVLALLRLSPGVQRPGSPPFPRLFAPGPPAWLGPPRLLSRGAGSTPLGARIKSTGVFCPSPTPRSPHRLEEVLPAAASVLRTELKVCPFQGDGSEGRVCKRNGFQLNRLQQGPDVSINLPRLDSWKSSAIDQTGENFPLIYDPQGRFAVTSYVPPEEGPRDPSCGPRGGKDSLVGAPKGRFPPTFWVNSTDGAATHFRAIPPIPSHSPRCNMRYATFTRLRFMKSCAHEIILRFHITQCRHTLGKPWCIVGTGEVSIHLWREIGVITPPRERAPLESFERGSHVRKNAQMATRFATLELSTPHVLLLAGPPTTGFLFPAGKGIPLTHLLKRETQRLAAQPRARWVKMGPWVTCQIFVRNLKYCGRIYS

SEQ ID NO: 970258 - protein, 476 aa, Homo sapiens
MASVWLVGWGVLLLAWPRLLCCVFEVGALAGLCVLAVVGAGAPVVLRCGSGPRTCRCVPYAWCSSLSVSLRLGMSPIHDGVSGDAVSRSVGLLAGVHACCGGERQFGLCWMVWEERAVGSAPGRFVCSTAVESPGVGSGGIGGDGFGVLLQGGCGGASLWAGPVGLGNEGSLLCVYVLCSVVSRVRDAVQRLPCALDPCGLRVRRVVAGALSGSFSALGGVKGRCLAKGGGSSCLFGSPVWLCAPNWMGGVSFSECFDAARSGGPKLCLRKFLALNVASEPCRGGSKSQVANTMLVLHKEACGGDVAVGGAVLGKSSEVLGPPWESWGPSGPVPGPVCCCVPARRPLGVRLLYSWLKVYAGLARPGGFTASVPSGPLRSALWPTSVGTNGGSTTMHPICPAGLVASIHRRSHVGTMGTPDRALFSARFEDQTITHTSVGVHPTTPQLVIALDFTYKPTVGHGPPLFYTKISNKFLP

SEQ ID NO: 970259 - protein, 311 aa, Homo sapiens
ALRLLCWCVAVLCALLVVVAVRVCVRVQVSAVPILLARCFRLCALGPAEAPRGWAPYPWWAKCAALFARGVGSRLTVVAPDPGVRCASSAVVLVGAPAGPLRILCARIASRGEIEASEESCSRDLVTPCHPSSMLHESQIYDVENDTGFPEGYPTPIPLPCTYWPKPIFDPPRLPPRSASGPDDPVCFVASALAQARLLYGNECPRFLEAAPGGSEALGPEWNVSVPFLVFHTGYPPRPGTLNEGVTEIWPRVELTTTLLLSRTFWCSPRDPQREWLLEPRWPRLVSQPETLQKVFSSIFALVLREREDPF

SEQ ID NO: 970260 - protein, 482 aa, Homo sapiens
RFGIGMWARSCVPCAVLCVASVVWGGLRPLVLFALFVRAFVIVLRCSVRGRWFVSGASGVVFWLVADLWCLVCRFVLVVVFVGRRSGVASRSIWPLCCVCVRPFLFAVAFGLLLLFFVCLCLFLWAGFCCSPVVSGSGFCVCLLSSATMVCSDGGVPLGFRWLSALLVVCGVVCWLGCGVKGAVLIQSDVGGGGVNVVRPGLMVRVVCCACRSFVSVVGVLSLFLRLARVSCVGGGGVTAWCVLRFRLGVCVCALVRLSVACRRGVLPVSAGLGLGEGCVRLGGLPLWASVWRLMCLLGLRRPCVGPAEQWASAGVLRRGVGSLGVSSLVCDGRACVQALGRGCCISLLMGVLALVSPWVGVPRCELSEFLSGRRSVPGHFAASPILSYVLSCGACELSTRLTVDLSEGRRCGGACLLRPPGVPGCSLMAPACLRPARAHGAVAFSYARFGASPFLVTVSSRRKRRLLVGHVRCGGHWEAPS

SEQ ID NO: 970261 - protein, 284 aa, Homo sapiens
PLSQATVMADVALTVRAPRPCVCRSMSVFLRVLFLGVCCTSLALSVVSVCSLAWGAPRCHPVVMALPGDFARCLERSGQVLCVGSASLLASVAMSNLLQTVPDCSAKNKEGRNMTDHESQEKDFRDPCISENLIQFCAIGRAVGTNYPKDMCDPHVWSEDSYYEALAQAPENEMDQLEKAQKERTKIEFVTGHPKKAPPTHATSTTHSAPATHTLLQNAQKRKEHSGIRLFPVTTDMPRPPSSPPPATPATLLSLVTPQRHAAPRPTVISCCVAPIVKKAQPVT

SEQ ID NO: 970262 - protein, 133 aa, Homo sapiens
MGTPRVREGRWKDEHFSPLSCSRVNTSLEGPEMHALWSPTSCTFSSAVVVEALRGPSLFALHPPVFPARAPPGTPPTLWKWPRSLPGLLCEGEKILFFTSYATLTTLTICFETAPKFSYRVVCLQFFKNKTFN

SEQ ID NO: 970263 - protein, 127 aa, Homo sapiens
GGVPPHRARPSHMAPPLLLHVVPQHSVAGGPKRAPRSSPVSQCVIAEAILLFSSPLRLFPCVGPRPTCRSRPVAAHFPQGGPRQRTCCLPLGDVTLRGAPPPILDPPPLSSSRPWGGFLSPPARNGL

SEQ ID NO: 970264 - protein, 126 aa, Homo sapiens
AIVRVLVRECLVWGSAWLLVLLPRFSAPGLGLSAVRPTRGVASGSLCLFVPPLLLRPPGMDRPCLLDERPMRFVWCSVLGLVDHVVLPPAVVLLMCPPTGCVVPGVCSVAPLMEVGRGGCVCVGWL

SEQ ID NO: 970265 - protein, 216 aa, Homo sapiens
VPLRSCKVLCIMDADRPRSNNRCLNNQQSLFQPPPGFVFLFSWVSPPRVFSWCIPASPACVHVVEPWWLRRGPPILAFGGFQPWTAQVPQVAKQQESNSFPRVIETPLRLPPCGPKYSFPRQKGWDLLTPFETRGNFCPRGFLFSPAFKEKFLGAPKTDRNRGFTQGGPQVTHPRRGSSCGRLIFVVLPGINRPPGVLGPWGDPPPGSFTPQHWFI

SEQ ID NO: 970266 - protein, 149 aa, Homo sapiens
GLSSSFCCFALSPSVFVSRVLYLCDCLSPALLLCFGCYYTGHFPCFFSYQSACSTVFLPGPPWATSARLCPTAPLGCLPWGGLTGRASLSCALSAFPSRALPPSQPPFSCTFFRAGKGPTFCFCLPISGRYGYPSEGAGLRPEFPLDRG

SEQ ID NO: 970267 - protein, 150 aa, Homo sapiens
SAVMSATPAAEVLLKDGVSPRSVTPLRAVGALFLEARFFLSPPFWPRCLALSCLGFPPPRLGSPPGSSEAPTGIAVAKAHEGPTLVAPGAFVQPGCSADDHRSQRSMDPRLSVPNEPRPSREWFPERNPGYVRYSIPALPPTLRLESLWY

SEQ ID NO: 970268 - protein, 404 aa, Homo sapiens
VRHQASLQGARVVSLSVSSFFLRVGVTWCIAQRPSSVGRSLSLLSSIYIGRTTLVMCCRVCGICCFVTPTGGFVCGARSMSQCFFQRVFPRVPWAPYGDPVLGRIGPVARPIGVGVECWLVTGAEYGGWTQGALLGGEDTVVGNPLVVPVVLPLICRSYTTSQEYRLRHSGALVLSNAAPPRVLCLLGSYLLLEDCDIRTVTPTPESRVLSSLTECCLIGTCLALGPDLPVLLACSLLAPSPGVWPLEPLPCVYHTLPALDAPCGRRLAWGRSASPVRIPCHPGAVWIGQNPGPPETFAHTHSFPLSLGHSPWIVPLCPRAVPFLHGGLGHWVLGPSDPSLLSMTQCCFGQDVTMQWVTSTTTVSKATPTLLPLCLPVQKQLNLFHIVIHPWEFFNEYIITMKA

SEQ ID NO: 970269 - protein, 149 aa, Homo sapiens
MPAGTPRTYPQLRRVFQDDPQSGKPDLDQVLDLELKGDLEKCLPAFVKCAHQPTQRFFAREASIQPMKGVGDSAHKAIDPGLWFPQFLKLTMDDIQRHSYPEECMVSLPFAQPSLDETQGDYEKIPGGSLCGGNLTIPLMVSSYDPEDL

SEQ ID NO: 970270 - protein, 106 aa, Homo sapiens
MELKSEDESTPGSESWPFFYECPTIKDGPPMRPLPYFRYPESRRVAPLSTVASPLLGVALRVDRYVCEVVYIGSISLHWPAQSITSDLCGRSSGAKTFTSCPGGKY

SEQ ID NO: 970271 - protein, 155 aa, Homo sapiens
DSHPSAKRVFFTGTPLVLCLPKGFLPLELGGPTEGRPLFATLLRGLGPPSPGPAFAWAWPGSPIVRGSHPSCLLYVGDVNDPHQVPGWKGWAWAIQPRDCPVTRSFSQRSYQKISFPGYINSLPPPATLFFCHHTGAPAIVQNGRGLYQGETLVP

SEQ ID NO: 970272 - protein, 329 aa, Homo sapiens
LAARWSVLRGGASAMICWCVRWRVCIAAVGGCWRLAVVCAHVLVGRACLFGVASWWLLEGVVSRFLAEMEGPRAVRAGGGGVRVWRVRSSCMGGVRQSCPFVWGGVRLAWSGAEWRCVGGGGELGADCCPPWGGRVVAAARVWEGWKMRGGVFGRVWLVVYDGSRSLLSAGPPVDGGTIVVWCERLVVMAPGAFCVGGCGTTHRGEDSSRRGCVSAGRRGGAPHRGWWKVSAAVRRCVVYGQRCVVASIERGGEIGTARGKNGCVCGKRASLVEGGPSSPVSRGEFWVFVLWETPRAYMVTPRALSLIDSPLSLGGGHTPRAVSIDVSL

SEQ ID NO: 970273 - protein, 260 aa, Homo sapiens
FVCGTGVGVGYCCLVRGLFGCWWWGVAGFGVVVWWVVVFSFLCARVGCSVGACCWSALWGRGVVCVSLLVGGAISRVCLCVTLPGPGVAASRPPGWWRSRLDVPPGPGCRLLGTFLRVWARGTGIHPMFEQPGGTQAMAPLMALFKGTHRFRNHRVCNPQKDTRLVNPVSADFSPGIILFEPTGCPRERFGPPTPMGPRVFAPHKTPLERKGRAPRGAIQYREEVMLDTGRLWGDTQRLSQHRGTTRGGVGCGEGDVSPP

SEQ ID NO: 970274 - protein, 193 aa, Homo sapiens
GELWVGGTRCCGSEVWVGGRGCVGVLGGVCGGWVSRRRVCMSAGVVGGKKVCGGALRPSNPGTGRRRLVVVGAPRVMGRWRCAGWGAAAVCVCCGGRFAGEGGCVLARAGRCRGPAEGGRLAEGWGAERKTERRGAPGEGRVTHRGREERGGALCKKGIGPPLPAGAQEVKPCVSGGPQKKGGCGSGEKNPRV

SEQ ID NO: 970275 - protein, 225 aa, Homo sapiens
GAVGPVRRVWSPARVVWVVAGGGGGVSLERCLCSGARMRVGGNVRCGGLWSRVRRGGVALPAGHLWLLVSGGCEFAAVFRRGARGVGVLDCPAGERGGSLRGKREWKGAFPVERGVFGGAFWGSRPGCRRGGRGQDGCERRTRDAGPRERGEHRGRHKICVAWVLRKETPGPKNGGERPFTGGAQEGVKWEVSLEEERRCVEIMRRVRGPMETRVLRTTRSHALL

SEQ ID NO: 970276 - protein, 144 aa, Homo sapiens
MGLDKTRGNGRPAQKYSAAPPYAQGPRQERGWMVVWGGEEQVPTAGDRRCREIVQEWPAEAKRYPGPGHPKGTGPEAPRGEPHGGRPRGVAPGRDLCCRPPPRQEVSRRKGEAPCPKTLRGNPWGEGARAPGVASSAGPTWPWR

SEQ ID NO: 970277 - protein, 281 aa, Homo sapiens
MFSCLFLGGLVGAHPVSVDVSFVVSVGPTGRGVNTTLTATLCAHTPDVAGGPRGAHRTDSVCPSAGSPLRRSGVLRAKKTRVLEHEVRAPTTTGARQEDAGLGHPRWLGTSGPRERWESLANAGSDHTAPQPGVRPPPARCFSTRRKGDYEQRPRGTTTRFFEPLSSLLEFCYAAARPGPRHVRRVAVAHPRFPGFYKRARVPPPATQPLLNSERRPGPAAFPRFFPRGPAVTPAPPQTPEFPHGPSQVPGLPPPQPFHRVLTYLAPEFGAKPEPIKGLEP

SEQ ID NO: 970278 - protein, 111 aa, Homo sapiens
MSQQEVCVVCPDPQRRCPCACAPRLQVNCLVLEGHHHEGPSHTSGVASRAGHTLWGPFVPTGCSHLEMCHKVGAPARLLWWPPRVCAHCGPLLTRALSQSERFVCVISCRL

SEQ ID NO: 970279 - protein, 112 aa, Homo sapiens
GAIVSQGTVCPIAYLVRTDDQVWSQKTGWGPCPGNSRGIVVLPHRVAAAFWMTHGWFFIARAESWCVDPSPHEGARVLCGRGPPLFPGESPQCCTPIWPGVFTNMRGTIFAG

SEQ ID NO: 970280 - protein, 106 aa, Homo sapiens
GSLEGNKVGGCSTGAVLRALPGLLDPPLFVNGGGSIEVGCLGGGARRGAPVRGRLLLVVYFAGTFFFLGICCRLLGVNWEEGGPGWRMYACGPLWAGFCPREGRGV

SEQ ID NO: 970281 - protein, 282 aa, Homo sapiens
RGVVYRGPESGHKWLPGDDEEVNHQGFAEEFLRFPKRKGDGPLYGGTRDTTAHSTSEEHATQIHWGPAEGGARTGDNTSLTPHETLVDSVGDVGVRASYRRNALLLAEVSPTFPPPGGDELSERKGFFLTKRMCSHPAREGSCVSRPRVSLGSRAPRRPIWHIIWREKASLFRGGNPRPRESAGEIFYRERRMQREFGGQQPFFKDVVGWENPVGPAPAPHPICAHAFLALHPELSMHTSVARRFYSREGAPHMRHAPRALRPLTTPGQANFLEFEFLAAGL

SEQ ID NO: 970282 - protein, 149 aa, Homo sapiens
MHRRAFDITGESVVCVFTAGNTPGGGENLAPGGSSCAQTPRLPRPDVVGEISPPLSGWSPAVAPHTKEAGPTRLFSRDGGKKKICYSPTHVFDIFSRENISIKERKRKMRPFNTLSLREDTFPTNGTRFVWVAHLVSTENAGKHDGRTT

SEQ ID NO: 970283 - protein, 67 aa, Homo sapiens
NLLTSLSLGEQNWMGGAIPHENPDSALVFGQGLSGNNTGGFVSLDCEQVSKCSPKMLIHQPLLFSNM

SEQ ID NO: 970284 - protein, 314 aa, Homo sapiens
RLPAGGGLIQDDPFCGDRPRVPWGRHQRTPCGGPPAKEHPGGALYTSSRAFFLFESRAGGMKVHYLPPRRNSPSVPPLAAFFGGAQPFESTAVLLRNEQTHAAGGSSRSPVMYLAGSICFAPPSRSGVALYIAPPAEYGGSRFVYGEEAPRPPPPAWLFLPGVPPAPPGRIVFVAAAPRRRSHPWSDLLPVVSRGDNTNARGCCVRPPGRGARVGRPPEECFFPRLTPPSGERLFFDSLSVAGGPPLWLSLFEGSPHRGSLLLPPRVGVLRGARLLPPPPNGGPPPKILGGFLPPLFFFFGGGKRGSPKRFFPP

SEQ ID NO: 970285 - protein, 300 aa, Homo sapiens
MPLGDIGNPRSPSLSSADLDWTQGNGETVENVGNTPSVGVCPGVPPPRMGKLLGLVIQGQLHGKCVTQGDSMPLFKPRIHRGRPIPLREPRSGNLGKASTPEDLLNSSLTPPRNENPKDLTYSPLRFSPRETHAVIYKGVPRYPRKVDPTEFSTEVPRKIVFCKMGSYPLSYMWREISLTTGNHPPPLAQGMPPYPTEYGDHTLHHPSLTIHAPTAPPSSSFTPPYSTDTHPRTTTEAQIPRDYTDVHDYDMRVDDFLRRTPSCCHVAREKYDPPERDPGNESETPLEITDETESEIEDV

SEQ ID NO: 970286 - protein, 144 aa, Homo sapiens
VLFLVGSSVHRVGLLGELARGPSLRGFVVPVPALLLCFPWAALTGPGRALVWGVSSVGARVRSVIAPLRARTHVSVQVYWAPVYVPLRWYVRCPPYCARISVYVQRFDCLVSAFPLSFCSLWISFDSTSFPYRRSILQPDNHKT

SEQ ID NO: 970287 - protein, 119 aa, Homo sapiens
QTSFGRPIPGDAPPRCGAPYDEPPGLVSAPPGIFTLRPPGGGMTNFLTTGAQACCATLAALLGAHPPREPQVCCDHRNTQVGPAARNFPPGELFLAAAAPPRPRCGGDHPDFLWCLAGQ

SEQ ID NO: 970288 - protein, 66 aa, Homo sapiens
AALAVSTGHGLTKVIARFGTQPAFFNGYPPQWACPPPAVVDTIAALGDFVVFLVFLVVVWLKLVIF

SEQ ID NO: 970289 - protein, 102 aa, Homo sapiens
MCRHAVVWELPLLVGAQEYYRGGCIISVLRSFSSVVGVFSKRRRPRSRDWWEEALSFFVSAPPHRGGSSPLLGGARERYIDVGYLSSPPGGRGAQHPISSSL

SEQ ID NO: 970290 - protein, 168 aa, Homo sapiens
LPHFWIGATIADTPKPCLSRTTIIPGANHMDKGPRYLRDDTMECELEPSLLGTHGCEYGRKNAEELIFGTDPYYHRCFPVILIMPLKYAKRMVTQFGMSEKLGVMTYQDTGELSPRNPICPRRNKDPSKGLHMTSQTYLETHAKEHKNLAEALLTYETLDAHRDSNCS

SEQ ID NO: 970291 - protein, 214 aa, Homo sapiens
VAHDQLFQTLSTQPSPPQSETTLLKRAEEIHDEESIYEELPTPPFCQDLQCCREKAEPRPWPFSPRKGTRMTSSTQPWPASPRGHGQTARQPRTQEEGSPQGDQSPPPPENPGRPPEEPRHDPHPETWCRAPWGGSGTQTHPGRAPTRLGPPHLGAPSSLNPSQPQLCTPLRRPPLTLPRHATERLPARHHPCLMPHAEESAGAGSTAPFPPLR

SEQ ID NO: 970292 - protein, 125 aa, Homo sapiens
MGGMKDYGAYWGSFRMPLMAPDHERCLVLEARYGRPNLCVSIEFGVPRETFLERPLQKSGVILKRAGVLNWATQPGEFACKIFDGAPCTRELAYCIKYKFKKIMYGLVMMSILQVYGYKNMSDPP

SEQ ID NO: 970293 - protein, 158 aa, Homo sapiens
MSGGGSIGRAPPPSLALSLVARPHGDTLSARSSVCAVRSLHQCARAAHCLSIREARARAPSLPLEGCLFWALTALSYAHTTRDTTRRAPLSRAYTPQRPHSVFSPLGVPHRWGVEGELPVSGCVPLFPLSLPLPPLPSIPLSPSFSPSHGLSSPLWFC

SEQ ID NO: 970294 - protein, 285 aa, Homo sapiens
LVISLPRTWDRDPEDIFRGLPPVCFPGTLRVIPPLAFRNQGGSLEPYLCYQERVPPPGFQGDPDQPRISPHGGSRQHSTLLLVPPGLDNTSFEPHSGIIWVHQYRIPILEPRAPPPPVERYLSAARDLLRKVAALTTPRMLCSPRPPLRLVALGPPRAFLKTALPKEPPAPQTLAPGIQEELFPAPWLLLSPAHLALAPKQPPWAGLALCWSPGIGQGSREAVCPSRHPASSPEWKAPLRTARIGTWTWGWPQAPVHVLLPFWKTRFNPESPLRDFLCPPGRKSN

SEQ ID NO: 970295 - protein, 102 aa, Homo sapiens
RWVSRCIPSRLRVVSVSVTLLFVLLILVVLDWCVGLYDAPLLCFPALCVLSRGGMCASCFVAFVFCFGVWCEFCRSPVCASRRCVWWLLCWFAGRGGLFLRK

SEQ ID NO: 970296 - protein, 137 aa, Homo sapiens
MDTTDFDLKAVKGICVPLVSVKFLRCVAVNVKTDDTLCDSVCDPACFFLGTPQHRIGGICSRFARTDHWASWLSGALCCTYHVQRCSQCTHPTSSTSNQSCLKLFREKYFIHKYPFYSHVPKFVEKIIASYKLPARR

SEQ ID NO: 970297 - protein, 105 aa, Homo sapiens
MRCWSLSGSGEVKIYVGVRKQTRCIREVRERLYGIFGLKDVVPTRYERWVRGKIKRAKRVPHRCVGYSTDERPPRENEMEPVTRSLFSAVVVGARCLLLPQYGIL

SEQ ID NO: 970298 - protein, 282 aa, Homo sapiens
SGVPPVVVDARRGADFLGRLGSVVFRPPRSISVSLNGSGVLVGALPPSEAVLMAPFLKEGCGGDARPGRGGQPAVGVNFLPCFPRGSPPRVVAPREVRALGESAFVLPIPTLTVIKLCAPPFSRPPFHGPPKSWGPNKPPRVGLFGEKFFSGKRGISPSKRGKVIAQGSRQNFGKKILCSMEHVSFITPSLWGSLIRYLFGGPLNPLVGPQIVFQNGIFTLGPTAHLWKDYIPLCRPFSLWELWLNNRRQRSFSYPEIFFLWCTYEVCKTHRWHTLERAHQI

SEQ ID NO: 970299 - protein, 249 aa, Homo sapiens
AGAWVVAPGAFDPVCLVVVGGRPVGGPAAVLVGARAVSGVGTQASEVCFECERRRVGPVAPWGSSRIRCHPRDCGARVARAPRCALGRDSECPGGGNPPGQSSGRGERGAYSRGVVGAAGTDARASVGTCWVFVGRQLRGSQPVCTSPLARCYPLEGCGEREPWDHPVLILRGAGSGEPGSVRPRSLDEVDSRTPGRVSEAAYLADVGLLALAASRPYLSTAAWSRHRHVLEFQVIFSPPLVFFPGLFP

SEQ ID NO: 970300 - protein, 207 aa, Homo sapiens
RQDPGVKGNPQSGTSHPPTLCPPSVLGRVETRLTRATPGGWNQLTGPDAPVCFPRVDTLSRSLGIPRNEKIAVAPQPDLRGARPERKILGEGVLKSARSDGVLRKKTTFSDNWKLWCLGVPGTPSIWVIQIMTPDNWYFTAWTFLCGAGLEPGFPAIRQTKRQRQAHFGPNTGIHPKERAQPWFPQKYYGIILPVPINFPFYPKETN

SEQ ID NO: 970301 - protein, 139 aa, Homo sapiens
MRALDYPLSKTQCLINSWRLFIQCLLEMETPGLLELRKKKIEEAMDGSETPQLFYCVAQRREPAPVGGGPLMGSNPTIYDKSPGYEPGRAPAPELQVWKWRWRLKSCELDPMALTPKYEEHVREQQAPVEKEDFSDTGG

SEQ ID NO: 970302 - protein, 284 aa, Homo sapiens
AFPAWPDFVSAHLGINLLLTSTLFALATDGLLPPVTRSPQPPDTCPQPSTPIRLPLEGMPTLSSACAAMMGLLTAPGAAWGPGPLDPGWWNHVKGPSSGRTALEGEARTPLPIPPYPLGPDRPEEEAEDQLEALERTEKHWGVKTRRSLPEAWGLLDDDDGMYGEREATRVPRGPGSPFADGPRAPLSPRLLIRTLPGSDKNPGEEKAEEEGVAEEEGVNQFSYPPSPRECCPPLEEEDDEEAVKKEAQQNLYFCLVSRIPAPPLGVLPRGGKRIQPRRIKKEK

SEQ ID NO: 970303 - protein, 280 aa, Homo sapiens
RGGVAVVGAWSSAGFQRLFCWAVFSPCGGNNMGRKIACRDARIGAPRHGLFEEELLSIVSWRRRVLLAAVLGRPRMGELGAPLRSPAGAPSSLRRPLGDVFFFSEDCSPLTGPLSVFSTFPHAFSRWSGYNPPRLAVCGPKTGVGASSETVSHEGHARCSARAQQFVLVLWSQQPQVGRTPLAGGDNPREFSPPRGVGEFLASPPRCDFLSPDEREQSYSTLSRSNPGASHRVIGEFFIPLLESPPHLREGYFVPPRQESGDRGPLEGEGAHPTSTGTLF

SEQ ID NO: 970304 - protein, 344 aa, Homo sapiens
YRPSFLGRRAMFSPWGDPAIASAWWFATRALCVSPPPGVAGVLIPLPRELFYSLKVPPGGAREVTTQNVCSKPSHGGRPQLCIATPILRSPLYFLLRVDTHRINLGDPTELFVDTQKKISQSAWGLKHRLPPGEILPRAAGIISVLNPPTTVFPPGNRPCGREPHAGGPTHEGPEPGPHKIEGENPGGSGSGPRRCGEPRGGDHPPPIRGDKRKAREEKAPPPFVVSSETLRETHHSRGTHSAGNSRPRGRPPFGSLTGRGSLWVDTLGGTTKLRDMRAHAGALSRRGRDIGGSPRPRWRVSQPSRHGLCASQRLSRENTLSRAHSWDTEMRVGDTSFVESHNI

SEQ ID NO: 970305 - protein, 294 aa, Homo sapiens
MLCRKIAYGGVCCLARHSVGVMIIFVFYYQRTTPTTFVGSTKVCYNSKDDAAPSRAVVVIKKRAARPPRLLWYEVFGVGAARPALCCLALGGCCDERESIAPPPPPFLLGAVTRAVGRREFFVLSAQDIIFSVCVVCVLVCCCDERHTDVVSLCVTPRARGRGPLGRRALCVSVSLSVSHTLSPLSLARVDTARVVSLCLCLPLSARVCLVRSTHAERAAPHTPARANFLLRFLERDEKRECFTHTLGPARVCCVRTTSTLPQWASTPPSRGCPHTQCGGREKGWEPPLSPPHK

SEQ ID NO: 970306 - protein, 214 aa, Homo sapiens
GDATERGVLRHQCVQQKGASHAVWGGRSFVPPREVAPPPRPKRCQSASLEEPPGGPHKERGSTNEEVAYRPARGEGGGKTPPRGGKCVIKAPAVWENTRTAPPPTERGVPPQKKCAGAPPAGEVEKRRRVCRPPPPADKMGEVIKGVCPPPPRGGDAATTPLPSENGKKYALSRNLIVVERIEEKYCCRPLTRCEGLNKKVSPLLSLWERIWKY

SEQ ID NO: 970307 - protein, 212 aa, Homo sapiens
VGRSLCAECVVAGGAWGLVAGAFAGRSGGTSGGFSPRGGPGPWGPGDVGVGLGFIAPPVGRFVFLGPPLWVVCGATLAMVPGEGARDPHWGGARKLAPVPCLRFPLRVEAPRERRCRPFYVGGGQKAKSAFGSPGGTPTAGSSPPAVHRSARGAQRPIVRENCEGGTTCLRLPRLPSEGPRSSGGCSWCVGGTAESPGSGVEESLATLAASS

SEQ ID NO: 970308 - protein, 201 aa, Homo sapiens
GWGRRGGGQGAGGRAGGGAGGEGVRGGERAWEGAGGEGGGPEALAGGAPWAGRPQDGAGVNGDRSLEGPALEDDPGSQGRERAGEPRWSSSGAHEGRRASVQSVDGLVALWLPGGGVSAPSCVVEIARLRFCRVRSRSPDLVGLIRAEAAQSHTRREEVVATDSWALCRPVSPATPAPVSWELTAPGKTWAVGGSRCGPLI

SEQ ID NO: 970309 - protein, 209 aa, Homo sapiens
GRVSGPVMGRGEWRATGRRPEAGSGGGRCARAAPVEPPGIELSHAGNSTPAGSSIQRPDGVPVTPPPVRIPPRGCCLPWSDVPEERSMTQMLNVQTRPASYFVEMDPPPIVQNQPSVTYPTSWPPDGQSPSLAKPQPIPELFKRISEPDSHAMFRRKAFLPWDTGEGMDEMEFTEAESHMTTSSLSISRTRMPPPKRRRISVRRPEEEA

SEQ ID NO: 970310 - protein, 138 aa, Homo sapiens
LGLDVCEVGFAYRSVCVRRPPHTDVVVVRCPAKSYCVLGYFLRAMSVRVFRVRVAGGFSSIRGERCRVAPPQTLVVGAQMVSGVLPHQRLPKTFFFVGEALLCGGRCWAVAIYGHHKVLSNRTSLLGAYSLVARATLF

SEQ ID NO: 970311 - protein, 170 aa, Homo sapiens
ASSARLPSVRLQGGISGRRLVVALRLDLRTRHPGYKPVLLSVFPPAGRLCLVMPLGRRAVVIRALGPQPAPHLAREIHDPEPAVWKGLSEGCGHHQFFDDPMLLETCPTGCCARLPPVRCVDSWELLLPTRGLHSCTEAETSYDVGLRVVRECLEAAVAILRPLYPPPTP

SEQ ID NO: 970312 - protein, 118 aa, Homo sapiens
FALCSSFCVVRTDVSHEDCFAVVSRFLIPPAISTLRVNDVAPPCLSREAPVVVRTVLLRILSVSNSHSRWGGASTTPEEGRPPPAHRSALCVWVAYDGRFGVFSTPDKIKPTNTPMPT

SEQ ID NO: 970313 - protein, 68 aa, Homo sapiens
MKEVSTRWAMEEDLHWEDEGETHGPALENTMTTRKEEESPELFTIAHKRRGRCCKRRFEIQKKLKTSP

SEQ ID NO: 970314 - protein, 137 aa, Homo sapiens
DQIGRAPTTVSPARCQAPAALCWYASIPAAHGALAIVSAPVPKKLLMNGWYRVSCYTSARGCTATPGQTSPRPPLEANISKTNSYLSPQTFWKETVFTQFPYQEFTDPLVTDPHPSFRATESGSHCGYNIGFLYQEN

SEQ ID NO: 970315 - protein, 192 aa, Homo sapiens
MDPLRALEMVEKPPKGPYMPPRGREVAPPLARPTKRAIWGDPLGVHSPSANGGELIIRHALFGEIRESPTIEGPPPNRPLHTQGAISSLRCSHRGYGLARTAEAPLWRDTLFWAPSARLACCVKDPEMLPLTCFVRSPSTALGEEPSWGSPTASFTRPRVLVHPLHKERLRTLRTRTSPIHFTHVHLKGFLV

SEQ ID NO: 970316 - protein, 138 aa, Homo sapiens
MKSLFVLREDRWVKLPPRIVFGHPPPPVFALSVWGPFFCLKRQDGGERPPRPSLLFGGGGKICPPRLWGGPPVVSSVGSKRDKSFSSPQSIGAVHREIGEPLLPSWGLSYKVSLPTRRPLPPPKRPRESVVWASKKSE

SEQ ID NO: 970317 - protein, 144 aa, Homo sapiens
MWEMSSVSRRLSPHTLRAFWVSHREHTAHADSREFIGALSRGDTLGRLCGGATLENRRVSLWASLAPLILVRRSFLRLFGALLTVLHTAGLSTRLHAHAWSLHRTPPPPPLTPSHLFSPPIVPHPSTALCWYRAYLYVHYPPWS

SEQ ID NO: 970318 - protein, 170 aa, Homo sapiens
MVFGGIEAIAGFGPNGHPARVPLLEGIRRDMAGNHCPEVTQRPAGASQFRHNLVTSRSTRAHSTGSWMNQDQQLEMVSVSIPGSEAMSGRVGEELDDQGIMLDAFAPEMDHTQSRMDGVLQEIGPSIPPLTSEPPTTWCATRRASGGASPRFHSYYSLFEPQPSLARLVP

SEQ ID NO: 970319 - protein, 145 aa, Homo sapiens
MMWWLETTSPCGVCYCVSHLCCESLLEVYLLWACCLKTHPRCVKETILVVVWESLLLWTPHPLRWSATSDYLVVFNNAPAPLARKVYFSDTRPAFFGGIDVSTPTVVTPPRGGCNFVPHSVSVIAATRDIGCSLFVLCGVGLCCK

SEQ ID NO: 970320 - protein, 332 aa, Homo sapiens
TLLCFKCGTPLRSQGVSAASVVVDSAPQFRTNPLVVLFATRAAPHLCERDLPPPGGSAGCSSSELLSSGDLSLRPPFMGPPPGGAPGGIITRDGCAPTTGVNPSLYCTPHLRAAVIFKGWHPPFFDVNPSVVVHHTHNIPRALGWTPGPPAEIFPPAGNIPVWTPPTGCSPPRGGKKSWEERSSPAFSFFAWHTPGVFLWALCLPTLGATIALKNLGCPPLVAESCSRFCGPKRYPHTQTSLSQKICKERETLGPTPKALKMFARGQGTFSRKPPLGPTYKLCGAQAKTLSGAPSLGYTPQETPGPSRGAQLSQAQSLEAPRPTTLQRGLPA

SEQ ID NO: 970321 - protein, 218 aa, Homo sapiens
MWGGKIPTGLVKPGRRPTRSWAPRREKSLWGNLGGPPRSEEEGASFVKPPTPTGVNTPWLGRTHNKEWFVGPHAKLWRRIVESGTRSSFTGGGGHPQRAAPKKGPCDHQKEGGSHPRESRCGPHPPPARKRPLSPPPPHERHLSTPVRGTSLRRKTGVVGPSGIFFGGRTIWALSLVRSSCCYTPRLISALCGHNTAPLCGATQKEGRYTHYVTLRPL

SEQ ID NO: 970322 - protein, 225 aa, Homo sapiens
DTANRFAGPAEMGLLWTPQGGAPPLEKGEGQLEVDIEERPEELVRKPYVLNDLEAEALPFPEKKGNTLSRDLIDYVRYMVENPGEDYKALAPDEKNYYPDTPKPDSGVRSNSRINAFYPSRVARLPRFFAEEEDGGGVTGLQSQTCPQAEASPGPSEDWSPGEGKEVLCGSRGAGPGPLEIQKVTPPQQCTLPASGEGTVFRGSHLYSSGGSRKSQNLLFSGWVM

SEQ ID NO: 970323 - protein, 117 aa, Homo sapiens
RLFACMCVLLCPSCGRKRGYILSAGLATLPPPRPLSQKDVGGCVDKSSLIHTCCVVVVKMILWWGGPDLCVPTPLLCGWGSTPPPSREPTLTTRGPPRESLISPSSLPPRGLCWGPD

SEQ ID NO: 970324 - protein, 51 aa, Homo sapiens
MPALGRNHISLWAASGLLEPHGPKAKGEWAQKAVFGLAQFPIIKLSLTAAL

SEQ ID NO: 970325 - protein, 564 aa, Homo sapiens
TGGCRTPARHSVERSSYTSRGGGDTSAQRNTSKEEGSGMTQQSCRRGEHRQEKRRGAAAHKPVVRGTQRGCCRRQLTTTPVGGTNKGSPPPRRGAADTRRDHAVCGGVCAQRRKRRRGRDDQACSSSWGGQQPGEYPHWRASYAAVEQQESVPFRCGPRPRRDKWLAPPPRGGEKAPLKEVGGRGNAPPRARKDSATRVHERCNPPVGAPTYGATDSSAESKKEGPTKTTSGGRSTWLVRPHPPSGEGGRTHTHGGCCCPTPPEEGGANNYGQREEEEAGGRLTTGETILHERSVRLVALARAAHQRTTSRAEYERGRNTHPGGPPPRGRGSTPHVVGPHTDGVSLYTPAGVCVSQHTFFARSALVSNSTVVCVCAQREIISQRRECVCATHHTGGCVLHTPLRHTDGCDARTHTLSQSASHSLTHSGAHRARTHRAPAGGDNTPTRGAPTERDCFPHKCVCEECERPATCARPLVGEPDREIPGHPERRPEISPHEKEQKERSTQPGSAREIFFSTFHTARHTLGPPFLLPTAPRRTLPRPPAPGWGHKGFVCEKKALFFFSP

SEQ ID NO: 970326 - protein, 70 aa, Homo sapiens
FFPTEDIDPSGELFVVDHNNTPGGAPTKIQAVVSAGPEIFPRGYVFGTTPLFLYLIGFDEETYTSGCLSS

SEQ ID NO: 970327 - protein, 298 aa, Homo sapiens
PSWGIWILFLFICVIEVNGTLSFFALFVNPVFPAPTFPFLPAPPGPHKVVPLMGPCPFLCFWVWIVHPRGFNVAWVSVFLTGPTPEGPPSGSLGDPGRGFLKGLPNFGWAPPPRGFSGVPGFCAFCCLSSSTPVVRPPLSWKIPVPLFSWDSASLEVHLLGLSCLFVPFSSSFLCSLWEHKGSNAQRLGPTALGIPPPPRIPPRPPLPLLVFSGGPGARNGTPSLGLPEGGVPSHALQSSAAVRPCSPRGRGLETHTRNAVVAPGTLTGDPHAAATPWFFWRISSLLSRKILRLLVPL

SEQ ID NO: 970328 - protein, 212 aa, Homo sapiens
HLSCCCSSAPASLLSFTPRCSVFVFCLISVVFSRCPLFCYLVGPSYFVCRGLFVSIEAHLHCGSLTHRVARFIHYCRLLVSQASPLWVPYHHPRAKLWVFFFKPWILCPSPPPPWGKKGSESVILTRVDSWVFTVDAPGNCWFTLDGTLPIYDLAYPDFFRHTSVKHHAGHRANCSGSKALPWKIPASLDGIVPLWDPRTGRLLTDYRGHHG

SEQ ID NO: 970329 - protein, 149 aa, Homo sapiens
MTPIALIVPKPNYRQLIFVEMDSPAHNSWKPAVLWTIRPPPGAIKMSRHPCQLAHQAPATSTGEPGSQAAISEARVTGHMFPAHKALLLQLVTPGEGHMELKMEFTPKGREHNTEMTSVSEVTTHVRNATTAEGRKGEFEEEARGRKVA

SEQ ID NO: 970330 - protein, 107 aa, Homo sapiens
QVSRTNFDEMDTLPGRLCTQLIDEYPLLATPATSYILLGTPEHVSPPRNREPSFCLTGWPQPCLTDHPPHEHQIRDLTHLFFNNNTGDSLLACQTPLNFSSYETIYL

SEQ ID NO: 970331 - protein, 180 aa, Homo sapiens
YPFCIYCLPVGGSYTRISKGGAAPPHPKICVIWVTHTAGPTPWVLSSSPHEGLDSEPPSSQSPNRVCFLHSRISPICFLCFPLGTHPGSPQPEPLFAVAAASQKTPRVSTLVSAHGRPPPEGPPPGKHTHMGVEKYIGGAHTRTHTARCTRWASLWGDHLLAPPRENLTLERIKSPPRGE

SEQ ID NO: 970332 - protein, 157 aa, Homo sapiens
MPLPFVLRHPPLGALLVSTPLSVFFVGCPRFLGAPSQSRTVKVSPCASSRRCSPFFDMDILGFFSDGGVCLIEVNEGVIFVPILCSGVCWKDIGFLGGESSCRLPHSQCLYFDTQHEFSVPSLPAPPFPAGGYQGPLQSPWSWEGGMGDIKPVLSLF

SEQ ID NO: 970333 - protein, 80 aa, Homo sapiens
GTTPRKCGNQLGPWTNRDPVRPGQTTHAHGPPPGVHHDPTGGMERNNFLGFHERNVLIELNMVCQTLFLFRLNLLEPPPQ

SEQ ID NO: 970334 - protein, 136 aa, Homo sapiens
HQLVIIAVFRFYGWRLLFPLYTVYLFALSLLFFFLFSFSIVVLLATFPNVALAPNYSWSFDVFRVFPPLASAPLLVLVFSAPKAHYSVLIPGHHISGLYCPTVPPDVDFQPGVLRIRGSYICPPQWFSYRYFCRMS

SEQ ID NO: 970335 - protein, 390 aa, Homo sapiens
MLLSLVFFPFFSVAASIYLLYVLSVSLRASFCARAFSALHIFVLLACSPPGVFSVFLVHHRVLPPFFPGGTKVYPGAISSGAWISRSFGRFSAEHQSSWSPFRSRSPKRRAPSTPGPGPLPVTFDEISFDRVQGAPLNAPGSVLTTIAELNLSKRPVCQGEKVLFLRISGPSQAAGDKPREMRLQEPTLSSGGPLLPDTPSTSEEPSKPLAQMPPFAHLVSALPGPSTHAFLRARGVLSGGAKPTASLTKAPSHVLVGGEGGGSPPLSYSPVPTNLVSSTFPRTHFPRMGSQLLPKWCRVITFWDTTPGHVRAHGFWVPEVHFPKEPLVGKKSTPPHWLHTHNGSHLTKGRRSACFTERRHAYTQRGNSRKKHERQRMEKIRDQKPTNTD

SEQ ID NO: 970336 - protein, 373 aa, Homo sapiens
MLRSFAPDHRAAVSLDRRSLLVGFVAARPPSFILMNCGDPLHNDGFQQQGCRLDMNVLRPTTSVFSPRLDHPGWKIFLRTHRFAFVFCCIKKGDTTTFSERRTSFGCGDNSKKTLLARRDFTHEVAARAPPVFVYRQRVDHRGRENKGGGPTITVETTGRCREKKQQNGLVIPPPREKPVYPPDPEALCRPTGKWLFSAAGNSNTAATKVYTVLEPTMAPKGRSTRDVFCGRTPPGRVFDKKGGDPPLVKGKFAPFPRHQSLNFSFEESGARPHTTKGPKNPTESLWSSLGQQRGKVVFHFSHRPPRIKRVCFGRTLPPHKKRHLCRIHSEIYYGVFFPRSCLEKNVEHPRRRSRYISQQAHHLLISHRRERL

SEQ ID NO: 970337 - protein, 199 aa, Homo sapiens
MHVGSAGSCSLGRSVGLGALVCTRMLCVLLPPGEFDAVLTLGFRDDKLSSVFVPLFGAPLVFQWVFDSRAGSCVVAILVTGLTRSSIAPYVGSVGVAMRRAMVVVTLEVDQLWAFTIPLQVLAWFVMALMWWMMHMPDQAYLPGISAAAAAAGVGLGVLQEMPLLPRDECLTSRDNPGTSSPVGADEETGCFASHVLST

SEQ ID NO: 970338 - protein, 219 aa, Homo sapiens
LPFCRLSCLSSFFFSLLYVSLCSRFVCLTSFCVRRSPSRTCVCSVSALLFVVECHHRVLLGLTPVGLGIGFGFRSIRDLPCLGTSALPLLCVLSGSHFHIMGFLWAEPPVGFLCLIGVNVLQHLAVTTLLLIWNGAPGGLCGFLMMPDGIGELFAVKHTAQQSESHDDKLLHWIAGPPLLCATCPHLTFISMCGDCKMNASYNSESDVMKLYVTHDTYI

SEQ ID NO: 970339 - protein, 105 aa, Homo sapiens
VWVCVVPGVSTGCVDVVSGWEWVPGWDLGLGVHVRGYAVGCCDVPAVAGGCISWEGGVCGGQWGWVVRSGRGALDCWAKGVDRIVGPEWGKFDTLVVRGPRLGPC

SEQ ID NO: 970340 - protein, 168 aa, Homo sapiens
MPVARFLLHACGRCFFVAPRGGAPSFVGCVALFLFVSSPGCGCTAPHDVAVTLRLLARVAIGSWGFYGTPRVRSRGFISGLSCRGHPSCSRLSFSYAPGGVLTFALYWVHARTLCGLNQGHILLRCEFSPRWCAPRLFIACCGGVCRESIFVDTCWQVPPPGGTPLCA

SEQ ID NO: 970341 - protein, 225 aa, Homo sapiens
PLVVGSPSPLRLCVVSNPLLGWFGWVGPSLFLFGVLPPGLRMLYWFVKDRLYFVGVCVSAFPLLSFFRRRTCRNGAGVVCALFSALMNVFFVEIGGGKLSLGRWLFVSSSRSEISVLGVIVLPFCLPHFLCRSFSTRVRGCLPATQLFYLCSPPLFSRLFLRARRVLVFLLCGERYLFSPPSLLLPICGYLLSPSVSSRLLSLSPLSLSPLSLSLAPLFPCEKRA

SEQ ID NO: 970342 - protein, 150 aa, Homo sapiens
PDMKEEMARYRRGYPDLLNVKMAPWTLRLPTYRKLLEGEETGFLCLFPTFRCPEPEGTNLDSLPLVDTPLQKDTSDLRRLKLEMDKVIHGTFSASRWTLDKNCTHSGQPYMYPPEIKKRIHILKKPAFKCPSASFSGAPDRFGIGISSSS

SEQ ID NO: 970343 - protein, 102 aa, Homo sapiens
MSLVCYRGICRIIPSWWAPSSVHKRHFVYVCCVSSIFGDPAPVRVFLKPFCGPAHWKRQILTRATRGSWFGKKGPDSCKLEEVFYGPRTRYTRAPLGFNFSR

SEQ ID NO: 970344 - protein, 70 aa, Homo sapiens
FVVSVLGFFCLLCCVCSFGRSIDSSLVHVDFCCPLCRRPPVWCGNNGCLTDGGVRAPSLVVVAPWWHTFW

SEQ ID NO: 970345 - protein, 221 aa, Homo sapiens
TTCGYLYSLSCPREDRPTYTRGPPLKSLSVGPPPPTNPNRWCLNNSVFIIFFWGKSFSTKGTPEPLDLGFSPGIPGPPKGFPLSAMEGEGEPEMRFGFFPPGPAPTPTHGRLCPPLHHAPDSNELQEPEWNRETSGTQRQRLGFVECPELHYAAEESHPNGAPPTPTGNAHHWRLRLGENTCPLPRVGWPNHGWPASTLPTLPDTLTPTPALKSMEGEPQS

SEQ ID NO: 970346 - protein, 104 aa, Homo sapiens
PERRALGGKQPHSSRDYPLEVVPPYGSYTSPRIVWGVVFRFRRSLRPFFVGSSLRGALLAPRRDTSPHHPPATDSPVGSGDPLASAPPRWAPPSERTPPWRATD

SEQ ID NO: 970347 - protein, 180 aa, Homo sapiens
LGGSCLSWSSPQDRATSASWAKTLAAHVSPWEQEVFWKKCALSAGLCGQKTPTLVSRNFRGLTLQVSHSQEDHAVVVPRVLLPFLVFKRGPVPQSSHNTRSRERPLMGPALTPPQPWAPGHGAPPGHSSSLLRSVRSVPGPTGLAPVPPRAFMCHPPPGRPFPVPRHGAKQGAQVQATTC

SEQ ID NO: 970348 - protein, 117 aa, Homo sapiens
MMLLHELESPSLSYVCLPEYASTVRRASTSLVMSTSRTRLTIELHPDGRHGIVQSGPVFPWPPKLVDLPLCYGSLKPLIKNFLPRQLISVRCLYPPLMVISILLWRSPLLALILKPA

SEQ ID NO: 970349 - protein, 159 aa, Homo sapiens
DQISVSGFVPETPGGLQGAHVLQFTTRTAQCRNTVAALEEALDVDPMVLYQMKKSVKAIHSSGLAHVGEMKSRDTPALEKFGGNCVCRDDPDLGSAFLKFSVFTKEFDSTFPNLIQNMTTYISFPLDRFLKGDLKGVKGDLKKPFDKAWKDYEPTITQI

SEQ ID NO: 970350 - protein, 174 aa, Homo sapiens
TFSCLLECPLVASPPLEPLGGIIFPPVPQSGRKTSQRSVVFLRRGAHLSLVFFPRLCCATDGRPLVAHISCVGDLFLWHTMFRTYSPARGPPCGTQMDPAHRLWCDHTGEFWRARSPSGGLFFFSRAGSCFRAPHTRSLSCGAPRTTRRTPSRGTHLDQALWVAPRLTSLGTQL

SEQ ID NO: 970351 - protein, 120 aa, Homo sapiens
MPTPVTLEDKYLDWAYRSGGYQKARAVFKSLPGDPTHFPVTFSRKMIQFEKEPESLPYGDIREYYERALENLDPPDSDLWMDYMKEEIETTPPGRPENLWTDLLASDENVATGESARGTL

SEQ ID NO: 970352 - protein, 136 aa, Homo sapiens
MFNSSSLVPLPESNAYYFIIAIYLKKSQDLSRGEDEFKFPYLRIYNQHETSLLPVVQLAQMYYTGTMKERHQPNYPVSPENAPKPIFGPVYLIPCGRKGTIPMYHLELNVINLALFFGRNHFFKEASLALEKFPTI

SEQ ID NO: 970353 - protein, 120 aa, Homo sapiens
HKRSTLGLNRIFLGTILHRTGLSPRRNAPEPPHRRRSHLTPSGHRGTDGREEIHFVEIQGDDHLQWGPTQWMTKLLDQKSNPGVIPATRKVSQAHRPNSGRNHPDHHILFIQAQGAGAGD

SEQ ID NO: 970354 - protein, 132 aa, Homo sapiens
MEASGFTAQVIILNHPPHKRRLCPCIGVATRLTIACQFAELKEQDVIPVLVKSWKMRPKFLKSGDAVPLLIWFLRQPMCVESFSQTTPPLGSLCCSCYEHQPSSRWVSSNPVDQKAAGAGKVTQSAPESSEG

SEQ ID NO: 970355 - protein, 207 aa, Homo sapiens
RGVQALLPLGGTRFDLNFGGLDVVPAPQLGNFLGEEIFGGFIWRGDYVTSLEILVARDFWGRCPVHAPAALDRVAGAQPMVGGYYFAALSPEGASGVRRRPGSGCGEHACVSCDAPRASPVRTPPGLRLIITLFFARCPEAILLCEPRLWDISLCADRAPTSRDRPPKTLSPPEDFRPRPLCLSLPPPIAREHHLYVGATVFRKIKE

SEQ ID NO: 970356 - protein, 70 aa, Homo sapiens
PLCRVIVLVYDRPFYPCVMSCELWGYMISATLYIDEEYKIENDITSPWVPVLVPMLCTAPEVSVAAADAT

SEQ ID NO: 970357 - protein, 33 aa, Homo sapiens
MLELNPTLTVFQAILFPHRIGPLGPNKVGILPP

SEQ ID NO: 970358 - protein, 96 aa, Homo sapiens
LWMFVSPPVWGVRVRVSVCVWGAPPLLCHKPLFIGGSARVPFLFLSVPCSLQTRFFGEMRLFKAFYLVGAKPRVLNPWTFGCTTIPMVVFLVKPKA

SEQ ID NO: 970359 - protein, 76 aa, Homo sapiens
LVSSPECVVSLYEMCLFVVVGPRCGHDAEGVFLYGASLGAQGRFFVSGLLLEARVPPRPPFVGTPSLNFGAVYSAC

SEQ ID NO: 970360 - protein, 103 aa, Homo sapiens
MATGIRLGGSPASFVLCATPPLLSLEGARPANSGVVVLNKGGQFGREIVAQNLIRAFIPRLLCRPPISTSRYNLLFLTCAAMCCAHPSLTSSFPPCFSKASKK

SEQ ID NO: 970361 - protein, 147 aa, Homo sapiens
TSCAPYFAGNQKQLERPCSSSTSTAASRTEKPSWLEDHELLPAQLGYHRKTLGRAAPGCGRLDLVPPVVTVALWLGLLFLLGPDTRFAPPCYGGKRPGGPEVAAPSIFLAHRASFPIFSFHFTAHGYDQTTPGPWHHSSGWGVLPDP

SEQ ID NO: 970362 - protein, 104 aa, Homo sapiens
LRRWCSLVVLAGRCSLTVGWLLVTLLLPSSFASPRRLPPLVCPWWTLSRAGALSRRTRVFLFAPPGGEPFFGRWSRVVPPGPLFLSSRGCVPLIRRGGGLPRGP

SEQ ID NO: 970363 - protein, 175 aa, Homo sapiens
PTFLTPTNPRLSGLCKPSVCPFEDFLGVGAHLGITTAGPGPVSPTSMPGELSHTEARNRPRSGRCKLLEKVPAELICLDPRALAEVEVISLEQGKKDQIERLGYDPPGKGSPSQPKPIAEGPQLHGKPGEEEEEGHWMRHTNGTRSRRAFSSSIIKEAKAQPTGARPSAWTEFVR

SEQ ID NO: 970364 - protein, 72 aa, Homo sapiens
PAAPGLQTLGVPCLSFPEKLGDFTSCVQPPLSRPILGIRCRQVPSPLTWEPAPLSLPGSGGLYVLRSRPSIL

SEQ ID NO: 970365 - protein, 172 aa, Homo sapiens
MPKILSLNLVTHPKATEEKEEEIIWKDIFPFMGQPWDTQGTQLPVLGGPGWAQPLGVAPRCLAKLFGPPPCRRPCPRPMLPISLLEEEDEPLRLRPLSEPSLDICNPLVHRKVLGLKPWFLPTGFPGTSRVGGFAEAPRVPSRVLGGKAPDSRRDPRTVGTPFLGFPAPFPS

SEQ ID NO: 970366 - protein, 87 aa, Homo sapiens
PIGTFTYWGSFRAVFTYSQKIPELWIKVTRVEGNLGPLDITVIDGPEPCAPRRSVVVTSLPEAGKGLRASDQEPEGDPISGGARYPA

SEQ ID NO: 970367 - protein, 106 aa, Homo sapiens
LFRPLWDLEVGSSPLSGSSFWDVGRPCLPAPSLVRAPSLLGSHLVHEDGILPTALFHLMGLDLAPLVCPDTLFLESTLHWRRDLGKRTEARVPVDHWGGEGRCPSH

SEQ ID NO: 970368 - protein, 112 aa, Homo sapiens
MAFSPPRGNTPAGGALRAASGWGFSPLCVGDARRLRHSFVVGYARCQGVRPRADRGGGFSVWEGHEGGALRGGGPPSSPPAVFRAADAVFCVQWPPCRLAAREFCFRPHFGF

SEQ ID NO: 970369 - protein, 131 aa, Homo sapiens
SVRGCCKCSLIDYIYRWCVWIVVVFASASVSVCWCWNTAQVGGLLSLVGVVPHCGLAVVDLRRLRPVVHLFWMNPLGVVCTHTAVSGVRPLCCVVGPASPLVVPAAAMSIRGVYSLVSGAVPAGSSDDYHC

SEQ ID NO: 970370 - protein, 117 aa, Homo sapiens
CDAVRMIWTTHLGNFLANGSSQELLRGVLCANVGATRTPPLGQLGSLVPGGFPFPLPRLYAPRLSRFGGPPPGPLAKPSFLWRVGERLCRPVLGVQPGRRGPPYFFGDHVADAPRCC

SEQ ID NO: 970371 - protein, 205 aa, Homo sapiens
PGVRVFACAHVYNGPPFCRGGFFLRFLMRVVGCAVCRIRVLRRFPGGCSPAAGVVVGVPPCVGGFALLAPVVLHRVVFFCVAGGVYPLFVFFSAVCVWLGAPPQFFFGVGWPSVCVWCCSLCFVLSLCLFCPCAGWGASVFGGPSFEFSGFFLVVLLSVWLLVGLPPGCFVRRSACFVVVSPSRCLFFTAIVCCVALLRVVALRL

SEQ ID NO: 970372 - protein, 93 aa, Homo sapiens
MCYLFPVVMLSLAASAVAQVPCLLPVCVPATQGHPLCRLADPAGHPLPSNDVCGWDLLYSVLMANLLHLGWVGEGVLAFFVGFLFLKKHSIIL

SEQ ID NO: 970373 - protein, 225 aa, Homo sapiens
CRAFGPLGQGGANRGAGRIPELLDTGLPQGCPQDCRRAVFVRAVGVGGPPPAGAVFELARPPFARAWPTQGTHWSAAKGACVPNRANTLPGRDSQRRKLRGGGGHINRRRVEGTIPPHIERKEHSLRGHNSTERKFVTTRRGSTSPTRESSLSLEERKLSRVGVICDDTTHCEPTTNTRVNVELSTLGGARGATHLIVRITNHGGVKAIGRGGHTTTTAGHALPL

SEQ ID NO: 970374 - protein, 115 aa, Homo sapiens
AQDFPQGFRVWGLHPAPSTPWSTPRTEGDTYSLAVGPLCPESYGGTPVPLPHVNAREGFSPRPGPARNLQHRPLEGPGVSPPAPLPLGTGRYCPLCWLCYHLPPPIPRPSSGFFH

SEQ ID NO: 970375 - protein, 203 aa, Homo sapiens
QELLLASGTGKTLWPGLLINGGDLIPSLALNWSEIHEGKGQNGEGAFSPGTGDLLPSIIFMDESTPSAPPGLRGVLEGTVKCRALMLELLHPLDGFEAPQDLQVILATNRIDILDSALLRPGRLDQKIDSHPPMRRPRWTILKIHSRKMNLTRGIHLRKIAELMPGASGAEVKGVCTEAGMYACENRRVQVTQEDFEMAVPRS

SEQ ID NO: 970376 - protein, 108 aa, Homo sapiens
SQLSLSLSSLVVSVCVCLISFLSRHLLYHLHLLVAVCSCISCVVGGVSGLCQRTCCCVLSSPSCVSVFVRSLLRLWRALIRVVCGVGRAPPTVRGCASVPTFESSVLC

SEQ ID NO: 970377 - protein, 345 aa, Homo sapiens
YLAGVFCLVPRGRGFPVFNPRETIVVAPFRPLLLGGHPFCGHKRLCSHIYIPGPGFPRFSGIFPPGRCPVVPHPGSGLVALFTVAPWDVECPGGVLDAPPYVTTGSSKRAPSERPGNSVPLGPRAYRPTAPSWSPTAPIPATHLSGGHEFFGDHSRTRNVEGTMFPQYHARTGGFTLGRILEGGALRVRHHSRPNKPPEHTSKVCLAPSSTTRAGDPCHCCAPRGGPRTVSTSFVGTPHPHALGVPTITSEGPSRETTSTWLVWWTRVPRASRGHRTSPLAFVETCGTPRPRHAHSRFLGLSGHEDRVTLGGPRGWAPELHKKCVLDPDEAPMEAVHSLPCRPCK

SEQ ID NO: 970378 - protein, 457 aa, Homo sapiens
PPPRWCAAPLLRTSRGSCILLPLRSSITSLVPRGASAVHQVLSAPPGDPTLLCCALLCPPPFFRGDPPVLWRRERCGGPHNKTPGALWLPPGFLREISPSPGGNFLSGNPSPSAVSHCPPSGVFLDMGVGGNTHRPPSSSPDGGDPPWVMLARPFLTGGPPAAVLYVGEPPSPWGGIGPPLPFRRCLCPNPGVVSSPKGRILVLPWMDLWRGPHTFLCAQTPPRYGISHVPLPRYFRGKALFFAGAALGRGPAFSLGRTQNDRVGAPPREGTSFFSRERARTFLPPADLSYWGPHKTLFIWKNLWKKVLFCRSGYRDSHKRATGGKFERERRQSPTQRDFVDNLSSLESLGFINCVEILLVTRFFPLSIGAHLCHRSLWAYETLRENSSREFSGEYTIFRHLYSLEKPENLTPNMTPTLAPTIISSAPVIIPGVVSPGWRRNACLKYPCDIDLSDSP

SEQ ID NO: 970379 - protein, 317 aa, Homo sapiens
RCSLVGEKMVVLSVVVLFGVRPPPQEWVVRSCTVVVSFHYSLVPACGAGVVASLIYFSSPWGGAHQFVVKTVQFSPFFFLVAGARYLRPPPPPPGVLLRPASLLCCLFGGAALRERSGTTIFSDECSSSPPGACILFVATQCVSRQHAVCFRTTNNRPCGWSSYTMIVDGVSYSSLAYLPLLFPPKGSSSRDFNIFGGAPRSPPTRGLYLTNLGGLSLSEEWRRPPPLGRGAPSWGSFEHHRGSSSGGARLRVVRPPLVVSLPADFFFTRPTPAVAHLSSWETLLCPPLGGFPSDKTSRTLSVAPSLFAALGASCTH

SEQ ID NO: 970380 - protein, 367 aa, Homo sapiens
ARLLPAPCVFCSGSALGCVSHVAPSISPAVVFYLLPPQARFGGRVVLQLSSSDGWWFGAVPPRGGRLFFFVGGLLAVDVAAHRVSSWAWLCLQQWGRPALVVRCVVTGCVCQGWGLPPRVCCCLLCGAHTLVVAPCASPSRVVLSVPVRRVSLLVSHPPTVGGPFTRLLPGVRSSSFYSSCGVRPLVDVSIDDMGGVALRSSRSIVPWCVGRLCAPPMWGPAHRWGADHQGGCLFPGVFSVNAYYYRGEDFFSVCVFSFAPRCFGVICAAAPVVLVMSCCRPLTTVCPSSLLMMGGGSAPKPVFFLRGQPIMPPLCVPQRVTTLWGVGVVDTPPRRFKRKGVFGVSSGMSPACSTGSAPGFVHHIVV

SEQ ID NO: 970381 - protein, 135 aa, Homo sapiens
MFLWYLPTSCASPPSECSLRVGPTCLAPGVFVTPPVCTPVDSPSARGAVVKENPWCVLTPRGKGRWPGPGDPCGATLGPPSWRHFERFFFCWFFGSSGFLLWWENVVASWVSREPQSDLLSRPLCGFPPRKFFLS

SEQ ID NO: 970382 - protein, 82 aa, Homo sapiens
LVVFGVVVIGPVPVPVFGFFAFVLFGVYVVVRPKPDVACGCVGWGLDPNPFRWFGPSPTRLCGETHAGLFSTAESGGGIDAA

SEQ ID NO: 970383 - protein, 104 aa, Homo sapiens
HLLDGSTHHHRWTTPLLTWLAPDRHNGGFQSANLHRWGGRLPQDVVTLPWRGVNSPFRGDGMPPPCLIVSVPVPLPVHVPCCHQPQSNLPFSYCLCHHSERWAD

SEQ ID NO: 970384 - protein, 105 aa, Homo sapiens
MTKSIGPEEETLEVHFQPKRKVSQPTRPSNRPGTTRVHQILYPSRPKIRELGLKDPWSEHQAIRRPDPSPDMDSRALDLIAPRILLPSPSWPGPPAFTSGSPRCS

SEQ ID NO: 970385 - protein, 275 aa, Homo sapiens
MGGFLSRGVHASGGEPGFRCFVGATWFRIGVELSKRLPRARVVCQVRGWPPGEWCVHQGCVASRVVVLYSGGICALCVPLARTRTERRWCPPATVVPRAHRVLLLCPRDGIEECPPQFLALLLEAAPTVVGFLVGCCPQPSLCPPPGGVCTPAPMPRPAASATHVMSTEGVCVVAVWCASFLFFEKRAPPCSGSTTHLCATARGVFQFSHAKPLHHTTDGAPTGNPAEPSLVFSAYPFTHSHFLLMDAVKLHLLGDYSAFTTHHDEGTFREPFTK

SEQ ID NO: 970386 - protein, 183 aa, Homo sapiens
SRSESAEDGIHVDSTKGSLFEKKRAHKYFRPGKYDESQLTAYHPGLDARSHIIPCCPPTERPAYFRLEKFAVAESDCIYAVALDRSYTKAYSRRGAARFALPKLEEAPKDYERVLGLGPHNFGATNGLREIPQAFSIPRNSYPKEADIVIKSTEGERKPIEAPPNKPPALSEKDRGNGFFQEG

SEQ ID NO: 970387 - protein, 169 aa, Homo sapiens
MRHLISRCRRFRRTADLTGSRRGPEKLSHCGPFGIREEGANGGSSEEASRRKPHMMNAIKKYPERRSLINWISLREIQKPLAPAPEGRSPRPSQMRKGPRAKRRYENPKFGFGGKKKGSKWHTRESYDDVSSFPGPDQLMAEASRGLARKGPNKRPWETNQREDEEPTP

SEQ ID NO: 970388 - protein, 140 aa, Homo sapiens
EGDAVLPGCVSGGGGGGGYIYARRGGAEFVRTPACLVVAQPVGVGVVDSSCGGHEGAWFRMFSLWGASHLMFVPPSVCVRYTQGGVALARTLLVAGEENPSPPLCFLTEIAWGAAARHGDSLPPRLGGGAGSPPAGGGLG

SEQ ID NO: 970389 - protein, 117 aa, Homo sapiens
MCLDVVWPPSVGERVLRGLKDATWWCVLACVGVFVRLVLSPRMCGCRGVCRRCGWSPGGLPRGGVECGASCLGGRRFFEGGRCWLLCRHLPRVLSFVGTYNLLPASVFEEPILSLGI

SEQ ID NO: 970390 - protein, 136 aa, Homo sapiens
RGYIGGKLGPRPSFFLTPAAGRLPLRSRAPLFSTVSPTNSTHPHICVHNLFHSGVGVSWRAPPHPEHFSPHGVSSPHPVKLSVINHATRRVGTGNPPPAQGCGHPPLATHEGKKNFLEPLRGWGKKNGNFCAFNFF

SEQ ID NO: 970391 - protein, 108 aa, Homo sapiens
SEVRGWLVVCPLAPPVAVNGGAPYYYILAPHTPRFGGPDLFFCCCKDGLVVTRGVVVCPCVRAPHIYFVVGAYFFLVALLFLPAEEPTCIGFLSLASLSIGFVAPLYD

SEQ ID NO: 970392 - protein, 107 aa, Homo sapiens
LVSHVQLLILFRAVLSFVVVVSCTSVFCVRRLRVCCSFLHPFFCPPAVFTRRGDRPGGCWARGGLSLLEVVPSMSPFLHVVGGAPQEVRCFGPPPGCFQQPLWVLME

SEQ ID NO: 970393 - protein, 282 aa, Homo sapiens
MGRTPIGGAAVVVVRRQCFADALGACLRERPLWVGCVECPAAGSLGLVSHGVVAAPALWVYTPCLLCALSHQYVGGGFWLICVAPGDSICMWWSRISPSVGLLGRPRLGRAFKANWVVTIRRTNRDGRLGALFLCAAQGSAPPLRRSLWCTRPCSLVRTLGGATPPPCCGTLSSLSPQVSPGGLWHHLPAVGAIRWGAGLFFSPEASSWRNFSRDLWSPEVAPLIAGRFALPEGPFVFYSYPGFPPRAMGGGFKCHFLVLDSRGPPHRGGFFSLKKSTDKPK

SEQ ID NO: 970394 - protein, 145 aa, Homo sapiens
PRSPPLFYPPYWGAPLVPMGLWDLFLRPCDYFGPRDPSFHVAAPGVFNPRRAGYYTPRDAFARARFMLHSGGPRGFYKGEKSDFYTGALLLLFAPRRPTRAWGENNMFVGETHHLVGWFWGGAPLENNHGCGNTRLPCLYRREYL

SEQ ID NO: 970395 - protein, 94 aa, Homo sapiens
RLTLFCGVLRALTVRPDPPAASGLDPARPGGSPCRAPQIPSLPPRGELGSLELALGLTSCFVTFLLPRGLDTVTTLETYPEATSERGPFCPSPL

SEQ ID NO: 970396 - protein, 104 aa, Homo sapiens
MLSSPQHTECPPLSMQHTHTQCVCVPISPTHSPCHTDRNTHSLAVLSINTLFPTREKKKNFFLCVLPTSLYCTREHTIFAWVVKNIDEEHNPAFCEQHVFWFLF

SEQ ID NO: 970397 - protein, 154 aa, Homo sapiens
ICVGCLLLPTYTFFSGGCHSLLIWGGEGDSVCAAVVRTVSVDTRLGGLYSLWVGILLPSQLGGEEEIVRLLLVCGGEGGEPPSPLLERVLVCLPLFLSWEPSLTPCLLFLEERGAPPPPARREHLSLPVCPHRPHYISRSALPLSSLCERESFF

SEQ ID NO: 970398 - protein, 83 aa, Homo sapiens
LPYAEAVIPAAAMDGFWGHMRLQCGLWNGVNSPVVSLPELNPEMGTDHDSENWKEVHKMVVESAYEVIQLKGYTHWAIGLRCG

SEQ ID NO: 970399 - protein, 104 aa, Homo sapiens
YPALGHHLGAPFWEPPVLGAPPLAPPPHQVLTPAPLLMWGTCSHIAATFSFEASAPLLDHLDFQDFQLALATGPVRAPVAPAFGGGSSVPGFGSPGLTFSHCFF

SEQ ID NO: 970400 - protein, 134 aa, Homo sapiens
NHCLGLPLLPRPSMGPAVFWKFQTLSPPTSGWKSCQVSPVQMETARYLLVARLGPGPDPPASGDALSSTGLHGPGFWVLVKEVHPQAWAVASCLPLGFQNPTVEPKVTPRGPPGWSPQDTLTLHEELKLTRVPC

SEQ ID NO: 970401 - protein, 82 aa, Homo sapiens
MPCAALRSRFQNGHGITHVWEKECGMRNLVVHRCTICVNVYVCDKLHVCNVAITPYRRVVVSLTGIFDGVPHHPYPIIYVGW

SEQ ID NO: 970402 - protein, 290 aa, Homo sapiens
ATVVPGVCSVWALTGGCSSRAAVGEHSRLPRPVLLWLTPASGQAGCVPPSPVVGVVRFFVLLGSLLPPPARVGHSDASMARRGAPPPQLWWCAPTMGAAPPPTLLPATLISLCVWADRRLRSVHPLFSSRTPLLLSPRSLSLTTSLRPCLRTHLPPPSVRDSLFVAVCVYRGTPSSLRGAPPMHTHRRVPPPSLIRGGSVCCLPPALSLSVVVRSPPLTAAPSAFFFASASCCAPTSSSLVVPPPGRRRFFSWVWRPPVGCGGRPRAAPLKNPPPPYFPSSPPPQHSQKI

SEQ ID NO: 970403 - protein, 169 aa, Homo sapiens
MACFPLDGHVALSEVPTLVRAPDLSEDSPLPGRESIAALVDLHAHCDTFLLPPTSVICFVMSTPLPLSDPSLASQRCPDPGAQQWSMGMPGSPPWALLVLCSTSSPRDCPPVFPDTPTLSGGTPVFRASAFPAAPAPSGGPPSRPLYFAFGGPGRPSRTFPPSPLLPSL

SEQ ID NO: 970404 - protein, 103 aa, Homo sapiens
MSVLLYTQGENLFAVVSIEGSACSGSPICAISKMNAVIYPDERYLISPLGISPYHQSLYPYSSRISPDRLEIFFSVISGFALLSQPDIFLSHFDATIEETICK

SEQ ID NO: 970405 - protein, 164 aa, Homo sapiens
VLLHAARAFFLVPLLVMFSLRVGAIRPPPPVGVLCAAPLLLLDLAAGGRGFLRCCAGWFVCRFVDPAAGGGGVFASWFCPPGGGARLCGPSRVAPVFFVCAPLVLVARSVVSPSFVTPGVFSRRSRDIFPARVCVVGPPPSLFARGPSPARVFFCSPRSFFLVE

SEQ ID NO: 970406 - protein, 157 aa, Homo sapiens
MREGTRLWGLVEEGVVHGDVYIEETRTLMGGPAHTLFLGYDSVAEIDMDTLLLSARPHLTYTTTGEMRPRAAHTGAGLRDLLGPQEDEVAYGHTAELSHMHQRLTHEVFSLLSVISHEVATEHLWSVFVHERDTRLGRHAAHVPSSVPTLTFCPKST

SEQ ID NO: 970407 - protein, 133 aa, Homo sapiens
SFLLFVACFLFFLCCLLVFFTRREFSSAVFFVFVVYVLLLAAAALVFVCSLSVPAFVCKRGEPSSASLCFVLVVSRPVCVSWLHVLCLLGGKQLIVVSFSSLWGDCWPPAVILGAWCVVVWEGMFLVGCAPGP

SEQ ID NO: 970408 - protein, 67 aa, Homo sapiens
SKAWTGLYSVRHECGPQLALALGCTKEGRLGVFFLPRSAPLARSTSSLCVNRRERGGPPFIMREDNI

SEQ ID NO: 970409 - protein, 231 aa, Homo sapiens
SLCPGQGPPLIRCGSLRVGMGNGVPSAITPEVLAFGRPPANQPVYQVSRVCPALWCSRSIADGGIPNVGHIAKALGPLGPPNQYDGLSPGCPPLRPLVNTSFPMGSRLKKYPRYGFSRCPGPAPQQPDQSISVKLTKIQVAPGVSGAVPGPRVHPTECCPLPDCWPSHTQARTIGAQSLTPVRAHDSTLGSLSLRRERPQPRWKVASTSLPSYENGFSEKGSRTPPRFFFP

SEQ ID NO: 970410 - protein, 146 aa, Homo sapiens
FPRPRFWCHTWGARKETRATVFLPLDALALPGATAILPHSVGRRAGGHGYHCPGPPGSPSPTCHAPETLHPIVLSHAAEEGGAWSPLRPTPTGRPTPAEDGAWAKVPQWLKLPASHEVETASLRCPLRQPQDHLLLPARNKDLCIP

SEQ ID NO: 970411 - protein, 192 aa, Homo sapiens
PPAYTGHFPQCSQAGTLTPCTRSNALLRHLGRPLGLYGKDPPEAPLVDLVNDGLEASRCQYVSLIYPHYEAGQDDYVKALPGPLKPFETLLSPEPGRPDLHLWETRSPSLTTSLLDLLLIPEVLAPGCLDAFPLLSAYVGRLSARPQAQAFLASPEYVNLPLHGHGKPEGWGDSEREAEFAFLSPGPIKFLR

SEQ ID NO: 970412 - protein, 141 aa, Homo sapiens
MMFGSDWGLSDVFGGSVCELWDFCRSVFLAVLPGARSPAAQHPLVCTGDCVFLLSRMCGQACAYLLQMCFLPRPGTCPGGWSSKGSPWGGVSPLGYLGCMFCICQPRGVCLGATTYGTSGSKGPVPSVISFLAPASPTSPS

SEQ ID NO: 970413 - protein, 110 aa, Homo sapiens
GLFLGRPCPRVGEFSLPPPTSGGALPLLRSPGVALHRFGGACKALLSGEVLSPGGPPPLGRPLAGAPGVGFAQAFRASRGGRVPSGLRYSGMPGGFPGVSPRCTHSLRDC

SEQ ID NO: 970414 - protein, 313 aa, Homo sapiens
FASVLPSCDVISCARVSVHTGPLLCPLIFSPPFPAFGPLRLFTKRCPSLPGFSPPVKSRGRGPAGSGPVYALSSPRFRPRLSRGHCVNIEASHCVLPIRTHVRAPEEPPEDSSRQNPRALTVPIWDLDPGRPRTCGPTESNLLQTFRRWPHTAQMDAVRIMAKDLVPPRRYVPQFVLIRAHIPAVSPQIPDHSSPTTDGPSPEGCPPRPWATHGPDQLKLPPDPRRSMMEFDPRRARDPGYEGGDDEVIALDDPLGDEEDEEESDAVGVPRFLDELGLSLHQMSFLTPSPSNWGLPLVWLLVGKNPRPPASSP

SEQ ID NO: 970415 - protein, 113 aa, Homo sapiens
MALTRHTFPPSCSPRAAGPPCTPCILFDQWIVLGWLSRSLLEYESSFSGSFPPWSRSVDVHYLGPGNHFPRLLPPPTPIGQDLALASGPIGCLPSDFLPPLLPSFELCWAWGS

SEQ ID NO: 970416 - protein, 73 aa, Homo sapiens
GATSCKWGSRGAKTQSNGPGVLGAPRTVSGESVHGYSLCWGDDSASVEGAPGKFSGKTVSSTVSPDLPPKGST

SEQ ID NO: 970417 - protein, 209 aa, Homo sapiens
PKVYRHMTWIPLGNQLISFQRALSDQCMMISSSLNCGLAKKLTCSCTVSQGLGQDHAQFSPSGHQPQLQAPAQTSTLLEPLEGEANCGVEPVLLTLVLLRCTEVPGKKVAELPTPGWIPSAEKSSRDEKLKKRCEAVPGFEITYIFSVESTRGVAPTDVLVSEATPSNCWGKCPRFLDELDCGSDGLSLDASEATLKLWVLTDPPYKDC

SEQ ID NO: 970418 - protein, 162 aa, Homo sapiens
CGLRFRQKMASEGYSVWFSCFHKTGDMFLLFCLWAAQQRLLSLVVVVLPSPLLIYVLPPLPPPRCGGAHQRLVGCVHTLGLPRGGGVYSSLLVIHPFSSGAPPLICCAPSLGGVNIVSPPPGVIFVGEFLARNTQPRGRVNTTVWWPTTANKVVVWSRKSFS

SEQ ID NO: 970419 - protein, 476 aa, Homo sapiens
ALFFVCVPPSWGAHHTVFVAPTLILWVRPLLLLWVGPPSPAVGAPAPPLFVASPPARCCGRRHSFWCERDGGVYLLFWRRHSWGVLSPPPPGATTTQGGVEPPRHIFSLRFGGTLLSPPVGCLTPAVCVPGSSLYVSLPLVVESPPPRSALTSSSLLCLVRRGGGVFSQQAAAPSSWWYLSGLKRERAVIFFPHSRDIIEDMFYLLHNTAHTACVVVNSTTRRALSSSSRVKRETLPLSAPTPECLSSRGGRAHHYCDEREETMLCDDTTVSSTERRATTTLFSSLMNERADSSSFSFISTTSDDTILCVVFSSSSRGVALISVFVCVYVYSPVAPRASLCALSSCGRDYTRRVCVRAPESAPPLSLSSSTARAVPHSLPRDLSRARGFRVCEREALSCVSALISRVVISLSRGVYFVVFLTHTERRFFVAVSPPPRDEEGALWGAGRRVPPLGPARLLFLPPPFSFFVYPSLLSF

SEQ ID NO: 970420 - protein, 110 aa, Homo sapiens
VPFSSHREFKMALCVVAHEKRGWLYSTLCGEPYTRGCVNSSFLLGVVAPPPPGEKVVVLHPPPQHHDFWLCPNGLTTEGVFPPTLLLLPPRTKYAARFLEPQCPPVVTTG

SEQ ID NO: 970421 - protein, 458 aa, Homo sapiens
SPFVCLGGGLLFAWEGFAAPRVFRRILFFSELSALGRPHIGVFDLAVREDFCHFLFGGVILQPRPPAVFVSKRPGTGNFVPVRILLSEPTGLWLFLRTADCRTCVGSTWGCPLSRKSGPTEGALTPPRWWRARRWMMDPMEMFPPHGSWPHRPPAAVIYRCFSPLCPLTEREGKEETSFYEKTRPHLEMSLIRCGCNLWATHTPPSALTRGYRKKFVPPSIGRIEIVVYRERRELSFGRNPLGGLYTQREKGLYLHKLCTHIFSWATHPTECHSPPSQPLLTFNHTHSENIVSVVEIVESVPSVVCVSHTILLRATHHYCVSLLMKTHYWPHLSQGLWRAALASTHPRVFPRHLFGRAREARREFSREVFAEVFERDHALETHTTRRGYPLLSLSIKIPQLCRGAGGTCGLIYSHANLGGLRPRRNCLKPRRGARGFGEVEDCALALRPGPPPAKLRF

SEQ ID NO: 970422 - protein, 157 aa, Homo sapiens
MLLRKQSVLLGRREGREIIPQGLIFRKGFTVLKLFFLKTDNRVPHLMCPALSRTGFINRGRGGVSPATVICSVLPAVCAQFSRALPPESLLDSLCERKSFCVSRHWCWSAQSVGIPPLPPRLWPRQDCVLKRSSLLVDSSHACRSVSAPAECSQREK

SEQ ID NO: 970423 - protein, 220 aa, Homo sapiens
MPWYKGHMSASPPWHQVFPARASRLQVTIEALRDPILEGLFPAWNSFWGGLSLPAPPQGYFLTQSFPPETWAPMARFASHVLQEGLTAELGIRHVLLTLQCLLSPPLPRVLHSTRRRAPCFWRTIEEYFRSGPSAHPRIPGGPRGPTRHGPKPVGPGPWQLKRSSPEPWGPQGAPERAEGPHGPEAMLASAIKKLAAQKKTGPESGRCGGCRWAFFLLPP

SEQ ID NO: 970424 - protein, 134 aa, Homo sapiens
MLGPPPLSRVFSRVLNLFVLTPPSVSLSSLSALAPRDLPTPTGFPESPETSPMAPGPHRAGVRGRPTGLKPPEPRPSTLEGLSLWLCIAPSLALRRHSLSWLAPCLPRGEPPPAPHGEPQGLLRGPLSTLGPRL

SEQ ID NO: 970425 - protein, 246 aa, Homo sapiens
SFSWLFRVSYCLLFLVCVVSFWGYLPSCVPPGPLGAGVHISLVLLIPPQNSGYAPTPVWGFCSPWSLPFRSFRVLHGRFGTVRFANVFSDLRRRMATSAWMVQTALGLVAQLSPTLPHWKCERVLLALFCHGPCRAPAISWLPTPPFPWTRPVAHPGFDPDPCPPSRRICSPPYTLPHHGVCPTDLGPMFQANSTKLTEAQARRASPSIWPAALFLRRAMNEAFWDPQFSAVLVEPPPDEPALVLA

SEQ ID NO: 970426 - protein, 71 aa, Homo sapiens
RCYVAPFLTSDFIFPAVIHLYSGEYQLRRHSSYTAESPTVTLMAVLSDSGSTHPLLHLCAQSNSCGKMFCL

SEQ ID NO: 970427 - protein, 79 aa, Homo sapiens
MGVVEVRPTLNCCTPFNVLYEKEGEFVAPFKFTTLLLMPHGPMRITRGPFEPDLYKSEMEVPDAELKALLQSSASRKTP

SEQ ID NO: 970428 - protein, 143 aa, Homo sapiens
MLYNYYMRRAHTRGPLLSRLHATPRGANCLTLSWAHTRRNFTLGPNTPEGARPRSTTPSHSAPSHKPPRLVLCHFRGAQLLRGGLSVGIWRHSSGILHETAEASPTLTPLEDGRLFNMHPQGLTRWEPPSHPPAHQLRSPPPH

SEQ ID NO: 970429 - protein, 130 aa, Homo sapiens
MGFFVDLRHWPPGPILRFSKRGSSPCAFDHPELGLLLRLHMASRYPEGPRIGALSLGPSAGPLAHNLPFSSQPPCGQTNLVFPHQFPPCDFGRPLPCGQSILVVFDVSQKIRCSLTVTNHLSSHLGRPNS

SEQ ID NO: 970430 - protein, 349 aa, Homo sapiens
DTSYLTLGFSVYMWYSLCWPFVSRVGTMVGARVSHNRWWFSTAQLEFCGRIYWWPRKHRSPSGDTASVVPPCHRATLGPPGRPRDPLRPPESWRDLPPRKEKKVTQAVDPLGPPTSEPSQAEEDLCKAPPGDLDTGLLSVFSQGHETRTRRGKGIGVPPCEMPVMSHRLCPIGEVYTQPKPTKGSHLMDFTNWGVWKFVENLLKRCPLSHAPPKSCLSPLFYRTLPSTTGESSLRGLNTRVSLGRTHSPQESLPSCLSPRLLCTLSHPLHSITHPPHSGDLRPLVSHTQGHTSAHTPLGLWLQSLTDFRRTHTPHRRQPPPTRPHPLARWRSHITAITHPHVHTFTCTG

SEQ ID NO: 970431 - protein, 251 aa, Homo sapiens
MVNVVVKTREVFVPQRAVAYPLVSRRFFPRALAHSPPREVCLRLLVCWRKFPGLGGGFFEDPLFVEHSTRYILVSNTSGATALSLREEKLCFPPAVVERETRGPRDWNHSSHTHGFRPCHRCSPPHGALSSQWALLHIVCGYKCEELFSGVPCSQRVVSHMSCEKKESSVGCPRPSGARHTQASGLSPVSPPQATGSSPPSFVGLHFGEPHSASLLHAPASWPRSKAETTEPLNSRGGEGGPRNAGAESRR

SEQ ID NO: 970432 - protein, 452 aa, Homo sapiens
DVARCCRLRWLFPLVTTGCCDLLGLFSPLFQGHPPGRGCRLHPHRGQPTSPGAPGGSALRVTLVVCRPHPLWGDPSLTLGGIPRGKSPPRLKEGRPVPPPHIFGGVFCPKVVAPATPPRSPWEPPVDPTLGAPPLESPPRCSKKPSFHGEASWFLRRGAPRRSPHQACPRVCAAPPLATPSRWNRSPLGCSPRLGKEGPFQRTLAPLLPTALPPPDFGEELWGHPLALLAQARSVCAEHCTFGAPLFEVCPPAPRFVTPGAGHEGPSRPSVIPTMAAPRPPLAPSLSRTHRAPTVLSPRSHRALYYFVSGALGAPHARPARPPTHSPTQMRHTHGYTNSVGTAPSILSVENRAETPRAQPPLNGPPETTGHTRATLARALSQSRRGDTPRYRLEDLHSKAVTPRKPGTAEENTGTTGTQMPAHDTLKGPTCARTFATCTLRHPRTGLKGPVL

SEQ ID NO: 970433 - protein, 312 aa, Homo sapiens
VITGGGGAWWGVGGCAWRSGGRRGARRVALVGAGALPLGASRARGAKLWRDMTTLFPLPRGVVATHGCVVPVYRTPGVAAKGGPTGVLVVGGATAACLRECAVCNSRGRVEPGFRPGVEWRRAVVLGRPPVVAAGGGRVALDALSRQALWFKPLSWGALLFGGGVGLAHGRLGPKAFWFGLRERAVPGGHPSFLGNVDCPRPRAECANMRGKKVSGDSVTGGERGYGAHQAPTWRGPTLGKAPRVPHSVTEHACGASIEREENTPLDTQPKCNIVPLSEVLRGGPSTHNPTHAWGHCLGWLARCVLRVCFVL

SEQ ID NO: 970434 - protein, 153 aa, Homo sapiens
SVRPLLSRLVLWPQKSFCVGSSVCSNSPRISQKVLFLLLWGTLFLWRLGLSWRSFFGRHQKGFCMILCVRCGHKGVSVAPYGPLLCAHFCCRVQRTLHTTPPILSALPAVFPTPELELSPRGDWGPVDESPPTASVLCLSRVGLLRRRPPRVC

SEQ ID NO: 970435 - protein, 170 aa, Homo sapiens
VVAVVRARVGRATVGGCVGRWSRSVRVLVGVVVVCGALGCMGWLLFVLRVVLGAGVVFLRRAVVCVVRRQAVGGGTWLVLPRSAWVVSGAPPFVPPRGAVVDAAVVVCAGKVSGGVGAPPPCGSKRGPLSVCRGIVCETRGRGVVCPPRKCVSHARRREREDERAARCVE

SEQ ID NO: 970436 - protein, 222 aa, Homo sapiens
MGNCPFNLGYYPEVLALFYLLGPPGFLTRFSAHFPPLHEKLCPALRRLYACLPVSLSTSRPRRASRESCRLWIKPMDTVSEPQSSEAWRALMSAPMGADFPFLFPPLGIPEKYLATLEPQSVDPESHCSCSNKVEPLESRMHNPALGKVEAPDGRLQTPEQVPPSQSWRAGKGIFSSPKDFWPQSPTWCPARTTPHTVQMVSVSFGPRPPEIGALVLFRLLM

SEQ ID NO: 970437 - protein, 118 aa, Homo sapiens
ASSEIDRRREVLSCEFCILCAGGGIVLIVPRRGDALLPLVRASFVGAPPVRGCPRGGVSRRARAVVVVPGRREVSAGGCVLVCDTQASLPTILLFGGAAGGLHVAPGPCVCCCCPPVI

SEQ ID NO: 970438 - protein, 260 aa, Homo sapiens
DDLVVCEAWWNSDGVEHAGCSGPIGVVAATVVRRCVADGDLVALVCVLGACVVVRLVGMWRRCFQLVGGDKVGLGFVLSAGAPHEWAPGGSSSAGGWEPPALGGGPQGLWLVFRDQGGGFSPRGGVDPTSTMPHRVYPQKNCCRLSKGVVQRLRVWEDSSLVWEEEEYLRRRVVDEGGEEGVWAGQTVNGQLVRPPHVFKSNGGYKEAPSWWGPPQEGCVVPRTPVVISPPVHCTTRGRGMPATDGGCALVCRPPVGVVW

SEQ ID NO: 970439 - protein, 211 aa, Homo sapiens
MFFPPRCFSHRELSGGPARPISPPFVGAPPTACGRYTLSGPYEMPRLSFLVSPPHSIWGALWRFCSLWRGSHALLGPLLSVLSDTPRCGHHSAPASLLGAFLPPWENGAPGCVGLWLCGVGPLGAPPAPCVGSLCLIRRPHSSSLTCGGRDPRAPLYTPSPPRVLYVKEKKKVWGVEGEILVCFPRLREGENIKREGSNLDFSGTPASRSL

SEQ ID NO: 970440 - protein, 73 aa, Homo sapiens
TGYSALYDCRIIVEYRLGTTKLFMWLVLVAGNSKCLAQQTEVVLNCWVEAGGAQPFLTQKQPPSSVVFPPGGN

SEQ ID NO: 970441 - protein, 146 aa, Homo sapiens
VCPPLRLSRMSYENGHNKNALNARSLSMPPLGLLRKSKGVFGIWVATLLVYMRVCQPRGFLRKGALSASDLEPWYTVLGPIIQKGAYLAISSPRKELLWWVSGNFGEDALVIAGKEQQIWGPTPVNGTFLTPGVFSMLLISEARIR

SEQ ID NO: 970442 - protein, 287 aa, Homo sapiens
MFCALGLTSMAHKFSNFSEFPRRVTRERTLESPLGTFQAFVEESLNKVQPVACPGKWVHCHVCSGCRQHFLIVPTSGDSRPILGRYNEESPKPAAFKPPRQEPESHSSMKTRIEDPRRLGGNLRDGRVLGVLRGFHRVPLGTGQYQRLPVSNSCAPTIQTAAQRDPSMTRFILLACDGLFQVFTPEEARELHLVLFPRMKRSRPREGKSPADARYEAACNHGWPTQAVHAGARPTHVTCDVWSRIWAPEGVARRPTEHRTGIELKRFTFVCVHPCVFCVTPVGLPWL

SEQ ID NO: 970443 - protein, 385 aa, Homo sapiens
CVFDMSVWWDGVVLCGRACSCAYRCVLVSVVGPLSRRLFEQVGAWLFERALISRRRGVSSRVSSERYVCRVFVRALGPFARVVMYGVGFLVGRALSCSWGAATHSWGGARSVSVLGCVVWICVCSPRRACSSKGVFFLRHERSGGAACEVYVTWEVRLVGGGSSRWGGLLTHRLSHTHVVGPLKVWRHGKLLSSKDKWCLDKRGKQPQREKNGGAARRRQLGVMFCSRQLAEARSGCLASWEEGVLGGLFLWWKEAGIGGEPTTHSSWWWFGRKYTTCAPPTSSSGRGSHREDLVPTLEHHQQKRRCVRDASVVWFMRVAHDWSCGGAPHTPPGLSGRALWHAVLCGGHSSRAHRRNTLVVYEAPPLFFCRLGTGVSCARLSLIE

SEQ ID NO: 970444 - protein, 240 aa, Homo sapiens
GWCLSSGGDARCWLLFVAGVVRPGVLCGGGGWLWCVDGVWCVRGRLLGVHALGAAVGGAGGAGGVGGGREVFAGGVFVWTGLWGGRVFWVVLWCVGVVVCRGCCVPFSSGGGGAPRGVSLAACCQLWGLVLLLDLGSALVGGCCVRLLVFGGVASLAPSALAGGATLRAGGGDARRGGRADCGRQRFLWGWNRVMWGCPPRAGGGRVFCVCVATPPRARVGPGGGTRPSLSLSVGAARAR

SEQ ID NO: 970445 - protein, 239 aa, Homo sapiens
LCPARLSNVSGVAPWPTCVGAQSVPRCLPPWKVGFRGVPTGSAFGVPTSNLSPFVLLGGPGGNRWCVHPTKNVGVDPSNDAERVGCPCVVGAQGSRACWCPGLEFMCDPCPSVIPQSARVPKFPPLAIPRAVLGNPGAPWTHCPIVVGATGLEAPWTSPRVRQRPIAGVTTDWRVWPSGTKNVMGPHGRARCALGVEKDSGPIGPLCGGDCHRVSQREALGLVVTITCGRCHIPRDHAR

SEQ ID NO: 970446 - protein, 239 aa, Homo sapiens
MGNYEVDLFNRPEEGVISLASEKNLPWDLNSAPAERPIVPLEALNEPSSRTSARERGVCFFHVGEGVATSIVFDPPVHYFSIPKRENQVFDPVCKDPGQRKNRRGKKNKIMPAQEDFQTMMEEAKFNPEPLLVNLPAQHAKDSRFQAIEKMEDREALFNEFVAPARKKEKEDSKTRGEKIKSDFFELLSNHHLDSQSRWSQVKDQVESDPRYQAVDSSSMREDLFQPYLEKIAQNLDSR

SEQ ID NO: 970447 - protein, 189 aa, Homo sapiens
ACCLLLPGHSAALARRRTPPQRVCGRAPCSSRPPGGAEVWRRFAGCSLPAWGRRGGAGLAIRVWSCSRTGETTDVFLRPPRVGPEHVCSGAAPPLMLEGPAGVCVYHHEEAHWGLGESRGCSHGGVLLRPAGVIFLLSWRSAPLPSPFLLPREKAWCAPPTLWPGQFSTERTCGGRHNPHEVLMGNPLL

SEQ ID NO: 970448 - protein, 195 aa, Homo sapiens
MLASVASLLRRVVVARPQLGELPRGGVISSFRRGLCLLGSRGGRERTTSGVHAPRGPTVWCGGPVCGRPCFLGGHPLLCDAPVVCGAHEIHTGVVVCPAGVRGDVFLPRGVISGVRGPTEVVVSEVIGSVVVSHVGGVGCARARSPPVRRVFVVVCVPPHAPRCFLRGDKSSGVVFCRAAPSIKAPPEECLWRGG

SEQ ID NO: 970449 - protein, 103 aa, Homo sapiens
GKRQKRGRSDLGFWTKGRAGGAREKRPGATPSWAEQAWEGPQPWGNNFKGAGDHMNCPPKVGRGTPPPDQRPEILGRTRVPQGTQTKQSKSWLWEITGNSSGG

SEQ ID NO: 970450 - protein, 106 aa, Homo sapiens
MWRGKSCGETGCSVFGCKRNKWPPDKYPRWCSAERKRVEKASLLKKRGGPAIERDLGGELSLVSLCWGKKGLIDSRLYPQRKSDKLRTTYRDIERLEGHHPRHMFL

SEQ ID NO: 970451 - protein, 116 aa, Homo sapiens
LGRKSLCRYRPDGPQPNWDFASPEPLLLHIFAGKSAQGTGSSVTMLVGYPVDVDKILFRQYDSPWVKAHRKSGRSPVKDFIWTPTRHPLAQLSRAPDFRTPSPPQPLLPYFPPPAH

SEQ ID NO: 970452 - protein, 110 aa, Homo sapiens
MGTIIDHLAAGLVGGAGVVLVRAIVPEYAVFETGAPAPLCPGSGQGYSPSPAMLLSASHMLRHLNLEYHSRMIADAVKKVIQVGQVRTRDMGGYSTTTDFITVCHRSPAD

SEQ ID NO: 970453 - protein, 101 aa, Homo sapiens
QFNIPPPPGQNPIVNHGYSNPAVFISKDFKTPRNCVAVTPLHGGTLDRIVYLFPVAIIEPLMNLVNSPKIPRLFWFILEALSNIFQAAEKLGETEKLSIMI

SEQ ID NO: 970454 - protein, 123 aa, Homo sapiens
MPAVPSPCLGVCRGSAASCNRPRFGVGATTNRAWGPRHFCFDRESGSKQNFLRDPRVHPLPLRTGALLSALGVWKKTLPSPPLPQNLRVGKPKPDVVAPNCSPRKMRTSVVPPAPVDSDGESD

SEQ ID NO: 970455 - protein, 246 aa, Homo sapiens
PRAIVAIPGCLSVALSSDHRQNFSGSRDLPSSYGIRWVCANTLSRMRAPPSGFLCPLFAPPPPPYRSVSCGWGKLVKGMEPGYTASWRPTTLGHHPANLTPVSCLSTMESLCASGGQEWPGPVNGSLHEGTTPFTRYDGGDNHSTPCASALYRYWLCAATTAPRKSRVWEFMRERSLVDELKPEVNHVTTAAKAEPPPCTSLAWFADGPDFVCWVHGQPGASVAGDPWHTLEVYGRAFTKLPKKLA

SEQ ID NO: 970456 - protein, 180 aa, Homo sapiens
PHFPAGTWPGLGPKYTLGFHQPPEFRRPLQLGGTHGSFVPYALLPRILSLMPWSPGVDPRTRSLFAAYACGGVEFYEKLLLGNLALRPSLGPRGGEDCIHPAGTSSPDTCSEIQPFTLPPPPGTLCCRCGGGCSIRAAPDGLITRTLPACADTPLPLSLEGPVGALGPIAPGPKNHWLWN

SEQ ID NO: 970457 - protein, 70 aa, Homo sapiens
PGVTVRAHPGHVGHGEAYTARASTCGVWSCPRGGPSVVWEQANPAALCPRLPPAGRLRGASSGFLSPFMP

SEQ ID NO: 970458 - protein, 106 aa, Homo sapiens
MVSRNNPREAQRSLATPDVDPPDHEDTKYTVDQRFGLDFKEIELIGSGGFGPVFQRQTTRIEPGRLTLLNRVKYNNEKAGAVKYKALGQNLITVNNCSIPMACWDG

SEQ ID NO: 970459 - protein, 78 aa, Homo sapiens
KGRTVIWRPRYNFQRHPIDNKGVPKPTEHRRWGHLVEDGKARSIQKILETIDKKHRSVETEEIPAPKPFGKSAVGPPR

SEQ ID NO: 970460 - protein, 319 aa, Homo sapiens
MANNPRVWCVSCCRPQCGRPPGWVGLCAPRLCPGAAPPRYAGAHTFPQSRGGTQGKPFCDSACLRRICAQRGLTTRGGGLFGVSVLGTGVVQRPQFALRGTPSSRGRDRLCLEGVSPLGPQNDIPGCTPAHSGGLPQRVLLCVPPTKKREMCYIYISSGGALPHGRTQGGYKRALRISMRAPALEKRPGPAYTLSLVKPPRGPLENWAHENSVSPVLLFAREMECEKVRECECGVRWPACECAPWRWRHAALVHIYPNPRVGGPLCLRPLTTPRHATEIIMVVPIFLCGPTKIYTSKGLEAYFQEGNSSPREHRLTHRS

SEQ ID NO: 970461 - protein, 134 aa, Homo sapiens
LVCVLWLRAGCCCGLVVERVAGVAFAVLPVCGRTIRSRGVGGPAFRCVPLIGSTCGCVTRWLPGDLCGLMPVLPGWAAGEWRPVVGLRDAPSAATLSMPTAVPVPWGSPSVFPWAGCTRPLACWGLLDLNRPSW

SEQ ID NO: 970462 - protein, 344 aa, Homo sapiens
VRVRIRAFPLPFLYCVKSSLTPLGFVAVLVAPQSPHPSLRADLGPRHCGALVSMVKLFIRNLPREATEQEIRSLFDQYGKVLECDIIKNYGFVHIEDKTAAEDAIRNLQHYNLHGVNMQRGSAGKNKKAKALQAKFAFGASMQSPGWQQIKGACEGKFVERDMVAAHRNVDMRGTDLLTCVTAWEAGAAGMAGGRAHPGGPLNKQQQFSKGKAKWHAGKFAAPRPGSRDWRRGDWGEPEAGLLYGWRGKEGGPGSKRGVAIDSFQGRAGRTLNRGNINEAIRSSCGTPLEPWSYGGFHCISNNAVRERSDGYYQALAVLLGPMEAVAAAAASVYNYAEQTLCQL

SEQ ID NO: 970463 - protein, 282 aa, Homo sapiens
FPSGSTVGGGVLCATGGDVWCSEGVAPGVSCSRGVFAGVLCVGPQLVFSCPPGRPPLCHCCVLDAPALWGGRSPTGVAPRRRGLGVGAILVQVVLVCVRAARVFVLGGGGVCRPVRPSSQSVVMLVAGGGPFFVAQWSPPRGGATHTCLSLGAQLLCEGPLPPLFVPTGGHAPGDIGFTRPLFFWPHASRGRKTLGGGCLHRMSPLHVTTLESVRMTTLMRLRTGLFTLWALHDPQRAKMSPHEAPLHSHILPQKGGPPRYVVSCDVFVHHSFFVSFFFTHA

SEQ ID NO: 970464 - protein, 114 aa, Homo sapiens
MRFKHTSIVARPPALYRRHHSASALGSAFRRGQYPGDTLVFSLRCIGKHLSIGTQNLHPTEKAFSQIEYLSTLWKDTLGALDTTIWDTTDGRIYPCPTGKNRNIGVCKYPRIIR

SEQ ID NO: 970465 - protein, 75 aa, Homo sapiens
YSRVLLVLLFVVVATTLCTQYTAVALCECTQVVIGLSRGRESPVFVLNPGVGHTRAPISGTPEVNSRREMPPMTF

SEQ ID NO: 970466 - protein, 117 aa, Homo sapiens
SAGRCWVFFRGLHGVVGVDVWCCCVGAERPFVRPPLASLGAVAQRLCCPPTRGPQAPICCAPLLAWGNRAAVFWVVLGRKCVGNGFSPRPVVRTALFFGGRGLLNAGVERKVFGETP

SEQ ID NO: 970467 - protein, 121 aa, Homo sapiens
MATLLLLPSGCGGDLDPRGLGGSPAPVSGPSFSRLRPSVAGTYSISSSFTRQNLALPVAPYTCAVTHISLEEPLGARTPVVPPERRTALGVIFASQLFLLCTDVPGASETASTYRTWAASG

SEQ ID NO: 970468 - protein, 104 aa, Homo sapiens
MGVLAKELIADSYSHFARHYPTGTAPPRNMGSRLCDLKGLCCQLICNFRSFKPLLDQIYPGEHPLRDSTPRPFPGNPSRILWPTKSSPKTAWQLRFTPPRGVWC

SEQ ID NO: 970469 - protein, 179 aa, Homo sapiens
VCVVGAALVCVTPSVVGMHTSLGGVVAVVLATVVREVGHTPSFVYHARLVGSLRACDLSSCSSPRLVHCFVICLLVSAVCSSTLLDLGGDPVFCPATIPGSGRHFWYRYIYAIQEFLGEHSHRMSLWWMYGLFFPRKCVVVTPLDCYSSARCCYKGIPSCEEKFEFPVVGAPHVEVEPV

SEQ ID NO: 970470 - protein, 292 aa, Homo sapiens
CCAVFVCAFVRVVPLLAVCRWATGSKGRSFSQRTFWGGHTSRHCVRSTQAPPIVWARRFLRVFWDLDMPRPRGIFTHFTCPPDPQDGIRVGPVPDVILQDHLKAAPLLRARGLAGWAPPDFVPPHALRKMGARRSRSPPVPPPLFSSFLSVVLSSPCPLSSRRRGGVPPASLFEDLPLSEMLVMALVPPSGHLFWFLTLVLFCDEGEGGHTSESPRLRLEGPLLLHAWTPTLCPTPRPCPNAPVPKFTGSLLPRPPTPAARRPPREKHQKRETPPILGTPVPLLISRSFLKK

SEQ ID NO: 970471 - protein, 211 aa, Homo sapiens
GGVGFLLFAVVNLCVGLGHIEGRVVCLLFGVLFLGAVLRELWWGECVFCVVLMPPVVIAWGRQGWLFYRLGLVLICGMSPGFECGIAAGCVFSVGAVVLCARLVLETARFYVYLLSSAWCVNVSSARWYHICVGGGVTDFIPLTLRQYSSWWGDTPLLVGGGWLLSQVERFVVSSSLSRVATSWAGSTRRLSCCPPPYCVEPVLCCDRAPK

SEQ ID NO: 970472 - protein, 186 aa, Homo sapiens
PDRSQTFGTKKVQNDCPRRIPDVSPTGPERWAGPPREADPSARRPKKGLTKEEEILNEKPIGAPNDVFPPTYSGRGGRTTPKPEKSDSKGSSTHDVSPFLEESKSQDGCGQSHGNTWTMMETANVTSRNSWPLVALVTTALPRVLLNMSEIMKAAQPFSCTETVMPENADTQGFSLVGAEAFPAVL

SEQ ID NO: 970473 - protein, 83 aa, Homo sapiens
DNLEWYVIVFRSHSSANRGKSPQQNKQVKHGCPPHSPDPYLVNSGFYQCLWAHFCTDQIHVEKCSVCRTPRYSLIVLMSRNGQ

SEQ ID NO: 970474 - protein, 228 aa, Homo sapiens
WTLGISFLWEPCSWGGFPYPSDSSKPGDLMPLPASARPCCMRIRPSLPDWRVFWSPFGPNSIHSGGMRKPSPKKGPAPWKNLNGPHPFNRAVQMNGKFPPGVHMWVFPAPVKEKAEAQARGPPEGCPPRATVSPRSPFTQETTHPVALLRMLPAPPKSFVWALAFPALCLHLCQHGGLAWGAPHVWPTPTHGHIPTTFWFEGADTGREVKGWGLENGGSPGPCPLLFS

SEQ ID NO: 970475 - protein, 99 aa, Homo sapiens
IDLYVHQQRVCSDHSAHMCRRRACVAPAWLPYVYTSSCDNPAVFAPRELLIRVLPRGFRLPLYACPPLRPRIVAPNSFGPIGGGPAHPHYCGGCNPPTW

SEQ ID NO: 970476 - protein, 109 aa, Homo sapiens
MPLVHTPGCSLLLTHTVCFLVLYRLSSANCSRGPSTTVIARWVPLRGQVLVLILLVAHILSYALPRPTLRVDRKCTTLFCLKHVLGFAGYPANLSISGLLQLGTVFTHI

SEQ ID NO: 970477 - protein, 72 aa, Homo sapiens
MTTLDKKQQPERYTPRDRTTGRGRPKEQWRVEGSSPTPPRTNKGGFSAKNHKRRSGCTSSLRERPTPHTRQH

SEQ ID NO: 970478 - protein, 113 aa, Homo sapiens
VLLSLVFLTAVVSQVSLVCLHSCIYGRVVLLSLWVVVGPLFTELCVSLIFVPGDFPRVMLVLHCGRAKPLRWLRALFTRQGPVPSIFIMWSSSGCSARPLLGNYPPGVYSWLL

SEQ ID NO: 970479 - protein, 178 aa, Homo sapiens
MRQTDTSETAEDEERKKREGDQDETEKEEKQPHNQATPRKRGNRPAGRERTPGTKKRTERRKELEKTNARKARRQRTDGTQRTEPTSNPNKRSSRKSKNSPGRQRGREPRRGRHRERAKRAEGESTEKPRSRTVSGRAERKAGTYTEQERTATGPGQQQEDEETRRRRTQNERRDKQN

SEQ ID NO: 970480 - protein, 90 aa, Homo sapiens
IWQTTYMMLVPDKNQDILREKVNEEDVYRKVIGYNGDSSSMKVICVWLELIRFETSPSSIIYQLKTLIKIVKKTLQGLIDCRVCRKEALN

SEQ ID NO: 970481 - protein, 133 aa, Homo sapiens
MACHGNRRHASRAEHDGPSNSLDTLGGQTPSARCSQHRLAPTCTSMPMGTQHAHDAPIPQNNKTTNATNHKTKETNTPGSERDPQQNRTTTHNGQEARQGTKSKKQQTDSTTNEEQDEQGGRTTKVQRTKDQT

SEQ ID NO: 970482 - protein, 268 aa, Homo sapiens
YLTEGDQNRESTVVIIPDKRIVTLNDKVVSSSRHRAAERASQASDGAYGARLPEDARGATEVQPEAPGNRATAGELETWEADEENSETQEEDDHLRDIKEDGTNAKAGRAAVRCHWRIETVLCRLRLPMLREMSSGWRGLNIRTVCVPPGIPTKTHTCQATDGNMPDDTGRQPQGHGGNRLKPSSALERGAPQESQAANSWSAKHSQRATTHSIQGYCKEERTLTETDCPPESTTTGRLQAHTDRRARGTPPRHKVPQGDPAPSARAT

SEQ ID NO: 970483 - protein, 184 aa, Homo sapiens
PFILYLLQRTDKITSLLVQTLPCQSPARFNPKVKRMCPKQNTPNRPSPIGFPRTSYPRALSPLRCPTPQMCLPPIAKKLGRTPPYSQTFFIYRPQNPAGVSPRVPHHSYLCPISGGPNTPIRGVSTKAVGTTDASSPGWASPRCPPTVKSNGVLPPGRRESFSTKSGALDLSPFQYRPLGVSDH

SEQ ID NO: 970484 - protein, 259 aa, Homo sapiens
IGEVLHSEKAMFSSDAPKIVTAQWRASLARVQSPGISTVLSLGSLENATSGTVWRPPASSGSMTSFTRQLQGHIGTRLRRLGQATASSITSSLRSPGIPSTPGTHRFSTRETHSRKFPGASGQRAATSCAQHTHSFPRSAAKAHRYRFLLSIRDTKQAQQHPHRPLKRPNSDPAQRTGPGQPTNHTMYHAPTNHARHSHQRGKRDPGTHRSPGNPGTHMGRAHTRGQASAHPQTYPRAFPRTKRRSHTHRMGDGPHPYG

SEQ ID NO: 970485 - protein, 145 aa, Homo sapiens
MIPPWWTKEGQRSGIQPRGNEESLCDVFDTATTVPERCDYCVAMSQNGARVTPPMTSYQIYKWKLTSWESQKKGKSCPKYHALEIGFTGTSPREPTTPMRDKELISATAYKEHHDVIPRETTSLAQGEKVSCTPSFLRRIKGEIC

SEQ ID NO: 970486 - protein, 216 aa, Homo sapiens
LWWMGGRAGVSLVCLSLLYLLSSVLVAAVSMWSVSLCETSCVVCSTRAVFVVVVDACVLVVFHHCRAWGRSAFFLHGFLLCATVSLRCCGFLPPPAGCFSFLGESLSSVRSPPLLLEGVSPHLCLLGVVRSGYGACVPRKKVLVCCFLFASVCEDSRCIISVNGGKMSPVVGMTVPRAPSPWDHKKEGEERTLPEDRGFTNRIRRNRIVDSGPRPW

SEQ ID NO: 970487 - protein, 269 aa, Homo sapiens
PSTECAWCCHGQQSLRSASWPSLGRPLPPSRPNLWYRPVGGPPPAKTGVLFLVGPAPALVCAAPAPIPVPPCVPDDTSGLCSFAGPHVGRHIALLCVLLRGSLFGDEAESSTNSHACLRSPRWSSLSLAPRQCVVCRNLVSSQISFHFASSCLSSASRYLCHSRHVSLPLVTGGAFCVSPRTCVPTGSSLTSSGYLIAPCVLVHFLLGRVIKEKAESHFIVFPQPSSAAGPCEQKAPEAALPLHVPHGVCVCPRVRTQDKALFVPSWNH

SEQ ID NO: 970488 - protein, 88 aa, Homo sapiens
SLSMSLLAQPVVCVVLLPLFSVIGSVVVLTGMYAGGLIDKTKLFVGRRRQYCAIHVVVGHEEHTIVEQRASKQQLLAGALPNELGCVL

SEQ ID NO: 970489 - protein, 133 aa, Homo sapiens
MFSEEDSAFACTSIYQAPSLLLGYRPNGTTHLNYTSRASPMATTARQRQLRAGTHKGRHLGNTGFPAHQATNTNFLRAPGGTPKTGPLRFSNDPIATLEYPWEEQRKQETQTFLNKRQKPGKPWGEQALGGSG

SEQ ID NO: 970490 - protein, 97 aa, Homo sapiens
RLRHVCGVLFFLIVVLSLLLHNCALFLSAALVLLSRSATLFFHALAFPLVGLPRPVPVLFGPLLSTFPCYRLEVFPDLRILPLSYITGSARVSRFED

SEQ ID NO: 970491 - protein, 201 aa, Homo sapiens
ASDNSFGTAMSFLSCSIQFVVLVGLLSIIFTTLCCSISIVRSLSHSSSSSGCIFCKRVPFGHSTGTLSKTMHAHQFLTLLFPKVGVLIHVLILGRLPSKHKCSLGSTIKSRLAPLSVAPCSTSSSNNLQGGTQQFRGHPNFVQARGPNFPTNRSNQLGQIHRFVLTTTEPAWRPHQGFSGNNSVQVEGGPIQPSVNRSKGL

SEQ ID NO: 970492 - protein, 167 aa, Homo sapiens
MDGALRGVSRQPKARTPGEPVTLAALFYGRICACVAESLTAVSVCEHGKGYLRGLRGVGACPPNLHESQNPPGHGPVLPTYPCIPSLDPRDIHGLNNGDTGSGCRSSHPTLSHFTHVTVLGNKVFTFPSLGFLICEAKRHPQQPVSLVYIADMEVLQPEVLHKHQAT

SEQ ID NO: 970493 - protein, 215 aa, Homo sapiens
QCGDPQYGAHGTWTGWEYHVAKGRPRLDLFRMGLLEPRREHWAFEGLSPSRLALRGPGVYLGIAGCLALYDDPLCRGHQGLLVWRPPTALLEARGTDNLLKCEGDSEEVGRAIPRRFMGKILRTQGEDFPRIHEMTPVFPRLDLRRTPRLVDREEGGGSHEERFNHLLDCPLPRKKGGRKNKKEARIKSARSREFVPRGLCGGIGEEEKINLAGS

SEQ ID NO: 970494 - protein, 126 aa, Homo sapiens
MCARTGKPKWEERTMKAFGTGWHNNLAQARRNNATRRKTNDTTPKRSPDHSPLRTTGSEPTTHHAERPRRATAAEMGPEKVHTSPQKRNTGKQHSGARQRPRRNQKRKHPQQRSKTQEQDTRGRGH

SEQ ID NO: 970495 - protein, 101 aa, Homo sapiens
FFGPPGVAPNSRGLTPGSPLGPPNRVVPPARPPLLRPPKMGKEPSVGSPGKLSPNSQGNKVAPLGGKRKLAPQKKEEKGGSIDTMPPPRRVTTRTCPGSAP

SEQ ID NO: 970496 - protein, 80 aa, Homo sapiens
SQITYGDGCGVWITRSGWIEIMLANSVKAPSLLGIRNNYVSVVYEAVECSDNPHDITAGALMDTENGMNPPVDGRRLDKW

SEQ ID NO: 970497 - protein, 154 aa, Homo sapiens
MVTHKSGNGRMRILYQEDLPWGQDDLLLDRWKILMDFRGEMAFLLACLVPSHCLTVRGLDHGIDCNREWVDRHQSRATIQPSDGGSSHDPKYEAAHHYPRTKPSPHTGRRTQEPSSAAHKKVSRLELPDNAVTQGGFTQTGDQRAHTRRSTGNR

SEQ ID NO: 970498 - protein, 125 aa, Homo sapiens
GGCPRRVSVVLSYVRCLLLVFMLGLVVSCLYVVVLLFRFSVIVVSDAMHLCRALLADSYDRVVCEVNPPPPRLFVFCGPTRGCLFLMVLYYSPCGRQFASPLSWPAWRKRGGSLPIGVLVLFLPP

SEQ ID NO: 970499 - protein, 320 aa, Homo sapiens
TCRLSAASTTQPGPTLGPTPALYLTQLHTQSSLGCWLRVCPVTPMTTQRRPDAHGSNSALQHRGRPTASARRRPNDSATTCHLSSPWRCNSLRQHLRHRPHRTHNKTHRVRERENTQRDTPHRRGARLTPYPQYRHTWRTNRAHSYLVRTTHVHTCEHTVTTHYQTSTTHATAQHTNVVAQPWPRRNLTTHNTHPADANRQERKTSEETTLTSNQDAHNNPSTQHNLRQHTHPSSSYANELVANAGQTTTTRQPRNDRQTVASERPHGGAHNKQPTTPQIRDAEQHPAARQESVRRANDTHRYKQGTQIGQAKRAVGPEH

SEQ ID NO: 970500 - protein, 163 aa, Homo sapiens
APSLLPTQLVGTTTNVVFSFCSHKSLAPTPSRIRVCPTLLDHAGGACSPLRCLAKQWFAPTRAVGSSHGTDTMVGRAYRSTPACAWLCFKDWRIFISRASSGASLASAQTPTVCLSSRLSLGGPRVFLADVRSLWPPSVFVSTDPPRPHIQVADPSPAPTMYP

SEQ ID NO: 970501 - protein, 363 aa, Homo sapiens
CARAWRSLFPYERLSLFHRCVLFSRACSFLFGLLSRCSKTQVVPVRSPGISGATHSPSPLLLVTPHPPWDPPGLAPPLAGVKGGMEKVKFFALRPPLPFCACAIGTCWPWGFGAHTLSLSPDHKSQGLTPGLLWFAHWVIIPHLGGLPLPCVAFLGFLRGPPEEKLIVCMSHPLPRLFCLLITCWCEVCPHAHLSRANVVFDEEYKAEMFTKVLYITTTFRATPRMGGILFPRLTTPPPLGFEILGPTELHGTIFKVLVGALLNYHHELGGENALSTSSREPAGSPRLLAAHLNVNCWALGIKFPPQKANPHKEGCVGEEIVGLAEEKNVLVVGCTHALGIAFVEVLGIVFACCLVKSNHESG

SEQ ID NO: 970502 - protein, 134 aa, Homo sapiens
LAYSSLFITTVSPDPGVPLVCRTPVTFGGPPKVFGTTDTWGCSQSGHGRVPLRCKAGPGSNLLPVEGNIICAGGVNTNAAFRSPVGPPVHRGSQKRGCAAPGKRQKGGAPPAMKAFKGPNHVMPPLMRRPQSHA

SEQ ID NO: 970503 - protein, 335 aa, Homo sapiens
VRRDSGYGRAVFVCVSLICRVLMAVLVVVGLRSEVMVQSARWRHPSFWSSAKRARASLRGIMSGCRWWCFLPDCVSFVSVVPVRLFVRFSHRLVVPPVGFVSRESGWADVGRQLLCGGGLSGGRRRMLLAFSCYFPRRCFPPHTVVVCVPPPLFGSSVGGAAFFYRRVSMDGVWFSATTGVLGLDERCDDLRGHRGGHSISSGDVFVSLVGSCFCLAVVGGRTPVVPRVFVLFLSPRGVCRMHLPAQHFFMCAPPPPLGSPGVATPPLALVYWWFTEFSGTPPCENRFCPPLCGTFARPSRSSGGPKAHRFLWLPRCFLSFVSHPPAPPSFFWWG

SEQ ID NO: 970504 - protein, 249 aa, Homo sapiens
MCFLLLALSRTFLFVSGVLKFQPILSLKSPAFHFSSHSLPGTPSSFQSASITCLSPGAHVGKPQPDVLTHPSHAATQINTQHHVSATDVGAHLLIQLPAAALHPSIIANPGVPLLAASGHTPPTLYNPVTPALTHSSGTHSYATPLPFPRTQFGSRTTLVNRTPLVGLAPLGAQIMLYIRNWSTTSHASSPGPFIHYRLLKVTHKPPLLPLARNRTDDSPEVPSRLSATLLLPPHQSTQCTAPRPIGKH

SEQ ID NO: 970505 - protein, 135 aa, Homo sapiens
MDAGRIPAASWKRFPRPFWITGYALRTVGTVLVNPCENAVFRLHPDINVATGTTLLPLVPTEELPPWSLFPSVSRPPRLCAESKDWKKVEGKVFPLLWAPPGESPRSPGFASTDLFCDPDELASPVYLAVPRALF

SEQ ID NO: 970506 - protein, 306 aa, Homo sapiens
SSGADYCIIKYSFEKNEMKNLTELSDGKEAHAKHHGQHSSKQACNLASRSTAYKSASTIPHSKGQQQQHKAVICSTHGTSSTWDMMPPPFMWSSNLASTATNGKPPDFTSLNRLHVVTLPSRRHYSVRGTIPIKILLAQIGITLSPKSTQSCTHLPELSGTPTTQPHNVFAGRLWHTDLAMDEPSLYNSLSMAMADSKQQHAWEYKVEQVLLHFSARPLPTAIPSQSFMALTPRTLTGRTTSPVSDSASPCTTSSWRGTSPETRAVPRYRQITPYSESSPLISAPRQSAKPTTQRRLRYKIRPHRR

SEQ ID NO: 970507 - protein, 178 aa, Homo sapiens
MPVAGESIWLTFKIPKQSSMKSDFNTICPKSSCTEYVVQMWCIGTPTSQRDPLHANNKQTNNQHTIIRVPPNLPNSVLTTYPSAPGPQGQTGTPALKLAQAATGHTPRAEQLQKTHPRPAHSPQTSKKQNPTRIHSEPRHTNPQALHPETTDARKQSHPPPPSNTRRNHRTDHTRRTT

SEQ ID NO: 970508 - protein, 245 aa, Homo sapiens
MTYRAPGPGCPAHIGSCLTTQDKDPEVVFIGTPLVPTQAPHARFWPNSSLLCKHLTLALVVTAHSMYFGGCENWGTGTHPAHRFWWSWVGPHNPGHPAEPVTGGNQGQLGQLVNELTTPHGPGFGAGPASAEGPTIPNPHFGKKPTTVKRSCVTGRHTGWHTPFGPTLPKNADPSAVQHSQMAPTSRHSLTLYDYLHLRPPGLHTLFAGLCNSLLLRSAGPRTTGQRCSPAGARTLSILLPSHNI

SEQ ID NO: 970509 - protein, 154 aa, Homo sapiens
LCYCHSSFCLGSWLWSCVMSFSDSSSVHIVLGCVLSFRPAVYPRVSLCFAGYVFVCLLCSLSLCVFSPYVAPLLFFSPACSLGSPGFWATCFMCHTNAFPLRAPACPLGIFGGPSSTVDPSGSLCKCVWLPTCTPSELDYLGHAYRGNFLRVFN

SEQ ID NO: 970510 - protein, 231 aa, Homo sapiens
MQIIQALALLQFILGLYCTLLRSLRVLRVSLHPFPTAIYGSTFCVATGFHGLHRHYWLKFPHYLLHPQLIFHVYSPNYHFGFEAAPDTGISVDVVLLFLYVSILLMRVLKKKKTANDIHRHIFSAEEESLSGKTICEERTYSVGEPQEEPKSRKHAKRVLPTAGRYENTPPDSGTKGMRIHQPDYEHPPGGKPCCDANDSPQGAIESNHNVGFNHTVGEQANLLTNIRPAR

SEQ ID NO: 970511 - protein, 67 aa, Homo sapiens
KQHDPEKLWVNNEIKAEINKFSDNNENKGTTYQNLWGTDKAVLRGKFIALNAQIKKSDLKLTTYVHD

SEQ ID NO: 970512 - protein, 124 aa, Homo sapiens
MGLDVRFPHSRERDPRCIDYTIRLRHTWLLAPTAGVAPQNTGCCSGHSQGVKSHCLALGSPTLGERIGASKRAPSPRATRGGTLLRTPRMRYLPTHPPLSRNTKGWESHEAALPHAPRHVPTTH

SEQ ID NO: 970513 - protein, 402 aa, Homo sapiens
GVCVGVRCELWFVLVVWLVVAWLAVCFCWFGVGCVVRLCVVCVCLSVFVAVCLRQYVFVLLVYRVCFGVVVSSGAARCGVAGVCGLVVVGVLVWSVAMCGRCFCLRLVTVVRGRGVLCWVVRVLIAVSVVFGVSGVVCGGGEVGSVCVVGWVGCGVVGGWWFRGGGFVVGLCVFVCGWLGGGLLLCEWAVVFALLGWSGVVGGVVGGGGAGWGGSLCVCWWSVCRGVCGVGGVGEGRGGGVGCLVVFVWSLAVGGVFCRWAWCVCVVCGVVGCGGRALGLVRLLVARAVAAASCFRLASVGGGVFVCVVVVCWSGVGARGLLWVSCFVLVVCGGVVGVFVLVWRRVVCVCVVCCCFGVLGLARRALRGGVWGGGGLVLGGWCVFCVLFCAPAGGGVGSVLGG

SEQ ID NO: 970514 - protein, 270 aa, Homo sapiens
MHVGVVSPRSVEKAGGPIYYDRGGGRHPKEGYYILCRRHAPGVGCEAAPANMWCSYHSGVVCTTSDRDGFVVTTRSPSPEMFFSWPKCALSCDDSHTPIVGFLTHTPRGRTKGCQSPQWTKDLFGVFPVGRGKPFIVVPPPVSQCAIQPGPPQKTFVVNGAPPPGGILLGRLYGPPRGFLTRDNCNGPWRFLILWAQRVPKGLVVGPKGFNSPLEALVPAERCFHPGTHGPLPAGAPHTGPQRVCPHWVGRHSRPRPLSIEKTRSCAHMM

SEQ ID NO: 970515 - protein, 332 aa, Homo sapiens
PCTERRAVPAHLLLRQPPGAPTHATTGQPLHPHFSQPLCLTACLSAMRRADTDTRRCTALLVPGFPLTPQPRGSLAPALPSCPPGHVPPTAAPPTHTHTLPAPHHPPPLLHPPTPPLPPHDPPHSPHSTHPHTHPPTHATPTYTRLLTAHPPSPHPTPHPSPTPTPTHNPTPLPHSPPTPPPPHTTPNSPTPHHHSPPTTNLHHTTSNTTAPHTAYPTPTQPPHYPTTSPPTTTTNPITTIHHPTHHPTTHYQPYTPPPSHLTTPPTPHHTHPPHPPTPPTQQPPPHPTPPNHTPPHATQNPLTPHPTHPPPPPPPPHPTPPTHTPHNPPPH

SEQ ID NO: 970516 - protein, 126 aa, Homo sapiens
CRRCVCSERGCVGRGSRRLLDAVGVSGDREALVVTVVRWGALSWWPLAVLCLLALLNCPAVVRSPGVMVRRRVCAGRAAGSVRWFVPAFWCAAPLGETLVGCGSPSCIVLTYMFCVAGAVWGARRV

SEQ ID NO: 970517 - protein, 349 aa, Homo sapiens
SHNTFSALSGMPRRYSDYPDCIHHMKHPTHPVRLISLSLTAVTINYIFTDSCTTPFALRHAQTAPYIRYKQPLPYTPLLQLTYSCALPPTHLHHHHSRTATPAPTLQHSSTNTHSDSELDTTHTSLAPQPPQPTHWAPPTAPFPRNTTPTTTPHHHHNPHNPPPPPPPHPPHHPPHPHHTHPMTLPLPTTHPPPLYCPHTTPPQRNPPPPPTPPPLHIPTLHPTHPLPPPTPHPFHPTHHSTTTQLPNNTTTTHLSTPTAPTPPTPHSNSPPHTLSTPPPPPPPPPPPPPPPPRPHPPPRRHSPPPPLRPTPPPNTPPPPPNPPPLPPSPHPTPPPPHTPTPPTHPTPP

SEQ ID NO: 970518 - protein, 96 aa, Homo sapiens
PEWASPHKKGGEKGKRALLCPSTPKVCEHPEEYHPSRPFHQPPYPWEWGFQESVPPLGHIQREFWKFAHVRENGNIPDSAAIDHPGVQPRLSGPKE

SEQ ID NO: 970519 - protein, 159 aa, Homo sapiens
MTGIQQMNDEKVHAIVDRSPVGPVTGPAKKLKPVIVPLTTDTHWAGTWMRYQGNSSLSRVTADKRDGTQELIGTDGATREGPADIRIKTQTTLCRRTITTTPKGENSTQPASLEGGEARIGAPGTQTKHGRTIDGSRKEGHADTATTKPGLTYHTRNPG

SEQ ID NO: 970520 - protein, 157 aa, Homo sapiens
MVRNFLLGKPQPPLPLRGDKQSPQSWSFPRWTPPPWGGRSCLPPGPPDWATPLGPAEGPQVGPREFTEPGTSWGTTISMFVYPCVARSDVVTLLSHEPILSYVVTAENTTFQIAPVIAAGPFCKEAPLYEAGEQPRPRWNNDELATIIITRFCCGTI

SEQ ID NO: 970521 - protein, 353 aa, Homo sapiens
MVLALYFPPPFPALYLPLALHELTSTLAHLMLAMQQGSPIYIPTKINFCKVCQGSTPPGVPHTRTTTSHTDYSAPQHHSWLAHPREPAALGGTQPPARQPPPLPAARPCRTPRAPTPPGNPWDPLHQGPQPSPSCKYLKRIGATKRSEPIGRHPIHRTPAPCPGRLYAHNCDSTPKRATPNCANIPWLVHTPAHLTTSGRRQRTAKTNTRRGHGHPLPNLTGPRTRTSAPAPCPHTHNAPPPPADPTYRTHTRGKTFNARKLATSPTQNTVGPPVTQHPTICRGIDGTHTKDPHGSRAHDKAMDVEHHTITHPALRTHLAQRLHLHARHARNTIRPHTRPNPRRLTTTHDHDT

SEQ ID NO: 970522 - protein, 322 aa, Homo sapiens
MSWSTSHSLDSCTCFSFTTQATIGTIQAIHQMHYSHHIVLQVCNSLHRGASLRYPQLIRALLPGTTQQSLRRNSSHILPYLPQLNSSHLAPPPSASNGQHLGIVLTFSAHIVSIPLGTAWFPGRCQGSVTRFNPVVPFDSSPGIIKRSNIKPGNGPRGPIHSLISRSGVRRIPRDDKGPQGQKQQLPQNPGNRTPPAVCRSPLPVEVTGTPYRASNRHLTTTSSTRCGNTRRRQAHSAPLTVTFFSCETTALLLRITPHKSRAHTHPIATYCSEISMETRTVAYDSIPPSTRTRLLCCHFMICAPCVNEPATRLDTVPAIDP

SEQ ID NO: 970523 - protein, 144 aa, Homo sapiens
VRSYQYADLPPDHTGETYQPFVIIALIIISAVICVARSRCMSLCLYIVSYTNVIYYYDLRRIIEIESVCAMLPAIILVLIALPSLRILYITDEVNDPSLTSNQLAPMVLTYEYTDYGGLIFNSYILPPLFLEPGDCDSLTLTIE

SEQ ID NO: 970524 - protein, 258 aa, Homo sapiens
GVCSHLCVCAAWVFLGVPRPWLLVLVFPLGALPIVRVLGSLLRVYSPRGVMSGATAQFFVSSFSLLAYHGVSPPRLCFALSGESHAGGQAGAEDSPLGGRCGSTLTLGYVVNSARGFGEESPPHCGGLCEIVRYRRASPQDDLSGRSLLAGMCVAPPSWAFRITQWSQFSLGPVFCSNMALLIPRPFYSPPEFPSGIKPVTSSPRYRRVTTARYSMYDSSLLFRPTRIMPGISLRLSRHGPAPYLHAITRTDDTVCKT

SEQ ID NO: 970525 - protein, 144 aa, Homo sapiens
EHRADSYAGVTVIDETIMSLQGTFSSIILSPCSKPAFEPSHYVHSALQHISATISHSVACHFHSLQPASITHPSSLISSVPSRITCTALISLRVSTATSCSAPISLLRHSQPSHASHRAHFFRSHDTTLGNFARAPLTFLVTSS

SEQ ID NO: 970526 - protein, 39 aa, Homo sapiens
MPAEPDGTTATRRTPRAATRTPGHRPQNRDNKQTTHHTR

SEQ ID NO: 970527 - protein, 116 aa, Homo sapiens
VLVSSGTKPGSSDTLEISEGRFFHKRITELDPSQVRLSDEVTHFNIHSTRLPVNSMRFCITQYTNETLLLRDTVLGSSTDSQPEEVRNDEAYGSIQTLPTPVPMEKAFRITGINIR

SEQ ID NO: 970528 - protein, 242 aa, Homo sapiens
PDNVCIFFIFIYLFGGRKLRDEGNREGGGGEGGENWGGHRTSPGDTGACGAAVTTRNNELTQEQDGENKKRAPGNTTTDREKNERITGGATHGGANDTRERRTRRRGANTPRRGATQRAGNRTDSERPTTKRGRQEETGAGRDDTHQGNGRRRRKHTAEPHTRGNKQQRREEQEREKSREKRKPEYEKHNKGETWGEEKKAEGAKNTRQSRQKTRANANRGEKHKEGKHTKDPQKKKKNKNK

SEQ ID NO: 970529 - protein, 192 aa, Homo sapiens
DTEKELSKEKIQEALISAISRTEGNIVQQLVGDGPPRANDTRQEASTYPPAKSLKNERSERMQRLLNNVVRKRSITNTHLRNTRTADRQRDISIGHDQHTSATTALHRNKQQLTPSRAHNSRQTSPNYRGNNTAKHNYTVPGQTQRVYNAPQPTPKLKQTQAQQQRTGCTARACWETARAQLGQQAHHTEHW

SEQ ID NO: 970530 - protein, 113 aa, Homo sapiens
CYVVEQGINFVYSVLVCPESRHALPPAVVKSSRGVNIIRKVERNVSKRLKKSGNAQNTYCFLQGYKTLGGRRPTNSLRETGASTALCFGSPSRGVTTPLFDREIKHIVRCSAS

SEQ ID NO: 970531 - protein, 131 aa, Homo sapiens
MPFMATNSLNKNSTDDICVRIKTSPNFTTYHQHRDPALTTPYDPVACFLNPARRGIYGLIPRPPDYSTIHTGVKQTFAFTLLFNGWSPRTSTSSFSRYDLCIPHKSLRTASSSAITASTTNVTHRSISEHA

SEQ ID NO: 970532 - protein, 271 aa, Homo sapiens
GATALQPGRQSKTQSQKKKKLLARHGDGACTPSYCGRPDGMRNLAEPRRLAVASSVRDSVPLCIPAWVVDHARRNSGPHKQQRWRGGEHTCGSHVSCRPEAGGLCLSTGVLDMPAAPSDHVPPWYFTRMGLDKECRADQAFPPQTPTLHENTNTPKLVADNRHQPKNDQNTHNPMCARASHPKTKKHTRGPNESHQPGPRAIQQNSARELTPTQPTSAAWKPPRARNTTTKALSSTTVRPTKQRNGPHHKSTTGDTEQDTEEARDTHRTNG

SEQ ID NO: 970533 - protein, 117 aa, Homo sapiens
NCTGEWPFYSTFSVILYLVKMDEKSCINALYGNFGSSANYFYPFNKATPIWSKHIYLHAWHIGRTLNLWAFGIMVQTKNTHTKKTPKTPSCVSPQNEGWSLWFHPGFPTLYCECVHY

SEQ ID NO: 970534 - protein, 197 aa, Homo sapiens
MATPRPWANKETKNSGPQKQNDKTQRKQTQPWGGGHRPPREKRPQQPQRQGKRAGHPKEHQKNAAHTRPKGNTRAQQARRSLQPQRNTAGEKRTRFEHQTNCGSSEGNRGSKHTDAHSTSNKKSPRARTNKEEKNSHQNTKHKPARPTKTQDQIATTTKRTETAEKQNTTTREKRHDTATITTKKTHQHHKTKNNNY

SEQ ID NO: 970535 - protein, 123 aa, Homo sapiens
VLYVCVLLVDGCLLYVVLCSVCRLRFYECVREFCWRQDFGPRGGPLRLSGYPPVFYASLLGVLPFWLGVPSSGRTPPQFFVRHYIEVPFPVPAISRVFSPLPRGVNYGQSNVNVAISGTEPAI

SEQ ID NO: 970536 - protein, 115 aa, Homo sapiens
MYQLMHNLRPWDRLLQQWRKGTLHLLLTDGFLALLKHRMLTTSDAFCTLYQGLENLLHKKQSPIYTMKFSYLCGPTCGHSSHCLTLTSSSELSAYTLTTPSNDQKIDRPGIGYIH

SEQ ID NO: 970537 - protein, 115 aa, Homo sapiens
HQGVNTCGPLISSSLRGGCLLPPRVFPRPSLGDICWPLGGLTPGCEYVQHTAGLFGTPPSERRLVQMLMDNPQQGVPTPPNVATEIAGGLYKRRMPMGGLVSLVRPSTPKRTRRA

SEQ ID NO: 970538 - protein, 435 aa, Homo sapiens
MSTGYRRLWLARDYSILNLTVTSYLSETCISTLTGLAVCPQIPLCQLDNFHYFRATSSVLLNTYGAPYIHMLINALFTTSTPPTFITLTPPHNPLSIQSPGRLPSRAHRGLQTEPTLMRPSPHPHWRTCIKQTFTLHSHTTPAHTQPFGSTLHLTRSPQGGRLHTLPMPRGKTTHMLCPTTRMRHDAYPLVHQRFPTMRGPYTHSLSTIVSGATLFAPPRHRATIHPYPTSSTYWTLLRTLATAYPLWPRALDTAHIGHKHSTARPPLVNTTKPVSLHLLRSIHNYTDKTHQMHSYRTNHTWSSIQPGHKCPTANTHAPLRRPPSPNATTITPAQSTTQHQHSTTHQGKTNNVRQKHHHHRTHTTPRTRHTNQPQHTTPTPHRQQDHPTTTLAPARGTQNTHYTATYTRTNTPTHDPSSHPQQHNNHRPTQHKQQ

SEQ ID NO: 970539 - protein, 347 aa, Homo sapiens
WCLLLIHHSSSCWYILSQYSVCTLLCCKAQTAGKMLTTIIEMYTHNCSIFNNQYNMALALLLYLWFFSLTNFVFSCWAGSGVLVLLTRARSRARQASPVTSCSKPSKIALYLSSLQCATSQHISLSRALAPQFSSHLARTHLPVHHSHKSSQTSTNWANAKPDSAGILGQSYGPTENKLSFKQLVLGIYLILARRAVTHLSTIIFGTKSLCNLDLVRRAPANEVLHGHFQRFIEHRTNSFKLTIPLTLCNKQHPADGQSDERRQLELFGLGSIKASSQVKPPTGMRHTEHPTDRKPEKQQGKTETERNTAAAGATKVNHHRVRELEELTPKQETTPNCHGAQARADH

SEQ ID NO: 970540 - protein, 72 aa, Homo sapiens
FVYKEEHPFEKRRSEGEKILKEIPGPGAGAGVETAPTSSDRRPGQHEIPGRLLISQLAQFYFLIRKRIHLRS

SEQ ID NO: 970541 - protein, 208 aa, Homo sapiens
QVDKVNFHMFDVAVAQRDATHASVIPVLQTHVEVPIHTYVAGPASQLTTPASIPSAGTKPSTQTQPCQAALLQRSFQADHLATHTSTAACSQPILLIDTMCPSTPEATGIWHTTSSKQLTCTLGQTSATHLDGTSHIAHDTYVASGLTQHEHTHGAQWHNIRADDHRARAARQTLVRPQVSSTSCRHGTGKTITTLRDRGRNYTRDDP

SEQ ID NO: 970542 - protein, 185 aa, Homo sapiens
SELSGCVVDVSEHPVALASHGLTKLHCKQPALPGDSKAQPFFPTYFCTKSMGAWHTHTQTKAHSRANIVTMPASYLAAPSTIPNQQQPAVHQATIAISHCDSQALGLPMGLNMGATKHCGANLFPPHWAIFSSFGNQQMAIGGPTRQPTTIGDTRQPTRGNQGLATSPSTHIFQPGKSRISRTAL

SEQ ID NO: 970543 - protein, 186 aa, Homo sapiens
MPHELKPGATERGPAPNNIKEYEIPSQATPVKYLTSLVKYLHQRIGIVLALQLAASSHLLFQFQISAQHPTGLRYSQDLATNNGSTALTSHTTLTTLHLVRHTFNTPRTHGLHIHYDTNLQMPKGTSNFSNGYTSFTHHFTHGSSHSGGPGLHHTTINKLSGLSHFHHRQRPGLVYTTNLKTYRNV

SEQ ID NO: 970544 - protein, 203 aa, Homo sapiens
IPATFQQAAGGTASTQGSGSIKHHPGLNHGATPQSLGGVAAATHVGPPQRSRPKARRLQAPKGSQHATGCTPPVVDRVAARPIGAQVCKAARHAIWAFGPNLRITFTPKAPMGRPENHKGNGNAKRGTNFHPGGPKERAAPRPAARKHATRSTHNASRQHSEATPHDPNTHQPRLVRRDEAKAPAADSTRLRAGTPANAQERK

SEQ ID NO: 970545 - protein, 236 aa, Homo sapiens
SVLHGLPNGYHVRVNRTYVCCGLLYRRRQSPFWVKAPCAVIPLLELVLQTFFSVWDLLLPRSTVSGHSERLLRKTRARILRAFFPAAPCDRSSVRATYTSCTRWSRKTAMDQHGGVGCTRHPGSSGAAKLGWLVQKENRHRAWEGRKSFYAANCCTHAFASQYSPAGGRDVSFSNSSHQDACLVLTPLPQKSGGKKPAVRTTIRPPKRRPNTSRGNQNSSSNCCQIINLNAGYLRG

SEQ ID NO: 970546 - protein, 95 aa, Homo sapiens
MYSRATHNSCSSSLAKKIISDASSLPRGPQEQQPCPAGRALTLGRTNQVGVVVTPCKCCLPGIVNNIVVSCIGIGSIRKQPGGGVNSNQKSLQKD

SEQ ID NO: 970547 - protein, 202 aa, Homo sapiens
MRHRWRNDSVIGSFAVALLSRVIYCPCDNKMFLPQGVPVRCLWGLVTLLPLLLAVVRLRPSTNSFILCPHMGVSLTPLSGLVYIASEVDLSLGEMIRSARGRMLSRRPLFSLSSRLCGDEIGGGRDYIWRGGKLFADRPWGATFYVAPPLREAMYLQTPTAVVCIGLRRRLSNIGTGGLLKRECTKRCPTAGARELDSFARG

SEQ ID NO: 970548 - protein, 120 aa, Homo sapiens
RGRKGYLETGVLRSVLCHIDVASCCLQNVVFTVCLAILLLVAFTYTVGGSRRRLIFAPYHVGFFGETNFYPPPGVSPPARPHVVAAASAQFPGVSSNLVNHPGCFPSPRALLVIQGAGGT

SEQ ID NO: 970549 - protein, 318 aa, Homo sapiens
TIDKKKTDRDRAKATGNTQVCVARTVKLHDVHNMEKSLGETYYIASSRVSAQCCVLRNLGVNIQGLCPSYVGAWYPPRPGDVPSDQGTQHAGTRPISPLGAQVFTRRSATRICSPYKLDKTALAVLAGPTRVVRNHLPRKRKKPSARVLAPRFHMRHIKFLASASDGFSCRWPAPRWWNQHGVETRHGELPVNTVGPPPAAPAHGVPPESPCNSLGARHTHRRKPPTRWEAPPDPRPDHELRCGNPRPLGLTKAAISTRAPRATQTGRQDPLHIVVERVGRRQGTRKTPKAGGLVGQPGSPVSETPGPQQGNPLPQKT

SEQ ID NO: 970550 - protein, 132 aa, Homo sapiens
MPVREPTRLWAPIFSMRPRRVTPVLTAGLFGDAPRVCVSAPGSTGLFFREKRFPMFSRAPLGQSPVPPEVHLAPSPDPLPAKSPRPSLLGKPLMKGHTLPRAHKEHGVDNENIAGPKEVKSQMVPQWGPMSQ

SEQ ID NO: 970551 - protein, 185 aa, Homo sapiens
ICVTPCLCRRYVPFQMRRVLSYKECCFQHRPPVSYKRRPWYNCPALLYRRVSCPYLVFARWATVLWAPPNQGVVFPQGRYRLGSGLFVRDSDGEPPRWGSRCEVSPPLGSAGRAGVIPCVHPHSGVPPPSQLTATHESRANPSPRAWASPQPASRGEIGGAQQKQRTHPGTNGQTPHTKVFPPRG

SEQ ID NO: 970552 - protein, 184 aa, Homo sapiens
MAFIEPPASLRKAKTDEQAQVCNRGAISVWDNVLAPPRKGCESSAAPRAPARKNDEGGTDTQDTTQEGGYYNYQGDPLCCVKICGMGQHPAPPRSGTNTLHALTPHCELVELCGVCPLTLHTHIYEGCFEERNTFIWVGTSIQQYCLSHANNMDCSTSQWCTAQQFLKKKEVGKKTKKIPTKNH

SEQ ID NO: 970553 - protein, 157 aa, Homo sapiens
MWFPRLSVVWDTTIGHSGGPAPSSPTRKERFRPPKRALIPRSSPYSRGSPLVPLNSCPTEAPDCPHLSFIRGRVRTGVSPHTLSEHARTKVPATAYIGKSPQAIADLTEVKHPIHFAQVHTYLCSRTPREYGEIHVDKSSDRHICWSQNRQILDKGT

SEQ ID NO: 970554 - protein, 214 aa, Homo sapiens
RFSGAPRGRGAAQGVRSLFPCCAGCPWYAKSCPRDVLGCGPRRNGPTVFPGNSWRSVPRFAIDVFPLRDGVLFSRRGNYPPGCVLRHDALGVCLPRETIAPCVWLTRPCTVLVHDNSDISLAHPVTGVVHHQSVHNVSDEGSPWCSPPDKYGVFPLRSPPAVPRASPDASHENHHVSLPRHHPRFSQMTPILSPPITIFRAIWGFHKITSPTYK

SEQ ID NO: 970555 - protein, 136 aa, Homo sapiens
VGHDEGEADVSSEPDVLSFCSRVVATQGSYTLLVQGGLNKGVGFLKRERWSHTGLKKAVSGPKQDSHRLGTKLPVFFRPLFLGKKHRPPFASVNAPREENIAGGQTSPETKTGTAVVPKAPQPPGFMKQHLSRDPS

SEQ ID NO: 970556 - protein, 93 aa, Homo sapiens
KSLHIWEAQEGGSHRGPEVQTRLANNGKPWSLLKYTHLPRVVVVGHPIILLLKEARWHGRELLETPGAEAAVTPKSYPFTPTNPPWVKKENLF

SEQ ID NO: 970557 - protein, 242 aa, Homo sapiens
LSQSAGVAASSWACLVVCCVVLSGRELVRAGGETRPRVGAAAVVFLSVLLEGLLPTLRVGVVTSWWGTRPSVCGANTVRGFLCRRAIARGFAPLARRCQIVSYFNRPWVGVVIPTPVRAVLEVGRGLVPPTGDLNPFGAEIPGIIPLGVEQIYVGSKNKSAMCWYRGYVRCALTRYGFCPLLQSTAHSAPYVRSPRAPPSEGRAPRLDSGFWPPSAYLGHLANTSRFVSPPLVAGLLRTSDT

SEQ ID NO: 970558 - protein, 95 aa, Homo sapiens
MPHCYLAEVIRGKTSIGAGDGGTHLGERRLTDLRSGDTRREAEQNIGERYDRKRIRGIIAGELEELNTTALLARIKQIDNISTRNWPKKKPNQKQ

SEQ ID NO: 970559 - protein, 67 aa, Homo sapiens
LLRSGHRFLRESRRKNLPFGGIDNVFPRRGYTWVACTPANKQGTPVSPLANGVFIMVPGFRFPQAAN

SEQ ID NO: 970560 - protein, 114 aa, Homo sapiens
GVFGPRGGYFLEHRVVKGFFSAHANRGFFPPPGKQSFPPPLFVGERTCLSARGRRLRAGSSLELVFPLWEELHTVGGATTLPSDGEKVRPLPRLGPCSQLSSLLLRSPSPPIRG

SEQ ID NO: 970561 - protein, 244 aa, Homo sapiens
MCVLWWLCILSRVGCFVCGCVCFVVALIVCFSVCSPRVVCAVADVCVVSFVWVGMVLVVSRQFPGTPFGERRFPRLAVYPLPQLCIALPNGSSVSPHPSVRGAGSSLCRRYRSPKFWFSKPFITKVFTVRVPDKISPDFFPPFPPGANPLLNQSSKYLGEKLLFVKQPPYPPPTPLSSNLGFPQIEILICLTCNNFSPTEPCFIPPSKFTGSPQRATLLLDTKDKTPVRRRVYITLNNPIIGRL

SEQ ID NO: 970562 - protein, 277 aa, Homo sapiens
WGAGVRGGGGGATGRGAIEGSPKGVDPSGSGVPAWSERRVAVVPYRRPFCVAGFPAIGFFHRAKGPGVYRSRWCPPIIWCIPLWNPLLNCQHQHKLVVPETRFFIRPENSSIKDGWEETHLRALLVEFPASVGNTRFPGRAPVHKSGQGCRTSAPPIGALQGPRVVGLLVSPRLLVSVWPPTPQFREGPCDSSFPRGAASVLSRIPRASLLHPGKKLPSRRLVTVAVHPAVKVHALVGGLVRPDGTISRGPGELSRPPFSGHSGKSAAIAAYTKIIS

SEQ ID NO: 970563 - protein, 295 aa, Homo sapiens
RRGHGGTGWRRCVSVQCGVCVSTRGAGCRGGVPCQRPSRAADFAALAVGGAVLGIGGAATLVAPPTRYAALECRVRLVSGFSSAPFSRISPCADHRVRAGAQIVSLGVTTRGGFLVRANYLAAESQSGVFFNPFPGYWGSFLPSRRPPATGVPAVHNCAVISARVAHPKLRLVGIAVLPPPHTFCAAEHSFARAASMGGFLEHLLAPSVRTPNKLLPQSFPRTVCASPLDVSPPYSHGLTRSSHYSRRRRSPPREVSTLLLAVDPQVNGFAYSLGRLFASHSPWVLQKRPPRPPK

SEQ ID NO: 970564 - protein, 44 aa, Homo sapiens
MRSVPFLGVSVDCCTSRDPWCLPPIMERSLASPLPPSPPQAKIT

SEQ ID NO: 970565 - protein, 102 aa, Homo sapiens
MLLAQSPFGSLSHNSPLARENNTVSSPPQPHVSRLIPCECPPARFLGGHSLGVAGRPPTGKHLLSSSRTDPIYIFGVHPYNFQICPHYRIKHTFSFASLEIP

SEQ ID NO: 970566 - protein, 134 aa, Homo sapiens
ARRILFNPGKTSVPPIVCLGHPRVTLGDIGCDGVHTTAGVATSPVLSPPPCGIEQLLPTVVRIDLMDVPPPRKGYQTRKQQFPGGSILHAPLCPRYTQPGVNTHGPSLSKTVGTPTPPKFFTTPFGSLKNDFPL

SEQ ID NO: 970567 - protein, 214 aa, Homo sapiens
LGPLLTRRGTPPTCAVLRGLLARALSSAPVWIAHRPCRPKEGPPGVSFPAPPLACPRWSPILKRSSGADPQKALYEPPGFVQTTSSGPRFPFRAAPLALSGQPPRIHAKRPWWPPGVPAECSGVQHNVKRVWRILLDLRPPIYSVSQLRDTHSSSLPRTPTPLLGDRVSPPCGLLRGLHHPYCRAGPPTDTRMRMAAHHWGTLCRFKKITPPTK

SEQ ID NO: 970568 - protein, 254 aa, Homo sapiens
MALGCEVHWTLPSGTAERCNHPNGFFPPCRCRFWGELRKLCEPIQVSRCPARTIPGVFASFAGDNYVLVMANHPLGGGGKKHNFGQTHTTTGEKLVGTPLKGGKFGGPNYSPPTGGGGPNLANTRHHKGGIGVVPPPAPMVFAAAARQEFYMRAQQMLFADEWRRSPESLSRTLLSSPKLCNSPPIPMAAPEHSNLHPPHRTTCFYATKAPRWFWAQKLDAPSILLAYMCLQPFYLLFSPFHWKLKTNPPPKGF

SEQ ID NO: 970569 - protein, 123 aa, Homo sapiens
MRYIVESQTVHNFQGDPPMSFHGYFQYSVYNPTVPTKSPPPICVAYTLPRPLSIHPPCSAPPVVQFPASVPNTCSHVSTPTSTQHFSQNPKRLATAPINCICKKIIPNKVRHWSSTTPYTNAC

SEQ ID NO: 970570 - protein, 88 aa, Homo sapiens
SFPWMRATRDRGENEREEGATTHCRIRVDSLHESLHSVFTLLDSPLDYSLVQEYQSETLSYHVGTHTLARTQEILRGSLPTPPMSTLW

SEQ ID NO: 970571 - protein, 139 aa, Homo sapiens
MLEFFHFGFPCRSLLSSRRKSRSDPPNPPFSNCWLLRLPDCFPLWVLCPGFLPPDPRSGAHDEARLGDHTKDPNFRYTPCVGLSPPGGCAAPNFSRGPLGGPDHGVEYGKNPWGSLQKLCQCSGNPGKSFRCPVNLVGY

SEQ ID NO: 970572 - protein, 212 aa, Homo sapiens
RASSCHPAVLCLEGTFRVFYMWAASQTSGVGRRNLGARPSVGPLRRYAGGATTRRASSVKRVHHPARSSFGWSGEPALFPLGSAVYQDRSLGASTTPPPVAPNHRWVTPTPVAIDDTALALISHPPALLWSGASPRDIPPGSFGVGAIGALGESLPACTPGVARRGVSLPGPAKICIRARTVVLPPPLWAKPAGGFSHSLSRSRNNGDMSVF

SEQ ID NO: 970573 - protein, 287 aa, Homo sapiens
AHLFGGSPSYMENFSPGRPDTSVANCVSLQLLPEDVTTLIGDKIPVLPGDCETLACWVKRAEFVFRSPPCHEAVISHLLSCTSPPQQVLLVDTLVSHIPHLCGIIVRRDNWYTPPLPLVRLVSPSYSLMVVPPRSLTLPPWCEHRKSPPFLFSNKNKIIKKTTAPFLSTKRNEMTPPSSSLVQDTHKVSISINSTLSTTTRRPSVFCAQGRLKLGSESRMSRVVSQAVFSQAAPRLFLRTVFISGAPRNTSGAPGAPWRNIPRRDSPPPSGAPHGRSALAPCVSRRA

SEQ ID NO: 970574 - protein, 70 aa, Homo sapiens
LTPPEIYYPRILSYPSDESTLLVTHTHFSPLTYAINSVPLSPIKSPNFPRNIKCPRHHIADYNQNWRSSF

SEQ ID NO: 970575 - protein, 192 aa, Homo sapiens
MPWFLMAPVSRLVRPVGPCVCRGNDSAYAGAPPVVGDIASDAGIVRPSAVSMRPLSPVPRITWTSHLFRLIKVAYQGGARPLGLSPMCSPPWWGVSWACQPPGPSRLYHAAFLAPIPPEIPWFTPHDDAHIAAVGSSSRSRTSGAAGLPREGRVPSSAPSLDTDVGGPRDVPLIAGLRPPSFPPRAPTAPHH

SEQ ID NO: 970576 - protein, 89 aa, Homo sapiens
MSCRAPGGSMPPRWPTHKLGGTLFFATTHLYYYRVSPCAGPPSFINPYMGRLSWEANSCDVGQRRRVSEPPCCGPPPFPRGPKQFAPMT

SEQ ID NO: 970577 - protein, 128 aa, Homo sapiens
MCRVNPPFSGGLSDQAGHRWTTVVPTHYMSGGPPPYYHHEVSTLCEKIKPLWPSPAPRRIIEMGGVNITTGVGAKKNRGAMGGVTKEKYILDVLSVSDRESGVQEDQLGRPSDALSTYCLVAAPQTHG

SEQ ID NO: 970578 - protein, 73 aa, Homo sapiens
MFTTHTKTHFHNNDINSPPRPPPPLIFSIFKRHLMREPRSLPPLPPPRKQVSPIHKDYSDNEQTPGTPNKCPD

SEQ ID NO: 970579 - protein, 33 aa, Homo sapiens
MKTNGRLWGPNNEVSPREEVPRAPPVPPKKPPK

SEQ ID NO: 970580 - protein, 108 aa, Homo sapiens
MERTMRDRPPTATHPAPPPHTDRTSEIDFVTAAVLSVYNSPPTLTHTCFVHCIKNKYNTLIHSALISVCFAQNTSMTDRSHDPFDHPLSSPLINHHISEQVRSPSIVQ

SEQ ID NO: 970581 - protein, 36 aa, Homo sapiens
MPVGDTGPSSSSLCFVPAPANDIESSPPNTTTPDIY

SEQ ID NO: 970582 - protein, 287 aa, Homo sapiens
CADMFRPVQIGGACPFLKHTAWGCRPRPLGGEEAPAHEVGSTKNHHPGSDKMSTGAILDTLVRSAPPGGDTNATITLLRVAAATNYKWDFFLSSTYKSVGNPLLVAPPSMAQSLAHASTRMSHRHLGPLICAHTIISVKDPPNICSSSRFTTKQSLLLDRRNCFGSRLSPCCKRGVTKSPPLILSCRVMRNKPPATLCGLAQRSHDRVHRRTTLLQDTSLEPPTLARGPPPRTQNEGAAAREAYNNHHHATLGARDGNDHARAQVVSPAPTIRGLKQTEKNKHKKQR

SEQ ID NO: 970583 - protein, 50 aa, Homo sapiens
MPHFNTPTLHHISLRPFHKICRSPLFRSSQFQRSTHPFGQRTKTQGLNHK

SEQ ID NO: 970584 - protein, 85 aa, Homo sapiens
ASVQCSALSGSGSPELECVHMGEALIFGGPFIRGKLCCAVDPAVWGGSRHALPVLPPKLGGTITKILSACSPFAANPFVTLVQHR

SEQ ID NO: 970585 - protein, 218 aa, Homo sapiens
MAVVLCPSASPGGPPGVVGGPNFGGAHTKGSAHGAQVAPPQRGMFGHSNVRPVFLVNPSRKGFAPLCPHIGACAVRRLLPRRCAAFFSPSSPTPSVNKLSPENNHRNVGILLQHIITPPCPNHFNHNHRGMASPIKGNTFLRDTPFFSKIIFSHSGEPRYHHLLCQKVRKYRKHLSWRSIALHRPHNFCFKCRLIAQESVIYHRGNCHTDFIVPSVIR

SEQ ID NO: 970586 - protein, 132 aa, Homo sapiens
MPIIYISINKNMKHSIIIPLRQEPEYTIWAPPPPMEPQFLHHKLSSPPNPDSPSPRGKLFKNNRAERDPQRRLAQPHRIPLRGTKNYPPISHYIKAPPLLVPARDFPPEGCPSLSTPNGLTNTDGGFFKGFA

SEQ ID NO: 970587 - protein, 169 aa, Homo sapiens
VGGGGVCSGRCCLRGSTRDRALPLPPLFLRPLWASVLASWRLIFGDRLANLVARTFSTCSLAAGSGDILPRVCVSLSAPRGNRVFHTRARTAAGFNAPPARFSNVFCPPGGVTHSYPAPPSLGRQLAGWHGLFRQQLSARRILVVRRTAHGLCYSRVCGALPHSLAPGT

SEQ ID NO: 970588 - protein, 107 aa, Homo sapiens
MFPREPTLAPQRACCTTPGFLHNPPPLIIHFSYNWRVFKPPPRALLKSAFHSTPLPCPHKIGFTTNLCANLMFQLPRFSASTSDDHLFRRPSLSTNTLIGFSLLVAT

SEQ ID NO: 970589 - protein, 120 aa, Homo sapiens
LSGLIGARLLPQGPCALMGVYTLPRLFCQLGARPTPGNLFSRDSPGVPPPPPCSFRAVCRTFFPVSGSPPCTRFETPTGAYTRPQGPPIELPLFLGPKWRLIFLLGQQSPPGYTISVAHD

SEQ ID NO: 970590 - protein, 137 aa, Homo sapiens
VNHCVPLPCSSGCCPPPYNWGAHCSLRRLRIPRGLVVFDLPNRAQISPPPLSMAGPKLQVFEDTVNDPGPFSPPTSGILGPPLRMEHTLPLLYEDAVRVNPHISWESAPLPLFIGPLFKRRSSPWSIIPPLRTTPLL

SEQ ID NO: 970591 - protein, 155 aa, Homo sapiens
FVLRCVVVPCVGRGADGCWWRRACVIPVCVVIVRRGCAVCCSLWLVRLCVCVVPCGRKVVWCGPPFFAVRRSGGPVAPRRFPLPPVLFFTPHRGFFPLLCWPGPQNFFGGTRPPKLFGVGGHTLYQGFPVPGPRANSPREFRPIICAGGAPSSVA

SEQ ID NO: 970592 - protein, 113 aa, Homo sapiens
AFLPLGGPTNGVPWTTRCLVAPPIFRKPLSISPMGDPRPPLAVPGAPRPRVQIVLGRWLDPVCFGALMSTPPLVSSRPDSGMFLRPLSPRGFTRVQLCTLVRNSPPPCRLVGG

SEQ ID NO: 970593 - protein, 146 aa, Homo sapiens
TVFLSPRAVVHCKGGPPVSTRGPLWGVLTSGTTLFCRAIVPHEGFRVLARNKVPPEDQSSVSHLPCHVGPLICVTQRTCQANDLCGATPITGDPIPFCGCSTKTFCRIVRRFIPPAVAVLVSFSSKALPAGRFLRHFLRRAGGHTG

SEQ ID NO: 970594 - protein, 144 aa, Homo sapiens
MGPLINWPSLHSIPGPSYSRPLPFLCTLAPLFFSRIPQEVASPPPLGELLRISPLWCKRTLEALWPPTTLGSEIMFSCPPGAVSLKLPKSHPPPMFFGNSLDIASSGLKKNNMCYSIKNPTCNSQFYDKSLESLSSSCKNATLI

SEQ ID NO: 970595 - protein, 204 aa, Homo sapiens
MWSPRLARFTFNRVAAPASFFHRAPPPLPIYTGGPTPPLPHLGEHPFLPRKLGNFSTGQPHWFWAPHPYFHITIYNRLNPPVPLSTVPLSYHYHYSYCLTHRKYLSNSTPRSRFFSIAPRPPLVFLSTVVVTHDCPRSLENTSSPHMSNTISRRLPQSCRELSQCLLISSLLSTGHRQVHTPLYPTPLGAANSRVTSHQSPGEQ

SEQ ID NO: 970596 - protein, 175 aa, Homo sapiens
PRGVCGASQGVAHKHVVASHTCISLVDRVCPNLERKFGVHFSPGASCPPRPRLSPWGGPVAEFIQTSGILTCIRELLPTGSLFLDATPHPAVSVMFASHVPAQYVSPNTGYSTTSPHATIAHLACVAPFLRARLASHRIACRARHAKLILALHLVDAAWLPTHEVFLAQDSLSPF

SEQ ID NO: 970597 - protein, 229 aa, Homo sapiens
HGGAVGTKRCVTFLVRGITFGWDNPAGFGSALPPFLTKWMGCTKAPAALVLAGNRDVARNTSPFVAAVPCGRCTHPQVCAPAPQFLSLEEIVAGPLRTYIAEAAFAPHGVSLYKQVRFLFPGRQLFLFIPPLFRTPQKICSFCYSLPHKGDIYVPHEKGEFSSTQLCSLSIQACDRSDDPPPRRLPLTNTQVFLPLIDNNSSQVPTDPRPNHFLPFISKARYFTITPSL

SEQ ID NO: 970598 - protein, 159 aa, Homo sapiens
QLRCDVVSLLPPLCGFSPEDFVKTPVIRCSAQTPGVPPLWRWTGVFPPRCLSPWGVEGSYGPLPREPTLGFIPFALSRAPNQGRRVARRHLFPCYSPSRRVVPCLFLPRVIKGYYLRHRVKKAVTKSFLVEQGLLPPIVLVIPPRGGVPPVSGRPQEIG

SEQ ID NO: 970599 - protein, 257 aa, Homo sapiens
MCSVAGPEYSPVLPYLSGLIFRVSMPHSSPFAGPQPSVVNRSLAPRLASSTRGRNKGAFPPPSGDHFSSGGPPPHEAPLLWSPSLESVPLLPCPAPPWADHLCIPDGFVTASQAPIFVGATNPWGLPRCCSSGGKPPRARLLSPLGDRPGVAPRGSRAPSPLVPRVGTHITGTTSSITSAPWGPGRVGHLFSRPFFHLPSPLPRPPPVMIAPQSAPPPFLPAVEEPSCVSPGALFFFRPSRRRVRLCARKGAPTPTK

SEQ ID NO: 970600 - protein, 86 aa, Homo sapiens
MSCNHNIKQILQKPLATPPYNGHATNHVGHPDSCPPNQIHRVIFLSAPLPATSVLCLQLFEQQVEFHSSPHTGFFKSFRPIKTEQN

SEQ ID NO: 970601 - protein, 180 aa, Homo sapiens
MSVAPLKSPCVRGISGAAITFSVMRNTPYYREFFPRLCRVPGQKSPRDFLAPFLRPAADYQCSGVYTWLSLHNLVNSVEPRTFSKEGELLFPKGGVNTKEDSLYLEKYFLCETLRDDTKSSTSPRRTTVREHQFSNPEIPPIGDHNPCGVTSLLYKGIRCHRKGTKKFVFGGNNKGKPKK

SEQ ID NO: 970602 - protein, 114 aa, Homo sapiens
RPPLVWPPTLSPAGCPPPPPFFLPPGFWSSTFSATPFWLPVSFTQGGYVKLLGIVGKSACVSVKFAAGDHQCKCSLLGQSGILHGQSISCGVVNPGAWLYHSHRSNTFSTVPPS

SEQ ID NO: 970603 - protein, 66 aa, Homo sapiens
MDKQTNKYRGEDLSTSNQTMVAGGIVVAQPQKTPGHLFGQGHKARWEQRMLGPPPPPSTPIPRPTR

SEQ ID NO: 970604 - protein, 273 aa, Homo sapiens
RKPKFGAPIVLVIGLPCVPPCVLRPVFACLGPPRATLVNCVLPSQAVLRTHPVYVATKTGGPHWVGSHATGTKRNLWAFVPTRATTNAGCLGAAKKVAAYIVCRAHPPDKGTTCVYCSTRSTRVTSLSGPSLQPLLKRSILLGTCRGVEGGPHHGVVSSEKMLRRPLVINLFKCCSPLDVEPTKDHLFCLAACQTQQPRFLDLLYCHYGISRQKAARSTKQVIYVIPLQQLAESRSRLCKKILAGKSSAPRSSHTRPGKWGPPDAKSGNKKQN

SEQ ID NO: 970605 - protein, 149 aa, Homo sapiens
MSLSPPGMSSPRRFSLASCHCQESPLSASLTLTRLLPTTKRGPLFYGQGDILLGPPPRALCLIAVMPTAWLSLTKVSCVLEPPPPPMPGSGTLEGGNIVAYPHCALRADYWCWSLQAVLTTDAHREEHSLYPRIDSTKKGLIEHPSVPP

SEQ ID NO: 970606 - protein, 229 aa, Homo sapiens
MSSSASIMQVCHACGLMYSYQWFDACPRSSVGIHVRVMSALDYLDACRGAALYPDGRPVIFVPIAAGTRSSFPPQMTLAPRVLSLGGPSPPADSWAGQGSPEVSVSPRGSPLVSTAVLAVSSCMRCQRPRRLVFQDGGTARPGHTKADRSYPPDGALIYHNRLGVCGWHTPPQRSSSSLPSSPRVPCVGEGGGAPPLPPPPGRTTAPAPPRKTQKRTDTTQKTKKTNKH

SEQ ID NO: 970607 - protein, 78 aa, Homo sapiens
PDALGPHNGGVDYLPPPGQYTHREGAFHPHTAERDTSPPRGGEHTRPPGCQTSESDEARDITQQRKAPPRRSVSPPVV

SEQ ID NO: 970608 - protein, 294 aa, Homo sapiens
LWVYDVFPPSWFLSPQYMPSVILCCKVGLYCAPPLFDIVSVGCTITQDEPPSVSGTPYAGCTDLPDLLAPPLQTSRRAPISLVDPLIMAPAPPLAAFTRRRLSDQPTIVALRKPVLSLSEWPRLSRFSFVVPPPGRASLRDCSGPEVFLRHVLSGVTRELSCSPSCFALVLPLVGGTNIMRRLLAAPQPPPCAVILAPPPCLLPVISVCLAAALPLTSLVALPNIRAALTAVSAPNISGPLLLIPICSYYVRLTAGRSTHRSRPDGAGDVQSTVEYTRPHNLLFFAYHLLRPSS

SEQ ID NO: 970609 - protein, 312 aa, Homo sapiens
GVRLGIARGSSWVGVWRCAGSVTCGFAAWVGHSFGVCEPLLSRVKCCCSASIVGGALAPGGLGFGLVASVPPEFLFSLVRKGAPVGRVSATRFLWVVCGSVGSLGVVVVLPFVLVAFHEGVFVHPDWVVLSLMVAPLVSGGHHLVSRHSCCLVPVAALNFRLRRRVDCLRVAEAGFSVGINWWVRPPSFVVEVCPGRADSPLLDSFWGAPFAPPAYTFFTPGPFGLTMLQFLALNALGYWGMDNRSAHPSHDGRGYTHERSKYDSSTSPHVQQLARGYAPLSSRTSRGSRARRPCTRSGRTTSDYRHYHEDH

SEQ ID NO: 970610 - protein, 114 aa, Homo sapiens
TGPRKGGGDFCTTMEVHPLQIVEGVSSLPWGPRTPTPVLCAPNMGSRRQEGVSCPPVTSRGDRCATTSRFWPIETEQPDRWSPQSFWARPHAPGGKAAPSGCEAHRDHQHGAHS

SEQ ID NO: 970611 - protein, 215 aa, Homo sapiens
LSLRGFVVGAVERVVSRPGDPARVSGGNAVWPPLLAGFNLRPRGFWYTRAPQLIGWLSSSPKFLDVLAGRPRDTPCAERDNRRATNIFLLVGACPFVYRDGFFRDRGRARTNHAAGFRPLFPPAGDIHPLVEPPRENRPVGSLLPIDSQDKQNNQLNSGVGGRGPLVNIPSISPQRSTAPRNHAANHVEARSSSPQSTMAPAFPPGPKRNFFSNN

SEQ ID NO: 970612 - protein, 206 aa, Homo sapiens
MALSSAVSESSGRLPAPCRGKGCFLLPPTVCITKLRLRRSIVCCAASQWDADISILVVYAMGRAHNHGWERFVIKEYHRWSENSLLVVRCRTPRYDAVTKRTALNPQCIGGSNHSVIFEKGVMRGPALVLSSYTRRHQERVQDVAIRRRKNSSAEVPSQILHSLGQDSTPIVCVSLVSVLLECLLQFGSDEKCVATLALKMCNSEG

SEQ ID NO: 970613 - protein, 67 aa, Homo sapiens
RKKPGEGTQHEVRGLPHRGKCGQPAPQGPQKIRSSAGVPSRWRSPQGGQKQRGEKIPPQDEHTKEHP

SEQ ID NO: 970614 - protein, 122 aa, Homo sapiens
MTRAARDNALRSPGGGEYSGGETTVVDFRAETTPLGEEEKFSLRRPNTPRRNSQRAVDQRRAHFNPAPKYVPAGLSRELSNNARHNRRPPRYTTLLEKFLRPLIPGRTPRQHHLAPHGELHK

SEQ ID NO: 970615 - protein, 238 aa, Homo sapiens
LDHPQMGSAAVFGGLGVMYIARSSGLAFARPSRTRGPLALRCRPIGPYGRLLLRRVKDPPFYPAVAPDHVRRAVAPPPLEPGSRFAMIEERFFSRPPAMARPVALGLPDGGTPAECSQNTGTKFRAPPRVLCADALTRAQQHSTELGKGRGERSRIEMKGLQEEGTELEPDPHTIRGELSQRAVHTHSVNNKVTGRELAAQENRKSGSRPAEGGPTRRARPEQRQASTRDTDFRGEQQ

SEQ ID NO: 970616 - protein, 258 aa, Homo sapiens
RSDTRGEENVKTQTGGDPPVCSSRNRAQWKKKCREPRSCPQVRRPRPCLKRDAQNLTGSAVKKANAIFRRVFQRVTSKKVGMAGTGASPPRWRAASKVRSQAASERSPSGIILKQRPPKKISFLAWGISPIKRGLLFVRSPGISAMLGVSTTEETVPANVRENLIPPLLKRFAYHIVLPHVRSGMSAKRTTAPGSNRGKPTSIEEFYHKGCLHPRFKQVYMPGGTLSYKTLFNNIPPPKPFMDLSNGHNALVTHTAPE

SEQ ID NO: 970617 - protein, 295 aa, Homo sapiens
LSTSSDQIDKEERVNQAPKPARLLIGSQIGREELLDSLVQVSKIKGPKEQPGPITQTICRTWLSPCVNLGPCGRTIKTPTRCSCVAEHRLCGPPGGNPPVTSGAVNSRGDKTNWGGTAEAREATADSTRRQERGMLILRKKIRAPAPPKVAQRKESDRRLFVWKQQEGPAPNKARSLLGGGKMEKRVIPLSRPVAPLSGRIKKVRSPRTHPLCEILRPRILVRPYRHKTEQLSFCSLLLKQALNRQFFCTRQQNNALFQKGALQKYSLGSANASLMRGNPGCPPYVSRRNHNNQN

SEQ ID NO: 970618 - protein, 109 aa, Homo sapiens
MGIFIELGPPRQGDKTPTILGEIMFPKARKMFEGISCRFSQTFAVLFLSNKWGNKVQTQPIGCLGQERHHTTAKHAGRWRAHISTSQSLKVAPDEMLTASICAGQDHIS

SEQ ID NO: 970619 - protein, 121 aa, Homo sapiens
PLIFITNKLSAQLPPNVALPLCYRDLYLRIYLRRYPWAPLFRKNLLYSPLLLGLPQPCVSTLFTRETEPFSKPSPTKRHPRHNPPHISLSWPMPRGKKKMVMLPRNNLFRGRIPQGPPPTQ

SEQ ID NO: 970620 - protein, 207 aa, Homo sapiens
GYVNNNITQSPEDPFIFGEHPRCHYVPVGARIPIRVYSKVSFERRPAGGADTPLRAWKFICYKRVSDVTNWIIPRPEGPPLVFLQEECFLPPPPNRDLSSLDRQSNICVKLELFALLPMVLRNCEDNSGEYRQNRRSSSGGTEPGRSPTKGLYITFPPPGKMNASVINDPERCSLSGSQRNCYSLVWPLPPGKYHKRDIDHTRVGRE

SEQ ID NO: 970621 - protein, 179 aa, Homo sapiens
EKLHTKWHVHSDCAKDYDIEMLNGGLAQHTREHDRRVLRLTPAHPTTLVRAAGRLVKTRGPSRPIHVYLPGAKGFSQDASTTGLRIHADNHTPGNWPIFINRVNGGPGKSPQHVGARDEHHGLRNSMPYYPVFVGRAEKGSASSGGFLIKGAITMEKLESFSNLSIDTSSSCIKSNLQF

SEQ ID NO: 970622 - protein, 75 aa, Homo sapiens
ASKDKVRTDRQTVSVENHVGSMQAPLMSPEDGLPQGDFSARRQRQARVRPDEHTGRAPPPQLGWKPLGAHTLGKN

SEQ ID NO: 970623 - protein, 165 aa, Homo sapiens
MDKRETRNDRINRPVQLAATCRACGGSNTATRVKHEVNTQTVESLVLSREYGINQVVYLAKRNVTSYISRKQCRGRSKCIKRRKVNNETQWAEPEGSTQQSIYVRSRQYTSARERWSHAQVNGAASSERSRWVDYSSPQSSRPTLAHTGETAVSDHRKSTCALVT

SEQ ID NO: 970624 - protein, 238 aa, Homo sapiens
LPEEIQSLKQEATRRRSVVTCDERPLGRVNTCGGSGRHRRGRPPQGGYLSGKKMLVPETRLRADRGGAQHPAQTGAHVGPPQAGSIRDARQVVSAAARARGPLCPGPQKGRPEESSPGVGKKSWFKQGGCTRAAAQACARPKKKHWPKIFPNRDTKKESCQRTSEGTTLVGEKATNSWGNLQEDTTTQLERFVFIDRPRVSPVGFDDQDTMLFVGLYSTRRMNAHDTSVSERSYGADQ

SEQ ID NO: 970625 - protein, 124 aa, Homo sapiens
MGPAPRTRGGPCGDPPRRWEEGRPLRGQSAGQIVRKRLAHMWRVRPTGLPPKICCLNYVGPKTLINGAPMNCRKEVAAHSWARCNGAARQQRKFVWETVHKPWTHWSAMLLAKQQKAPMLVLEN

SEQ ID NO: 970626 - protein, 217 aa, Homo sapiens
VICVSPPFWARYFCALRSDGGPRSSLARGTRPLSFVGCHPLYAGGYSRCPVPASISPRVFSPLIPPPVGSPLPITRARFSPYERPPTKLGNTSPPEISTGWLVAHYTSPTIGPLQFLLGDKYKMPRLLVALNRPLPVGVYSHHINCTRAVCENSRRAVCCSTSKRWSHEPVERFSKDLCCIVLSTPGAARWAAEYGKNVASRKSVFVLAMTPQGSLF

SEQ ID NO: 970627 - protein, 83 aa, Homo sapiens
LNTRIWFNNFRGHFSTFFTEARLKETPRGTPLGSHNPGRVKTTTLSPTFYFQNVYLQIYSAKRSIALETPILCLSFLTTPNLG

SEQ ID NO: 970628 - protein, 111 aa, Homo sapiens
MFAPYCVVGPQPAHCACACCCCRAQVWAGGGLLPRCVEVHRGWSAARSSTISRSAQPEFADNNGGNEILLQLAIVCKAQLRPVTENVSQGGIVCRPSQVEQEIGAPTTRRL

SEQ ID NO: 970629 - protein, 81 aa, Homo sapiens
PRPLYPEGRIFVLRRVCPLFRKYSCWLTEWPVCRNGQTLILLLLKGLSPPGVYTKIPLVDTPGGCRHRTDQPSVYEKLPHN

SEQ ID NO: 970630 - protein, 216 aa, Homo sapiens
AVPFFVGGVCSVFAGPPDTKCRRGFSAPYSGARGCTTTPSCVTRTGLISVASSPAPLCLAPCLLLSPAPRLIGIARLYCVSSSPHCFLWVKSPPRMIPVCTSPVPHPCWAPRLLSPRLMDRNHLMGLQNDISLWTPLCSLSPRNHSPRGLSKFSKTTLRDSVHTIYHVTPPNCIEQSRSPPRFLFYLPTLSLSCHQLPSSLSIALLKRKVFKNNVI

SEQ ID NO: 970631 - protein, 58 aa, Homo sapiens
MVRLSSSERMLQLTHVAVYVLRAATPRTEPRLQPMFMRCRWNPDRQNIQYNIPYPPLS

SEQ ID NO: 970632 - protein, 118 aa, Homo sapiens
MSRYLREPLAAPLSWGASSAHASAHQFSGPPCFPRVVRRVDTQVVVRTGSVDTKHFPAGQRAVWTGTLGDSCVTDVETHPGDPHPSGGRLTKGSVRSPWRVRGSRHPPSGQNRPPFRK

SEQ ID NO: 970633 - protein, 190 aa, Homo sapiens
MSSAHSSCGVFHERQAAMFPRFCASRLCQVYPFMSCRGHGLHSKAYCVSCHACFTVLGRNAHVYPTPVPRAPLYTCTCVLRPRAYVCRASCISCTTDARPHGGPPARWAVCSCAVNEYELPAPQFSFISPLATNGAAVCRGPGVDTTHSLCLRYSPPPPVRAAFVSMTILIERHLFDFRVFKSTPLPPTK

SEQ ID NO: 970634 - protein, 124 aa, Homo sapiens
SYLLLAWPFLGDLMLSRLRHHFPSVFAYNGYYTIRWAQYKNLSYPSATARLFITNIGGKSQPSGFVRPWIPTGVALYPWRLAYYGQQQKWSRATCIADRRLPMVRLIVSLRMLATRATYSGLPQ

SEQ ID NO: 970635 - protein, 139 aa, Homo sapiens
MCCSPGLFVTWVADPSPQIAHSALGVHHSHASGGRLSCVFDAPPWYARGRGYGPTHLRHPGVGAAQCRYTGRPHSGSRIGSADRPRPTFRDVNHARSAYVVRVPPRSRKNGLPDVPLARLFFDRNRAPCFPPLAPGPQT

SEQ ID NO: 970636 - protein, 104 aa, Homo sapiens
MVLPGLGEQLRLGAKNLVRRRRSQCARIAMQHCRKRGRCARVAFELNHCLLRLVTEQIRCWRRCVSRLVHRDRESTECTTTVGQWGDAIIEHCGADDRFESSGE

SEQ ID NO: 970637 - protein, 291 aa, Homo sapiens
PDPPRVTAVLRPESGFRPPHNDRAVPQPHPSCGAALQPGDAVEPLYSGRAQCHTPIFVRPSRWYGSLSTRPQASRTVLRSPPSTKRSSANIPAGTYIFGPRYCFSHRRDSAALCRTTMIAAHSWNGESPPLAAFRPRHRDTFLARADPPLGSPPPLAAGMKTPCRRRTSVPRNILEIVIPPLQGVHHLASTKPLRKTTSDSLWPCIHFSAIELLLPPPGLPSVARFFKPPQIPTPQQFMRGTPTYHLFPNMCVGFPIIIPITVPTPHPRHHVITTLSSPPSIMKFFPPHMT

SEQ ID NO: 970638 - protein, 54 aa, Homo sapiens
MFGRVGGDHTWSPPRVSAPLLFAPAAGSAAAVPPVLDGLLAVCLRKKATRTNIT

SEQ ID NO: 970639 - protein, 139 aa, Homo sapiens
MWSWRPALGSVLRTTAGGFSRVSTQEPPPPYRVFHMGAPLIMARMARTVVVSPCEARLLGPPCARISAFFYGVLHRRPSPFATPLSPTPPSSLVPLQRPSLSRPPLHASTFSPSLLERHHPKGPLQLNKRAPSPFILLQ

SEQ ID NO: 970640 - protein, 103 aa, Homo sapiens
CLLSSSRIRRGPPLCPRVFPICVLPRTATTLCDCPILYEALDVPCRPTCRDSPISGAPLRGLVPSPRGVLKLRKPSCGSPTGLPTSPVVGLESIRRIPRPGPH

SEQ ID NO: 970641 - protein, 133 aa, Homo sapiens
NVHLIGVLGGSNKAEPGQKKKKKKKKILSGPPSGPRKRFLKPFCVGGGGPGEGTGASVVPREHRAPGIHWVRGGSPTKKKKPPRGAAHAGRCCETNSQRGASGGATRRGRLLTQGRCPRGAPDTQNYPAAARG

SEQ ID NO: 970642 - protein, 50 aa, Homo sapiens
MKGSREAMPSCIKNYRGANNETRPGPKTKRAVTRGPNGGSTNTGCPGDAI

SEQ ID NO: 970643 - protein, 240 aa, Homo sapiens
MHFLLLRRLEPTRVLSPRRAAPPIEPRGIQDPPALAHPRNRAPGARSVFCLAVACKQQPGGVTQQTDLVGGLYNIHPTCRIDTNTKRLSFLFVGKGFITDRAHSWWAPPLGDGRNPPLSQGGFFPKSTRLFCPPMTICCLDTAPLLLSGRVLEEIATHRWMAPPRVFALGAHNTPVEIPQYLGGGWGHGGPIVNTRGLSPKGYQLCEHCGVYRRLPLTLRLSGLDIREREIPLSFNRTRK

SEQ ID NO: 970644 - protein, 134 aa, Homo sapiens
MRSASRATNLTPVWKQKQTRWGPRPAALRSLQLLGPELGLIKERRTPPHKKLGAHDVAPTPTWGPAPGPGSSTQAGAAKDPAGQAQTRSTAIPKQRGRPRQQTCHSATAAQPRRQQRNTQQDTNTHTQRPHTTT

SEQ ID NO: 970645 - protein, 175 aa, Homo sapiens
MVPEKKHTPGSRTFCVFVSPQNNPPPRFTTFLYLDRQVFSGRLTGRQCHQGQRQGVLYARGGRDQTRFRVNLPGWASYRFKQGPSTKLKRARLRGDPKPGCQPPGQTHGSERCTLRNTHQMGHLLTKPNTKPPDNRRTEPFQSRATSTCCHTDPVSTSKTGFKNTHHKSTKTKIK

SEQ ID NO: 970646 - protein, 104 aa, Homo sapiens
MARGRESGTIRANMGEAPGLLKTAKSGPGWMAGTGGPSYREAEKENLNQAEIAELRSAITQAGEEQNFRLKNTTVRLWGLNVGSSLRILANVFVGPGFNFLSAT

SEQ ID NO: 970647 - protein, 154 aa, Homo sapiens
VGLQDATIPVSYKRLISLHDLAHHKHLPVSVSYSGVPVSERSSRREHRVRTNEASSTAHQEDRKNVSENGMRPDNESLLVSIIGPVPSRTSFLYRLRDRGSSIPSLTGANQMGIIVNVNLRVHRLRGLIFNSYILPPLFLEPGDLRLLDVDNSE

SEQ ID NO: 970648 - protein, 115 aa, Homo sapiens
MGLPWRNPGAMDNRGGGVPHQREKTRPGGPQDGVSWTKPQKGELERGSKTRAILHTARRVQSEQLRNYKNTRPGHGGRSKDTEVAAEQQQRPTARQHHRDEQQQHSTEHPSATQE

SEQ ID NO: 970649 - protein, 122 aa, Homo sapiens
RYKRFSQSHDNPLSGIFKASTPELIACEIDCYATPSYKQLRTVSLTLLSLLDVEIHLDADVLTINYSHESKNNLILASLQVFKILTLQAPYTPIYDFYSTMTNEATSFHSHKPMIINPRFTT

SEQ ID NO: 970650 - protein, 192 aa, Homo sapiens
MSSWDPGRPAGVPQAQSCEYHGAREESPRPREKPPPGAQHGRDVSTKRPKGELGDHKPQMRHKRRGRRGARKNEEFPPGGRGVITLEQPAAEKNKANHKKQKTEEGTETARKKTAQGDEKSSEAQSGVSEHDNKTTKLKITQNDTAAENRVLTERNKNQVTNHKNDPDQLTNNEPIRVRHIINAQASIRKRR

SEQ ID NO: 970651 - protein, 250 aa, Homo sapiens
MSLKTQSIITHRVNPLLQLSKKAFDTGIILFMDLRSRDFAGYSEAGDESRLSPYPPNEEGHLGPRGINTGKSPLEDNQFLQRSESVILAIKEYPSAALSCDHESDIENKRTQKFNATKFIPPRGGSLIYPPTSLKSTSKSPSHFRRESTVNIFEAQAPRTHVINGQFLNIWFIATSIHLHPTSRDRNARYWLVMGAIGATREPNKKTKKRGAADINAAGPRREGKNEGAQTRRHLGSHSPREEAGEPYDT

SEQ ID NO: 970652 - protein, 165 aa, Homo sapiens
MLQSPYLVTHEIQTSMYNQSPGMPTPTSELLAVRMEQAELRILLLQMGLSLVNGVSSPTLVILHLIDNISKTIQTPNSFKGNSPGRKPNRLTLLGGRRELMRDKVKAPPEATNQTMGLPSRLVISHNFKMRTGYPRGRCALSQASVATLEVSPGWRRAKKNRARE

SEQ ID NO: 970653 - protein, 183 aa, Homo sapiens
GFLNGGLPLPGWVMIFSPCWGAPLFWWDVWRSLGCPCGPSVICCLLVGSLSSCLQGRVGCRIDVSHSGPAPVPAVFFRLVPHVSLSHCGFSPSPASLFVVPVLQSLPHCAFSGPPEVGVAGGFSAGCAHPSCSNASSLVTPLVWVSPPLLAVCSPREAYSPRYGCSIFDPNVSSPARQFLHNF

SEQ ID NO: 970654 - protein, 270 aa, Homo sapiens
MRKSIVTDDTFAGAGARAKREPLRMSVDQGRETARETLKKMREPKLPGKGEDHNARADTEETTRRRDEREEINHTTPRGIKKKRTPRGGRQKTLVEGDVTISENTDMCRESREGEEHPPGGGRDQQTHGGRAVCSYQPPTTREESPKKRKRARREVHPKKIESRPPRGGCWRVVLTQNIRQKRQSRPRESRKKHARTDDDGSVWMDKARTTIHTKESGHPQEEEGRHTTKQGGQTLLNKPTRRTEARHRQSARTAHDNSQDDRRRPRGED

SEQ ID NO: 970655 - protein, 147 aa, Homo sapiens
MGLRWPLDRAFVYCQTLFFPRVVFSSLCGFLVAHNISPPGSHARRLSARGLYSALSFPCTARVRLPLWSPRGAKYRLSPADPSGQRGPPSDLHGCHPQPSSAPTPSWLTTRALSLPSSPVFTTLFISSRKLMLSPPPLVWTLLCCPL

SEQ ID NO: 970656 - protein, 181 aa, Homo sapiens
RSRKRFYPRILLQLLSLLEYCDLMHLPVLVTSPVCPFAERSGRRMNEYCAFLEEAHENHKNVPDDADGTINLCPLSASPVSAKSFLNDLRNERLDGSPSLTMRIQKGHSLGDGKPTKLHPELRGGTKSFSSVHYVPAIIPEIQGDLETFVGRLTTRVRYSRLEGPSGDELVASQHTVFAII

SEQ ID NO: 970657 - protein, 83 aa, Homo sapiens
MHRRQLTSSTHFSAIGCPSSRTTDVPKKSIIVALLSTGLYSDGGIVEEALKTPPGIGPPHERYQRAPADSVKKKPRSGRDRPN

SEQ ID NO: 970658 - protein, 260 aa, Homo sapiens
MAHACNSQRQLGVARQADHKFRTSKTSLANMVKPCLYYRLRPVELGVVVGTCYCSYLRRLGTWEAGGCSEPRSCHVYVQPGVTEAERLASKNILTEKTLRSPGYTEHGRGLRAKGTTGGPRNKPTGNTVYAGVTFLPVSGGTLAVATWVEGPRVTAGPARVARKQGPTWRGLQENHSHGRTTMVKAGLGQRPRHGQPNQPGGLPLGSINTYNKTEAAKCAQTVQMSREHAKVEERVTSATRNSKQRQTKTDRTKRGHETR

SEQ ID NO: 970659 - protein, 105 aa, Homo sapiens
MRGGGARGAPERSEDNTGPKARYPREKTGATGTKGAGIFSYPIITKAPRGGKPRRRSVKQTPKRGEVCEGGPNRGELYHKEGDPQRRERAKFQNKTPQPAGRKRQ

SEQ ID NO: 970660 - protein, 116 aa, Homo sapiens
MAAAEEQLSTPHGGGRARRPPEEKEHTGHRGTHKNRKIGAATKNRAAAEDLSTHTTKKHAPRAGSTSEAGVVNSKPPKRRNTNGEHNPRGEQYKRRQERHTRTSNTNNKKHKNPRR

SEQ ID NO: 970661 - protein, 158 aa, Homo sapiens
FSDIQLGRRCESFRQRSSRMADTIPECVHSSPYTSGATHQFVYRTDICGHTEFVPTFSVAKHTCRLVEPNGTQQRVLSVEPTTDAEQGCTAPAHMLFLNLAKNNNSNSGLGRSPKTTWGLSQTSLTVCVPDTPPARCRKCWENHHPRKGPRWVKQKPV

SEQ ID NO: 970662 - protein, 112 aa, Homo sapiens
MTLNHNTKCMARMIARAKLRLPIGHQNHHLFANKACETGESYILTSEVFLLRWDVSWSLYGHSIRSSPLPAQGTDGVVPYPQLALSNPVASPGRVKQESALSRDSRSNPCWA

SEQ ID NO: 970663 - protein, 143 aa, Homo sapiens
ADSLWISHSQGNRRSHTRHIVIRPGVKPCGASRRIPPAKQVAPPRPTVFGTRLPRMESTPLGVHRKPLKGSFPKCSHTYVPMRQKPLGVSGPHNARGWNSGKRCSTACGTTRKVGKLPALSFKRQRGPNTYDYGSPTVRDTLR

SEQ ID NO: 970664 - protein, 278 aa, Homo sapiens
LCFCWLLVVWDATGIRGSLLLVAHDYLVQLVPCPFVVTPPVGCTSYIARCCRLMSRAWMSWLGPPGILVETITLYIACREIPVFSLFCWRLVFTYYVAPGHARAGKPHLGVADMSPFCPEGLLFLSIMLLCYVDIAAARYPNMSPMPNNCVSPYGHRGRNPLWSNTTKKWRVLRKKTLNLTARCNACVRGDFATQARALAGKQRAGDRRLPSASYFGGMTAAVLLVSQRAAAALVTVFDQPLLAATAGQNPAPVNRYSVGVFQPVPMGPPPFRGPSPN

SEQ ID NO: 970665 - protein, 283 aa, Homo sapiens
CGDLLVCARVPLWGRIRAGASRVVRLRWDTLNSRWFRQRGSRLRGVHTRLVVHTFVVKVRVSRSLWPRSICGLVCCPHRWALLCTLPTGRVDVLLVFVVSGPEISCLLVMRQPPDQVVGVPPPFGVRIPLFRTPAGRFRPLSLLVYHLSWPPPGARELVCCLPHIRWRTMFSRLTQRTSPPPYLLGTQRGHLDISSVCMYTPLEGYVIPAVCDAPPLVIKQNGTRSPKAFVSTPHEDWLAPPHRGVSSTRLICLREAVCTPHYVFALGSHRRGGLTSPRRHRW

SEQ ID NO: 970666 - protein, 222 aa, Homo sapiens
LLKLIFAHAQYVLLLSAALSVLWFRCAVLRCLAAGPFVAPPRAVVPRLSEGGLTVLLPSATGLSFAHNRPFVACWPQPETMYALGCVFTAERSMHRRHNLYAVLLRPLRRGDFLIDVPVRIFLFRPGVLDRFYQGAVFAFLALCVGRYGPPQWVAPLGIPRQCSLIRRTHPLLTSLRHGDLKTPPRPPRIVSSTLSAVPPMMYQPPWERPNCLGGLLCAAPS

SEQ ID NO: 970667 - protein, 188 aa, Homo sapiens
MNQAVTPDGPRFFAPNGAITWYPVHKPRVLSKSMVPRLLTLPRYFWVGGPHIMLGRYTCDIVGHPNRDGVFEPSVTCSSSSCRMHVAPVCGPNTQWGHQLKNGLLGPLRDANTCVCSSCELHCPLDDIREDWMMLSFCHNSRSAINIRVRFCFRSPVSEVLLRAPRSGTASTHYMSPISAKKDQTYTV

SEQ ID NO: 970668 - protein, 97 aa, Homo sapiens
MELTPKRVARLIIALKCEHHTPLGKPGNTPALVIKQPKVYTGVSRGTTTRHAHDYSGKGEEGSESTRVKTHSEAEDVPRRLEPPPMWRHHHPRRSVS

SEQ ID NO: 970669 - protein, 101 aa, Homo sapiens
ATLCHNALVGRCDYLGVAYYSRSRNNTRSLSSISAFCLRGIITACPCYRPQDRFVFSRQELFLEPVAYNDRRCALPAPHYVAGAQCPHKRGLPPALDIPRS

SEQ ID NO: 970670 - protein, 172 aa, Homo sapiens
MLLPLEGLVSLATPPGLSPRPGHSGYSHILGGFYCSIATPFIHCGEALLPWNHQVFLPKAPMFFPAPPPCPHPRTSWAAPWGKKQNSEVPTEDATDVSPGSPISSHSHKLFSRVLSPTPPPRVWEHPSPPATEELKWAWGDTTDTQLKEGPKPRPGRLKIVDLGRLFYTMLS

SEQ ID NO: 970671 - protein, 179 aa, Homo sapiens
VSTRSVLDTHFLAAKFREIYNGFPPPFALPGHVMCPTPAKSAARQFALDTFLTPRLHRFFTKSPLSRLLTPSLSGGPPCRCPLGSGPVYRPHNAGSSPDVAPVFRRFNPVARSIAPGPWFSCPYCLAAVILLLVSQPRNLVGRYPPDSAPPRFLAAVPPDGAFTRPVEHIPLLPLGGRH

SEQ ID NO: 970672 - protein, 169 aa, Homo sapiens
LSKSKEMRKRTRRRSVSSRLVRSYAPCCWSPVVTPNSLVLNLSVSRIYVGPCQYWLLQHIALLANLHWLETLLFASWVTSDSQPVGRHQPRLVKFSIQRVLCILVSLRNFSLHRRVKRLLQAMFLPPSLPVSIFSGDELPRPCKLWRPPFPTAFFLGRHSPSEGSIKPG

SEQ ID NO: 970673 - protein, 289 aa, Homo sapiens
AVAPFGRVITARPQVVFFPRLLIWALCSPPLRSVQGPPRSHLLRGKPGRHTFLVLAGPPYIRSVFTVVRASPDIFVARGFSRHYLAPRGYITPGFHLYKTAWLVLNPCSLALPARCVGNAQVWAPHSQQRVFPPPSGDTHGWAPNTLYMFPMFAHTTLAAFNIRAIIPSSPFIPIGLNIIGRPPHCIFIAPLHDHVRRKTPTCWDDPGPRPCRSVLGACSLLVGLVGPSAPAPLFVAGVPPPVFADRPLAHRPALLSPITRGRSPCPHSLGLSQDARLLRRGPPSPNKT

SEQ ID NO: 970674 - protein, 228 aa, Homo sapiens
MWLGSLFAGPCFNNLWGANTCGEFISVPAPGAVLCAALFFPRRQFFLPVQIAGVILVVKTHPWVGLTNCVEAPLLPPFKPSATRNPRQGVTAKTTLLLIVVKWARRAPVVPPHAEGEPLRLAGLPNVVFPTCSNHFSPARNEPLLPTVSKNNCITPHTTYPPPFGTNTRINTRPLCALRNTNTPVAFYIPQQCTNPPPSLYGRTNLPKSVFSHRAYFKTRLFTHVPTA

SEQ ID NO: 970675 - protein, 283 aa, Homo sapiens
RALLVRRWPKPWVVAPEPWLRVLGGSTRGGASKAQPRWAVHAPSCLVGQLLCAWAPRSVVCARATGTSVRPKRCRRPLSGPCRPKPQVRSPVAPRACSPGPPLPAGDVSPHNPTGCRPRRPVPCAPGFLLPPTGSIPLALRCWRDNPHRASPAEVRLSRGHRPLLAVWCFPSRALVLCVQLPSGSAPRYLGPRGDNTREQFLPTVPGRPRASCAPPCCPESLLRLSRRQYFGAASSRVGSPLCPRVSSCVPGSCLEPSPRLVEFFPAPPRGKYAPPPPPPTKT

SEQ ID NO: 970676 - protein, 173 aa, Homo sapiens
PSIGYNIPLTHTLMAPCTHARNHDHPTRKRCLTPLIHSASCASQERRTSSSSLTRKILSYAPIISTSAPLTHSALSSVLKRTFPLPATHTCTLNFGCPAHGRDSAPRLLCNQSRSPFCKEELSPIYYVGVISPTPTSYVSIVSHTITNIPLSRSAHTRHVHSLYTVLSLPPQR

SEQ ID NO: 970677 - protein, 259 aa, Homo sapiens
PLRRIPRALAFVFFVVSRPRVASISLPSLYVLAAPLALAVSLCLLGVAPTPPPSLVSMFAPLSPPDGLLSRRLVGRAPSPERDVTVLWRGSLLSAAADTLLVMSVCLALVTAPPALVSLYALLRGNLLLLCWVVPHPPMFVSSFSSHLFTTMPLSRSSSGSSPHFMFCLAPPGISLLSLSIVARRPHTHTGWCLALSPNPSSSPHETPSFSPLVTHTPPVLYPTTSLTPSLLSLLLSLSPPRRLLSLSPRRVLSSLCIK

SEQ ID NO: 970678 - protein, 82 aa, Homo sapiens
MSKTQLPGPNTAGKPRCFYLKYPNTNLAAAYWHGAYVPTTREARATENGVKPAEARASTCPEIGPLQLPGLGHPSDDCLQTK

SEQ ID NO: 970679 - protein, 80 aa, Homo sapiens
LSDGPPALPSRALCGAQRPTLARRPSPTMGSACGPPTPLFGASRTTPPPGVWSPPHCSCAIIAPPPLSPEERVARPSLGL

SEQ ID NO: 970680 - protein, 80 aa, Homo sapiens
MVWSAHYTPSNVVSAPLCLHSSICLKAPTLLPAAKDVTYENRFNLRDPALVPSRRGFTQRAVAPATLVFQASINVSSYGD

SEQ ID NO: 970681 - protein, 190 aa, Homo sapiens
MYCPTWPQKIARDRPSLSNWGRLYKGPQIIQKFFGDPTRVSPDRFWKTPFPLFRPLLTNFWHPVKVLFRHPPRDSILFSFTRPRLIMSKRPAILSSHHQSDKSTFLPLPPPPAAPFCLLFRPPETTFSHLDLSHKLIFSCLLQYTHTCCGMNKITPKPQWNQKKNTPLSNPQKSWRPQNSEINPINPHNK

SEQ ID NO: 970682 - protein, 261 aa, Homo sapiens
YNAPRAPPRVSPLCVRARDTRAPAHNLSLLCVSAHTPPVSRRDVCHPVLRARVVPPAGSIIIIVRPPPPGRNYLFFAARSSLLPPRRPRPRMFVSFADQKNFHTGAATLVNLWSSPRHSGVRHGKHCAGAFHTPHVGGTHPATSVLAGSHAVWRLSASLSLLARPPRGLVRPPPTPRLALGPPPPHVRFVVSNKPCEAAPRSMLCAKTPPTVVLAKVALHPHRWYRTGATTLTLGVRRPQPGSVIKCGGARTVSATHPWYE

SEQ ID NO: 970683 - protein, 239 aa, Homo sapiens
GGSGREKMRVSKSRNLSHVGRRLVVSLIGLHAQSKVVVFYGVEVARRGDVYFSLVVGIQSLRPVEDVRSPAGYNDESPPLPRSPVSCYKEFIILLRWVTPKRGDLFTGTKLEYTIIGEMIIGAIVLFPAGYNFTAPLHHSGAIFLAPHRYAPPSPEEIFVGPTHWGPSTHTGVAGHTHRPHVCLRDNSVGRVARFLCSEQYIGPKQFCWGGHSLRHVTPPTMAHTFLRKVRNPTEPFLI

SEQ ID NO: 970684 - protein, 170 aa, Homo sapiens
PPRFTTLGPRWNPNPLSGNSCSIALITMCTEIICSEPRSPQSPHGGEHLALEYTHSILKCFHGRCTPIPDCSNVCQTLQLRSFAPLSFKSSQVVSTAQYKPCLTLMNVLDNPHNVNLIRVKVKTFQCGVYPDTALDTIVLWESALFTYPCAPPGPLKTYWFSLAHPAFMS

SEQ ID NO: 970685 - protein, 101 aa, Homo sapiens
MSRCPVLISCPQHTSARVGTHAVLSLVTPRVLIFGVCRTALLPLTRGQTLPLLPGRRYLSPHAREQNRQNNRLVGPSERDLARPESTINRCCPLCHNNYNN

SEQ ID NO: 970686 - protein, 77 aa, Homo sapiens
PDFSPPSLKNFSPLEICPLKLEDFSPPVFSSSQSFIKNYSARAYKSVYNELQVPHTRVLLNNNMPSEIMPFVKTHPS

SEQ ID NO: 970687 - protein, 224 aa, Homo sapiens
RVLFARRTLLSWPKNSCVVVFNGVAPALCFTTPPPPLVVVVSPPLASSGWFGGVTGYLPSCLPSGGRSHVFRICAPPPHRLVSRPSLRASSPHTMPGGVVARHAPAVFLSHPCRVWCSRARPPAFYFVLAARLATIDVVFPLRRRDTPPLGGAASATLLSRASPRGFSPTRMCPSSFLPRGHPLSLGKKPRLRPHVVPAQYVARCPAATLFIPGGSPQHGQNST

SEQ ID NO: 970688 - protein, 184 aa, Homo sapiens
FPNPFPLSGWLFALAFLFPLLTRAFPIRFVSPLYGRFRFTVVSPSSLPITQAPLAPPSLAHSCGVGASSRLFMTPRFFSRCQNHDSVPASYAGSTTVFVFPAPPLILPSRITMLCPHAPLLRVSHHPPPPITHTLDHSAISTPYEHTSSLLLLSSLPLPHLILRLSSPHLTRHILNFTGIVSPR

SEQ ID NO: 970689 - protein, 96 aa, Homo sapiens
FDPHFSRTPHITLVLNYHGLHHYYVIAPLLTPFNILYQTTHMGSISKPHHPRPTLITPLSYTENHPFKFKTPINPPPFVPFPLTPNITYPGVSSLY

SEQ ID NO: 970690 - protein, 232 aa, Homo sapiens
LLADFSAVLFVPPLCLGLLPKAACLGGVPGGSRLYGSAASPTGHSVKAEVRISVVSSSPLSSRAQSGFGCVIRSLEALFAQERVGRTLVGRGSPPLCMAPHGFIAPDHAACRCRPRVTAGCPVMLSYVPHSLRGGLALETRAAAVGNTRAGGPYFFSSAAHPPVWWRFASAPARVHGPAKGRTSTLACEVEWELMSQSAPQGGPQVPMVLESNKAVWCKKQLFFLRPSNVKQ

SEQ ID NO: 970691 - protein, 159 aa, Homo sapiens
GPLLLSACCAALRSARATTSIYSLSRAALLSFSPRCLSRAARALCALSLRARTIVCVALHTTRITRARAREIVQQGAARPAAASSRLQQKRFVVSVCASSPPVRAPTLLCVWAHHASCVSLSVCLCVVLCLETRCARAVRGAVVDYYLVRFRRAVSFAA

SEQ ID NO: 970692 - protein, 212 aa, Homo sapiens
NCKPRECPMGPPPHARRNTLRAPHPGGEKPTCDTPATQRYRPEIILPSPTTCNAPRTLSLRRPPLPLWISPGQWLPPAGVKIPQCKSPPCCAQSNVTLHPSLSVAPRAGTSDPHVSAFNSPRNSLPPRHFLSPMTTSDHSLTYQREVYTRGQQYVLKISIGSTTHPTSCLTHIYCLMKVGFLPEKVLMKHAGPSTLCPRSAPPLPPFNPHKT

SEQ ID NO: 970693 - protein, 65 aa, Homo sapiens
HGVLGAGQGAHAQRPARAAPRDPGTLPPPPGHTRDPRKLAPGACHTVTHSPPSRDLRSQVQQLAP

SEQ ID NO: 970694 - protein, 43 aa, Homo sapiens
MSPHFHNVIGHRTSFRQLGRGAPPVVESDLETHNFSPTIVQTN

SEQ ID NO: 970695 - protein, 105 aa, Homo sapiens
ALRARGAPARFSLDLGGGNSAAAPSLIVLVWFAADPRRLYDKGFRLLFAGVISRATLIVPPRARFSGAPLCRAARELNSRCAGTIAPPTEILVRQKNRRFYTTPW

SEQ ID NO: 970696 - protein, 68 aa, Homo sapiens
EWTSMDEKCGYGTAGACHHARLIFCIFSRDGVSPCEPGWSRSPDLVIRPLRPPKVLGITGMSHRAWLC

SEQ ID NO: 970697 - protein, 128 aa, Homo sapiens
VLPRRTALGGRRSAPWGAPPSRFLPFGRAPWDRPRGSRAIIHSLWYVFGAPSPAVLIAASGLSRGCARARVDLLRAQHICLPGDMSSARALLSPAPRRCHNTLSRTSALLSPQYDLFKQNKEDPRTLR

SEQ ID NO: 970698 - protein, 130 aa, Homo sapiens
MGCRETKRGGFRSLAVWCSGRYWARGCVPLGGRDSCAARRSRGCRSCGCVLRGGVVYVGAFGWAAHPRLFFASLFFGDFRPAHLQFRGYSPRVSLRALLSLTLSSLVLSRGWGAHVSFSFASPARGRYFL

SEQ ID NO: 970699 - protein, 182 aa, Homo sapiens
MRITRGVLRGLLFNLQNTLVENNKNGLSHGAVTYIVRYSQGYGHASPRFFYAEDTVVHKGYGGMRIEKSFGGGSLPPGVAMSKDNPNSGGGVAEEPRSIEAPGDVITSKKREEKKLRQIAEGLGEGGGTPPPKDERTGDILNQYIGEKAEHPRGETSNGKNRGLNFFMFNPEKFSKNPKKHN

SEQ ID NO: 970700 - protein, 263 aa, Homo sapiens
RGFVGGGFFGLGCPGGFVVVRRGFLWARFVSTSGCWALFPGPLFLGVVVWGPRSSAGAYPFAGVSPLRWWCPPFRSFPSFPFGCFCGSRGVCPLNPRVVGPPRSCGIRWYPYPARARHVDSLGPLAGGAPMFFSGCVLFGPPRSCPSPSRWPSWGFSPRRPRMSRARVFVSRRSPPLVVCLPRGVFPGAFSPLFFCALPIFSSCLLGLSPPPLRISSPLFHSPHPPRGGLWRTPPLCYSRRSLCERDSGVCTLVFVDCVPSSI

SEQ ID NO: 970701 - protein, 130 aa, Homo sapiens
MSHVGGTPCHRVTKGPPPTCQIVTDKKLALLKGSFQVVPLGSQGGTLPTLKATGKGAPSVQHKKDAEKNDPQATTMLGTKNCESVGHPPREEKTLCFRSRPQGVKKSWHHHGGLYQDTSGGHLPLASFPP

SEQ ID NO: 970702 - protein, 57 aa, Homo sapiens
AATGVMILYKSLYVGHSYEDPFFGFDGKFLNLENPPLPGGPKMGGPPPSPHLEEPQK

SEQ ID NO: 970703 - protein, 296 aa, Homo sapiens
PGDAAAFEEVCRVSSCSTRGRSRRFRSGDEPPLGVRSLPQPHGRGAFLFWARYTADPPGVFFVPFTPVLFIQRDMGDTSAVILWHREPSVGTPPLKPSVAAGRFHGPALRGGPPSSDKGRSFHERDVLPLLSPPAWLLWASFPRTEPSLGSARCFQRMRCGSLASLRLTTVSARSRCYSASMGVWGHPAPHKTACSAVWGPADIYTKTHRVLAGGSPNSPAPYEPSPCNTGHCGVITHHLSRYCFRCANIPVPKESAPLLTLDCYETCHARRMLSHPCMLSVYRHDAPNKSVSRQQ

SEQ ID NO: 970704 - protein, 269 aa, Homo sapiens
SVCDESKSVRSVLCCVISFVCCAVVGLVFVFLLSLFLCRCCLVVASSIASGDAWPLLRGAAARVLFTPPIGRCSPLSVPGARFFVQCPPPYLWLDTNCPGLACPVRENFCVVLPLARPRGNLSGLFRAPPWVVPPQIGLVSKVRPGDATLVARAALPLSAAAEVSQNLYEVFLLATLLSAPHKWASSLYSYRAVFAAHTEELSGRLSCLGAKVRPCQVLATENTPVVNLVKLRTHSVLRVTPPERLLGGCYASLPIDALSSRQSRESNN

SEQ ID NO: 970705 - protein, 129 aa, Homo sapiens
RATPRWGHIKGPPRKIIRYTAHPPLLWAEEGPSAIVGHPTGGGCSPAPPEAPPAGGEEKKWAEPSLLSVAQHTCVCITPPLVVPRVPIESPPPPFFPRGAHCVCGEAPPPLEVPPRLFSYAVRSLSGPR

SEQ ID NO: 970706 - protein, 230 aa, Homo sapiens
LWCIKVKDALAQLFSHVAVWVARTSCYSLGRNNVAPEETFVEADLFGGILVMPPVALIMRRGAPYCEDNITMLLKEEPVAFLTSQVRPQHSENGLLVTSHNCLYGTFPTPWCQRKKVHSAGSKSHPSWGSSPPAEGRKPGVQKNAVWGRATRPVEVKMGSRNVGQRTRPVQTETERSRRATERSKEESPTFVPGEEHSEIPLGARPRPTIVFIIPYNNIPRNTPQFRGIE

SEQ ID NO: 970707 - protein, 121 aa, Homo sapiens
RNCQLTHRGPPPIVWGALKQRHSGFVLYLSCCTSLYPPNSRALTPVVSIFYAQSFPPPVFYFAKKKSSSIKVSSCCLFCNYKDIMNPYSLVTQKLVVALPPSEDLRLTHRVLFANEGRSLL

SEQ ID NO: 970708 - protein, 203 aa, Homo sapiens
LVDCVLCYLRAALLIRGRPYDGLLARRMARSRAAGWFLVREYSLCSLGNLGSPLIALGVVCATLSVVRQCFILVPGVRETPMAPRGFFAAPSFRRRACYANICVPTAVHRGPPHRPPLLCAPPGLAARPLVRCKFSWLASFYWPVRGPLLVVVTPCVESPGRPRWEFSILLVPRSHLMLGHKSHCAGGTASTRAVVKSRREGF

SEQ ID NO: 970709 - protein, 172 aa, Homo sapiens
CVYGIISAVLFSLLFSRQFAFFTVFICYLLVAIFLPLVGRPPLVDHGCESAKRPGWFPAGHAQFDFRGGANRGRYSLAALCPGVRLRPADFRGPNPGLWGGPDVLPRYIGPPAAVLVSECVRRSSCHAGAGQFTSLFKVLRGKRKFDGHELVPPGVFQTNMFGPTAIIVGRG

SEQ ID NO: 970710 - protein, 113 aa, Homo sapiens
LACAQLTHMALIARQVRRPRSGAGASCISTLTRMHVISSSTVPEAPVSHNRRPCVGYSPRTQSVTLEQAGSTAMRLREVRVPRAPKADSGNLAVERGVVTRWTINQGRLKIDS

SEQ ID NO: 970711 - protein, 65 aa, Homo sapiens
MMYPHHNNIGGSAQLTPPPSDQTVKRRSMYTHEDNNTPHMVYNPSPPFFPFPPPPNSFRGFLFNK

SEQ ID NO: 970712 - protein, 138 aa, Homo sapiens
MARRLRVLFACVGERQREVSAVLSGLSNQRHEYPTGVVSDPPTKTPCGVKPGLSTTAEYTCSLPEALWSAPASELMGLWSGFFPWPPDDTGVFADTTHAEVNGVRLVAQAPVLVSPCGGGAPLPDHRNKVSCMRGTFS

SEQ ID NO: 970713 - protein, 160 aa, Homo sapiens
MAPFVIYVRRTIVILSRTTRRRVHKGTLLGPHGEIVRAGAISAQPFALDTYNARAKNIHDSTSSPPWCIKETHRVPVVFPKDPRLKSAGRMVSKNVFENQKDLGEGDAPLLPPYLVGFSRVYACALPSPLTRMRESLSRKSIPINLRDKNPHATVPTGPL

SEQ ID NO: 970714 - protein, 151 aa, Homo sapiens
ATMLPLRTLSLLLGAVAGKEVGYERLGLPTGDDSPSGQECTGKTTIHILAYASPNRCLTPASSYILMTRPKQTFNEVAADTSKDISGSNFENTSRRRRRFISIRGLKTRSPNLRNPSPHLSTGHRTPDLEGRAYLASCKVGPLRGTEVSLA

SEQ ID NO: 970715 - protein, 113 aa, Homo sapiens
VCFSRFFPTSASQGVAQHLVSLWVFCCRETSSVWCRAGGVGRQLFVARRGPPFGCQSCWARRTVVRVLCQPRRLMASVTAGGHQGLVGLWAQQEVCPPQRLRGFSPLWAQRVV

SEQ ID NO: 970716 - protein, 154 aa, Homo sapiens
AALCCHPRRRGINNIFVIRAAAGSPLRFFISCCHTSGKTFYRGPPPLLTTHFGGDPPLIEGRDSQVCGVALVISGCHPHHIEGSSATLCVAPRYSISLHSFGQLLSFIKESPSRLLEGTQENNGRILLGEYRAKESSHTVRSPGIRGELCELGA

SEQ ID NO: 970717 - protein, 204 aa, Homo sapiens
MGRRVPAPLKGGKNLTPRGFAAGAAPPLLNDSRVSLTSSHWVVEVSVLLEFDWHARALFGSSCKVVVSLPALSLAPLDFMGSSPPPVHSLQVRTACSPHPSSSRALAPRPLSPLGAPCLPPPLPACFVRPPNVAPHPLLMIPPHDPHISLLSTLPALIYAASLLTPLSINTSLSCLTHPRALELIPPTLISSLCSLPPTNNQKQ

SEQ ID NO: 970718 - protein, 135 aa, Homo sapiens
MRLILFLVPILGISTVKKHCGRPSSVSMYQAMKNEIKKSATSWRLKNISSCDFWKSPTTQGDSQSRVPFVERPGSQSVLGVPGIAYSIMIEDVQVLWTKRMKKCSLIGEENGVVTSIWGLPYPGRDFPRKWITSW

SEQ ID NO: 970719 - protein, 309 aa, Homo sapiens
SCRAVSAGGQGRASCTGAFDRRSSPGHHAGLDTRGATCAVATNKFFLDALLLPVGAQIVARPRFHAVGYGLLHPKGIWRRNPCSMVLCNPSCLEVGISNTPELGNTSLGGGPCVPLRANALVVLVFLTPGAPAPLVEARRPNPNLALFPKAVLGSLVRALFPRAPREVSQTGRGSPIGGAKRVPRVRVELLIGPWHDIGAPKGPHIVLGNAPWRPLGHNMGSTNELRADCAHTPSVGEHFAPGADRDEAPKYRLALVTRGEPTGPARGFLSWHSPSRSLAPTTPGETSAAESENATTLETHLRRDAPPT

SEQ ID NO: 970720 - protein, 117 aa, Homo sapiens
VAYHVCLQEVCLFVAGRLCVVVTVHARRCYLSLFGARCVPAGGAPWFRCAMRGSLSICAWVNPPKQARLGGVICMAGFGLFCGVTGSRARCLVSPPRVHPQHCVVNLPATRVSPPLR

SEQ ID NO: 970721 - protein, 203 aa, Homo sapiens
PPRVLAWRLSSLGDICEHCLVGGPPPLGRIASLASRSIWGFPPPLLSAGSFVRVPHPCAGRTGFPTERLPCSLRDFVSTVRVLGVTPRSSHLWGDVLAPPVSLAQAAVSRYARCRVHPPSGPTSSVGLLAPEGSCCPLASGWPLFYFLQRIPPSSRPGSALFVLLVGSSHHHPCEWLGSFFRAPVIGVKNINTIWGALPRENN

SEQ ID NO: 970722 - protein, 195 aa, Homo sapiens
PSSVYVILLPVAPILWRRRWCCITYAAAPPAPLDSKILVLLFSMIRAAPLPTLYMGARPYVFLSPHSCSLLYLRAPPAPRSASVVSGERTRRRNDAGFVPQPPLAYASVSSLVVGGPAKNYAPPGIAPHLIRRREHTWVFLTPGAALLSPAALPPHVVFSPPGGLGVLAAPPPPVGTPPGGRLFLKTHKGWCVKT

SEQ ID NO: 970723 - protein, 81 aa, Homo sapiens
RHPMIVPLGPREFLLVREGKCAPPPKNCSVVGTTTFNNDSFPPLRSRFPRDTIFPRGFLRPSFPSAGVYSSALRSPPTICR

SEQ ID NO: 970724 - protein, 198 aa, Homo sapiens
GPQTGASTRRVDAPRGFRPSVETTTGCIPPSRRLLPGPRGPPHWCVSIVSPRAWPRYSAVPWRVRARLSTGLFMFVPPLPAPLGVFCVPPVPLFPPGSFPGAHHISCEAPPRVSHGVLTRPYLWAPPFAPPYWCSPPPALGNVSLFTGPTPTFGLEEPPPGDTCAFFYEKRVFEDNILEYGYSCFLCGRAPAKQMTKK

SEQ ID NO: 970725 - protein, 300 aa, Homo sapiens
LLCVVLLWCYTLWLCVVARLLLLAESRGVGGSPQSAPVLGVFPSPPAGCGIRARPFGRGFFRARLMLARGVAECSFWPSGVRRGASLLLWARPFYPLLSPCRVSRHHCPRVFSPLSPALVMFMPPSPGLSDRVILPVAPPRVGSFLLLDANWVILGRLSFVSARLTTSSQQGLFIVEIGCFVEQLGWGALNKRGRNSFYTPPAHDRLPPVINKGYMLCLGAVKFIICVSPRMRQQFNVALCLREERLFVVELGFRGLFFATSQCRKHNYVGANSCGALLLLSQRTQKPNPGGLQKTPPHK

SEQ ID NO: 970726 - protein, 130 aa, Homo sapiens
MEQDLVGTFSTRGLPRSWSKVPGITERRRNSREQILLEQIGSGDNFPTFCHKSNTILTASERRVIKQDHSKSGGVKSPKREKSRHIREFCSTHIKTGLIKHQEHQRLRTNKLQRVRPHHTLGETHTGGDS

SEQ ID NO: 970727 - protein, 152 aa, Homo sapiens
LLFPVLVWLDRRVRSYGPSAVEYHSRLVLGNRVLRGQGRQTSLRLSVSRGCACGRSPVVLPRVCFLCAWVCPWLPPRLLWFASCLVSQSRGFGASWRQARAPGLSLGTRSCRIFIAKSARVFSVRGTGSPAWPPGCDPACEPPCVYITSPNS

SEQ ID NO: 970728 - protein, 563 aa, Homo sapiens
MRMKQEREREGEERGEPETEKAGPRTDEHRDEQEPVSIPQSRDAPQTDTATPRSAGRYAATEHEERSIATRKERPHEDDRSDNQRSRQDTQSSHSSPVSDRQEDTRQRATQTERTTDQTDTLRTHEREEGGQGKTRRETETRRANDRRMRERREKMSRTSHERRKNADQPNTNGAAQTEAETTPADQQREEERGWNTQRRTGNQTRREIEEPRTIDMPPESKAETMPTRNKHTAARAGRHERHRQQETTSIPWNGPSKDRKQEEEHGTERNACTGLTTHHATARAQQDRDRQRKRHEQRENDTSPRPIQPCISQPPDPPAYEHGVDELARSHPPCTRRAARERRHGREERSRQTTAPDRAGDSHPHERTPQRGKSETTPRRELTSGPQAGRVGDTQDEARLTTEPDDTGRQEQRHVYEENESGKRYARMRPGHKRRRPEQSVGETRSDERERSAETGQAKTRAADRPEDISYQQARAHSSRRKTLRQADTRQEREEQEKDIEHAANTQQKLPPAQSSIDADRAEPRGELTRGQQARPLRQTDEERAERRDDTTAGTGTKKKGL

SEQ ID NO: 970729 - protein, 137 aa, Homo sapiens
MYGPRKKSHYSPDPSKVFLPTTPRVINTRRVSHPARGLKKMKYRLPQSTQEDGQQYTSWEHIPQGGPDRNSGDIEAFSGAQQHVILTTGEVTPRPPSGAIQDCTPRNPPVDEGELVSTNKERCGAHHKNPQRPTVVA

SEQ ID NO: 970730 - protein, 254 aa, Homo sapiens
LSVNVSPDGRPARCSFGGFGGSPGSARKFVFLLWFAGTPVYIAARVISRLAAGVSRGKIFSSPGFLAPTLSSALAGANLSSHSRRFPAKIFFGNWIISGSSTALEACIVVAKHIFGSRDTSCIFEAKHIMWTHRFARPLDFYKSSLSVEIWCSPPPVRYIFRGETSGRPPLGVLYARGKELKDVSLADTFPRGASWDTTPSKLFVQMCAHHDVSADLSVYIVFVIILLAHISLLGPRGRHSTRSYSPTKKQITK

SEQ ID NO: 970731 - protein, 232 aa, Homo sapiens
FRRVILYARRGRILVFRRCPRCVSPPVVPRPGFLVTGSIKRFEESLDPAGPATPPGPGSRRVFVPRPPLPVARCGCHGSPARQFSGVEESFPPLCVKAWRCRLFSDGLGGRAPLVRGFPAKRPPCAGGLSRAGPTLGAPYRVRANTKQQTDQRGGRTTQKPGDHTEGALATSSRHSPQWRHRRASHEGQKDHHAACDGAPPPALIERGGKDRVFQATLGSLHRRRPLNSTHV

SEQ ID NO: 970732 - protein, 110 aa, Homo sapiens
MLLAPRFSCGRESGAHFFFVAGPLERVFFRCLAVAGNIISAGFFVGPCCVCWAGGLFPVDGLFLALVALIKRLRFLRGVARNWLHCRASCVLSLCGKSSVANPLLISRCR

SEQ ID NO: 970733 - protein, 232 aa, Homo sapiens
EGGRDGGAARSRSGGPRVQKGAADRGGKKRRRGAEPTVGRGPYPPATRKRGRSRLPGHRGGVPESATSGAPTKVGPTAKTHDLPLKGGYAGRTTLCCGGPTMPPTMGVYPTSNCCRYIEYIPHGWSDPPIVKRVCLRVVQRAVKVSQRSVGGLLKPGEIPASGWFNGPCSKFSPPGVVERASHEEIIRRPLCLKAARVPPRVGERHNVVQRGRGKTGRPRAPRSTRGVPQRR

SEQ ID NO: 970734 - protein, 200 aa, Homo sapiens
SWWLLPRVSRACVVSPPWLWCERAGVSFGRVPRGFRNWLAAVWEVRVVSSPRTPFVAVVFGRAPSCVVKRVGGAGFSSVRYTMTAHLSTRYCSIIDKCRSALPGEYSRLVCYSVSNKEVHPAIVYVAEVVLPSAYVCQESQNINVFYFQGRRGVFGSSSGVSLLVLTLLISNRNKFINIKIHRTGKKTVKEKQQPDKDAK

SEQ ID NO: 970735 - protein, 264 aa, Homo sapiens
RAPRTPAVCCAGAPHNVSPGGPQRVSQGRPNTKWCAKAGPDMPNRLVSVCGTQNKRERRPRGNRARGAEEKRTHKSFARGHTYTALRWVTAPQTITSQRGLVALIGPPRDQESPHKVSPEERVPPQRDGRRPPKGACGVCEVESLMWKTVRKATPQGGNKRPGGRLLWPYGEARQQRPHEFEEARSHDTRQKDTLCVVKLSVDRIGRHRQCAHKWSDVERKFVFHTRRIESPSGYGYSISRWARPEELCTAPTIKPKLVLATAR

SEQ ID NO: 970736 - protein, 182 aa, Homo sapiens
LLAGESSCPRLIILLVLVAPPPLFARRVVFPIWSARLLLVFNIFWSPREYFLAAPSFCRRAVESTSRLRPPITLVRLRCAFAITTFYPLGLSIFLVARRPSSRRPPLRVSLSVGPLPLPHHKCLARAPMYFAALTHTRCCVETPHGGLPQRRSQLLALYWWAPNTSSAALDWCFSYPPPLYR

SEQ ID NO: 970737 - protein, 304 aa, Homo sapiens
ACWQEPRTLFWVVPRYNPPNDGGNPRGGPKQACPAGSAHPGRAVLDRPQFGPQRRGAPIALMPLDAAEKTDDQVVCAPAGRKQAADHAPPRGHPRGMLSHPGGFLSPPKSGHSAASLFGPGHQGGLRTHAAYSGAHSSTGERTPTAATHDRIVWWGDTQQSRRLVGTHPQDRLLQGGGVQGHTSGASNRLHVVLRRMYGRREYSLSGESMTGRYAQSDSSRFTPTPPRREPRTRAAPHTRLQRRVSAGTHHNECCGCQHAQAHRTGGELGGRRGSTTGRTRPSNASWARAALPEEKKKRTGENQ

SEQ ID NO: 970738 - protein, 101 aa, Homo sapiens
LVLRRPLLLCVTGLCGVCLCVLSADYCAGVCFRLSRARVVVWSALFVSVACLCPFVVMLRGVLATYTSCVFPPAFCFCVVSTSRPVAWVVVPPPGWSAGPV

SEQ ID NO: 970739 - protein, 279 aa, Homo sapiens
MISRTHPGVCNGVQNDPPLRKYPTRCKVSLTRKSVMEEVLLPRAVVDLPRNVRCVKSLSTEHLGVVLRSHALLRDTLLKETLLFAVAAGRDSRMGHHTVAGVTHPRVCGGLSLPPSPSRLSLVSCGGRLLVPPPLSLPVSCFWVAPPKWGPHTCCGEECSLTAGGRTWGGSQFMWLTHRTLDVCAALKHALALEELSQMCVQQRSTIMSGAPLCGSTLLRTNKFANTWENSTSTVCADYAESTAPTFLVSHPPRVRPLSAALSSLVFFAPFISLKDPLA

SEQ ID NO: 970740 - protein, 102 aa, Homo sapiens
CFESSAATLHKKGFGGSKVMVVPAGQGLHGCHSIVRWSPPPRCYVVGSPLSRIYAAPRSMYIRCRSEFSQEMCPPNQRLLRAFTQNTTVRAVDPSSLWPPQQ

SEQ ID NO: 970741 - protein, 40 aa, Homo sapiens
MLWVDVYSFLMSPTEDFSAARFCSVAPGGHCGSLGRTIVR

SEQ ID NO: 970742 - protein, 127 aa, Homo sapiens
AAYTSFLPMPDLGSLGVPSARFSSLCAEEVNSAPARKNFLGVVCEEHTVLTREVSRTVWPRVSSASKKIRRARDFLGPPYYSRAVRVLTNGVSLTRRPLRWRPQLTTTSVLRTPHSVVRLKPRSVSG

SEQ ID NO: 970743 - protein, 114 aa, Homo sapiens
MRLVRALAHHALFCRQLSPSGYSHHSCLRWCHHCTASHSPFVSLTLCSYVWRPHMFSLLTALSHLSSPLLRTLYMFLFYHFPHALSSCSILNTPPPETLALFVLISRVCLNYIE

SEQ ID NO: 970744 - protein, 111 aa, Homo sapiens
GRVAALVVGHWVTQEGAASWGFSACCAESHAIGEGCDMENPLCCGPPLFCGVKQRGAFGALVRGYMRVSPGEKEKKRRGTVMGYGIEWPWVRAYGRECRCIDWRGARSCCS

SEQ ID NO: 970745 - protein, 169 aa, Homo sapiens
MALSVGSRPHCVLSPALDVSLFSVSRARAVSSRRARECRCWCRSRGTPRACRASAFSVFALLYSRRWVSGCSPALSPRASHTLCSVGAPPLLRSASRCCICEALAPPWSRALSASSPATPALPLPQRLYYFTPESDSLLLYDLAVSMYAPYRALYYLSSAHCVLLPPFY

SEQ ID NO: 970746 - protein, 80 aa, Homo sapiens
RIEEGIQRIAYLPRVKAQWHRCIRFVNDRTARLLPINGSAVTHRASYYGCRSLYTISMSALPHATWCGLSDFRPASPTLR

SEQ ID NO: 970747 - protein, 176 aa, Homo sapiens
SAHVAVSVGRSPPRCGSVSNRSMGSAPPRFVPRGDIRNGEVYLPLVIIVLCFSVIIWFATLLLPETYGFPPPPLNRSSLGVSTLAARLVWAPASELGGARTNCGIVVYLALTDVGVSPRPTVLLSGIAQDERGSAPNTPWFCAARSCGVRFVPPPPGMALLDPRCIRSFVPRGTSL

SEQ ID NO: 970748 - protein, 130 aa, Homo sapiens
VVLGVPGCSGVPVLFLSFADVRLALVGACVAECGLWSSVSVGGLGVSGSLNRCAVLVSDGLLLVRPDGYYGGARDSAARADLNLLVVYSFVLLEFCCCPGVFVVTFLVCDVSAVMYLAVYDAGFSELEMA

SEQ ID NO: 970749 - protein, 156 aa, Homo sapiens
MGSSAKWVRTEAPPVLNLRRKKAQCAPSSLWGAQDKKSPAGVNSEPERRCASATKEANEEPPPNRVVVFLPTGKRSLPPPSMSDPGGAHHCQQRAPDLSRQDLQEGKKNRPGSQLEKDEPPGFIGAPGHPPHARDTQGTRASNMLTGAPPPPARVR

SEQ ID NO: 970750 - protein, 177 aa, Homo sapiens
MVKRSSLYARSPCLIPSYGISYGFSTYLKSAFRTIPTEQNSVKTALDYLRPVKYPSGGYSSPQMILLTDCDHPPSSMHVLITKPPRVSLLRGCSSSSTRTKHTGAPHMVRREHLVGYIRGYTGRRKKMFVKTLRNTTVARRSYSALDPTADTLGQSPLCTLHRTPGVGHPAVRAPYC

SEQ ID NO: 970751 - protein, 129 aa, Homo sapiens
MYIVGTCVVLAALRSTLCWCVGGVRLTALIDCAHLFERGRLPLRCGAHLLTSSAATLRLHVCRVDAFLGSLHCSVSLALLISRTCSRPKRCDIYFLFPALVLCPPSLSLVLCGVCLLRSRVRPLLSLVL

SEQ ID NO: 970752 - protein, 120 aa, Homo sapiens
MAPWGYATLRGRPRTGLRLRGGKTAWCTTPEAALTSHESACRVMWNGPQSHLGAPTKVVGYQTLCADAELIMSEAPGPRRLSYTYHGAHSNKACFNIKDTLLFFRDSRISVIAPRCTTCI

SEQ ID NO: 970753 - protein, 244 aa, Homo sapiens
FSVGTVGRTGRCNRVGPSWGSRTNVRAGCLRFRALFVLRAANVGACWRQIWAVGSSTRRTRWWVGGVNSQAPGSERTNYIGRQFVAALFASHLAAVCASTRFCVRAGGGAVRARLMEGQGTVNLDVAVEVIGARVSCQVLTDSELASWPPGGCLVWFGCVARWLAKGDSGTCEALAGCGRSPRTLAVFSLLGCHGPAAVIAACLVCPHRDCCGLTYGRVLRLSTLGLSLLVPPLFCGPSFRPCL

SEQ ID NO: 970754 - protein, 185 aa, Homo sapiens
WVATLSFVVAGGFQLGCESFLASVGGRSLAAPLWCLHGGGPGAPLLGGIGCPSVRPPATPSFSGVTYTSMGSDSSTGDSARCGPLPSCVLSSRPPRAHPSPLGLAFPQGAPLMEYTAWPPSNVSRASAPRPVRVRPFYGSSFSAACTVLHELFSPRLSAFFLRPHAATEIMSVIAGVTYLSPCQK

SEQ ID NO: 970755 - protein, 240 aa, Homo sapiens
HEVLFFAPSSFWPLFFLRHVGWLLGSLRGTPLCGGGGILPRRISLSGLGARLRFSRDGFLPSVRGCLRAHTIFVPRGLSRAPLFLALSEGIGGPTLATREYVPLLPPAHGGAIHTPTAEISLFSRPHKHKGWCCSRKRRQQGQLVRHTAETRQDISATHWWEVHTRGRYSPCPAERDLHTARRSESEQRRSAFTLYQENPEEIHVRQPVLPPPVDPGGGHHRGENALHHQERPRGVPSKN

SEQ ID NO: 970756 - protein, 176 aa, Homo sapiens
SGCSTPGLFSPNIGGGIQCLYSSRVPPGGNQLCPQMPAGNYPFLVNGFTPWPPFSVAPFPSQPRGVPHRPAPFNVPALQLFVSALVLPVRLPTRSCASLCVGWPLASVAPPPTRFPRGASALSVSTLWLTPLECGAPPRPHTPLPRVYRRFEAPRVSEILEGEKRWYFLESLTTTP

SEQ ID NO: 970757 - protein, 130 aa, Homo sapiens
MAQEAARQKGTRHKTESSLPPETPPKAGPLEPPFLGPQGTLEITATVEIRERKWGGQNLKGAPIQPNAGPRPRRPIPGQKRLVARSAQNHQERCSRRHEQARYVYVAFPRKVFAPRDDAIESLNPVCLVT

SEQ ID NO: 970758 - protein, 94 aa, Homo sapiens
RAVARVEFDLYAPGSPCALWSPPESLYHMSCPQGAFAYPKIMGKAESVGVHHLGETCRRHLCVNVSWRNNKFGGFLPPAEIAMFGCSPPNSVAS

SEQ ID NO: 970759 - protein, 229 aa, Homo sapiens
MELHEDVILDKTSSVTVVPALAYAAISPARFFTLAPSTEGPFPPVLWPFSPVYRGFNPSCYRALLRRSPQMAVGTLARKRVLPFFRGRTPRGQSERARNHRRGAILPFPGRQEAPPRRWWGQPGLKTKQQGALQTAGKKLEGRPLGRGCPPVRPPARYRSPPLAVEQACREPPTPKMWHARDTAHLKDRGDTAGLNSGSQKIGCARKTRLVRKIRSSQDTTPARAARLN

SEQ ID NO: 970760 - protein, 116 aa, Homo sapiens
MTGYSRKYVGKCPPWTPGTHSEHLNHADKKGGGPHREDTHNVRIRLEVHVLKSWTKGELFQVLPVAPSTVHKMHQSRSGGSRLVNPTAREAEVGGSPGTQRSPGPKPAWATPKTGL

SEQ ID NO: 970761 - protein, 250 aa, Homo sapiens
MSAIITPGATRPCYTAEPRVSTHRVVGRSPPPKKKSAAARTRAALFRETTHHEKRRSPEARAQQRGGANHTHGEGEHHEEAHHYNKIIKRPPRDRERRHDPTHRRQHTETNTHTPTSEHHDTPMTIDRPTHANRSTSHRTARRKTKRTSTRPTETHMKAPKEEREREPEARDYDSSEPAEDRHTQNKPARDRSTTSDHTADAHASADGAEQDNSDDTSTHRPQTHEQPREATTQHNTAARHTRRQRQERT

SEQ ID NO: 970762 - protein, 131 aa, Homo sapiens
MQASTYGALCVSLAHRQAMFAGLLSSIPFGLGGYRPSRISFCCVAQPLLEQCFSHSPGFRDNNCPRGFRPPILVPAGGLLFFSSVPTSCPVTTAPTASVNIFATTSRRLKIFLVWGGPSSRGRDRPPSRRP

SEQ ID NO: 970763 - protein, 275 aa, Homo sapiens
LTVVGIRSISAHSLIVRPYIVPERNNTSRVFIYTLLISTRARTPHSPRIPTLLAGRIAQYLRSLSPTCRKAAALRPYAQYIASSHSSKAHYCAPSTYTLHYTPTHPYLPTALTHLHSLPHTHSTYYNLTHTEPPAHFPTHTNHHYPSPNSNHKHTPTMPFTALYPHSHHCPSLPPQTQTHPNPTPHHNNTPPHHHARAHPPHPTPPPTNTTSHTPPPPHSERPQTPTTTTNHDPPAPPASHTQHHPSPTPTSPSHHLADTNRPPPTETDDRNTHN

SEQ ID NO: 970764 - protein, 125 aa, Homo sapiens
MPPAFLSTTENRVFTRDVGTKTRHPRDTVGRPIFLVVNGSFPPCALIRRYNPLPPRHDLPPNRVQGEAPILHTRSGSLIRRKRPFFIKKDHTRISGARDVHELYRGSVHIPHVLLLPPRVVLKYE

SEQ ID NO: 970765 - protein, 70 aa, Homo sapiens
NPAVVVQQGNNVPILAAQQHTKCPNTVYSRGGQIPSPVKWYGSPLVDKSGCGAPGLFTPARRGTVCLPAK

SEQ ID NO: 970766 - protein, 189 aa, Homo sapiens
MGETALFGEHPPARKGADRYRTPGCTYSKPPPLPPPPTGSTPMPPPPPHRCESTKTLPTTRQRTKRYEDNSTTNNGGGDSLAQKNKGISNSRVQSGHRDTGHHLPTAALGTPRPTGNNPMSTAGANTATKKLIRTRSREDTTWTREAYGVVGPAGRQHHDGVSREQRHPPELHQSEGPPAGPQGNFSPK

SEQ ID NO: 970767 - protein, 160 aa, Homo sapiens
WSLVFPRGVLVVCFAAALWLLSCCCRVAYHFVRVLIPRTPWGPARGSRLPAGVFTDHNRATAQPVRRPPILVPSRALFFVPPGYKCPRCPGFGKVPWVLPISPPSCECQGNSLVTKSENVKPRGQKPVHRAGITAPVGRDRTDAAASSRGQDVRPTNPVI

SEQ ID NO: 970768 - protein, 90 aa, Homo sapiens
HVSVPSASVTYNTQAITAQRAVEHLPQLYAETCCFIGSHTRYRAHWGLAPVLRQSGETGNRPHGARINDTTLGALTHKQGANTARDRIRS

SEQ ID NO: 970769 - protein, 45 aa, Homo sapiens
MSHIMSPCVITLNHDSLATSLAALVFTHPHIYTDRYKTHITTQNH

SEQ ID NO: 970770 - protein, 251 aa, Homo sapiens
KLNNRRRCGAPAWMSPRAAKGCPGSHFGDNEDQTGSDPSRRSQKGGKHTQTKGRVFTKPGQAEKAKNCAPKIYGWVKMKGPVSGTIPGSRGDAPTKGAAHGTSGTNIIVKSRGPATCRPHPRAVNPQGNPGILWASVPARFPGDHWLATTTCGEKQTIFEGGEPWKTINHREPPQRYLGQICGQSSREDLYHDRALRNKSCDVLYLVHTWAAGDIKGTSWADHQKLKGAQSSPTSEKKWEIPDPDRRMRKQ

SEQ ID NO: 970771 - protein, 182 aa, Homo sapiens
MRPLIVPTTESPLPKNGPPPFFPKKSFSPPSFSQSSRVNFLCNAGALQRKPILSQDRVRSRLIHITRPYFHAAFLYKKTHCLTRAALFLPKTPRGPSFSILPVLHKMPPKPLLIYKNYLPIYRQPPCKRGEIHTTLKKIIFSPKQQHPCKTSRAAVLIYPRIPPLFVPHTHPVHAVLSTTTT

SEQ ID NO: 970772 - protein, 71 aa, Homo sapiens
QWLLNDCQTTAWAQQPDTPPINENGQHHTGKNAVEWPKQRTLRPIETVLATQNGDKTPHLGSASGLAPGVG

SEQ ID NO: 970773 - protein, 103 aa, Homo sapiens
MHRASHGEETPVGGPPEGETGHTLVPRRPYTPSQYAHGGPNNGARHSTPALLILETIPTIAACQRVEEGTWHTPYEATAHKGGGKLSPPALIKIKIFQKNPHD

SEQ ID NO: 970774 - protein, 171 aa, Homo sapiens
VLGTRPVRVECIPAFLFTPCLGPGFLTLEKWRARCSPCGGPVLPGPRWALPCAPLGAFSHESPQGQAAQIIDGRCTSVLTARGVYPYWGRCEYLLGMTGLGRVSAGDPGRHPRARESPKKQGKIKGAKPRVQLQIIMYPSGAAPTTPSPDKKDISPGGERSQSGAPRNTGL

SEQ ID NO: 970775 - protein, 195 aa, Homo sapiens
NGAQISSRPSSFAPLVWSPPPAMPRSTHPPLRPSVAIVLSTLVAVFASTEALWWGPPLLFSSRVLLSLLVGTAPCACPAARIYLLSPHALPRHIFLGQYTHSLSASLSHSSPGGVVIAHAGERHFYRAAPSSAVPPHEAPPLVFPPHRGREGGNTPGSHGRVISGSNDHGGRRPPRAHAAPGLCSRLNRSYLPDK

SEQ ID NO: 970776 - protein, 183 aa, Homo sapiens
MDEKIPGGKKQGGGPQELFPEPGREAPEFGPREIQSTPGQPCQIKGYTENKTRFLLREYKEPAPRSEFQRRPFEPGIATHARGDSGATIKEMWEKPTQVKHKEESTKGHPPGVSMAERSGPSNSSGAPTMGNPLSRMQVRRPENPPRGGECLLPAPYPLWGDSLLAAHGQASSKKQQRGIPTK

SEQ ID NO: 970777 - protein, 133 aa, Homo sapiens
MHHYCVGRLSPTQRGRHVCCLPLSSLEASSFCWVVKSHTVVANIFFSPREMYPAPALICLNNARILSNCYTAPPIFSSHASAPTPFLVISPHPLLIHPPTPATSLINRRSAIKYITTRILRLTYILPPSFTLT

SEQ ID NO: 970778 - protein, 268 aa, Homo sapiens
MLASVAEEPHYTICARNWVFLGEPSTDLGTLTACPPEYDKIWRNTVREFCHNGAHTVTTTGGAPSQEPGVIRPDAVTSQSTVAWEANTYLPGDARLSSTCPKVSVAPPIQLRLGGPNNSHRLVVRPLAARRGNNAAAPAHGQGDKRPPDQGDAQETSSADGGHPSGSMARKPPQPDGPTAGGGRTDVLSRRLMGEPPPPAGDRPTQTSFQSGPPTRGEAKTLPPRTDHRAAPVMPRGKHVTKETSSPRGWSAVAPEQATPREETPPRG

SEQ ID NO: 970779 - protein, 247 aa, Homo sapiens
LHRCVLRVGVPLSSSSSQKKLSALLRPLPLLRVWHVFSFLSRTLAVLSSSSLFRATATSSSLLMCVARCIKDAPVLMCAAATTLRVAGVPPPPRLSVKIKCHSALLVPGSPSALFGLGVCPPSPTFLWARCPPSPRSCSHSLSRLSPHWLSNPSTPLRGPLLFRSGRRSGASPTRRSGPARTSARLVLHWAAPSPLRDEVLVPRRTCGSEWLRLGRRAPPPRAVRPFGGEQAARACQRSKTTTGHNN

SEQ ID NO: 970780 - protein, 311 aa, Homo sapiens
YDCSRSPYVRRVETLGPAVTCCTRFQAFGGCAPGTVSYYKCACAPPFSREGLPDFSDPPFLEDGRPPFYMTARASTIFSKGAHNFWAPTFKCRRLCEQHAQRLVYLLRRNHGVQAPRKGARPPLKKPDWAAATRGSLQKGQKAPCQPEPNPRCESPAKNKYLFRRGTRLKKYLGVASPLMPPNWVTIAQGKKDGPPRISLGEAGTHAHKRTHRAQKKRVVLQIQQHKKGAPAQQTMHTGVLVLERRIQRNGAVPIVRAHAYTTPPLGETEGPEEPPCKPREAKGIAHETLGAGLRNEHPPGAPKAKPRSKK

SEQ ID NO: 970781 - protein, 82 aa, Homo sapiens
RPRPKILCKNKRYHNWMTRLSPKHCSRSTRCDIEKHLRDLSSLLILQFSPVRVGCTPPLSSLVGGGGRTLRALYPRDILKLL

SEQ ID NO: 970782 - protein, 179 aa, Homo sapiens
MLLYLICITYRYLAQGLCSIEYISGEMRVLPDPKLLVSWTASPDDKHFGVLERSCPPGRKLAHTGGLPYTNRGFTSTRVNCPLPAVTWGQHPPLILGGGFRPFVFAAQWLVSAPPPLPADSCLSQGSVMLHKRRVVPPPRLVKLAAWFAPPFVLEPPALRHHWAHHCPSIFPLGATMYE

SEQ ID NO: 970783 - protein, 308 aa, Homo sapiens
TPDPYLGGSCSWCPLDDDDKIVGATSVRRIRVPYLGVPVIHGNTYFCAWHPFIEAEQWVAQVEQATCVQSPGNSRGENWEMHRQCRKSWRGMEQVHESQAKESSATPNTRVKKLNNDIIVTQALLTCSDQRPGVHQSYCCPPATPKPLARGASSLAGALTESSGRRLYRRVAVPCDAPVLTRGYSVKLLTLERVIKPMYCVGFLEEATDHVRLIHGGPCGLMDRSRSVSGVMGVPRRQLELPRATPSEGYERKVHRKPEFSQQKDGPAKKQKFGPAQVYTAQKRQSTDGHTGTQGAQRHAGRRAQDSD

SEQ ID NO: 970784 - protein, 134 aa, Homo sapiens
IEKYCCYRKLIRIVWMLIVLGTDVAGVMLMGQPSGTPVFFPQLGVSQRAPDILWEPPPTLSRSLRMFCLARKIQGSSLFAGAKLGAQPNNKVGSNSTPCFACACRRKGGQTRIRLAWTHSVNRGLRVDLDPSEG

SEQ ID NO: 970785 - protein, 235 aa, Homo sapiens
VRSRVCMIRYRHELTWSHGPYVGPIYHKVVGADSDPSPFLKTMVDYAIFAYRDTLNVGPKQRLWNTAPPRATPGSLFFKDPILAACAEICNPANFGVRPENYTITRLVGPHAGGPPPRPPPRGAKKTLANTINRGGRNSYAPLTVGERYTNRPINWHLQRIAEGRGKCRPQQTESPRTCVVKIKGESQSFSLQVERANGFVFNSSGHDALVPPKSSGPYRRQQEKTQIEVYRSKI

SEQ ID NO: 970786 - protein, 285 aa, Homo sapiens
EAVARKQFMPDVTGLMRTPVVSPFFPPLEGQSRGLKVKELPTVGGAPRWGSPPGWAPPRQGGHTPPKCARTGLPHTGTGWAAPFGTCPFAHLAGTPPADVAVRPPKGVTPGGFCKPNWAGVNHLPQGIPVNKARRATWPTVKQGDRPPEGIHSPLPPGGDGVSPSPPGPRHLTGTPREKKNHAPCTVKDHLDDASPASHEGSSAGRSPQKGAHVCVEPGTETQHICKGKRAKTHTCRGPQGSTMELPPGWKESEEGCPIRLTACRPEPEGESAPILIKNNISPNM

SEQ ID NO: 970787 - protein, 116 aa, Homo sapiens
MSVKCDRTFLANLVKGQANCESHAWTPFQNFLAPLRVSPGFFKYHWGFHPKAALFRDQTGDPLPQKGSACPPLRRGDYTSRGKVFNLGARRADPPRAGTRFGFSLGPELLRTVKSP

SEQ ID NO: 970788 - protein, 137 aa, Homo sapiens
RKKQSQEAKKRMEADKSCTHVENLYASGHLPGQCCVHRATLPPLWKVGRPDKFWEPPRIMRAVKAQPLFPKAPLKWARQRRVFFREPTPPLLKNLLRTGAFILGWLPTPMPLPGILHPPCQPAMGRTTPGVPPAGIM

SEQ ID NO: 970789 - protein, 167 aa, Homo sapiens
MMLRLLSSLLLVALPQAMATLPLTLPARVSMVRMRSPTAGLEVSLLYEKSGSFYHTCGGVASFAPDLGCDCRLTVISDGHLTYQVVYGEYNLAVKEGPEQVIPINSEELFCIHSGTVSCVACGNDIGPHHALDAAPSWEMPSSSPHPSRGDILPKKNPVITGGGVYT

SEQ ID NO: 970790 - protein, 196 aa, Homo sapiens
MRWAETSRIMISKNARMIGGPWCVTTIWGFLPHRLFCCLSAAPIKRPVYRPRGAPEVSAPLVKKKQRLCAQYKARVEEDFVCLSRAPRRATLGKKAQPPARHRGFLRAAVSGGIAIGRLAPAAAHIIGGIDNGPWLIFKPRGYLLGANAPRIMRYKYKGGAVEVRSTSCPMAVVITRCTADNNFCCSRDTPRNPTK

SEQ ID NO: 970791 - protein, 130 aa, Homo sapiens
LLILTFVAAAVLPLDDDDKIVGGYIVGGESVPYQVSLQSGYQPLCGGSPHQTNKGVVFSRSLLNKLPGIPRLTTRCQKHPTTETPLERGHRQHSHSKCGPNTLPDNPKKTTNPAYPRKNDNPPVRQAPHP

SEQ ID NO: 970792 - protein, 278 aa, Homo sapiens
LGRFAAHHTGPPDSGRHKLGGVHPPTKGTNGVAYTQGPHCGKNFDEITELPDRGEPPTILIYLGGGGMYTSLPKLQRTRDLRPPRNPPLAGMSGDTKKTRLLWFANRALHTRRADPKSHAGFRRPTCWANSEDARTPLGRPQRTRQLLDRRGGKPNHGVVWVPRYPHTEGIHGGLGERVPSLREPPGAEGGATHPLPRRRGLSATQQHSSSGRSPEGGHKEFPPHGEIRVAPHGATTAKQVTHKTVIPGAKLLMPPRKNKAPRGGNTPRANQNTSACE

SEQ ID NO: 970793 - protein, 105 aa, Homo sapiens
PLGFVSNRAPSFLPEGWFRGVQKHLPSVANNGFCRMTSDFPACYLSAAPAHIAAVSSWSPTPYCVVWRDPTRRCSTTSASTAKNTELRPWAHMRLPPTERAPQRR

SEQ ID NO: 970794 - protein, 37 aa, Homo sapiens
MGILRPHLPRELLRIHEVWGTRVSEHTVLAITPSFTN

SEQ ID NO: 970795 - protein, 292 aa, Homo sapiens
MMLRLLSSLLLVVGGLRLWPTFLSLFQPRVHGEDAGPLELGPGRFTLSGHEKQWKGVLTHKRVCRDSHSIAHTALGLCLAGHVRSRRALTLSGGVRVKYNLLAVKRGASQSSESPIQHLEELCVHPFCEPFVCGPGVIGSSRSSGSRRCVQTGRCRIHASDLQSLHAGDYPFAINDILVQSPVAARRRIANGPHAQDKSSRRPRWRVNYRAPAQVYWWGPTVQENQVCAEGYLRSAGKVTLEGPSRPRRRGEWPGVTTLCGLGDSRDAEEREAASPEGAHSRTSWAAHQKVD

SEQ ID NO: 970796 - protein, 193 aa, Homo sapiens
CFVCTSAPFGPARVTRGPPTWVIPWPHSPKGFYPVERHLRGRPMRFGVLSSALFSSGPPGSCEGAPRLGFIGITRHVLTRFSTEQTTTLPLVTNGDPPPKGGPHSNGQLPRDNKQRWGPPMCWWSETPGGGTTGDCSTPREDNKVYRLPPTVVAEKVSTAKQTTKTGFSLRGKYYGILLNPVTMKIFTPASLS

SEQ ID NO: 970797 - protein, 153 aa, Homo sapiens
LQLSQLPSSSVGRLPRGYGPIFLSLFCSRVVHGEDWRSPTAGPWLVSLAVCESVASFYLTCGGSLDRSRSWVVTAGAPWFSRASELPWWLLGEVRWLAVIGRSHEQVSPSFNSEELCVHPMLEAVVCGRVWNDIALIKLSQEGRDEEMGPGSP

SEQ ID NO: 970798 - protein, 246 aa, Homo sapiens
MGGPHNQTGGTQRPAKFPHRYDGGPKHLTPCGHDPFSTPSLVSGPPPLAVGNSVLHSSAVFFLVLGLFPPRCCSRAPGGSQQRLLWPPLAPSHHSGATTQAPYYFRAAGTHSEDSSGSPCLPPQEGLPMLLRHALPAVMTPGILLDSPFLPCGRHTAKMCSWGVLTREGTDIHSPGVIEWATHLVLPMEQEPHTADMCHGGECRRTTPERQNTRGLYTQGAHQTSKGINQPPKAARSRSPPVFFQV

SEQ ID NO: 970799 - protein, 77 aa, Homo sapiens
DRHNGRRTFKILTVHRYKHVCQNLGSPHCVGTKWAVPAISRAAVISPRVVVPSSSTAKTKCVPFKKREIVSPKEERC

SEQ ID NO: 970800 - protein, 193 aa, Homo sapiens
RKHQPGRRGAPRDLWAPPCDPGSSRPQLPTPRGAPLRGRQNRGGEQKPPGSNVEPRPPPAHHSVEEVAGEPSSPRYSKADPPQVFCPTCPPLPPKWGSLGTRDQKRRDTSVKANAGGAPSQSKRSGSGVSQMIPGKETRPQAAPSDRQAPHFARPQEAGGKTQRRHVAGARARVVPQNPTGRERHPKPNPPTK

SEQ ID NO: 970801 - protein, 105 aa, Homo sapiens
FVMNVLPPMWDAMVMLQASRICAIKDVGLAGPGVVDRIFGSWALGRGTSLMLGQRVRSVCKLRVLSSVAIRTGIEARTNSEGRFRNLDGTQTRRPLVESDASGMT

SEQ ID NO: 970802 - protein, 287 aa, Homo sapiens
TSPTNNRLWTPVCTAVTTTVRTHLGHISNPLKSRLVPIWASENTVTNYALEMLTFPPKSITSAPLFSSHSYKTSRPETYKNCSQTTFPRIISTRFPSLNGNFPNCKSVALSPLQQSQRRVLPNRCVVRVSPRPLFPPSRGPPDVTRHNAGEPSRNELCHGRRRHYPKGILLSPQTASISSANMPEPPFPPRNLVDREAWSPQRAGGKQPSFPRNKATEVLRVKPPNSVSNLGAEWDRPWGIESTPPHGRTQDSMIESTRRPGGDAGGPKRRCVNTRYFPPDILRGII

SEQ ID NO: 970803 - protein, 113 aa, Homo sapiens
SGRGVELTAVVPRLVRGVWRTSGRAEHGGSGTAENKELRGHRSHKWARRDKGGILATELGSRVAPAGNIGMNGPTKGRFPLSMTPQGHLLRKTMPEVVQRPGVKAESKGPGAL

SEQ ID NO: 970804 - protein, 282 aa, Homo sapiens
GFLVVIRAFRSVSSFWGAPFCAGVGWSSPVGGCVSGPPAVVTTCVSRPKNRRSPGCHKVGGARPAWVSTTAGSSVCLGGVPHYRGGPQRCGFCTRRGVVRPLYCSHTWRRQKQFRPPRAGKQRGRGAPARSGSSVAQLWRGVHPSELKVLRTGHFPQPTLVPLLARGNCECSEPCGSLWGSPPGGQYVYGDEPRGVRPRRLVTSAGADSFRTVFFGGELTLWRGRRALAVVCLSRVPFRRRVRVLSCLPASPGLSGGRRRALFGPTCVGTFPYRFTGDNPQN

SEQ ID NO: 970805 - protein, 107 aa, Homo sapiens
MGKSKAHNWKQPMCCIIKSPVEIRKIIQCVMLLVITGILKISWMGFYSPPRDFWKGAGPPDYPGIILRKWYKPSALSFTWYVKPDWAPTLPGDPRVSTLSKNLCVAF

SEQ ID NO: 970806 - protein, 142 aa, Homo sapiens
QLFRRTRGSRSAGSCEVRPLLPADSRSPGPSPSGFSPGVCYGHIPRAQYMDLCVPRECARCYSPLRGSQHSFFFLGPTFKKQPLARLLEMSLIMAPPPPFTLSHPSNFLFFKAAPSFFLRLQKTRLLDIFHPDLGNSFLPPQ

SEQ ID NO: 970807 - protein, 264 aa, Homo sapiens
RRGPPLVFRPDRGARVCLPPPSPRCLWAAPPLFLPRACVLYGEPPLLGDREWCGPLFLVRYRVSSVPDGHAAHCDFPALGWANTLFRAAPPAEIAGQVVPWDPPLGSERSPPFFGGAQPPGPLSCLSPHGGGTHSWDRLFSRPYYVLGVYAALRSHSLSPLLVPAPAAVGSRPDGFLAAPLRRGLVGPPHRGRPAHGGPPLHPTHQSVGIFALFIVRTVFPEGPRCILYPAGCVGEIVWHAPPSSLSQRVFLLVALYPRCGTPL

SEQ ID NO: 970808 - protein, 220 aa, Homo sapiens
GPPPCAPARPFGRRGVCGQRILVGEPPFRRGSPPPVLGGQSPVWGFLVPAGRTGWHPHASLVAARYRVPSSPVGHTRLHMVAAAEVALFGVALGEMAAPSLGLESRSAYYGRVNPSLMSLPVGEFRFSRHAHGTILSWWVSDLPPVEGEAQEGFCYFFRGGSLLWEGPPRWSFSPMGPPLSPRTVFLSPGGQSRPFPQGPTPAGVLPRTGDAGSRVAVGL

SEQ ID NO: 970809 - protein, 150 aa, Homo sapiens
MCLYRFWGQPFVAVHLSRDHLGGTPRPRGFPPVPRGVCWPTAPVAPPSSWHGKGPFLFVSGPRGRGGEPMEENPRSGGASLLENHQSGRVFYSCVLWGKKGEEKPRISSCLHVQDHPRSRPPPRAPYIMAMPESPQFLQLISKKQDFSPD

SEQ ID NO: 970810 - protein, 162 aa, Homo sapiens
MAGRRTRRGTHPTGRFIRGEVDLSLPAVPKPTRNVRRSKRVHPPQDTPPAVFTKCALRGTHHGSCTTSVVPTLKKAHSPVDNHPGQEMGVSYPRFLVSTQSPNVEGSRRTHTSVTGPRAMEGRKTPGESCAWLIYETEVQVSSTCGGDKKKSRLLRGVHYKM

SEQ ID NO: 970811 - protein, 309 aa, Homo sapiens
SSGVIVRSPCSHGPFVRLRGCPPGPRSPKQGLPHWRAPPARWVFAPRFRGIHPPVAVGEHPLLVTRAATVCPSTLGENCLATPGEPLLGARVWTQLLLRCSVMLSRTEPPTGVIPWAQRALQSRALGPSLSRSTPPRGPFACVASPVFHHRAPSPHTACHHCPGLTRRVQVIISAPPSGESPLWRVSPPREQDTPVSSSPRCILVPSDPARFCGAPLISPPTGIDAARRHSGGANTIVCHGSALPLVFGAHPQACSASGSPSYMRRGWGGNDVTTPLGPSGPPSAVPQLSVPTPHQKQQVFRNSPPNKT

SEQ ID NO: 970812 - protein, 262 aa, Homo sapiens
CHRRRAGAVHATDRSLRGKIGRNIPLPPQGGARKCMSVAASHSVGTPQSEARGGRAARGVGARVGGRTSHHRRRETALCGEAPPPSHLGALDARGDACSHRRAEPGTCSRATRVAPPARGSIARPARRVAPCGIAPARVDVREHAPPEWNMFVRHAPPRGELEEKGPRLPSPQKKRRAPRMCRTPRGDRNAPAGNPRGAVATANDAAADRAANGRASLCKKQESFTERFHLPRPTPRTESLQRARVDPTPRVGQKSATAAPT

SEQ ID NO: 970813 - protein, 271 aa, Homo sapiens
RGYVFGPVRAPPLVVVRHGGVAPAFGSAGGVCQAPPRVCSRRTIVLLVRRTQRAFCIGTASGGAERASLSTCPGWGRGTHNLLRNIVCGARGSSLATVGAHGLPLRVQTAHTSFLLVPPRTYIVRGVASSRRSSVADDCIPPAAPSLCFSCVGGPSPRAGGGTQPMFSLLSSRRRSFFERRHSSGCIFLRQPRAHTNLFHLPRVCVWSGRRPPSAHHTLACGAAHSRTGSFTRFSVEQGWCLPHLVVPPPRDYVPPAVAFLSRSRSFLRTP

SEQ ID NO: 970814 - protein, 243 aa, Homo sapiens
PKFRFPSLALPPPPVGPPSSPLSVGPHDWEPVSLSDDQCTVSAVHFGPCLFSPGHVAPLLPGLGSFTTHAGLSRLCPPHAAAVYLGLGSAPPVLKIPPVWAPPTRVNALYVFSGGFIPRLLFVSLQPPEATRGAPPPRARGLLVIPPPWVPYGLPPGQVVSLPGQVTLWGLRRAPTDQLVRGVTGSLRPPGVFLRSCVGTTGAGLSPPPISHQGIQHFSPLPSGVQPRFPFDLIRCSPSSPLV

SEQ ID NO: 970815 - protein, 199 aa, Homo sapiens
GKFKCAATNTAPLSSFTSMVTPSPVPMFHPGDIGHTQLPLGAPNHSCASSGVHPVAFNVAGVGVPAPPHHVLWRTILLMEGGTYSVAVAATNNIIVGATTLWVASGELLLRWRPPTNLRGRTRVYLMLPPQPVDGDEAHTSFHTMLGAANKGGATRKLVLSLASRDDNKGRVIMIVGTPLDKIGRVSLCPINNSGATRL

SEQ ID NO: 970816 - protein, 127 aa, Homo sapiens
MPIPLEDDEFRLDNVAKLRVRVSRPIFAGTGPSVRLPPCWQLFAKPEYGAPALPFMTPCFMPAPPGGRLVRAPRWGSPGLTRRSSRPVVSQGSREASTKVARKWKTPPQLEKEICTKKSFTQGDLFR

SEQ ID NO: 970817 - protein, 193 aa, Homo sapiens
PPRLEAPSGTPQYSGSLRLFRPRSLRRLVRTTQGLKPGQEPESPSSLRSLSFDPTGCVTIAIHAKPGSQPNAVTALLFPSSTIGGDSGGRFRPGSLTLSPRLEPRGTTSGHCRLDFPGSNHPPTSASQVAGTTRCMPPTPRLIFVFFEETGSRHCCLGWKSWASVILLPWLPQVLGLQAMSPCAWPELFFLLY

SEQ ID NO: 970818 - protein, 233 aa, Homo sapiens
VSPHPGLVRARPAPVVGRLGWYGPLRPPWLLRCVGAAARGLDGRPYALGRVLCSRAEIVLSFARRNMWSDAPCLGFGAGVRGSGAPSLLVWLHKRRGWGATWLWGWNRPLRVDRVVLVVRCDSVLADARRASRELLIGPARGAPTRSDAVCAGGRLDSLGPCSVPQGGPAIQCRCQRWYVFLRDIRPPVNVRFLLFRDSARLRGATLRCVTALPGASHCGLRRVDPCGHPVLG

SEQ ID NO: 970819 - protein, 135 aa, Homo sapiens
AGKHTRSGNTHRCVRPTRKEWVTLYTTLETKKYSRTPSWQESTGKWYKHELPFLMGDYFNFRPLSGVFQRCPPTPIANAHTAHNHSGLFNHLVKNQTIIPSWDPTWDTISYSRPPHMGDFTHIHRAKLAGDWGPE

SEQ ID NO: 970820 - protein, 289 aa, Homo sapiens
MLDTELARVVPYILATRSRVHVCPLSALGVLYRGHQVSGTSLSRPRVHGTRSLRGSTTPGGTPRICPGPIFSRGFAFFSSSASRYVLYLGHINHPEGSLPTWQPKVTLLSLSSRSLPFGEQPMSAVVAGSSPNWAFDAGPPHSVTTRGGVPLQWPGHIVVHPAHHVHATGLAPAAAFKSSPRLFGVQLVIGGPWIVRRVARSLPFTHGDYREPLCLPEKGHTPSGAYYRFLSPGPPHCLVRAPHSCDTGEAQLNCSPPASATPLLSRPSEAPQGPPRPTPNPARLFPKI

SEQ ID NO: 970821 - protein, 202 aa, Homo sapiens
PQRAVAYAHSATKVLRPDKPVRPTAGFSALWAFRFPKGRHSLSPPGAQNPDWAVTPTLRLFLDRLPPKWPPHLFACTIGTVIFSGIHLVEERPTQGVPAPKPRGLFRPTAPGFSPVYCKKRATFPPVQRTQRDAVWKNNEENPTFAGLHTCWRCTQFCQPVVLTTVVLLDKKAEEGGTYFLRDVQAVHHNRRSPSATGGPLT

SEQ ID NO: 970822 - protein, 315 aa, Homo sapiens
DCGRDTLWEARAIVRCADPISVPLCRSPHILSGFSPSAPGIFLRPAGGRDHPTAPGGLWSTTPGATSSGEPLGLVATSVAILSGHLCAAACYSPAPSLHALLFRQSILCAPRGGRGLPPWSDNVLPLLFPPPEAHESLFLPTPSIAHPPLDLPRASSGFSAAALWPAPPALAATQWGRPAFLRRESRCIDGDASLFAGLTLGWCKHALLWLINKQRQKITAASELRRGHHPLSLPPADFSVELVRARQDIGEDTLGAAALPLQCHWSAAPPSVPTPHLSDEQRVASTPCPPTNKRRKCPPQVNPFRKKKFSSHKT

SEQ ID NO: 970823 - protein, 226 aa, Homo sapiens
CCRGPIHCLQGSCPPWRYPWLISMALLSSAGLCPCLAITPVAVFPQFRTVSLIAASRPPSGRFLRASLTRMPCASSDPGFLALLNPRVATPPLPGARCLLATPARARVTHQYAFPRSWALPHPLGITKGAPPPGLFFGVTWSPGYFCPPVVDPFPRTPPLAGPRCMCSSHTGFSPVVSERVSRVAFCREVLDPQRFLRRVTRQCPSGPRVASCDFTDSLECPPPGS

SEQ ID NO: 970824 - protein, 102 aa, Homo sapiens
MVRGKHPPGSGGSFQVHPTPRERTYPGRTKDQTKQIYSAGGSYQKGTRGTTQSPGASTESQPVVARQMLTEGTRSIIPRVESPRPPLHDNTVVEQHLITTWL

SEQ ID NO: 970825 - protein, 235 aa, Homo sapiens
NRPVRVLCRGVGGNNPFWVPGTFFGTGPFSWGEVFFLKRERGGSSPSYHGAWLGTERQNKRHWGGEPAQSLLLGALAAPRRRDDGVCLPWRFTDGHCPPMPRGTQQSVLSERQQRLRIGGAPPHKVGGDNSGLFLLDAPPTLGAGNGGLSTILAPPNKVTQSVSPAPLAVSRAPSHTAAHILIGAHPRGFLGGVHHGGILWLLPPQSEALFVKGYAKGVFHGEAKTGEPISGEVQ

SEQ ID NO: 970826 - protein, 170 aa, Homo sapiens
MANLGFKAVSFHPRFPISAWFPPHVVGTRPPSKRGAAGSLIFPVGPTPLERFWVPTYPGRRASAAPWDASPLCVYTPRGVLGTPSLPGAGFPATRFPLRASLEGTAQEFLPPVIFLVPPVVSRGGGSPELFPGLLVLLPPKDHALGSSPTGPPNQFVSRHSAPPIRPPQA

SEQ ID NO: 970827 - protein, 275 aa, Homo sapiens
RGPRGSGQCFVPPLCLAGWSRLPPGSVASTIVIGERPPVLSPFVGGTHADGSSVGAPGPPAPGVVLSPAAARFGVKATTRRVLQVVHLLAVVCPPPFCPRGEVCPQGAAACPREQPCGALLIAPQRPPISGAARAPQSQRGPLGSCMFSEERAPPLAIPLATPGPKGWVRPSRRAPAAPLVMILAARPVVRSPHPAPWGDTLVVSCCYWATNTVHFPVAPVETPGATASSSPPPALVSRSPARGEPRLSCQDHSSGHLRRHPPFGSPRQDHGPLK

SEQ ID NO: 970828 - protein, 113 aa, Homo sapiens
FALSPCFAPIRSLPASQAMSLLARVPRCMSQMLGPPVRIFPPGPEFATQTGGPPPPTNGGSNRPAVQAFPPLGCGAGPTILMLLWASLPFLHIPARVLSRPPPLFRSEYLLAQ

SEQ ID NO: 970829 - protein, 300 aa, Homo sapiens
LCVGVSDLYALTKRYWSLPPVVPFTNLSPSCGFPCGLPLVGPGHAVPYVQIWATLEILPPVRILTHIGGPYNSQRWAPGPVQPPIRWQSGPPPEFLPGCHPSLTRPVLAPPYSQSGLVAQTPRLEISVAFRPVDGNSRALPASSGQGPAQPTGGPRDSLISGGRGNTTMSIVDPSYPTTGLPSPGCVPCLSARGGRVQPPSPGQEFPPQVRSGFPPWGAGILCPVIFRCAPGVPRRQPPREVFPGGMGAWPARQGPGGFTPRVSQHSWAWVYTDPLSAPRAAKPPGLAFFNPKSPPFHKS

SEQ ID NO: 970830 - protein, 103 aa, Homo sapiens
MVGPPPALLNSTADFWGLPRVSSLSSVGPKRPPPPFSMSGAIPGVYLGAPIPGHPVLHFLCVPRPPLGGEFLPPPPPRCRQCPCSAPRCLSNKSWGGTPPNHN

SEQ ID NO: 970831 - protein, 89 aa, Homo sapiens
MGTNYLGAGRMKPPLRETEILKGAYSAKPQVPGRLKQKTIVQILAQFSKSKHTFFLKSDKSNLRPPKVVDPKPTLGHIGPKPNKKKMNK

SEQ ID NO: 970832 - protein, 154 aa, Homo sapiens
RGVTEINAGEHNVGDTRDESQDVHRNGLLGTTHRSGEEPPRGQSPPPEGELPPIARHTYRGSLKLSRQNVKEKCGKNPASHQWRANIESLLTPLGTERPARGDYPQAVQWDGVTNHLYGGSFQVRPPRVVYPIDKGGMPLMSENEPGGTSITRV

SEQ ID NO: 970833 - protein, 173 aa, Homo sapiens
FVGCCLGPAVTVWLQWQRRHSEGEASSAPGCAECYLYGVRVLAAVSCAAVEPTPSGRRQFFMPLIGASSPAPRARSLGESPRTSLLCSPLSGLPLLGLRHNHPGFSPLADDNTVPRPTFLSAHGGACWWWNTRGHHVLGPRRRPSPSIFGGARAPFPPRSSHGGTKQGLCGPL

SEQ ID NO: 970834 - protein, 165 aa, Homo sapiens
MCGWGIFVRRDRSARVSPPGFLTPLGVFSLHCRPPFLAGPPTSLLPTFTRFPVRLRAIPGFPFLPCGADHAHLLLNRGPFRPRARPGVSRIFTPHTPPPVCSLLRAAPQAPRLCGANSFISRPVGTPSPSLGTLSSSRRVAPRPLTAKSPLTVGVGFHGVSSFRT

SEQ ID NO: 970835 - protein, 80 aa, Homo sapiens
GVAAWYKLVGPNTSKSWTHFKGQSPSPLRGKRIIRPVPRKREPPPWFAPKQCSTSCCAYETAQDPRSCIPETARHRPDVG

SEQ ID NO: 970836 - protein, 119 aa, Homo sapiens
GLCHVRALQVWVWSRPLMSLSRGAMRAFAGLSCGIGRRCASVLVCADLCLAYVGPFVYGGLQVCQCGQPLEVGFISPAPLCPDFCRPPPGRGLRLGGGLRRGVGAGATFSEAALFLEMF

SEQ ID NO: 970837 - protein, 121 aa, Homo sapiens
PPRVIYAKEVRQLKLSLPRSFNPVEPRPPWENTRWGPITPCVPPPPVSQPRVNPRSLLRYPDFPALCGRVPLSTFALWQAVVPPEIVTYILGWARTVCPLALSYHPPHPPRGAKNVSPHKT

SEQ ID NO: 970838 - protein, 62 aa, Homo sapiens
MTNMRQQKVTYRSNIKKTRISPTCGEIWKKDILFPKHLVVMKNPPFQGSKKPSKKNFQPLTK

SEQ ID NO: 970839 - protein, 94 aa, Homo sapiens
MSILWPHQPHQLYTLLTAPHKSSFCKVRDTSRLTFKGLPIASSFKDDSVQYRTPANNTFVINPHQAGFPTSASPIKNPVPGVYRDSPKNKPPHN

SEQ ID NO: 970840 - protein, 103 aa, Homo sapiens
MVAHRRCDKWPDCSPPEGGGPPPTTTRRGLVKINKSSTNRVKLQKLSPNNAGDMRSTACMRAQPAEESTLVLRDQYDQWPLFKSTGLEKYKQEEAPLLLVGAA

SEQ ID NO: 970841 - protein, 298 aa, Homo sapiens
AVCCRSMSAGREAQLSGFPVWGEPGYPPVRVLTAAPDVCVTRPPYGLRLPPPVVPGPPSVSCAGEPAPNNVWLWRSPPNSQFPRCPWSSGNISARGVVRALSLPGGPPLPDTGAYFNCAPLYRSARSLLFRHGPLWCCVPPSPPRYECCHTSWDHTPPPPTPSVTPQPSAGVTPPGGPPPSTPKRAGAPPAFFLSPHPTTSREAKGPSLGPDEACAGAHCVRDDAPNTWPQKRPPAQERGPRSCGTNRGPHKIGLTLPPNMGHVLRIQPAPPARSTPHPPPRPLPAKKGKKPPPPPQN

SEQ ID NO: 970842 - protein, 88 aa, Homo sapiens
NRGAPPMGETPAPAALRHLLGEKTPWPPGGPLKHSGSRWTPPISVRPGRTRWPPPTKGAGRWPRMKTHGQPRYTARVLANPTPLWGIF

SEQ ID NO: 970843 - protein, 103 aa, Homo sapiens
PPRVPRYRLSPLPCRDGSPFFLSRAGVSGPLPVAATRQWAPRRCALGLLGNQLRLYVGTRFCTVVTPFPPVFVRLQGHLELLVDVLTPLAGEGFPLASRPPYC

SEQ ID NO: 970844 - protein, 163 aa, Homo sapiens
MPTVGLTPEEICPHHGRISAPLVGAPHPEMGAFYTGRVCKPPTRVGRGAHNIRFSSSGILPPFLSILPPAVFLPRRPRSPRGYLCGQEAITWLNGFSTTARLINSRPGRPPTTVVPTWPPIHDVWATARVLIFPGCGRNNPGYYSGPRLPTMVLPTAAEGFPG

SEQ ID NO: 970845 - protein, 168 aa, Homo sapiens
MLPNNPHILFVPRTHMGVCYHNEAGSLVGAPNGGHAGATCSPAAKVSGKPHVREHSIVRAFTTVRFSIPNIRTGVPPQHGAPVREKDFTNAPAVHAATHKNSRETLFPKEHPSDVENLQGTYEPYISHFEEIDLSDENITFWDTRPKEGLHDSSSWPPSTRFMLPPEA

SEQ ID NO: 970846 - protein, 198 aa, Homo sapiens
METTPTILVRSFLEPSVRPAISRDVCGNTKDGSPPRVQTSGLPMYFFGPAPGDSCGTRVRFQGVPSGTAQAAGCLSVCHQPWQSAPPGFNPGVLRPKPRRGGILNSSLPQSHLSPTRHRLAPPGEISVTIIMAPDLFKQVVFRGHPPACASRRVREQVFFLGSSGERPRNYPTVETTTLLLSQEFVANKSAVNIAQVV

SEQ ID NO: 970847 - protein, 194 aa, Homo sapiens
RFFCWAPVSGPLPHHGRPGKALFFPGWAPFLAVLSLATPLGDFPPPRSMQSSGPYGSIALSVPETTVVQQAFWLGAQICLRRRLVVPAALDIKPPGFQSGALCLFSHGGFSGHPNRWVIFPGATTSPPAGSSLFLSPIIIRRASVSSPAAQGQGTPTGGFYSPARLSREKAESFKAGSLFHHRTMRGTSGTRTC

SEQ ID NO: 970848 - protein, 125 aa, Homo sapiens
ECVRLAFQQMGHFWWLFLLHNVGQRVLLLQDKCFPEGEPRSPGVPPREFGPLHWKPLSTKFLRSGPPGVAKRGETPDHPTIVAPDIKKSQFAGHMPAAANGRHAAKTNDRNTGLPEQHPYQIQGH

SEQ ID NO: 970849 - protein, 85 aa, Homo sapiens
MTVGRLRSQPDKLRPLCGKRDTGGTYEVPENWHPPGYNTSGKTPRSMAIRKNRKKRYTSSGNKRHPTLPPRGNKPNPFPNQNRQN

SEQ ID NO: 970850 - protein, 61 aa, Homo sapiens
MGPNNPTPVRPTREFLTLGGLTPSYVHAADYEEDSSSQPLLFDPDAPPTDARSELGPPTNP

SEQ ID NO: 970851 - protein, 296 aa, Homo sapiens
TEEIGAHTGPGIMETTHGGGPKHNEHHWVDTTGPLVTVPAPMEDWESNKHTDFPVPGNDTAFHHITDASVSLAPRPITARGNSCPLTLHGKQSASLPRGVVSLAAPGGPTSSVAPPRPPFKNQVGPKQGPFLFFFGGGTHNAEDLGPPIHSPHRGSLPCALYPLPVVDPPLITGESLSSSLGNSLSPANTLFLCGASPSGGCHKISNSQLAVALRAPPLVCLNEQTPTQQVVVHPGEFSGGSPERTNTLGFTHQVATTYSRIGHSSPRVGCPARLIPPPVLLSFLNPKRTPFPPQN

SEQ ID NO: 970852 - protein, 328 aa, Homo sapiens
YAGALNVPQTAEVFSQHALATCATTPRGVPLAHHVCSSDVPRVCVFDWTPYAWVVSRRSNLYPAMDGPSPHSVCQHSLCEQGGSPPHFPQGSTLLVGAPQGHPRCSAQTLEKEPRCWCHSRSGARTHFFAARSQCAPRYPILAGWRLECPTTQPGQRVLSYICSHTRGPGPCRLCAVLPPACFQRLYRYVRAHTRGLRPGVRILRSRVEESWVVSLRSAWKLLCAAPQYILPRRFSYAPPLGTGFPRRSCTGFEGFTLREVPMRYPTDPALSQPRVSPNYTRPGPNPRGWATVQPPKKSPRAGPNSGKEVPDRANKNKSKRPPNRPWT

SEQ ID NO: 970853 - protein, 60 aa, Homo sapiens
MTWETHNLGEPTFNSFRRPRTAAGGKSCHPPPPPPQGRDVPVVAPEQFLTKILQGERKKN

SEQ ID NO: 970854 - protein, 243 aa, Homo sapiens
YCVCCLSHCVVMICVLVGAWVDNKHPHFCDEPPPPRLHDRGETLVPKQCMGLFHRFSRSDRPVCSKRRLGPPTLFVAQTAPLLTPPGRNRADPLIFSVWGHNHMENLGRPEQTPQRRLPTGLGTVLLWCCNPDGEIMWEPPSPGKVYPATQFRCGPSLRGRQRDSHSRGRFWGALVLPRHAHKEICSSGDSCDARQGQRLRRVARHSGRYIVIANRLKGATKAPPLSPPLCFGFLNPKKTPEI

SEQ ID NO: 970855 - protein, 143 aa, Homo sapiens
MILTQRLPTLPHDDAGMTDGRYRPPPTLLVRGAARATGVGVTPRAAPRVFNRLPAGHKCDDKRHSPFVNKSDDIRHPAYWLRPVHAWRSDSICRRRYNTAGGGDGVVGARKSTRPVTLATRAVGRTRLDTRGWPTQNPFAQIT

SEQ ID NO: 970856 - protein, 276 aa, Homo sapiens
MGNLVVSRFTEPRTRALQLALSEQLGHPLGPGLFLGLQQPRSRWERPPTGLLRHCSPQGEIYTVATRHLCSHQNTGVAHSPMRRRIQVRSAPTQALLLLGGLPPNNEEHPPHQRWGEENTALPSVERTPGRWIMPPSRATTMVVGASPHPAGARRAAESHPTRRRQGGGAATPHDCGQWIEKSRDPPPHGHNTPSARRVTNLAETPPTLHPLLCALGHTARPSGISPLAAPGGRSSTPRHHTGGEGHPPPPVHIWKGKLIFNPFGKKKIIHPAPNK

SEQ ID NO: 970857 - protein, 158 aa, Homo sapiens
MREIAHHTGLKYMRTRPCVPNPKKAPTFGGSPTGGRDTPEGHRGVLTPPAKHGETRGDQENTGTIFDVGDVVGRPPRCTLTLARVVTNKNMAVTPGEAGTCLVETWSIAARHPPHGEPRDQTRWPRKKTNKTKSENVLSFPALPTLQPPGKYLNPPKN

SEQ ID NO: 970858 - protein, 118 aa, Homo sapiens
GWNDAAPVHKPLLAEQRPRVSPLVRAPPRDTTICAPGRGHHHRLSLVVHQGGSLDTTRRFKAPPQVRSRQDRRLTPVRVLSARDMHTPESMWVFSRRQEIPPMYRAIHSEEETLFLRD

SEQ ID NO: 970859 - protein, 230 aa, Homo sapiens
FDPAFVNWPPRLETFFPPLFFARYPSAIECAPLSLVQGISGPKKFPSRLQIGSPDQGSASQTRSSSISLEPPNYCGPRAYTDAPQGALVSTHHSGTPPVWLRPPPWWYAAPQFRLFSAGNKVHPTQQRGRGPIVYHRSQLFSHSRHTPRLPSRPAPPCAATRLTPQLCATTAGPPRQSGATPPPLWPPLQGPSTTNVPPPTHGVRSASWRGESYSKSRPLEVSPLFLYTR

SEQ ID NO: 970860 - protein, 143 aa, Homo sapiens
MCRSKAANQVRGLAADTPVWCGGRQLPLGGATDLLGTSPFGRKLNEHAVWAKEHTGAVVVRKSTARFGRYRESIGVPVGHGKLFPPRPSDNAGMFLQPHEVLPRDTPKFFPVECGPPVHFKRVSLGINTRYYPQAGKQHRRGE

SEQ ID NO: 970861 - protein, 171 aa, Homo sapiens
GRPAKPPERTSRSTLRVECPNEQAGQTERDARRGHPRKLVRTNTTAVNERITVGQTRHTAGAVWEHTAKVIQGGPHLSARSGGAPRWATGDRKTSIDRRGGAQRRRQCSAGGTVDRPDTGTAGAPFYGRRIARRSEDWHHRIGEYDNKQRGAQVTGADPPQEMLAYVKDTA

SEQ ID NO: 970862 - protein, 206 aa, Homo sapiens
MADGENGSTTDKRRKTTRHTTTRITGAPPPGDTNGPHILPGGGCPQKSPPQGRKTEIGKSDSLAQYCWATNGAGIGPPARSGSAKPTACLQRLPRHTAAFPGQQCGRPPQGVPQLGHIPRTQTRGAPKLCVEHRGKTTNGAAPREKQGSHVPTVRRKGHTTHNNQFSFSRNHREPVKPIEGDSQAPAPLQPGGSLMPRENSETAQA

SEQ ID NO: 970863 - protein, 275 aa, Homo sapiens
KGREAGNTGSPRSRCLSRGGVLKKRPCRGAAMALPPVITAPVAVARSPDARAKLWPAAGGKGARQRFARPRDLLSPNARMRKAAQHGVRNAHGRHTRDEAVPAAARNDLPTSLGGVILFKEETTNRETVAVRSKWAEDASIRAATRVRGLATEKSSGKYAGCYEKEKLGLWIRRYRHRRPLRETPLLRIRQQALLAEGLAGNLNLAHDPQDGHSLPRMVILKTATIWGEHPVFQGHLCRQSFVGDKSRTMRRAVIPGDTLLANRLGFCTSSLGET

SEQ ID NO: 970864 - protein, 285 aa, Homo sapiens
MAQTRLEPSRLLSARKSVSIRTPRCRSTMEPRCPVIVTLGDPWRILPPHGAEFGTTIRGPPTHNQGRHTRQSRTCPHPPVGRGAEHTYLPRGDVSTVLHMQARFCVAAAIMYTGGFFVANTSPCMSEFCHTAGRLNVRGSPPILVGPTAHYTMGGPRRPPLIFRAGAPKTLESCGHDQSPAGGPPWSLEWVLVGVTPGRAWLKAPLSPAEALARTNRRCLAVSPRRSAEMSPPRVVLRQPHLGPPTEGESPRQMFLPAGNMSPEPPEIERTPGALHTKGIHTTNE

SEQ ID NO: 970865 - protein, 293 aa, Homo sapiens
MSQRLLCAAWDNSGAQYRGVRPQRAHVSTGGNSGGKNASKWAHGTLEDEAFAYTTRRATPWNRGTVHRGCCGTRSAGSQVFWQDNAPSGAQGRTPPKGGTQRDRHPVTPNSGGPTSHFRPPGVGTHAVGHRARNNRFHAPPTAGAEWVHDNQNKPVWLRQYERNSPAPSGERFHGAPCPSPVDVACSMNVYADNVRFLWEFSKWHISTIMEENQGGNNPTCTLRRREALHKIFTGELTIFRERRLSTVVCPRTPRTAEEKFSLHPAAPRAGGKDVQRAPSGFNTNYRGNPHKT

SEQ ID NO: 970866 - protein, 113 aa, Homo sapiens
MSPLTTLLNRLEFVTARSLPGCSDPLCGYNEKRSLKELFKAPGTMKPHSRQRSYPASFSKNSTARGVLPPQTESVCYPTRRDHSYSCMVAPPVAPEPPQGGHKTLLRQSRGVV

SEQ ID NO: 970867 - protein, 201 aa, Homo sapiens
RGPSRCLPGIAFPRAPKQPPNGGPKLLPPHHGETKAPGKNPPLARNPGERQGHTHTVGTNKRLRTPSWTRSNGQGTIQHCLRRQCIDEAAPHGGRLQGGPPHTEASPNRDYSDGNLMEGKTQDKKKPGGPKNRGKHKVRAHPTGGLTRNPRAKLGQTRDSEEKCREADLWARRGQVPAARIPGYKGERHSRKKFFHPRKQY

SEQ ID NO: 970868 - protein, 182 aa, Homo sapiens
DRNLNTTFFDPYGGVRPHYYTNTYSDFSVTLKSIFLSLPGYRTNLPYQYTYYSGNNETQGHIGMVCRYDINRLSYGIIVWAHHIFTRPNRRRHNEPYTHLRYQIIAYQQPDVQVYQLTRHTSTEAPYDLTPTADELTEPHKASNPFPTSTRSQMDPDNGTSHYSNTPNQPNNHRTYHRHKNQ

SEQ ID NO: 970869 - protein, 65 aa, Homo sapiens
MNGEPEQLIKQGVAKNPRKPRIKIANTQKGSNKNTQKTYTRHTVAETLDPAERCNAKRERYTHNE

SEQ ID NO: 970870 - protein, 212 aa, Homo sapiens
MSVLGMFVCQYAPEGILITLSCCCLSTCQRHYDTTLEKAVPLQILMIAMPKCRMNLSLLRTEPQTSNQLNNRELSDAASGEYHIPACAISLVHQDKYPKCHTPLSGPGLAEHPTTQWARSCRSTITLTHQRMPCRQNCTFYPGWPAPQNCMLSAFDDNPPTKCIKLNPHVAPGPLGCEHGDTWISPISWTFRGTHPFATRIHWPNNSTLSIT

SEQ ID NO: 970871 - protein, 68 aa, Homo sapiens
PSENTLIVIAVYGARPRNDAQGETLWTHECGVLGQGCRTLRKKDGKSTVPKGSKKDFKVYLRGMVLNE

SEQ ID NO: 970872 - protein, 161 aa, Homo sapiens
MTLRTHDPTHHYSILQHEGPALLAPNLDAEHSPGLAYPDNLPTRTCTRAFPQLACVHFFMDVNLGPQYLLSWGWKYPLDTATGLRAPATALAHICLPKPHVEAPGCNHLNFSYLHPLAHLLRQHALQPLCTPPYGTLKYSIVETTLDHHVYTSTIPLSDRN

SEQ ID NO: 970873 - protein, 154 aa, Homo sapiens
VVSSFLNLGEGLFFSSPTIGGPIARVFCAERQTPPPRGVNDKLFCATPPTQLGDQRPGAHPLRRREIFVDFLEEATRAPPCLPHRAGVLKTSVPFTPFAPRGGPVITLLGVSLPGPPPLPPAPPARFLNGSPPLLFLGQPGVYRDASSRKILPL

SEQ ID NO: 970874 - protein, 223 aa, Homo sapiens
MHLMTGYIVILDQCGASLLVSCVGNRCPGMCDDLLMTWTPRGPPLDSSPMWLVGEFSPKGRSNDVATQYSIWYQRLHASRVAIQAQYLTPQKRSIEPIPKSIEPTKPTIRDIRTLSKRSSSSAPLYIASRTPYVSIQATNPLEKRFANTLKIPLSYSLDPTPGAMVMCERPSHVKLNVPHSSVPTRLSLLSPPPLRTAHNRPTIGADTCKYYITGPKRVTLDH

SEQ ID NO: 970875 - protein, 277 aa, Homo sapiens
MNATRLTPSTRLPFHLGSLQTTHCNFHTRHHSTKPPGDPTQEGPPQLHTNPNSRTRGHTCRLTTTLTHVDRSCTSTHQATNPIFYVPQPNARNGLDLYTNSHLPPRGPTPYYTKQRTTFPTRRQQGALYTTRTPLPHIPNLNRPRATQNYAALPSVKHKPPLTTNLATFHPYTSPTHNPPPTVVPNPISHLRASCGNTNTRQRTLRGTTPMPHRPLTSFHTTPRPATTHTIRATRATHTANNAHSTPPTKHRSPHHTHPPPPNRPPPHTYQTHPPQP

SEQ ID NO: 970876 - protein, 236 aa, Homo sapiens
MSQAVVHLRNSLRICSWCVTRGDTHDCWHLIYRLTVITSKHRSYFQGSSCPHLVGAAYPIYERTRGLHLTLARNSGESICLRWGTHNLRYQNVRHARATLAKIFLVRHSKREMLGSHGGHTHEILRILRSATHKGANSVSSYLLKAPGRCNRTLRLSNNTCFTYRTGMNLHSHQSFSCAFCLVNILGAAARKVHSHGMVKAACNYATRRGFNGLVQGPRVTKVDPPTGFISYFNRD

SEQ ID NO: 970877 - protein, 107 aa, Homo sapiens
MVLAATTSFLHTHMSAYTYATIDASTHPLNTPPRRGRPHPHPAFFNNQVAPAGAHHPHTTPPHTPIAQPPLRGTHSPCQEPTSRASTTPTHAPPHTQRASHTRRAPL

SEQ ID NO: 970878 - protein, 31 aa, Homo sapiens
MRKAVEHSVSSPKLTVFPHRGIERKANTVVQ

SEQ ID NO: 970879 - protein, 228 aa, Homo sapiens
TREAEVAVSQDSASALQPRCQRKAPSQVITEKKKTKGRRQWALQTGNNPPPHWEQDRQSGGGTTTAKRTREHSEESKPCGKPTRRTSSPSLTTSTYQQRDAATHDTRAHQPARHRQRNTSRGAAASLLVSTKNILARENHHWVMRLHNVARPLIVPPRNQYYVPVVGVTPQTLVRSNINRTFVDIPAHSSTHPQNALIIARLDYARKRCAAASRQIGSDTKLTRHIVY

SEQ ID NO: 970880 - protein, 160 aa, Homo sapiens
VPPYCSPYGFFPPSRGRSFCVDPRNLGWHHFEFTSGPRKIPGSAPSLARWPRDFRCTPRGGEGPHEHKHKARFTNQPFVVTPARSSFPKSKKKKRPRPTGSNAVYPRNLGRLKRADHPRVTRILRTSPGQHPWNPLLVLENTQVAHAMLAHSPYPRYSGG

SEQ ID NO: 970881 - protein, 361 aa, Homo sapiens
IPPTQETEAGESLKPAEAAGCTSSLGNGRLQTPKTTQQRGTKDTYHAASQTIIIYNHSSYTQKNPTVHQPTKGTNPEQHPGHRYKEPTGGAQNQYQTKHTTRPNKAPQTAHTPRHKTKGRHEPERTRAQDKREQIHVPPKVNIHPKTNRYYKQERRRQHQTGEERKHTQPLRQCHTGHTNHTQTPHKPKGHHKPNTASKHHPAQEHNAITTTTQNTNHTNYYPIDRDPTEGGDAGDNTDRHNNPPEADHTKTRNVAQPQDTRDSNTRQKAEHETRRSETHPRRYTRHERKAPYQATRQSTTAMSQPNHKEDVEPGDHNDRRPSNKQSRQNPIENKQQTQKTATKNTKRRNTRGTRRRRTQN

SEQ ID NO: 970882 - protein, 167 aa, Homo sapiens
KKELANLAQLEALYQSSWAQPVSEMVGRTVLFIKSVLCTVKAQACNHSRSNVHNTPYHLSLTLRTKLLFTSESKHHCNMLSTHLQPVSSIGHTLGGSSRTMRNGYPEQHVGRSSLTQAARASIRQLPQSPQIPVGSPTKSTIQATLTPSAYEIYTLKSLITTYTQQY

SEQ ID NO: 970883 - protein, 319 aa, Homo sapiens
MTHYPVTKSWQANATYPVNHYHEKNSTISYTTLPTHLLELKPFTATELIISISFIRNHTLSPTLDYHQPDEDNQTERLNRQAHTSYCYTLARLPSPTHRTDNTHNTLGSITILLLTLTAQRHYPHILTPTNLTTDPAHTNSPNQNTHTPRQGNPQMTAQQPSQKDPHIARDQIRYTGQQATSYNTTDGLKKYTKRTKLNHQNTRQHTHQDETTPGTNHNDHKDNTSNSHTHTDTNPTDTHTRTKPKHHKQTTHENTAGTTPTDRPTTNHNAATTKTRTNDHPTQESPPATDSQPVAHKQKRRATHQQQTSTNHRTTADA

SEQ ID NO: 970884 - protein, 86 aa, Homo sapiens
NSFRLIFTADPCGTHIQQTAYGHRRTFYNSPPGLQPPLQVGYNKNLISDTTLQWRLKIPLLQRTLLILRPHQIVLFVVTSLAQTVR

SEQ ID NO: 970885 - protein, 71 aa, Homo sapiens
TFSPVNSGQPPNYEMLKEEQEVAMLGVPHNPAPPMSTAINRGDSVCHVSGPCQHLFMNTVPGLHSIAYSVI

SEQ ID NO: 970886 - protein, 111 aa, Homo sapiens
MVKMQIFGKHRFTGKTINLEVEPSDSDLKICEGMDPVMKEGHCHTSRQRLIFAGKQWHRGPQVVSELTIIQKGVDPAPGYLRSEEGGYAESFVKTLSHDTLVTVKRRIAYT

SEQ ID NO: 970887 - protein, 101 aa, Homo sapiens
MGYSLHYVNFVEMLVMCSNSKYGWATVCVSLRRLRYVTGYAEDCKIHRKNVKKEFFYCEIWGNVEQVRIGLVGVKALRGYAFNLGSEKSSEAWAKYVGGQM

SEQ ID NO: 970888 - protein, 171 aa, Homo sapiens
HHHHFMSASSLPMQHGLITMPSSLHRGHRHFYAPNGAHFFQPQHMVRTDQSQPPNGEFKGACKPYEIAAICSLKNCQPVSSWFHLIIHCKHNYFLQLINQAYIVCSVLIAFGTSVLNSISFIGTGTIFHAPAFCFSNHDHMRVYVPSNQLVNHSVNAPDLPYILISMLNVV

SEQ ID NO: 970889 - protein, 340 aa, Homo sapiens
QQVNVYGVCVPGSEGKVGMAAVQLAPGQTFDGAEVVPGHVSRFVHPMDYASPTHFIRIQAAMEVNRHVPNLMKHTDGCDEGLQMWRIEDKTPHAQYLEQPWPRSLTGHMHGTHNVTNGLRCSRTGTLGRASESTMDHNQLEIRDITTPHDKHHHPKNKTSVDPISNSPWERHLESEIAEAWAQIPPSKPSQVGLGTKWTRMETPGTHRQGNDIHNSREGGSTAKTNKQKNEKNKKQNYKPGRITAPTKTHYHDKNTLVSEETRKPQAREEATQWEPQSGETQGKTKATTQKTSEGHSTPPHNKTSRGILHLTQQQQQQQKTVRQKRKNNTTRKTRRRNLY

SEQ ID NO: 970890 - protein, 156 aa, Homo sapiens
MARCKHEKAHTEGHHDTTWYQKGLRYGINPNKINVRKTTHVRKGQKQSDVQNTQGQSAPKPTKRKEGTREGTKQRHPNPQDTTITHVTTESPRVAIRTQTYSAVKYGQSTASSSKTNMESTTKKKNIKKHNEKASKQQKERHTEHHTERGTKTRQT

SEQ ID NO: 970891 - protein, 113 aa, Homo sapiens
MRHAPRIYHMTGRLFPTASARPHKSPRSRPTEHAAAGGPFHETTETDDRIHCDPRPGSQDYTWNARQRLRRMGGKVPGPARQTDEDRHGLHSGCIDGHAEYGQTDEGQERQDG

SEQ ID NO: 970892 - protein, 378 aa, Homo sapiens
MPSKSPPTEGTAAVISDSDGFRTRKGQTYTSHKQHDSSRTFDQGCTTTWAREPVQKSTARRALVALHNLPTHDNSHTELYLPLRGIPIDPNGNYTPSLTTRRTGSRDKAPPTHTGPDSLPLTGPDPTLNNPQSPPLSDPPNQGPARTWGNRRDATYRSNLTGHTKPRRARSPTHHQTRRPPPTQNEPRRQPKPYTTTLPTGMTTINHKVPPGNPAPHNHWQPLAHQHTPHLRPTPHPTQPATPENPPRQSPPRRHTHHPPKQTHTGAISSPLPTSDHPQHPPATLTPSPCPTSLTLTTTPLLAPSRDKQQQDGQTTPQEHTRTHPIGPTTTPEKTIADRGDEQQSLPSTNHPTLTPDNSPHTQMIDQPTHTRHPHTTP

SEQ ID NO: 970893 - protein, 496 aa, Homo sapiens
MHAHCLPFSCCILLQQSQACYAKTHAAGHKDVFLGHVLVMHIMHSTGHPAFTRVVAAAAALCPSTIMHNPRLSSTVLCRHAGSSMQSLMRTQLLRMHIPHTYIVGTAAVQQFSIHNHNIGARFLRSQTLRAVTEISQKIVAHLSIGSPPHMHKSPTKSGPQFPHYFLSNSVYQRKHLQCNKLRPAKMVEVTTIPCTAHNTDKWPVHVTDKAPSIKSATGTPWHTPGEMTGALHHCKKQQTEINARHQHEQTHRMDMHNQAKPHLCDGTHKAPEAPTRHYLTQPYRGTQHSEVATPHTRYPHNDKLTHGLNSTDSHTLTTRTNALYLKRHQAPDDTGDNEPNTTDNNHAATTPAESAGGRRNKRPHTAKRHTKRPQEPLVQEDRQNETTARANNERTRAAKEERQRHGKDEQTEAKERAEQRQRNANKQQHTRRATTDNGTTKSTSAQAPDNNAEQQRAMQQHKGADAEQTNSQRANPRTPTQARTKQHSQQTAQPR

SEQ ID NO: 970894 - protein, 598 aa, Homo sapiens
GGTQVLPFLVILIGIGNICQPSMLVSQHSPIIVNTSFITISSSVLICHTSFSRCFQHRFSYPHILASRHAITISPSFTHYFLGAIDGHITYADNIITLYVNPNPVFLGTTLVSTFLLTTYNHQTQLLTKKICTNHNHIVLATSTTHLSTTHTIPLPSHIASSISIAPSPLRRRRSTHGTSTHTTNTTDTPPNPAKIATRQRLHTTSHRPTNPAHTPRHETHDTPTPTTTRPLTHAPHAAATPTDPVHTTTTRATYRHRTRPSGTHDGGSQCADLNHTQNNNDTNKTQMDHQHQNTQQQQRMATIHARAGLGHPHTYLRLRHQRAARLPQQHPTRTTTQQWLSQMSDPTTPLAHPNADTRLVSPSTTLPSSPTQHPAPAPPPTRHPATPPHAPLQTAPTPVPSATTHNLHSMRRTADTARPTPHTNNATTATHHTNNNTKQSQHARHQTPPNEPRPAARHRSTQPTQAMTDQMAEAPRQPPTRHKDKKRVSERHEHQSLHRHSDTSCMKTSDNNNMVATRVHARRLTERGRTSRYQSKAVRDENRQPHSKREHHYPHYCTKQVVKQRDRQSMCVLLIVAHNEQVESTYITPYFYPEQAS

SEQ ID NO: 970895 - protein, 451 aa, Homo sapiens
MPSISTLDIGQVCAYSGAYTFPPDWRRRFVQNACTLTTSGGIQHPFLTLGLRTHHNTLHTVYTHSMTTYLYLLNLSLTGIQTVHSWFQHSISHSIPGDAFNLGPEGDRQELTASCVRRASHTATFIQSHTFRSHHALTAMGTQHPWDVSHSTDGHQALHTHCVYNHRIHSTTVFRGQQHNYGGAQHNPHTTLTFHTDSHEASNEFTQHLAHTTHTTDTITPSQNTDTEANQQEHNSEAKNRPTSRTTIASTTEFYYTQHHPTEPEHKRSEDPTHHAPTNPSTQRRTHQTVAHPQSQPPPRRATSNQADMRANSNHHQTNNPPGRDQPTDQTYMAHNHRQHERHKQSRQTTSGTNTPSARPTRTTTHNTQTTTPQKSTKEKHTDQDETEHDAPKQQTRHERTRSHTTNNHTQASTKYQTKTPEHRRTRPRDDQEHTEPKNTQRQSDPSQDPP

SEQ ID NO: 970896 - protein, 144 aa, Homo sapiens
MARLSGPFVSPGSRGNNSSLQASSNYLLASNKRKSCSLHRISKALFVSEEEQNSYSDGGLTSNEWGYEKAAVRRDAQYEPRLCTTVKGHLRGGHPYGSCRYLDGVSPIMLEPKYFATGDPRTAPLTRSPRERRSYQSWVYSGGE

SEQ ID NO: 970897 - protein, 449 aa, Homo sapiens
MCSDTFHLLGRSHLGACGQSNVVIATESHRSRQPLQTNNTVDNDYTTPMGTPKQPIGDQRSPIPHRNNTQKHKTNTKKGQKVRDNKQQDKQHRTGAAADRAAWEHKHRRRNGNEIRTKEHAHDNEGAAARSRKSAEESTTNRKEHREGQHNESQTQKKRYGHKDRESRGENATAHSQAEQKPTEQTDTHQHTTDQTDVAEKDPHTPTHRKDTHNRTTAPQEVRTTLRKARSTSQNTRHVTRPKHVRPHKEGGAHNKPPGQNTRADKKTNKQPEQKTKPNKNNNRRTRNGEAESTHGEAREEEAKKQKKDARQRDEKDTRRTRRREAARESGQTSETESEGVKIRNEKGAAERITRRETKQQTDHGQTDTASRQTATNEREKKNRSGGSSMKQEHRSHAEAQSTRGDGRAQDGEADETHTRRTPMETRHDRHAQRRHERGEQKKAKTEEQ

SEQ ID NO: 970898 - protein, 67 aa, Homo sapiens
MPIVPEVNPRKNRWKKGPKLPRLDHVIPLNGDNSCHTTPWAPPPKDRQGGEAAEEQAKGQTGDRPAK

SEQ ID NO: 970899 - protein, 145 aa, Homo sapiens
MEIQVQSSRSSKGGNISKYFMRHCGIECVNYRKLVTFPVDITVGLHCCHPKLKLWTSVLSLSGSTLTTLEALGQKGDVVTPNWGHGASHGLAMVCPQRLENQGIYNNKANWLRPDTYEGRFYKVPTQAQLTLEQNARCNCERTYL

SEQ ID NO: 970900 - protein, 41 aa, Homo sapiens
MVDPHGGGGRVTQARDSHPRLSNRENPPKTQTKNTSGPPTP

SEQ ID NO: 970901 - protein, 96 aa, Homo sapiens
TAQLLEIISMTYIKVTSDYNYNGAYIDHTCDAESLHHMCPSNGRLIAVSDLPLTRIFLSYKVQECVSTSLVPTGVTRGTPFAMVLMGTIKMKKHVR

SEQ ID NO: 970902 - protein, 362 aa, Homo sapiens
VLVNFFGRKGTVLIATMARGGGRGLADTWLHMLQVICTQLLDKFLLVSQGKQSTAQRQQILQAGALSHTTHSKHFYHLASWQELLHGQATTPHHFQSAAHSLPTTVLPHRLSCKIQTDTQEQTHFALSQTPGGLTNSNLYGVYDHGFMRGQHNGLYTVINHPPIVHNEYTADRLITISRPFSKLQLPCTNDHRNAHSHLATIGTRLYFANRDFTSNLISPFPPVKTLESTKHSSFTPRKEKIQTPPAGRPQPGQYPHTNTTWQAKGRQSSSTCKRASVRDIEYTPIRTTTSTTGHVKSSPDARKAPTATPAHPETSDNYHTDIFRERPHTPENHTLGAPNGPATERHTNSSLLESLSHHPNA

SEQ ID NO: 970903 - protein, 334 aa, Homo sapiens
MSRSGRGFCGSGVPDKYVMHKSGIIYMKMKLANFFHEDERTKTFIKICCILDETSNKEQTILNTAVSQHPFSFNTTHRMSKQSQKTDQQNFIRNQGCTSVMHRRPYERPTDNTSPLATHFHDAYCNHPTGLLESHELATPTHTLTSDSHLTYLHTIQPRTTPLRHVCDPLGTYPKNKSRTTLTLCYTVLPTIGEPDLFHPCSGGYTQKYPPMPAPSAPRYQCKHHQTHIAVIPTRAYPCVPQPPDGTATKRTSMRQNTVITTRTTTVRTGTPHQTTHIAHTLSTRYSFDDNTDMPHLIPPILIKRPPPNTLSTCRTQTLQQQLYYYNNLISRYY

SEQ ID NO: 970904 - protein, 87 aa, Homo sapiens
QPRHAYWPTMKWDNLYTFTILSYSISLGLSFQEELLLLRSEDNATQQTLTRLTQIRALTQIYRATTRTHTSHTKTPIGDSATTSGHF

SEQ ID NO: 970905 - protein, 456 aa, Homo sapiens
PVLASCLRPLIELSAYPRYSICLSVNSYSTGILSRIHSTSPGSAYPLHPHETTQVHLFHIQPWTPTHSVLEQQQLIPQPLRTRSLTLSLNRNTLAEQQGTHHPCLSARIHAPPSEPEQTSDTNSDLEALKELRIHVTAPAHGIDTFGKTQNLITHTRPHRSVQIYPSTRARSPPPQKSHQHVRHSIPPFPLPPFPIATEDLQYSTLLSPLTHLTQHNQTPIHFETHFSTTIALKFHNTLTPTLLRTRNPPTNKAPTTTLNPPHSSAQNVLHPIHPIAPPRTHTHQYPNASANPLTHNTTTIHSPIRPHISSSPICPNTATPRDHSDNQHHSHFHHPPTRHSNVALHTYNTLPHTLTNVSHARPSLTVEHTLINTRSSSTTSQDFPQHPEQLGHNAPPYQTEATKAHPPNQPHIYPTPAKSGNITRQHNASSNTVHHTSNSIRRQIGRHYNRPPLKP

SEQ ID NO: 970906 - protein, 210 aa, Homo sapiens
MVSRHNPTGQAIITHNCGYYGNIPYAIDKALKHKSFVNYSNTFRLVRRHIQQHLRGYQYPFDTTLAPTSPWGCFKMAELTFDHYTYIVTRPLSNNNSKKYTQQPHYKVTQQLNSYYMDIPSHITATVLNAYNMDFYDGNTNCAVMTVELGYRSKTISLYKDKTVYYKYQHGISPTLLRHHYLHTWLPRHEIIGLSAYQIGGIRTREPTGA

SEQ ID NO: 970907 - protein, 71 aa, Homo sapiens
LDMLVWAALSDVAEHCVKDSRWGALDKRGGRDFAKMFVDVVAPPCCEKERAVNSPPEARLQRRGLRIAVDS

SEQ ID NO: 970908 - protein, 235 aa, Homo sapiens
LRSLWHGIGNTGTGTDIPQAHMAGQDLSHSPFNGTRELYGGLWLSELTYVLTAAHSIHMMALTTGTLNHRLTRRRGAQRDPGSIEASSLISPQLTTINGNKQNQRHPEITLTIDGTPDQQLNDITLTHIGQALIQASIIYYPLHREGKQDPSLYERLPTEDKQLDKPITTGQTPATPMTHRDNQNDSMAQTQPEQTRTKHTARDTQNTDDTYNHQDMQAKHNKAPNDDNNDGPHK

SEQ ID NO: 970909 - protein, 382 aa, Homo sapiens
GQGTFKLVELANIPFNHVICLTNMSWRITLSTYCNTSRYIIISYGPRPLHSNHFTTSHQSMHHHQAHTSQFSLICAHILFIHPLQSLVSLCQISSQYYLHTHSSAHLKSPRMFNAFTHTPRACNISAVSPSPIIGPPHFFTLHQGRYTQRWGSRSRGSNTGSLPRVERYTPHCYTANSTTESPNPPTEPQYPVVALHTIVLQISKRKNTSDTPIIYTAVAGNIFPQQTMYSYKTFRNSRAPIQPERILPQEDRVLPTLSSTTYSIVYDHTTIPTFKDKKGTYATSYGEAHSPATTLHRRRDYTHRGRTQILTVAPHAYHPTSADIFQIDNRKSGSNFLDTWADGISRYTSTHFVVKTTHHNSIIADTRQMSGQTHLYSTEDN

SEQ ID NO: 970910 - protein, 148 aa, Homo sapiens
MSWSLHPRNFNSLTSHALFIVSRSNHGVSHMFATQQTNVLPSYQHDTAFRSAYLVQLTWWPLQHFPDLTSSTHAKVSNKRILPRTSWQRPSSHPSLTPPQHHQERQPSLASHQAKSDTPLCIHPLMDIPIPKHSPTITRHPATACRYF

SEQ ID NO: 970911 - protein, 459 aa, Homo sapiens
MSWSLAPPEFNSLLLCSLITLFNHVSAIMLATQQHNCCIFSMQSIPVSILVPTHLWPLASIILVYLNQHQTISTKRLYSIIVASTICTVNALHTRKNISKLNTSVTNKPIPEHPHSLSPCMHIHQQTNIIASARMAHACNVPGTHWYRKQELCNIMHSHPDNDTPTQCTSHRVITDLLSGDANTFIFNVSTPYKFYTRRTPHHTSDDPVGKKLRHPWHVKAPPNAPRPIAPPKMPTTKDSIEHIGEEKKQPEQENIYWHTPMAGATATCNQPGTRNNTEKHNSRPTHTLRRRATAQTDQPINQEHTPPNETCKTTRKQQTSQSRPKHTKDNYQTPRNEFNIEQTPSTDSHSTHTEHSAVATTHATREMNTSRQHTTRDNTGYKRQRPTTQRPRVGTNTNNHTRQTATTKAASTSLTRPSKRGNRSTDQEAHQNRLNNIKQDKQQTSNREDHTQPTTGRH

SEQ ID NO: 970912 - protein, 65 aa, Homo sapiens
MVSRKGNASHQARTEQKMGGRKQLAEHTRQQQSKEKTRAGHRTRHNTRRPTRANSAQREKPEQTG

SEQ ID NO: 970913 - protein, 131 aa, Homo sapiens
MSWSLHRPELKYLYFYALLISLFRMSEHMLLTRVQRAAILDAQIRIVIVQSTCGICRFPVLSCTRNQEYDKDSTVLLEEQSYIKLKTKSIRSQTADNKQSKSLIIPDESSEANMIDACYFEVSRKNVRNEN

SEQ ID NO: 970914 - protein, 336 aa, Homo sapiens
MPSTLYHLAYSSPKHPSTDLDSLPFWQLTLTGGLGHAPSPLPHGMAAAAPTLRLSPEHHALHQAKQVGTLCRYNNTASTRSLLTLQLPSAPSPISRPFRLASSHLPAPYLLLLPLDPRRTPPLLLSPSPPALLAQRPTPPPLPPHRTLPNTALTLTHAPQYCHERAAHRDPPHPPPLPTTHAPPDPYSRLPDPPKHAYPATHPLTHHHPHRLANLPRSRPHAPHPRTPPAPHARARTPRPTRGAHNPQPCAAWIRTPRSTDRPPTRRRTLAATHQTTHHRTPHHDHPPTPRPKEEEARNMSAEPHTPPPHTRPQHGPTPPTPDAQQHPPTMTTHPT

SEQ ID NO: 970915 - protein, 214 aa, Homo sapiens
MTAQADAAPGWYMSSHSGAIRLVNLKRTIPCRDNQSSERCDYLPPNEQKWPPAAQEPEGRCARFKSCTKSGRCDSSVQCNYRSPDLTHRRVTTMLNDDDYILTFTGPDLGGTTPTPEKPTAQTIYYNATTQTRVAFPSQPRLTHTRHTTDPTSYGRTSQANLHIINLQQTRRLAPHATTYHRGTRKTTHKSNPHCVPTPDTLADDHGPPPPPQH

SEQ ID NO: 970916 - protein, 223 aa, Homo sapiens
PERFFLSVAHMGTLRIATCDFSVDHAVPGGTLPAARTVCPSLKNAAFLVSRGIAGNKDLSYRAAHLVPVTTLPEYGGQVRYGLIPEEFFQFFILKLVYTGPYVTRNWAYSCYALSQEIYVIELQRPSLPYTELGVKVYGIPKYGPFVADFCLLNSNRGKKQPQQKEDDARYQSKHNPRNCNWQTRERPHPGTRVQTAAIQLSEAQRHNNDNGSRKHHTSGTTR

SEQ ID NO: 970917 - protein, 133 aa, Homo sapiens
MALSREVKPEHYQRNQQRGYNYGQCSRETREQTTVQGNWTTNKCRYKCGKRARIDPKAPGLSPVEEKTETKQRGARPRSNTRGAGPNKRTAQDAKRAPHKPGHGGHRTGEHSAHARERETARTRGEARSSKAH

SEQ ID NO: 970918 - protein, 83 aa, Homo sapiens
QRNTETTQQATANTKTTQESADSEEDKTTTHETGAAETEHRQRHKSKKKSRRKKTTPKPEKAKERKKREQTQQQNASQNDGQK

SEQ ID NO: 970919 - protein, 95 aa, Homo sapiens
RVPQEVPPRARRQSCRGFQKPLEKWRKPKGVNKPGALKECPRPGKPILSGGPAHNGKWGVPKKKTPARGKRGPHKTPPRKPSGDSGPTRFQMAGR

SEQ ID NO: 970920 - protein, 134 aa, Homo sapiens
FHIWVPLRCPSILVLMRSLPMPPCETVAHKVLVVQLSSASWILKPVLYISSPPLSLVSLPLPLPIDSPVKKHKRGVNNASPLRHHKNTSGAPPGGPVNSFGYPRASGGSYFVHVPQQNGPPPLCGLWRPTRATS

SEQ ID NO: 970921 - protein, 113 aa, Homo sapiens
PGGPLFLGSYSPIGPGLAPPQGGYFRPRGISSHRGGNLLCPPPRRRVLLVDGPASPLVGTPPLLSAIPRHPSSPRVRIPRGIFSSMLPPRCSFYYLGPRRFLYLPHGLGTLPP

SEQ ID NO: 970922 - protein, 120 aa, Homo sapiens
MVAWTFRVLPFSAGLFSHVADKRFAAPYLCLYPGGPCGNSLLSRVPTTGELCPPPVGAAPPSGLLIAIPRAALPSLRVGPPPLWRFTTEAQFSRTVLYAHPLSARVHRPRGNTPRSQSSL

SEQ ID NO: 970923 - protein, 112 aa, Homo sapiens
IVLPHGPAGNTPLSSKPPLFHRHSFFNICPPRLISPLTIGGAGDKSSTFKRHTHNLALIIITSSHRSFQNSVCPPNKALFVRNFFTPQPPRSLPPPFPRPYFNPLWRKSPLW

SEQ ID NO: 970924 - protein, 185 aa, Homo sapiens
LPGPYGLLRRALRAWSHPWLCRGRGPAGTVFAKASRVAAVLPQTPDYVWWAPSPVMAHSIGSCIFHTIEPSIHGGPPLFHGTPLGANLRPNRRCAYLYSLRAWLIRTLCFAPPPTRFSARLSPGCPRAAYFLGTYPADGALHPLDIPHHSLSLQSHSLTTPWIINKIFHRIEKTSSLFETKFPLY

SEQ ID NO: 970925 - protein, 203 aa, Homo sapiens
YPSRVLCFLLLKRIGGYCRNRGEHGGHVRRCVKGARVPAPSCVDVGSLSYQVFVKFWEPMGQPWVEKGVVRTTSYILWRASRPPNCSWARHHGFLMGRQFDMDPLSFGRNWGFVTNVGLLLRWPPEISSSAYQGTPLPAISWTGQALNYVITRICHHTNPWFGSEVLTPREHLEMKWLSKRSGPRPLDTRSYICSSFFFDFPS

SEQ ID NO: 970926 - protein, 128 aa, Homo sapiens
WAERDFPTLPWFHLESLLDLGSGQPDTAVSWKISGVDPADFAPQWRQSLPEVPIPWSFFSTAFWLCGNVVKSRIPRPLVTTTNPCPCGGGTHGIIMFAPHKFGVHWTLLEIRPQFDSFSRTDHPTPPC

SEQ ID NO: 970927 - protein, 131 aa, Homo sapiens
MGRDSQVSCCITCLFYTCWCTTHLWPMSVLPSDNRFGRQWPPMWLSALGPITGDCVTQKSPWTPLVGAPNPGNGPTKCETSGRKDAPCGAYLSRGASPKLWFTGDPARSKSSKASTETLCDKRHIFLLLDV

SEQ ID NO: 970928 - protein, 107 aa, Homo sapiens
MSLASGFAASEFNLVLFRAEGPLWRVCNPNRASPCTCVSSRQRFTVVACTGPPYWAPSPRIRVFAHNIGGFTIPRMFRLIFRGDPPLGPTLAGPNTLLRLSKILSSR

SEQ ID NO: 970929 - protein, 148 aa, Homo sapiens
MHQGFHPLMSFSRPGFFCTLGAWGFNPSQKLFSVHLCEAFLLGSRDQLGSLLFCPLMRTPFLTGGCAQIFSHGRGDILNCPPKGPWGVLGPKNNHEIPRGYLPESFAQCSEDILCALTRLPNNWAQKWPKHPQLTFRTPRGACPLEIH

SEQ ID NO: 970930 - protein, 100 aa, Homo sapiens
LCYLASDQLARPLEIRRDIGHTGFQKLIALSPMLEKDDKIGPVFEKKYVYRILRNSFHHDGCRLALELPKRGTPTKGGKINSLLELEIVEDTHSCRGPIV

SEQ ID NO: 970931 - protein, 281 aa, Homo sapiens
RRRSRFTGSPSGVGADCALQFRRQFPVGFRGNGSSVKRLPFIAFRCLEALIRSLVVLAGSLCSSLRREVVLSLCRFRDEYRVCVFVPPPIVMVLRCPSLSRGVLFSNPAGVSGRSLSAPNSLGAPHWGRVPRGRVPPRSARAYFSTSLHDCVSPLMSLLTRRALGNSLGGRTTSGCEPPRLCAPPAVKYYHSTKRSCTLNETCPTTYGLNHNAISRSRRKPKPRCRPRHHTRGVLTSVTILLNSVDAQPPPFHMSPPPTKLIPPNFLIGALFSPFPPLSPF

SEQ ID NO: 970932 - protein, 71 aa, Homo sapiens
CEVGASTREKGRGYTGVQMAKPVDRDVVARNNVWATLIRVPVPVNGGGWQEEGTGGAYKKCSASVFQTGKV

SEQ ID NO: 970933 - protein, 118 aa, Homo sapiens
RAKDPPDILRYIFAVLRVLLSEPGECVYTRCSAAQSRDVPRFPRSICSPGPNLSCAPPSSTCQCGGFPASDQLAWRQVALWPVYARVALDRSGRRNRFWRVPPALALDPIRALNSRFS

SEQ ID NO: 970934 - protein, 111 aa, Homo sapiens
MPTARILSCSRCMRGTTATLGYGSYAPEYRIRQCSWKNEDKKGLPKCTIYTQRGPHDVGRYDLRASWVKLGTHLRSSANGADLYGVTEEATPGAFQALHKAVLSHSNEKGL

SEQ ID NO: 970935 - protein, 149 aa, Homo sapiens
MAFSDPFLTGSLRLYRRYSVSTPMALFPADVVVTGLVPGLVASSWLRTQYLMYPVAVPCIFSGVLALLAPGGVFENDTLLPQEAVGPCVLPEIIVVPPRPLWVTTISRRDQFTRGPTREGVRQVFPRRVFWKVPDATLRPKLTTWHTTV

SEQ ID NO: 970936 - protein, 118 aa, Homo sapiens
GVLSLFVCRGVWVLRIGRCRLALVTSDVSWWRVGCGRLLSVTAWLRRPVVRRLFFVRRHVAVVACFALVCCLSVAVSSRVLGVDLLSARCGGFVPPLASRQFVCQLSSVEPTLGGYES

SEQ ID NO: 970937 - protein, 110 aa, Homo sapiens
MESLFGGGPNPHPLNGLMASVLPSCLCDHPQPPGFFSPPRDVSLDPRKLETSWLLNWPQKIRVLFYKKIVPFAFLEEIESLLSKYLAFYKEPTNVNYGRIIPRRSVIKYN

SEQ ID NO: 970938 - protein, 209 aa, Homo sapiens
MPINNLRADTKTVSAAADDSPDYPLDASVHNGRSAGPQSQRLGCHHKPVPPTLQGSKTIEKGPQVGRPAPEECPRQKDINPGPHHEMGWQGKPPARPGPHNAAHKTPGVTQDPALSLLAGIRVQTKTSPKKILWRDPSPLPPPHNNGPPFFGEEKPHTKEPHPPPVVRVRRKHHRPTAKPKEATCKLFIGSEIPPGAVGREKTSRRLQI

SEQ ID NO: 970939 - protein, 133 aa, Homo sapiens
LWYAPCPMLPGPVGGWAPILHICSGVRIGRLRGPNCMIWGFSAVLCISQGPPTLRRARALGLPTRCPQKCPILGKLGPLWDSKALGGNPQEGGVHAPQRMWADSPARVAQSSPKRRFNSGAQKIPNFGRTPAL

SEQ ID NO: 970940 - protein, 158 aa, Homo sapiens
MRLAAFLFVSAAAIVAPSYSYVLRRNLVPFPAPVPSPGSNAAPGFQPGASPSWDANPWAPLSGPFTQPPAQILRKGFYSPGPSFTEGPLNPRLGGTPPPLVCVCPPAQPEGAVFFQGCTLTARARAFCTAPLPDVPPGYVGHFSHKILGGPSTFAQRW

SEQ ID NO: 970941 - protein, 193 aa, Homo sapiens
VLSVTTPHRCCRRVFGRSPVGPSFTHDRVVARRGLGPTLLPAGFWGTTIVNRWALPVAGPPLVAGLLRMIPRLCVTTPSPRNPPEWGFVFWAPSCGSATRCYWGHPTPWRLFAAPKGGQPYNPRVATTPCGNKTCLNCSRLGKRAVCAPTLLHHTPRVMALTFDTPHRGGALHQRSWVTGGTYLYNGRKGAGT

SEQ ID NO: 970942 - protein, 111 aa, Homo sapiens
MRRMQNRAQRARRNGTTHGTPGANIAANLCGNTRGKRVRCAKHDAGENNVWSTATSAHPTLPPALVRHNGGIDVPARFLMTQERNTFLEKTLIMELPQGKPHSRSTQRDLV

SEQ ID NO: 970943 - protein, 213 aa, Homo sapiens
MLHVHLVSLLIYVLAAIPGAFRDSVSPVNGCLFQPGPPVVSQALCHYTGPYHAPGGSRHGFFPPSRTRGTIIRSGIAPRPRVCFPRPSRDPDVFYEWSLTLPRCLALLLPPASLDWSARGKLAPTPKKHWGRKTFLVDIRELFSGHPKTLQRVVFYTVHEGGKTLGAVLFFNRSQPKHGPKGPLGGSFSKALDVLRNFPHARSRVPPQVGEKE

SEQ ID NO: 970944 - protein, 198 aa, Homo sapiens
HPLSFPAPTTIFHMLRRGLYPPYMCALGQIPMLRAPLNWLLINSSCSKDTHKSLVPPPKRPSFCETFLRKLLRYTCALPPPRFHTPWELLSLANKTTLFLSSHNTASSPLLTKRLSINNSVVHALIIFLLIHNFTTQNTQLAASHFTTTPLTLAHHMQTPLLSHREKPPSLGFTKSSFPPFLLFPHPRNLSRVFPEKK

SEQ ID NO: 970945 - protein, 84 aa, Homo sapiens
PLLLLDAVLLCVAVCVVCCLFGSLRPPFTLGAATGLAWARYCFTIQFPSGPQIRLPLAGRLCRTPRFFKATGLGAPPKVFFSVK

SEQ ID NO: 970946 - protein, 202 aa, Homo sapiens
CSTPRCGPRGFFSAARVFYAPGSRRVHPAAEDFFFLFPLHESLFYWALRKHIGGNPLFLSTYEEEPPIYPSGAEAKKILHIAWGGTSCKLPPKGQPGFCGRPETIQPIPPEENNPARVFGHEVGRKTLALNQKPPHKYGPRNGPRTPRPTAAALAAAGGNTETVPFHHRSPRDTGREPPGRETKPGEGPQGVFKKNLRGPKK

SEQ ID NO: 970947 - protein, 207 aa, Homo sapiens
KLCCERCQHGWCTYRDILVYAIFTPDGRCPMRDAMRDWHLVAHISVLSVRNSRLPLARLGVIKHRPRMLFAFAFGCIVCPQNVMAPHNGALPRPRPNGAHVWCTLKRSPPPENPRLFPSRVFLRRPRPPKKGKKYWGAGSPKAGYRVNRKGPNDARPPGKKNGIGRQVYHKAQGPGDPRKGPGSYHQKNLESGYTERNPIALLFPAY

SEQ ID NO: 970948 - protein, 147 aa, Homo sapiens
MGALVIAREGFHWAAPRKALLNRLALVTPRLLERSPWVCCNEYRANARADFFPALMKGNNSNRGNVPLRRRSVPPLPGNEENTKGFPRNKLTPTRCQYPGNLIFLEPSLGQKANTISCFYTKRRIHPLLRGLTQEGNPLEAFSKPVE

SEQ ID NO: 970949 - protein, 67 aa, Homo sapiens
GAITAPPRCMGPFYYNRRRIVSSGAEPPTFSRAPLGPESFSWKRSYRLWKNEPRFQKCCRNFSEFKA

SEQ ID NO: 970950 - protein, 245 aa, Homo sapiens
RHAGYPRGRAPRGLAVGNNRTLGGPRVRGPPPVGGSKLGKGHAKVTSGSERTPSENKYSGCRSPLVVVARSTPPRGRVPPQRARKTWGAPRDTNVFQFVESHGNTRVPQEVYPEPAPFPPIYAPPSEEESPIQRPHRTLVGVRGTTSPRPPKSPPVKLCYWKMFPTRFLLEKFCTRPAPHKEDLALPEGRVKKNFCSNSQLPYGTIHSPTLKPLLTPLPLKGYIRKQNERIYNTYIQSVFLFRLV

SEQ ID NO: 970951 - protein, 137 aa, Homo sapiens
MRPYLGSLAPLSHGFGTRFLLDLGHQGQVKNLAAGHRVHHDWARPQKPMLGNPFPGLCGPRLPPEYHPAPISDGHTATWPTGSFYESTLSLGSSRFSWSKCAAWSDTRSLHRAPMHLPRFAGVIFREIGVGKPEPAV

SEQ ID NO: 970952 - protein, 105 aa, Homo sapiens
PPCGCPSATRGSSSPVFRGWGAALPRANCSRGLSKTNSFWSFYFRPRLYWLWKGADAPFPPEWPEGVRRARCHHAFFLGECRNHGAWRPPLLFPGDIQENRPALE

SEQ ID NO: 970953 - protein, 191 aa, Homo sapiens
PPGGQIFLGASPPPAGPNFYKIFCPCVLAPVEANQVFSTRGAACWRLVFCATLLLVDTLVYPAKRYTFVEAHRPPNGAFSHIDRFFSPTINGGVFYFPGWSPPHFSGGSTPCAPSPYSPQIARSPTQYFSSAGNLTLSVPPQNVSRHLRIAPHTCHPAYPHDSAVHTHLCYTSSITPLRVQSQFFSHPLYK

SEQ ID NO: 970954 - protein, 234 aa, Homo sapiens
SGKTSVDQNLGPHLKTSENLGTQYPMAWQMGPNQPVCRPERRGPPLCGVPKPGKAHQQSHTVTTKKSLCRRLTNPGPARQKMGCQRRPPAMAESPHKGHENTGEQPDPTFSISGESVNKKPLPQSFNREPFPPSPSRLYAPPFLRKRHPSRHHTPNLFETLVNTQAPGPPKTPTWKRFYGRILVHLCRKMPSRPADKETPFSQGGLKNTCCRQIKLPLGAYNYSPLLSNLRPLP

SEQ ID NO: 970955 - protein, 104 aa, Homo sapiens
MVWRRIVPHLLVTQSRLYHSRLEEVFHHPGGSPQEVFICEHPPARPIIFSRPALISPQFIWGLFILPPSSLRVSSSLPSPISDGIFGSTFFVTTQAFHRNFNVT

SEQ ID NO: 970956 - protein, 158 aa, Homo sapiens
NFGAYRLIGCAGGFPMWRKRFPPRLSSSSNPAFPPTGLDAPPFGVTLWRRTTGAEVSEKSPAWGPPPPAAIGQPGAVHNHLFLFVLFSRPIIVLFESRGPHLFSRFVPGEAPGFTELSPLRIRKPSVAGPPVFSPRTIPETPPWKNEVGGKHPPTAPP

SEQ ID NO: 970957 - protein, 80 aa, Homo sapiens
PLMPAGVTTAVSDPSRPGGFFRAIQFSNSAPRACSPLPLYCLALVAELTTVLEALHLARPYNRPFPGVSKCLVAHQKRGF

SEQ ID NO: 970958 - protein, 109 aa, Homo sapiens
MGTQNPKAPPKSQADYLEPIPKLPGRGDQSKTLASPKTQATHTWEVRTVGKARKGEHQDQRAPPKNIYRGPDHSKVVPREDPPRAEPPNAQKPFVDQPTKPFPTPGKLD

SEQ ID NO: 970959 - protein, 269 aa, Homo sapiens
VPPLRRNTGGTMCREHTVVYFINEGLSSSRVILSRWPPVAFYYVCLVIHTPPDVPPPGGCVVEYVARRPPPSFSSSRCGGVTLSLGCVDPPAGYLLFVFFVVRQRGVCCDSIYIRSSVSPAVFIVLGTLCVVVFTATDFVPPWAVLLLLGVSGGGTPTSLSPQVRGHMEWCFFSSPAQEEEWLVVPGAPSFVGPPPRFFSPPPRGWTAHPFFCVGGRRTPPPLPPSGEGGVPPPPRFPSSSPSHPPPPLPAAPPPRPPANQRKGGGGGK

SEQ ID NO: 970960 - protein, 189 aa, Homo sapiens
VLSSRISGFLPGFLSNAAARFPVAPFSRLTLLAIEHVTPTAAGCPAPENIMCAHISGPTPPHYLGGPPNVSGRPEPKYPPPPWEASLFVSATGILSTGLCLPRNYSCRPDSFIPIPGVSLIKKGTWVATKRTRLWVPPKTAPCLCAGSVATVSRSACKIFGATGVSPGFKINLESVSRGFNNHILSLPL

SEQ ID NO: 970961 - protein, 133 aa, Homo sapiens
ALCVQAVSAFENRTDVFISHSHLLGFGALCYLSPPISLVFCAPSHSLRICFQYTNEGLTESPPFPAQTHLAPPQGVVDPIEGTPHIRRGVIFFHSLLKKLLPPYCSLRTPRRAALCIPLCTGRHIRGWCPPRL

SEQ ID NO: 970962 - protein, 100 aa, Homo sapiens
MCWRCRYFGQSETRDELVCNRGDGGSFAVDANCTPGLVAPHGENSGLLPHYPFNQYHVTTSTPKLNTHYPHKVTPKAQRQDTFVTHNYFGYPPIPKKLTH

SEQ ID NO: 970963 - protein, 243 aa, Homo sapiens
TLGGRGVCITRSGAQEQPGQYGNTLHLYSRKYRKITLGVVCTAAIMVPGRTLAELLAECSMLESLGRQEVDSDARDHARLYSEPGNPMSCDSISVILPFTSTEEFYSSQYIETKEYYPRSYLYPWMEDAGLPSAKQKEHRYLNNNQVSSGAHSLLMRQQRQKITRRDTTLVIPKWGHRGVPGKTRVWHMRPRESKTAPKEPTVTRGLLKPTECAVYHGPMNREHYTTYGDPLAGTILKVPPHE

SEQ ID NO: 970964 - protein, 59 aa, Homo sapiens
MPTKTRALTPKPPDNTPARNLHPRQPQPQPPPTAPSHNPNLRPGAGKASTASTQSVTQA

SEQ ID NO: 970965 - protein, 161 aa, Homo sapiens
WGSLDSPEFSSPGSFASLSLMQWLQPSNSSQVLQEKQQQLCEASATRKQSWQAKVHIRQQLQQLPARISSRSLFHKLCAIPTQIGLRPWILAFNPSECSYATPLPINKLPSSVYGASSQVHVAAPNGKQVIPVCDFKCPNLCTSFSHPRGSSSTLDSLTQG

SEQ ID NO: 970966 - protein, 201 aa, Homo sapiens
KQANTAQKRLKTPEQTNAEGQDTKNNTTKKKQETEKKKQQDHNKRHQRHEPPTNKHNKREKNDDEQPKNESKEKKAAGTHNSPGRGKRKTASHQSNKRRGRHMTNRRIEHTKKRRKKATHNHNNTPPRGHRATPQEHKQDTKIRKAQKDAKKNAEDTKLARQNTETNKDNRSTNTKKTHRPQAENNPTKQQTGTSNNQETA

SEQ ID NO: 970967 - protein, 32 aa, Homo sapiens
MSDFNPVGDLFIAQTLLGGNEDKHPGKTGTPL

SEQ ID NO: 970968 - protein, 293 aa, Homo sapiens
MSSRAAYRCCALAELQILRTRLKPLFTAQHSPATQRKTLGPLTLLTLTVPQLHGSQLLTTVLSAHNLLTNTGCSCTSAHTPRGLPLAPLPLDRAHNSFEIHTSPLSPHTYPPRGTRPTHSTLPLTTEHTLAPRQTSHPQPNPGRGATTRTLGPTLSPTDRQLHTFSQGAPLGTARRNSHPYARLSGHLTLPPPTSLPKRHQTPALRGTPKRAHLEPPQTTAAYTLTVAHRGHADAPASPYTTAHHAGNPALSKPHRAAAGAHPSPAAAPTRHRATNNNEEEPSHDPARAHRAK

SEQ ID NO: 970969 - protein, 102 aa, Homo sapiens
CSSSSLMYTNAFGVFAHTHALMAVTSRPTNSLAAREFGGHSYNSAHSRVPTPHACFPRRPTRLGDGPPLLVIRLVNTHITKDALGGACYYIREQMFPGVCHS

SEQ ID NO: 970970 - protein, 104 aa, Homo sapiens
MADQLTEEHDLQNFKRQLYSPKFDQQMADCEPITNQTDIGEPVNCDSLLGQKSQKAEDYRSSECKLRGRSCVDLGLTWGGTNQIVKTFSHLGKKEFVSLGDKRV

SEQ ID NO: 970971 - protein, 282 aa, Homo sapiens
GPPWSFRCRARPNVLSALPRPPALLMWLFRARNTLLGVSPSGGGSDNTWWGTRPRGVAVTQRRREKYNLLYPKAPPCVATQHPCGATHPRGKGDSFSLRLNTLQCAGPTSLRGLYPSFSYKKWPITLFFQGTQFTRANVRVLLNKCARGQSKFYARRVTNSWARSSPTHQCVCLLRKCRAHAMSTYARGGIIPHGTLSDSPHVVFLVHPVGVFYTRDTNSFFCNVFAMLANTSARSPHSISPLCRRPDFPHDTALPKLATIFLLLPHQLQNATTFTPTIYKH

SEQ ID NO: 970972 - protein, 103 aa, Homo sapiens
MRRSIRIHTAQRTRCLYITHERHISICKLIRIQSNSNKLCNKGWNSYNGITMLRTESFDEGSWTKSKLMIALEQVIPSCPTNKEMPVISKMQSQCGFETPMAS

SEQ ID NO: 970973 - protein, 118 aa, Homo sapiens
MFPCLRRSCVFGTLIPDSAYTISSCLLYPRLLAPKSQSLILVLYGSSHPSPTDFCKTYSVPLLYLFAVIFHIFLSLPLAQNCFVLIRDEKMDQQKNLNKKQKITNNIPNKIKIQITTI

SEQ ID NO: 970974 - protein, 219 aa, Homo sapiens
QHNITSSHHQYLAGTSRCPADTLFYPAARYPNPCNTASHNHLATLNFRGTMILNWPPTTAISTHASSYTYSTPQHAHTRPLHPVKEAPRAHYTNKPQHARRTAILGRPLYHYKTTNPPNTTLTLNTKQHPNKEYTVEPAYNTKHTHRPLSTNTNYYRRYSRDDGNATTAERPRQKPRRKSTHFHGNDHMADDPTIAHHYGYTLFHAHKKFPTNVPRTTP

SEQ ID NO: 970975 - protein, 307 aa, Homo sapiens
MVFGYLSPSMMVISTPNSEFNPLLSISDLKKIQIINLTWTTNGSFQTWALYVANRYDYSAGALLVSGKPPAGAENVGYCTQIGIFRKHGAQGNRIMSFQTSMISMLINARHTHPHTQAHSQDKGSHHLALGSTDACSHTSCDTPKAVKPTLPQGRNRHRPAAPGGGYRPNDTGRPTRPLDPLPPHHDTTDGRHPPKIRRTYPHNTRTGAATLTNSPKPLHTSKPIRNPHDRQHGELSHTVAHSKKAPHAHSQTQHVHWHSKQFDTTPHDRRKKTRTTHSTYTTRHTENHGPTDTQDHKHKRQAQDHT

SEQ ID NO: 970976 - protein, 201 aa, Homo sapiens
GSGVRPRLRGALTTTVWEGWSPFVRRMGAGSGSRLLLARPPRGGGASSFVKPPILMSRQSERDYVRPVTFFVGHDTLVVARAALCAAPHYASETQCADGRRSAALSHDIFLAAPLQRGIKFVALAEFSYHSAYCGESAGRHVLHQGLLSSTRASPTRPRLGDDVAGSGRVVISRVRESTPSLVPVVVCAPPPVYPHKGPNK

SEQ ID NO: 970977 - protein, 194 aa, Homo sapiens
MACYHSQPCCKRLKKFIASMVFSTWSNVMCLRAPFGGCFNRTRVGPQFNSSDTTTFGSPSTVQWRYIALVCSVVLKQRALGMKWICPPEPDFLPHCGQETHLAALCSGATPGVRSAAPRTTSPSLLSPCEGVPRCAEQPNRSIVRTLGRETPCLPTVQVRSSTTWATKTAGRKNMGCAPTAYPRCGDSPVSPRC

SEQ ID NO: 970978 - protein, 239 aa, Homo sapiens
HNSTIITISLHNTLFSKEHSPSYKSRSITVSTLTIYQHHRLRRHHTWHETLTAFQRPHNTATHQRASVASPAQQANHHAKQVSHSMVALIGRPASISAAIQQSIHISISISPILCLRTPQLVSHPLVHGLFSPLAGTTLNNALHYSRNTICMVRGIAVVHRTSSAQLPVTMVTTLFQTTSFTIGRPLPKNAFTLHHWPQAFLDYSAYTGLRKELYRVAVGSSNATHLPLVHITSTYTQH

SEQ ID NO: 970979 - protein, 72 aa, Homo sapiens
VYPHANSGSHMVNNLRKTSCPSLGPPELFRRHKGFSRPSISQSLQGEKRGAGLKGTAAPGLFTCRLQHRAPL

SEQ ID NO: 970980 - protein, 127 aa, Homo sapiens
MAQATLTPGHPWATGGRPHRTPGTPPATQGTPTTTTSQQGKRNSKTEQNWPPGTKVGIMDNPQEKNEWISKRRQSQYPPSATHRNYGRNTCRKTLPHTTHTHPNNTPYYNERHTQDTPHNQHINKTS

SEQ ID NO: 970981 - protein, 507 aa, Homo sapiens
AQALTMLWSQTTVGKAEIELCSSTPVSLPPLCMHGQADHTCINKLFNTRQSKNIILSLKTQTTSTKHNVNLHCTTTTLVAKLLLGTTVYHIHLRLHLALLQLSPHTLSTRECSYVSEQCFATPRLLYISAALSNHYSALPDKRYVTTATQEGLSHWIQLIDAAPTVAAETAKPYTLATPLTPQTRRYIKLAQGIRWTTQWRHSTFSGTAHLKDFPLWIHQLHRPSACKHRVGSAKQDRPKHTHAYTHTGLHYSKVVSNIHRGRSLIKPTNRLGLHPFGHSAITPHRSANIAFAGQRNVTDTRLGSTNTRSLSTRHAGNNTQSITVTQTPMVPIPRPQSYPPTLGHPSGMCTTTVVQQQYAPTTTQTPRQARQIRAQAATPTPTRRTHKRPAAQRNTRWARPNTDRCLQPPTQRNDTALAHTPDAPHPHAHPTLDNNPMGPPTPRAHLPPAQRPSTCAGDGRHYHPRERPLTRKHNAADPTRRTQQHNHPPQQTRAQPTPQTRSTPHA

SEQ ID NO: 970982 - protein, 106 aa, Homo sapiens
MRMVMLGTPHYTSIAPRHSSLGQPGGGGRPILQTTTNDKTTKTHHNPGSGVTTRGTLRRSSSQAPPTKGRPGATTEQTSDTEGDNQAAPERTGDNTTPPGHPHHNT

SEQ ID NO: 970983 - protein, 118 aa, Homo sapiens
SQHLGRQRQADCLRSGVRDQPDQHGETPSLLKIQISWARWHMPIIPATREAEAGESLEPGRQRLQRAKIVPLYSSLGNKSKTPSKTQTNKQKTQKTARQKKQDGRRNGETKTTLRGVQ

SEQ ID NO: 970984 - protein, 84 aa, Homo sapiens
LNASKQDGPMPKPHSVSLNDTETRKLMEECGRLQGEMMKLSEENRHLRDEGLRLRKVAHSDEPGSTSTASFGDNVASPLPSLLV

SEQ ID NO: 970985 - protein, 121 aa, Homo sapiens
MCGVTSYPGVRLMIKIPSAITRTKHINSDSSRVPALALLEASLIPISHNRQSTHTNVCQCAENLVRTNTMVRDRGARYVIREDHTGRYSGCSRVKDNTVKHRMQCPLGMSYRNRRSIFEGF

SEQ ID NO: 970986 - protein, 293 aa, Homo sapiens
LSDTKHADPGFSGKVRPPWLWRSHHMYRLHSCLILNTCCVHGLRIHALPLGNGIHGDTKKYPSVQASWTQHQFPQDSQTPTLTSQPTMHCRRLDILHHQGAASAKTHADTHIQGSNRRAHMATTCPSNGTDNPKAQHPGQHVTTTTGDKRTKMPHKSRQNIPQQWATIQPGTWDPRLAHTHRANTRDKPPHNTVAHTHGQPQHPRHENAAPHKPNYGTRAPYGRTTWAQAPQLHTARHHRTQQPNIGKRHVHTDRRHGERTKQLETARPKDTKKDSEQTTNTTHHTTDTTNTT

SEQ ID NO: 970987 - protein, 143 aa, Homo sapiens
MHVFTKIPIYKNSCLARPTVCWLCSVPVTTGLYSYGIRISGIIGTKYKNKTGLSSSKTNTQQTKQKTKHTQMNKNKKRHKKEKTAREGTATAAQRRQSSTRERKNKHIGSDEEDRQRSEEDHKRARPQIEEQQENRADITNRS

SEQ ID NO: 970988 - protein, 176 aa, Homo sapiens
PKGTTLKSLKEHKSDESKVTLEGNYEKQEQTKPKFSQTAEDNYTNDQTPRHLNLKPDNKQNYKRLPVDNKHTPCSPLETTPTKTKFKHPRGAKKPSRPTFKGTTPEYLKAPKRTLQNAPEKGANFTAANKRTRARGNNNEDFPQEIEPSFNPELWDPPFFAPLDTTHRRRFVLHNE

SEQ ID NO: 970989 - protein, 210 aa, Homo sapiens
MRAFDISHPDLLLTSVKPTDFFLRTLFMRTQTFLGRWWQTQETLSLNKCPDKMPKRTQDAGTNSRSRCSQPSTLCVSRGLTTCPTAHDDPHSSRERATTLNRGTLKGKTQRTGHQHSPNAIPVKARTTYPKNRPTRHDPTRENNTPPGTGTQNQTQPVDLTHSTNDMDTKGHSGRAHKGNTGRHTPKTQHKGPRGNRNNQQNTGTHTTAA

SEQ ID NO: 970990 - protein, 102 aa, Homo sapiens
LPVLKQLYCLCILSHPYLCTSAFIDLRNLAFSSVSDVALYVAAITVRVDLVQGTTNFVISRNLAQDHGNSKHNSVLRLYHDNGLDLLSFYRNNWLLCMLLGF

SEQ ID NO: 970991 - protein, 108 aa, Homo sapiens
MPRQHNQASGHALPRNNQRANPIRSHIPPRYHTSPAAPAPQPSAHSNSNRKTRDKHRIWAHRDNTPGCHEHGRTKQKTHPRTTNANNNGAAQRAHTPPTTATPRDTEH

SEQ ID NO: 970992 - protein, 167 aa, Homo sapiens
CVFTDQYCVCICVCSQISTVCAPVCVHRSVLVCMRVNRPVLCVHMCVHRSVLVHMHVCSQTSAVCAHKYMFTDQDSQEHRCKNTSQNISQLSITETPVLHKLTQRCSAVPLRAPTAFLEMGTQSSKACVEMQMTWETQNNSLTKKQDFKTYQKATVTKAGGVSMRIQ

SEQ ID NO: 970993 - protein, 107 aa, Homo sapiens
GERESGSIARRDGGGIDSRLTGNIPPPGFKAILRASASVEKRGLRAHCHHAQHNFGILGRDGVFTMVGPGGVCDSLDLVILRRWVSQGCWGFTGGGATGSRAQNHKS

SEQ ID NO: 970994 - protein, 105 aa, Homo sapiens
GSVGARAPVPGRCVGSDLCVGDGVEGWPLRVRFCGVGGAAGLPLLPPRYARSLVLSLSARPVPPPGPGKLRARDLSAEETRYMLVSFRRAAYAIKAGWEETMQGG

SEQ ID NO: 970995 - protein, 215 aa, Homo sapiens
MPLLPHAVASHSPPSEPTAASSPTQHTHTLLPTTKQNYTELPSYHVTSTAQAPPPVIRHSPTQQLITHSRPWHPLADHTQPTRTHKPKPARTGRNSPTAASRAAPYRQPPELRTAHAFLDTTHTLSEDKYTTLAPPPNPPLTPTAHPRLDHRANRAPSTHLNQIYHAQSSVHTSGHPKHYNLKLPPTTTLTQLYPSHPGTLYSINHHITFNPQLP

SEQ ID NO: 970996 - protein, 61 aa, Homo sapiens
MVGRVSVYTVIFFHFEEDKDQAALHVSPHRIYLAHHIVPLPSILVHPPPPFKKPKKAPNKT

SEQ ID NO: 970997 - protein, 187 aa, Homo sapiens
MNAVLRPAIIQNGYSDLMLIRTMENQAPVWFAKDGLKLGVWTFNQSLSMGDLKFQHHVLAHTFDAPPALPKAHSATGIRGHCHSAANTTQALSTVHNGRSPLQQHHKPSATRCLRAPTIGLTLQHRPALTLPSLTSSCLLCPSATCYRRYYAEATTQEKLVRTSRSSAPVRGPYERVSAATGCKASR

SEQ ID NO: 970998 - protein, 263 aa, Homo sapiens
MRLNVGVIRYFVRQTDTTVFSRLQNSNTHLLGDHLLNRNQQQPSPHGTAARNPAHQTNTPADIDTPADLPTPTRLHSQHMRHNRLPNRTAEHKTTPQHSVPTPRRNGYNPTQQTTITPHTHTARPHYQTTHTPATDDPPTTTPSNHNPPTNPQPTPASRLVGLVSCLRLDRRDSTHRSFSSLTHHALLTYFLSHYPSATHLNYLPHTHHLLPNISLLTISNINTPQQYLVISRHPITPPVTLLHHQFLSYLPIPTASPTLTLT

SEQ ID NO: 970999 - protein, 235 aa, Homo sapiens
MCPGSKRVDTKQGLYLAATRVRHRFPICVDDTRNRERVFPGVLLTTRRHCPLCRVCCSRKVGHPFMAKAPSCHTLGAGHKCMYYQPSLGDVPARPHFWESTHTEILAVELRSGQDRPAGFSWLLLAWRGDTLCRVGAHLTSFVPEVLQNRVCGAPALELGGARLVGVDALVTLSESADDVVKLESASAPLGWVFEELALVRRFCYSYLLFLTWGDPTSQTLLRHNSIGLLKSTSC

SEQ ID NO: 971000 - protein, 153 aa, Homo sapiens
MAPQQQYGNHLSLSPPIHTPTSRFLVRLSLSARTTRVPGSPAPLLPPFAPFAPPPPLRWFATYGGFSIQSSRSSVLPPQRLHRAFSSPTSRSVFLLPPQRLAPQLTALVGPIPLALGLGSFLSSLPLPLLPYTATRGLLALFVCPPALLSTTP

SEQ ID NO: 971001 - protein, 108 aa, Homo sapiens
CAVDRAGCCLPALLVGFYCSPFRSPTMGLNSSAVSCVDKLPCVCTRGVGELAPRIPPASSAECSCKTANFLFDMLQSARRGRTCGRTVGRAAPIAPPPGGKGPISPHT

SEQ ID NO: 971002 - protein, 200 aa, Homo sapiens
NNRQRTPLAMASNFKKANMASSSQRKRMSPKPELTEEQKQEIREASDLFDADGTGTIDVKELKVAMRALGFEPKKEEINENMISEIDDGTGHRNNMNLGDFVTVMTQKTSEQKILKEEILKALPSSSHDLMKLGRFRATDSENACPRSRGENLTDEDAASEHESMTLIDEEMADGHVSKRFLRTHEQRPASIKISVYYLY

SEQ ID NO: 971003 - protein, 114 aa, Homo sapiens
SSLRHQAGDPGLSGKVRPPWSAGEVSCPASLLLVLDTAWVRAAWVQALLAWKLEGIPEARKFTSGETIWTQTSAPPSSVHLTVNQYDDGAGILTTGGGVTIAGDTSYVHGVPYG

SEQ ID NO: 971004 - protein, 174 aa, Homo sapiens
GRRRLGCAPLGVFLLWRPNPGGVHPSWRRFRAMFCPPHIGLQRFAHSTGPPLWSSVCGPRYYSLRGRSHTPVEQPVRSGRSCVDVSRKRVCSREKGLPPFCAPARSVEKRHALHGDIRSPPSGPPPPALKAGLNGSPPVWQTPWAAPPREGDHTTNSRRPLDKGRPNTARRATT

SEQ ID NO: 971005 - protein, 96 aa, Homo sapiens
EGRGSKNCPVSCQAVGMISLLALAENLRLVSTHRKDGPCLCHVTAVELAVCRAYVNLLRHYKYLLLYGYRGILLMAFGSYKVIYNLIAVEQVPVED

SEQ ID NO: 971006 - protein, 306 aa, Homo sapiens
MVLLTEVRSDDQNGETDVMRVKKNIQESEVLDEIKLDVSHARVRIAEHLCVSSQAGERKFPWSGDFRVVFNLGSSKRFRASAKHVNWGHSFHGLNAMVFTRNPIFRHCFTEFMDEKHKEIGIYYEYKRDKPLIISFGMQMSLILDIIPQHQHEFPIWCKSLVVRLRVAGREQPFAMGATGARGEKKLWTLGGHPTVQNPVGQNLATAAPQRRPRTQHGSRPATQRRPPCLHTRSPRPHTPPRQRIRRTRHTDATRTPPTQRGPQPHPNTGDAHRHRDHLPAHPHRHHQPLTRTTHNTHRQQPPPPP

SEQ ID NO: 971007 - protein, 452 aa, Homo sapiens
IPALWAGRGQVDHLQVWQFADPTWPNHGANRCLSLNTIPKTFILGMVCGAPVIPAHLWRPQAGAHRLEPHGVIPCYLGQAAGQEHIAVKPTECGRLHVKATASMAILTRTGQSTEQQPLSAAQTPPHNTVVYTSCSIVQHTKHRLVPALQYLFTARFCQQLVRVSQRTTVYATYSPMTDTAILLQNRRDVAFRDRDDTITRLSMQIIIRYYGCNSHTSLRNAKKVQTMERVRLQCIPLERLHSVANIHRDSTTTTVENRVSTLLVEIRTHPSELKELHVTPQPRTASTANKHAMDPTPQEDRGNTNKGKYEHKTKAETRKNVTTGKHTDNHVTTSTEINTPPQTTTTYTATQTQPTRARTHQNSQSMDEPTYSRDNAKNANSEDDERATNRGSETQNTRLNGHHSQQEQKHKTQQRTEPDTRRTDNTRRSKARHSSSTQHEQKKLEESCNDY

SEQ ID NO: 971008 - protein, 134 aa, Homo sapiens
MLPCPLQGVLQPPCPGHSWGTHPRKPPTLGGPTTSAETHLASPRFRSPPAPHNTAYRPRVGCTLRPHKRIWRNVSRGNRQKPQSTTTGGVAAQRNRSQSQNLREHHRACTLSRTDGHPPALLHYGASPPPSHKT

SEQ ID NO: 971009 - protein, 105 aa, Homo sapiens
HGETPSPLKYKISWAWGRMPVITAAGESLEPGRWRCGEPRLHHCTAAWATRVKLCLTKKKPKKQKNNTKFGPKMFTNRNPRTPWVDIGKQFQPPLNTSSGASSKS

SEQ ID NO: 971010 - protein, 237 aa, Homo sapiens
MKRVDEMKDEMMRCKKHAACNMQMHANANAACNMQMTINEMQKTCKIMQMQDANSHAACMHTFTCMHPAHIHANGKMHAACSMKMHAACNAARTMQHATCMQHAHSACRHATCMQMHAACRHADMLKCMQQAHMHASMSHATCKHANMHMQQHTSNATQRKNRKLHHHASMHNASITLQQHNQANMPCKVHTRMGILPCKVQQWTMAHMPPCNPQCTMHTATGPCDHGHWHAILARW

SEQ ID NO: 971011 - protein, 217 aa, Homo sapiens
MLGQMGGIIWSRYGPSGRIIAGADVTIMKAGDLIQSRCQVYSFDSDHSSVSHHEGDHFTPAFLAAAIRGLTMDPTVPEAPPLSINGMRLRNASHGGDNFEEFPLIEETISSAKHQTYSNGSILYSITSGCNWIESNISDHINKKSMWSADISMKFPRGRGMREWEIGDETPMHVEYKKATYSECNILLNYEGEEHEIVNIGCRIRKGPIWDAIYYGA

SEQ ID NO: 971012 - protein, 187 aa, Homo sapiens
GCTPPCGWQPRVVLGLSVHYYCSSLRVVLAPACVVIAHPIAVDVASINWGRGPPAGVVVAPLPCGGPVLPLPPSTAANTLGGARLTLVMTCRANSRTCRVWVITSVTPYITTLCFVVVNASATEWCHAVSLYASVRARIETLLCLLSLGARGVSVFLSPLGPRAVVCSGPRAVIGAPFGRGVEDPYL

SEQ ID NO: 971013 - protein, 106 aa, Homo sapiens
LAQEVVRPPGHCPTKYGVPQDPRGHNLLWGPPFGEGRHYLALTRYSLVPNFTGGLSFNNNTRRGPTHANGSTRRRNNNRTCYLKHTAPSVTQEQYQSSLIIYQSSH

SEQ ID NO: 971014 - protein, 70 aa, Homo sapiens
RSMWTSLEKDSRENFNYTGGTQTGVVKQKEGPICAAKQTIMRGKPPRPPVASPRMFRRSFFSTPTVDLFE

SEQ ID NO: 971015 - protein, 264 aa, Homo sapiens
HVLIVVVDQRAGGCSYHWFVSSQQQAWRTLNDSVLVDTAPPRISVALSLPCVLIAGVREELSQSVSSRKASPSFYSMNKYLVLSCVRRYQHMGRNNSVRVCSVSLLEREMILCAHLHGEDIALHIYKISALSAVFAAPRTFAFLVAAPLSLECISRRYCLHYSSPLLYTDIAVDKYPTLLTRSSRNSSSCIYHSLIRLVSISFAQLFPLMWRTTVVPAACEEVSPFSLSIAPCIVLYELLHKGPTYGSQRRPPLLWRNKITEQT

SEQ ID NO: 971016 - protein, 61 aa, Homo sapiens
MERIDRIYSLSHRGGRTEADARQDETEENERVSEPQMTTTLPRSERFHTPTKKEKRSNKRT

SEQ ID NO: 971017 - protein, 60 aa, Homo sapiens
MLWRVVSKRSFTLPHPSECRGALPTCDVCDDVGARTTRAQCEQHLECKRPCPGHTNRQDK

SEQ ID NO: 971018 - protein, 108 aa, Homo sapiens
MGHTLCASPLECHTPLTRIRAVDEYAVRVIPGRSQPCACNALFTLDASGTHAETSVNLMVKLTSPLRFIGRTQKPITTALTKYTLDDGAAAGKKNTIINNNTYTQNHT

SEQ ID NO: 971019 - protein, 110 aa, Homo sapiens
GISLNGGFSWDAYRPRGCARKEFSRGKPPICLVKKGVYSKVLAMVWFEMDPPSSVKVLPLLRSPHHGSRDLLKTLWSHNGVASLLGPPFEGPTTLCVRSFKPHCSPPPIS

SEQ ID NO: 971020 - protein, 94 aa, Homo sapiens
PGVKRPYLSADCARLTPGSLCGARVKVAPHGISWRRPPWRADGFIVVRKLYKTGRIYRGEGPIWDAIRRITKVGWCPPLPPSSAETLVCAPPPK

SEQ ID NO: 971021 - protein, 110 aa, Homo sapiens
SYVNATRAQYIYTTPDNLSSGGAHASCCTPPARHVWSSPSSVSATPVGATTPSCGNSTPALSQHSLILFFTTTLLNYHHLSSEHALTTNSFSCPQQQSPTSCFLNHRLNK

SEQ ID NO: 971022 - protein, 118 aa, Homo sapiens
VEKGFGGLSPDFLGVSFRGLVPPRVYNLCYMGDPKLVVLVSFRRGNVPSPTILVSHLGLLDGAPSRSPPLCVKTWPKTLRMVPASPPRLLLPSPITSPVRSFFRILPLVARSLNVFIE

SEQ ID NO: 971023 - protein, 103 aa, Homo sapiens
ERCVCRAGLVLSLFPAPLVVRLFPLVAPPLCADLVGVVLPPGVVSPGMLGCPLRGHVRAVGGVIFFEADCLLFAPRVVVICLRVVFYGAETGGVVCLSCCRET

SEQ ID NO: 971024 - protein, 71 aa, Homo sapiens
AAATCGRYVRKKYAWDTGRSPRVGPGIEANMVKLAGFPKGSLISVRRSKLFEQICGDTPALVSVCITPQRG

SEQ ID NO: 971025 - protein, 116 aa, Homo sapiens
LTTLHFCRSASPATTRVSPEFAGTSFWCSMGKYGFFLGEVVAPKDICTRGGGNISSAFPTPSPALYSRCAHTLAAFFPPVEPPCNSSLTHPFWKFSFATGIICLTNKNLLIPSPTI

SEQ ID NO: 971026 - protein, 69 aa, Homo sapiens
MLFVGIHKKGKAGPDVSPQRFLLKPIITCPLSMMENARINSCVSEYVVFPTIFSNNSPIYRPQTINKHN

SEQ ID NO: 971027 - protein, 235 aa, Homo sapiens
CCIPRRPNFGPRVSSPPPPCRSSVAPGSSVCVPGSRSRPPINVLCVFERGARSCYSQVVSHSCCSRVGSCATYIRPAGGFSPAPLLARRGGPLVSYSRGECSPADCLGGWPAALVGWHLLVGHQQWVVHTPPASARHTLWAIPRSSPRVYYPHVLSPRVAGGATPPVQSPPTASRAEACGAREEFPPVENPGGHQGSRQSRVGVTPRRCAPALGLATGLNFCCSRKQNNPHKHPN

SEQ ID NO: 971028 - protein, 147 aa, Homo sapiens
MGRIIGVALLGFFALLGSGRVLLPSLGLRAPSPLLARPLCPPVAAQSCGASCLPTRPLPLYEVYWRLPIIVLWWAPGVWLHHPAVSLRSLQLRRPQVWRGVPRGPKGFAPHSWAPMSTRPPVFLSKYWLPAGCIEISILHKEKQYQR

SEQ ID NO: 971029 - protein, 232 aa, Homo sapiens
RRGGPSLGFFPPIMHARVIYCAKINTPCRGRHFSFWCRIYCPLACDLRLCVCRRMDTRGGPRSILSRPSRPGAAPARCCLCLVSTPPLVGDLGGGRFGLHIRWYNVVCDSLRSAAPALCDTALCVRCVPSPPSCVPLPRHVYWLFAGALYMYSPRAVHLSLLLATLFASRCVALRHQDSTQFHIVGTHSISFSFSRYYCSPCFSSCSAPHLSLLLLSTKYDNKTHHNKYQTK

SEQ ID NO: 971030 - protein, 236 aa, Homo sapiens
FPTALLSMKEAVLIGINERHRMLLECISLVHGRGAKLRVSKCGEVPPLTVYTRCRPPFRHSPCSIVTLRPALTHNMWVLCRHLPYFCCPRKIQALGHVTHDINARSEFRATFCLIFKTHQGVFVRSHRCLSCSPRQGLVAVGGGHPEVSHTPSSSMARTRHPFLLVDSRSVGTPYVFAPIDRLLLLALFGPQQLFLHLDLCHIQNKPFGQASVRETTPPLFPTVSLPSSPRPTITN

SEQ ID NO: 971031 - protein, 92 aa, Homo sapiens
CELTLREIISAPAGVPAHESAPPLLVRCPSSNAMDRSCKHACPPHGFLAPKQPVGTKGVMSMRGPPLFGRHRMCCLPGSVSSGPSGGKMYSL

SEQ ID NO: 971032 - protein, 207 aa, Homo sapiens
RVLGFSKRVPPGWYAVALLGVAVCVLRWGGRVLVVGLGIMGSSRWSVAPPVEAVFAMVCSITLVSLCVVSRAAPLLILRVLCTVVWLRRRARGASMSSRDGTHVVIFRRVGASHFFVSPRADSPVSLGYLSPGLLAGNAPSFAPSPRQSTLHAAGSATFVVIEYDALTAGVIACVCAPGSRLFLPPDPPRSRVWELFAPTLQGHPFT

SEQ ID NO: 971033 - protein, 218 aa, Homo sapiens
QVSLLSAGASSCFVSHVRASTRGVYLRPPAPRGYAAVMSYWRPPSLCLPRLTPIVQAATHVWVAPTVVSPPPSTSGLLPAHPWVCVAHARAARRTRHLGAASLVYAPPDMSCGGGALFLRDRSRVCSRLGLFPRFYGAVDRTHAWCLFLPARPSLGVPGALPLLLPPPLLQMRIFSRIYFSVNPLCPLHNIKEDDHLSYCGDGGCVERGTCGRTHNVQ

SEQ ID NO: 971034 - protein, 149 aa, Homo sapiens
FAEQSLYPHGGSIGQHDANFVPPRGQFGRWGQQMRYSCPIESNKKCDEPEKSVNKSICIPHPPIMFAIYSNPPARPTHYLDVPRPRGELDGLSDSPPVVLAYYEVFVAGFLSCRLYVRAGWRLRAALSAPWPYGVCLSRSPSRRSHVVS

SEQ ID NO: 971035 - protein, 83 aa, Homo sapiens
IGGGGMRIVGSDCVASLCCFDDLPLWMFGKFGFKKTSQCGFSLNNLSRNKAARVVRLYGGHTKLRGRIIVSLVFALTRKLTCR

SEQ ID NO: 971036 - protein, 122 aa, Homo sapiens
GRPPPACPVVERGLDFVAPRLLRDAPLVRTHTPGQHAPSTLANTKVGNLAPTRFLSFSGRCGLYRIIIQTEINQVRVPLVSLAQTDVLEKIMWLFLTQRCHVRDEHISYTILFFLSRAPAHS

SEQ ID NO: 971037 - protein, 171 aa, Homo sapiens
NRRKVAAKNFRNEPPVNLAAVKPPYGTSIPPPSIKMYKRAKQRLLCLPTDSNVPRTTLGIKGHAGTQDHLCEAHSFVAGIFSLALAGRARFFANPGGEAPGFFVDHRISCGVVFRQRQALDPSVWEVMGDGDDPSSTPTDGAGTPQRLREGDAPAPRPPWGRMSGNSPSHK

SEQ ID NO: 971038 - protein, 87 aa, Homo sapiens
LFIPRRGVFFQNSCAHAVLVVAPPRWGDCPPLGVFHNRRRLCPPGLWIFPRDPFWPRGFPSVPPGWTPLRFPCESAGLSPGNNLPGR

SEQ ID NO: 971039 - protein, 194 aa, Homo sapiens
MVFSPPVEALHRATKRCSALIFNRILIAQRVEQANFRTLERSLWERQLTYRGVPSTLNGGVEEEAVSSSGGPEKILFANSCGGVTRPSRAPAFYIPLVKAPLLFVHFKKREGDISNPHYISDHFSNSARSAYSREILFKGHILFITRERQPPDEAELTQITAVLDHPPHPGAIPHRYIPLQSHTILLRPHSLNW

SEQ ID NO: 971040 - protein, 184 aa, Homo sapiens
MCGALVLPPCDPPPLVSAQGCVAQVFRGPAFPRGDLSPANRGLSRESPSVAQRSGSCGSHLFVRHGPGFWEPSYTWSPPGTSPHNGTHQRSCPFFRQKIDPPCRAAPLVSQRSPTGSFPPPPMNPLGCKFHINGKYYNSFIAQDPHSSNTCLLEKRLQTPPFENTQELAEFSTNCREVNSNTIT

SEQ ID NO: 971041 - protein, 164 aa, Homo sapiens
PPVYLAPPYFGPFLPKPPPYPCSSRGGMSPPLLTLFPLIPLICVDQRLFLKCPTKPTRPSWSTSTIFPLPNNTPFCVKIITASIALLLNTDSVPPLHYPAHDLRNGFCNLSPPTRQHPNFPRPISPPRTFSGEYFNPPKIPEKFFTRKMMAHKPPTNRSLIITG

SEQ ID NO: 971042 - protein, 102 aa, Homo sapiens
PCSRVGLPVVKTSLQEEPSWVRLGRWAFDLGFCQGIPPWCYKLPCRPPNSSGVPLWYSGGSPHLVNTPGLSSPPLNNGGVTITLFGESFRAPTVYSLGLPLG

SEQ ID NO: 971043 - protein, 156 aa, Homo sapiens
GSSRERFPIGRLSMGGEIAFGCNRDFLRGSCSKTPALSDLTAVVSAPPLGPKVNRVCFGGSSRAALFWVFLDLRRLLGLQKSAPQPEFVSPRGPPPPRQNGGKTTGATPFSPTGGVKGTPAPIRHCGPLNFGANKEASPRPRRYWDRVFTPPCEQL

SEQ ID NO: 971044 - protein, 201 aa, Homo sapiens
TINVLPLTAGALSFPWTVLRGYVKKNFVWNPPFSEKLSVQWVNIGNALCVQKKVVFPTPVLLGAPSRRYPYIGILIENSLVFCNLAKYYTPPFILPLKELSPCNNTPVVNQHTPPGYSTPGIAPNGTVPETVPKFPKATTRRRSETHGRIGGNIQGQDTSKKGFPLSKASMRPHRASMWAKPTSQKSFFVNPPPPSISFDT

SEQ ID NO: 971045 - protein, 187 aa, Homo sapiens
IDVCRPLFNFLPLCFSSRGAFYLLFRAFSPPLLSRAPPLSRFVTPRSICSPGSLYQTALSPGYRRCHVVAPPRPRTVSFDNRHPVLFQCPGLRPIVAPPNIKLAWKTNCGHRRASLTPEGAGTQPPFPLLFAVEPTTVFPSLAAIPVSPPTDLLGEGPGGDNPPVVVIPLLVPPPVVHSCNVATPPY

SEQ ID NO: 971046 - protein, 138 aa, Homo sapiens
VVFSPPRPGSNLPPHTALWGVNPRRRSGFSPPGFFLGGVPAPNTVPAPSASRCVSRQDTVVGQILGESFTEDRQVGDCLRRGSFCRDTRRDTPTRMGDINSSRGNEDKSRILPVMEDQYTALLEASALSSRSAVSNNQ

SEQ ID NO: 971047 - protein, 111 aa, Homo sapiens
MYNTSQHMGGEEILRGKIYYNALGPPHFSTRSAMREVGVSSLRGAITLRGVHASLSPKKGCCFFISCGGTLHATRGLLLDIDVAREFNTLPSASVYNLEHTVPHKLHALIM

SEQ ID NO: 971048 - protein, 112 aa, Homo sapiens
MAKPPHWAANIITSTPALLRRKFFTKEHFNEKIRNKPYFPKVCLSILHDSCNIPHLAVPVRTPIIHWWNFPLAYQSSQHAHFMYRLAPLIFNNPLNEMAGNKHSLQTSSKYK

SEQ ID NO: 971049 - protein, 169 aa, Homo sapiens
MCAYSLLTTSVSVAASTCGWEIPSPRYCLVACSYKNFLVRACPREKCRLCFSVPSPAGEFYVTGRPLGVGFVTRRQRGIRFRPAFVPSRLLNRILLSFWTPPEGCLFIPYSHFLPYSTPFVPKLFTRRIAFDTSNVLLRASIEKIDWYTHATPVLFVAFEFDGQYHELD

SEQ ID NO: 971050 - protein, 172 aa, Homo sapiens
GIPEMCWVRGWLAPERCAGVVPGSSVVVAARRVSGSCKWTKVGFGAAEGPVAPVPDWKGECMKRELMAVEDTTAFGSYDVGSLHRQQVSEAGVCWFLLHCLGTQDYVYTTSLCGFAVQVASVGVIEPDGHELWSLSPRPSALILLGHNNHILYGRHGAHDDGHYWNPLYLDV

SEQ ID NO: 971051 - protein, 92 aa, Homo sapiens
RTKKKETSNTSTFVLTPLSTMVKAGWFSPIVFIGAHQTLACDICVTRFVNPDKLRNDVGITPPVSPGDIHFSPRPREFRLGPNLLGMGRHRH

SEQ ID NO: 971052 - protein, 121 aa, Homo sapiens
MACQTGVGERATGIKKVGEKKATRGVAKTRWGKKKGRARATPHKGPGVRGTEGRTVRITEPSILGPPTRGHRRGPPQTGIASKEGVCPPAKVVRKDNVFGPTPPVVVFGDPSGTIKVPMRI

SEQ ID NO: 971053 - protein, 204 aa, Homo sapiens
MAVCDVVCVGGGLRWGCVVGRWLCWKKACGSVSKHVAFTPSSGDALSRLSGVRTPPRWVLPPLIWPLLFPATPNMPVGSPEVPWAGEPGPANLSGLARALFRMFSVGLCFPENNFSPDSRPISGAGYDDGVHARWGMLFPPTAPGYGNRLCLYKRRSNIGRQDQYRFSKSGTLRQVSRVELPQEYRAECLQGPGKEDSPCGDIK

SEQ ID NO: 971054 - protein, 120 aa, Homo sapiens
MQLGTTRRLRLGGEETKIWRLPSRQEVIKRPPPHNKSLEKHVRDRSNGYPLTQKALFCLRSSERETLFKKIGNHKRGPFKKRVSCATTGIYTGKIRRWRYFKEALQSTLIYRISARSPDN

SEQ ID NO: 971055 - protein, 283 aa, Homo sapiens
MSTYLFLTCVLGNRCENTRHTHLFIIRCPTGTCTPQGDAVTLRPRPFGDPGHILFAGGHLLTSDTHHGWAVRPSTGLNGDTGLDKVPLCRPHKPPIADETNLLVFDLKTTRELSGSAVRTAPTPRRRVLLHLPGLNRGLRATGRSTRHGYICDRHYNICLTRAAGTRIWSTHVVFSPQEQDLLLTASYDPTIKAWRSPRTMRVLQSPRPRPHTFFSWLATPEALRSCWSALEPPGPLEDIARALSTFSRAGEFGDAYSSYALGRGHTRPRHTLTHNLLTQLVM

SEQ ID NO: 971056 - protein, 95 aa, Homo sapiens
GRPFAHKSNLGAQMRPRYKMGPRGRIYARSREDKAGQPSATASKRKMKSSVRHHGGSRQAPREGRHPRRRCLSIRAQFCEGTDRRRLTSPKRAAV

SEQ ID NO: 971057 - protein, 172 aa, Homo sapiens
MPIPRGSRCTCPPAVPMFQSQPFFLMRAVRLPARTKRFLVQDERWAQRCTNRRAQTKEPQLLAKYTFMQNHLSGNRLCVHKMLRVLSAVTCVGGNNLCGIAHSILVQEKVLCVKGAKLWLAQHNRYFMSIIARAVRVQRLPRGAKVSSCATKAAMRILTHHVSTNARVLFVN

SEQ ID NO: 971058 - protein, 169 aa, Homo sapiens
AGATDQVGVRFKRAPGSDKRASTGTRTRKGVEVTPYLPLCGVGPGAPEAAAPPSWEKSVTDAAESVTGRQNTGGSAYLRRGSSPAQSGVSSVVSLGGNQHVCGKESVSSKLAALPSPTETEVRLGIKLSSQLAGDPLERVRIVSKRARARRSDRNCDLYLIGAATGGGA

SEQ ID NO: 971059 - protein, 56 aa, Homo sapiens
MGVTPLRNTSPSHSLLDTVTRIFGKTALLSPLSGYGIDGITSVLVMTTHKPCLGKA

SEQ ID NO: 971060 - protein, 130 aa, Homo sapiens
MIKRGVLGETPSCSLPKYQLMTQTAHHICGPTRFARTQSGSAPICVDISPRVENFFLLRVSLPHTQSISPPTPAPARRIKKVTSPGWVYTRGGFRPKIVSPSVSPPVGAKTLYTRFLPCQNLPCVKASPT

SEQ ID NO: 971061 - protein, 111 aa, Homo sapiens
MDARVNKQCCLESSLAGAPPRGVFVRGPPPAPFVTELCSNVLGRRLCEVFLLPLLPHALFHTIKLCASMSGIFSRQEVVPPQLFSEKEGAIYGAKRLYSEKRALHGGPIPV

SEQ ID NO: 971062 - protein, 49 aa, Homo sapiens
MVLGVVHFLKALATRCDAAVDSYKKLLFSEFFVLRKLYVLSGSPIEQQK

SEQ ID NO: 971063 - protein, 108 aa, Homo sapiens
GYRFLGEYGSAKGRQAGAQGYPGRSVHGEVAVLRPPENKEGVTHTLAQTHKRCVRPLQTRSRQEYGPCQNMPTAGKNLCDSPPPAKTRTPGQVAPNKARNPHVWCNRD

SEQ ID NO: 971064 - protein, 131 aa, Homo sapiens
MANKRDNITRPLLKGTNMWWSGGHHSGRQTNPTMEPPHPLVGHATRMGGEIHLRPPQVMCLGPSPRGTTIYVETPSSSDRIEQLRIDYKRSLSLSPRLIIYIKRHHVVNKRARLHARFCQRIYTSGGYTPL

SEQ ID NO: 971065 - protein, 112 aa, Homo sapiens
PLWCTIKSPRPQLPNAPAGLICPIPVGPSTPLWERPPKFMRNFCCFAQNDCAPPLNLLFQRQDKRGNSPSLKSLCERSLAVLLLPHRTDAHSFRFKPGAHTKRVAPNNTKDA

SEQ ID NO: 971066 - protein, 151 aa, Homo sapiens
WDGGIARPTWAGNTVGPICRSSGVSHKNVAAQFGRTTENRCPFWRPPGVLAVILKRELYQYHRPGTTGNAQTPLFATSTQVPAAFILAALLIRCKRTPPGAIKIIFVHPSLCFPANNFLPRRSPFGHKRLLFLTQGPIAYRFVNHGSHTSR

SEQ ID NO: 971067 - protein, 114 aa, Homo sapiens
MGYSVPPPGPFQVLFMVLTAGDSCRVPPRGGPGLVLPPPSLHGLGWQPGPVCSLCGPSRLSPSNQSVFIRPQQGTLLTPLKVPHFSARSPPRRHNYRPAEACLYVFMSPPCLFR

SEQ ID NO: 971068 - protein, 150 aa, Homo sapiens
GGGGGGGGGGGGGGRGGGGGGRGGEGSGGGERGGGVWGEEEVEGQGVGRGRGQRGEGKWGRWGGENGGRGGGARARGGGAERGGAGRGKGVGGECGRAGEGRKGGEEGFAAKHGRRKRARARRARRAAAVVREREAHTGDEHTNKEQKKK

SEQ ID NO: 971069 - protein, 134 aa, Homo sapiens
VPPPLRGCLDPPVQVLTRDTGAFCVRLPILQGWADRLGIFCAPGALSMKCVRCEDPVMLGANYVPPPVLAVSSGVLQPPRRASLPDMCPGTAPGVYHPGESCRDFIRTISLRGLPAASFILRKTLRKDVTTITF

SEQ ID NO: 971070 - protein, 209 aa, Homo sapiens
MKTDTGARLTSVIKIQCCLYLSVYLESLPPETRLVCKHPLPAMVALRLPCGPTRCPQNRGMLNSRAAEVTPTFALAGMYGTGGHILFKKPRLFSSFMTTGSILPALFPAWTTTDNKVVGQTAPPHGARGCVAHRAVAPHTSGGTPRGPPQIPGKLMDSLDITRGSYHQKFQHAPCFLALAPPKECWSPPAAFYKAQGAIKQDVFYKPPP

SEQ ID NO: 971071 - protein, 290 aa, Homo sapiens
RGLVCSRVFSSGEFVHPLGAASGAYLVWVPVCDALHILSPGCAGAPLSPGACIRLAPRRPDGGLFLCWWSSGLPVCFLVLGWCPTAASVPRFVLCRERLVYLLMGLPSSCGDIYRLVVLPLPLLAGGPVVTAAVCLGVGARLVGTAPLAVMLLSRRGLEAPRWSVAALWGLYLYGATISRPPRVVVCSQGAVSFLLQRPPSWGSALAACPLGWSTRAEPPRRWTGYYYWRRRSHRPPPLGGGTQRPQSLLLGWSYFRSGVSPPGETTERGPRRSHGHSVPSQNRQPPTNK

SEQ ID NO: 971072 - protein, 106 aa, Homo sapiens
MLQTPRRTPVVGRTPTRRSNSVTDFFRRMGSHVVTSPLLAMHVVPPLLFSPGNFPPNFQDSPSSICPLISLYVLRSPPRESDLLVMDVEQENNMVTCVFFVVIDAQ

SEQ ID NO: 971073 - protein, 221 aa, Homo sapiens
MYFPGSKCALNNCEKVTRGDMSSPNGSRFTRRRDNASTLNGFPLTNLGLTPPSPEILSSSKGLLLYPAHQIIVPPPPFVLMHCLPSQKVNQTSSLIIANHPKVECLPPTHPQLRSQTFMRVPTPPLEHYRGSLEEKTQNFSTTTYYQKEVLRSYFNLEPHLCKGPVGTYKIFFILSFSQPPKGPQLFLLYMPPVQHQWWNHYAAPQRIPRHLLCRPHIIRF

SEQ ID NO: 971074 - protein, 162 aa, Homo sapiens
MQRVKSCCYMVRNLYVFGLVMLMSLGNHKSIVLGAPPGIFLAPRGQCFVRARFNVAENKDSRRIGERDTCRGLRKRFPLEVTPRGVHPGQQEKHLMRVPAFAEGPFLSCLIRGRFCPEAPCSCRPSWNMLSAMSLCVKPRCGSFNGVSAPSWKDSVIVLRVQ

SEQ ID NO: 971075 - protein, 99 aa, Homo sapiens
RVPPSPHKSGGFVPPPRLPPDVFGAPPSPLAVGIALAESPPGGGHPPSTGAAFIGTICFRPRFYIFHYDSPRDHNMFKQEYWSNVHKSVEAHLWLQNRL

SEQ ID NO: 971076 - protein, 211 aa, Homo sapiens
WGATWRRIYVATLSFCIFRGILYSGVTPWVDHTVVCSYTVFRRCNLVSRGSGVVPPPVAFSVGPSGRPELRPFVPTGTSAVLVPTLAVFVLARKVLAFGPLFAFSFSIGGFCALPQWVVAPGVPPYLSRTITLLSDFYPSERVCASTIVILGLNVDLFLVATTVFRRVSRSYAGISMGAARLLGKSHPHNCFHARLATSFFLSTRHLRIVK

SEQ ID NO: 971077 - protein, 136 aa, Homo sapiens
MGKEVIKLRYLPLDMYSPLPGIGPVVKCPHPSLDRAHFHCGASTDVLLNNKIRSFLEQILLEHKQLRNNNVTRLPLFQHTLLLRVVVTTGRVNSFTSKACTYEYIGLSSHAPRSYFVSATKNSMHMVTRPFLIFTI

SEQ ID NO: 971078 - protein, 110 aa, Homo sapiens
MPEFLTTNFISNTSIFIKDAGVEPCEKVLPLIIPSRTRVFPRSPGVEGDQLIAAFSSEREDIFVGIVGEKSGEVSGLSKKGLTAAPFIACGTIHDGATGIGAPQEARLVR

SEQ ID NO: 971079 - protein, 102 aa, Homo sapiens
VSPLSPPRGCCFWVTHQRGCVCRRALLGGYLFWCDDVPPVRCATGGEGCRACCRLTGAKYFHSVGGALLRSAAERAVGYALLHSKRGVILGKTTYARVYFNR

SEQ ID NO: 971080 - protein, 220 aa, Homo sapiens
LTYIRKRSVSTQRFTNRQQESAAPNPVTPETPSWGFNNKTGTGGRPANTSRVMENLTQEAVAFQTRIQTPSPQDSGDPLCYKHPSRQEVQNEPPTRHKNGSTRPHAARPHTGASLTPRYGQRAHIAPTHYRRYINREPRYATCPGQHVIERMMAKIIPSKQVPPSDGSPEACSWSPQNRYRKHTGGLKCAFIKAASSNSASCLPTLFSPPKKKTPKKLLT

SEQ ID NO: 971081 - protein, 127 aa, Homo sapiens
AVCPPFGAEGSCCVGRRDCWGLPCVRRGGYGPLCGREPSCAGFGERAAAHFSWSGPSGNPDAAGEGLVEARCGLGRLPCWDSRPLAAGRSSRGSSPWEVDSTHRAIHYGVPRISPSVLLLIPPPKEK

SEQ ID NO: 971082 - protein, 180 aa, Homo sapiens
HSAEEQMDKQRNNLEMSASFVVLYLTKAYLWHLEFETLCVGKVPCKRNGCVAKSAVPTIGRFPNRGIFFGNVLLSFQFLDTPKLVANGQPPLENDVSPQSGKYLRNMSGDSHCRKYHFPRCTDRYPPIPATPVSTPLPHSPPSFAPTKHLKSNYCHPILHEHFLPPLPILLRETSSANPP

SEQ ID NO: 971083 - protein, 222 aa, Homo sapiens
MTWGDNMGRPPSRGAGVCSLRSFVQESRGSYPAYAPMRFLSSSPPVVVVHPARFAGVSPTYLGTIRRGIPCAPRAVPRAFLNPRWRLSPHDQGALWDAPPPCEPPLVQVMFPKHSLALSAVAPVSPSRKFAPHTHTPFIDPSSFFISLPRNHRVCYTTHTIHCECCGFEIPIKPHNSLRITPYATSMSFLPPPKVLPQTSLHPTYVTQAPSFGFPNYNKPTK

SEQ ID NO: 971084 - protein, 140 aa, Homo sapiens
MLCADATSRSAVARAHVRRGRLIAATHVSTCVTVSGIPPSLTYRSGTPEGLFPRSPKSPTGAHPPRGLPRPKFPRRNKKRCPESLPLQCGGIPDLPHTSSVQETPPHACQQGGLNIPGDATAGRVKKQALPVTPQKQQTK

SEQ ID NO: 971085 - protein, 110 aa, Homo sapiens
MAPTDFSSGGVPLSRDDCGVTINLRRVLTRVPPLQYGAPPGSRRQAPRGRVVHACQGLLKFRATSILAPPWHAVISGLHDFAAPSWHRRPPDTPFLPPPRRVQKTPPQQN

SEQ ID NO: 971086 - protein, 119 aa, Homo sapiens
PALWSTWRFTCSVSLWSRLDIVCRFHGGFRTVRLYNWASPFSRGCFARPVGCCVSRAGATFVSWWGADWMSPWCVLSCMVRSTPSGSVPSEPSMFIHMCPSQVIFFNTTPRFDHHPCKK

SEQ ID NO: 971087 - protein, 147 aa, Homo sapiens
MSFSPPRVGVRVWPIRRGAWVAVSPSRLGGIPGPWCPLTIRAFCCVFLLENGSSFVPCSTPGPWKLQWHDLCSLQPLPPGSSNSPALASRVAGITGTHHHDRLIFVLFSRYGCYTMLARPVVELHTSGDSPASAPCHPDETPPPTKT

SEQ ID NO: 971088 - protein, 156 aa, Homo sapiens
MRLPGFQKDCAWPPAHLLGYLGIHHAARLPPHNPTDILVVSKRTTGSFSNWRQVRCSEYRGLPRVLMRSPVGASPNVGGNKGWHAPTCPSPYRTFMAYKTRASPPLSMRCMPGTSDEKYTIVYEVHGNICLNEEPSIIPLVEEKKIQRGRGGQSMT

SEQ ID NO: 971089 - protein, 63 aa, Homo sapiens
MYPRGMQGGQHPLMPPRPTARREEAPKKSKWRTPGGHEGPPNPGAPPLTPPRGPGRDSFPHIT

SEQ ID NO: 971090 - protein, 92 aa, Homo sapiens
YSQQQNTKKRRHMTTGRHGDHVPPACEQSPILSPPLKAPIHCPGKANHCGHPAFNGTPTGNRGLVPTGGTHVSVARCAPRVNPHVWRRKVKH

SEQ ID NO: 971091 - protein, 113 aa, Homo sapiens
VAPLGCSGRHRDVCDSFPPRPGLGLCKANNGRLAPSWKPTCVVCWIRKSRRLLLFVSPLPANYLLSACVGGTLARTLVFVARTSHDALVPTLLGRQSCLLGALLSSIHTSAMI

SEQ ID NO: 971092 - protein, 207 aa, Homo sapiens
RGCLQCPGTASASRARSWSWRDGGRSRVVCVWRARAQTCVVCRRRGRRPVSLCGGVRASGCPVGVVGLCRPCVCWCLSFLCLVSSCGCGARTVYRVCRALLQTRVLSRGIGAVARQRVVLVLRWSGGSWDWRWCWCVFVGFGLCFRDSCTEGFVSCRFLASAPTVFVLSRCGSDFCGCPAALVRRLLRMSRLCVGLAGGGLFLFCCV

SEQ ID NO: 971093 - protein, 149 aa, Homo sapiens
MLGEDNGGTPNLFLGQPGCIAKDNCRPQRCFLSGGRFKWSLVVPRGTPSARVVHAALSFGVSWATSAVLFQAPRSLGPPPDLDIRGQGPPNETFSETTCAPSFSIWALVVSRPFMRGEYPRADTNFGGLASWRNHVGRSLHDIGALGQT

SEQ ID NO: 971094 - protein, 204 aa, Homo sapiens
LMIINQAVHHTRDNNKMRSSALDPGVLNIVPIICAPSRQVLAQRLHLFPGCLPITTGVQLLLWGILTCPVDFLHPVVADICSHDKHPGCRAYLVWTPYNPCGGKPPRFERQGCDPEKHVDKSWCRTQLLVAPPGGPAPHCFVGVTMGCNPTGAFPIHRGLLSPLSPNGVGEFLCRAPHPRGNPRVDSTPGWVEFPRPMYAPTTL

SEQ ID NO: 971095 - protein, 299 aa, Homo sapiens
YVVASWFRITDTARVTPCRACYPYMGLSSARHFAGPRLLVQPICFLSARNAGLPFLRPKGWGHIYAGITGGKTTDPPGGIPRFPGILQSGGCPRCPLSPAPRFSLAPPRRCREQLKRPCGSLRNSCEEKEKRPRRTRNSHGRRWDVPHGSTKNHSSHQGGKSTEQVLTKRGNSVLRTQDHPKTNIGAPRLSWRQPPVEMPPPPPGNKASWARHPEGSDSQKPPTGQNRGNHPSVWVEEYTNYNRRSGGQRTNRPHSRQERCHTASRFRTPRRRGPCPADPDAADPHPPPGAQNTPLQQN

SEQ ID NO: 971096 - protein, 124 aa, Homo sapiens
MIVVGVASRRCLGDGRGARRPPSGVTAPLGVYRALYWLFFFPPPHCPPPESLVRRNGSPNFLLNKHQNQVFTSAPGPPPKNSGVFCPLLPGGPTLASISAHLISATFRKLRGSPFEAHNPPVLQ

SEQ ID NO: 971097 - protein, 301 aa, Homo sapiens
WVFSWRRCRFCCGGARPSLWACVSSLLAGEIETKKKNRKKETITRRKKRESEKEKETRRVSGTACCLWSRLRLVSMLMSTALTFAVLVGRFPDLLSIGSVVRLVLSIFCWCVSYSRLRCVCCRLVWCGVGGVCVVCALWLGLLSSALVFVAVMRKYVVLCFGLGCVVVLALFVFVVCAFVCCGSAVLVWLLRSRLVVLCLCRIALSCHGVVVGQFRSLCCVAFCSLWSSGLCSLCCALVLLGDFFCKLSVVFLAVEVVARRWAPFVRCRVVSCLERCIVEVRRDSFDGSLLVCSSMLRFVL

SEQ ID NO: 971098 - protein, 120 aa, Homo sapiens
QLLVNGSLLFIPRRRFNPVPAPLPAVFRAPRRSLLGTFPPRSLNTHKSRSHPRVVPEGPPRARPLCVLETSHPLGFSARQFSSPHILRSLCCAPRDEPVNIGSVSSPPPALLPHKRLSHH

SEQ ID NO: 971099 - protein, 112 aa, Homo sapiens
MLGGARSPRGVWEHISCPPLAESVPHVRNVADLRNCSLSHGDSPRPRPAPLGPKGISRGALSTRERYIQKTLRLDTAPLFSIDREVSSLYRAFARTAWGAPPLTLAIEPPSV

SEQ ID NO: 971100 - protein, 111 aa, Homo sapiens
FAHNPSTICGPHTWSPSRPPTRRVSTKWRTFKRLFYQPSSVKLLGIPERFNTSPPPAGAPTLNSGLRSHPKRPLLLPNMLPQTSLLIHAFCLPNIFGNLLTELPTSISPQL

SEQ ID NO: 971101 - protein, 423 aa, Homo sapiens
MTGHPRLWCGGSLFLSLWRVVSGSRVCVGVGLALVFVCLSVVVCVLDWCCSSCVLFSYSLFFPYSVLSVRPLVVGLRVSFMCGVYVCACCRFARRVAVCSLGVGGSAWSRRVSCGVFDSYCVCLSPALYGGVAPVDVWVGARGVCASPRISSVSWWGVVVVGCLRSMSPLSLLIGVCLVCMFRHSAGFSSCVWSFLLLRVCLASAFYGVLCAYGSSCVCVAIAVYYLSVAVLFVFVLSVSVLLSPIRFAVFAFGCGGCFVCLAVLVFSRFSLLVFCSLSLVLLSIVFFLSCLLVVASRFFFAHVLGCVSFCCVSVCVVVLLGVVWLFVSVVGVVSCCVLVCCIGGVAFLLVSVRGVFVWFVRVSARRSGPFAPRLCIALTSSCVVWPPRVPLPTVFSQVAFRRIVPPSYIHLLDLCGPRHALL

SEQ ID NO: 971102 - protein, 123 aa, Homo sapiens
MLPPRVCSRREIQYGQTRFPNFSLNRRRISICSPPESTPLGLFPTPPPHYTSSPEKILPLPINLILKNSSPFRVFFSNYVRPATTTCRTIFPHNPPLCRGEIIFLGDSHGIKKRGNILLPLPL

SEQ ID NO: 971103 - protein, 35 aa, Homo sapiens
MIAMGTVPRHSAEALRALWRALKKNFFFSPNTTKH

SEQ ID NO: 971104 - protein, 295 aa, Homo sapiens
RQQANSIAGTTPRALSEHRANEGATQLYARETSCGVSGVVGAPPEIGRRRTLSMVATRGCSVGFGPSQEGVVTTNGATAREAPAVAGLFSHRMFDTSRKGVDMNTDGRQQRRQMRRACAPWGLGVYPPPLLVERDLMPFSPPTGYLPVEFSSPLEVGAPRPTFVLLLPAYGAIPRQGEISPTKRDLRYSLSSLVRSQPLRGSSYLCVKLAECLTRHPAEYYPLLMMNRDTYDFPQDYTEENYLSSRPVDDVAFIAGKPVITHVLHDGPTFGATKFSRPCTIGVFSPGGPFRTPLQ

SEQ ID NO: 971105 - protein, 216 aa, Homo sapiens
GGTAVPHGSWVYRPRRCVSLLGRLAPSVVCLCGLGDVCFLAPPLRGGRSSHTPGVPPPMCACRGPPPWRSTPIVCPARSPLGRSLAVCSTPRGAFVPASWCVRTRTELFFWGTYLPAMCTHRRLIVLVTVPHCEVTLLPTTRWNTPLHSFALDGRYASRFLFRATPTQDSMILIVLLARCQRAEAPFAPLCPAPDSICLQLSWRRTPPAHPRGGEK

SEQ ID NO: 971106 - protein, 110 aa, Homo sapiens
WTWPPGGTGVVAVMSRLVSVPFWPLGGPDGALVWASGRVSARASPGVFVASVYIAAALVRRLTSRPRMGEELGARGPSSPLSAGAGHGGGVHHREGGLQRRGPTRGHSDP

SEQ ID NO: 971107 - protein, 62 aa, Homo sapiens
MVFALFACSARLRLISGCHLLSVCALLILMTASAGSYLSDAFCPANDCVCSFRVTTPTPNKT

SEQ ID NO: 971108 - protein, 284 aa, Homo sapiens
GKHPFLRVDRTPFPCGFLKPPPWGVHQVMFALRPPLLPPLLCPRPCTWPPPTRPFVGVYYPPGGLSPENGAIPRRSPFCLPPTVIALLPTYRVSATMFPPSRLLLRHDCLICFVDPPRDGFQAFPLTPRDLYVGGCPHHPPVLLGNRCINFASLDYLFQCSRLFGATESLASPPLVETWPLGDDCPPEGGRWRDPTVGLARTGGLTPPAEPPPKRTYAPPISGNRYEGMHHDRTRCEIASTPETECSMAPWRYERRRHKSTQVQQHTSWAPLTDPKLRAAFPKT

SEQ ID NO: 971109 - protein, 108 aa, Homo sapiens
MIVARVTRALSLRSSCPPRFLPRIHPRGGPVAPNAMKVLSPRSLLLQDFIGPCHDVALQSFLLVVLLPARRRLFLIPLGLFVMGLTAKHMFRQKWERFSFYDNPLGNA

SEQ ID NO: 971110 - protein, 187 aa, Homo sapiens
MHAQRFGPCFVNPWLTPLLRAFFAAPRPLGVHENCLFRPTIWVPKTYRVPKGRQIVPDRMCKFWPKTVWPVFGQAMPERGCPSSRQRRDCYGAPPRKGGPLIQGPGSAPVAVGPARHHMALGHPAGNIGAAVPQRHTGGVVPLGDHCACAPRLKLRFACRDTPSQVCVKQGASASRSRMGALAPMRL

SEQ ID NO: 971111 - protein, 188 aa, Homo sapiens
RHQYCGRAEGPLLKGRLSHARLTIFGVARIASYSAAGQRLRFRDSKRLPLARKPKMGAHRTRAVGSRPVCRANVEGLPSPQGGTLGAGVATQCLCCAPQPEWVHVGFLEKPFNTPVLGARPLKFANSLPRPTKSFRALISGPTKTIAPETASAITLRWVHRPVAPILHPCPMPTSETIFRLPLVHNIR

SEQ ID NO: 971112 - protein, 90 aa, Homo sapiens
RSRGVFTCGGLRGCPRDVPLGPWYNLPDPYFGPSVCRAFCVTVGIFALGRVFVSSGATSFSGLSKYVTLCSAVRAPTRVLPCQSAPHLGV

SEQ ID NO: 971113 - protein, 206 aa, Homo sapiens
MTLSVVLCYVCGEVVFSVSAILVVRASVTRGTSPLECSAPGCQPLCSRVSPLAAVAMVLSGASLRISLWPLKDGVSPLGFRHFPGLCAPLSAGGSGSFATLCPPLLAEWQMVELFLFGAVFSSPRVIFGGPFSPTSIGCVRRLSMPHHQLCRDEPQAPTVCPVVPLATLFSRDVVLLLRAASLMLALNSPGKMHSRDTNIRCEELI

SEQ ID NO: 971114 - protein, 187 aa, Homo sapiens
THNRRRKRVDIDSAQLRYKLRVVTSCAAKQVHSRFETMPAHKVVDTLPDVSRNYPNKASGIPRTCPEKDPPRSVHRMHNQGAHPGTITHLVACTNGAHKVRQLQRWQQHGGQDTPYMCSVAPKGCVQKKKVAVMESSLSGVCSSETGVISEVLPPFLGQRFVPSGGTMVGEQPAYLEKRFPKTGPRR

SEQ ID NO: 971115 - protein, 156 aa, Homo sapiens
MRCPHKVLGTHGWRDPPYQTRTTIRERNRGKKPMLTIVMDRSKPKILLLPDEWVRTQPSLYPRLVRKTIFIRPPIVLDNHNPMARSSNSQVVILSCRSHSQSAKHTQVLVNQNFIVTNLSARHLVTYLISRRSPKQKYRKKNREKIPQKKFRAHIT

SEQ ID NO: 971116 - protein, 268 aa, Homo sapiens
MFALWHDSDLYRCGGRKDDYLDGAPYSEAVKPRLRCYVRDACVKPVCFPRGLPRHFWGETPFARPLSPVFIRPPPPEVFCVKPSPLIWAAFSYPPVEQRGAASRVPLRVARNTRRRTKFFLVGRAPILHEQCVTTRRCAPTHANNFPLGDFSSPPPPRREFNYSTGGPPPTHCGEGTKEGALQRRVTPHGLRRPNRRSGPPPGVMTFWQAAAPPTVNSFHAQRLEEERVGRRNEERMGRIKTLYRNTQPRRIQQPPPGTPKKTPPDKN

SEQ ID NO: 971117 - protein, 309 aa, Homo sapiens
MDNAARAINDCRRTRGQKRVNTGAHTRCGAPPLSRRVVETEVRTNPRGGQMCPHQDQRGMPPGDCKVFLTAATPRNFGRRSPSELGDPTNLWAVGASERALLRRPDASLRPTKTSAKSWCFLLKEFLISGARHPPPPKEGVNLLPGSLSAAEGKKLRGETGIAILIEKHKVTRKSSVGEVAQKMKLFVIGERALSQDYDGTIGPDDESFSSRTPSIIAGKKAPTGLTMGAPVTKGDSRTRSGDKGERIEIVNGITEESMKKTGMKKGASLAGVIFAEEGAPPETEKNTGKFPLWAREMVKGGNLNRPNI

SEQ ID NO: 971118 - protein, 240 aa, Homo sapiens
MLSFSAACVLCHVRYTGLSGDRSGCPLPGFLARGFLLRRLAHRGQTGGSSPPILGSPAPLGVNFGALLRLTDSVQAPCEKRSGLKKKPSSGFTAKNTGPAFFFNAAKKAINGAHSFQTKKSDEVGNPNIARRERLPRDIQGKPLYHESSVLQHHYRHLGVRDKNVSCLKKAGVRTIKPPDSPQGDIDNPPHEMGGPTGRNQSGDRRVPHLSRAHSGAKTGRGICKLWGFLFPPVPGECSH

SEQ ID NO: 971119 - protein, 112 aa, Homo sapiens
NRRTGAITHPPCCGREKISRNRPPPLAESTGESGDDKSRISVLSWEINHTTPAAGGRPPDRLRPRSHQRGAPTTRCDSASGSETKLPWGRNSSIEPLADKTPPAGGESPPRI

SEQ ID NO: 971120 - protein, 268 aa, Homo sapiens
LDRLPLALAAVSVWSPRMFSPSIGVLICARHSLVVAKDALLCAPYASPWAQQTPPGRRVVPGVFPGLCHKGPVYNAPLLSIFIWGPRSLRRVNQPRLSWILAPARFPSLISPSGSPMGRHRPPPPLRQGVQILPASPGPPSGGYPRLVVVVPPVAQLLRNARSDLLKLHPRGFSMLTLNFSSSGVGQKFPHDPIFSQPLYRSPVAPCHITCPPDILTRPWCTPFPCAQHLGGRVVQTTCRAERTLVPLNRGPHAAPPPTWGVLVRQLP

SEQ ID NO: 971121 - protein, 104 aa, Homo sapiens
MSPLHAGGFSRQVLGAESYGRVSENGEMGRIKLGGVLNATFTAVKILGPPRTRRNKALALWRETNGPGHQDHNTGGVPLPLGARTPQMIRRNRIPPRGFLNMIK

SEQ ID NO: 971122 - protein, 268 aa, Homo sapiens
ERLLREDAVGRAQVMPTSGTAGLGRNAVMGSRRPRLAGTWGDPPRRENRAGFTRRAKRVLGDSLAKSPGVGRQVGPAVDGPRPEMTPGRSKGRHLPGAGTNSQGPTAFSRRKYLSPTEFWLCALKNRGKGPVRAKTTSRRAFIRRLMRVPGCASRTTEGGGVIAFSPPPPIVEDRWGTPIKLGGAPQLDSGAEMIIAPKKQSGRAPRKAITRTVGGKVLYRERGQHGQSTLFVGEKENMVYATDAGLRRKKVNLLDWCAIVASKKRGL

SEQ ID NO: 971123 - protein, 103 aa, Homo sapiens
MVSAYRCSKPDGAFPTNIWEQYSCTFLAENQGYQLFKRSCEKPPFAGELKGRQVPLFSAHFAGCGNTVKWAIHPHHEGCRLQRPAFLHDKYSRCTVSEPLTPL

SEQ ID NO: 971124 - protein, 147 aa, Homo sapiens
MRCESYTLEEESRRRVVRRAWMLKGVQRPAAGHNEVDESSRALLKTTKIEAGAVGGIYPLRPREYLLEEERGRRRKNNQRSKPAGERAERGGSDDLTCRLSAAGQRGRLNDAVWIDDEVARPSSRGRSSERESNGRQAREGRLSEGT

SEQ ID NO: 971125 - protein, 120 aa, Homo sapiens
MGDSPTNTGRRHQTDTVAGSNTRRQNSSSQTPRGLHPREGRDMGLKKAAPSYYRQNYGTLIKTIFVLTQQCLPAPTLWFQPGGIYPPDPRNKRSESTPYTYVEHVCRGNVPINESESTPG

SEQ ID NO: 971126 - protein, 123 aa, Homo sapiens
MLVTYHVNGHAYSCHQNDRKSLCMGTSDNIRGPSRLPRDAILGPDTRAQGGLVCGHGSGPKSSVLSFASQNLATNSNRRTTAPFPGTGFTTHAVTKRSPTKGGKDFSTTAYKACALDDNELEK

SEQ ID NO: 971127 - protein, 74 aa, Homo sapiens
IPAFKPWPPVEPNNEVLGPPTTPKALYGSNPFYLGSYNPAVERLQLLLDRVLAFQEMGRTPKGAIYIDHVPREG

SEQ ID NO: 971128 - protein, 148 aa, Homo sapiens
MLGESPHLRRDAHSASLEYARVYRMTMRPFQMSSPWFRTRDRIVLETVRHRPEFLAVCLSVEPLMHGDSQALLRLVPANIGRTEHSQWRCCRIVLIDKEAVLATGNPIEVWTPARNSVFRAELPLTSGRTGYKQPALQQKQRIAHELD

SEQ ID NO: 971129 - protein, 210 aa, Homo sapiens
PLARLFVVKRALVLTHHCMNHGPRTLPKEVLVMGRPFAGGNYLLIRVDAIACWNNCWRVIVIPGCYLYNRVKRISGSPTYVGGKDLFMIGEQPSSCIRIVARDTPCPLVGNNTGEVHISGVMHNALFLLTEGFHSWGGAGTPYHVTAERPMYVSPRHQAGASPCCATPHSEDAYWYVHVWERCWDVLPPDTVFTKGVVFPMHLIKNPPQN

SEQ ID NO: 971130 - protein, 107 aa, Homo sapiens
GAVFLGKSPNSPHIIFVDLSKGSRGFLALEFFYCQTAVRTNKGGVVTHRGCCTLGFSHVLLLCPPDCGQSYAPRHTPPRGYGSERLCGRRSVITKEYTVGPTSFPNK

SEQ ID NO: 971131 - protein, 86 aa, Homo sapiens
MPVQNLGFYGTRGSAMAQGSKPDYALLQLPVWQSRTAPQVESAWGNMVQGPRLGTARSAVSARSRHDQGARRTGRTRADHTRRRHT

SEQ ID NO: 971132 - protein, 210 aa, Homo sapiens
HHHTEAGLVRTPRRSHREAYNSCARTQKRRKCGKEGTAGRVLSAAPVGCPKANCTRKQCGETRWWPGRRSHGQKSPTSPESPEKLPQSMETLGHNHAEDTDRTRRIMGNGPHTPPAAGCTHRGPSHNVALWIEHMRDPANKKAGHEGAWPLQGTQAASSLCVPSRCVKHRSTRSLAASIVRTSVPDTKRTRCAGVKFHNSTPPARRPPQK

SEQ ID NO: 971133 - protein, 232 aa, Homo sapiens
MMSSTWRLCSETYQHRRPDCTVESSRRMTCDEEERLSRTFNSSDSDSIINNWTRMTGVYTPSRPEMFTRGTGDDRSDEEWATSILKMDMSEPETELEGESAEDALDIANMRGACPAPGMRLIGKRAFQATVLNDRWDAADLCGMSSGAVPDMSSKLKGGTGSTAGRVCACATKGPRATWRCRYRHTCGGHTTQTTRATGTPKAARREDGKEGTKAGNPRDTHQGPQEGAHHA

SEQ ID NO: 971134 - protein, 181 aa, Homo sapiens
MLNNVVKLPKNTAQSKGDILPPPPSDEKPRMVPEEWPPPPGWLHARISVTKSPSYSRWRTPREERIVSPRQEVQACLTSTSHRSPEAAAAAYNLRHDAPSRHAPDIVDQTSCVPNIQIGNVQEEWAKLNPQRPPVCDKISPRGSLTGDGLFPRRPANETYQQPNRRQRGAKIKRGRPTKNK

SEQ ID NO: 971135 - protein, 237 aa, Homo sapiens
MIMAPYENVHLVANLLPELFDMVMAGRGGIRKAGKGRLAQGVFGIRDLQTTPTNTTKQNNKLGRGAPSAPRKKSFTKPTSGGGRRRPSGLRSPRPHGRAQGGNSGGCDTRSRRFPTQKKEGGGGERDGLLEQIPKGARRAHRGVPNTQGSTKGQPIKEPAAAGRKERTSRCTSEQKQHTRTSDDNTTKKNEITEKQQTYNSDRQKYKRTTQKHEHEAQIVQNRDNNTRRRTIEAYNC

SEQ ID NO: 971136 - protein, 205 aa, Homo sapiens
MFLKKSEKLESWTYLESCKTSCTIVAAREQIRPFEMGKPPVSTGFTGLIMSVLASCDIWRFFDAVIDFVLRQPAWFLAPLASYESIQRLQHFMASVRIQPPLISSAPIFVPGIGAHPTSCQTKTFLWLFGNTPYSGAKHRVLIYIKKEKAPIYTTASRSYAHRCFSLETRLIIITKGIYTSDPLNCSALCFTIASTPAIDYISWS

SEQ ID NO: 971137 - protein, 292 aa, Homo sapiens
VVRVRVPPPRPSGKRPFQEGGQPPNPGGPGTLAPKCGAARRPPDVATKNCCVRSGMETNGLVPHVGPPPQPQEGDNPVFHPPLCRYNAFRGGDVAPKGEMCPADCFSHQRGHAPGGKSQGVPPPWGKESYPGNYQHAVSSAPKFPPKRRGHPQRGGPTTPGATPEFIGKTSLMDNRNNLQAPTQPQWVHHPVRPRHTSVKGNRGAETNKLTQREGTHAGKTTGVNARPVSTNAANIVPARVWGYPKDPSDSRDVVKPYEHMVLKPREGAGEPQARWYGPHPPHRGDKGACPQ

SEQ ID NO: 971138 - protein, 222 aa, Homo sapiens
MWRIPGGTPRGAPASDPRGLKEEGVVHTGPKDNRPPWQNRSARVAKGSDWCGVGRPGRRGCRIPLAHTKKSEQGVGATINFPTAPGKRRGVVTPQASTKTGRRGSTKVCDEDRPPSAVVGTPAASHLPRAPQQKIPAGKHSKGTIDPPPAQTSRPRFEGGTNKQSTRSDNLVAPSRHATMWRLPPAKGGPPQNPYSSITWHPFPISTSGSRNPLSILDNLPR

SEQ ID NO: 971139 - protein, 164 aa, Homo sapiens
VDRLYPSCVACDCSGHDGGEYVLLKDMAIICQLSQVAPVISYPQYLQSIRAFHTCTSSMNMLSLGSWMATGTFHDIRECLDTAEVTEPSLIVQSPDAYKACGTKESSICAQAAQCIGCQSRTQLDVRCLRRVQDKCLDAIKLSMSIWDYRGPLELWGYDLGNFT

SEQ ID NO: 971140 - protein, 202 aa, Homo sapiens
LSWCGSLPRYPCGLARVGFPIVRPLWWRPRALVCFGPGPGNQRFGSPFFPVGRPTLVVLPQFGCPRRPTVPFVSPPVVGPPALFATMAVGRQLEDISFGGDLARRLPPPLGPEPLQPVGAAPQPEIKNVCRPALWRTQKWGPPGPPLECHKGPPLKRREIGGGGNPAETPRTSWEAPPPGQRNRANHPHGEISSSRPPLATI

SEQ ID NO: 971141 - protein, 298 aa, Homo sapiens
VKNERTTEHGKQERNGKGTGNRTETEQNNNTNNKKKKNLVCGAPPLAPYREKKSALHTDPFWRWARRAGPQYREKWTNGRKSGVTTRKKPVGTKTQSAGGNSLTPKTQKRPRGGDNRAGGPLSNKNSTKRESITGGAHHNGRTQITKREGATKEEAPARESQDMRKAARGNQRRRTKQTTQSKRRDNRTRHTQQTTKAQKERDRRQDTTKKDKNKTQQHNRQEERSEKKKKKTKKEKQKEKKHRGRDETKNNKRRENRRRGKRRKRRTRRREKEKEKKQTRKKERRKKKRDRKERKRK

SEQ ID NO: 971142 - protein, 310 aa, Homo sapiens
VIVHSCVGCRYVVTQARDITPGVPGRDWGPSLCATQVSLCAGRPMSPCRVKHRRGSGKHWFVSRPGDIACCALAPVSYELPRWYTWRVSSENMMCGDHPPEVVSGCAPPCRLIGATPPLGQHSSEPRGFGRFLYAPRRVCSLLGRRALSSFCSPEGPQGGGLEHLPVTRRAWTKPTPLGTISHHTISEHFFLYTRKTPLRSICLLEPDDSPSPAGECLTAVPIPHLSYSRGNNTKHSRTLHPNRWSSPAHPGGHTMGAPPPSRDASGGYSPQRKGESFRHTRWVRRSPWLTTYGKHRGPPPPKKMSAQQN

SEQ ID NO: 971143 - protein, 217 aa, Homo sapiens
RRYFPYHEKELITLHDHALIIIFLICFLVLYALFLTLTEQKSLNVILDISDAQEEEEDRSELSVARASILSLNRPVPIPKRSFTQTDEVNDPVPYHQINWPPMVLNLRVHRTTGTNLQLLHTSPIIPRTRRLRLLDVDNRVVLPIEAPIRIIITITRRLALMSCPHIRLKNRCNSRTSKQNHFTYTTGGLLRSMLWNLWSKHSSCPSSLELSPKNLE

SEQ ID NO: 971144 - protein, 108 aa, Homo sapiens
ALSMVDCVTSTMCRSCVRCTGAMTASPRFGAPSYPKSRSYSVLSPSTLFVPLSPGLFPPRCILSRRPGGPSPFIVGQTFPKTPNRPVVYPRNSLGSDSASSMVKHGVK

SEQ ID NO: 971145 - protein, 261 aa, Homo sapiens
SINPRSWVLVTAPLRYVSFGPTILPPQICSQRPAWFPFGASFFFSAASRAPGVLSAPPRIVAPPFGPRLGLPSGRVSFSPVLLLPPFVPGWISHPASCLDRLNFPPRWRPSSCLLRAPAFSPRAFYPPPLPVVARWTYPSCRFRLSGPQVVALRGGPPFLYHRALQAASSWPRIPGRLGGPPHSLCSLSSPGEELSPLAGRVFFGRLNSTPSPCMESSCCTEFFAFQNALVRSYETPASPAESGEPDPRRECPLQGEYGPP

SEQ ID NO: 971146 - protein, 104 aa, Homo sapiens
MRKSESPKTPPLCQQDPPPPPQVGQGYDTTPSSEEDIYCRPEHTRKSSVTSLATQKYAHPTPMRNPSHPPVDIGQSVIKSGNPTGCWRGSGENKEHLYTRLVGL

SEQ ID NO: 971147 - protein, 95 aa, Homo sapiens
QLLEFSVLLEADKQVLGPRTMYRNQYDNDVTVCEPPRPGFHLNLRLCDGTLLNKGSVTVGLYIKNVMQFGALSLYKGRISELCRLIRNNRILHVD

SEQ ID NO: 971148 - protein, 225 aa, Homo sapiens
KCPEQAPRIPPKNGPDHPQTLGRPITRANPAEPPRPPGGHGNTGKTDTGRGPPQPPIPHEGSHTSDGETRRSFAPPGLQTRIPRHLRAEPLRAPQRCSPACDTIKPKRRKYRLQPHTAVLSWDTHPPPEREASTKRPPKNLPGGHHGLEAPHGSKRTRGTPQLLLKSGLPGPHEGGDATQKCLIPEGGGGPRTFDPPPWSCIIWRLWIHRDRPPQKQTSPDSPNM

SEQ ID NO: 971149 - protein, 162 aa, Homo sapiens
RLHPFHVIRINKMLSCAGADPGSKYGMRGAFEKALGQHGGLGFLQIGRSMIMSDPHQMPAGIKERCELEAPATGGPSVRDVHGLAEKHPTIFKEESWGLYTYSSQVLDEMVKTMDGWRGRVIPDWAVGVQYMASALDHLELEMVRSPAVLMSGFQMCLARAS

SEQ ID NO: 971150 - protein, 146 aa, Homo sapiens
MARCADCHMSSRCGPSRWPGPLACGHPVGRPRNSDPCLCGHPYIWVRAGPVIPFLGPLLPDFLTRVGDLFGPAVSPISVDLRVSRPYVPFPARRYISKVCPRRIDLACHGQHVGRTNVGGSPEAHRVRATLGDIVSPPSLPNTSRV

SEQ ID NO: 971151 - protein, 197 aa, Homo sapiens
MLYLALNGSPLAVAPIKGPRLDHAVLPLPLFAAVYPPSRGDQGFPPPPFVCPPGTDFMVVRFRAPCGDRSPFIPPRPWGVPPVHYHQPGPLPHGLSTNRGCLAPCLVSYHPPRVPPSPGTVFQSSTSTSCQSVRQVPFYPVLLVDECFTTTQGVKPKGVFVLEPQEELLCVKSNTHASRSLAAPNNRPTITSGSHIL

SEQ ID NO: 971152 - protein, 111 aa, Homo sapiens
SWCPLVLAEEPLDEPRKAGQGGQALWGYQNRSSNACVWPTLLDLSRDESAKRNSSKIGIGGIMLELSVHFGHKGDLTNGKERSSGRTIRKFLASQQNATVLKSESSKPMNG

SEQ ID NO: 971153 - protein, 269 aa, Homo sapiens
SLGSSPPSYSPRGRILQWTENPGSVKIGPFFIILQPSFTGSLVPPIEPLLPKRSNPRGFKDRRPLTFYQIKSARLWNQTLDIIFLGGNSGLDSSTHSTQWRPRDFKERISIWLFPRLIESPIPLHHEIAPVSLIQIRRIPAPFLKIDQQIVGPLLILHIVRTTNISSELTFYPRPVPSKYFVPTKLHSHELGYIHHERHTVLAFTPPQPKLSRSSRTLVVPRKGKSHYNIPSTSHTYGRTTDHVYPYASSRKPHHDFWGRNKIFTDILR

SEQ ID NO: 971154 - protein, 121 aa, Homo sapiens
ALPPVVSPGNFFASPHLERAFCPIPAPSPRREHSVLRAKLWILPPRSTPAELNITFGAPRSPSTNHESSHMRIALLICIPRYTVPLGRVLKPHHQLGSQYIFIFYDNHNLRFISPASCDKI

SEQ ID NO: 971155 - protein, 65 aa, Homo sapiens
MNIPRKVCDEQWGGDPLRPTAPTGEAREPKEYRLETHRRRKGPTKITSSPPRPPPRGQKKTPPFK

SEQ ID NO: 971156 - protein, 125 aa, Homo sapiens
MFGRESRTRVLEGKSCINTILTGNPMVLPKIIITVRICAIPSRGSVRGQHRYRTHALIIGLTRWAQQLQVVPLDFKESCSKLVSPWSYEEQPILQIAAVSPGATPQRVRDLDYFLQKNPPVFHRH

SEQ ID NO: 971157 - protein, 260 aa, Homo sapiens
PQTPLIEVAALLNKAWGPPPLSFQKMSRTTFVVQSPPSLWRQYNSSMPQYMADPAPPPNLCPKLAPFGSPQQETVSLPREIMVVRIDIVTEPHARSSLIRDMSKPHITDLPLFAGSETLQHTKRIFSFRGGPRTLFSQRAPGGYYPPPPDTVCGVLHMVNPLYWVTLIEEQRKSSGVYVKHPPYTTMSCATREYMFLEAPKNLAHERSHNQYVRTILSSPSYRPARGFFVLYFVVTRICCKKKQFYAVAPRQASRKTRPY

SEQ ID NO: 971158 - protein, 139 aa, Homo sapiens
MLGSQLFDGPCSPVPPMMSTAMWARTRLSELFLCAYPVPSSNGRHTLAASYKRFFVRALFSGLHLCHDAPRRNLGQPSWPGHGPLFLPRGLQVGLPECTTHIHGVNYSPLMREVTRHPADIPPGCILEVCPPRTHFRSL

SEQ ID NO: 971159 - protein, 94 aa, Homo sapiens
MTAWDLLELRLALLEGPSLDSAAFLVGQRGVISIGYETWRLPRLAKIRVHNKSNISRVETMQTDAPTAASCSRCAPPPPRLPPVSPLPFKNAKH

SEQ ID NO: 971160 - protein, 220 aa, Homo sapiens
RATKCIQPSPLCAQRRGNAAGGAIPLGVVNSNPLKVKVGGETLAGNPTGGLLTTASPHLGQPPPPLEQSGALSERKTGAPALPPQSRETHSPLELAHSRDRQHTFKRANTPQAVLGTLPPDRWAREAHRFSGRITSRDRCAHSTNMQHTGCAPPPIQHPGCNNPARGNMRGKTQTLGPPSWTHGTTTFLRERNPLYMGEVDTKFHGECLRTSRCLETAVQ

SEQ ID NO: 971161 - protein, 238 aa, Homo sapiens
GPREAWRAEGGESRPQGRGSDAVRWERAAEGRDCGGVKLTPYGARARAVGVRPAVKEMERGGRGCHPEGRPRCVEQTSEGGGGRGEVATRCGSRTQGLRRPCGARGKPPWVITEGGGAIPQARQMCEMSWSRTEEEMMGERWSMDNGGVRVGGEKAERGREGGAAGGGESATNAVHEEAAVNQYEGATPVRRRKLPTGPHGDKPLWAIVCLGAPCGCQTARMLNPGLIKNMPRATGGN

SEQ ID NO: 971162 - protein, 285 aa, Homo sapiens
MCLVRVEGPPWVYSPPAWVVPRVAPPLTFGWPHGGVVLCHISRERRLISGQVSPVWAPQMCPPSGPYRGFLRPPGHRLFSAPHAVTPPLLVNMAAGMPQGLAAPSKTPSAFGPLGARGFCLQPPQSATFLLYTPRGPVPRPYPSPGGPHGGEVAGLYKQIDHRGKAEHGPAEIFGGKMVVARRMPFFCYAHGHPLETLREGFCSHFPDITCYHARHIYFKLDFLRGSPHFRGTILLFGPGVWVHPRAAGPPHVGMWVPVRSLASRGILPPPVARDPGPPKGPPNI

SEQ ID NO: 971163 - protein, 162 aa, Homo sapiens
MGGHPRHVSPPVLRGVSKRPLITFPDPVPPRPPCWSTRRVFIPNSVGRPSAVRDQVLLCGYPRAWRYPADVPQGRSTTRVGVGLPHTDSCSLLPPRRCGGVQPSRTPATLRGQVKYPAPPPPPHSRSNYPPRPTHLMVNSPFLSTITCPKHIPPRPSMRKPP

SEQ ID NO: 971164 - protein, 70 aa, Homo sapiens
MVQPPAVFKSKPTYYCRFMTTATCSGPHYREVYWDESCERLGDEGRREKDPELEPRPPHPGQQRDPPPTY

SEQ ID NO: 971165 - protein, 288 aa, Homo sapiens
TFVSVGADAAARTRWGRLPPLVVPPPRFLPPLMPVFLPPGVLAPGSFVPGEPPPDIFVCTPSYRALPLPGSRQKFPAVLSPFSLRGPGFYPRGHPPKVGHTHGEAPSNLGGLLGHAKKRRKLWNRRPPPTAAGSSPPIPHPPLAAPPRGGDPPSPRHQKRTKGTYSASLLGSCSEVDPARPPQYSSSTRHGRPVAELWVNHAHLRGCKPARISHLGPTNLRPRLGATTCGPRPKCGNPRTKPTLRAAQQTLDLHHHVIGGHSSAGAHTGTPIPRDRDGPPEGVPFPTK

SEQ ID NO: 971166 - protein, 207 aa, Homo sapiens
MPETAVLCRPHLLFCTPKNKPLWKTQGPQFPQITVCPNPLFCTPHFTTSHTDIFPQNLKSCPTSYNILYANSAPPNWGPPPSCLAFTPPFSPTHTLWKAHYSATRQTNDGHHDDMSTPPSGQTHAGETPPVAAKKHTPAHLFSRGARGTAPRSTHETPQEAREAKDHYGVDTIAKGRELVIPRVPENQCPVTATPQGHKNQNPPPIT

SEQ ID NO: 971167 - protein, 188 aa, Homo sapiens
MTDNSYLNPYTCSRPQHLTDHNPAHYILGGTTEGYQQRAGTTPTGDNISISPPENQGPPSPSQHTRDHFKSATSVQHISTAKARTHATVEHLDGLTNRTGPRRTHTLFRHRPPKTVHYAAAHATCTQKHIQPETTSHQRLRNPWHRRNTREQNPTSSAPYFTHPAWQPPRVPTHSSAANLPGHAQRFR

SEQ ID NO: 971168 - protein, 38 aa, Homo sapiens
GAASFHPWTSLYPVNQAPPAPPGPPSHTRPRRSRPSPG

SEQ ID NO: 971169 - protein, 116 aa, Homo sapiens
MRELGDPSEVCPGSWLMLVRGCPVHSRTNCTVLTYTERNRRRDVETYGAVQELGLGRQGSGSRLSLVATVEYHPALNEVVTIWPGGVGTIVQFVNSPLGEMQMGIETCKRVINGRV

SEQ ID NO: 971170 - protein, 101 aa, Homo sapiens
SSLWWSSLHLLCMPRCAEPLPCVHSNRLTTLRCEIRTIGWKQMQRQRPTVPQDLSGPAFMLSFFVGSRVTYREITLAVCLATLRSGLGLVVHACKPNTLGG

SEQ ID NO: 971171 - protein, 288 aa, Homo sapiens
MRVSFVHSVVHVVFSLFFTEVRFRLVIRSNVAANVWLAPIFSDKFLSRSLSSPFWGPAPLTQFPAFRSQRPVPLQASEVPGIHVQLHRSSWRVLSGLDFLSGGKGATQNPPEEASSTFVPPRRGASVPSAAVPKLLSELNRLDPRLYYSPLVNHRGLSSVTIYFLIQRTFLHPYWATQGRGKPLGASIGIPTKPPLPRGKLADRPPADIVRVSGPPRPRPGKRGGEWIMIGKRVSTQLDAQGSRKATKDQPSPHPTDPLPQATAISGRAPPAGPTSTHFYTPPNPEKK

SEQ ID NO: 971172 - protein, 221 aa, Homo sapiens
RNPCASLCGTGVVRHHRRASAEAGHDYGRAPQISVAILLDVDVALRQCRGFLLLPAKVGVLGRKQTKGVNNGFIVKRGNPPGGSAFTICRGCIPPPPPGGEAQHSPPAFGETNKDHPKVKHRCGTHKRGPPRGNQQCAGYTQRDSATPICLVLKYKTPRLGYFFAQVIEKRKEIISLRKTVKCLGGAPLYPPMVLIEIRALLLGGELREAHTAFGAEETDI

SEQ ID NO: 971173 - protein, 120 aa, Homo sapiens
MALLIGPSRLLDVLVGLWARQQILRWTPRDARKSGRGPVSEIEKSPVAVERYSLLMEHIPPSVGHSRDRLAGCCLGWELSQAGNSEVCRPSSQWQSRRRPTSVGENCIIQETGEDLKQDD

SEQ ID NO: 971174 - protein, 97 aa, Homo sapiens
FFSEETKVKIEEKKKRRTEGKVLCDHVYEIVSFMVTTCLLATMHFWVICDPVVNRPTLLVRCGTDILRAVRPIPMCTVIRNPRFQTVRIKLGNWNRG

SEQ ID NO: 971175 - protein, 75 aa, Homo sapiens
RHLLAEIAEKSCPPGCVRSISSAGSADFVGGLTTRPRLSFSLGVGPFPPRWLRGMPRVNGSELVCGSRRTGVDVG

SEQ ID NO: 971176 - protein, 44 aa, Homo sapiens
MTKTQAQNHTKNTNKTINKTDANTDRTKKKRQNTRRAQLQNKDK

SEQ ID NO: 971177 - protein, 103 aa, Homo sapiens
MRVVAVLVSACVFVRRLALWIMGRRFKWERAHCLRLGSTVCPRTGRRGVRARVPGALTGCVSSASINGHSADRSVKGDLLERLLFVDSTVTGRGVPAVPARGA

SEQ ID NO: 971178 - protein, 60 aa, Homo sapiens
MANQFFAALVGGRPSSHGTFGGLTAHRRLQFSLPGDFVGVVGGRSPLPHPARQKDPRPQK

SEQ ID NO: 971179 - protein, 115 aa, Homo sapiens
MSKYIVVYGYSYRYFLEGIIVKKGVMSYDVHPRYTFSNEGLGLDECCYENGKCGMYLVRTREVCAQSNVKQPMWDSSQSLSKHRWCLIGYYTVGNSLIVEDHPAFYASRNTVMAC

SEQ ID NO: 971180 - protein, 296 aa, Homo sapiens
PLYRGAGGRLSVLFPPPLCVPWGVLLRVAPIAGGAVVSVVGVVDPPTAFVFRRVSTRLVPRLGASAHLFHRVATTGGKTKFFVGATHTRVLPALSRVTPPMVVSAQHLLGMAPRAPPLSPRGTLPAPPPACSFFSSAVGRSSFGGSYHAVRTGGTPLALVLSRWRVIPLGETNLSGCFNPHRCGALPPVGILCEGRAFARAKYCLLAPSLLPSVQDLHNQFRHLPRGTPTTTAALLSPRGERWYSPLPTLCCKDTKPNSSRRAPTRTHSGVTNWDPGVDHSYESLAKKNLGQNKNN

SEQ ID NO: 971181 - protein, 118 aa, Homo sapiens
MAPLYLLMSFRRMRPPSSWFTTPRWAAQKSRYFLAYSIMPLAPSPLGLHDLICCSLVGPAPTTCCGFIYKPTPPHPAPGSRSQCSSISHGVVIPPQYWNIVYQSLFSTEGGIVNGVVS

SEQ ID NO: 971182 - protein, 295 aa, Homo sapiens
VCMLRCFVLSPVVFSVEVAVGTPFGQAGGCSDVLVGPSGDVRMSGVKRPGGSLCESVSNDGGAPTGAIAASLLLGPGLIPGPRSRVDVPRAGPVCHSLGDVGSVVEEAVFFALNAPTHKVSVHLYFLLPFRAAKVPPPLGGRVPPSMLLAHNRGSTPHIRRPAVSKEIGPQNILCAHSGHPRTPTETWFDDTLHLYRRVPTPIHISPVVVIKSYVNNHNVGMRRKKYPSSGHGHIRPHNEVIPLLNEASLIFDTLLTKTTISNSSPKAPLIHLHNSDKAFKSEIPPQNKYKCKHN

SEQ ID NO: 971183 - protein, 176 aa, Homo sapiens
VRGGGSGEGSCGAGLCPPGGISVGDWGMAVRVAQEGVAPVGVPGGSVGVGAHEGLVVCPELVPGVLWWARCGVCCRPGWQTQACGRREFAVARGLWCVARAGGSGCKGRRVVVGRRARVFFFLEGRPPCGGGRGVWVGPSGAGNGFVVGALDWRGVRWCAGGAPERWLPVESWSAS

SEQ ID NO: 971184 - protein, 97 aa, Homo sapiens
MGFRLVVLAGVERRVLMLTQSGLASPSAGSTPYGDRAACPHGGRVSLCRLGYPPLFGTPQFPAWGGPQVSFQRPRVFNRSGDPDREGPSTGDKKKLC

SEQ ID NO: 971185 - protein, 131 aa, Homo sapiens
MLWGPPGPKKKSSTETPISLGERAGGPPPAEDTTRHKSVGTNPASHQRERQPPGAAQDKRTRAAGGPPPNTKKKNTSRPRAEPPPGAFLARRTTSTQRAALHTGSTKPRRAPHTTRGPPHKATLQITHIPP

SEQ ID NO: 971186 - protein, 111 aa, Homo sapiens
WYVTSLPLPPNLSSYGSLTERPDSAGRHTLSHIISSCRQCRICIRGDHTLYHRFRDYSRTSPLGVSHNPPPHMANTNHRDWWANIPQTHGCLFFSPLNLHIALSPATSVLE

SEQ ID NO: 971187 - protein, 96 aa, Homo sapiens
SRYEVVIGINNNLAGVVSTKKTLTRCRRSILYTLQMSARIHRVPMKAPSPLCVRTHDLSSKRKKQRTNHFGTFLTSHLTPNLTGTLYSDIKHKSAI

SEQ ID NO: 971188 - protein, 238 aa, Homo sapiens
LLLRVRFPSPPGRLCGATPFCSAANLVCDLLVGGPNWRLPQWSPGDKNFFGSALTVFSQVIYAFQRGFFCVPRVCFAVTRVCRGRRMTPVVGRTFEGTTPLCRYNTHTRALYRPPAGGGEHGSPSWGLSHIRAGRPLVAVGLDAPSIAVFYDSLSLRTVPPPVCEFFPGEVVIRPPRPSWETLQSARCHACCAKIFLTPRHYTKGDDMCPVTTPPSLTLLSQYHYNLIPGVISNTLFL

SEQ ID NO: 971189 - protein, 104 aa, Homo sapiens
MKKIYHRPALNDCHVMEDTDVSIRVESKLSREDSSQHFCRLLNRVIVPSSEITYGMVVADLCHSLWESVQNLVYNRFRALACQMNNMYPLATRFSLLVFYADGC

SEQ ID NO: 971190 - protein, 186 aa, Homo sapiens
MRVVDAQELVEDRRYMLQTLLNRCDSKKAYHLQRSTLTFCDYPYMNMSRLSPGTSIFWTGVTEERIQRTHLKCPSLTPLGHYNNTAVIKYSLCPIVLQTNCTNTTSYYIAPGCLRKQLKDATSRGSEPGFLPCSRRKTPQAWFPDRYPNRCPTSEERYSMEWRNLPRLGAHSGNNPPSWHPGATMR

SEQ ID NO: 971191 - protein, 141 aa, Homo sapiens
SRSIRSAEDTGRNGPVVEQRGRVRYQGPPPEGGHSVHGVHTRQSLNGELKGEQGAKQEVILLCVNRSAAPWQGVFPRAGTVGGAATHEASRGSDNISRLPGRLQYAATGAGWTTKCGVVSVVKSEMAMPQPLLSPQLMGVF

SEQ ID NO: 971192 - protein, 115 aa, Homo sapiens
MGATARCTQGAEGGGCRAERGGRGGGQGGREEAEVARRGEPPDCGGGSGRKGQPGGRSPGGKQQVRQGGECLGRGRRRTWRASRQGGRQGAEEATLWCDAARKCPKGPKGDNPPK

SEQ ID NO: 971193 - protein, 45 aa, Homo sapiens
MCLHAIQRMSDENEVACAPRMVESFTVSPSFAPQHLSAWVTEPKP

SEQ ID NO: 971194 - protein, 182 aa, Homo sapiens
GSFKTHPVVSHRGEEPPFHRVSRGGTPTPHSRTHQGVPPPRGERSPPHTRTQAGGRHPRGNARKSGTPRRWGETFPPPCGRDGTTGGTYQGVLATTRDCEACPSGTIESPSVGARQNERITNDPKGPLQPLDPPRKKGGMGAGAKAPRRSFPRGAPQKRRVYAHTLGGTAPPTHTHKNREKN

SEQ ID NO: 971195 - protein, 78 aa, Homo sapiens
VKFLLEPENVSRVTACANMFQGPVPDDSVALMLALVEANRFGENALLAHKFAQAMRTTVCTRNNLGGLWYAISWDNEN

SEQ ID NO: 971196 - protein, 253 aa, Homo sapiens
DKAPEGRRRPRPAQLGAPPPHKGGACSPENIRSRKKCGLHTTARSFKKETDRYAGSRAPAKWGCEETKPRRPSSNYLQRHGVIKNAPGGRRPPVAPPAARDAIPGASPGGATTHPPQVGLLPSTRSPQTRRGACICCVPTRKRHAPRGPPQEHNITKKESAPATKNTVQNTYFAPPQHDIRQMERLKEERAPRARPFARQEDPRGSRLLRRRSLNMVECFEAPWPGETKSCSSEGDHKTTRRVGESPVQTKTK

SEQ ID NO: 971197 - protein, 204 aa, Homo sapiens
VCPYSVSNKLVSTFRKSYQRCERYRGCLIAAKIIVDSETLEYWRRFPLYVVGLTVKPLGGGSIPPPRGMSRLNYRCEGRSCSPSDVHRRDGLFVKTKVWVLTPHSIVAWITKHHSAHTRESTVTPVARSPPEVYSAFFAFHWQTRPRRFGGNKKFQTTWMSSGNVHCPRNADEINARAPRCTYPKSCSIQYKQAANKLGVKHSK

SEQ ID NO: 971198 - protein, 134 aa, Homo sapiens
NRLVRGITPDKKNMMGELYDRSPLDAIHLVHRLQYNRDCTDIYDRKKDTLKGISSSLVDLSKMILLWRSIMDGRISGGGSRGTVLYLIDYIGINAIYWESIGDVSSPGEEIENVYEEVYVGSIDEIVSYEYPTL

SEQ ID NO: 971199 - protein, 288 aa, Homo sapiens
LSSDRYGERDEADATHDASKSGHRRIHIWGPSPKLAGNKAADLCRLGTHDTAIRGPIKWDKPPTMKGGKDTPFTQRRPGINRRTPHLWRIQTHTCCIAVVAAAPHEGKGPQYRRPGESTKHVSREMQDWAKPLETMGSNAREVTVHATPNPMPMKTQRRIARDRNKKLYRGVVCKAKGTVNQSVNQTNARECGENVVARIRKPYATEGLEIPRSFHGLPTRSTCRNNKAKGDGAKGPKNETILQKKMKISRAHQQYGKKRSTIHLNIRGKPSKTKKAKPPHSPKMAII

SEQ ID NO: 971200 - protein, 120 aa, Homo sapiens
KTDTLEDLYPSQPKSQILDFRDYFRCLLHRALHPREPLYPLIHDSILWNMLNPPAEVTTEKSDSSSLIIKTLFPLIEEPGTKDQVTAQEIFQDNHEDGPTAQYINMTEQGGAHFSVLQSG

SEQ ID NO: 971201 - protein, 121 aa, Homo sapiens
WGANPKTGHKWPRIIQKHGFKCVTGKIAGSHIFALLARKDVVTTTTGGERNNAPHSGEPGSVPPPPESVDNPGYKRPPAWAHPPMVVGDPLQGFYESHFAKTTNSSGPHYLFRPRLFALFR

SEQ ID NO: 971202 - protein, 100 aa, Homo sapiens
VLLWGGYRVGSATTSLLDNFVRVFHLVPVSGLRTGWSTYQLPVVCPRSPPGGALAPPESGGKLVFLAPISFLLVGMAFAPLGCTLPLCSIISSVGSLSHT

SEQ ID NO: 971203 - protein, 279 aa, Homo sapiens
PQRLRCCCRRWRGRQRTVAAKGGGPRWVVNRWGAAAHCAPWARQRCGACPRRSKRVRTRVGSCWSHSAEREMGTHAGGRSMRERRYPVMRAEGAAKSSTHAGCVGLLGGGTGRARCVDRTLGEEGPACVGECKGAPARRRGGRRIERVMEVHRNRWLRPPGIKYRPRWPHHAGDATLWMRGATARREVHSACEEGCTREYKKCVGRGDNKGAPPRGDPLLEGIGAPGIIAHCGADVLPGTPQAVHNLTGCGDSQYLLPHCFSPKACQKVCCSSRKHIKN

SEQ ID NO: 971204 - protein, 222 aa, Homo sapiens
RPVPPNDPPPLLNLANNLGPFFLIDRCLRRLVYANSPFERYHEMTKRFQPPPQALTGTKHSVKVSIIPHQGIRCVHPEAANTKVQSALNRDALDPDTLPHCGGGPTAGPLSHTRRAYNMMRPHCRRPRNQKRGIPLERRVPPPRSDPHHMENGLRPRTNLLCHMRYFGAIPWHAPRTSLVVTPPQRRTLSSPRFLPPTSSFFLSPHPPLFPPPFSPTIAPHN

SEQ ID NO: 971205 - protein, 158 aa, Homo sapiens
MESWFNIRALTLILGARYLFSRPRRESFLPARPLRVSLLPEGTSPANTFWFCDSSLLSDVIPFRRGPRTHISRRGFSRPHFLAPRGDHHNPMLRWRSLLRGKDLIISGRRTSFVQPRDESLRPPYTLVVIQGTFSSGRSGSHNSQGRHRTTCDTCLST

SEQ ID NO: 971206 - protein, 161 aa, Homo sapiens
MESSESDDFGPRSTIHILNQRLSYELFQSTLPPVDSDFVYNWNPLLYPVSPTPLYLPARSTHVNGLPLGTLTNALAQEFARCLGNANRTDGAKLKSKDPGISYAQHSDIVRLYTHGVMKPGEYKTIARCPGATEACGHLNGQTVGGASAFERTEATSVIRL

SEQ ID NO: 971207 - protein, 71 aa, Homo sapiens
MTEAPPTDLLHEQDEATRARGSTPGTAATQPFVGEAPEREGVRDPTQAQRKFDEPPPADNNTGEPPASPQN

SEQ ID NO: 971208 - protein, 157 aa, Homo sapiens
RVPGVECQPVVVSASGSSSPARPPTGEPPAPQGRQCTNCFPRRLEYIGPQPPALGRETCGGVPVHCEPFPDPVGDVPPAPRLFTRVYPQQPHLWPVMDGPRTFTALMRAAGPSLYLGARTSPGPPRRPGGAPFPAPGHLPPPGPPHWANPISNFINQ

SEQ ID NO: 971209 - protein, 307 aa, Homo sapiens
SVHYGRGGYAGLTGAGLFRTEAWISEVPELLERVCGAPQRICFRRQGIRRLAAGDSKCPHLAEVPGNLRTTENRDCRWLGSPGGDRCTVSGGATGIYGGLISLHGQVNCPLMLMAHILSQEQARSPQCPVQPCCAVKALFHDSMRRSVRWGGRGSRVPLSLSPHTRREGEGAQGRSGGNIRNKQAVRSSGRGRRSTLDGVEKPVASLFCTGAMEMLEDSHGLGRHDLLGSSITQIGDAIGPTCKKAPQPHVLETNPGNISTGQLKTKGLRDARGRNSKNNDRHGHTGPRNKLAEDHRQDTQADTTPP

SEQ ID NO: 971210 - protein, 247 aa, Homo sapiens
MGVLPLSGGQSPFLESNLFWPPPPSWKLLYPRKGRISLRCMSVHIHALIERGRVFPRERASHPGREKFPLGSLSHNGRTTHHPLSLYTLARCAHRLCRPRLGEEHIRALGVTEAHRESSTVATPPPVCATTPPVGAVIAAHTETTFAPQRNSLLTEKREERRHSRYFLGGEKTTAAPPRKELLALVTAEQEKIIRNGRSLTGPRGAPRATRPTYSLIGRSSRSHHSIGEHRRRPSPIREVFEAPTKK

SEQ ID NO: 971211 - protein, 173 aa, Homo sapiens
RARGGPKRAPWGHPMREGRGTSTGSPHLDKPKDLGSSAPRPDFSHTHEHICFCPHNETNTQEGRVYPHRENTAVYKRLSQRTPGIQRVTGTTFYAARDEQGSTTRKEGRPQGARNDPRRLPRAEILIPPEVDRPQASREVTPYKSGEAYSHGASPRRECRRFPPGNIPTQGEN

SEQ ID NO: 971212 - protein, 94 aa, Homo sapiens
MCTLCNYWLDKLGLVLGPLRGGRVLPWHVLADLSSELTLSHGEGRVGSGRVALLVPSFIVVPLCTGDACWLTGSGGTGGRQCGAVGMGWAGALC

SEQ ID NO: 971213 - protein, 312 aa, Homo sapiens
HLGGGNADATPPSATSRRPEACARPKRAKPKGPKVSRPAPTGKRPLGLPRENNLPPEGRIKHPTAHGHLLPGVPPTLHKSMLAPHTTTRVPAAPKTHTGALATPISASLGTTRRPFTDSWAHSNRRLTRRTGYSDTPPPRTLLGMSAAGSAKIGAPTGGVEDAPRADRLREVAVDLHRRHPMSDWVITTAPARRSSPHKASYERMNVKGGDCEHGRLQTSAYLGTRYVFLEPGASQNIAALHPEIRCTFFRDKVDRLSTILRRPYRECILELGKASAELSHPQVKCHMDPVRNHPYKEANRALPKKKFDNHN

SEQ ID NO: 971214 - protein, 121 aa, Homo sapiens
FGKKNSHFVTHSGVQGCDLGSLGPLASRVQAILCASSLLKLAGHCEAPATTPGLISVLLSPEERGNASIVEAGLKLLNLMYLRCLELPKCGYSQARSRITLNSSSSGNLGDVFKKRSLGIA

SEQ ID NO: 971215 - protein, 118 aa, Homo sapiens
FFFAVSRRFRGETRFPGPLRRFNARAPCVLLMTDPPNIGALFLSSHSEELDAPPEVSCAEGTGARQYFLVLAIPLIPSLLPLPVTPNNNPPGNLCPLSGPGNCLSLKEGALLYNGKNG

SEQ ID NO: 971216 - protein, 102 aa, Homo sapiens
MKIGGGGGAPAGVSDERLMWAKWAVAAPRRKTRRGDKQQCGVGGVSRTLNNKSARRAQDEISAEQQSRRRVALGDTKGLNIETTRTREDGTLKNNTPHRGGR

SEQ ID NO: 971217 - protein, 115 aa, Homo sapiens
SHLVETLHSEAEISVDTSCELVRDMSWGMIVLELPGARLAINSMPYDISCSTITKGTGNARITTVCDCRIARAYRSSSSITLTSLNRSTTPVFCDKWSVDTSSLQNNALKFSHAT

SEQ ID NO: 971218 - protein, 279 aa, Homo sapiens
GHPNAPRVTGSRVRGFATLRLCPRSPLVGCPPPATVKADIVVVLERKVFARRLLVQSRQIAPMFLQAFAGETPQWVNNGLPGHTTSIWVCRQRCPKGNTPQGPTSSGSGNNCNPQILRGGCIATKRTGAHNKVAGGHAAKGAPPDVAHAEGSTRGPQLADITPRVGIAAPPPAVLETPGVRSKRAPAPTGLGNTHRGPSLQASTLRFIQTWGQGEHTGRCHRPHIDQIDSLGGPTLASVFIGVRWHRLMLIVFLKRRSPFWRGPGLSPNDTLPICRQPP

SEQ ID NO: 971219 - protein, 115 aa, Homo sapiens
MKEADNDNYEVLFNLEELKLDQPFIDVSELLQSEKICGCKKELKILKHLLCNYKAQRSARNGSFFPECVQFEWVHRTEEDEDVCILPPSRGTFAVMTYIRALWVIQSNERFYQKK

SEQ ID NO: 971220 - protein, 276 aa, Homo sapiens
MLRTTLCREFSVRGRWVCVMPWGARIPRGAKNRVVPPKGLIRFFGAHNMGVTGPIISGKGKHFPLVNVAEEDPGTKWAGTNNEQGAKNQCPRTSSVKRWVPPRESPAKGRKTGPERDRETKPLLPELVSKRCPPFHGGSIYPPASVVKFFRVGKVLCEDKYERGQNKFSVENWLNTGGREGGEDRALGGNRGPLSAPRRGLNPPPGAILPPWDPEFSRPQVVNPQEVDDPCTVPLGRGCISTITLADDGVSQSFFVSVVCRTFFIFPAKKNSPKPH

SEQ ID NO: 971221 - protein, 139 aa, Homo sapiens
MAPASPPRWNNSLTRDAAGLPHAPKRRVMHLPMSATLGRQRPASEIHPEGPPISPCATRETVLRAYTPHENRVPLGDPSVRKSSLPPLPQLFGVQNRRYQKPQAVIGGAPPEDCTPDAGWPADTRDNPGGKKKSSPPQK

SEQ ID NO: 971222 - protein, 295 aa, Homo sapiens
KGAARSIRREADMAFPFDLVFAIVALVDTRSVLHKYRGDFRLKGLFVTPGFCFTPMSVLGPVGYIPPFSGLPQVLAKLPYQIISGLQILEGPAIWVPPSGGPPRVTTHCMRLGISEPVPQKVDAPLPPLEDRPVLPSQPFGGPPLEPPFDGGLMAPPPPPLQMVRQLSRESLLPPCKSRACHHTPATRDSPRARSMRACCQQSQVQTARAEIAPPPPSLLEKTMRGNTFYSWCKTLAPTSNSPSRTPSSKPPPRPIIDSQMVCETQDTPTLLGLSPPEPGTPWGAGGPNKNSKLH

SEQ ID NO: 971223 - protein, 106 aa, Homo sapiens
MAVTTDQGAVTSAAQSPPPGKFYQTCRHRGLWHDNPAQIGNPVCETIPASSALGKLATDHQSLVSHMPSSLVTLQPHHLMSIVSWRPIINALLPLYNTTTTGTNFI

SEQ ID NO: 971224 - protein, 118 aa, Homo sapiens
MGRNRRERLLRCGGPSVLLGETSRGMFRGELEKRRDEAFVRVPTGRDVVWPLEDAHFRLVVWGTIGTRFSLRKEELNYAPGVLWLMDADGNQLPVWVTFWCRGGLKGCIARFTKATGW

SEQ ID NO: 971225 - protein, 52 aa, Homo sapiens
MTGTRTQADSPSYPFIVAPHQTVTLTGETVILVGLDSSIAVIMRNNRYKTGT

SEQ ID NO: 971226 - protein, 231 aa, Homo sapiens
MADSRKGLALGPKFGTRTGGLDLGVDMGLCALPGSKARCLFCHRCFSVQHGWRTWGVPLPPIYLWALSFGEFDIQKRVGDEPACFAGQTRGVMLKCHWTINGVVALTGALRKIGRRIPRQKGLKKMFQGITQGPDKIESSHWSREISSIRDYLGKGFRPAELVQGIERRRDSPKRLNPKFTAWRDKPLYQGGSCTIEGLLFLHRERPGMIGGGEACPQYTLAYYTCLLTIL

SEQ ID NO: 971227 - protein, 228 aa, Homo sapiens
MCLSLATSTAPCCLLYFLFLCWCRLFVLSSLWGARARTVDGPSVTPRFTPLAFPPVGRPRLVGTPPTCCPYRVPSPSAYAGPPRRVRYPVPLTLRAQPSLSGPESDPPANPGTLSIGQPTNLNLPVHTPQSDPSCCYPEEYSGERTKIQNGYEYPNLSPASHRIPPSGRRGEEITRVRVHRSAGHGNPSSDPITVWWTPVIPYWTAEAEILTQGRFLSRSHSPTYPGN

SEQ ID NO: 971228 - protein, 141 aa, Homo sapiens
MVTIHSATWERPQVKPATIWVCEGLLTTSVRVLKNTNKRPNFYSDICIYPLPERNEAVPQNPFTPYTPPKDISNSILPVDLLSEHAKLGKILPVGLLYPLFEHSTPSFWYARNNESESNPSWIPTQHQRRILPASTNIDTI

SEQ ID NO: 971229 - protein, 392 aa, Homo sapiens
MTWDDICGRYGLSHGVSTRKGDTASVEATLINRNAEEHSARRTLGRTLPYHLEGAIHLRQSSSVHHEHGESRKATWEERILRYCQVWALLIRSTLQRHAREAQVYQPADDETQLNFRVTNVTWTLVSTTFSTRLRLKIKRYGNLWKNGTGRLLVELNLVAGKLREPEPTRQFSDAPRGATPDHRELSAHSLEPFHLRHSSKAAFSMWRTQGLSRWDTRTPAHQMQRTTVSGIQIVLTSRWTGQHFLTFNYRPIKVAYRLRYQTDLPQRLSPTAVSGATEANIQTLYHPSTRYSYPSRNTATFPKHSRDLKATTSLMAHHLLSTRRAEHTLGSPIPGTLPAKHVTTLSCKQQRSRQRQLSLVGNTQFHRRAGQSTTTTKRKEAPRDHTPLFTS

SEQ ID NO: 971230 - protein, 149 aa, Homo sapiens
GSLFLVVLAAVVRQQGLFPCAVFPPEMSLGEITPCVARLLTAWCLNRAAPLMIAVYTRPPPIIGRAYSSLSRQLRDRARCRQREVLLSAEGETAPARIPSVVAQTTYNESVSTSAGVGQLYRPGESRAPFRARGGTTKSTPQASGVFCW

SEQ ID NO: 971231 - protein, 318 aa, Homo sapiens
FAIVGQSLVTRRGLVRPISVLDSVPPLGSPISWPCRGYNTGPYNTLFGAPLKLCNPTRVCPLHLGFSRLPGVHPSHHQHTIWGGPAAGHSPPCGAYYPPPCPTPGDHPACFPPLPHYSLAVVVAVNLAWYNPPPFGSVELTQPGGFLTSGPHLKHLSVKMPARLQIDFSSGGAPGCSRHPFRIQKGLVPGPLGWVQPPPNNPPRHWWGQEPGHAQTPPPPGRSKPPRIAATRSGKPPPLSFKEKTTQNNNAQSGRAKTPAKSHHTPEEDEQHTGEYHPRTREGGRKLPEEQEECRPADPPPRGQGRQPFPNKKTTQQK

SEQ ID NO: 971232 - protein, 45 aa, Homo sapiens
VVRRPARPPALLRSIMAEPSGSPVHVQLPQQAAPVTAAAAAAPAA

SEQ ID NO: 971233 - protein, 141 aa, Homo sapiens
WGPRPVLPQRHSKSARGTDQFCSDCPWTMGLYSEFPMVYKEGPSPAPPQIPENREPRSPMGARKHKRMFFQEGGSEAALGPEVPYVVSSEYDEECSWEEDDVTYVDVVTRGLQTVSVARPQKRVTHEAQDQCFVVTALQYT

SEQ ID NO: 971234 - protein, 87 aa, Homo sapiens
SGFSSLKQQRCVFIGDSQFIGQEEPHGCNHKRPGSAPHSPREENWKSRLSSTRDATPARSQAACAVNRPPLLPRLSLDFPPGLPYLQ

SEQ ID NO: 971235 - protein, 109 aa, Homo sapiens
MPKKSGNRKIGARSQAEPIRCNVCPARKRSTNSGSAPTDLETRRFRLPVYTTPQIAPSGAKKHGIHGGPPPECGDHNIHTTAQRQHEREHTDNSPPNDPTGTQPQRQDA

SEQ ID NO: 971236 - protein, 115 aa, Homo sapiens
SLKKSPCRGSTSSPQNKAEQKDGSECKQVQDHATPYAEAEKEIHWAIPYECSQEKQESENVKSVQEEYRGQVPVAISAISQRERPQSLEASRFCRPVLECTGPSVVTAALTLELK

SEQ ID NO: 971237 - protein, 33 aa, Homo sapiens
MLVLLQDSLFTGSSDFTYSIAFSLCALLPLSSR

SEQ ID NO: 971238 - protein, 441 aa, Homo sapiens
STHHSRPNTAHTPRLLLNTLHTHTLTPTALRRATAARYAPQPTSRAHALQRYAQQPAAAHPWRSAAHALCQLYTHSTLPPTCHHLKPLAPHPNACSTILNGRNTKHTDTQTNTQKHTHTRRARAAGPSARPPPRDNTPRPLPPTRPLCAPAAARRAREPPLFGRLPRVSHRCGPTIHPVCRVLSLAAPTSLPAPPSAPPRASPRGSPLLSPTPPPSLSHSFPPPLRRRLAHTPAPPATRATTPIFPHNLALLSPPLAPLLPPASLSSTLLPRSASHTHTHPLPQTSPLPLSPHLPLLLGRTLPPFPPLPPPPPPPPLPPLQLSAPPPLPSPPHASLPLLTPPASPILPIHPFHPLPPAALPLHTIYITTSSLPTTLAPSPLSGSRAPQAVKIGRPSPAPCSLCVLEPFPLLLAASIPGARRLPPLAACASLLSLAPTHRPS

SEQ ID NO: 971239 - protein, 90 aa, Homo sapiens
RRPTSVRYVTSGELELVIHPKLNSMNAFMPFTITSAQGCIEVLRNISAVLSSPLSDGLTGHTAMRCTQFVWAVRWSIERLGPIGLSFLLS

SEQ ID NO: 971240 - protein, 82 aa, Homo sapiens
GGKKSMSGPSGLGHIINPGGMSGGGNFAPGGASRGPPIPPGGMQGGFGGQNRGSRPNDARFTCRYENLESCVLFRGNKAMFC

SEQ ID NO: 971241 - protein, 71 aa, Homo sapiens
ESVESHALTRWNSCVCISPDIKAKGRRYGSVASKCGHKELRTTLVREPMSKWNVNEAITLTHLSPQGDSWS

SEQ ID NO: 971242 - protein, 138 aa, Homo sapiens
MPLVLSSPIHAYTRSKNDVQKGSIISSSKVLRMDGLAREMAYAIGKPISRQISVVKSAVLIDSQEVSTYMLPPESPGEGVDDVQQGGPKIHENFLVVFGENLQCAFFVKRGVNGGMVEVWSAKLILNTSRRGREFSSS

SEQ ID NO: 971243 - protein, 30 aa, Homo sapiens
ERQRIKEEEKRAAEERQRIKEEETIQQPGS

SEQ ID NO: 971244 - protein, 108 aa, Homo sapiens
EVVGQRILPLRRTTGLGNLPLYQAGERSGLQLNEVDLPTPLRAREAFENRYSPTMMATELPHRRFAEGAPRRLDASSINVIVIQRGNVGGFHDNSGTHQVGVSTRPRI

SEQ ID NO: 971245 - protein, 107 aa, Homo sapiens
NPSSFVPGGVSNDVMSPSVRHKPLVMEIDGPFPIKFWVVVTALREGLPDTDLVNVCLTGSLLEGLGDVVASLAVDEKNGSFLLGQQVGGLVNDLGRRGREFSSSRRP

SEQ ID NO: 971246 - protein, 305 aa, Homo sapiens
KCLPKKLWLAKRKCVRTVNALRDTMTPPRLGPPHTGGTRRAALKCDQRAFCLRAPKVGPRRNRLGGKIGRPLFSNHSLSGDTTGLKRFLSPGNESMSKPLVRQEGLFKDRPLLESAASPRSPPPESCGEFFLPRPLCGLRHHKKNPPAATTPEAESAPPGPHAQKTGGQREEERRLPPPGRTKPLGVELHPQGSRALGKYKQSSQNGPAVTTRRRANSYRGDNKAPRVSHDPCKRWTDQKHVLYMRYHGQCGINMITGGETPPCARNLRPSRCAGVSCKSDPPPTPKQGSPTEKKFLQETIKRTK

SEQ ID NO: 971247 - protein, 80 aa, Homo sapiens
EGAKRRNQMCSKRCERQCTKRRWYNAVTPKARGEKCTQEVDLTTKVGPPKAGSGGEKMRPKGCPAEKTVPHAGPKRLHGV

SEQ ID NO: 971248 - protein, 161 aa, Homo sapiens
MAQPAGSHSGNVAPSIGGPQEKKRFADAPGVNLSSGGKMAHIANQGATHGSKTSHMFRPIVVGLQAPRRDGAPTRPGPVYRTLRGGSFVVNYRLPAHGFQALLEFVRVFINPRGQYTTVVGFFRNRPRIPELPMPHLCGLATTHKENPLVGGPPVFHPPVV

SEQ ID NO: 971249 - protein, 174 aa, Homo sapiens
MVRGRFGRGFTFCFPGCRAGAPSPRPSGCGRTRLCAPPSGVFCIVPGCGVAQFPWAHELGCISPTPLWGPAHVLSRAKMLYVGLLPGPRPPAPFFNTASAFLMGTLWASPPGPASWGEIRLSRARFFETGSRPRPGPCAMPAGPFSPAFGMSGAPSPPRGAAIVRLRLSTLPRV

SEQ ID NO: 971250 - protein, 112 aa, Homo sapiens
MSSPPPGVSPPPSCGAPRLLTLWGFLSPPPAWWVLLKKNPYLPPPCPPQWSLFFSNALGKPRKLSLLPRATHQPQSLKPPPFSHRETNFSQRAHKRVFFACTQHSLSPHKRL

SEQ ID NO: 971251 - protein, 119 aa, Homo sapiens
RGRVDVTFALEEIEYSRGCKGLSRLSNWLAPRLMGNSCSRSSSCRPQSQSLSRAWLASSCNSSSQGLGQSPQTRRKISGVIRVIIQVIEQGFAHLIGALSVTPLSPVDAAANLVVVGGR

SEQ ID NO: 971252 - protein, 52 aa, Homo sapiens
GGMISIEGPPEEYSNKAITLIRYLRHLVSRVTIAYGSNYQRGMIGIEGTSGK

SEQ ID NO: 971253 - protein, 146 aa, Homo sapiens
DTLGHHGPGRVDLRTRQITRSDKGVQQRQSTIQVLMGGVQLVAKSSVSSIQPISMQNQVLMVEGLSGDSGVGSSVVPLRTNIGCDSNVPERGGIQLPILSTKTCQSSISSIVDCHVDSHSNTMSSVQHGSGVILPRVEVDHGPVST

SEQ ID NO: 971254 - protein, 102 aa, Homo sapiens
VDDRHRERQRDGGRNGEGYRDRHRERDGEGGDRDQEREREREREGGRIKEGGRMREGETETQRERWERGERDREREMEGEREKDRDNPAGRRGREFSSSRRP

SEQ ID NO: 971255 - protein, 124 aa, Homo sapiens
ALDLSLCPHPVPLSVSMPCPSVPTLSVYPCPVPLSPPCPSVHLHSVPLSLSPPSLCPSVSLSPVPLSLCPCQSMPCAHGFPSQELSFSHNEQANAALGEGRAPPLKRTTQSVDAAANLVVVGGR

SEQ ID NO: 971256 - protein, 88 aa, Homo sapiens
VGDDHFLDVGRADGKPGVVATASGASLPAGLRERTWYENQQGFRMPDPFLYFTFLPSVVLLLLVFIFYTLAIPQRYIAQVWAEENKVF

SEQ ID NO: 971257 - protein, 93 aa, Homo sapiens
QAACGSRTLPPFPRCPLRERAATQACWLRPPLGQALAQPAEWGVVGQSPRSWAPAQAHRARPHPAAPRTATSGATPYPIAKSTDTIFGVRCLL

SEQ ID NO: 971258 - protein, 394 aa, Homo sapiens
GLGTKFNKRVLKEQNPNSKIQLCQGNPCLLLGGRRGVGACGRAGLVASHPYRLRESGGWVGRYSLILCGFSKSASRWLEARGFLIGRQSLPRWGSRGPSNDIFTFEVPKKQPLFLTQQVWPHRQVFNALEIVINRGLFPGGETHIGAQSKKTFSGYYSAFVFPRKFIPQKHRDKNPFERPLWGPHEYSFQGCRHRGKAHTIAEGAYRENKEKAPNKRRVVEKRQKGTLRARSATGVDTQKDPYKGGAHSIYTSKIKRPTKKECRPSGEKRHKNASSGRTQTGKEKGRQEKFPTGALYYLPIDKPIVLVSREVGAKHKSELLGDPGDGEVNMQTTNKLRRRVRILRGNRYPEDKNNTITRHNPKKEYSTMKEKTSPNQEEKKGEAQMRGWASRGK

SEQ ID NO: 971259 - protein, 569 aa, Homo sapiens
MREIVQLAVPGQCGKQIGAKFWEVTADDALASDPTVAPTTVGQLTVQQWNCINCVLLMMATCTGEVLCPCAVALLDLGVPGTHCDLLCCICGPFRGMTLHVPGELSVIRVRRWLLGKQLGAIVVHLPPRQCCVQHEVGTSVMHWHCSADWTCAGMKKACCTLALAEAFRMRDTPQTYPNMERLWDSSATTLWATLGEEHRGDQPTIPHPKSNSQKEQSQSEHGQITPTRTNGDIHIDTHPPSNGCTSVRTNTLGTHHHKDWLHVRTKGMEMEERHPINHKRGTHHATYTYNESTQYTQGPIQASRHKPTTHQTPRKQPPVTTRAQESERNSTSKRDRPVQLTGNKQYYEAMSHETNTPPKQQGRRTPHNAQTPKTWDLHPIRKPHTDRNGHHGIPRPENELGSVTNHNNPWAHKRKPDHHKAPQRDRNETSATYAHTNSHGARAQHNMYDTRHINPGSRADTTIKRTPEPGARQRCNHPGRNNHATTRVGAGTRGPETDTPPEKTDIDSNNIQPNIEKPTRENPPAQTPDTDKEYTKQYIRATAYHKQRANRSITTTRRRKTTHTRAKK

SEQ ID NO: 971260 - protein, 460 aa, Homo sapiens
MRQAPTTHNQRYTDAGEETHTESAPLYTAAHETHKDKSSFTGKDAPQQTAARSTLPEGEPDHKLSPQHKNTPQQERPERRVRETPTTTSERHRAPTERRRTTMGGGDHPPPQKYKHTPSLLRPNETGGLHGGTHQPKAGEEEQNILSYTTTSTSSVHGRWVNTPQTDSDGIHRVTKPPSQDSGTDTTDPPQDDTNNVRWRPPQAMSGATSSTQTTTARPRKLLHPKPNSFSTHDPNRRPWGGKNKNDNQLHHTQHQRPMVWTPTRQTDCRAVQQNKGDESELPPGKEDETRKTTPTADNRVATETRRTNQAIVPTEGTQAPTQTLYEERHEHPPEEGTHPTSATRCEQPDTREEISGWTTIHQSPRSGIHPGREGTTTGQKRPGGAHSGKTPPGVVQQPPRRKRDKRRAQQTELTYTPPRMKRTRADNTTEHNTHNRRRKHTAEKQRRNADNRANHTAGQ

SEQ ID NO: 971261 - protein, 156 aa, Homo sapiens
MVRRQLPVEEPNPAKRLLFLLLTIVFCQILMAEEGVPAPRALQRIAPNARHPWGPPLCPPSSSPFNLTSEPIEITLWSLSTFLHAKTARSPSNCDSPHSPNNESEKSTIETPGVPGARERIPNGDFRGNLNSEALQLEIATRWLVGGTEAHRERGA

SEQ ID NO: 971262 - protein, 589 aa, Homo sapiens
WLFKVKTGLHLLARMVFNSSVTFGDSARLRPSQSVRGIYRRVSHRRPAPFYFYTYKVPCQGAASKPEKNRTWRLQRGTLLPVCVRALWCVYTTFIEGPRGVFPLWPSEALGGHYLSHPNPNEHTPLEPTSKPQCGLSNPSPKALCGPLSHTERLKRYSTHRAESLSPESPPRGNTQRVCWARRVGSSSLPFFYRSRHKAQSPPYVRPSAHAPQRPFVHGGTPKGHTPRVVITVACCVAPKPPIKFPQHMWGAVTSHPEVGGPPLVVKAPPLFSPTPQNFPHLLFGPRGHSTPRRALLWGALPCGALPTRAVRSLQAHMAPPPPPAAAGGLPPHPLWPISSWHSETVVPRPFNLAAVGHRGRKTSSKELTQRGGAPSKPFPTENIRPSALVRAPWRSSLRPPKDFRHNHTPPPHTTATVGSVLPHKQVLLPIHSPLASTLQARHQLIKNLRANNSQPTEETEDMHTRSPLQTHKGVTRLSALRNISSLPRTTRQRPPEHTTLGVAHQPETPPLSVGTAYAIQNNTHPPMRAKTGQHITDSNTHSTYTTVQSTSADRPPITRNRPPHSVITAARTVQHLQTRVANNTNYTA

SEQ ID NO: 971263 - protein, 181 aa, Homo sapiens
MYPTIIIITPNTSLILSTRPKSKYKTLTHTYTQNYHNTPIIFTNHLTYHYLTIPAHTHHYRQHILYSMTYPYFLSSHLLLAHISLSSYYTIIKKTIIYNSIHQANYYIITNIITILTKYINPLSSISLSQLHYTTSRNISDLYSTLSFTTSKLTSTNHNPVITYHTYQINSTNFKINSLHI

SEQ ID NO: 971264 - protein, 146 aa, Homo sapiens
IRAVETPLRQLVAQCGLRGARVEATWPATAASCARWPGRRVGTPRWHPPPGLWAGSWALVRRLIPVRESPRRSRASGPPVSPPKNDSRFQTWQTFIFAKMNRLSHMGPARVDEVPDGAVKGKRKTKIPILRLVELMRGDLCRDQRI

SEQ ID NO: 971265 - protein, 56 aa, Homo sapiens
KREGKAANKARSKGDTTAKATARRRGANEGRQSDEANRGQKEENEHRRTHVDARTR

SEQ ID NO: 971266 - protein, 309 aa, Homo sapiens
GGDESDPGSFSGRCPLVWCGTLNGSSLAYAVPQHIPVLLVAGASGLLVLYCLLLLLFWIYSSCIEDSHRGGYRAAALHVAISAIAVFLVLVLRMYPSIWQPGLSVKSIISLNTTISCSEAQKIPMDDPLELLCSYTVNLHNAETSSWVNWVLWCVVLGLQVVQWKSEATPIPGSGEEVTLIWSSGDSMLLWVHASPFLKHKRSASGQPKTLCPKCLGKARHDSRDHVTVGKPHDGRLPTGREGRDNIETRAPASLPTATCECQRHFRRHPTTDTHAQSRRPKPGTTHTNATPSAAPPARRTAHAPTHHG

SEQ ID NO: 971267 - protein, 204 aa, Homo sapiens
RVYTTRGGGRGRSSAPHSAPLLRATPSRRQRTTKLAGRQTDTDSRRQAPGVKQQEQARETNSPQQHRGRYHPSTEKERHPQGKRTHTRRERYHAQSNRSRAAEQGAPTQPPTSGGDHKQEAGPRHTAGLSHTQYEQEEKQEETAPPPPPRGRDTRGRHEKSHAGTNRAVDRHAAPTHRQTEYAPNATHTNRPGGAQRDTENGKT

SEQ ID NO: 971268 - protein, 113 aa, Homo sapiens
KAQKKKPRTDADSCQLHESRTRQRRTRHRHAYPQPQHHERNESTLRAAGPLPTRLTDTRATPPRHPTDQAPDPTSPTPGPRHLHTATNPHERRPDNEKPSHTPHRTRTPHHPP

SEQ ID NO: 971269 - protein, 152 aa, Homo sapiens
MKTVTSDPWEDQRPLLMIGAAWSSECRPVLGQQCMGAQAWIYKPSCWARWGQAVARASSTYGCQSRSLQLPSKNAGHAVWTWTYQYVVAGRNMMPENTVTLPWAALGSGGHHRIWTVAEQARILQSREVPRHLCCRNPEWLFRIYQDTKVDI

SEQ ID NO: 971270 - protein, 351 aa, Homo sapiens
MWHERVYMRGGIGSSCAIYIIRAVGAIYNVLLQICFPLWRGTIIYLYIGAHKWFSTIFYNIGRIYTFIIGGVNGCWGRKKVCVLRIRNRGGDVGRWGVSTRRLYVGKGFGPGVGALFVLTLVGDLHVRGKQCGCRRNGSHIGTLWIQDTGGLLGVRNWNPLGRPPQFERDRHSGQYGLSQHVGLLARSHRGSYQSATRFLPGTQGVAHPKKKVYGSRTKCLWRHKSVALTIPTLTNKRGCQPTTKVGGPEKRIGRSRGSEKWDTSRNCTAHLLTTRRQHWSLTRRARNLGRAQKYNPTTAERVQHALNKAGPRWKFPQKERGDKGTVDTGRAIDTQRNTPTNTPAIEHYAV

SEQ ID NO: 971271 - protein, 68 aa, Homo sapiens
KTRIRHKADREDQDETQQWQDEKDKDMGRRKGAQKLQAHTTEREQKQRKHRTGNEHAGTRRNKTQEYT

SEQ ID NO: 971272 - protein, 213 aa, Homo sapiens
QGSNEEACEGSEGARYQVRAGAQEEASERTTEPGHTIKPLRVRGTPSGAYQPAGRSLAPKKIKPYPQGRKAAKRESAKVSTSVVEPPNTCHGVAAQPCKGSIRQDSEENPLGKHWQQAQTAQGAQESEEDKGLKYLSRDTEKGHTRHKKAAAILKARQGGARATGQKGAAHTGKEPRQPSRQTQAGQQAGQGAAGHTRKRKTNNKLEADETAE

SEQ ID NO: 971273 - protein, 111 aa, Homo sapiens
MGLGPGLLTGLLSGCGKHGGGSIVTTKLTRRVGEANQQKRSPMTDAQEPVDGHSLVRGDPELDETQEHREEEQQHRNEAYKNEIENMKEHYWLTRTGAKRSRNRHGNKSTV

SEQ ID NO: 971274 - protein, 56 aa, Homo sapiens
MSNRQYSRNRTAGRKRLRDREPEDGQGSSNERSDAGRQHAPDEGVQEEDDKEEGRK

SEQ ID NO: 971275 - protein, 132 aa, Homo sapiens
MGRGLGLSSPQDWSSHEVGGIGKPGAQGRISSWLAMTLSFPWGKQPTGSGVEVLAGVCGTRCPCPPLPPACTVAASLEEMNGIAWESGEREDTRDLREPVTSPSGSVPSRQDEEPGSGGAAESRSGTRTGSH

SEQ ID NO: 971276 - protein, 159 aa, Homo sapiens
GLKHKLILEGPQHLVSLSPGTVWVPRRRSVPGGQQCETHFGGQQGHSSVGMWVEGFAEWCVGGVPPLQKGCASTRDSQWPTPPYILGVPESVSLLLALYIFVVDSARGAQPFSRKWCVCGTILETPLSPEPHTHTHNTHTELSVCVARERRRYNTLLCV

SEQ ID NO: 971277 - protein, 256 aa, Homo sapiens
KISSDIGQGTRIPKQAFTDVATGSTGPGPRGPLCEMAYTAQTTIDTGQLTEIYCLAWEMAELSEGHLIWREPLDLQPDTLLTLGQALMDHSYEHSNRLGPRRDPGTHLHSTRTGPSTSKQEAQAIGESNMTINRKNGQQQRDRHMRHSATNAPMPRHQATTTMPSTSKGPRHHRENKHHGRRHVKTNIHQQPWLTTHTRRIHAKPHATNSNLWNPQRAETTYGPSTSPQSHSHTTKGTNTHSIRGTPRDNRPTESP

SEQ ID NO: 971278 - protein, 534 aa, Homo sapiens
QRHMFPSGSRYFSLPQPLPLAAAAAAAASPAPPFARSQLRPAGGAAWAPAPTSTAPASPPALAGRGVLIHRAGLLVRRPASLTAAHFQHPSSHNNTAPPSRIASRAPGTLLRQKTTPTMRAPGSSTLMGQAYIANAVTRPHHQQAHLAQQGHPHSIPTSQPQPHPARHAPGSHTCIHSAGIASMGHHQAKQHKAFIGTKQVTIWINPTFLAAHRIKLRHLGHSNSQNTPSNPEDPLSGPASHSRANIGAITGEPYIPHTHRLGLKKVSQSPGVYTSGQTWPTGQTHYKTWGLWGPNHFGNPAFPPHTGWPYKPLLPPPGVHHRQTGPPKQQAVTSARAHVAIWQAPPGHHIISGKGTPQNLLQPANPIYGAAPFSGASQPSCAPHIIMGTLFPPHWGNTTKTQPNLQQAKPRQIYQEDDNSHQYLHGRVTHAPGNTHTHGGTTKRHQYPTQPWGPGHNRVHHTHVDTTTPKAGPNRTRHTYTTHTRRATSVLHPCTCNHEETEARHGTQEPESNTRGPPEVNTHYSTGNEHNTT

SEQ ID NO: 971279 - protein, 162 aa, Homo sapiens
LGSAGKGRATADNLRTSEQPEVPNAEAQRTQCLIWNISGHQLVSLTVNTHGHLNYGRKPHIVHYASPIPTEVEQQEKQSVTHLTLERYTCHTARTCEPASLTTPHAVTNPPTKSAHNARNESYGETPEKCPEHIRVATYSIKQEQSPDKKNHYHIDEKYWHT

SEQ ID NO: 971280 - protein, 106 aa, Homo sapiens
MWWGCGVADPPEAPVTMGTRVTDEYDYLFKVVLIGDSGVGKSNCCRCFTLQLMFNTVRRNEQPFGCGVLPPAASRVDWQRPIKWAARILGHLLAMDAATCCHHLLR

SEQ ID NO: 971281 - protein, 208 aa, Homo sapiens
MEQKFDENDADIHVLANFEQCMKSATLGMLTNGQRSWRRLHHSVRTVLAGTATVSRMCSATICAALTYHCPGQTGNSPYFPHYAEEYTYIQNVPLEDRSQRTTSGPERERTDCERCADEWFARSLTKLSGLLSHACMNIQGNITFLGQIPLWLKIDRRQGCPKPHGAYGKLDTAATSPRGSATYEMLPRNALTSLTRAARPRQPVRAS

SEQ ID NO: 971282 - protein, 209 aa, Homo sapiens
SGTFSGTSTPERIDITPVSQSSASYKLASAYGARQLQGLLAARLFAILLPAGPRRSMMPLDLYAYARGHMGSPAGGERRAYRFLACELTMALELQGDGLVPVSPQMLLHLLLPEERSGWCRQLYAGPTVRPCDILELGWSVPLHEEVEGWVETDPVPNDAPLRRSLSCRFELCHVLGAKRTVYQKEDSVGLVCNSTIVPFQVVWPVTKA

SEQ ID NO: 971283 - protein, 221 aa, Homo sapiens
RVINQEELRRLMKEKQRLSDQSETDRISISLKYNRLGHAELLPCVTLRVNELSSCGMLTVLVKCMHLREQWPELKCALKEASHGFCPASSDAISPVKTDKRLDRRPTIDVKQSARPPLVPQCTRPSTICVDHQLLTKLGKEFIRANPSKPSGLTLLPDYEDEEEEEEEEEGDGERKRGDASKPALRRTVTRSTQISSFTGGNKVDVLAKDSYRYYSSQGPQ

SEQ ID NO: 971284 - protein, 111 aa, Homo sapiens
MGKVKVGVNGFGRIWAPGHQGLLLTTGYSGYELAINDPFIDINYMVYMFQYDSNHEQIPWTPSRLRPGSYDINGNPIQHTSRSEIPPKSSGAMLAAEVRRGVPLDVLTTTW

SEQ ID NO: 971285 - protein, 167 aa, Homo sapiens
MFVTVAFGYSPFLSFTDGDIAKGPVPCPAGGDATQAGSLSPPLGCWRMSGGFMDMSGDEMNDLIWKHGDTLTRLGGNCQTFSSFHMSSPYSNTGDGSHPKVYQETSRDCRSAPQGGTPGRQGRNCSRIHTVGTVRRLYIGPFTIRGTGLNSFSAPQNTNRHGVTSAG

SEQ ID NO: 971286 - protein, 345 aa, Homo sapiens
SWRSELRIENNCEIGCLAKLTNTYCLGSDTEAQRTSTDVYRGLSSTDTIPVVARYYRRAAASYGRIVCRGTGTVSWYPTSTTDQETATHSNSLPDTVQITRVEERLSDLGTRVTTCNDYVAYGHNQTLDRADRRNIWQMCSRCAQSIHTDSGRTSVLVRTATGVISALQGRAGCIPKTFNSEAPGCKLSFLYFIQDPPLCADRLVNPEDSERSTACTVDMAGIALTWLVSFWFTHGNNTQAHVPVQCVHYLVLPKPDMKAKAIAPDEPTNKQQIPPTEQATPKKTHRSKALGPKRGTTQGDYETTGGQTPPTHNIPPHKPGTKKRNENGKKHKTRHQGSSRGERH

SEQ ID NO: 971287 - protein, 121 aa, Homo sapiens
LLHACVGSMSGNKRLLVSWGNACSVVPGGLAAGVPGNARWRNVPDSAGCDSGANPIVVAGKMNDVRSPADSESESLAPMECPDVKEGCDGSDACDVKLATVKMKACCLCQMLYLEHAPVMQ

SEQ ID NO: 971288 - protein, 70 aa, Homo sapiens
MVCLPETANKHASALTRRALGQHVVVPTEKLVTVVLVMRNRVRSMSLFDCKRRNVIVGAHGVGRPREAEG

SEQ ID NO: 971289 - protein, 594 aa, Homo sapiens
PPPPPPPPPPPPPPPPPPPPPPPPPPPPPPPPPPPPPLTSATCADGPVCLAELCALSAPAPCYFHLHTCCDYLAADAHMLLPPNLCHMCATPTVPTSSTFPLSSMQHFTLLHCCTLHALPTFLSNCTLWTHFAYTPVTPLFSPTSHRMLLPPCANATRPLALLASAPPPPFSTLSPLLHTLLPPPCTLLLFATAPPPLPTLLPPNSTALSLASLALLHTPLSPNCLSGHRNTLSLTALCTPHSLPTPPLMHLPPLSLQRTLHHHCLCACPLHALALLLLRPCLARVQRPCTLAECLDTLPLHHPNFTLFPLGTNSCGLACLHTPLGLARTSCGPFLLPCALPRPLPNFLLLRLPLYCAGTFSDTLLPPSRTAQIAANRLRDRCTFAQHRNLRNPLATRPPFFHTLAANFNPPTPLPWPPTFFSHLKPLGPFHKRPQPHRQPPKLLPLVPQRRLPLVSLKTHRAFPQQTPSHTATFVSTQRPLQTLLVFSAPYGLSGLSNTPPTVPPRGLAPLVEALCATFNPKTRALQTSSNTLAPQLFPRAQAFLQTVGAPQLPNSKRAPKQRSLTLLVSSPLLGQDMGLPPSRRVQKLSPTL

SEQ ID NO: 971290 - protein, 471 aa, Homo sapiens
MWTNNKNADNDSASDWSPTRQGPRLVRHKLLVYSTDRPATLLQLLDIARLTLPNHISIRTAPATLCSFPAAWNGKRPAKRMYHGAGQTHYCPARHSSLNTLLLRPTDTVPNTLSGTLASLLTGPILGAHGDSTGPAPAGHNSPLHLLHYQDRGRLTPKPTTHEHNCTTHNPTQQTQNRTPMQAANGSPRKGATRVRHSQRPNRTQPLSTPPHGRPLATSLPKPVPHPTTLRHVSATGGYPTDPHIHPNDPVPINALGPETPIKRPSSALAHRDLSRPPHFGPERRQNRRTSIESNASDSESHNKHNDQSLGDSPIIQHYAPRIQTTGTTWAQPTELERPPGAHRHTAKPLRPPRSNGRNRHSSYTATALQPHTNIHFPGPHSPQAGLCARQDHIAPTISTMGAAAHPRRPGITSPSTHTRCNHKPAERLTPPHTRHGATHLRAKHSTHPQQATHTNNDTPRQHQHRTTQTH

SEQ ID NO: 971291 - protein, 229 aa, Homo sapiens
GGAGSYLSLPNSMWMWHALCVPQLTGGSVYKYASFQVENDQERFLVTCINESASEENKRNYGSRPRGPLRSYDVTTGKGRDERRQHMPGRRTRRRDTHPPNDTAGHTTETAQADTDPTTQHTQHKQPPAPRKPAKNGKQTTNDKRTEGVKQKRRGRNERWKKKEERGEKEGPRRPGKPEKQARRGREAHGVKKRWTSTQPETEKETHERKQEAVNTHTQEQSNHARKRT

SEQ ID NO: 971292 - protein, 209 aa, Homo sapiens
RDAHVVWAVVLRRSLPSGGRLDPVRTMGRVHESINRSLIVGLKISTKSVGRDEREDITQHLQIPRGVLRGEGGLHKGETTVNNTGPQKEDDRDGHADPCGPEHEHGQLTHGPSLTTSTSNSAERVRPAASCSVPAPISYNGILGPECGTQVPAQTSTGALRLSKSVPLGHRSMSKVPVTAYTGDPNTHHRCGALTTLAARLSTSIPAGC

SEQ ID NO: 971293 - protein, 173 aa, Homo sapiens
DVSPCLGVRLQLPRCGVCCCCWRSVATGVCTPARGLRWPDCAAAAAPCYRPGKAWHHGLDRLRPAVLPLHLQPLPGLCGLRHARSVAALLYYVPVHRDLPVLACASTTDLPPQPPSLELVTNDHEKVELTWLRYAVTVVANITVYGACWLLLHLHGLVAGGAHQDISISDQLR

SEQ ID NO: 971294 - protein, 342 aa, Homo sapiens
MGRNIRGLYTHHITPLCTEAVAEYTHTTTKDNPICAHKCNLRDSQDIKITQDRPHEYGTPSIRTLLKTPLCEKGNATHQNVTNSTCDVPTWNRGIYNTLDTLGPTTDDLDTVPTLAYITIPSTTRPQYTLYPTIIASTPQYKASHIGQCEIQRHKWNEEPTGAKRKTHEHDVPHGETKTPTIGGSHKEAQGARSHTQTPSDAHIHTAMGPVHQTTHHKRVNAPDYEHPHQHQRATATETHETKTSHSTDQNKDHTTRAQRNHRVAHTKETIETHPMRTTYTNTPDKHTKLAPHTNNRRRPQQDATNELQTQRAHDKTHRNQNATRGAHETKDPREQKHKPTT

SEQ ID NO: 971295 - protein, 293 aa, Homo sapiens
PVPFSKDELVPSTDPFTNGVMLCGVVGVGHDTPWRARRQTATLCCRGREEEGTGQTHRCCRADAEGFRSCRGRRDIDSTVISGKVLNLSRKALQETITKWEEEAILGFLVLNGSCPPKMRFGLCQGTYTGLVGFSTAYSTGSPGDPPPKAERCNEKRTDRTRRRKNAERENTEQTLEKKKDRDIRAADGKRENTETTGHQISTATEITGQKGTNTHTRDTSDNNTGRTKRNRENTQIGHETNNNSIHGSNKPKTPQDEEKLNPSMPQITQSDEMGEKGTSGNPKHRGQLERES

SEQ ID NO: 971296 - protein, 346 aa, Homo sapiens
YACGVLHKMLSVTRCCGRGSAPFLGRAGLVSRNALGSSFISCKELSMPLTLIFQQALGTARSMSSILASSVILGADTSADLEAHTGRVLSIEVIGHLPSRTMALQDMYQASKQHGQQYFYIQAFNRVMSIETIGNLHNVRVVCPMHTGHNCITHLTSHSAQAAYFSLAQQATGSPNAGTVPQYGSQGSLVTGRTASTGLGIDPLMGVKYGLISHWGTHGVPTSIGSGATRQQPDHSSTPTRLTMNKSTPQRIIHIYAYPTELRHHRWTIEQNPKSGAEHHGADSTARTTAGESRPAGIATRTARTRPQPPKPDGNTMDLTMRGMEPPDHMPNEGGQTRKHQYTKDV

SEQ ID NO: 971297 - protein, 135 aa, Homo sapiens
SRGAPRKYGSPGLGTPRLGGVWAVFPRFFPPRLVPFPPAPSADLSRLPCCPSSPAPTAVIPGLCHLGMCDASRLAAWDMLMAHTWACGPAAWMCHTGPVLSCSWSPASPMATLEVAFPRMARSPPWGIGHYANCP

SEQ ID NO: 971298 - protein, 120 aa, Homo sapiens
MRTWPRTPGPRDEARRRRERERLELAFFAFSSAVEPWWGVCARSTMTSAGRMPRMPATTWELSLYELHRTPQEAIMDGNERLRVSPLGHMQFKNSMCPICLDMREEYDDTHKECLHRFCF

SEQ ID NO: 971299 - protein, 66 aa, Homo sapiens
RSAAPPPEGTLSPCSGHPGPRPADQLTEEQIAEFKEAFSLFDKDRDGTITTKEYGDSDEIHWTEPH

SEQ ID NO: 971300 - protein, 564 aa, Homo sapiens
MAPGRFLEIVAGNRCGQLMPANHNLSDYYSTGVVGSRLLIIIFSLQDRVHAAVLSLGPFYLYISMLLYATTPAIHTGGASTNVILTSVTSNIERKYLYCSIHGNRSSHTRYYWTEPNYFIFATHSAGGTNTASQCTSIDALKANNYATSPLAPVAERALANHALTPPPLASPRRHFPATSNQPSPSTTRPHFALRSLRSLFNPLSDAKQLYDVLLLGYPHAIPSKWSLPSTADTHTYTTRAKQHLISAAASSSPPGHLNNSYMTPTYTSTRPQTNHKPLNTLPPQPVSPITIDKHTHNPHPHRRTIDIHLNLRHNSQLPSTIYYAHPPSSKQQQHHKSPRTHLIYTKLHIHSYNRSIHIEPLNLASSQTYCLTSTYRPTHNSGDPLEQRNHSLTIECYILTTYSSTIRTHSTFVHTHPHFTIPTIITAISTPPKYFISLPPIRYTPYPHTHPSITTTDSDIKSPSSNGDIYIDKPTEQMTDTTEARKRLVLTTINSSLGRRPESNRLMLSISDRIRLQYHHHNTGSSHTTHLTSKRTHNLNHPTPAHHETISRRIHHMTSSEAP

SEQ ID NO: 971301 - protein, 136 aa, Homo sapiens
MNIRNAQPDELMNMQHCNLLCLPENYQMKYYLYHGLSWPQLSYIAEDEDGKIVGYVLAKMEEWTTPQRNDVPHGHITSLAVKRSHRRLGPGPPPPKKRGQKSPELGPGPPEAMIENFNAKYVSLAQNPGGFSKGTE

SEQ ID NO: 971302 - protein, 278 aa, Homo sapiens
MDKDVMNFVNCSELEVRYLTQTTYLWVDREDRGSLISKETFTYLLALKANWPDRITLLRGNIMRVDRSTQVYGINDDDKPNMDNANAWRYCTKVYRHAHRSQLSIDEQIKSVHGGHLLDIKNMAPHTSHRTESRKMRNTVKQLRRPQRRAHEPGRRETPREQDTREKQREKEETPATQDTDNVEEYKTTLEEHQKQADTTLQTVYHATYDNNLLTNIKPLNEKNNKNTQSLSKYANTSCTKNKVTSNELKPYQNNSSINLKQREDTKKNDKRYKQNTQ

SEQ ID NO: 971303 - protein, 225 aa, Homo sapiens
EAVTGTLFLSACLTLFSPYLFGHELRARSRAVMCLVRSYGEEGRDCSLVAAPLSGRVIPRGVPILGVRGEVSAFEASANGVRWPAWHPAGMCCPAEWYLLLQSARGNPGQDFVDRGAAAGRLGADALCCPPALWSTQGTQYAQEHGLNFHETPGTSHGTYRGGLFWEGHDPVWGEEKRQADPRLLSHGRLWRAISQPIWLVSDSTESVYIQWCREAYGAVTQTVR

SEQ ID NO: 971304 - protein, 131 aa, Homo sapiens
MHKTGGAANKHELKDTQGALAQARRPPGTTHTSPLHTQQVNRTTPTPPSIPHQNTEREHDTKQKQLRPQQYRTPHKRATQPPTAHSTDKKQYNKTTTNKHPHDTPNNNTRQHTRSPQTQHTKTAQTQTSAT

SEQ ID NO: 971305 - protein, 147 aa, Homo sapiens
RGSGLGTVQLDVGFASFHFAGVATAEKNLLSQAPGPQEKDKCHPEQSHLQLHSAPEAGPAGPVHLLNNVLYVPVWQVARMQLNEQQTVLSRTALCFPGWCCAFIHLGSSSAASPRLARNIGRAPQLSSARTPIQATQRKEEGAVGIY

SEQ ID NO: 971306 - protein, 121 aa, Homo sapiens
AHSRVENISGIDAAAWYRAFDDPPMSYVQKLDKARTSSGWCQGPTNPAINGSAPRDLYDMKPFKMLIRSASNSPDRMSMAEQLRGETLDSMEKLSRREAEALLQLNGDFLVRESTNTPGQI

SEQ ID NO: 971307 - protein, 160 aa, Homo sapiens
MPWIIGEGATCRIRKSAGTRVQSSGTVDRSRLDVAESSEEERFDGMLLAMAQQHEGGVQELVNTFFRLPSTQNRLFHWRRRRDGEEKLITHDFHATTISLCTGKTLAVENESPGLDGLSWVGESAGAVAVTRTGQGSQCQETSCGPQIKELTDEEAERCS

SEQ ID NO: 971308 - protein, 209 aa, Homo sapiens
MQGGARGPWCGPGIGNRGGFRGGYGSGIGAGVAALDGGRGRGQGARGGKAEDKEWMPEHQDRDNWSKDMKIKSLEEIYIFSLPIKESEIIDFFLGASLKDRGEKIMPVQKQTRDLAAARRFKALVCYRGLQWPSQVWVVKVAPSDVWPHAIRGGHHPGQALHRPRAQRATGVEHKIRKAPKLVPCKVTGPCGSSGWYSLIPVPRGTGHR

SEQ ID NO: 971309 - protein, 90 aa, Homo sapiens
MRGGARGGPEGDKGKRGHKGGPKGETGGRGKEGRGISPQYIKKRPGGNGGGSWEKNPRRGGIRGRIKGGYFHKGGPRRTPNFKLQPRPGG

SEQ ID NO: 971310 - protein, 200 aa, Homo sapiens
RVPPFTLELQCTTSKDEAGVSEHPECPCERTFENGQPLSKEPVAQWRSHCVANKAQGAMEPGRACADLPSCLRALQIQDGLSRGETSCGPSDTVVFREKQTKGGDGSAISRSCSNIINSSQLLNQEYSDVVLNKEIPEPAAAGRACPDDTPGLTLLEGTPREVPWFFHTEYVACRCASPCAPADPSGQGNSRWVLQQTPC

SEQ ID NO: 971311 - protein, 165 aa, Homo sapiens
MACAISILGKSLADELCSCGCLEDKLKGEMMDLQHGSLFLQTPKIVADKDSFCDPNSQDMSDGNCKESVRKEGESRVNLVPENNVNVFTNSIITSDRPSTVLIASSIVVSKSSGHSYVCYLDTKWITQNTAVIGRGCNLDTAIDNRYLMADKTWKFNPQQIAMDG

SEQ ID NO: 971312 - protein, 32 aa, Homo sapiens
MLANPSPWQNPQADFWAVSCSKPQLNAMNLSN

SEQ ID NO: 971313 - protein, 119 aa, Homo sapiens
STKVSLFPHVALCLSPFSPDLAHTVEKFTFSAPKIPSTTQTIFCGTCVKVVVRECRPPSLKKKKKKKKKIVCGGLGPSGELFKTPFRGAAGASMSRAQWWHKWSQETRCQATGRGFPPR

SEQ ID NO: 971314 - protein, 298 aa, Homo sapiens
FYVCMRPEVLYRLRGSSPLAIASLTVNGLPSGQGGRGRARFGASASAAAPSLRRKPEAAAGSGTLRAAAEPGGRPVPRAAAGCVPVRTTCDEGTGDLWLPFPVTEELTMAMSYCEGMTSSESTLKRKKRVPGWDHLPTCVLKECCPETWLHPKCDLPMASNLGPVGRKPGLQRCKVYWPRITTMLYTSSGGNNGGFAPWVATKPNATTFPHKPLYGTHLVLTGYLRHKTAGHPVQGVENHRTHFRSLGQRIAQTGVPPGNTGKPSVLLACRGECPCHWPHTAEIRLLVHGEDRSVKFT

SEQ ID NO: 971315 - protein, 297 aa, Homo sapiens
TRTTNCDSSKACLEAGEEERTMIDYAEKDEYNIKHEKGQNKGRTHKDTTKQNTEDETEATQRQETAPATQNHNQDSSKEQNSHTAETKTNKDTRDQDTLKKKATKQKDKIQQDKKPKKRTKSQTDRKNRHAHDHPNAQHITPTTATTQTTKESTERKHQQTGQHTKPQEEGTEEQKTSSYKQAETDTESETQKREDRKPQNTNTRIHNHKPAKRQSGTQGNNDKETSQRVVTQQQPPKRTQTTKHTTTPPKYTTTTHLNNNHQHRHRNMTQENENKHQHVNTENTHDTKPTTHKHTQ

SEQ ID NO: 971316 - protein, 97 aa, Homo sapiens
MAEEKREGIRDDLLEDAEPAVVDRILFPGSISEAMLYDVVGRIPMDAMKGCHGSCADKKLELEAFMDLHALGYLREGNLAVMISWRVNNLMRSRSLS

SEQ ID NO: 971317 - protein, 142 aa, Homo sapiens
MCFVVFLGIRGVFAKVLKFPSTRGELGKNFDRRRNIFFTFGATTGDWGFNNTLYIPWGRVLKKHKEPFLYREFYEQRVWWQTKNSGALTTQLKLVWKGNGKNCTTGALTTLAKGFKQVERVGHVGNTISIIGGVTSQRVIKR

SEQ ID NO: 971318 - protein, 219 aa, Homo sapiens
HPLTNPRISPCQPYHTPSPKVTVMLNNAIWPNYTRTTLLSYHTLYKTTQKITTKQHTHNNECRAPAPTTTPPQTKTISPHPPPTTRQHTHHPTRLIHKKSTNVAVTRGFASSLPLSLGPTPNTTVLIVLFTTHLYTQYTDGGAHPPRKELDACTTPAERKRTIKTRDTYSTTGAATLLHNNNRILSLIDYNVPHRQLSTTTLTAPPAITQTRVPTIILY

SEQ ID NO: 971319 - protein, 68 aa, Homo sapiens
CIDILIEKEYLERVDGEKDTYSDLAEPFCERSDCVTRSQDQFMEDNECNNNSGAIAVSLPTLYLPFKN

SEQ ID NO: 971320 - protein, 148 aa, Homo sapiens
MREETRLVGIGAKAPESRHNPDPSSRIHVGTRIPSFGTYRSIKVTLHDDDKLFQGICILFIGNSQQSWSAVSVLPSLVQGPVVLWFLPFVNVLHVFDLVYMSFGGELCDPCGSGRLLHEFVATIQEADFVGPLPKRLCLTCAPFYSLN

SEQ ID NO: 971321 - protein, 104 aa, Homo sapiens
MGNLVKETNRKGNSCVSRVSNVILKWPEIKTLITCMQKSAGLEPRVFGKQIIKFSGHVMPYSHLAILSTISVPRVKFGENYSELLEPTSFKPVEPLFKGCPDDI

SEQ ID NO: 971322 - protein, 92 aa, Homo sapiens
MERIVSPVKKEPNVSVGTMRHFSSHKPGSINLELPIAAISQTTNVFFLHVTKQAALKEHRVRNRITACKNHLSDKRGRVTDKKGRPNIGAKE

SEQ ID NO: 971323 - protein, 208 aa, Homo sapiens
MPHIGEMAVTWRNAQYPTTSTGRTKRTSHFWHTDKLLIPISIRPSEERQGTIWHDKGDDDQTYVHQGARMHTHRCRTTNINHWRRDTTHRRDGIIPHHQDDFRYYKDRTGACSTTRRHAEYRSTAQAPSPAKNNKHPRQKATTSENNRDEPQIKQNGHPAHTQRRKTDNHRDPLHHSKNNGRSTLNKLVQHHTELNKRIAHEGENAQT

SEQ ID NO: 971324 - protein, 196 aa, Homo sapiens
RTIPGCPSPVKCHVLPCYCNSHICVSRPTLSPASVMPLMPHGEKVERAIKISGIVATVFGAPGFLGRYDCQTTVGTHGVTGNHTRIGVIKYDIMHLRPMGDLGPASVLEWDDERINDSIRRVVQDSNGGQSRSYWTRLGNQIILIGRMSCEDSPRQWLNCLKEGGVVKTSIHVFRSEVRTITSSSRYREITLWRAE

SEQ ID NO: 971325 - protein, 113 aa, Homo sapiens
MVAGQHDRRKQYSDKRGEEKHLSNHLKETISAQGATVWHPPCDFPSDAQLARVPTIPQTAWQAQGRDNACSRGRRLRPQRAGPGTGSGNTSAHRARKGAKPTQTNRTKATPEH

SEQ ID NO: 971326 - protein, 152 aa, Homo sapiens
MQNYTTNKTTNKKNQANEQANARTEQRSNTEIRELQVKKQEQENNYQIKRRTDNSTTHADKKETESRARKEHEQNETDDREGEKHKKVQREKRTNKKDKEDNDTKQSSDNDKTSKQEKKCRDTQRKTEGNKNTETEHKEKYTTNKKTDQQTR

SEQ ID NO: 971327 - protein, 120 aa, Homo sapiens
MGSQASIQATHYRGTTHPPLYTESPTDSITKNSRQPTDNEKQNYRGNHRQYQTATQTEGHKRSRTRTTLQCTPRRHMPNDRRVKRTHQAKTEAPRQQRPARTTRTNHETNGQSQRNRGPA

SEQ ID NO: 971328 - protein, 75 aa, Homo sapiens
MNTSKMTTRARKAYSSLLQAPIEENSGREKPGTHTPGGPHTRPEASEVPPGRCPLAGSLLRTGKDASQTQLRAAQ

SEQ ID NO: 971329 - protein, 191 aa, Homo sapiens
RAWICSGVGMGPRFFRVYNKREQQHCKRSFKNFKEEKQKKEIQKTQPFLGPAFRPLEKRFKKTQCCWRRRGGHIGHETLGPNVWLLQRVAGPGDDGLAILHNKQPPGETAGIAFRETKLQMGHDRRDRKVGALSRTGEVHMVIWIQILALRWDCNYVAIFIISIISALYLHMSRLQCAMTVLTGPCAKVSY

SEQ ID NO: 971330 - protein, 221 aa, Homo sapiens
DTTRETHGTTAQEKQGHTATRRTRPHTKQPPPHYPHNSTTHTYNPSAQQQARDGGDDDGGRNGPRKRDEARGSERGARDAAGRGHRTRAGRGRELAAAGARRERVAGTRAEGGSERDQRRSEEGDSEKGEGGRSGSDRRDHAQRGRRERATGRDSEDRQRGQRGGGRGASEGNAERRHTRGSERQTRHARTQTAGGSTETTRGSGRGAAGQPSPIQGTQHS

SEQ ID NO: 971331 - protein, 118 aa, Homo sapiens
MSAVGIISRLAYNRHLLQAQSTQCTRATPSVMCDEKLVTKYGRLRNCCYRCGNIASIMVLKGCKYREPKVIPGSARFRDVSIPSQKDDASISCRGLRTSPAELILLSLFLPQVAGITR

SEQ ID NO: 971332 - protein, 157 aa, Homo sapiens
MQQPEWRVSVEAAALSLSHGVYRELSTQGEHLITIGATKWTSLMQSVDMFSKVLEHQLLQYYQTGGSEHGGSDSSINAGIRWMRMNWNACTDERLQATRGKLTQCSKTIAHGFPEKGHGANTEKSLVNETFLLRDSHGSTCPCGVPMSYTRTSTFEV

SEQ ID NO: 971333 - protein, 83 aa, Homo sapiens
MGTSGHTGAKAGSLRETRGQGTKGGEVLPPNIKNAPGGHPGGVLGTKSQEGGSTRGTSRGSLITTGGSKGGPEIPNISPRPGG

SEQ ID NO: 971334 - protein, 127 aa, Homo sapiens
MTSPQPTPTHEDEDHQHHQKNDKTKHQTTKNEANNPNTNRQPQRHAPKLLNPTNSSHDTHTLTLLATSSIPAYHIHQHYYITPSHPNHNTVTYYTLIAKQSKIKNRISNRLTLYISITTTVHYQLLN

SEQ ID NO: 971335 - protein, 119 aa, Homo sapiens
MKVMYYLLLQEDAYACLEMYVYKKETIHKVSSCAGLDLDVYVVNVRSILHAVLRRMPPSGRASYVHIQRYAILIMLTSISFGELVLDPSKMYLTIYGRSRSQHKSVLSPSMSILLCMVA

SEQ ID NO: 971336 - protein, 103 aa, Homo sapiens
MSDVDDYQLLQRIPSSHCSLLYAPCFVGPFHMNLLAAFSVDFRNSWPELRIEPKSRLQNTSLVREHIWLPFRYQSVISTKDDIYFPNTFWKQVAVSRLSLNVL

SEQ ID NO: 971337 - protein, 104 aa, Homo sapiens
MIATVWRGAYCLAVCIYCLVWQPTCLAVALLSVVAASVCVLGLPVCVWAYCRLCAYSLCVGLVSVVGLLSGCWAYCPWCGHNCLAVGWPVDRAGTCNEPVFVQP

SEQ ID NO: 971338 - protein, 143 aa, Homo sapiens
PENPKFSVPPITPQKKKKKKKKILGRPLAGPRKKTFQKNHPRGAAGGPQLGQQSATGGHKRRSPRREHPRGHRNQGARGYLLPTNIKKKRRGGEQPRSGLSNTISAKEESPGRHIQAGPSNHNRGVTARDAPNYTNYAPSRGT

SEQ ID NO: 971339 - protein, 281 aa, Homo sapiens
ESSGENHHSDRPHQVAIFKAFAMIIDQAGGRYHTSLHDQQERGPGGPRSLLRLVVTAQPVRLPDLGKGGCKIPKRSARVRGAQVFQVAGEYAAQSSERAITIAGSCPQSCATECVTADLPGHAGDRSPSLRKGEVSEHSRYQPMPGPGSPVIWAGGKIGCSRTLRGYPPCAMNVDGEPPRRMTYFDFHGPSNTQYLPAHDHGAKRDTRLALNNQSSALPLSDTAGHGIRPELTSRSPEGETVVEATRMHIANTQNYRSHYSLGSSWGHTATNEIAKLSQNM

SEQ ID NO: 971340 - protein, 186 aa, Homo sapiens
MKKKESSKNSKSTRARQTNKKRRRESEREQKKEKRSERGERKANKEEQRTREERTRGRKRRRGEESKEEDKRRREENKSDERRSKEEHRKASKTQQTKRGRRQKNERTKQRKENTQHRNRKSTNETKKREPQEKETESRGGREDEKRKTVAQRQKRTTKYTLTNKSTTTQKKQQNIIINNIRVKSN

SEQ ID NO: 971341 - protein, 285 aa, Homo sapiens
MRWGGGPRGRGTGALYGVGVPIRENPWPIDSSAWGFLTKLKNGRGGNRTGSLEQFKEGRVRSVIHGASYHQESKGRARIIKLTPRPGKSDAHIYAFRRPEQWETPLNNGGQGVTHRELRTRGDYQAHPGGHLGGEQNIRGAKWAEPTGGTQKNVGPPMWEHGVTHHDRGVNTNHSGAGRDTEKKYFSQKRPLKGKKRGQAITRDTSAKLARSFGVRNTARNKSAGDLNTHKAEKQGFRSGPVKPPVKGRHFQISGTFNANTSRKKFTPTNVKPAKGLTNRESPTE

SEQ ID NO: 971342 - protein, 148 aa, Homo sapiens
HSWRVYPFLREKLKKPLREEIKFMFKLNVVYGTGNTSIVVTSSGGNPYMDTFSFWGRSPVPFFMREHTSICLIAVASGIWNEDPPGVMNKPRLSATQENTTTKTGWRSGVKDPHIHVNQETLCPRSTEKENTLGQSRTNKSFSTGYQP

SEQ ID NO: 971343 - protein, 39 aa, Homo sapiens
MGSVKKLQEEGARRLHNGTPYSPESPDRTDITKINAPGE

SEQ ID NO: 971344 - protein, 116 aa, Homo sapiens
MSGDPFDVLQDEGGGCPLSSYAAGTHLGGTLNLDFHGWNRTSIKGKVMAVYIDKSQEDLGEAFCMASSCNCCHGKALLMSVLYASRNTGQRAVLKFAADTGDHSNCWPFSLLVTFD

SEQ ID NO: 971345 - protein, 209 aa, Homo sapiens
MRGSGSANYTGNSIIKQGSSTRSSDTKIYGPARGNKPDTAVETSTQDNRRRGRNKHRQKRGAIPKHMRKSANRAKKRRRRRAQLGESITKRSKWNEGEQQTTSRPTRGAPIRTKQSGGKNSTREPGEQTKNINSNDNNTEGQKKTRNTSRKATNNRKNKEEKRANTNENNERAERTAHKKTRNKNTNNHKKDKDKKRKNNEHEKAKTRK

SEQ ID NO: 971346 - protein, 68 aa, Homo sapiens
SVGATTVAVAAGHLDGRNAVRCLGQLETVVAELKYTLPRNGNAYCCESYLSSYDVPRMAKCDYGEQSR

SEQ ID NO: 971347 - protein, 211 aa, Homo sapiens
VRMCTRMRMRWGCAIHEKLSGSRWVKREELFIVCNLWCSYHEKGLVNGACRVKDSSATIEAGLSGASILFHWGDWFYSLGRNFPIDESGNVVPSDTKFWNVGGMEELVDEGLVKAIWHLQLQPSPGGDDLKQTWLESISLQLTRYECHPYLTQEKLIQYWQSKGIVVDRYSALGLLTGLGQAPRTLSLLEDPGSGIAASTNKLQPGLIRSH

SEQ ID NO: 971348 - protein, 225 aa, Homo sapiens
GGKAEDKEWMPVTKWGRLGQGHEDQVPGGDLSSIYPAQLMESEIIDFFLVGLSPKDRRFMKIMPGAEARTRCRTMRTRCKAVCCYRGLQWPRRSGCKCSKEVGHGPSGGAIILGQALSSVTRCAESYLGEQRSANAPYLVALQGDVAEEGSVLGTGLIPAPRVRMVIVCEPVPKKLLKDGWDRGLYTIKPGAVCNLGKYQGTLDAISKTKGTDPTLGGDVSQVPL

SEQ ID NO: 971349 - protein, 148 aa, Homo sapiens
EAVAVSFSWLKLGGSDGGPARRDTGLRNHCTHGGCALTYNTNVCDLLAGACSMLRMHGLGGKQRNYYLLPLLLDVLLSFTGWWTYSLRLHAAHFIHTTEPDFPTPLITTAVCVSIGKPSTPLQKCINCTTLDLRPQSAALHRYHTTQG

SEQ ID NO: 971350 - protein, 466 aa, Homo sapiens
LLANFIHTHSCPHMRNATHHTRALHCHTMQPSPTRAPPATLAPPLAAPPYSRPTALHNKRRRPHPTPSTPTTPRPHASHHSTHPPCTPPPHPALRPAHRTPPTYPLHPPPPPPAPTHHPPHAPPHPRPTTATHSPPPPLIHSRLPPPPRPHPSPSRPLPPSPTPRTPPHAPPPHPTPHRPHPPPRPPHTAPRTTPPHPPHPPNTQPPQPRTPTPTPDPPPPPHPPQRHRPPPHPPPPRPPPTPHPPPPTPPTKPPPTHTHSGPSPLTTAPPTQQPPHPTSPPPPPPPPHHSPTPATPPTPAHPTSPPTPPPHPNTRPRATTRPPRRTPALPLPSPPTDATTAATSLRSQPDSRRTPLTSPTPADTPYYPPPPTSHPHLSHAYIAPPPPDHTSIPTTNQLPTRNAPQHPSSHAHPPLTEPPSYPSDWATHTRPPPAHTHHPTAATHIPRTRYRNTQLNTDTNTEPAR

SEQ ID NO: 971351 - protein, 104 aa, Homo sapiens
MLFHIHPSTPSSVTSILTYTRHSYIYSISITPHFTTPHSQLTASHTRNYLPSTHTPSHPHTIHSTHNYRHRLHRQLNYQSLETYYTHNIQIKLKKQLSLHFLST

SEQ ID NO: 971352 - protein, 308 aa, Homo sapiens
MSYHNFREPTDFNYELALQHIAFIAKRVPRITELANYDSLKPSVRSRPIDLVTSSLRASTSCKLGGYGYNYALTSSFSTHLSKTDEHYPVPCDLIPDEAELLTKLHLAYRKTRPKIRSCAILFKSGKYASVVTAILIQYTLKAFTGRTIILIIAPRHLNPHYYSCTAILTIERISSRINDPLSRTSNSIPIKALRKTLLQIMINIAFTSIINHLGEPSVSKTRYPSQYDEQKRNQNKTTFNPQFPHNGHPHIMNKLSENPLELQYNTHSVLKKNGREFEEAERFHHLHIIDEQQTEHTLYALLPKSKH

SEQ ID NO: 971353 - protein, 85 aa, Homo sapiens
MATTPDMSMATDTPPGGPLAATTHVRPTRCPPKRGGQNSSPPQANSAKTPTNWWATNHRVTKSAGQPTTATRTHKHNDTTHNSTE

SEQ ID NO: 971354 - protein, 293 aa, Homo sapiens
LTEEETRVMFEKIAKYMEENLQLLVDRPDGTYCFRLKRPGVLCELRKNYWKAWAGQIISGGPSWVSLGDLLGKIHYNPQVSVCTSQLVDYLAPYARYKVGIKPGAEQSFLYGTHVLKSGLGRITENTSQYQGVVVYSMETSLGFGVAANLHKNGKVDPWDVVFHQARHWGICADEETLIEKKHSNDRRVYGKGELGFLCCVDSHHSMLNRPQSDIFQDFLFKNPNHANGGGVHISGCHRGPTLENETVTWNKACREWNLDEHVVRYTYTGVKPTAETRNKTHTNRGRTKHRTQ

SEQ ID NO: 971355 - protein, 78 aa, Homo sapiens
MRLFPPSKADAGPFCGWISQSTQISAWVCFRSPKIHTFEISTISTSKMYTHLDCGMQMCNWKLNEKLRFLSNGEYFAL

SEQ ID NO: 971356 - protein, 67 aa, Homo sapiens
MGSPSGAGSNVQRQGGNTILTGLNLALQKDPEYTSLELGKDHFGPGDPRDHYPGQKYYQCGPHRHGV

SEQ ID NO: 971357 - protein, 171 aa, Homo sapiens
MGAKRGVHQKGEELRGNRRKAGGGASTHTHQTKPPGGAHQKASKGDKKPPEGKYAGGHQKRGNLITKTRGESQKREREDKNTPTSRAPRESGQQTNKKKKDNEETKKKERKKEGETDTREGKQQESEGEKGGKDKDGENEKNNEKEEKKREAAAKSEKMETERKTKKRAKE

SEQ ID NO: 971358 - protein, 186 aa, Homo sapiens
AALFANRPVPPTSAGRSPPLPRITRCRHGKARFSLQVHARLRRTRAVGNDLPDSLRLARVTNLQQTLLPSPPIGHRISQRLRKLSDSPDGDQTDSTTTTVWGHRRATAREFPRTGPTDTASLTEEAPRDNHQPVITTIPATEQISADDIYTSEAWRRAIQGELRNGAGEAAYGRGTKCDPGTRHTD

SEQ ID NO: 971359 - protein, 191 aa, Homo sapiens
MRDNGCTTAEPLSPHYRQTVREKTIKPLTPETSPRRQLTTTEATNPYNAPYNTTINPHQKCPGPRQHGRLNKVTPDDLTNNPPQWPYRRQKNGTAQTTKHGNNRTGVTNQHQKTITQTVLAPKCMHERATGTTRQSHLDSTKSPGSGTHREPVRTHTNLEHIQELETHRKGQREKPKRATQTPDHYFQRLR

SEQ ID NO: 971360 - protein, 199 aa, Homo sapiens
CASKNILINTQVLSEKKKKKPGFSTIKITLEVALNSNHLRILGDITVVAYFPLVTRHPVLANSGSWPSGLPPLTSPNLDLKRPKYAYVLGELHTGLLGKKPLVLRVTTHSRHRHIVAFWAAETVSGRGGTGGPLFVTLPNSAVLQKPQLPIANYDEKPLRLIVSRFVTKHKDGCGGHNVFAARKKGQTFRVINDNGSER

SEQ ID NO: 971361 - protein, 76 aa, Homo sapiens
MTWRGVHARCLRDERFILCVTLMNVHCDGFSNYTGILESGHVAVGSTVNQHASLRFCSWVVITTQDPSVEALLNAP

SEQ ID NO: 971362 - protein, 126 aa, Homo sapiens
DAGSRTLGVMYYKVYVVFIAMNVRVMDASGFVSAYSPQGLKPAVIHRSTTYHIGHTNYTELRFHRCMIMLGKNKVPGLQKFFQKADGVPVYLKIEASLTKCCYRITMALTVGGTIYCLVALYYGFS

SEQ ID NO: 971363 - protein, 148 aa, Homo sapiens
MNNRGVGSSSTNNNKTRRGGETRSGLREKISQKGESPGGAQYQGISYYNKGEAAQGEGLSDISLKHLYGPPGPVGEKIGTGRETNKRDRQQARLKQEKVHARERNPWQRNALLASKAQTNSSTDHPVDKKPTNRGTTEQQSEPAVELN

SEQ ID NO: 971364 - protein, 261 aa, Homo sapiens
MHQRNTEAHTHRPKNQHNKGQNTQNTEKKREPKHRPENNTHTKTQNTPSRDQPPSDATHTQTETTATTPKNQTARNDPPQHTKHKQTQKNTRRHTPRTAPQKHANSKKTKRPPTTTQPTKETDGSTPDDDKPTAPTTGGKQREHNKTAKNSGSQTQKQANQHSTKEKTERTTTRKHKKAQKPNTKTKTQQAVSRDKGKKRQEKPANRQRRNPQTASGNTHTLKNGQEGSKTHDHHRAAKKTPNQGHRQKEGQTRDHTTESP

SEQ ID NO: 971365 - protein, 240 aa, Homo sapiens
LLLATLMCSDYISNKKSSHHKKKKKKTKKTWWTATRAPRTTSLKHHRRGRPRGPPPRDTDDTGSHSESPNANTRRHENQRAMETTLTQIKQTPGRKPQTAILRNTKFRKEGTTQERHKRAGTTQTHEGHIPKTTHPTNQKLQPPTPAGPHTRSTEHEKTHKRQQNTHRRHKHRKRNTHPTAGTRRRRTRDSARGRDQRPTKTAQEEQKEPKETASGNNKKPKRNQQRATGRSRPQRDTHP

SEQ ID NO: 971366 - protein, 268 aa, Homo sapiens
ACNPSTLGGQGGRIMRSGVRDQPEQHDEAPMSTTKYDTFRPGRGGRGGLVSSQAYFKDGLKDREKFRPTHLTGRTVTRKAQEYTATGTARPWRDPERRTSILNNKKQTKTTNKQTHRHNTRKGQHPQTQSLQQNTAESERAHQRRTQEKRKRRTHGRNKKERPPQRDNNGVNKGRTITTNARAKRAHTNTKQPHPTAVQKKQQTTTGCTDTQKQETKPENEAKTQRRRANTLHANKAMTTHNKTDTTTSRKPTEAKHYTKDNNRRTHQ

SEQ ID NO: 971367 - protein, 275 aa, Homo sapiens
LTCHPPSTTTLLSKLPKKKKKKKTKRDSPFFLGGLGRVSSTPNITSTLHSWRELRLVALRRPLGFKFPLEGLWRTLGLPQKVSPIRRAPWRYLKLISGVRGANQPLRFELHYEVLLFNRGFWSRRASGELFSTLYKVPPIIVGATTAEPGTIAELLVTTTNEAKITPVEPENSSPQRECVHKTSGQTIERKPPPKEKLPDRQMSRPRHEIFCAPWALIAVRHHLGGQTHHCTHQQSVGEANLITERAKEHTSTYADTLRRLGDKTLSGHTNEGVL

SEQ ID NO: 971368 - protein, 102 aa, Homo sapiens
MREKRRARVNYTKQYYSEPPQEDPAGGARRTKETREDSKHHKKEQKNTKRKQRRKKKQRHHTNSHIKDNTSETEKNEKPDKRRQQKPKKRHTHKRAKDNHTR

SEQ ID NO: 971369 - protein, 321 aa, Homo sapiens
MLKPTTHSIYYHTQRHHDRLRNTRTDRPHSRQTHHAHKPHTHQTRLLPPTRTAPTQRTRTQTTKRSHTNKSQRQTQIQNKMNQHGQSHTRAVMKAANNRTVDKPYHTDKHNTETAQYPIDTGHHYSNYTTKNTQSHTTTPHQHSNKARRKRDTKPDPEKQTTNTKKRLEKHTNQKQKGTTTDQHLHTTTAQYTKKHHEYNTPNTHQQDIPTQQDNKNTNHHSKPPETYKRQNKQSEQKQNIRKISRNAQTKQQTGTQPREKDTHKETHEKKTQDSNAAQHKQPTHTNTRRNKTKTKKQTKTIENKEYTTQTTHTKSANKHK

SEQ ID NO: 971370 - protein, 139 aa, Homo sapiens
KELAKDIASRRDRASEATIRTETAHATNRNQQPHNNGHRAPDKEKRQKTQHSAQQRTKERREREGKTNSSRDGTEGPRTKKNDEEPTRSEHRKETQHTAAHQRREGGREHGRAHHQQPRRGHTGRHRRPSACLETHPET

SEQ ID NO: 971371 - protein, 122 aa, Homo sapiens
PTVSFPSHDAFTDRHEYTAYTQRHRQSSEMIFCHRSLEINKNSWPCLKGTSFASTFRVWLLVPAMAIMAGHYQFFLRFGFGSNIYILNTLILFEKFDLFNEASWGFVLLLFFSVVGGSGARC

SEQ ID NO: 971372 - protein, 307 aa, Homo sapiens
MANSWLQGLSQGPDAGEFSSTNAYGSNLLTAEDANIRNPIARLSFCCGPACKAFSSLTIGQFPQGDTTRSQPCAMRSAAHAHTITNTNVPGRPANVDGARTLRSLRTPLETNTTPTPPHLPSPRIASPHAHAAGPHQRGHMVLVPGHSRTVHPGAHNDRNAKGKPEPKTPPDTENAYIRGSEPDKYTRPHPTYHRTQAPPPPGHLHNDAHAPARHRGRLANKGDNSGRPRPAPWASYHTAQENDATPTTHERRSHAKRDDKLPPGHTRAHTGTAHTPPQTTQCNSNNTRRGDTNAPQQSHNRQHTHH

SEQ ID NO: 971373 - protein, 610 aa, Homo sapiens
PPAGTDAPRPQSQKRDEHATPQQPRTMTATHALRPEPQQNAWRAEHRQDNTHHAPTGSSHRGPPARTHRHHTQEHTRHPTLSHPREEKQTARAQAHPRATRTERRRTQRASETARATQPQAHRPRAQKRHNAQPNTRAPPAARPDSTRPSTQDRQPRATATPGERATDKSSHSSRRHPAHGAAERVALYMNEENRGHEGRQQRHAPPSRQRNAKKMANDKEDETEYDKDGESGEKRAHRAPTRPSAGPLQPPGRHSRPHHDARPAPDTRATQPRDEERTSHATPGRTSPYQHAAPDTRSARPRPRRPNTDDTTQRTADEHRDRNDSTGQHTGERPPSNARPRPPPHPNTVQHPESLRTHTRSRRLRPTTSTHDHQPSSYRDAAAQISESTTIKTTTRVPAPTAAHGARRRAATTHTPPRAPRHSVNAERLATARRRSLHPQLERRRARTARAEDQDRGDAGRRKRECGNEADCHDAHGRRPERGDASTQENHAAAAERHARERAPTDTTTRQHRDADDRGEARRDERQTQQDPNTTHKSRRRQRIERTTNQDRQHARSEPGRDAAASYSHARQSPAQEMPGEHDKKKREETGEEETVQRQQSETHTLREA

SEQ ID NO: 971374 - protein, 297 aa, Homo sapiens
MRALLFGAAGLLLLLLPLSIFLLLQDTCGPCEPALLPAPMPPLGCHAGAETQRRVRLLPYVRPRAIGEPVRGWRRRPGGHCAPGMECVTEPAHERRTTGTSPGASHAWRHPGLLTRPADAVCTEAATPRASRATTERRSHPKPRDGPRPTWRPPAQAPARGPEQHRRPHPKGPLKPKSVTPNASHTTAHSQLGIRCPTTDEQPPPQVPPLTEKMAPPLELDPKGRYTSGQHGLTSPTSDKPPPVKTIDPLNLLENTHQVKPQQIAPLYSRTIHHSGTQTSHKQMASNQRHNPLDPFQ

SEQ ID NO: 971375 - protein, 143 aa, Homo sapiens
MQFGLTSLLSRRAYRGCTTTERIINGCTQHTQEITGPREGWGLQASPGPQGSVPQPWAEPCVLNKLTTYTSRRHKLKGAPPNRNAGEHNKVLLKHYLTALDITTERGQQNLVATPCHTSPTRPATTDTRRHARAQLVTTPGTR

SEQ ID NO: 971376 - protein, 189 aa, Homo sapiens
TFIWQHKFSKSGGTSCYHHHISLSSFHILNNIFHFMQSWACVVIIGFSPQQFTLCSHSTTVTLITTHQLTQSAPHSMHPVCNSAVHTIISAQQHTNPKLPSIIHNTSQSPITATHLPTQQHPNTWHTWFLASTTWAYPGQAKYTQHFGHTRYAYSPHDLPLIAHFSTHWISSYRAPASIWIFLTAFGEP

SEQ ID NO: 971377 - protein, 31 aa, Homo sapiens
MPLSSPYCTLTYSRYSYSLTIILLYISSQSC

SEQ ID NO: 971378 - protein, 185 aa, Homo sapiens
MPSLTHTTTNSRDSNLNPTILRSPNHNSPSMHSSSHTHSQHIFIQSPRQYTLPKHTGTLHHTLSGPITLHRTTTAPDTGPPAHPGPCADTNSTTTQAPPQRNNSIYTTNTRAADSKTRISHSTKTSDTTLTKTPPNPPPHAHKTTPAHTAPTHTPYPLGTHTKPHNRTDKQRHYHHDIPSPATSS

SEQ ID NO: 971379 - protein, 320 aa, Homo sapiens
SVECNCFCIGESDYELETPKKKKKKKKKNSLGAAAAPRKSFQKPIALGAAAGPRSATGTGAIACTKGETPGPDNVAGTLSPQYKKRPGAANPRRFVNQIQSEVGGSSGDLHQRGTSRGAGIIQNYKPPARGTNLTPPSGTNNVHALATHSWKHHQTGDGVKPVQPDTTARSSHDGPPPLTQQTQEPQQASNTRGAQRTTDHTEHDRTNQHRRKPHPRMRRHTTPIRNPTPRPTARDSSGRGGNDKLGDPTVARTAPPTAHNPKRANRKSGTNPMPPRQTARTGTTRDRKRRQQSSPTAPARYNTRTRDGQTGNKPPRTAR

SEQ ID NO: 971380 - protein, 171 aa, Homo sapiens
MKNLRALVDETVTLGIYERYKQAWNVEVPIRKMNAKGICGDDCIGWMGTPGDLIEEVMSPKLNVMRNAEAMFGTRHGVRDRLGAYKMQNITGRSPLGQDTFSLVKKEYAPPYCPNTALCVDEVAPQDCKNIPGLPTRNLQRPGGKHPRGDNWYRNTGDVATPENPKALWRE

SEQ ID NO: 971381 - protein, 51 aa, Homo sapiens
MTLTPTREAHTTTSAITQHHAPHPPQRTNQTADDTTPPLLLHSTLEHPNTN

SEQ ID NO: 971382 - protein, 78 aa, Homo sapiens
MTTRKQRKQKKDGKVEDKRDEQQEKERRDGGKEREGKARTTNEGTQKQRQEQKKGQKGQERREQRTTKRKKGRKKKRE

SEQ ID NO: 971383 - protein, 202 aa, Homo sapiens
MLISYHMHHQSAPEAQAPSKTMGAHPTTHRHPRHTHTTAVRHATLKSYTPPIPLGTRHFLVLPDTPLPSHLTPPAVHTSHTRPQRTSFTLHHLHRLAHTWRKPRTQQASAKAPSSGHEHTAPSPAHHHHNTPPHPRGQGARAEARGHTQRGPRPARNTAQRPTGTPAQPRAHTHDRGAETKHTPTPTAQTNPRDRAPPPHSP

SEQ ID NO: 971384 - protein, 286 aa, Homo sapiens
PGAMSRAPRAPGPGSLPLPPQFSTFRGSFIVIKTEWDFSTKTKQKPRKKKTLLRPRPGPLEESLLRTNRVVAAAGAPEKRLRGETVWAHHPVFSLRGETPGPDLAPHAAGEGSPLTQPYNKTTPAGGGHHREPDVLPRHHTLPNRCETTDQKAGHNHRGAIYTHNSNGGCHQEKERSENSQTINTGPRSQEMVHPHKQHTPPNNRHTQDRNPTPPNTQPTTHHQDNHNTNINTHDHTNNTDTHPTQPHQPPATTHKPETTTTPKRNCSRHRANNYTRHYKQDNTNT

SEQ ID NO: 971385 - protein, 112 aa, Homo sapiens
MRVGTKKFFMNVDRYKMVEMLPEKIDLCRVESKMKLVGSMFYPRDGMIDLYQKSGIYWIDRLDLVLPHCQWVYSRTRKLHRGTIAVDLSENQMVVYYAFANIKIEFSSEDIF

SEQ ID NO: 971386 - protein, 321 aa, Homo sapiens
CRGRLAAGSGGTNVGYQGYFSHTSASEPISTSVCCTSSLNVFVKSEDFSLPALYGSRVTTPCRQVAHVKHLSASQKATEGRQDEGPPGAALSQWMQKRSTLALAPPPPHRPEPPADTRHPGAPPTRTSAHTGGAAARPPHPPPVPTAAPPIQRAPPTPPTDRNRAPPSPPTAPRHHPHAPLRSPPRPTRRTARHHLTTADPPQAQLPYTPLPTLGDLTDTTTPTPATHVDAHCTPHAPPGTLAPLRHSTPGPMPTPPLLAPESNLAKPPGTTPNQHAWIPQLVNTTATSRTPTKHQSTTKEPATPESAVTQAPPRTTRHNS

SEQ ID NO: 971387 - protein, 291 aa, Homo sapiens
EYVNLVEDVDTKLNLATKFKCHDVVIDTYRDLKDRQQLASIQAANWYDKWITHEDGRSIDARFSASSHNSMARIYSGIDYLEACLISSSPACAKQSELFSRESCGITSLGPITLAHAARLLLTPDNFRLTLSVHGNIICRLDDLNAPSHETDFSPPGAHLTAGVIPTEGPYWRKISLGCHTVTGPDTDRGMPQPKRKPNDPHHSPPTTPALAPANRNTAPTRTHTEPTGPRHACQRTKTIWKRQNTASTETPHTATTTQTSSHSKTPDSHNTPTHNDTPDNKDRPHNTPQP

SEQ ID NO: 971388 - protein, 161 aa, Homo sapiens
MECCVAAIRLLAVGVSASAGTQELRHWRTRLSERLSAGTRQLSDDTRDSVSRASLLGVSRVDDEVEHVEFTLKTVSLGVRASTRSDARCLLRESSTGAVLSVASVGAVRRSVRQCASWLCRLRRASSIALGLDRARHLLLITCDERFARWLAAVAACLSSS

SEQ ID NO: 971389 - protein, 258 aa, Homo sapiens
MAPSRKFFAGGNWKMNGRKSGVWGSSSCSSERGKVPGDDRGGLCSPYRPISTSPGQKLDPKMAVSCQNCYKVTNGALTGEIRSWHDQETCGARWSGPGCTSEEKACLRGVTMRLIGQKVAHATGERGLGVIRLLLGEKLDEMGSWHHLKNGRVRAEHKVSRRITGKDPAQGRSLAYEPEWAIGTCSETETSQGGRGSTTEKAARGWVKASAIMMRRLKSTRLRMAAPGTGATGSAVATSPRRLLPGVRPTTGSGSHAK

SEQ ID NO: 971390 - protein, 104 aa, Homo sapiens
TNQGMDEICSRRQSYRVHTMTISNNINKDDIFSTIIICMLQYHSGEHTFSTFYIRVVVEYRVHSCNVIGTRSITMGILNSYSSFTLGKAKFIRRRIAGILTLRQ

SEQ ID NO: 971391 - protein, 108 aa, Homo sapiens
MMNADMDAVDAENQVCTGGRKQDLLSHSVGNSNTHCERSLCKSRCSEGRPSEAKIQKTKFLDNIKKDLMSVRSVPKATDTQKRKRKKGIDTLLFYGMLLIISFFYKLG

SEQ ID NO: 971392 - protein, 476 aa, Homo sapiens
ELGPIRGTAPEWHGRWNAAERSDKMYQVPLPLDRGCGPMRYRNPASPLVSPESTVMLSTLIALHSSAIHLVPAHSTFKGDKQRPHNMMGDAPNIPDPSRCSIRPSDVGECPQTLTMLAVYMASSTATSERTIRNNQYEMSPYQTSHGENNIHIQACNTSHTIDYTDYSGHGIMEQAIKDIETINKYRWTENHSATLAYGWHTHYIDSYTYQYQKGPIHPKYNQKHTLHYPTRWYTICPFQSHIRRDTHLENINTMAHYLLGAGDWDPHKDKNNTEKHEAHETGIRQKIQTHDMEKNQTGRNNNKHDNSERQPPTNQYEAEQSTATHHKQRDTKHRTLAQQRRNNRTHNKTDEHNQEKSQRMNQTNTHNGESNKSQGTEVRTNAQHSRDASDNTHSDTQARNSRRNTQTKRKRARREDKRPHTTRTHKRQPRQTKKKTGEGKRRKDRTRDTNRRTTSNNNGTRKRRDKKHKRRRKTE

SEQ ID NO: 971393 - protein, 51 aa, Homo sapiens
MGAYRKANRNGPVGHRRPPALARGRNQKSARGERGGPLGERHMGNVSHGVH

SEQ ID NO: 971394 - protein, 254 aa, Homo sapiens
MSEETAGHGHQARVGHSSPNLTKTPAAAQPDAFRDNNTPDWDPGDATKQRALLEQSGDSQSEDLAKYPTLRTPRDTGVHYNTHHSHHNQLINNTTTRHEPTQPPQTNHTTTKQLTHKPPLTNHPIATHLPTNHTTHRYTHSNPDVRIIDQPTSHSYSSNTHRARRLLHDIVLHYTLHRHFYTAGVVQYEKQETQDLTRTILTVRTHCSVQERQAAEYGVTSYDRQAYGSLACRSCLSQSLTDGRRCVPASRIAR

SEQ ID NO: 971395 - protein, 76 aa, Homo sapiens
MDTMGYHVLWQYCRGIESNKQALTSTHSTHVGVQSYSRANKGVWNKNIACLACLETRQADHANTTTKREKQARNHT

SEQ ID NO: 971396 - protein, 347 aa, Homo sapiens
CNPSTWNIKVGRSLEPRRAKITQLYSSLDDRVRPGSPKKKKKKNKKKHLGPAAPCGPSQESPLLRTPFRGGAARAHGRGRGKTGPESWFPEEKFRAREQSGLGFSHPLKNAPGGNRTAFGTHHPKEGRDLGRRAIKGGLTTQAARLHKASGLGISQNITPPQGRGDTPQQRRQQEVEQEQQATNSREDTTHSATQHHTKQQARRTHNNEVATDKNTSVRPQASNTERQRTNETRRAPTTAQRASRQTRNARTEANTQQHKTERHTRDKRRDTQRRQHAVNNEYKDRSTTEAQDSESHNNIEPHRARRNTKHQPEHATQEHNDRDAKQELDSNSSRDRTETPSRPTDD

SEQ ID NO: 971397 - protein, 315 aa, Homo sapiens
MFYPSRHRGTLLEDHAYSKSCVQTLAPTTANRTEGDQEATADRNATQHWCEHPGLSRKQRAWLGEQWRRSPKRNSRTQLLGPFGRHAKVKAPGQHHLWAWEAHKGKAIDALGCVGSSDYRTVVLPLSEALGLGLCLCTRRPWLICYTHWGAYPFLNWGDFHPKRGGTHGSQRKLGGPSELKFPTLGNNETFVQHQLCGGRYPTHPWLAKLSRQKQRHQGGRLFMGIKTDLGVRRNALNPMRKPKDATKEEDEVTALEETPGPGNLKGEVRGHMEPYGAPRKRRSRGEPRYSRHHSAPDTQGGTRGTQNLGHIKTG

SEQ ID NO: 971398 - protein, 494 aa, Homo sapiens
MMADSCQETSRARRHGPTKSPKERSHRLTNNRLTINFATVAAGSDWVSVACSFNDLTEAYTTVQATTYIDKAYLCNLNQRHLFHTDELELHNFRMLERGQPKSTLENQDSDPVPQVVQHGTRLHTDYRTLTCCPATDATHRAHASLVPWTMQGTPFALSVLYTLTHNVLDYRVLHEAYTEVLATFRCTTSTAHKPLANTLGGSEPQLRTNVPLGTRNINPRRTYGFCTPFDNSSFIARSCAPRPPCCAAPKSSPVSCNLRALRPRLRTAALTTPVGALNSAWLGPTQQRPVCYASGHDVRPTALRRTLCCSATGRAHAPWCPPLPLRAAQQPFSMRGHSSGRTTLPTISRAGHQHPRVTSRGARPPTLTYLTRRQQLPRTEQPNTNLFHTPPPQFFTHHPINQATWAPHAARPLYSPAPASLSHAQRTTRLLRARLEQHATTHSYEAPTNLTACASPTERNTTSTQHATPPSAPYNATTIVAEPSPAGLYNAGA

SEQ ID NO: 971399 - protein, 101 aa, Homo sapiens
ETIRIRRRKCPNGRTYLTLYFWDVERTNGTPAHVEHLGTTVMDEETHCNTTHHEVDKNRNGHAVQTGACRYGSSTWTIWFWRHANLHTGIDFLSSNSINKI

SEQ ID NO: 971400 - protein, 468 aa, Homo sapiens
MEISQKRDKCREAQEHSISHSPVTLGMSHAQTDNLVDTLVKASSDSRGQLRQEAHLGILSPRCVEPNRVMYCHITEAPARGLRRTIDKRLLAKKRKMTFNLQVSRPLPGVTPFLIHFHRWRTPRWVNLGTRKWVWPHPRKRGRVCQTGNSGFPFGCSLRWSLHGPNGPRAWASSGFMRNTPLKTPPRRSQKGNKKAGGRRIFRHSKPPHKTGATPAPAESKFPFPPSDKDHSLVDPCGEPFQKWSLPHAQRALGPVKAPQYVVAIRTDGECYPLLREMRYNTIKMPPLGSIFLTSGQKIICGGRMAQVGQVGLFRRKDTILGDMSSDTAAIAGTTRGIDHVVQLKSNRVIHRHTRLGTNGTCTYGNTLMNGAPKPGRSTPTGSDPCGHATRGKTTKGLTPGNNGRSHTQQQPRNHTADVCDDRQHPPAVQSARTPPAARSDQHDDTHQERAGGETKTHNSPTSSRAAM

SEQ ID NO: 971401 - protein, 342 aa, Homo sapiens
ELADRVSRVWQRTGTDAHGTTKKDKRRDHTNTHKHNTQKEAHDAQNTTLTQTTTITPTPHNHTQTTKQHHTTRRDNTNIQRGKKKKQGEHTLIDISAREEDNGTNTGIEDRDKYPGSTDGEISHTTQPRILSTRQERHNSARAQQLREQRLTAERTDPEDNQHMKKHHYHQTHKEHNNHHKDYGSMHNTREERDEDDDRRTKVPNESELKMKMNKSSTTTKTSRHRATKKKERRGKTARETKRRTEKSETDQHANRGEKKKNDNSRVRNKPHNQQRTLNAPNRLKIKPKPLTGATHKRGREHITPSTRRDDAGATGEHSLPQRLQHTINTDTTNDTTQNGQS

SEQ ID NO: 971402 - protein, 299 aa, Homo sapiens
MPPHRLPSGTNPRTAITTPTVAQSTRVLNTWYRHSHIHLILITASPSHHHSTFSVCLSNWNSLERTRPYYGLFRTSAGNTRFPLNTYSYSRRQTTTLRLHRPLGTRGHRYTTLAAFGPPPPPPTLNPTHSHPIRHRNRPGQITPQMPLPKGLPRPSTPLPAHTPPTTARHTRTPAAHAVTATHRARHPALLKKKHQPSPQPAHTTHATHRCRTRPRGPHSKRPRTTTDRPLPAYTQTRPRNNTKRRNAHYCGHTHQPQNWPAEKKTTNNDNKIKPGHERNKRAHTTAMAPTTHQNDAHT

SEQ ID NO: 971403 - protein, 71 aa, Homo sapiens
PLPGAKRFGVSFLCRGDEWNIMMTILSEERKRGLDAVYNSKVGLVIHLVTESNVVFESVFSKMISNRCISV

SEQ ID NO: 971404 - protein, 102 aa, Homo sapiens
MHSRRRIPLVHRMTRCSCIWQDILTALTIIKSRWVSDQTDMPKSPKSYHGKICITAISSQSITRTYSGTHGAYSLLLSIRIISSFNRNNPSIHISSWHGKIK

SEQ ID NO: 971405 - protein, 152 aa, Homo sapiens
FCFRLRYHVVVCVLQEAGSVLLPHVCFKNTVLTSLNYYETKFTTSDERRPIKIHSLIPAFLSSCGTNESPMNITMQTCLPMTPSYQCYAALLNIAANSPIRKLTLSATTIGILSYRSQSTHRQCAPRPSDPYSPISDPPSATLYEPSDKLQH

SEQ ID NO: 971406 - protein, 369 aa, Homo sapiens
QEAAIVGYCDAKYVWAATAGGVFQQHYSQLEIDYDATENDREGLLYQPVSTLGREEMLSVSEHSSITSLADLHQLDTPGHTELTGCGEPHTTTLWHARATTPWLARNSGSLRSLGATRATDAPTANAATKPSTRTRQTANSLHTSAILTNPGTLATRSLNWLLQGQRHHSSPPLRNPFSKTMGSFSSSTSPTCPLTPLTGGYAANLAINPSAPLGASATAAKPPFKPFYTATCLAPHQTLYYISLKHIGVSPLRQLFPPLSVYTVDPPQHHIGRTISPTFSFFALTTWGLFNNTHATQPMGHKSERHKQHARRTTRHQPPLSKHYTLWGGDSKHRTFITSSLVRGSPARRHTHDQHVTNIHYVGTTSYS

SEQ ID NO: 971407 - protein, 104 aa, Homo sapiens
MQCFVWKKYPRGHRKNQNISMGTDHWPDTMISTNIQCCVGNIDLTLHANYTSPASCRYRHIELIQRRFIDSLQIGRQTRVAIGPEKLLHSTHTVASQKISPHRA

SEQ ID NO: 971408 - protein, 99 aa, Homo sapiens
MSPTKPQSISGPNKEQHITKTELATDRIIAADTETPRPPPRPALHIGAPLNTTVGPNTPRPRIVTQHNKPPSGSNRPRIRCRHTIVPRPPSENTRPRRP

SEQ ID NO: 971409 - protein, 69 aa, Homo sapiens
IEDACHEDEYNHSLHGQCTEPEITQRHSDTIEEQAVFYYYRHNGEKTTHKLTKEHKLGTKARHNHTTLV

SEQ ID NO: 971410 - protein, 314 aa, Homo sapiens
MLLVEYIPAMTSTFRILMPSGFVARTLPNTEFPPRLAWLMPILGWGPHARYIRSCKSRNTDYGPVRTDPFHTPVRAHYRRTLASKKLHALREANVYLLIHLWHDISQERMSITPESDTTNATSAKLMRIDCPSIYSVRSHKVNKGERINCEGSLCPELLSLPSGLPRNEYTTSRRYLIYAESEPSTIDGQAMWSLYPRRRLAIMVGGKTSNRLVIASVIPYQYVVYLITILPSQKNKISIGEMATLKPETASLWMHPGTLAPADCWPQDPFVDFLLAQGWWGAGACMCIEHADPAARIPLAANRPLSRRHAMST

SEQ ID NO: 971411 - protein, 118 aa, Homo sapiens
MRTRSTRRPEDHREDKHMADQDAETDSGNTQQHEQNTPKWVEKRQAHGHKQTKEQNQEKADQNTRRKHTQEQNSYISETNVTKTEENKHKTGRTKDNKKINKGHHKQQQAAKRENNNN

SEQ ID NO: 971412 - protein, 118 aa, Homo sapiens
HLGDFNLTEPLEPKKKKKKKKKNTGSGAPLGPAERERLFSRDTTSRCGARGGPPVGSRREHGGPKARVFPRGRHRGARNEGGGEFSSPDIKKGPGGQTAERVLVEPKSPEGRAPRRPH

SEQ ID NO: 971413 - protein, 67 aa, Homo sapiens
MERTGSTSTPIISDQARDTMAVERMEPKKIHAHANKRSHTHEPHSEHTCRDKTERDATTTQATRQPT

SEQ ID NO: 971414 - protein, 90 aa, Homo sapiens
VVADGGYTGTAERGPVHRRLRAMNLFRIHSDAVMVWCRVIIFIDVADDRYMTSDAEHSTSRRFSKEGKCDEVDEYGGIFGGSLTRKPSTR

SEQ ID NO: 971415 - protein, 152 aa, Homo sapiens
RHALISAGNMICSVEVVEGMSALTIKATKVHNKHARTRSQHCRAKGLVRMRTMSLEQDSRRGGRTLPESESSLCDPRGGNRHHRERRFRGNLCKTGRKGGQYPNLAGRLAGDLRRERVYSRNPSPYRPDHHTLDETSPCCPVRALFRSAYVQ

SEQ ID NO: 971416 - protein, 295 aa, Homo sapiens
SARTPAAPGSQAAAPCARARGSVAVGGGDVRFAGVLGSGTAAGLRRSAARGTAAHGARVLGCPTPGSRSLGFLQPCDMTGQVRALACHHVPGQPWASSCALQRPLDVPTGAYTSWSPILETTYLEIMGARNKPCDPHSSTHRQVPAQPGWHRMTASSTAWHMHFPLGALYETSRRHQPGLPADQGTWPSHLTLRIHKPTSAEPTILLSCHPRMPTPDCPGTLPPHASENRVSSRTGPGDTDPDTIAQSEYPATEHRRTRNHSHNPNSNTDAQYRIRAHRQRYAAPSHQTNNPRSP

SEQ ID NO: 971417 - protein, 578 aa, Homo sapiens
MLRGCFSAQSDASFYSSAPAVPLLTVTLRCRPPRLERIIDCDTGTTAALLQCPQQLTSSLSRSAAHPYTRLRNHTALYSTLSTRAWHYTCTAHTLHATRGSYSLFYTQNPRSTLSNRGPLAWRHHAHLHGVWHNHLQPPQHPPRKTATPAHFYPHKAPTPPQTLLTHRLNTNPCGPHPFSGHQAPGCAGITQRPTYNLSSIYSPPNMAEQKTTSTGKTNLTNTPPSAHGPGGSSFSTHGGYCHTTPSLAASPHGGRPKAMRDLTLPNALAQTQRHETTPYPPHAPRTGATHEHATWPTAHRPHAHRNLDTQQPRDTAQRRHLASANQRASPSYNLYLHFPSGNTQRPRASPCSRLPMLHAGLGTLHRPTPGPSPNPPTTHTHGYTTTPEPHRPAPATRHMNLQPDTPTSTLPPPSRNRPAPAPHPAQPPRLPPHPTPPRTSTSTPPRPHPTPTPPPSHANSLPHPNRHYPPTTRQHHPHATPTALHTPHATRGHHTATSHHRPAHRLHTPPTHPHTDHTATNHAHLSLTRQHHTDTPDTPIPTNPTQPSTTNTSATDQRTPSATHTPTKHNLNTTTHA

SEQ ID NO: 971418 - protein, 255 aa, Homo sapiens
MSSLNCVRRIPTGRVGSAWSMHWSACSTLRGLPYSLRIVFWASRSTCDDVAREGVSHFVPVDRHVRIKRGGLTSVSCDDAKWRDDAAAHSSQEQSKEVQPAHEWGTMRACRGKVAVALWPEYILNDAWGSSMAGSARRDPHSLETSLGISTILQSRKCRDPAIWGDQLNKPAERGGQRRWKKPPKINATGIQALRQNNERLRKKGMQATTPRSLKAKAAPKNRGQKKESGRPNYLRQKDEEQDPTEVHTVQTETV

SEQ ID NO: 971419 - protein, 112 aa, Homo sapiens
AARGSAGRMKVALYAAAVRPRSTLPSPALIERSYPGAQELAEEALTGWPEAEGMVTGCCGCSGTSWCVMRIPLREASHAYTTLGSGVHGELSSRAVRVKKPTGKVCALDDSF

SEQ ID NO: 971420 - protein, 413 aa, Homo sapiens
MTLTLFSPDLPRRPRQVIPIDQPLKAPRPAHQARSDISYSPYTNTSDPSLTNLGGRPLHHSYLVQSVITRHISHPVPPVHITRASNSSNSVQPHAKARKSTYLVCTIHIGPTTHTFAVNIHNPCNIRHETPQRNATWHKHTMSINTHHKIRKQEGHDRYQCQQLTYTECKHKPHNVRPAQVLTSEINAHKTVQCDSQHQTSRNRQPKTELKHCQNTSSRPHKTETGTQADRRDAERKIANDTQNVSTEDDRRDLSEERDLVSDRQAQDDDNTTRYTTEHSKTSTHEASYSQDNTRYNQLSTHLTSDTLSQASSTPPQKQAKTQEGKTHKTKGREMKPQHHHTTEQNRKTPNTERNTPKRATPTPQTHTPSTQKGNITHISAARPRISEEHSQQKEGKNSTQSTRTENNTENST

SEQ ID NO: 971421 - protein, 129 aa, Homo sapiens
MRSPPTSHVTGTSPIDYSDQDLEVQDQEYAHSFYLVQHLRLPRPSSRFGVKLGTARYLDVKLATGGLIWGLLAFLITSLWRNASLLNYESLTPVAILSVAGETAHGTSTSGQQVRLCDWLSQDNGNAYA

SEQ ID NO: 971422 - protein, 166 aa, Homo sapiens
GKAGIRSDARHQVGRCVKEHEDQCPVEEIISLLPAHEGIRDHVISSVGASLKDEVWKIMPVAERRTPVAWPAATRFQGAFVCAMRGTTIGHVGVVRCKVAPRGSFGQRQIRVGGHSSVAKAPPIRPRAQEAYVGGHTDSGKAPKKFVPFGKGVGPGPGFEGYEVVE

SEQ ID NO: 971423 - protein, 192 aa, Homo sapiens
RPRAKAGRLKKCIRRVMIMSPARDPLLSRGTNQACVCRHSRIAHEGNASRKQSFHTNNFTTLRWDRAGSFPDQCCLPGVQLKLASLQFHFGACGQATVRVWMGSVRMAVGTGVGSLMHRLCQEAGLSKQEFFSYAILGLRPWSEAMGHIRFDRSASSYLFRHVRLQWGVTGRVVLHASSHTHSRCLAMLLRL

SEQ ID NO: 971424 - protein, 39 aa, Homo sapiens
MREKCSKVAEGGKGWGGRTVREIKNPVSDTGGGPGRKSR

SEQ ID NO: 971425 - protein, 112 aa, Homo sapiens
SGLGARSSFLRKVKGSRKVLCKLSLEGDRLYIPKVRYGSVRKPDIVTVDAERDALNIGNSQSETKGGGMRSSVVRTFGASRQASATEDEGYGLCAYPERYQIRQLAIRLLKV

SEQ ID NO: 971426 - protein, 286 aa, Homo sapiens
MCPINIYIIICLYLYYLFVRKREASNRGTPGAGSSGGKAHKGIKNNTHTSRRENTPRLLNDTRTEPETNNKNASTNEQTKQRMHEKKHTTERHQLTPKNDGARYNNRKRADEENENTTPKLRTHTDAGETHAKQSGPDTTREGLREQTHKPKQQRSLKRRTQNKQEQIMATQEKAEKQERTADGTRHRTGAKPKPGSYACPQQRETRKEPTASAQPRKTLCETAQPPPDRTTKAAGDKQHRQQKQTRIRPHRTAGDQKTHNQGRKTTPKEQRAHRPTGPYLHSNQP

SEQ ID NO: 971427 - protein, 78 aa, Homo sapiens
MNDTVTIRTRKFMSNRLLQRKQMVIDVLHPGKATVPKTEIREKLARNVARPHPDVILVFGFRTRFCVCEHRTKLAYGS

SEQ ID NO: 971428 - protein, 130 aa, Homo sapiens
MSWNIEKYFSVSLQNMMSAKCQGFTIYIFLTYNVVPFFHNGSYHEHIEVSLQDTRMSCTGGDLKPTRWKVNHCVLQKRAAGMMSPSQSTQVYSCRPGSGHHPNRMQTRLGHTVRAPHYTDANQTSRNHTN

SEQ ID NO: 971429 - protein, 47 aa, Homo sapiens
MASTIEPKSYLRVDSKLGAVDRSCSYSAILAPPLYWRVLNRTATVSS

SEQ ID NO: 971430 - protein, 123 aa, Homo sapiens
MWQGTVEFRGQTNWGGDKNTWDNLRRDHSCCIRVNVPILGPRITSHKPSDNVGRCGHPPHISGGASLACQGKNEALLFVRHPIHSRMSWISQQPSLMQTVFHTKEYAIRLLTHLTQVFIAGIR

SEQ ID NO: 971431 - protein, 71 aa, Homo sapiens
KVHVITTLSSYYWPELNVRYTLTHFMVRNITNRELRGMILSVSDGYLVRPEHRNQSRNSNQYIDNIINITL

SEQ ID NO: 971432 - protein, 201 aa, Homo sapiens
MWAGSLETRPIQRTTAVIGKHEANRPRGDTQAPRGRPHVAGTYIFRPTWLATPRGPEPDVGRSRWGTSYKVHKPAWTHHQGMRCNRQQKYPKYPFGDKRPRARTRKRHRTEAHSLWCKQRADKADGTYIETPERCACASAQAFPRGPPSTDIPATGTAAQETREVIQAEICTRAGAPAHSAPTCRHTTGIGDRAERDIKRN

SEQ ID NO: 971433 - protein, 99 aa, Homo sapiens
MEHRALGKSHRYLATFGDLPKGIFSRASERRINRGAYGHSWFRASGEVSRVPFRNWGTGARKFGSHRRVPITTLSRVNSVGLPLRGPTTLSGSKSETVL

SEQ ID NO: 971434 - protein, 144 aa, Homo sapiens
MAGGGGAHNPTTNEGGNPYYPIYRKTSYSPLEFLVQHKPQPMCTPHPFVSPNTFWEDDKPLLFVRHLRGGTVLVRFRPRKKKIGPPPRNMVPFNYTGLPGGAEGSPHARFSDNQVADHRGGGNQEAAEGDAPIGVFVASTPVVL

SEQ ID NO: 971435 - protein, 155 aa, Homo sapiens
MQPITETSTHCRVGCAADAEITEKRNMMLACTQLHTHNCHTTTGFHENRGIIVLKNSLHESYIVLTDWNISSDALFYNSVRSTRHNISYSMFMKSATEGSPPDEVSIQHDWIRLAPMKVTLFSHSSIAPVNYYPVTSCEVNLGRLIEAVTLAIVV

SEQ ID NO: 971436 - protein, 104 aa, Homo sapiens
MDIGAVGILLTNKKSARGAQRGVSGKQNLPGGELLGGAPDKGDLLINTGESPERRLRNNKNFGPPTRGEEYDARYIAVKQLTANIDADRGDRTTRTGTRENEQE

SEQ ID NO: 971437 - protein, 268 aa, Homo sapiens
MVCSHNLRMGPPETPIESPTLVPRADPITSHPDKTEQTTSHETRKQTRPTAWQAQGAHLDGKRNCVDKDTERKAGSTTKQADEAALDRRKRFRFVPVKKAQRAKDTYLHGIVVEEGLKNNDITKAQRGKQRMKSERCVARKPREKGVKGQISLGEGRKSNLYANPCINKGTQYGLGEAQNSTAWNQKHKWHKPTGQSCTKHKPWGDDRAADAPRTLTSREHAQAHIGARSRPILGTPNTQQDLVEALAPHNANPNRGAPNNEEHAPGS

SEQ ID NO: 971438 - protein, 109 aa, Homo sapiens
RRSIHPSRSTCRDSLTAQLSVSLPVAANERKPVEGVTIANNDHIHYAGRPGARNVILSSCGRLSTHRQEVLFHPNLMMRAQSNMPLLVATEFEVLSTRTCHDHALSSTI

SEQ ID NO: 971439 - protein, 230 aa, Homo sapiens
MVFKLLTWSSARLGLPKCWDYRNEARRAMGPWTMVIAGTRVCASGAPQGWQCTQRHRWLNGEGSRPSLAQSKYWRSDHPRKWGLTGWVHTPGPGQIAEVPTPPDGGSHTSVFPNEESKTRGLQHDPCQPWVPTGGRKYTAHTAMDPATLTELHHTGAQTNVPGKCHPDNGLNDGPKHTTLRPAPTTTLRHTVSTVAHEHHNKRDTDTPPPDTSHTATTRRHRNKQTHPES

SEQ ID NO: 971440 - protein, 429 aa, Homo sapiens
QLSRILPKRHESAAEITDLAWRLASSSTDSAGIWYTSGHLRHQTCCRGLYEWTGTVSVHTHAPRIQERLNAERALTVFTSIIGRVLTFHHPPCCAKSGSGHTMCSEVREKAAAFRGGVGCSRSGWAIDSAVGWVKCWATNAQSLTCAEDLMDKSLNATYELCVAAFVARIEGAKRLPVRVLSALVATLNVSVRGVVGRIKLAENKAHTIPTSERGVPGFALETLRAHSVGRTQIERQLYRDPFPRGHVRRGRDKGEKERPGAQRGPFLAPFYERLGGFRNNLPNYLGRLRYDAVLWVDPPKEPFQRLPPSCLGGQTYPVMKTNVPKRRSGENTTGSTTDQRRTRGEDTHGALKPRNDTFGQDEHEAGALGPKTRPKSPQSAGNPPRSAGNPLGRRHGYELGAATAITTRGQPTDPPALGGNTGAQNNFH

SEQ ID NO: 971441 - protein, 189 aa, Homo sapiens
LGLPTLEPAGCCTVNAVPACHNCCCAECRLCLRPWLRWSLTVCLLWHPLEPVPPRDACAGTPVCPAAPHALTLRVALDPVPGRQSTATLEAQQPELTGDTMAWHSMAATMGHKEPRTTKSNKKENTTTRSIGEDHTEHHNTEKPSTITKKETDRDKTRNDPQKLHTTLEKAKQDNHKKTDARTHTTPTE

SEQ ID NO: 971442 - protein, 252 aa, Homo sapiens
MLLRPNVWVLVHKAEKENNLVDICIPDVVVYGSYSLWRLEGSVRRQRRTKHLREQQCVPSAAGPQLPKTCIRADARIVEAPSREVRVGTWRRGVGQSSSLVFSGMHLPGPKGVAYLTRFHEFMPMVTVDLTKGDALYFCSLKYGGDSLWLKYVFQRMHHNILTMRINYLCRPCPVLLKHKTENTQQGKIHTEQKGNSSGGSDLPFQRCLARWRAPITFRSLQPQIWAGSWLQPRLGKYNVPTCPPIISPGDP

SEQ ID NO: 971443 - protein, 156 aa, Homo sapiens
MLAFIPVLTKTNKPSVATEAWQSSIVLTQATASIILLIAIPLQASSTSSGPSDTSNQVRSQVEVASVSVTKSVSGPKPSKQRKDIGPPFFTFLELSPAGYPKGDPVVSIPALAVLSSPVTTHNLSAPESSKLSYTQEVSSTFRYNRYQPVSSVNVS

SEQ ID NO: 971444 - protein, 119 aa, Homo sapiens
MAKPESTGSIKDGAFYLFLAVPYSSHYTELPRTTAHQSKTNCVAPRPKRSYQNGAGPSRETRIRPDDRLPARPHQTRARAPPGREGIKQRRSGGTKRDDAAASADVHDTLHITKSTPRR

SEQ ID NO: 971445 - protein, 114 aa, Homo sapiens
MGSELDSLSHIVLPASNVNCSDDYTLVVGHGVESRLKEPGTESAVAKTVTVKKQDNKPRGTSAGASVAEPKVVRMDYDTGRIADFKLNRSPGGKGRPGQSKEIRGGDDHKKSPK

SEQ ID NO: 971446 - protein, 251 aa, Homo sapiens
EPRAPKLHKVIGAQGASMPMCELVLLHTMTLPGPAGELMIRLPWETSRRNGNGGFLAAGMGETFVGEGDMGQDLGVLQRGIYVLAGSPGLVDRCPSSALSVAARQCALRAWLRYPGCMWQAGLSRVSHLYVMGLASCHEHCADPVSNEDGLIPLEIRFLQNPDAAQGFVELQHSSPPSRRFYKNEGGTWSEEKVIQVPPKKVKGWLLPEMPGLITDIRALPGRPFPLLHATGLHGDLREYDHLLTQETPVH

SEQ ID NO: 971447 - protein, 104 aa, Homo sapiens
IRKKEDGTKGLSRCFMVFSVLLLKLELNLQLLELCRNTNRKQAAAKFYSFWVLKKQQAIELTQEEPYSDIIATPGPRFHIILRGLEPYYKHSVDSLVLTNCPHV

SEQ ID NO: 971448 - protein, 41 aa, Homo sapiens
MWSNEASGSGSLVFKYKIDYDSLLESSQVNCKMKIVETSDG

SEQ ID NO: 971449 - protein, 43 aa, Homo sapiens
MEGGVPHITRGRTHTHESTVTSDNGADERDNWEQLHDDCYQTP

SEQ ID NO: 971450 - protein, 140 aa, Homo sapiens
LKSVEHTAALYMAHRPTHLIVPLKRSVEIGARYIPYRQPALSPQSYRKKNRNTQDDKNNDSGSECPMRRILKPVSVRGTRRARGVALHWVFSGLLKISRVLPRGAFLSTVHKTDTGANTANVSIVLVRSGVCGVALFVGD

SEQ ID NO: 971451 - protein, 106 aa, Homo sapiens
GCCRTVAPRRRVARHVSAIPCGHFLPRADPQCLPAMLEERAVSKFICVLVPVKAKLFSTKFHHAMHLLVTARAIVIALYFLNRVLTNGPWFCSRLGPDRISNKETP

SEQ ID NO: 971452 - protein, 630 aa, Homo sapiens
MFSVCLFICFIFLVCILFIIDLNSNYYFQNIHTEQRDRRSAVRTRRRTEEISDSTDRHRKNTDRRDGGAAPEERITRQQPQRDARETRDQRQHDITDDLRCATRSNYLAKHKNRNTETKQTLHDDATKIAKHTRRDEDSNTPKQLCCNHTSHSNTAQHSEPRYNSTKQRKKKHIAHEAQKQNRPHTKEQTRRDAKRDHTHKDQRQRTQQEHNRPKRNTDDKTAKHNTRTQNTLATAADAEAKKETTTKNTARDTLTDSQKQPPQRNLDQLSKQHTHSTQTPHNSERRPNKISAHQAIETPTTHTNQPTQMRANIRTTQPDRAPHERRHPKPKHTQNRTSTTTKPPQNIYALTIKPTQNPYTKEPQPRRPHDGHHRPYTNTTTDDHNYKPGTTPTFGPSQKHSTGAQNKKKRMRTENQQHKKTTHNAQTHGDADQKERVENQYTTKGNPTHTEAPTHHNTYTNTHARHHRRNRTERQTKQSSRTDKHRNRTHCRVKNKTNTNQQQNHTAPSTTPEDTTTQKQNSPSTHTQQHQSEYPQHHARPRHSKQIKQLTTDDKLTKGRQSTNSPHTERTNDERPNQPTHARTTTTYTQKTRKEVIEDTQANDSKTALPIKRTDHSTSNDTAQPHTTI

SEQ ID NO: 971453 - protein, 434 aa, Homo sapiens
MGHQGEVTIRTFHCTLRPTRARVWKPMDASIGTPRPMEAMELTTNSIYTSGPYKTVTIGDSTHLETSPSKRTRDIYRHIRRRPRTFMTDRFLGVVGIKKFEEDSCRELTFESALLASVNPYTTRCLNGTQSGESVGIKQCSYDDYQRYTSVIKKEVNEIIFGGQENVHNESETRKYDYMTEHVVTNSAQTYSEHSNTLYAVARQKSNQHDVEDREIEQARIVRSRTNSIKEPAREDTKTQNQGAYHYTITAESGPEHQKTTHETSPHTYEETLEWVTATQNPHRNKRNHQQSSRHSQRTMDKYQTMTVEQLYSTIRQPVAKQHHRCARRAEPDQPRTEHTETDQRHHDTQHNTNDHRLNSSNHRRYAIEAQQTPLENEGADGDREHATQRARTQIDKPVRHSSNEPAQDEPQTTDQIDRTRRSDRQQKTSTSTA

SEQ ID NO: 971454 - protein, 190 aa, Homo sapiens
MDEAHIDQVKRKALCEEIDRESGNEEASEHQEVDGNPCLVTLGYCVVSEERRTNTTRTIDAQDLIGLGHSRYHLVPILFPGLDARDAGLSDVRMASKLWALRSIGMRWCDQLCMAESCSGVYEPGSLSLGSTGPGKAGAARGVSPNSVLTSETQSCLDEFGSKRAKLAFRQTVQGSTRTVRERQFKFNPP

SEQ ID NO: 971455 - protein, 217 aa, Homo sapiens
MHPGIEIRAWSSEGSRYSFREDACRTPDGTSERGRIDTKEDTGHLAVGPPRWLTGAGMYLVICHSLCILQGALVVHDRLSLYLGRREPSLAVLTGGDEAVKADRECESLTDMHAYVVLPRDVAPRGARSWVSPARTYRNSGPQEDNRTKTPGAGAQSGPQSPWPLGYEDRAELRMSSPSPLTASSQEGGSPWSPVCEPRFLNRSAGSYTLPFMFDLG

SEQ ID NO: 971456 - protein, 103 aa, Homo sapiens
MRIICTLKAEVPVSRDHTTALQPQRQSETMSQKKKKKKFGGHTGDFPSFQGPPLKFGFSRGETVLFNRGGTWGTFGLNSNGHRRWNIPSMEETHIALWFPIPD

SEQ ID NO: 971457 - protein, 458 aa, Homo sapiens
MCHPQSGQHFQLQQFSGHMFWCTAVCALSHSLHIASTFPTQDTSDVKFSSDRSSLIYLKHIPIVHVHNKCQHFTCLHNTFCTIHIFTIARYRLHTFVTATGYSLVVQHTILQHNFHPRIISTRAPTHYNCISPCIHISRHKGFQLSQPQALSKLHTSWDSHLVVTIGNGLTGGNIATPTHVPTGPLLTSQATGRWFTTPLAHTTDGLLTLTEVPLSSLLLNPPTIGPIVDPQTYPFGYYQAACHFWATESRDATAFYTLVAAIHRAPKVVRYGLQGHRTKHMDPQTRENKTMLRMGNSSATDPDQTSARTQPRPPQQHTTHTNVGTRKVDTQPGSHHSVEQHHKAQQMCKHSPQSARREKSTAKKNTEGGARHELDPRKKQPATAEKANNRRQRVNEQGTEQHRNNGATNAAMNGETKIERTNDHTKREKTRKDDRTEGHTTRLTRESTIHDGRVMKQ

SEQ ID NO: 971458 - protein, 83 aa, Homo sapiens
CPPERGTRCAPGLALPGRSPRVPLPGRWPSPRVPVPRSRARLFSAVGAREMAPSRQVLASRAAALPRMNGDFSAVDVQEECVW

SEQ ID NO: 971459 - protein, 360 aa, Homo sapiens
CSGFFTFAGFASPGQHSAFNSFTHVNCQVTRLEWHTASVSASSFIIMHTHVLRCPIYMRNFITCTHNCTLLPVCCISTPAASSLPIIAGHKQCTVGTFTTYIHKWGTPQPPFHLHSHRHPSMPIGHSGMVTQAHTILLPHTTIASNHTTLADDIQVGNYCFCLYTMTPPLNQLYKWCRLIDAPSSTPSHNRTTTAVTICFTNNATPSAPACHYYPHLLATTLFPRSWPLLSHQLCSRATVSLTTTRPPFQLVGLYDNQWTPHNWLQAPPIMKLVSNHNHISNTLYAVLLPVITLVPLSTRHHTFSVSASTHGFVSQAPHTYSLVLATQLGEAHWAPQQHNHPDVPNCPHNSHQMPNCTDV

SEQ ID NO: 971460 - protein, 172 aa, Homo sapiens
MTLLPLSEKELISFHDHALIIIIRLSAFLVLYALCLTLTTKLTNTNISDAQEIESRSELILPAIILVLIARPIPDGIRLPKADEVNDPVPYQSIVRVGAPSGTEAYECTRHTAERNLQLLHTSLHEFRRSEATMRFLDVDKSSSTSRIEGPIRHNNYITRRLALMSCPHIQA

SEQ ID NO: 971461 - protein, 77 aa, Homo sapiens
MVNHLLSTYVEKEELGKCYTKGVESKIFKERIYELVKVQRRRYEYGGGEIRRHDNYREGCEEQKVGIREIRYQEIQI

SEQ ID NO: 971462 - protein, 94 aa, Homo sapiens
WHAAKVRAGCIRIEGLRPKLDPGGNETEDAQELNDDLPRITGNFAHLTWRFLSEVYIHSISNSKYVHNDYYEMDGGDITIIEICELHECNAALG

SEQ ID NO: 971463 - protein, 110 aa, Homo sapiens
IGSPVVALFCLVSLQLSFSCSQLQGAVECGICANSELQGTVLAGSSMQEAGSYYSLMPYEEGETHDLTEEGIATIPSTLECEILLCWPRLCQDSIRHVTSGGIHPMDKYQ

SEQ ID NO: 971464 - protein, 102 aa, Homo sapiens
MISRDRIDLAVHPAGYLVDNPRVLAVSKESPGGPNIGRRSTTAPTTHVDVHHHSHTHPIHASITCLSHRRAVRNKNRRLDPTLRAACHVSSLPECVTDRLAQ

SEQ ID NO: 971465 - protein, 182 aa, Homo sapiens
SAPNWKRHPSEYRTIEPSLYTYHLQRMRRVLADYSVEIGVSPLHSKTYVCHTSSKAVYLHDNTLMNPPRSQCRIIYVKTPALMDPINTGPFVSAFSNWTLLGAEHMVISSVSYFPVNAPFEYRKSAYLSAESELNPVVSKVIAPPSGIHRRRRITTKGTPTEQPTVSQEQCAVSTKRDKSVF

SEQ ID NO: 971466 - protein, 88 aa, Homo sapiens
MYKRGGYPEDCHDKGWAGYTKRESGVRTAEGAHRRDASREAATPSRKRHTAAGTNGTRNHDNGGEGPREEAAHTRHTAGEHNTRGPRV

SEQ ID NO: 971467 - protein, 179 aa, Homo sapiens
MGVLASSDPSSPTLVACPKVRLRLHNEESSEAERGGYGRAVGSPGEKMQWMLACFPHRVVVVARAEFHSVFWRLLSRWMARPCYWALCVAVDMGQRSFLFFASRPNGRLSGGSSEGRGGSLGWLVNGRVALVPAWAASGFTPAYTRGYGHVCALSLGIFVPANSVWAKRLKWKQLPGSL

SEQ ID NO: 971468 - protein, 570 aa, Homo sapiens
QPLTAHLAQGSFLYLVAVPRLAPAGPRLPRAGSPLSSHCGTTTTHSPHPTHHLHTPSAATPHTLPLPAPSSHTHAAMPSTHTLTSALAHRATTAWPTPHSHPARAHAPNIATTIRRPPAPPATPTTPPLRPHATPTRLPPNGPHSSRLTPNSPRHRPSRTCLPRPHVPTPAPRHPHTPPPPTPPKPPAPTTTQPPRPPAHHPPPPCLHTRSDTRGTSPLPPNWRTTTHTPHPGMAYPRTPLEPHHPTGSSPRGNHSSPNTTTHQAAHQPPQPAGPPPQRAQHTPTRRQPPHISPRQHKHTKLPLPSTPGPQRPQRAHTTAHGHHFPPRTNTTTGHTPTDPAQPSTQRTPPTQPPAPGRTPNAHTHPPHTHTPTTGPPRRPPHRTHHTHLRHNIHPTAPTSLTEPLDTHDQAHTSPLTHRGTAAIANTSWAHNNTSPNHATRRDPNHDSKSTHQETTYTYTSASHHSTGHTHNLATTGHTSTTRRHTDTHHERPTQTLTPTATHPKNHTHQRPPTPPGTNHTHAKQPHCTSPTTNPTSRAHTRHEQQLTKPNHITTDAHHSTTHTTHTRTH

SEQ ID NO: 971469 - protein, 127 aa, Homo sapiens
MAFLMLTERRILGYIQLTLRPQRCKPLTGYYNSFADAIKLFTRRAPKNRHIYHHPLHPPPRPLALYQIALLTYGTPPSTRYPNPPWINHQHKVPPYYFREPNFLTVGRNVVKGFWIREDAPITEVGK

SEQ ID NO: 971470 - protein, 261 aa, Homo sapiens
LDWTASACLIEMHKKRYYVSVTKATYESHFRTEFIRPPTPLHIREDELAWLNPTEPDHAIQWDKSMCVEESTGVEIKRLHGQEPSKAPYPLPKKNHSYLARWHKTPKYVYHIGLTPAKLPDFVENNPLVAIANVLHIKCAKQITESALSWSLMEHVFTFTGSRPPTTYSSLIYLREFTTPSHLIHIALLTAEQNPRIMYLQKSTCCDHECCVTSTRGTRKNIVRRHGAVLRTPASGIEPPKQNCGLRRPTALAAPPDRNNP

SEQ ID NO: 971471 - protein, 295 aa, Homo sapiens
MSKRSTTTPKRTNPASSYHSVSLNSFFYCHRLTLTRHVLTVSSLYSQRSPSYSTKPYAMGQYPIIDARRSDSYRLSRHPTDGNKCTKTHTSSTHKDTTLHARVSPVPSLAYRKPIERYLQFNASSTVARTTYTANITARPTYIMPTYSHSASLATITIHTYPLTTTHPHTAPHRLRDYSYTPAAALKPQAPRYHNTTQITPPARPHHPQQTNTDNPTQAQPHARALDRPHKTDPDDQPATTQTNTSSTTKNTQSDANNEHPTRTARHRNHTHNAARKRATSTHKEQTTNRGQSST

SEQ ID NO: 971472 - protein, 66 aa, Homo sapiens
EMTSLDRYRNIRHVVDMCLRGRCTSESVWSTSHAFKRGRSALRAIDMVHNEFDIVPSLFLPVEKLL

SEQ ID NO: 971473 - protein, 140 aa, Homo sapiens
MTCVQQGLGLEARGARIPTPGRPDHSQPVRPPLHARPYGLAPKDPRATESRQPKRDNLHRPDQHCNIHSFEDSGTGQVGEHGRYAHIRTRGSQREKHNAARGKLEEGRRTQVQNRRRKKYQRRGGEAVLETGRVPRLNGS

SEQ ID NO: 971474 - protein, 409 aa, Homo sapiens
MACGVLSSRDLGFRPRLYCAATTDALVRVGEVVVLLEGMTDVSLQSVRAIDVSKHKVASPGKPSFMTCSYAHCWLRTTHADECQSYDVENMISTENIESTSGPSCGACHCVLTFKDSLSASNHPYGCRSAHSFIMFQVTGSFNYPLRNSACVETRDSLLLLLTIFASDCTKEEYATFNASFAFGRRAVVNCLHYHNPTKGTLAPDHCVPNVVHLSAEGGPMGLKGRTSGWGPLHKGTNFPGTRGGQYGEGAHSHIIARFMEPSLPCGRLRCADSHRCNNIVPELHEISFRILPKSDVYITDTWRIRSANFAFVQVTGLPPIYSRGTPPVCGLVPFLAFPRCAQSENLDVEISLTLCLGRRNYTLGVLTPSYRPLTLLPNLRVGAQLRVCVGPRYATGPLPKPLIEVRHT

SEQ ID NO: 971475 - protein, 150 aa, Homo sapiens
DGALSRSRLHVSSPPVSADQTCKIWRTSNFSLMTELSIKSGNPGESSRGWMWGCAFSGDSQYIVTASSGPNLGPVLVVWRAGQRSGESMGEHQNGWGLAGPSMTVCWASLGPLGHCLVPVVAAWRDPCRPRSRADPPLPGLRQFGPDGPL

SEQ ID NO: 971476 - protein, 235 aa, Homo sapiens
ASSASHLLKKQPKQISCDEWHALWAPMPLYVALGQRKEERKAHLTNQYMQGDGWNESTILARVPILLKSVCRVACSRGWHSSCARESHRLQVQASIFIAPKPVSTDDGPKSDAWGSKVFQGYGRSAIRRSGPRTTLRHLCPNWVVLRPLAGLPLAIHFGESGLSARYRLCYGTLVGLVPTINGLIDSCQLEAFPQSVEKLSATRLVLLLVLPGAVGPYRYRLQCPEPHAAYGSGM

SEQ ID NO: 971477 - protein, 614 aa, Homo sapiens
ACALTMYARTEPLRILVVWCRRLDDELYGTLLVSYDLGVPPVFAGLHVSPSKYLCAGSLCRGQAKMYVALERVDATALESCSGSHKGRGHMGGIGLVNHCRALSSGATAPCRRLQSSNVSLAFGYHVEQGGSGIPRENNCSRDSADRLALKCITHVDHELRWNLSQSISDSACWQLAPLQLASKRVHTGLPCGKGLSTGQREVTRLREGISIIWRRGTLPIGKGPPHANKGAASVPVSTAETANMWDREQMGFPERKALSFARNPLSRGLVPSGRGGQRHRCSGGATRPGDRTSRRSEERHWETPSLAPGVVRLTGALGVSNGGVSVQPLWTNGKSRFSTHETRKRSFEDAATYERTIRHIHIWLVTYKNSKLGACNTREALFRLHLVQTFDRGYAGAIGGGSFHWEPFERTSYGAPVGVRNSLYKPLRVRTPYGAEASALESGNATDFPIPFRYRRCHGRKLPEHRGGDKVLSSAAVVIFPTQTVFFGKPRVVAEALHEPHFACRSKAGVIHFEHMGERPINSACNRTPHCTGNMRRAIFGHNPRPRAHALQHLCDHQHEYQWPDETSTEETLRTATRRDNIQRCVRPDETYSDHPTCMTHQHDIHSQRRSTS

SEQ ID NO: 971478 - protein, 104 aa, Homo sapiens
MGDQKKDRVLRSVPHYIAISTNVSPKHKSTHVTVTVRYGKIVPRYVCSAHGFTFAVGVLCEPCDRVRGGHGKELASRDQNILGRWAKPSCNRVGKYITLTCIVL

SEQ ID NO: 971479 - protein, 123 aa, Homo sapiens
MSECLVPLPTSMTSLQWETVDSQAIPEGACAAGTRGGGWVEVSQWWLGWTWDLANESRSDKVTKSMNDAGMKDSTRIVETCLVDANRIWLESEGNISCVSVEVVTCAFGWTGCGTSSEERTST

SEQ ID NO: 971480 - protein, 98 aa, Homo sapiens
MSSKDGYRRKCSKILEDLEDLVMLACLFHGIDSRISWECVVDLELHDRSHGGTTDASYRSSGSLGRDRLDHPCVSVHSVEARGLDVVRIAERRLLAPA

SEQ ID NO: 971481 - protein, 147 aa, Homo sapiens
MNATRCSIKCDEIDVLLIYDHIAERRPLEVNLRDRPFLASVFRRHHDRVLHSGARPTNKGLLTESLRVLSYLVASTWLSGSTHKSLSSAIPAPESMKVNVFELCPTTTQKIKYERCRTYLRVPAQALDTIGRCQYRIGRVYGTIICA

SEQ ID NO: 971482 - protein, 324 aa, Homo sapiens
PPFVAYSVFLIILSFSFLSVCSIFVLFACSNFLSLLRSREAEVAGGWGRAPGRPRSSGPRAVRGGGGSPLCAVPSVDAARGAGCMRPGPSGLWAASSPQDDFTLKEPEGGGEKPVLEIFLGQIPDGQLHGVRVYRGVYVAQSNHSAVQWLEQFQPWLVPNGELYRRNFWTPTWMTDGEWWIAKQGGTRAITDNDMQSMDLRSILTKSGVSTSSSMEYMTLRCRAGNELKNPGLNPAEEDERGNIDTNNRADVVRPRQEIGPRLRHTRRRAGAKTNNHHGRNVLRVSPELLHRCRTSAHWTIAMTTTPGAEHTRTSTQLRPQNKQ

SEQ ID NO: 971483 - protein, 270 aa, Homo sapiens
VDYWRCARSSALSYCAYGTSTGYMVEPVIKYRGFVCVVTKRVLPIEARTESNTTLMLGSDAAAPDVTALRCGYKLDPGAFLRVTLRIELSIGGPGKLERNDDSTRCFWRRRLITASKHFAAVTSIPSKTHSLSVHNWEVNRNGPTRLVREMWNMKEFRSPMGGKGANPWSENCLINRLVHTSTSSNCLLVRSERTIACVGLRLKWAANVEGSWWKEIDRPVVGVRGKRIRGRRNISVSLRRPMKRWFIWDLQRPICPPIAPLDPFGTGCS

SEQ ID NO: 971484 - protein, 162 aa, Homo sapiens
MCRIDDDFPAGLHCSEGWKYAKYLPHSAGRYAVKRFQTKLSVPLCERLTNSMMMHGLIDTAKKLMIVRIVIALFFGSCIHLLTGENPLSAAGVNADSIKRDGFSRGGTPKRNCGSDRGTVEDKVSEYVLPPDACVNRGILDVVDRRIVKAVFRNIKSIVNDW

SEQ ID NO: 971485 - protein, 108 aa, Homo sapiens
MKYLSTTYIQTRPLVTVMVLLHERRATKKKFKSEQQTLLRMILGLDARNTHLTVIRTCKQFSHHSTLLNRVWFIVFTLAKCFQRLSPAGLTLNTHFTHQETDTSEINS

SEQ ID NO: 971486 - protein, 31 aa, Homo sapiens
MASALFDVVATHSETIRDIAQTGTHNHNELM

SEQ ID NO: 971487 - protein, 44 aa, Homo sapiens
MVVFTTPVAGPSGKPGLTQRGSRGRPNAARQWVLQLPVGPGPSF

SEQ ID NO: 971488 - protein, 228 aa, Homo sapiens
VCEKTKTERLWSTVVDLQTGKMQCFSTQNPGVGHCHEIDLVLSASPSGVDFPDLQTYMLRPLVRHAIPIKQEWAMGTLPNETDLRSMNSRVSLGIVSTLVVKKSDVEANLVEVWQKLWACFVYIRACLRSSMLMREMPGVVCRQGEGWQHVIAGQVWRYYTVAAEQEVSRGNSRCETDSCQGDCTAPLLLDYDFPPGLLMIGCTVHPERVLHPPPMIGLVVTSKVRCI

SEQ ID NO: 971489 - protein, 150 aa, Homo sapiens
MAHTSTGYWTTTHWNRSSPLSVKSALDCSGHQASQPHGPPYSHRPYHGRNTSAPRLFGRSLHPATPLPQPYPTSVHIIHPSPTPGTLSPQRSHSIAVNPSSKSISQPPHARPRHHEGLTPCAIPNPSLREHPQTHANFPLFYPPHSRRRT

SEQ ID NO: 971490 - protein, 115 aa, Homo sapiens
MVASALQVQLAMVGLYGHVSRLLTPLAVAYVTYLCNLFSRLLEAISAKASFRHSCCRRHRPFSSTFSTYEKNLTCMAIIVLSAFVNCHKTLTSNWDKINKISPLRGSSLTFFSQI

SEQ ID NO: 971491 - protein, 178 aa, Homo sapiens
RKKADLLYRERAVQIVVPLGGPKPLMIAVFVGLVGSPNEGDRLILDVSQWRVASNNSCRLGANVGSRGSFGERNFICGACEQISGKYSHSKDCYSVSRGKIINTFITGVFRGVCDDAKAGNRAGGRRNNMAPMGIFELFSKVFFTSGSDVKINSKSSYDLGYTAAYTSYAPYGTSFVP

SEQ ID NO: 971492 - protein, 254 aa, Homo sapiens
ISTMKVMQFNGYETQEASSPVPPTSSQHTLTSPPGPDVPLTIMNRKLMNTNDLEESRQLTEDDPAASEMPMAPLLMNVHVAERSSPVLADVRRADVLDVNYLVPDEEPRFTGARASLTTAGPCCSFRTHMLQHGHSPHVRVCSGDIFVRCWVYMLYVDKAVSGFTRIRDCPLDHTVCLWSLLEELPPGSFPKCDRPNDCVLIRDWRGWPLRKSPVLGPSWGAPDPAARSQRPSSHTMTLSLLTCFPQAFLKTTH

SEQ ID NO: 971493 - protein, 187 aa, Homo sapiens
MADHYILARFRYCISHILCIIQGDNGGSRVKVATRCKGSKGERYHTIGGKLVEGPRPLSDKDENRSRRDDNKLKHARTQGRIGEADNQSRQEGTNNHRGLAQDENCGECIGGPTDECCMCLDPANGSGGSLSRYLGGPEEEKRAAGPGASGSRSQGSQFRPPSRHPLGEARYPTEVGMLQAEEEQDS

SEQ ID NO: 971494 - protein, 114 aa, Homo sapiens
MGVPQVAFGRHLVWESSGFVGREGPWGGGAEFPLAQVFRSHQDWAELGSSGSLAASCVAVPALFGRGESLRKGVQNSSTHPRELGAIALCCPEVGGRERDRSRGGGVPPHPLVD

SEQ ID NO: 971495 - protein, 107 aa, Homo sapiens
MPFVFCHIGRFGAGQPRGVCRHPVLGAKGAFRTMWIKTLRGRHMWRCLRRKEYLSLIVEGFQRRLYAIFCYLQLLTPFSSTRDVIKDTVLFLPLFVSQKQTGGPWAP

SEQ ID NO: 971496 - protein, 304 aa, Homo sapiens
RRDLVAMQLVPLYEIVMLYVRGRGMTASSTRLDSVDPAQWLQCSLRAYSGTPQDTWNGHTCRGYLDGLNLGTPSIDLRIVAATAKKRRLPTAARIHRAVRLCWHRVGAEKSLEMIPVVIRSGILSGPYPCQDPFWHHAYFGGGANDAATRMAWLGDLIVAWGWYSHLPSLGPDISHETDDLAKISRRYMKHGNVQGMTTIGRTWSAEGVLLYVSRKPEGKQTFCAMEDRITQGTACVGPSASKQQNAGDVMGAPSKPQVRWVAGPPSASRSNDLELTNVVSTVKVASQERQKEQTLGGRGALKR

SEQ ID NO: 971497 - protein, 131 aa, Homo sapiens
MGANNRSRFSSCCLGESPACWERDLLKGTDVWIRLWSKAIDSAGYNDGVSGTMGSDTALLSTLKVFTRRDETDILFGPRDALMYIKAIEKRLVDSWRRILNGKAESIWGKVTRAHGNGGMVRAKIPKQSSC

SEQ ID NO: 971498 - protein, 82 aa, Homo sapiens
SLTFMQCNDLTAEEDGHNTERREDPMELECYLNAQTGTVYETATGSVRHTETVLIDEDFSGLRADARQTKEPERFAQASKHD

SEQ ID NO: 971499 - protein, 115 aa, Homo sapiens
PGLDRPEVLRGLQNSSSHLPKMEKSARDPSREWRRLQYPRDIGSCEVAYGSKEQSPDRQRDVFCVFWRTLRHNLAKTRVLVRLVTCRGSIVLHAAVESRRWMAGTIFRRSFLVYG

SEQ ID NO: 971500 - protein, 52 aa, Homo sapiens
MGFSSALFCKHDGQVPWGCSGATPGGGGPCFTKQLPAGLHSPLGLLLLLGVV

SEQ ID NO: 971501 - protein, 107 aa, Homo sapiens
MILTYGMTELHGCDVKKAMTTWHEFLNSMMPLCSRYAWASSLTTPWRLVMSLTTKARPPGASSRREETDGRAELSCGGALTQALDVSVEHDRRVTSNSGCETERVDN

SEQ ID NO: 971502 - protein, 234 aa, Homo sapiens
MYPTSGNPTYRAWCKPRETTFFCRLRDGNKIGLGVSGNFKEKRVILTQGAPLVYFRGQSKRLSLEPHLWWLLPFYALKTRLLRGRFSFCVPRLGPMFCGPVVYNSRGGGVGGSLGPLMAPNHRVGGMGLKGVVPQAEPVRGAPYPRCVSPNTPTAEESSLPNNPGGGGQLPKKRGPVEQEPNTECHSEDDSERGSGGEQAPIGTYSRRNAEESPVKSRTESSDQSKDCTTSADE

SEQ ID NO: 971503 - protein, 366 aa, Homo sapiens
MGFVGSYRPTPFVYIITCPFPMILEAHSRVSVKVGIGVKIVSAHPSSGTNLLSGYYDDRSIMDNLSPISVAAGCRMYYVAESTVTMCSKIEKIHTNSQGTMGARVKTWSTRLKIIQTVQYLQGSHIGALNYKMLSGWASRLYWPLGLQIYKVGFWEEEPRKCMSLRATFGGYELTERVRRSGGSKGRLSGGKRRANATHDSGGDCAYTKTVLGIGFPPQEVVTARNTGAIVCVGRKWSQRVRSMQGNAHSNALATRGVNLHSERTNFLPNQWGGGGGGEPKGFPPLRGGAPQKVLPPHEMLDQQSRLYVANQAGGRLGPPEIQEENGHEKKYRGAEGGTMSTQSKLIEKPRLSVERGGKHSCGTEQ

SEQ ID NO: 971504 - protein, 52 aa, Homo sapiens
MLVIGILDESQAIYVIDVSVIRYRMWYEDPYSLTDDLSQNCDDIRILVVEVE

SEQ ID NO: 971505 - protein, 130 aa, Homo sapiens
PAHDPYQEALLSPPNDLRTIHVITSSSSITLLILRTTNQHIESYTNDGATATTDTEHCTNGPHYNNTPESTQKAFSIRGYFSILYTLQKGFFSSICYVQFLSLHDSYLDTSYAWHREGALLKTPTQTLKA

SEQ ID NO: 971506 - protein, 107 aa, Homo sapiens
MKAGAIREHIAKGEQPNWSPPPNCVKTAGCGKVRQTKAGEQGGPPLCGKRNPIMPGGGGAHTNGRTHNHATTDDLSDATAGHNNNNQTGVKKQDRNRTPERSRETRN

SEQ ID NO: 971507 - protein, 172 aa, Homo sapiens
MNSDSRLLHRQYVSSNLVPSYENDHCRLTMCEDGESEPEKYVSQSSRMACEWRQYVHSLLCRLESRVLVLVRIPEVAQSLHAGFPQRRIRVTLHSTEVHLIHSCSARVREMLNEVASADGYKEAHKLTYERGSVREGAEDSYTNVPVTILYTLAIIFFPKHNQGRSLEAPPL

SEQ ID NO: 971508 - protein, 73 aa, Homo sapiens
VRIALTRCFFRRLRVEGRALGTCHPYETVVQNNGSQQGAAKREILSMRHACMASEERAVVGYYRDVLACTSEV

SEQ ID NO: 971509 - protein, 205 aa, Homo sapiens
MAWRGRTMEEGVAWARRISIDTKGLKQSSFCTVYYGTGIYSALARLLKPPRGRDSTPFKIAGDATSILVPSGHRHNVLVSCSHKSAKERCTWGRTGGMSNGGCVVEQKNVVGSLIKWRHGCVSRTCVTNYKTPTKWRPAPHVVVTGVRNKTAHQWRRNTQGPGKKGDTNLTWTDQWPGRRGGHKPQGDDTTKQKGEDERTNNRYK

SEQ ID NO: 971510 - protein, 271 aa, Homo sapiens
MASAVSARTQCTESSVRASHHRTRSLTITDEVNDRSLNIKSNRPPMVLNLTSTTTYGGLEYVQLRYSILRPHYCLEPGELGLPVTLTIEYYSRLEAPIRIISDEIDKHVIALMSCAADEAYTNRCGFPARLNQDTCQRYDDRGYTTVNALKSVEQTQFHAIVLELIPLEIFALRARMYAYRTPSTPLERKTSQTMRQETGSRRAETQRGPTTRKIERHGASQHDPSEAHREEDTRRMSQGASTGDMCTQETGTQGRQTEKRRKTDTRRART

SEQ ID NO: 971511 - protein, 119 aa, Homo sapiens
MYRKEIDNELMYRGRGTPVPGPSVVVKHNPVVVWSQISAVQNAEGLEVARTLLGGVPLGYRAVYSHVLLTLVGSCVVARMLLLWMSVRFLRAPLLSAVDAPLIPWCTYAKRGLDTIDCA

SEQ ID NO: 971512 - protein, 111 aa, Homo sapiens
TCNDMCVSYPVNSHDINEMRPSNEERLRAALSGVHDIYTYDQSYTVHALRACTGAHAGLIKYIYEHANKVQALVCVSTSSCAKVIHDSATEENIPCTLPPKHLCVACVVTH

SEQ ID NO: 971513 - protein, 246 aa, Homo sapiens
PVTAFIQTQSVCTQTMADTSLEHMCRLDIDFSTQSEGRNTEQYICTHLGPASRISGDVERRLIKVWNECAARLNFSHGTHEYHAETIKNVRTRRRRSLLHRAPSSYRPVAVAAEDTLQDLRSREVGVIKGQGICSRWRRKNGNARCLQNHRLDNVLQMEECDENILLVDYKNICKVVEVGGRIYVDDGAKLSFPGERGAGVELTWIDGGGETPVPWAARGCELRGAVGTACVSRRTFRTGVGGDRT

SEQ ID NO: 971514 - protein, 38 aa, Homo sapiens
MSHVHQALNQKRAPRENNKRRTNDGTKPHIKKKGARGE

SEQ ID NO: 971515 - protein, 109 aa, Homo sapiens
SEPLPECLLGDEAAYAGPRSGLGCRGRGGGERGRGPMAWDLAVAREWRAAPGISGAGLREGALRVGARGGPGRRGKQPCRPRGTVAGAAPAGMCEGPSRISGPIPPDLT

SEQ ID NO: 971516 - protein, 272 aa, Homo sapiens
MWDPGCGVTKGLFGQHALAWECSGSRPKYHTGIQPGGHSRHVDRRHGVGGPYPGDRRCETTGSGGVVAPRGLAPLGSHKGRKAPRSGNGESQILYNWWYRTALVAPIYKGRGDESTRLWARLGGRSAKRGSKPPERLVMVRPALAGGAYSKGNRRKPEAPKAPGTKRGEIPRGRRYPRKGGETKPVSRETLWSPRQGITRKGGTPTQGLNNLPQKKGGHKPGGLRYSAAGRTRKSPARAPGGSKHKAGGKTPGAEHATSAKRHSRATRTEKQ

SEQ ID NO: 971517 - protein, 301 aa, Homo sapiens
MLVPQGLERPKIHPLKNERTDKSQENLGNPSKNEDNVQKRASTVPGSPGAERRRSVLSSFTLPFRGVRRLIRHPVSRPAGVHSECGRLDYSARCSLYDFLAVRLTTTRGHGSKMSFPLYKNTNSSNNFQPILCGRKAQSSPCTYSSCLCQGDNRQHAPAERPVAQDGGPRAAVLSHQQRGRDAHTACIMPRTPSTSHRHTLPTPRPLLDQRSLSPPALPQPAPPRSRARCVPATHPQPAGLKPRTRQTANRPPNRRTNTTGPTAPPPPQRPPPRKEDNHNPPNPPAHRTHAPKTKPKTHTH

SEQ ID NO: 971518 - protein, 146 aa, Homo sapiens
MNLEIYTVKFIKNTKKHKHTKQNTTQTRGARPPSGRTPHPTARARHNTRGPPQQRSVRAPHLARPLFPTVSHTHTDTHTTAGLSQGEIYTPQRSPTPAGITQHPSSFSTTPVCIGRAQNTVSLVAGLEATPPPILRGGRQIPHHQD

SEQ ID NO: 971519 - protein, 101 aa, Homo sapiens
LKTHQAVSGCFTGGLEVHAGDRTWIIDEVQCILAKLDIHGTRSKATYRISIRSWMVFSKQNPFPPLLPRLCEQYTVVPDGRYSRCDSGRSLLSTSSKEALR

SEQ ID NO: 971520 - protein, 217 aa, Homo sapiens
PGSAVSRQMMHMERRLSRPPGDASGGRKGGPGNRAEAEVGSLNRRIQLFEARCVDRAQERLVTGLLKAGSIAEKAADESERGMKVIENRALKDDEKMALQEIQLKEAKHIARRRQIGRHEEVARKKVIIEGDLERTEERAEPGRSPYAERWMSSIRTDGPEPEVSELLLQATVTLHTSRYNSEGSKLHALLTDYNSTDAETRAEYAERSGAKRHKHQ

SEQ ID NO: 971521 - protein, 108 aa, Homo sapiens
SLIISVYWSTDRVDGSRSDTRAIERTVRRSAWVNFIKHSRGWWSHSSREGRQNYHIPANNTQGLPLPPQENSNSGKPKVNQSLLNLAAAKSPTISRVIPISSQEICDN

SEQ ID NO: 971522 - protein, 147 aa, Homo sapiens
MWALIISKTFSILSLSHRGCFSPQWSHHNLSRLPWSGVSSSNTLSPSASRRVTTQVVSSDKIVLLDVGSNTISLKVLPLLINDLSAHTTAVGSTKRVLTMLWQTHSYIKRRRRVLSETQPYHNKMYVHSFNDKQPQSRHNDYADQLD

SEQ ID NO: 971523 - protein, 145 aa, Homo sapiens
MHVRGKIASPGRSGPSPGVALRGGTCQGLPHSPSRPQKPCVSPLGASVKEAPECRLARPRLVFASERHTVGKALATGVPRSGGYLRRAGSFQASQRRALMLYPQGAGLCYPGTKGYALSTRRRGGLSPGRGCPFTPGARASRSFS

SEQ ID NO: 971524 - protein, 91 aa, Homo sapiens
ASGTLVTERSAVPFLPVNPEYSATRNQGRQKLPRLNAREFATLIIEAFSVRPSGRRQGKEPERAPQTNLRAVSAGARVTSEEQKEYDSVGL

SEQ ID NO: 971525 - protein, 232 aa, Homo sapiens
MSVICQALSKWLYEVSRKAALTSAVVHSSQSGRGSHGAGGTHSKDRGRLTVPGRPSAVVESSGGPRVDEWGYTRTVQKGFLAVVNQGVSDSRKAVLERSAHSSVKASCADGLRPVHTSGRLVEGASTMGTIELGGKLGREYRPLYLVRQDTVGITFSFTGKVKSVQGQMVMDPGDIHRGTNVTKELKCRGSLATGGCWLSPNAGNLEKQAERITGYTGGLYPAARLVAGAQR

SEQ ID NO: 971526 - protein, 219 aa, Homo sapiens
GGLAFGLKSNLLSNTGRVQGLEEEVLVGHNGGGTDLDGSQPTGGNAGDVIGRGGPMSHSSHQSVLSGGRLGFSKTISKKGLGVSRHQQGGAGSYIWKKRARERGTIWCVGGRTPPEPPRDTTTGGEWCTSLGVSRGHTQSLGDTLWGVCAPPKRARTGAPILSFHPERNKENLSTCVGVERSSPRPRREGEGRGVAPRGAHWARPKLVGEVRVAFGETR

SEQ ID NO: 971527 - protein, 286 aa, Homo sapiens
WKSKDPLIKHLRYGDPGGVTWGGGQTSRSCILPRDLNLGQGSGKGPARGSGAEEQGPHKAQSAHGVLVRGHGVGPREGLLPPRKVPPDLQLQGRVKDGPDGRVGLRRSAWKGTGPEWAPRGCPGLGRPWWASPASLSGRCQMSRSQPFSLKRGSSRLDPGQLSASAGAQGEGPSPQGSVATWWISLLCVKVGRPPVDRTHSPEEEGRRRGGPGIRDPGSVRAPKIAPVKLKIHGAITTASLSGKHSGHKLTAVIPQRGAKPGQENRQEKTGIASKTGPGKTGNKKQ

SEQ ID NO: 971528 - protein, 138 aa, Homo sapiens
NSFLKGGGGGGGRGGCLGGGLGDVLGEPDQRGRGRAVVVAGASWRARGGGGGGGGTAMTHPRRRSFSAHYRRRRLRKYNPEPPPPAEYTPTLRPTRVRRSGSSGDSLPSWLGDDMEVSAKELMTILNKVVDRNPDLHD

SEQ ID NO: 971529 - protein, 252 aa, Homo sapiens
GRLGCTLLDKWWPKSVGLEALGPWNPGTELEEAQNLQGFGSEATKRVGEVSQGKKGSACRTLESSARRLLLLVLYPAWPLLESSQGVILQGIVLQQGSHVLQTIQCKGLEEGKTDANKTRVIRVAVPGRYGNRPVNRAEQAEGYLLAVHKLLLELGSPDSDLKYSLTWVSIPCICVGRTRNEGGQEMNAMGGPHYHCVWKGLSCQSLDVKMTVALLRGTLLEQVFDCLGLLKLPAGAATLKMRKTAVIPKEP

SEQ ID NO: 971530 - protein, 106 aa, Homo sapiens
GLTQDLKTGTVKVTAVGWSEHLPQSFTSVAEDFVMCTLGCFCIIVIPNYEMHLLQEVPLPSIKATPFLSKEKWPSPLPSPHRGGDSIASGVNYVMQNFLNLRLNTF

SEQ ID NO: 971531 - protein, 76 aa, Homo sapiens
FFKELNYKTNSESPSVTMVTLLSNLGSQWSLWFGSSVLSVVEMAELVFDLLVIMASCVEVEADTGLQAEGAGVLRR

SEQ ID NO: 971532 - protein, 310 aa, Homo sapiens
VRSAAGVEARARDPPPRTEQSSPPSAWVQPWAEDDGGQAACGLGNAPTMRLFSCHWGAGRESGSAIPLAHKVKAVLIQGGSIEPECPQPFGTSVLGEEGPQSARAFFTYTPMYILCKVAGRSGLSRSRESRVDVRTALSNVTIAGSMTKGFPPDEDGGRVPNKDDMKTFPEEEVVKETSYENDDAAVFRMCAHPVMLSSLRCMVPVGWQGGQGTGGGGAHWESYNDGGARAYSREKPKLGGEWELGGEPGAIIKATGGTVWTQGGATKQGHKRPARGTVGGGGQAPREGQGESGGPTRYVGEERSARDRE

SEQ ID NO: 971533 - protein, 171 aa, Homo sapiens
MGSEGLETIVIATSVPFWGWRRDKAGPLVGARGRRGLSELGEGDGLQFLCLSRGRDRLHEVWGLQQAQVPGRHVGEALRPPKWSREYEQVDLGARQAPGGPGGKSGRQAKASIQSDPTGRRNTRVGQAKGQGPPAKPYIWGAPEKRKLEDQAPGPRNDPGQGLQGPKLGEQ

SEQ ID NO: 971534 - protein, 43 aa, Homo sapiens
LPEDAVQADGDQPEMLNKVLYRVRVAAVALRDVLGWKEDVLLG

SEQ ID NO: 971535 - protein, 129 aa, Homo sapiens
TTEEDRAAEAPERSCYFFMGRSHCSGRLRGLQLLLSLLAFICEEVVSQLYLMWRTYIFWSCVSCSRFLLSLLILMCVWTPFYERVDTTKVKSSDLILLVGTGCVSVGIHHLVSTHDRIQLRLLQCVWDL

SEQ ID NO: 971536 - protein, 85 aa, Homo sapiens
FLFQGSLMAFNLGSSKTTGDIYSPVGHPGKCTARLHYEPLEPSVVVNREAQTRDNRSGAHYNTICKMLRRRANEGPPRAALGLSC

SEQ ID NO: 971537 - protein, 160 aa, Homo sapiens
MIFTFDAQNTLCLSNTWRTAVSTVVVTRSPLGINQAIHKFQGLSPLSSEFPRNQNSKPLGPILMMNRDTIAGPPKESPPRSWYRRDSAWAMPTKDPLVATLFKHKRSKVALVEEDKTFFELYSKLVPGIRRPFYTKNILWSGGNHNDFRPWWGKPPLNSE

SEQ ID NO: 971538 - protein, 330 aa, Homo sapiens
MGHRRRSEKRIPSEPRSPNVSADRPPEARLWMVPRPAHKVPLCIALVPQPHALLDHYMLDWAMAGSEEGSTYRPNCAPACWEQDSVKFNAGSAAAESCGTAIFHAFVPSALVKGQFHEVPRRGTNWSGLPHTDCLPGLTQTGQGCEDRGDHQSWHREPVSTALGPQCTNRGGPVFAIVVYDITKTDTFARATNCVKELQRQCQPQHRHCTRGYKADLASKRARGIPVALGCWSARIHLEARTSRTAKHQKQSLMERQQVGVTGHIRKTATERVHEDLSVRWLRGFPKEAPKLAVWPGANHVCDPMEENTAVRRPAVSNWTPLVSLDRTPR

SEQ ID NO: 971539 - protein, 239 aa, Homo sapiens
AGGLVGLGWGTAVVPREVTAVDPGPGSAAVTGRAEREVRRNAPGKEWLPVTKGLGRFAQGPLKITFLGGDLFSFFACPIRGTQRSMISSVGGLSSGMRVWKIMPSAEQRPRLRPAHQVQALVAIGALPCGPPSTLGCKGCLQERCDTGQFAVGANTIRGPKVFSNSSPLVATGGTTRARDTRIGKRPKFGPLQGSDRAGYGLLCLGTPQSYAPKSQWVSVSARVALKRLHHDGQDFDGL

SEQ ID NO: 971540 - protein, 306 aa, Homo sapiens
PGTAWQRVPVCVSWWALRCGWRMRDARNMGADLCRQERSEPTTSGVDADVALTEPNSLRLLIQQNKNVIAPLMTRHGRLWVELLGGSQCRLATIARSEDYVDIVQGGGGVGVCNVPYISKIYLIKGAVAWGVELQSFQISSKPQECVDPDMAFCAKIRAARIVFMFLSQSGTPFGHLVSLDRYPNNHLKGTSGRVFSNPRGLAREKYYSTKKLQQSPWQGNLVEASPCPWMVIGSQISRGGGPVIEPCCENGPLWPRCFWAHNQGNRIHGGTRQRPEFGSHDAIVWRVQTILGKCAKREVPGLTGS

SEQ ID NO: 971541 - protein, 97 aa, Homo sapiens
PEDQGNLYIGYTMQVGSFILHPKNITIVKVPHGTEYGRGVLAEPRRQAEELRRRQVLRGSQVGAYLGSANCPGRPESMMRCSDLLLAPPTIREAKRK

SEQ ID NO: 971542 - protein, 276 aa, Homo sapiens
WFQALLPCALQRHLQTPSSTKPGPESSMFLLQGARPSPFCWPLCEISRGTHKFSEATLKIGDGVACGLRATGLVMRNTGVCCDTELKENADAESGSAREPSESFLTEVEQLFQVNVSPNIVDFAGYCAQNVPSTAWMYVASCSQRLPGGPSPRARPRLSNSLLAQRLDMLLCTARGNAVSTSGTAQRHPWRHQESNVLLDERLTPKLGYVLAGPVQALVAGSGPPGRSRIGGPGYLSPVRCPLAYLPKASLRPRRVLWDRDPFSLGGWGPTLLREA

SEQ ID NO: 971543 - protein, 246 aa, Homo sapiens
IRPHGVHMVLNQQGRPSGDAFIQMTSAERALAAAQRCHNEGDEGALRRTRGPLVPQHEMSRVLHGEGTLGPAAGMSPSTLQPALPLTSYLQQLPSHPKRSFPRRRQLLYPSSALLPVARVPAWPKPCGLLIPVPATQLYLNYTAYYPSPPVSPTTVPYLTTPTAALASAPTSAVVPVRSLGPHAAVSHYTAGMKDLLRRLPGLPANRLMTNTGLMAWWVTQLRTGRHKPPKAMGAAAGTASHEAKT

SEQ ID NO: 971544 - protein, 440 aa, Homo sapiens
TEDLFTLQLYGTQPARRNSAGTAEHWPIILQAQCATHNCFDVNIESLLTTNVPNWHTTIWYDAVLTNHSPLLLAAGNQKAGTTLTRQRTQLTARNTPLALPNRNSKQLLSAEPNEPTLSWPTQANLTHPSDTQPLRFWALLKGQASTLGTTPKPYGTLLDLAEWSLVFPPSTPNPKTGLGATRAHPTNYLGATAQPSLLGTPNRKRSNASGLCPPKANQKPLDVHYARGPLGNAAPWTSPPPWPAPHNSQHRPWRRRPLQGTGFLQANKASLKPLSQLHGGPRPWDFTLDLANSRSTARRRGSHARPGWAVPPTPLPTFESSISLKTFKTAPATHNWVGPSTNSLRSARLLVPLVTHAGRQLGKAVGVPLLPDGKDCDTLRFGAPKAPHHDAHTHTSKTRFPPFAGSPGRTPPWADSKFYSDALGALLSGDNPAHTSSPT

SEQ ID NO: 971545 - protein, 95 aa, Homo sapiens
KTSRWKLPWWKGGALLTAELLRLQHGSSPQAELLGCVSHEAREAPLHEQLTPRGPVTSLLSCSFLLAPCPHGSPCWYVPCFSSWKFLGGPRDLLP

SEQ ID NO: 971546 - protein, 103 aa, Homo sapiens
MYVVDGEYNQKPGKVVKERSGGQYNIGPRKRGLYIGITGIIKGARQREIFQEKRRGSTAYKFGPRVNIRVGREQINSSPSVVVYRTAERHTVKTYRRAVLVTQ

SEQ ID NO: 971547 - protein, 96 aa, Homo sapiens
MGEGILPQLVQSWEHSSDEMAAHEGLSESSGKRYSEYHQGPAVLIKGLPEIWQCPESVSSWEYWRLNSSNTRYSGAGERRGPVAYGLRSQACSIYP

SEQ ID NO: 971548 - protein, 144 aa, Homo sapiens
MKYGKRRQVSNVDRPATTHRNNIPHKKWKRHTKRPKKHNRQAQNLKGQKTHWWYLARNQYCNKTTKGTPTHGYQHLGKIYLGATKPGNLAQRSPLEITPTQIGKSGLKTSLPSMRSTSLGAQYATDNYKIHAERGNIAPRQLEH

SEQ ID NO: 971549 - protein, 204 aa, Homo sapiens
GGPGGPGMGNRGGFLLRGFGSGILGPVVAGPMARGRGPEAGGATQEGKGRQDTGSGCPVTQVWARYAVKAHARSQSLGGESILITPLPDYRQSEHHCISIHEEALLIKGLRYWEDILPRCRKAKTPMPYTAAPEVQRATQGCGFTLRRTYQMVPSVRGTLRVCITGLASQVGRDWAQRVASSLMEGTHSIPFVRRRLHSKSGHH

SEQ ID NO: 971550 - protein, 116 aa, Homo sapiens
MYRASYRPRGSCFIWAGSLLGCLDIGPQGPCNTPTRYDGGSLGQKGASPSGVPPSQEMCPPRVRARRMQQPMRLPHGPGRKRPMKIMLPAGVCPRRHTLCWAHNGRIFSNRGGDTE

SEQ ID NO: 971551 - protein, 77 aa, Homo sapiens
ADAWVLAPGTGSGPKPMLRQAQVSPRPQPQQTRKAKGEPGGLRLGIWQLAECETGPDHNIIVVKLPSSTPAYQVGKE

SEQ ID NO: 971552 - protein, 353 aa, Homo sapiens
NIRSHFQHVFVIVRLHNPCSDRCLFIVCAVTTSRDVPSFGASHFLKGYTYIPKSNVSRDYAFYGRTVIKCTEKCCSVNSDEVSGPMDNLVTSPGIPEEIWHEKNVTNDPISSPSDKFCRSSTLASKKKEQSKPYRRSRATAALWGHCTEQIRDCKSYYKAMELDCLVGISNEYISSSLEQDTKSVGLQLVPSRACRERWHFTLTHQTSEIFAMTRSSTARPQSRLTANHTFEADPKQIAQTVDSTGTHKRLRTPVAHDVLQTNGAYDTFSPPTGPPNDGHFVRSKCCSPPYRVIAPSKRQRNVQSPEHRNDPMCEQTFENRVKITTTRVTQTKLNNTPCKQSPPRLNSGYKYP

SEQ ID NO: 971553 - protein, 107 aa, Homo sapiens
MRTPTLTQCDSSLVRAPLSFSALMSGAASSLCVSLRSGSSGRATPLCGVAETVLHLRCRFIYSGMRSLPLRLSSPPRGRLHFDDSGLVPLPCPRLSAVALSHVMAWI

SEQ ID NO: 971554 - protein, 281 aa, Homo sapiens
SRSCNAPLTDEIERLDMAPEIGPGGQNADSWRLQPRVAPSVLLLIRGGRRQGTWGAVCSQTRDIICEQCLKNVSCLVVQHYRACLDLPSYKRLATGFPLEIELCTLESCRVNFEALIITMSVVGGPLLLGIANLLLCCCRRKRSRKPDRSEEKACVQGEERPEYGREERRAEMKTKTDEFRKKYGPLREENRYARFETQTRGAPRTFSPDASCEVAHYLQAKPRRETHVGLAGFMTLAIDLQLQDRAGNALRPALASTGTLSGTPLHNMPLHNTWGAHNSL

SEQ ID NO: 971555 - protein, 121 aa, Homo sapiens
MARMSSSPVPQWDFVAGYVDGQTEGIQQVVGALSCATTIALAIYAAQAYAVPNVDEDIKGLFAVATQGARLSSRCQWKRQDEQLSLQVETLNLDSPAVIHYAISNFLPPSSYASLPADVGQ

SEQ ID NO: 971556 - protein, 208 aa, Homo sapiens
MGVRVELKGGAKVHREEASHSQDRAPKLAPHMGGLQRKGIGPKTHRCRGAPCRLGEVQVLSGYPKAGSRAPVTLVWDNHLDLVGVEVASGQRAGRTPPGLLSVPGKGINAGEEEILSRTLSKVRTLFWGGRQHAWFTESGGPAGRRERPDSYSSRNSSGQGGGLDVRFGWVAPLKQPAQVAGQKVQKLWGQQGVARKSEAAHVKGLSD

SEQ ID NO: 971557 - protein, 356 aa, Homo sapiens
LLLLLLLQLLLLRRDAAAESCASAEEASLAPSRNPPGIGGQRAGGQGCPERSGAKGRRGLPRTTWSGDGPTGQNFVKAEPDGPVMSAADNTEKLTLWTPGFIDATWGRVGTLGTGGRPMAVPQLACPRTNAQREPFVKTPQLETPRQGGWVTQNRVEKAMVFPYRGTGVGPTPIQGKMTRLNRRVPPKEMPRLLRSHSHGQLPKSPLMGLTAWGSQELPVPADRVRVYRGPGWYRVGWSTFVAQFGTSSPFQGRGVKLCVVTWGELDITCLDNLAWMGIPKRVFDRDCLHWDLGPTTTNPGRKSDGLTRGPPESDMATSSRARSPSGAAHTTENTRLYSTKEGLVENPACYDAAAA

SEQ ID NO: 971558 - protein, 121 aa, Homo sapiens
DICLTHAVWNARTAGACRVSSALVDNDGLYDPECDPEGRFKARQCKQSVCVCFGAVNSCVALCLHRTKGDLEPTLAMQLVLHPTISSLTCCQPPHSAGCRSSHFDDRGTPELEAALPRSAY

SEQ ID NO: 971559 - protein, 145 aa, Homo sapiens
MWPCVAALLLGSAVLRISSALFNKHKIVVEFTFCNDTVVIPCFVTNMEAQNTTEVYSKVPNLKEEIFTPFDGALNKSTVPSDLSSAKIASLTITKRRCLFEDGLRVMLSHTQETTPCEVTEFNPEKVKPIIELKISVCFMGFPPK

SEQ ID NO: 971560 - protein, 37 aa, Homo sapiens
MHEHADTKTDAPRTAAADQEERQDRAHEQHRARAPTG

SEQ ID NO: 971561 - protein, 315 aa, Homo sapiens
MAARAARSYSSVRFTHCSYHLAQENLSYGHKVFSTPGWYRAKRMTALSVIRRPNIVPFYHQWLVLDRPSSVRYYLIVNEMIPNEGSPKGAPHPDSHAHSAAAHCAIDATASEHAPRHTLAHRRTHTRPQHMPPHTALAAPSTFATKPRRAPHIAHTGPEHQRTANTAPPQQHEVATKKKPPGTARSNPSHTAPTTHQTESRPFRAETSSANSGTRPEISPGRHSCLPRQTVTKWPRARLSTTNGSYKTLNALTGHTRGLSDRTSPRELQHPLLHSGRPYPAPTLRESNITNARNSLDSAQHQTAQAPTLRDAPGD

SEQ ID NO: 971562 - protein, 126 aa, Homo sapiens
MSHLKILCPDGRFVPNCWKAPFPRKSTRREPAFGVPPSLAEELHVFPASVCFDLSSSHRAQIVELSEKGQVSVASEDPEFQKIGMSLLFGVGFPQKWDETHLVAERAISLPLTRFLCPMSVWDTPR

SEQ ID NO: 971563 - protein, 151 aa, Homo sapiens
GTGRESKPGYTKRMKKTKVLWRAVQLRMRKTTACVASAWIPSSRCVLRRVCGTLVTLHQGAVKPHEVECPNSAGQGMLRAEAGATCVSNRPLKNRGASPSSTQVTMSPRRKMFWSPPKYIFEVAPGEAELGTSFIVPEAARGAYFKQTFIL

SEQ ID NO: 971564 - protein, 280 aa, Homo sapiens
MPHWVHPKHTPVGIPPWSADHLHGNDLGTAEQAATINQNFIIAQPRRQLEHKPLRKITRTRPCETTPTADSYRRTDTPKRTLSTRRPRAQTYHPRVSMREWDWGNAKRQVVPKRQFITPPHDTRQTLKLGASSFVKPQFGRENTCCTRSRRGRTPQADDPISHPTVESSPVDPPIADITALTPGAKGCGEHYRQSLKLFTTTHENSLSGPHKRRPPPFGPPVGNPTYELLPRLCAPHQGKLPQAEAQKTQDRKIPPNGSGKPPQRGHQARTRHHSPYATG

SEQ ID NO: 971565 - protein, 497 aa, Homo sapiens
SSLAPYPPIQEGTGPQTGITPLNPLEDPARFSLAIAMIDRCLTPIASFNDLGPGRTHTTVHHLEIHDSDVPMEIPGRHGHIHGDMTLLIPTSYRPADKSTGARRRWVLRILTLGTHRGDPCGLPFTSCATTPTTPGPGPTILCTLKTPILYVVRKREAGRYTAVLDSWTTTAAALTEPVCRTNAHSHSDWDDTHDAEDFTRTTFPTGYDPRYSTHFLTNPACDSHEAKDTQGKHILQRYMDRFPLTHNHSNISHLPHVPIRIGRNDPFSQTSEVPTSTPPPGDGISTIQPYVHRRARLIRTEEYPLTQDTPTKRNHPLSLMNCIPGHITRSTGPHTGGHHRVHRYKGTHLYTTLRPYGVLTTTAPTNCALVTRATQLGQDRAQYILSRKHLWHTSAQIQGLDNTTPRTMPRNNHPKPWQLPSGSRAEEDAWDTCEAANRRGPPTAHTVASQRDKHERDTTQRRHHSQRSHNTPTNQHKETQRQTLLYQPQGDTSRIA

SEQ ID NO: 971566 - protein, 117 aa, Homo sapiens
MPFYKPAQLARPEPLRELKAREDGQRKHLVLNYGLPCCELALGALTLLCSPKNLTTPDLSAAPRRQAVTQSWSHNCGLPSSTAHRTRIISTPLNSTHPFRFWMERLNLGLRIVCRTE

SEQ ID NO: 971567 - protein, 149 aa, Homo sapiens
MRPVTQWGIGGPPRDRPGQAVWPQTRGQAQPGCHNGGHSGRGDKEGETPHSSPPRGAKKTGYITRPGANPGGAPATYPQFPGCAPRRKGKSGPRRDPSEGPPQKQPSNAQWERGSPKCHRGEAGMQQAHTPAHGGSERAGQRAHSEGPI

SEQ ID NO: 971568 - protein, 204 aa, Homo sapiens
LDPPDTRVHRLYLEPTWLAAPPRLARPPRFYEAGEELTGPGAVAAARLYGLEPELTHLTLQALGSSHHHLLRPREPLTFSARPHREPYKEGTSSACARPPAQFPTIGDPGPASGMTGEGNGEEESGHSSIYPFLNPGPRAEVFRQGLPGPRSYTSPATSAGHGNLGNQHASKTTQHQAITWRERVTRESQGQQPLEEGSRGVCI

SEQ ID NO: 971569 - protein, 195 aa, Homo sapiens
MTPVQRGGAGGLVALGWGNRVASARFGSGIRAGVAAWTGPGAMAAESRRQCRDKEWMPVTKVGPLGQDMKIKSLEEIYLFSLPITELRAIIGFFFLGASLKDEVLKIMPVAKARPVPAKRTRFKAFVQSENYNGPRRLGVKCLQRRLATAIPVGAINPGTSFFHRSPVPQEGYLGGTRSESPKVSFCKVDRAVRV

SEQ ID NO: 971570 - protein, 174 aa, Homo sapiens
AKQHVPEQHPKVQANAFVRARVKKLLAAGVVSAMVCMVKTESPVLTSSCRELRLQGLLGFVEEVEDRGTVVAQGGGRGADPAVPGRHGRGADKGSPRPLPKLTITSKPEMTFPGERIYRGGPGPVVSLFAPQRAQALQNFEALMALTKLGWDSGEEASGQERILDTEKGLVPYE

SEQ ID NO: 971571 - protein, 151 aa, Homo sapiens
RTERYSFGERALRRGRDPSSLSSRRDPVPRLGCLAVLVSHPGHASRSPGSLPVPSSRARAQDWGPRKVFGVRASDCRRQKGKFLGRSLQDELLSVDQLNKAGRKNCLGELIIPSVPGYLQVGGTKEYLVLCRLQRGLGLPNIVVVIAGQAK

SEQ ID NO: 971572 - protein, 75 aa, Homo sapiens
RSQGSGNEAEPLRKGNSRHEHRRQPTRLPAQKQRRCQKSRGFLGDKVPPRPRPILKSPGEGSTLKTPRRPRALPG

SEQ ID NO: 971573 - protein, 166 aa, Homo sapiens
MFALLGDPSTAKSQFLKHVEEFSPRAVYTSGKASRCCWLNSSCCEQHEESHEFVIEAGALMLGEYMGVCSIDEFWYRRTVRDPSWSFMKVLAQGDHYFLHKSRSRRVLLEGRRHILGAENPTWALRRSIFGTESIGGPHVAGTSKLGEDRADILPAEITTKTDLSK

SEQ ID NO: 971574 - protein, 72 aa, Homo sapiens
VSTSGITPGRQCHRFDTIMVPFGLIYIFFAVPVLPLIGFSHEDDRQFRELKRAGESRPAYQDQLDHERGTNP

SEQ ID NO: 971575 - protein, 117 aa, Homo sapiens
MTTAGDHGGTAQGEHIRSGPNKAPLWGYLRTKGGKRPPLYGVVASPQCVGGGPHVGADTQKEASRYYPAVFSFPTNVGAAREGILFCYDPPQAQRWFAPFYIGYQLSAHTDDKDAFI

SEQ ID NO: 971576 - protein, 183 aa, Homo sapiens
MHCLRKRRMTPDVQPSGAQGPRPFVEGLPLKAHARRLELMPRRPPGEGTQVAAAKARGGSLEVLHPGQKSGKGSKRNGNRKRAPKRGGHSFWAQANREGAGGLFGTIKPRAARDYRLFPFPFFRVDARGKRQLPIRGTWFAGGGFKGAKKQTARPTKDGFPKCPKRLSFKKRGQEFPSPRGAP

SEQ ID NO: 971577 - protein, 71 aa, Homo sapiens
VDTKKQKTDEDDYDSKKGTVKLKKKRRGLFTSIPVSEFKRGPPFRKLKRPARPPWQCHPQMTRALHHQAKA

SEQ ID NO: 971578 - protein, 390 aa, Homo sapiens
ERCCAHGLRMDPKPWTLPCVALRQLADATVRETKVVMQPRRTPGQPWPQSSAGALVLDGRVQLASQLMARAALRTPPGLQPQRNPLPAGHWHTAAPPDRPRREAIVTRAAHGDQGKAGNEASQYDSSSRKGITTHFARTMTATVRDMLVARTAGCQWRACCMGQEDALPHGPCRHGPRHESSISPYPGTSGAVRVPGQVHLTPSLCPSQRGPGCPPAVHSTEALRLLLEEPDVALSRDASSCSTNWSCSNHKPARIDDACSTLAASAHRRHCTPSVKPSSPTYKPQSLHTPCSYTHTSLCTPPCHTHSAHRQHPLFNLPPPSDHTPLPTDSPNSFTRPTLKHLEPNLPPSPTTPTTTTIHPYHTQAHTPHHPPPPLHTIHNLSSQHHLHP

SEQ ID NO: 971579 - protein, 49 aa, Homo sapiens
MHGMYYAPHGFLKGHQVNNHGLPTKYTVLGLIVRMPFDLCNSGSAKRGK

SEQ ID NO: 971580 - protein, 164 aa, Homo sapiens
MKNPVGPIVLYLSTLPPYSDLGEHSNFVGRQPSSYIGRQTKHTIFSAVAYDTRAGSWRGIYQHFPEAMFLKLLGPPESLTRNMSDIYSNFRLSKKTRFRNVGQTRRRIITAAITRLETAGQKDNLLLGEIYYLTPCRHEFGGAGNKELLIKKSGTEVPGASSIQ

SEQ ID NO: 971581 - protein, 189 aa, Homo sapiens
MRDEFRRAPRRELPVYDQKCSARERNLGASWDRGKLREGLRGVPINVSRVLHSGGALNAGSSPFSLLARGGIVCPFVSDTLDQAHPSCVPKVFFPAPLSVVPFVGCSPLKCTIIFPWKQLGDGRLALNPGGLGGAPGGMRLPPSCPEMEPWGTDLGVASRRNAGGAHKYPGATVVEGHNPHQWGNLRRT

SEQ ID NO: 971582 - protein, 635 aa, Homo sapiens
MKKQQRTHKNNKQTRQNREPEQKTQNKKEMRHTTHGGPERETEDMSANRQQKNIADTPVERKKQSIADRDRTVHKKTQQRETREKKRQQQKERHRTTHNTNHRATGTHIKRRRHQRKEQGETSERRGTKATRRIQTRARPPGRNKHTQHNTEEEQETQTTHQNRPHLSSNRHTSIVTHTAQQENRPQQAARDERQDDRKKDDRRPREEEEHDEKRSDEHSLAIANEIEGSGEEDDSRQKEKKEMRSKADAEEVEEATTRIERERTRIGAERRAEKHKPAADRTSERRRTDNEEKERTHNTRTTEQTNPVVERATTKEKKNRARRDSHSSRTAKQQRARQSRQAGSTRQRDAHVGLNAKTKEKRRTKQSRHTRRGTDDPQQNSQRRHEPPRGPPRHNETEQTTTQNRNSSSTHLVAKARRGQHALTHTRRRKTRIDRERKRTTKRMRQRDKEDERRRGDSTTKKQDETKHDTTQHYHATSEQTRNARTTKKEPSSTADAAVADMQRRERTNVESDRRSDKNNERENEKQQYDTDKCKKSEVVDMQERKAHAEDHHASMNYQPKARGEHTRHSKRRASDAHEPRYPHEDIAVKLSERRTRHKRNESNRKILRAAQQTNHYAVRRVDGIATYKQHDTA

SEQ ID NO: 971583 - protein, 374 aa, Homo sapiens
KPHIPGEREHEREGMLTRGPDGRLRDAALQTKRDAPHRPSADRGAGQACWRRERACVQSSPLLSCVLGSMLACGGSLRGANPVVRQQIGRALRRGARGPFSGCQAPSPGSSGGKHAASCNDLDPGGTGWALKPSGPSAQGGPGRGEERQLVGGVPGRGRDQPLSELPMQQPTPGEGGHMRANRAGPPNGHPRSPFPSGRGSFQHKVCSTKDGRRLKLPFEDGVKPAVRRVEGQKEEGWTPTDARGSRRTPMREATGTGRVRRTERLHSQGTPLGGQESITVHHTRIRGKGAQHAQENEASGEKAKHKERQQEEGTGKPTGRRKETPPERRTRPHDERGVEEEGSKRNETNTEDDEDAEGQRTEDEPQRKKREQK

SEQ ID NO: 971584 - protein, 183 aa, Homo sapiens
CNAPLTDRATGDHGARSGPRADAVLEVAPSVAPALLAADSSRLAAAQEPSPELLCSQNDKDKICEECLKNRLRVLWCNTEQRLVWDYPVTKRLATGFPFCKFELCTLGSLVGEPCEALIITMSVVGGTPPSWACQSVLCCLQEEEEPEAGQELRRRACGEPVGEAEYGRREPESRGLKDKDHD

SEQ ID NO: 971585 - protein, 188 aa, Homo sapiens
MDGTENKSKIWMLNGPFWGVSLDRLQSLVPLRKGVPHVPRIIARALDWQALKSSCQSRRFKWSFEARFSCWEQAPLQGSFDESSQSVQQTSEEAMRIVSRRFLPNESLEGTVITEKYGKDATNVGDEGGFAPDPGAINEGPWGRPCVEKHLWRNSGAKGAWDLTNLDTGGHRHGRSWPPEFFRVWRTY

SEQ ID NO: 971586 - protein, 112 aa, Homo sapiens
RVRGARYTGITGRTHGWRRHPGAFAPAQDVGQDRHFRSFYSASRLGPKCGHERRLSMAREDTNAPSEGSTLHKVRRYDDGGTTSEWWRRDLPTEGSQNARQIRAQKFNRGSI

SEQ ID NO: 971587 - protein, 88 aa, Homo sapiens
MGSKSGAPAKADLPGHLAKGNPPSRSHQGLEWAKYRILSCVKQALHGEHLQARPRVKKYSIVLLWTRRGRVFGGSARPGVKGLGVLRP

SEQ ID NO: 971588 - protein, 176 aa, Homo sapiens
MLGHKLLACANGHRPHSHQVVRVASKQSLGHQQDQAREVHWGWSLACACWVLDNFWLQFIYKDLSLYIPDLDAGAVEHTASSGIGLKHRALMMSPPSSGVKGVGTFVEDPITVAGPFLVPPESTEGSIWEKTGQPGVSEIRPGGGPMWVGLTSFGRYKPKGLLNTFVTQLGPQATG

SEQ ID NO: 971589 - protein, 151 aa, Homo sapiens
MISLIDITRGEISHIRVPYNSKGTNLFGKVSVGSEGYTHVGPHQFISTNTTRENVKRNFFVGKKEGASASDFEETQPRFVATGLQRSRRFPPFLRPYHFLVNFFQLQGGCTKGSAIRGPVAETKVQWLDFGGIAHPSGPMFTQGMCVARTA

SEQ ID NO: 971590 - protein, 32 aa, Homo sapiens
LLSPELLYALARMGHGDEIVLADLNVPGAFHR

SEQ ID NO: 971591 - protein, 209 aa, Homo sapiens
GGPSRQVSFSLLCHRDTQAAQAPDQNGKPASGRSSVGHEPLLAQFIWIPTRTTKATLKLWEASDAVDMKPVPRRLCGAQLVSPGPNMNLRARRQLRTKPMHKIPYRAPGPMPGGINYGPWELGKTLAQSLTVLTSIPYSSSFTVVPMWDPLVWGPPGTPIMPSPADSTNSSDNIYTMINPVPPEAAANFPNGSRLGRSDGGMGGMEHTT

SEQ ID NO: 971592 - protein, 302 aa, Homo sapiens
GEAKSAASSRNARAKGVLVTSPAVLSLNPVAGPPPLPPTLHTRPSPVPETCYTSTMPYQYPALTPEQKKELSDIAHRIVATWAGASWLQMIPLGSHCQAVAVHVAPRTPEENRALLPASCLLTVDDRVNPCNGGVILFHETLYQKADDGRPFPPGYQIQGRCCGHSTVDKGVFPLGRTNAEITTQGWMACLSAGAQYKREELDFRQVAVCAERLGETHPCQPSQSWKIAHCFWPVMPVSAKQNGVVPIGEAEKSSLIATDLKRRQNFDEKGGGAQAEGPHSGGLLSQGPACANSKDRRAKQS

SEQ ID NO: 971593 - protein, 198 aa, Homo sapiens
SKFKNLHYEGRSGGRAIDRGKQMIDLGGDSEQVWDYKPQVDFDHCGPVNTPFWAPWGQPPALVESWQGSSHSLGSCGNAPIKVRGAPWEGLEKCGALPFAVVVTTQSVEGKGALHPWVVEFPPEGGVRGMNFVPCPYYSGREYPRKIAWSVLARMWAKLPCNTPQGALKECAKSQSGGPRGAVERPLCGEGPDNSWPR

SEQ ID NO: 971594 - protein, 143 aa, Homo sapiens
FFFAGNECLYGWYGTNMKTRRKASRDGKLSDNNIRPRRKKTLNHRGTNRYTVSAAVRSVTWGSHMDEGDQGRATPIKELNVQNTQKRVAYEEIEEKGRTKPQRGWRSPPFFRGENVGEEKLSNTLWAQPKFFHESRVARFSLL

SEQ ID NO: 971595 - protein, 206 aa, Homo sapiens
MWRRVCRSPGEPEREEGPPAVYSCVFSPRARPAFVRAHAYKRGRAVARALWGAAAGGKFRACKARGPSGVITILKGGHLCLPEGTHLLSPTRNPGGPRGGARPPFFAHRGVVSSRGESREIFGVYRTRARKAGKSCGYPICARAHERGALFFHPRRGPPSLLWGRLMCARHNRKRGPHKFLPHPFVGPMWWWPPPVLGGAPTPMLP

SEQ ID NO: 971596 - protein, 337 aa, Homo sapiens
FCCLVILVGLLLLGIEHRILDHRQLARMTRGSIAPHLYLHPPPQHHLFTLVSHGAHSGDTSTSGAPLLTNRNFNMMKQMTIATKERRKKRISTTPGLARTLAFRQKYQARSKEKKNRAPKKDARNGEKTRNSTYESKTNRWTQRQKEDGTNAPIMSNQEAGATIQQNRAAYGEANSDNEERSRSGSTVERLTEERNSWLTPSDNIEKRQAGTPDQVSKVKNEELTETTVYPSSSRTHQNELITKRREAPKKYLHADTIEYDLTKTATVSSAKTSQQKNRAEKKLGDYPPVDKHKGARGRTQLYARGTTPGGGEPPSKTRTTQHARRNAGPYQKQGTH

SEQ ID NO: 971597 - protein, 162 aa, Homo sapiens
MVHTLTHYRDSSNKYTPSLTNGHCRDGERAHDGDQHEPNEKALRSAVDMNNTTRKSITSKQHRARQRRQNPRRKAPRLRLETQEDEQGKQTKACVEEKMGMRKEEKTTNKQTVSGGSYLRAREVTERSKPAPRQSIRVAETAPGGAGTMKYAAPAEERGTQK

SEQ ID NO: 971598 - protein, 94 aa, Homo sapiens
MREAERVAFQYFSLPRRVSPCLSRYNRIENPRSQRLQSTHTIVCRAYYTRAILRANQVVSEHGVPKTHRMERTRVWEWSPGGLELGAHKQEARG

SEQ ID NO: 971599 - protein, 160 aa, Homo sapiens
MHGFRIRLFHYGPGPTDKGSSLTVLVLVVSPCWAHAPEATPAKIRCTRSSCPQGYDGSSLEHPIQGNGAWQVISPTRQPLRITRSAAASPQKAKVAQKQLTSTRGTDYTAMGLCPEPHWNRGAHNTGGKEERTRHAPGRGMARTPVLPYPGCPNRCKEYT

SEQ ID NO: 971600 - protein, 130 aa, Homo sapiens
MQILGATGEKPVAKCWRFSELADLGCRLLMFTGSTVGATQVVLPALGGISYLSVEGGYSGWWCMTGEGQQWDFQFYRLRCPGYCVQWPYMEAIKAFVALGPKKSAGTRGSVPSGCRPTELSTSYGGEHRR

SEQ ID NO: 971601 - protein, 123 aa, Homo sapiens
MRTGANEERVPSHSFREKEKKMSLAAKRHAQMPNGEQERTTKTEREQTKHPDWDMILGSHHTNNQSHHKVMGDSEQKKHTHNIDASEHTRADQNKKIRQKKKIKLAKQEGVNRATQVEKKIQQ

SEQ ID NO: 971602 - protein, 105 aa, Homo sapiens
MVGMPCGTQSSGGRRRKVKSSRGSVLLECRFLLTSEQFVALGSPSLVLTYFKSSVLGQGLATGEVLPPVGTLGVPPFAAGVRGRSIVGPATCAELVLAFAGLRRR

SEQ ID NO: 971603 - protein, 114 aa, Homo sapiens
MGDSPGYTEGKQTLRTRVKTPRPWPPNDTCWGAHTTQRKGQELSPAQRDGANLKPTLRATSGDGDSTLREQTCGNKRDRAERAPPGEPQDPQAENCGHQGISPATTRVDETTAE

SEQ ID NO: 971604 - protein, 172 aa, Homo sapiens
EQKVEPALFPPVPLFTAVPSRSFFPRGFLWDEGLSASVDGFNARGDPSLTREALVHWLGLLNADGWIGREQILGDEARARVPPEFLTDGGKFRRPSPQAYFACSPYARGVVTLYDVGLFPFLDRPLAPACMPGFPGSIRASAGPLANYFFNPAGPGTGTLPYQPYWNPRTYP

SEQ ID NO: 971605 - protein, 107 aa, Homo sapiens
MLSPIIQRQQKSSAGSNKGLPHAVFPREEPPARREILRGGGGRPSPHKYCLRPEKKRPPANLSPPHLLLLNLLSRRGRRQTPAFLLMRPPRKNPRNVFIHPPRKNND

SEQ ID NO: 971606 - protein, 98 aa, Homo sapiens
AWQQESHEMMEVDEAGSSLHRIRRWTKGTETRAVAIVAAPLVNRACKAWGRSGGRRTQQEEHELPVDLANHRTVDRDAEDVDLQSTIGIGQALKDLRY

SEQ ID NO: 971607 - protein, 217 aa, Homo sapiens
AFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECNRCGKSFTVSSSLTEARKNSIPERKP

SEQ ID NO: 971608 - protein, 510 aa, Homo sapiens
SDRALEEKVQLLKNDSLCLINARHERKSSSTVKDRSVDDEHTSKPWLIRLYCLDVAISLESSVHKDIIQMIISQQNYNYYIDMESLGYSWISHTLISHNSPRTACSLQASNSSASFCTHSSAQVFMQTLCKHVRYKLTLHLYSVRKKTKEQYTYGTTVPPGKTTTCKDILISSRITSYSPLLRYIPCSTWSVRYYGYENFKSFRANNHCGEKKRGTIPTQHRKPTARSRAHTIVERGRMTARTRFTDHWLALQTGITSNHARSPRQGTRFGDSTLSAPKSHRGTLQLGHQTSQGQQKHTHERRHAVQHDPTGTNPRQEHRTNRNDDATKPQTHKARHSTHTAGSQQHNTGTAATIRKGGGWAQRDEGRISADTYDGDAAVTRGRRKNVTTRKQGTQGEGRPSREGGESQSTRLEEGSKTKRRGRGTHEQQGGNQRIAAEKEEERKASTTKANRKATQRLRRERRRRREAITNTQRCERENEYRETKTAKETNEATAGDERQTRNKNGDPT

SEQ ID NO: 971609 - protein, 126 aa, Homo sapiens
MTSNYKLYSPSQLHLFATPYPPIQHIYTTIPLTNPLTPNHSPPTLYFTSKGHTTTRPPTLNTHFSIDSNGNKHHPCQWAPPPTSGHHTNKTLYSAHTHHPTSTPHPATHTTHTTPPTINRTTTRTR

SEQ ID NO: 971610 - protein, 290 aa, Homo sapiens
MSSPYTIAGDLRLVLGAIKLSSQQVIKYEKPPMTISHKYQSDPVVRLDPSVNHRQILRSPESLPDPRLLAISYTTKQTDKPQHHPSFDPAGGGEPSVCTKHHILSFSVTHEDLYSSSYQASDIISHMVTYYSGNQEPFGYMRYGLSYDINRIPRDTSGGTQQYYERQAIDVEHRSICNLRMTQNIAITTGTRNTLTRPRRDATRTDLRTRMTPKEHQHNTKCLQGRIENIPRTQKATENENTHTMAQSDTMTKKETETKRQQKSHKNSTTRKDHTQTTHNENEKRHNKRR

SEQ ID NO: 971611 - protein, 226 aa, Homo sapiens
HSFYGDIYYRNFRVNFPFAQTPRCPPLVHAPFLPGWGGRGGGRSIITFCGNEFRCSGLDFPANVTVARPFFFMRGYFFPCIGFGRAQLDRTLCHGSACHVKNVIQKPYGAQWFPKYSHTFKVGDREGKVSQKAVGFCVVPGQGEQGRIQKNWAPRGSEFSEELGGSHRPGPPGFGISSGGRGRLSLEVEDGDGIELRWAHSRAGATGSGWMKWTSVCTMAWIGGVM

SEQ ID NO: 971612 - protein, 175 aa, Homo sapiens
MRRKRGADVTEGHDRAEHRVGGKGKLTHSDNKIRRGNTEGHPYIEKKSNPTQLSPPEKRDVIDSINRYVEDTKGVEINEENNSAPRVQHNNNCVKKRDRGGPRTAYLRNKRTQHKGGGGEPTHTPMSLIDSRFSRPKKDYCPPRNEKARPLSNLCRKKKMVAAPDNGQPTDSRRR

SEQ ID NO: 971613 - protein, 51 aa, Homo sapiens
MPPDITHYSNSPLEGKTLNLYALPDSNNIFFGPYFENMPGRFYATLHTDVQ

SEQ ID NO: 971614 - protein, 140 aa, Homo sapiens
MERVVLGGMSIFLKKLSHVIKQLVSDEDKAQLASTVCPLKDEPMAYTSFETRSLIEVGLYCLNLGMIAFIGPRMVTSMWVTITSRYKTSQWLKNNRVQGKNWYGKKWAPCSVENNTVFNVCGKALSIMGCCRNGLAPKQA

SEQ ID NO: 971615 - protein, 203 aa, Homo sapiens
MLHRKRQTRGGAHIKIKHRAKIPLYPADLGLQSGEDVKILSENSQRTRGLTPYTYLPRYRATFVPQFPNIFLTMGTPGFAYRQKAPTACNKPCPIPSHEDHKGAHNLTNTSGVPPQADTLSTRAREEQTSHVPQLFVRRHTRAEFDQQGRQQTTTPGPNLIHRSKSNQGFRADTAPPRLPTCAPGGTTGQSTKNRHEAARHNR

SEQ ID NO: 971616 - protein, 144 aa, Homo sapiens
KCKRTEIITNYLSDHSTIKLELRIKNLTQNRSTTWKLNNLLLNDYWVHNEMKAEIKMFFETNENKDTTYQNLWDTFKAVCRGKFIALHAHKRKQQRSKIDTLTSQLKELEKQEQTHSKANRRQEITKIRAELKEIETQKILQKN

SEQ ID NO: 971617 - protein, 39 aa, Homo sapiens
MMQTNRLSGLESPTLYHVCRRTHHTAAHEQDSAEDSLIN

SEQ ID NO: 971618 - protein, 340 aa, Homo sapiens
MKLQEERHILEAGAAQRASDKIAHTKVSHTGEEAHRRGQVERTRITRGDTHSTTNMGANLSRASPPNNGTPQRRRRPQKVEKTAGQKRGPGAREGATLREKNHPEEKADVESNRSHHHDNAQTRQSEYQTIGRTIRTDQTTTGQTRPATRRTQGKRTRRLGRSNSNEESHQRTSNPENGGTRKRAETKPPERTGARNQPEHGKVRNTTGGNHQTAPHATTHGRSTDAGEHTRTVESARKHQAAHYGHAQRQSREDTPAKRGGSADALRTNTERERATHDPKTPHSAARRPRKEQDNEGRATRQETHNTKDTRERSHTKQEEDKHRTRAHAHAREETTPTN

SEQ ID NO: 971619 - protein, 206 aa, Homo sapiens
MVWEKTRPQDRWPINLCGREIIHPCVLKGSGRVDKKDAHHSVVPTHTYSAGYEECSTVFSRKVCRSYQHTYSRDLSHSGGGGGHSLYCSGALGAQEVAFIIIDDEEETRKCSDGYIHTTGNGDTKEAHHRVVLQRKPAGDSSIDMLKIDLTSDVDKRELVPIYKNGALPDERNTMCVFHQTEAWCGTPSEKSSTNDHAGGVEKDGW

SEQ ID NO: 971620 - protein, 524 aa, Homo sapiens
MCPKEPKGDPDLIPSRQSSRNPNILITEPVMIPTFGSKAIEGIHHLIPETRKAAPPFIDTSSARESQMMDHGTSTIPICQSIDDSSGSLTYRGPYFHMPRPTGGPHENKWALLSHRTCILPQAPVPASPPPATGSQAQSTARSEQPPPPRARAAAAPIAAAQPSPRPPTSPRRPRPKRHTRHSPLTLHPRQPSPTHHHHPTGSPPGHTHTRHPPPPNCAPPPPPRRSPNTAHHTGRPTHTPPPPRTPTRPPTPNAAAPATPTHTAPQTRPTPPPPPHHPPAPPTPPPQPPAPPPLRQRPPPPNPTPNTRYHAPIAQPPHADSATPDIHTASQDGRNTRQPPADDPPPIHTNRPDDPTTPPQSTTHIAPHTPTTHRPQHTGPPPAPPLPTPSLPPTPDQPHHPARPAPPTTPIARAPPACPTHTPPNTTTTTHSHTPPQHPQPTATAPPTTAPTPPPDAAPASRTPDRNRPHRHPSPAPGTPHSDHATHVHPTADIPPHGAPPPPREHTTRTDSRPTTATRTTTS

SEQ ID NO: 971621 - protein, 380 aa, Homo sapiens
HCRRRVGTAYSLLLDSRVFGDRGYSPETEECRKPINVRVTTMDAEPGVCNPAKYQVENSFLIRWSQTIGLREVWYFGLHYVDNHTGIPTWLKLAYSTGVCLQAGQARQNPLQFKVPGTKFSPCKHVAEAAPSQGTSNPSTTLSSIRQCTGTGNPFTRMQDLTAPTCSTALMAHLRVLNASWPGATVGGHSRHDKAQLPPQSWGSPPRLLGGRARIRCQQAAGHGDPKPHQTHCTQGAAKVGPRAPGHSQGWLAIGVPTTRLAACAPQVSLAFMVGKFTCQQWAPRATLGDTMAIADFKLQYPRKYNATTRTTGNTPPQVPPAACRYGPWARAQTLYARQHAGGKGNRETDWAIPCRRNTPAHHPTTGNQRGPPHPPPEQE

SEQ ID NO: 971622 - protein, 36 aa, Homo sapiens
LGFRGSAVLGVCWQLRSPPSRAARMMNRTTPDQELA

SEQ ID NO: 971623 - protein, 128 aa, Homo sapiens
MNEQQGVIKGPGGRKRKELHTSLTQRNKKWGHTKEWNTEEGRGTNALQKYGGVHPNAKGKEEPQGGYLPGEKLVGANNRAEDGLPEMYVRRRATMKSKKRENGAATKKIPHKGAQSKRVTQALRVTTG

SEQ ID NO: 971624 - protein, 257 aa, Homo sapiens
MDSVCSQQHTPIASLMCSPCRQLRGQVTPSRPAAQGGASGVQLRLIPHISAPRPVPWVFPTLGIMHHNKQATAECTGGSEAAILGLLDAILARTRTISGGLNAVQLADITVVCTLKWLYKPVLEPSFRQAFPNTNRWFLTCIYQPQFRAVLGDSDPGVRSMASLIVPKFARDPSYPGHTTDSEGHTAPTSSSPELNKRTATQGSMPSGSDDSTWAGNDNERWKGEAKGTGPLRNPAQNPFGDQHKARHHSGPHRETT

SEQ ID NO: 971625 - protein, 219 aa, Homo sapiens
MKASGTQKGGSRLKGAGDHTLGGMRYSHKTWCIRRTVALGGHRGRGVGSGGAQAGRKEGAYLFLVGPLVWSEAHTPEVCGSNTPGGCAPEYSHKCSQHTAGGPTLYTGTSLWADTTAGHFTQISPRGGNRGVYKGTTGGYVCDTEGRTSVAQENPVGHFHVVVSPASHKNTSWGRSPRRGDTRGTDTTRELSPPKKRFTENTYRHPTKRVVGGPTSENH

SEQ ID NO: 971626 - protein, 363 aa, Homo sapiens
SASGFHLIIIRILPTSDFSQIAKNHESQPDGSTATARRGPQLRAEGRQDSELVLGEVVRCTVMSRAMDIIALRQVWTARGSGHDMHLAGTAADRVKMHAHTTSERLITHRLTGSWVPTPDPRNLQRVTQGARLLTATIIDLHQGNHSDQAADTRDSDSGTPRRRRGLTDPGIRIQHPQTAEIKSTFTARRRPLRYLQDEPHLDVRLKTHSTQGTRADTHRQIHGGTQTELTVTLMRSYPKPTHRPDSAGQTHAPTRDAPTGDPFNLASQPMGELQACTAHWDEDEGDAPLILTTPITQITMRTSRAGATALPNRRLISQSFLAQRRARSVHTKWTKGVGGILNIICRTTCLGIGPSRGDTHAD

SEQ ID NO: 971627 - protein, 110 aa, Homo sapiens
MTKHGGRRQGTTGQANDDKEKEDIRDRTADERQEPNARAAEKTSEAEAKQRKKQRRTGGREQRRRQQRKQTVERSSSDTGRRKEKDKNPEDREIRRDERKRGKNKKERKA

SEQ ID NO: 971628 - protein, 217 aa, Homo sapiens
MLRANPRNTPRGGGHKPSRGRTNSGYPAVRRENAITADNLHPSRDNTVVVTNGGDPTLRVVTNYLPNHALNYYKTAADAPDHKDRWGTPDQKEEKFHHIMDRGDNKEGALAPNVGAVPHCGEAAAFEKKKNMGLTYRTLSVDPHTWEEEPPETFQKLPDVHETNLTWLPKRSREQGAIGSAQGGAGHTWCKRTRPASGMQRSHRDMPHTREGPPDRA

SEQ ID NO: 971629 - protein, 139 aa, Homo sapiens
PSQRVSSFIKNTSAINNSWVIFRARDMGQRQLGYQAINKQLLQTLPFFSRWTITKNLKKRHIINTQWNVSQLVECLVNTEGKRVIEGGGLCTYSPHIDRPVCGLSHKLFLHKSPTPRETYLERQSVHTVNTEVDRELNL

SEQ ID NO: 971630 - protein, 150 aa, Homo sapiens
AVRRGGLGKKVRDCCADSGTMNIFDRQNQLDALDNVSYNPEQRSSQLKKVYASFALSMFVAAAGCYVHMVTHFIQAGLLSALGSLILMIWLMATPHSQMKTEAEQDWDFLLDYAFLTGVGLWPMPLEFFVLRVNRQSSFLTAFHRARHMI

SEQ ID NO: 971631 - protein, 216 aa, Homo sapiens
PIGVFCASVRGKRRGPVFLDLPFAWFDGALMTPGPLTCLQFRKLRCAPVLRPVAVLACVLPNLAGKMKRLPGGRDAAAGQRGAGRGRRHKQGGRGPVVGIDLGTTVLLRRRVRRTCRVEDHRQRSGPTDFTPFLMSPFTPEGDRLIGRCPPRTSSTSKARGTPGPLGTGQSRASNSGPVHPFGTFDPRFLVATQGQHFKGFLCPVPNRCVRTTDHL

SEQ ID NO: 971632 - protein, 272 aa, Homo sapiens
KGGARDPTQAPGISCSPHPRSRRYPETVTPQPPPTSGPLGTPLCRLTHCALAPGRVASPAPAACIRTGHPGSSSDDRALLRLLLPRSRMDPGLGDPPCPGPPGGPPPRGRAPGGIPQALSRPPGPLDARVCALGCPMKPPNEMSRAGALPCCRQGSSTIGGHAASLRVPTCGATRGHGRGQGLTARPTRTAIDRTAKESLPTRGFGTTRREAPTFSSTRQPPPGEEVFYPPKGGSSISPRGAPPHKGSPPTGKAFLWAADTEPHTNITPGGH

SEQ ID NO: 971633 - protein, 227 aa, Homo sapiens
MLLGRKLGTWSHAWTRGQARGPTAPTTTPGEGGVENRSQIWGGVQAPERRFTQEIVQFSGSVSNHAPAPAAEPPGGGSMYTGTEDGRKRGSSGPGYDGNNGVDMRTNRRTLSSQEVTRGPKLGRNPLGTPDKRVLCPTWAAERPRGNSNRGGQRLSGSPHGPHTVGRLVCSALHRCGDHSHHISRRVAKKNNIDPLVRVQNRATDHLVRAVEVPTFWTAYEAKPILV

SEQ ID NO: 971634 - protein, 407 aa, Homo sapiens
MREILSVCKERGHRETQEDDVDLSLTCEPCVLSQGEIQLCVCPTSLLCRAADTPFLTRERAHVHITTHTHSHTHAHTVEGVKRTLPDIVILWCCATIVVRQLLWQQTKLRSSTPTLLLCRTTLWRKQKIFWWGDIHNNTNGVRPTCRGSTPRITAGLETPHTTYMRTVLTPLRPDDENRTRPLEPMTDIQRAPPVERSKSKDNKPQHTRQPRPRTETLTREETRGTKAPVEKKYRGDQQQSKRRLPPTRTYSKHSGAPTPTNESGTSAAPPTNGAAVTGERQHQIISTQDNNSRPLTVWHHKHNSPPEQTEGHTYITTRWRQLIPRTRADNITQPVQKHTKQVRTQHHSRPMTHTQTATSTKAAHYLEKAAHPTVPHNQTSLPARSSDQPQQTQEQDKPHPHISTRL

SEQ ID NO: 971635 - protein, 282 aa, Homo sapiens
MLCVACALALGAPNTNATVSEFPTGRADAARFGLPGTRLALYSGGALGPRAWATWRSACGLHLFCLRRTGEGSLSCPPVNFEAARFPDALEAPCPCLVGVRTRFIPRKALPPFLRGGPLICQPGGRPCWPSPSAAEATRRVGALGQGLFFPEGPEGFPPEALQKLLPRRGCFGCRSASREPFFPQQAVLPHKEMKSPLVCNKRGFPASVDKSITHGEYYTDGFFNQKGWAGREYIIIKCFCFAGANTKNNRAPHKISDAAQVDIGPLQDTTRRYDYIIDALI

SEQ ID NO: 971636 - protein, 575 aa, Homo sapiens
MKTYTSFAEHHSKSYDHHASGYSTYSTTSDTQSEGATPTSPRREQLTIKHTTTTMTTRYPQRTASHPTRTDQMTRTTNEHTTANPPTRPGHTQSTQHHTPERTTDKRHTKQQESKRRTQTHQTKKSNNKQRRQHKQHKTRTTPGDTRHTQHKTTQGDANNNNPNKKKQRTTRTKRHEETTKDQNTTTTTNPQQRAAEKTTTQAHNKKQTKQADDTHQTRGQQTTKTENEAYSTALNNDGQPINERRAHTQQPRIKRTEGKQNRPTPTTAVRKTTLTPARHNTAPEHRHTHNTHKQPKKPEPTQKPTTRHKHARAYNHTGHNNAGTRRKHTHIPYPTLSHTTNPSTTPHPLHHNILNKTTTTTYVLDLPILTITLQTHNNPHAHHTKKPPLKPYNNTHNTQPTHNQTTSNNNKNHHQPHTKHTTTRQHAEGAKLSGTSKLTNSATEKQESQKECEESLETMTSRTRPTTQVSTDNSRHISKAKNEAQAHHEQESKHNTRPPHSHNTADHHPKRTHWRTSKHASNTDSAATAEETRSQAHRTRQQTQYVESKHTNDTHTPTHSGNTQGGQEHRKTKK

SEQ ID NO: 971637 - protein, 115 aa, Homo sapiens
GRPLFDFIFSDQKRIILPNQLYFLEFKTVRGEKSFSWPWWENPPFFLYFFGEREFWLWCGSGVEVQRDGNLSALQREHLSVPLQWVLKCDSSCAFSPPEDSVGLMRRVCATSAVA

SEQ ID NO: 971638 - protein, 478 aa, Homo sapiens
MCVNSGDITRMWPQCPIYLEIIVYNRVKPSSYISHLYAHRQKVGPKSTNCAGGTCGLSEDPNSSPVAQTYNLWRVYTRVMRVSRDCEYVCSLHNIDSVGAILIHTTRFVTTLMCALSPPQEVYPLLYNTGDFVSSSLCGAHSLLLCETTQPAAIRQCCETRDIRSTNPQKTRGDKQCGHHLNAHKPRHLAGERLPHSCGNTAPTQPWWCSTTGSSYIFPPTTFVPVEKAAHTRLVLYHDQQHVLHHLPPHMTGVFLQDAANDERPTNVDKSCGGTALTTRRQLFLWPPKLRHTPLQRLKRGSGSKLSPAYNISRRLPPDFVWHKSFTPYNFITDRPPIIEVGAHYAASDQDTAGAPPRTNHITTPDAARLPPLLNKTDAPTAGANSTAHESTLRNTAVPKPTPARGPRERTTERRPPHPHHHNISGAPPPHIMIAAERPQPNSRRRPPKHMPWRTSTQHITQNRPVGSDASHTPPASP

SEQ ID NO: 971639 - protein, 660 aa, Homo sapiens
MIHTTHKQLPVGLISSRTITYFPPPTLRSLRALRRADDAASPRMRPPPVRHAFTTSRAASPLPRRPMPRLRHTASALASPQFCASPSSIQSSPTSLTCAPRLYSIVEQPQYPTTHPYHLHLPCAVLLLQPSPTAQLNTHTYILLIPPDPYNTQSIILTSSVLHHYLADSCFNSLPPPLLVLPTRTATINTILISIYTTHSTTPPDMDRPLISILTYLPPHSPPPQPQPAPPARGLPPPPLAIPLNSTIVVPNSITNPLHQRTIHTTTTDSSAELRVAPQMTHARAMDRRAVRSSVVRASRPLAARPRGHGLCRHALQLAKLSARDSAARIASQREIKSARQRIARRMLGRSSHVSHSSAWLGRSALRWPLTALVVTSPLMLVSSRVPSHRPALSLSASSRRAAPPPYHSVAQLVTKTLDLVLLADDHKTARHHISPFCYSELLSYLRRLVTTPTDSSTSRLALLSAYRIHRPTFTTRHRSTNLPSTLRHAPLHPPTPYSRTPPHPYTPSHATHSTHHTHSCTLPTSPLQSYSGPSTPCDYPSQYTPLATQPRAPAGSPQPEPPHRQHASTILSPTSPFLVQTQDLHIAHSYRLLPHPPPIPYTSHPTTSSHLSPHAIHHPRSACPTHTIALSTVSTNAHARMLIFSLLMSGRWSNTNTLM

SEQ ID NO: 971640 - protein, 127 aa, Homo sapiens
QWSSEFRIGGGGFPARRVGASRRMRSPSAGAAGGRILLAALSPAVAPSKEPIDPLKEEALLVRLMAHPTSLETELQLKQSFRVDEFSASVLTWKTDHVSSFQLSNTIVFVVGLPSKRMALWVLLFPN

SEQ ID NO: 971641 - protein, 64 aa, Homo sapiens
MDEKTIALLCAGLVITVIVIVGAILFVPGEYFIKECTGLGLICDFYGDININFILIVRYRDWIN

SEQ ID NO: 971642 - protein, 370 aa, Homo sapiens
PHALPNRNGSLFYDSLLNPGLRLVATPALSPPRQVERGRISIHPTLHPGADGRTVTVPTPAASAPCMWTTGRAEPSACAATTNLVLGTIMAIHPRSCKDKGGSVSRLLRFPGQSHSFGDSGVYDAPRFPYSLLAGPVCCPMVPRGPALRLWLQRRPCGLEPGLRWRPATLPLRDGHVVPLVQAPVEPGATAGTVGRSVLAAAWIGARQASAPGAHGAQSVGSHTGVTLVSSQEGLAPLPDQGFPQMSSNPYTVGLKKLSPFIHTRDSQETNGPLFDPPAQALSSRRISSARLLGHSARGPAARSGGAPPCGCAAPFVGPPGRALFPGGAPQCGCFSPPSRRACSGVALPHELRPPATRCLVRLTAALFVA

SEQ ID NO: 971643 - protein, 298 aa, Homo sapiens
MNREAHTRGPSPPYTFKAVYIVTQDCGRFSTNVFHSCGRSPRGSNLSHRALWHVIRDVYSNSVVKQNRCIHSQECPKNPLENTGQWVLLLCGTPTVGWDETQRYRKKSVGKWRHPRVHMCVISPHTVTTGKTYRRKAQEHRHATIRWGPREALVVDPKGKSNGDTEGPPGNENEGGGTTSKQQAPQGNQKRTTNKMWEQLQWGPLGNRGPIVRNMAPNTRNETETQRLEQVAQERTENTAALCEKSRSDKPPGEPPTPGRTSVVVTQGVQQKLGKEERALKEKLSPLWKGGPQESYTR

SEQ ID NO: 971644 - protein, 430 aa, Homo sapiens
NSAWTEPGARSPPRTAAHSQPSVTSFTAPIGHAPRTPTRRSRRRRQTPTNDRPPSSYRSTRHDGTAIPPRQDAPEATTQDSEAAHPTDTDQPWSIIRLHTIYHVTMIITYIKTRACHVASAQQRNGQHHVTIPPQLVHAGQQRQPVPAATHCMQACAAHPTHGGPDIISIPGIITAQPSHCGMPLRDSTARPAHAPLTVVHTPICNKPHVQSTQPTNCETSDPNWDTPAQHTMTPTHTQVHHDRRRTPLTHAHMTPRVNRPITNHIGGTPTMTPQIGSHDMRNDDPDNPARLRRNSTSTRDHARPMEDNTRTKGDTHKQTYGPHTNAPISRREGGQPQWLQPQGSVSTDQQGEALPYTPSYDKDGNHDNPITRQRSGTQHYRSRQCETAEKHNTKIELERNKLPTRPRTKTTASNKANSTLNTHATTNEA

SEQ ID NO: 971645 - protein, 72 aa, Homo sapiens
GGKKKPRETAQGSRPREMDEEDTAFIASNTTIEEQKTTRGSVTSEMAAGKWAHWLQVDLLNLGKEVELSPCA

SEQ ID NO: 971646 - protein, 138 aa, Homo sapiens
MCPTWGETESVIRGAGTYKREAPPRNHEGSAASLCKPTLSRNSLIARPHQGRHGHKPLQRGPSVLLGREKPKREKPPREKPRGGAHPPIGWRTRGHPRRALYRGAPNDKLQRRIKTVRVRPCGAPGLPQYDTNQFFLL

SEQ ID NO: 971647 - protein, 65 aa, Homo sapiens
MPLTATCETQGPTKTIYTRAHRSRPCPWEHTPAQQLSDHHYYTRVSRPTPAAQQTNASTTPPCSQ

SEQ ID NO: 971648 - protein, 93 aa, Homo sapiens
QRSPVSPLASRRSVSPLPAFSRTRADANSAGRCHARNKESYRMSDIPEPPHLFDPLQLMQVSGDEPDSRWHVTDYIHIRIHTEKREEDPYYCP

SEQ ID NO: 971649 - protein, 146 aa, Homo sapiens
MSIMGSVVLAYSGGLDTSCILCGMKRSNGLMTVTCPNLAKQWAMIRDRTFDGMPRIEWHLIGFGGQHKGCSIEGDSQSCGSVVGCEFTLGAVTLSMITVGEHDTEEIRVLSLATSFFVGLESLDIPSLATTIRGTIQSPEGVGWCR

SEQ ID NO: 971650 - protein, 313 aa, Homo sapiens
TILSHLNQHIILQRSTSVPGPWGTPSREKVYQLPCPSQGSFTARGANRRCVNTTVQLYNRARRIKGGGAHECLLHNRCRGAAHKHRSRPEVHTLNTDGPGRHQGHSHSPQNLRATKYTITGAHEEQRCPVHHPHESRHPLKQSLCETVQWSPPVKKSHLMGVCATRENTQRATITFSVSILTDQREPYNIFRNKPRIMRHHMWAGNTHRVVPHAHMRRTPHCGQESRTKTERTQPWDAPPQLIQKRGPQRMKPKQRTRHRLIINRRQKRGLLKALLAAEGRHTTSFIDNPKRKAALGRHTSERQNPNNKPWRS

SEQ ID NO: 971651 - protein, 244 aa, Homo sapiens
MWERVGERASPPASHLLCDPERVGQTSFTECRPVSGVVTLCGCTQTRPGCGYLPKWCWPTYFSLPPEEGRETHPQREPLFPKAHRGARGPKRFVSVAEPEDKRPSPFSQACLPRRHEAFPLVGHFPSGCVSIIRGLHTPCGVCFLLTFFLLNPSHLLGLTVKFGIQTQILWGMRVVSPQCRPILCWDLFSFCGRTLIATCSNTVCFSTPHHFGARYTPFSRVTHSRATSSFHRFPLSIKDHDES

SEQ ID NO: 971652 - protein, 366 aa, Homo sapiens
RSQCGWLQAAGGGIAHSAPWQQQQQQQHRRYPRPSHAPALVQPPFASLCSSSTSRRTSGSISLDRENQICMKFKECLSPYFDYRHGDWHRSPIQTDTCEPVTDVSAGVQKAATNDSVNVLARGLIDVETDNRRDVLLTWVKLAQTRLSDLSPAGKFARANRLLEVGPYGKNRVAQRQLPRELGLHHALATRFPLAVAFSLERSRFLGPITGASEPTVGLLIPPPVVNGHRKSVTGIKQVRLGTQRKPFIAGMDAPRSRYAEWTLAQLPRAVCSTFARSMSGTSPSDVQPCAHGTFTLSGQFDANENLVNRRKAAPSCCITLGPARVNTFVPASRPSRAFSQLGCTVGPLTEPSWDTLQNTPLRRLL

SEQ ID NO: 971653 - protein, 117 aa, Homo sapiens
MSLPRVATVVSLWLCGPPLCTGGDDPIHRLSGHKSLEAYGGTPPFKRVDPSYSSSNVMAPQETLCKGRKPTGGKRPRVGPCSKRPSKTPKAKGKPRRVKCSRTDHIIKEEFSTGLYV

SEQ ID NO: 971654 - protein, 283 aa, Homo sapiens
QEKNPAGVYRKHVLSSDRLSVKINPSMSDPDGIQGETDELVKRSEIAGYRYSAGTAYSVLPVTTYSSAIGNSYSKMMYVRNTYYTWLHGVCIELSFDDRYFHTLGGYAHGPLFRLLRAYCLRSHSASTGSRGMSRGQSAALHCPYTDRKLLTFIARKREELLTQMSQGAKVTYDFPDIIVVVRAYVDVPSDLETNIKMIFAANISHDEAIDARHGLTLRTEQVDPRVHAAELGPTAERVRAACSFWDALVSCCSVAFLGHLIGTDRKQSDNIDEERTILGHTT

SEQ ID NO: 971655 - protein, 246 aa, Homo sapiens
MKERCGTPQGGRGGNKFLELLWLERTRGLWPIVLPQVRILQKAEGGLGIPFCDLRGQKGGLGALLGDPLCATSPQGAGFHIPPSCLRGVAIKGFTLCPWQSPLKFTPKWWLNLQGQINTVTVQAGETGGVTERHQGVLPRSPQLCKLSSWNPVGALCCIPQVVFTPSRVYICGLYLWVAPLERGYTGGLGRGSWARAWLTSQRNVFILGRQALACCPTAKIFFPLVPPTGQPLVSSHNFFVLGASQ

SEQ ID NO: 971656 - protein, 263 aa, Homo sapiens
MGLPPLWLFRLLLPQLEFSRRNGKSLEETLENTACVRLLCSPSGSPGVVDCGVGESYVESPRCDHQKPVQHLCCAIVEGRDKGVTFYTSSFSTILQNFSHCVTIPIYICVGRPPPVCVQQCDALVMCVCAFSCGAFSVRHLYLWCSLWDNNMCVCPQRRVFRELLCGPVWSVPQTISRRKTGTEVCYIFLNIFSSLCVSPTNEKKPFILAQRYFVFVSTHLSRGCVAWSENFRNYFPQGLEKNLWRPLKSPRFLPTAGPWNQI

SEQ ID NO: 971657 - protein, 279 aa, Homo sapiens
FVSIGHLSLVVKDIETKVLRPFFEPRMLRICNGWSCGIAPVADHEDISRPYSTEPNNLKARNSFRVQRTDSPQDMWAWSRQRRAKCVVVVIKRRSGAEEDCHLLMCGPPSTRMLAPAQQHQTMIRKNKYPPDLRMAAIRRGPRHPAQPEACDGEEEAEPGHTKSILSPLTTEQKRSGMGFSSKATATKQATHQKNERNRQQTDPTTPEKKRLILEHHGSRNPKQTKRAKTQRAKTNHERPEQNEPQTPKDSDQYKRETANQETQTNAETTKSAENHGGH

SEQ ID NO: 971658 - protein, 352 aa, Homo sapiens
DPGIAREKAGVPTLKVRKGDFRGLWNWGASRRRRHLNARRSIARAALRGFPKPDRRRPQTGLGGVRLRVLAALKLGQWGHLCGLKGRSRGRYLPPGLAIRLLPPRGGPRRSGGHEETGSTPRTSCPGVSNALVRTRNAGEHSTAITLRGHQWSPRRRSPWPGMGRGVLRGLGRRDNQEIELTLDPKAWDAGFQRQMWWPIVVNKERSWHTGGWTCWPNTGIKTLAGREYSLSCVPEVGSPKKGQGIPDKTHFQGDIVHLNRRIRWTRQRSRGAPAPVTFFPNGGTSDVEQGPCGTYTPYYERLRAGRIRNTDTRREEGRMPRVHPPQRKPPGPGTGGLRRRATERNTLGTRH

SEQ ID NO: 971659 - protein, 194 aa, Homo sapiens
KLRLMPRRLSELHCPPERFIRKFCTGIDPISSSARTLSRYECLTQTQKGGWSQDPQTVHWEHFSYKLYLPAVSYQLPWEIQVLWAYVVSCPTRKLMSQEFDSYTSASLYRILSKLQKYLVTNSCELCGRYPGSHSLQGAKAKMDWKWAFDLLSLQEWHFTQRSTLSAHAQSLPSLSVPLTTWSSQPRDYVRKRR

SEQ ID NO: 971660 - protein, 264 aa, Homo sapiens
AGKPVRVIRSFKGRKHPANICSCKQGPPASCMAISSQVVQHHWPSRFPSKPSGIHCVWPLSLCQAQQHACLQPCVHWHLMHRHISTLVHRSIHVFTDYHMVIPARVSALIEHHTAQRHSTALQPGHQVHTAQRSAQMVKHHHTHRALHLSTHRMHVGPQQVPLPKGVGTHTAQSAAIPMRKPKATLGHVAFARQRSKHTPSETQRNTHSSPSEPATRIWVRKKRRRQQALGLEVLFVNRLGHIFTTLFPLWIGRQQGHSRREWL

SEQ ID NO: 971661 - protein, 82 aa, Homo sapiens
KGCGFVVRSSCSDSPLSLSPRNKSVRKPARKAWFKGYRKTHPGAGGAIHRIRITLTRRKVKSLDTGCVPDLIRGAQRKRLSK

SEQ ID NO: 971662 - protein, 295 aa, Homo sapiens
STSSTQSLARLGSPDYRQLSPAQLAWIPRHHSQFCSSFPGRVSSGAPPGRNELLHGHVARMSLSSWMTWNRMQSCSSAIECAPQSEDLLSPGVQAFPGLGTITDEEMKSWRPPRDPAPSAVMQPIQIAEEHGHQHPVAAQTGLPRAHKAMELSESKKAPAVCHAHDSPKTTLKGANRSTTEAQKKAGSSFLLNGPDRAPDRGPAAFLNSSTKKAREQALLAAGTAFKRRPGPRFPQNSQVDPPSSAASNHTDRAPWWRHGATLEPGTGTNYRAGQSATGSRSGDMGRQGFELHIR

SEQ ID NO: 971663 - protein, 306 aa, Homo sapiens
TGHQGGFKGHSTPREVHTFSLVVWATSHRGVRGCGGPPVSAPQPLETWAVPRVQPAFPARAPECENNTTITRSGHVHENENPKEAAAASPNNHRERGRARESSKPRALCGRRPLCGGVAPQGEPVPAQRETQRVELPKVVTPRGVHNYTNSGGPRGTEAQTIPVGSASITERHCEAPSIRVAASPPCEREIRGDTALGAPGGHITPPVGEEENEGEERTNTAREQAQKVCRHKRAHNKEGATHVVLENQRTNHTTPMRTDHKRREGDTPVQRETPESGVAPHPLYAASHVAEATGVPCTGPPGTTT

SEQ ID NO: 971664 - protein, 650 aa, Homo sapiens
RVILLEYLLPDAETPGTGDPAASIPSPILTLPRHTERPYSTYPLSHHHTHNDRAEKLGAPQKNTRAYRATPDTTRTTPQGNETNNDKTSSPQKDDRTREPHTAAQPHTSSDTPRITANKRQTPTKQHTHPDTHHTNTRDNSTKTTQTHNTNRTTNAGNTTHNRTRATTTNIRTPPQYDPTHPQHHSTENNNDLQTKQRRPNTRRHSDKRTTPHSRHQTGSSHTLQYKPKTLQKYGTTTPEHRIRTNNKEPNLKQHISTSKQRCTNKNDRHKLQRRKTIAQQDAQQIIADTLNHLEHGRSDQRQHSKDRDKSSSKNNTEAKNSNSIEPPRPHRELSRPQYTTTTSPLSTQKAEHHGTNNGPTQHSDGKHDHEATRRQTAEPPDAKRAKTLRETKGNTQTSKQDHMGSLRYTSHKQPKQINQGTQYKRGPQYLTNEAHEQMHMGNNNTDKRTSTERHKMHETRGHNSDTAHVVRRDIRKQHRAAAPKRSLLTNDERDRDSYKPKQQKCETAPESRAKHPRTTRRQNSDDAEHSSTGISTAGQQSTTDRYVKIDKSNDMDRARRTYTQLTRANTENGKQRKEKTINYRGEIGLLDTHILSKSKTKAIDRESKDERARQQGTRRSRKKHKRRNNTDTSEAREAVVEAQYYTMKR

SEQ ID NO: 971665 - protein, 195 aa, Homo sapiens
MVDPGGAPRVSRVHTRAIGALLLPTLGGSAGEGLRGRKARAAELCHVGRGTLREGTRNTSSQYRCLDLSTTNGPGRKLGAEMKGSGQPAPRAKVGEPQGLVTCSGAGVGGEAPKGARVSQTIPDDNPRGGVLPDDITPWSRLYHEIYRARVLSPAHHTASLPVEGGTPPGPGPVWTSPHVRGHHALPAKFCWPDE

SEQ ID NO: 971666 - protein, 299 aa, Homo sapiens
MYQLAQDDMMASKPYMDVPKSCPAHRPQTPKACDSKLTLMLNYDSGRSDVFKDRFYMRTNPFSPGKLSSNLHYSVLSGHNLPNGLCKLLTTFAAPAACKFRLFQPGNTYWAVQGTRNVPHTDHPKAILQLLWLTLRTRESIIECCTWLRNKHRHNHTFSSSSTNHEEVMRNINELWIPGNPQQLRRHEYSQALGTPRYDAEKDHDTHELKAHTHTNGKAQTNTNIRNHIPTDPEQLGTTPRQGNYDGTTLNGKNMTQYNKDGDQTHETENHSKEGTRQKEQQPGKKTPTQKEHQHKDHK

SEQ ID NO: 971667 - protein, 213 aa, Homo sapiens
MESAHIGPPFEDKDGLPLALFFLEKLVLVQNMVGHSGAATAGSVNANINYKSTPSQFNEFYTSSPLLGGLQPSRELPKEKTPMCLVAQKKSPHNPKVVLAPLVQWERPHCGVHVNLHRWFVVPPMGQRAHSKEHSITLGNKRHNADNKTQAKGLAKMTPSCAGGVEHPRGVVVHAQYHQVKVVRNTTGQGGGNETLKTANYRASPRPTSQTLE

SEQ ID NO: 971668 - protein, 234 aa, Homo sapiens
MTCTRKVQEVTDASAKASPILIVIHIREVSPSTVTERGKSISLGLVALGMVEQRSCIADRGPKPRGLPSDIEHWQAELTKKHSVDITLDSQLHLHVAAAGLALSDITPVLIIIIIGSLIIPAQHRLQATAQGRMQAPARAGEVGPSTGADLGPWHALVRRRSWSARELADGRAESPVFMDHSLDVNLLATLMDLWMCLTPDFLLPRIGTASARSVIFPKEPTRYPGPVAVMRTP

SEQ ID NO: 971669 - protein, 269 aa, Homo sapiens
KTPGTPFRGKEKKGKKGPKGGGKRGRCPTPAGKGMRARTPTSPRRSSRVVIKKSAPRGGDDQRGGGDNTYPRGFIVRGGRRENGKEEEWWYSRSFSKTVSPSRGGALTQEGRPTGGYYNTDWWCRTRSGGGLPPTQRAGGGRTTRVVVVPHIAPQDNPHSALLTHKNRDKVSHSRVVIIEANTTNDWQHHNKDVSSRQHKSNVAPSLTKAATNLKRGGGQHNTGGNNRQRTVKHHERRQTGAPNKKVLAHPPHKIDNNPGGGLPPKKSV

SEQ ID NO: 971670 - protein, 88 aa, Homo sapiens
MRGRRSSAEPGSQSKRRPNKTTDTPRDDTDRKTPEQHRQRTRHKSNNTSRPNQERQNQPRGVYHKQKTTQHYTHNKHENTLTPHNHTT

SEQ ID NO: 971671 - protein, 302 aa, Homo sapiens
SLACSLSPLWGSRGRRAAVATASPRPPSRSPPGQSLPPAHPSSEWPRQGLESTRGAGWMVKPCTPEDFTEDSWESWLSGSDLRFISNSYKHTRTSLNESSSAGFHMSPLSEISWTLLDELPNIHSHTAVMMLANDSGQEESPNLASKPRCMYTLLRQEVPGPTGSLKADQGYTRTNHRQHYPIINGAPAKTPPLQPAHRPPRSPPPRHTNHNQPQTTTPPLTLRTLLAPKQPTPPHRTPPAATRPTNRPTARPPPPHAPPHNPNPPPHPHTKHAAPPPPPPPTPPPPPPPTPPPNHPTPPTP

SEQ ID NO: 971672 - protein, 321 aa, Homo sapiens
MARPGVESGSGRHLSPTPELDAAPRASAQKQSHPTTRAKRRAPPPHTRGTGGAHAPAPRGARTRHRPQRRRPQQPPGPTTAPSPRAPRGHASALKQSTQERHTRAPDSAAAATAAATRRPRPARGPPRARSQPRHRRRGTPGPPAAPARIRPGRPLHHGTPATRARPSRPRDARDAPVAHRPEPAPGRLPGPRRRAGSSGPGRAACGWGAATRQRARRRAETRAAAARDHAAPVGRSGPTAAGEADDAGPPGPSPAAAALGGVPRSGGPRPPPPPAAADHERRADNAPDRGSRGGRAVPAVDRAAARIHHKSRRAGATAPD

SEQ ID NO: 971673 - protein, 463 aa, Homo sapiens
WGGRHAAAGTPDGSAGGGGGHKKKGREHHTQRGGGGERRREKRARGAPARGGEKKRRENLSLSHTKKGETKQTGVRRRTGGGGGEREKEREKGEVRPARERDTRRGKDNREGGVPLLQSAEEREYKRRDVVREECSPHAARGGGERKERETHTRGGCSRESARTEREEKTEAGEGGVAHTGGGAHRKGSNREGAPTQYSITNKNSLPPTKHKLTHPDKDTCRPRKQREAKPNRPSRAAGGGEGGPKNTKNTADEEGANERRGGGRKERIATQTGRRRSAPPREDASPRREKQAGETKPHQRRGRAEQYKKAPVTTLVCGNTKNPTKQSRARATRRGGTTTHNRGASRQQHSIREERQQRDTKIHKNTEGNTNHKISNTEREETPPQKEREGASAPPEGRVDGRTTTHPQERGTEEENAHRPNRLPREATPGGGKNTKGLTTRRKPPREVVGQPHRWYRERRNT

SEQ ID NO: 971674 - protein, 388 aa, Homo sapiens
SNFPEVSRDGQEVVWWTAIYMIPGEQGELGIRVESDVCCALRAEMSLSLAAEPSPDPVPTVVHANHFLAMQLPPASQTAFLPPGGWPCAAEVKKPAALKQLLCTAEKYEPQWLDTLAERSAWLAIQLVPGHGQGPGSGEHPGCHTVVRGLDRLVALCQLARQSWPQDVRKAKCSAGDAEAAAENELTVHARALGRAADASTPAKIHGRRKGDLGTTGAASTRYEHPGTTVHPPASIDHHKRQDKTKKAKHTWETDTPKTHIARKTRDHSDRKPKQTHGHAAHKTHRNSDRHCARQATTQMETGRTGDRDKERPPREVNADQYQANATDRQMEESNHQKTKEGNQRRSKCKRRQPNRSGASHITTPRNPTHTNKREEEQGSREETKSHA

SEQ ID NO: 971675 - protein, 111 aa, Homo sapiens
MKVLLLTMGWGALFFCLLFGDDNFDPAQPPVERDVLLTVGQRWCWLSELAYHYARLGSQLVLTAHTDGSPAEGTGGSQLVVSTLGRPRTSGSPEVRSSSTSLANMAKPGLY

SEQ ID NO: 971676 - protein, 450 aa, Homo sapiens
AVPAAEECHLKLVWTRVSLAVALERTAPDPGLLVQRIHHAAVLMLLLQGFRRLEEWFGAWCMGLESLCVAACLRGPHDACRWPHDMYHAAGWPLTHDFCAATWQHSCTGGDARGPFAWPAHRRVEGCLAVLDMPGSLRAVALRTGAEPGFASDPGQTVGGQALQRGSVTARNILGVGDNGLGPLACPVLNGEETAQEGLGRGAQGSEPTWLRHLPAKPETYCTVSNLHTPFVAGREYKAEGGYRRKVNALSGSVYAGTFLALTFRNEPAPPHVSMPGTERHPLGHHRVAVQCQPKAQTLSARRGSGMADRGPQCWVSDRLLQTPRKRPKTQRLTASGETHAPPTRRHTRTTDATQAQGESDSQRRDEQHGTTLRERGDQTRAKTTAAHHTPGGHGAAGLRRTTSGADRAPKGAGGQHTTATPTGAAANTEPDAHSGVRAERGRDRARAET

SEQ ID NO: 971677 - protein, 391 aa, Homo sapiens
MHSEPDGYNRTFWKGEHHTRKPRICVPAFCKSGQVRSCLPPQTRSTCAANMLKCTKPVTTQPASALISAVSTVHIMQGAQHSEIHNLSSHFKVRFASVFYRKRTRFREIQILYNTYRHQPDQVFIQPHSIVAAVSSSPDREEGPCAIRHKQVTLHHIGVCNQSFLSQIPFPLHSAYGQYCTRVEAILGGLFRGPFKSCEPYHTRLSTPHGRPFILHEGEKVHHRQGLNIAVSQILDCLTKNQGIACSTVMDLVSNVGTLGRQEGSTIKHTVHKHITEPAHTENPPGANRENLGTGTTGNQTQAPVTIETRGTKQDIPRTTRKNTQHEAPEKTRNPRKRSPHTDSKEKHKKKRRDNKENKKGTRQNSSEPTGQNSSKETQRGTPPQNAPTPD

SEQ ID NO: 971678 - protein, 241 aa, Homo sapiens
FKMKLNISFPATGVPVNSLHVDDERHNFSTFYEKRGHRQLLADALGEEWKLVMCVRHQLVGTDKQGFPHDSRAVCDRMGVSRLLTAVTGHFLCTAPQETLREQTRRNITSRGVHCEMANSETFSTLDYGKHKGRERILPRHCHDNYTCTRTPWDPKKQLRSNTTNLFKSLLKNDDCPPDMSYRKPVKYQKVKKTKEQEQPTDVSVCVDSHVSLQHTTAAYCSARSQRSKEQITEERCTQSC

SEQ ID NO: 971679 - protein, 457 aa, Homo sapiens
MNYLGIIFTIRGHTTEYITGLENTTWIIPLVRFTKDGVTMGIPGEHKYSHYGKPHSYKTKSHKKYTLSWYPPMEYGHGYSNISCYKMSRDTGYILSHGVNTISHSYMANIPNCGLTILISTTQLEVFIKRSFQNVASGCTNITILFSHLQGRCFPWKLFGALWGHGGLTPHIGAEGFLALGARWYTQGEKGPKYTGGGGRRHYYPGGRTLTTPWHVYRESPTKGGTGKGRKRGPQPAGARWAPQLGRRKDVLTRGALGKASWKFPRPKMVLFLQKPVLGIRFCKARKSRGALSTDRFAKRPRVHGTCGSVRPKLIPNGEEPHNLENHHNWAWDSKHPRRRRERKQGRAERQLADNGKTGTHKHNHEEARPRSTGKPRGPPRSHTRPGKRVENTNAVGHNKRPQTPRAPNWNVENKSSNNARRDECTHDKMPALELLNKQRSRTGISSPPRSLVSLTR

SEQ ID NO: 971680 - protein, 73 aa, Homo sapiens
MAIYLQGKMADIQRERAYQKQRPSFKTRRGSCGRNWQEKLPRYYKNIGSGFKTPKEAMEGPNLKKMPLLGNVS

SEQ ID NO: 971681 - protein, 138 aa, Homo sapiens
MPYLPRDEQYKGGNSGAKQSRFYMGFVAHHTLVRLSHIIRGASDWGYPHGNIWVYSVRVVNQKAWLDASTGSHGTIGRRAKKLETPCDSLIYYCRDPSVAQDYLKAKSYISHDVVTQGNPPRLNRLIPGAWLLSSPVG

SEQ ID NO: 971682 - protein, 129 aa, Homo sapiens
MCCHTRGEQSSGIRHHPRLLVDTLLTESEHHNQALTRADADEQLPKEASLEEPPRRGMIVAPPHPAKVGGLLNQARDEPPHNRGHQRLDQPHCRRPVEQQDTTQASSSHHQTERDQHAATRRGQRRAHS

SEQ ID NO: 971683 - protein, 425 aa, Homo sapiens
TPRFSLFFFLLCIYKTPLCVWPPRTGGRARARARGREEKRQGGGFREGGAERHTPREREREKQGGKHKALSLYTREREGGRREREREGCLIKREGRSRERVPRGRERERRAEVWRERAHRARAGERGCTHHPHQHTHQQPSTQAESSRVYILRETTTERRGARRRKDQRDARESAARRREREKRERERVCSTHTHSRRARARGARARETDSCCGEEESGEQQSERDVSMERETNMCSGRHHHHKQNTPLHERRSSAREKQRERERKRGGRATQVREEKSSARAKSRGGGGGGATNHPPPAPRWRGQQILHKKPPPRKRKQPGGGAATRRMAIATSPPRTRRQKTKQHKTGHGPRTAEGKGEPTRADDEETQTREETTTQSSTQERKGSGRHTTNTTHTQKKHTPTTNNPTGTTNAQRRPHNKEEK

SEQ ID NO: 971684 - protein, 376 aa, Homo sapiens
MAILNIRAKRKTSYAWEEQRKFGLRRRQNNRGGVAAETLGEGQGGGREPSYKKDFPKSHTPQFRVAENRGEAQPAVSYTLREREKARNPLEPIDVESTFKLAESTNSPFYFFYKKRGLTTLCSSPSLSHSSLVWRTGGRAPRGPILCLFSFHPKRGPRGSSSREASKKGVPPGAAVSLGFPLRVAHPRGLRGFRTPVGGVSPNEHTWRINPIIHRKKGPPGIKKTHPHFLDPPRGAGGEGNPPVEEAEKHGETQVGGAPPKRGDTRSYEAPEAPHKEPNLRARFPDGKDPGGKMYRNAQTVGGSTTTKNKHRQRGKKPHFEPVQQNTNYRRQHARLTWHDETRIYKMSTQHTRQATTLDTAHRRIPPQALYHPADD

SEQ ID NO: 971685 - protein, 153 aa, Homo sapiens
MGEMFYAPGAKVIISPRGNQFFFHVKSQRLERFSSKNARHLFKSHFLGGTSIPAKRTSPLSKKHHTNPLCEEPHIQEDVNTGGGPPHGGPPGGTNTRGCFAPTKLISFSLTIARTHSAQQGGVPPHFLIPPISFHEKKWGGTPTRSLSGGTPN

SEQ ID NO: 971686 - protein, 298 aa, Homo sapiens
MKRGRQECAWGSRGVASDVEAMWDGRPQARAPAPSVFPFGEMWEAYASFPSSCKYGVRVSLKRWERKNTEERRLSHSPEDRAPKPPNPTCGGSARERGKICATKPSVPEGAPLLRLWGAKVCECGSLSVGIYPQEKLLERQGAQCALSCGSVGPISLCALVDKRRVARVRLSWGPHSGAMCAVNTPPGVSLTHQVWPGPGDHLNGWGGHRRGKHFFLPRRTPSLPKCHGRPSILGGQGRTTARLVGLSTRKFPREDPNVVANKGEPCFFEPGYIFPSPERAYLRGDEVLGLVGLAEHG

SEQ ID NO: 971687 - protein, 99 aa, Homo sapiens
HSDTYLITGKNPKKLASNLGMSVDVRTLAGVGFGRGRSATGRWPQPGQGTGIYEMRLWRDLLLLVFISWVVVLSGIYRFSINSAFGPKWASGDARGEET

SEQ ID NO: 971688 - protein, 260 aa, Homo sapiens
MRWAGIQSEFFGHVTRGNKDFFHLETSAVQGKKWGGGSFPIKKQRLGQVLSTFVWQLNTNNRSSVCYIITNVLEQEIVRGMATCGLRNPSIGAGGIQSVDNHNQHVTTRDNTQPVVCTFRRTTHLCTPHDDLFDSPRTICTTPPRHKKQVQTITRFTHNPREHNRESVVGYNATTTEAHQLHTETTVATPNTCRGARTWHTPQHAYDSGCQRPRTQAGRYAPTTRNKTERTAKQEHHKNTRLKPAHPRMHGKSPYYDDAY

SEQ ID NO: 971689 - protein, 284 aa, Homo sapiens
MTAWGTHEHLVGLATPILQGATRAGHQRDSNNQLAGAQNKRVRDYSIHTRMDRHNRGTHSGPNEHSGPHNNGKEQTDKTKQARCSPHTMGRVEHGGNTQRRGLHTQAGESSTQHEWAHLATVVTNILGGTTNPGPTQPTRVVAHASTNIPEHHVRYQNRYRNRRAYEHTRTRHQHTTTPTHTAESNTTAKRNPKNREGNPGHRNQNKTTTHTSTPEHHTDQEQADSETTAGPQSNLMKQRGHTDQMQHTQPSLEPPQSAITQANTQRHNTDEAGTAHRADSKHN

SEQ ID NO: 971690 - protein, 335 aa, Homo sapiens
GVKMTDLFNLKGHRGYRRNQGVVPNRQATYVVSQQHYHFIFFQRAFVSPSRGYSVFHIKQKLSLFKPECVGHPRVLQRHNFIRCGPSVYKTNFSRVEQFTILQIHKCGYVRAPLWIQNTHSVDYKLYSRDINHIIDTQRQPYRECPYQYKSTKHESETIFIHTHCVRHKTLSAKYLKEKDKTRSIFSLCPAEKLFLKVALSVKHHTLELYIAVERAERGSVSPQNAAGRRGGYTRGKDIIDGTTTTYHTMSPQNVDTLSITTHKTPAGKKRDTPHEGLYHRVGESIERSVSKRGGEPQRRRGHYTGWNTQKRCRTRPQGEPFQHNGGGGIRAQAE

SEQ ID NO: 971691 - protein, 268 aa, Homo sapiens
FFSFQGRFNRVLFHKKSWAKYVLASLYGNNSNIKNVYMPGEVFFSPLAWKRGFSSLSGEVFSLHERGLGFSGKGVVCALIIHPHQREVFSCVVFSDNTHPHRDRDSLSLFSPFSIHSHTPESVFCVRCEQDAGVLSLSIVVSSVRACVCECRARVVSCARSARVVRSYILPAGELVCVTILRRARRVRRHQHSGWVLPAGAARVGLSVCHYVVVYIKTTFSTHSSGTLSSESIFSTRGVGGRPLSSLEERTLSREQKSGGTLISVRGG

SEQ ID NO: 971692 - protein, 205 aa, Homo sapiens
MKLLGLGARRETVQRTKTPHDEVLFSQLIFSFWPQLSSRGSPTILKGRVRGEWLNIHRAKIVRGTPWSGSPLEGLPVFPHYCRVVKDLRNRGMGCETKKAAGYFRRCTRRQRLNLWSSFEKEFIQYPREWPSEYPWEGIGEIRARTLCAPQGRNIVRPHGQQGVEIQDTEKGESRRIHSGIGCPVSRKWAPRTVQGGTHSKWGKP

SEQ ID NO: 971693 - protein, 485 aa, Homo sapiens
MPNRDARPKPARTPTKDDTQTTAEEQTSNTHRQTQHNTTTQNTTERKRTEHNNTEEATKKQNRNTTHKRKHTTEQDERRPTNQNQTEPRQETNTKPAAPVTAQHNQTDAGEQHRTKERETHTQPYTREQHTGTQTEKKKKRQAQNSTHTPQIEEKRKNTTKRATRETAQKNSNSDDKTEEQEDTREDHDTRRAHTQEPDADDRRQQRETERSTRRTRSTKHDKRNETSKRQQSRDRAQGRNTEQQSEKHSKEPSTPETRTAQQATERARNTSSKTQAHQTERNQNQRTEEKENEGGEATESSSDNTRRHGDEDTHTETKHGQTTRRQQQREQTESDQRTQRGTERKRHESARQRGRHNKKKTKTEKPTTTDENKDRHTDRTRRTKDHSESRKEREAKTQPSKKSSGKRAEQGRPKTDKRQEQRKVDEKQGRANTAREKQHGSTHTGPEHGKKSKRDAQQSKETQKKQQRREKSAEKREQQERRRE

SEQ ID NO: 971694 - protein, 189 aa, Homo sapiens
SFLNYSQKAAGNQKGSCRSRVLKSIKTTTEQLKQSERERERETRSNIGHWVLSTRFSQSSSGNWKAKLLLGKHWSSQYTGRGSLSGLRPTEAGSGAVRLGGCTAALSRRGGFGPFFHPIHPFPRKFSSLTETRGLCAGCALSPRQRGLGHNTRATGQPQSRNPGGDPFLHQPGGGRMVNRASTSHFPSP

SEQ ID NO: 971695 - protein, 278 aa, Homo sapiens
MWCLPDVSCVCSCMMHCLARTPVCSIQTVTMHTCDQCNVMLVITHFTLDVVVQELTWSNKRGHDVNTRYITWVQANEHSYGPYKTTKSEGMSQTITQASVGVSHELVVRDQNGMAWKGSPSQEWCRFPPLSYQFECRVVRTNWRSKELSWQGPSELHTKMFKFQNPMPSVPPRWFSNAGPQRHIGAQYPEGDTQRPKILNNVTLFDQPRGSVSWASQSAGRDQYPRGASLDTYPNNDYRTRCTTPHVCEERPPTANQFPLRVGQSTQRQVPYRVRTPN

SEQ ID NO: 971696 - protein, 259 aa, Homo sapiens
MFVGLRGQLKFIWREKRGTGGRRRTLKHKFGFFIYPQGLWVPRGGPGVVAPNVGENPFPSVGDAQEGKFFSKTLKTGATGCFPPKSNPRFGTNISISARNFCPLSPQKKNYIDSVSGVANHNEFFTDTNIIRLTQTSGVFITLCNEISLSPLVLPPKIPPPSHNFDSLRGALTNSRFGRPRGGGSPFVGGYPSCGKQVSCSRGEFSLVEALEWRRLTRHYQHSCSRGPCWLTTLSWGEGTLDYGRIACSLSSVILFLVA

SEQ ID NO: 971697 - protein, 295 aa, Homo sapiens
MTLEDMTCQVRDMQSGIYYRRRGTNTGQETTAPKAIITQIQTERKHQRPRTTATTKTANKATITATNSDSNKTKQTPTDKHRTHANTNPQNQHKDTQTRNTTHKQPHKHNKQRRYTSHSKDQEKTKTNMTRTPQKQRRTKPTQQQKQTPQEQRTSQHDQPAQTDTRPKTNKHKDTTNEQNKKDNRTTSTQTQNKQHNTRRRKQTQNKQDTNTPEQRPEGRTHRNGEALRSDTTSNKHEYEQEASTTNGGTTAKNRQQRARNQGEQSTEKKQTDRPATGATQRKGKKHPPDGAIAR

SEQ ID NO: 971698 - protein, 76 aa, Homo sapiens
MWWTVAYTTGGNRPTTFGGPRMTVFTHKGAHGRRQKKWRLNQNNAPGPGPPAIRGKAKRKARKKNPGAKIATTFGQ

SEQ ID NO: 971699 - protein, 99 aa, Homo sapiens
MGPVSSTSTRWRTRQESASETGLQKFTGSSCHKAIYVQRELGLGGRRPVREARTGTAARGKLARGPSPLPHPRCPQFSSSLVIRGWIAGLVRLVGGARW

SEQ ID NO: 971700 - protein, 395 aa, Homo sapiens
IHIYKKREEGERGRGAEREREREKKKGGGGGRALLLVWGGEQRKKEGGKDRERGGGGGEKSGGGGGGGAGAGEGGGGARRGKKGGCVCEREEEEEGERREGRREEGEEHGARGEGAGRRRREREGERRREKERGRAHTHRRERERERGSEEERVSATNREAEATEHRRGAQGEHKKKEERRERERQHERARARSAVRRQREREREEGERKRKRKRERREKHTTQEQHTPTAESRERERQTRTRRGQNDDTKQTNRATERGRETKKKTPESNKRTRTDKEKKKNTTRKRRKEKRKQTESTRKRRKQRRTERKKTAKKSIQKKRHMSRSQGPEHATEVEEASKERARSDENTDDNTTRDDEGRARRKPHPKQQIETKRDDEEEREKEDHNKTRTEQG

SEQ ID NO: 971701 - protein, 149 aa, Homo sapiens
ANTVGYTETSRMATMTGGPELDDAVAYGYTGMRCLLQDGWIFMVLLQRLLCPSDCVLLIPHAWTVGLDALPYPNPNRREYTSKHEDKIEREIAGTRTLLRSLIRVTSVARESAEHIGLFNMHVVSTRYSSSYHKTLTCVSQHTDDCTSM

SEQ ID NO: 971702 - protein, 102 aa, Homo sapiens
MTEKEGEQKQTHPRGARHQHPTTPPHRMTRQEKIYHHPHARGATTAKNRAGVETPHTTQKRERDQQTPSSGKQQREDTTHQRVGRWPTTAENPPPSPPDERG

SEQ ID NO: 971703 - protein, 121 aa, Homo sapiens
MARRQQMARPRRSPLHQWRAERVRHAPGGGPRARGARRAGPPAQPGDVLLRAQGRGPKGGAKKAGRDEAASGATHTVSRRGSRRTKVRQGAGAPLQKPPVHRTQTARTTWATRPGTTEEHG

SEQ ID NO: 971704 - protein, 356 aa, Homo sapiens
MGVLLRSFFPGKCGRVVGGLWVFLSLTQGYGAGWKIILNQSFINQLYPSPSSHWRISRPLQKEVGWSQNGVGGPGVNPQESLLRGVAKDVTVEHYVSLLFLNTCKHRGPSCGEDVSWTRLKVFGENNSRGVLVVQTLHTETGRDISYKCQKSPYIFQHALKVSLSRVGVKLFTYLLLYNISGSSHISRESALGCVTGVLRESREIIYTRLHHVEIGGSMKRGAGAKQKGGTYNSPTALYKNKNAPTGGNPERAEGGTRRQPPAGGTATTTNTSEQTGPQSAHFPKRGREQGVFPKRANGAHRPRRQKTFLSHNTERGKDQHTQNSLTPARNGNSGRNQRGTLLRILVGHRRSSPEM

SEQ ID NO: 971705 - protein, 368 aa, Homo sapiens
STFMVTYNNNATGGGSRPPRTTPSSEDRDVALQNRCLKGQKEDPRAQRDQATAKQEYQEHGRQSSGRGEDRGAPGVAPAPSILVSWRAGAWVPGPSPAREEHQGLSVISGNPWPQKALTGLQSERGRGVHRDRGCRAREAVPGPQLREGWEAGAFSSQTGRGLVVSLSWQLAKGDTGLRVSCKSSKPIESTERQTRGAEAASPTSDRLAHEMLLPGLRDGMDPERAGGLSKTGRQWPGMPIWFGGTLVPPRVPLKGSQTERVERHIQGGPWAFEELGAKWCHEHGEKGEQTEGNAWRGVSSANTPRGGGRKPTKRESKKGADRCVVTPVSDITKRRADSNGECTARHATQHPEAQANTRNQRSRAAAE

SEQ ID NO: 971706 - protein, 107 aa, Homo sapiens
MCSSRGFCGWGFELWVVGFGVSWPRVTRRLLQLQRGVDSCNLRAPAGSKRFSRASGPPEYSLRFRVARHHTWAIHFGYLIQIRRRGFHTQCGGANRRRDHPPLTLQG

SEQ ID NO: 971707 - protein, 327 aa, Homo sapiens
MVAGNWCSLHYWKRHIGWDNIPAPYIIAALNPEAHFSTALLSGPEYFPLQGYGEPGALERWARLAKPVEPQPRHSWLYVVGPLEMCKVANFGAQSKPVGGVPHKRGPQGTLHPRIFLRKNSATFFPSRDHFLGALAGGASYCSYSNFSGHMLPMGCERYSETGSNGEFKTSGAIGSIRTTLPNLAPLSEHRENSANTRSSPILAPLGERSHKQRPKRPGPPSSNSASNHLPARKKVPHTGHPAHRAGPPGTKNITTKRATQAQQREPTKKEQQPTTGVKPEKLAPASDEEPKSNTTKAKQLGINTHNPTSTPESPPCRAQPETTTQP

SEQ ID NO: 971708 - protein, 222 aa, Homo sapiens
RQSWQTVAPPLSYLLIKFYWNTIKKKKKKKTHASVLQLGGNPDSLAGAGALARRTRCGFEPGGGGGGPGPLWAGESRAPVFPNWGKPGRDGEAAGGGECPGFLPGALKFESKGLRAPGAPRAGPLWRRVSLPVCAAAGPCVPSTPVVPGAHASGVQPSPGDQLGPFLLRGRIPSTQVTEESGHCLYRAGKLVLGCNASGCPEQLLSRANVAGVALGNPRRTG

SEQ ID NO: 971709 - protein, 50 aa, Homo sapiens
IYVWSYEQHSRMTEEAEHVNEYCACYDCIPGRTEAGGGKRNILMAERNIL

SEQ ID NO: 971710 - protein, 343 aa, Homo sapiens
MPETNLDPASTMNSHGHYPTQPNYPVQPPGNPVYPQTLHLRSGSSLYLMLQLPTQSSIRPELCAARVLPHDPLPCTACNFLEPLCIFPWPSLVASTGLLRFHNTPWLIIQSVPSIHLAPQLLCGTGAVCTAACHDFGAVVLLAWATIPTSTYLHLPSQMLTQLATPALEPNVLVNSSRTGQLLHGLDQHGASHLNRLTATTGHPSPPANSPHHTLAALSSPPLTCSPPLNPDASLHPTPHLSDRRTPAPALPPASHHHYLNLHFTAPHCYSVSPAVPPPCSALSVPRPRAALSHITDLHYAVKPRHRSPTQSFPPFYIPRFTIYSPQSGAHCDFLPLIQSIHG

SEQ ID NO: 971711 - protein, 156 aa, Homo sapiens
MKQCLAGMTTKTRDEAAGGMIYLALDLGLRGEGACMRTPPSPEAFTAAQEPEFYPIALPGRLSAYPAPRECSYNYVHCSRSWFAFCTHGISAHKYLLDRGRALEAFTSVRKVSGTVESTVASRGSSLDNLNGVLHPRLLAGLIHERNHNIVGHDYG

SEQ ID NO: 971712 - protein, 332 aa, Homo sapiens
MCDQPVPFGQLTCVSYTVHGFLTTITNSKGQAPRVSCLVIPRPLRGRLEAGGIHLQVQEFENRPCTKLWCTTLVSHCNNHQHNIAQAEVGTSLVQSQAHWARPEARQQSTMNPRQVEGSSAAETHYQRHSQAGRTARDEHLSNNNTYTTHRTQLTVNRSARTEGPSNIHNKSTSYTILPLHEMTPWTSQEHGHATPSHVQTSTIIQDLFVQDAEVHLTPQPSWDMCLANPYTPVRASTRDGKELDTRTQLTGDNISSRGPPGYDKTQRTNKRGEYSKRNATIERAYAPTRTEKMEHTPNKQKTQAHQPAKSRTTQTNKHTEINPYRPAAKNK

SEQ ID NO: 971713 - protein, 111 aa, Homo sapiens
LLFCRRLRHQADREDGKRLQRFTCQTCPYCAHHHPQGNECVSSPKLKIYDDYRALVRTTRRALGSTLVELLPGRAGTVGSARVANNSNPSLTISHYEWRFITEHFHCVLSE

SEQ ID NO: 971714 - protein, 386 aa, Homo sapiens
VNTHAPWKLEDCAEDAHSGLSVPRCHDILLVSHVLRSLRPHEEAKVKTSGYVDERAVSILAGAPGCHAMRRAGYLPGVHFPRQMHTGIVDTDLGLVEGSAKISESLVHYVSHIVSWCTQDSDRKHTPETSKSNIWRYTSWKIHVWSPHTSSRWQQAASDPWGNPGSYEQSMYANEGDPYSQDAKAGLAKEGEEFCETGSWGMGNRAGCNCSVTADDLLKQNVGKATRRQSNYGRQQKLGSDGSKHSERRPIRRTRQHTHGHPRAMGEDTPRHYNSACTAQKAHYIRGHQDRDKWDRDQRRTGKGTRTPGREYSGPPRRGTATKPRPSRKKPAHAENRTRRHKADIPQYHRDRYDTPTTSGTAKQQEGTTGNKPKRRHQTQHKEKVS

SEQ ID NO: 971715 - protein, 193 aa, Homo sapiens
MPPRDVAHQANNTEHLTSSDPRVLLVTNYTIATPTTKSPRTHDDPNFIYDRRVPSHGSKTKPPIFTSINRTCCIKLAPHPQQHKHFPPYSVKTIFWAQCHHVAPLLTPSSLPKPRDYTVCYTHRPENNELLTARDKLCPVATTRRSQDETSSSDRTAHNPTFRTHRTRHRTIRCQPLSTHHTQHTRPPAPLIY

SEQ ID NO: 971716 - protein, 284 aa, Homo sapiens
MLWETKNIFAGHFAGCFSQIFSQRTCEGVEPPQEVLTKSLKIKNKKEDHPRKEVQGGVGAARPGRERHPPKQGGAPTGGGGESPPPAPPRRKTHRGVSKNVFSHVCGPQVTHSEWEEECGSVYDKSDAIKESPQKNSLVFSPPLTNYQGGRAIMWCSPPRGGPSKTQKVGGGKTPLRQHYIGGDPRVENAPQCEARGERPNLCGENKTDAASIRGPLCKTFGGPEKYMYTKGGSNNKGCIRRAAHTYWVAKKTPEERRTPPSGGGAQHKGGTTRGFLTTPQKDK

SEQ ID NO: 971717 - protein, 131 aa, Homo sapiens
MGRAESTKEGRAQLKGGLLSFLHTISYKEEALQGGNKAEVFLSPPRSLPLLSPREPMKCYTQQLLNKNAPFTRGGVGEETPLPPQKVAAVVDKPEGLHKVLQGADRLVRLHHNKRGGRGVTTRHWGEKALF

SEQ ID NO: 971718 - protein, 82 aa, Homo sapiens
AEQSAVTVERGASSVKAQSYTGHRGVQEDPASRVCRGSGAVAVSFRERGQCRACASLVVAPGYPEVRRFLISTLGILYPPKM

SEQ ID NO: 971719 - protein, 265 aa, Homo sapiens
AQARTFLSRRPEAESASSDRAPRPLLAPGGPQLGTRFGDSVPSIAGLFVPRPSGLAPGWPGGVWSQGVKAGSSWAKGLRAAPLCPPARPSTEAPGTGARARHRLLTRPRRQASQGPGENLQGQSRGRDPSGNRTSAAPPHQWAGGTPGSWDQSLVQFPPVGEFRSQSHPIVVVPGHPPGWRTDRKAHVRTPRGSERGKPPQTDGYLVRRWFCSTLGEGDIPNVRGDHKTDQTAKDETRPARPESNDKNATSGRLIRTFTCTERGV

SEQ ID NO: 971720 - protein, 514 aa, Homo sapiens
SKSKLFNYHSHIFFIKKGIIAKGSRLRVVYIKKLQVCGGKLAFLIHSWEAGAVLPDISGRKQLCTVCFRPPLCDKIARPVAHTVWHTPTGARQRRKQLFLGQERCALFAPLSFGYCAQRDRRAALCAQEIVQPARARQADRMCGSIPYGARSLHVSVERPHIFTQQRVERAPVCTPGVCVCTTLRTRSESSPPLPPLTLGLCALWRIISATTRGETPRGGATTAHKAGRHYVFISTRNETILSTFLFDRRSPSLVFSHTKHISPTIVEQTQKSVLPPHEGEGGFLSPPSTLCSGDRHNLTSERRRLQQQKGHTPKSTTQPHNQNAPDGPSSWLPHNFLSTRTVHTSCWRSHHLKSRRGRYSAGIRHITTNRAYIYNGYNIFVQARTDKVGAWHLRASNTPKSWSATNTVRHISYTPTTWEGPHKLARTEAPCVVTAWHPPCDAILLRHTGVLPPSCATVLYSPACSTCGVSAPPRANREGVAPISHAVVATTSVASRATKRCVGRNTPSFCVHR

SEQ ID NO: 971721 - protein, 348 aa, Homo sapiens
QADSLMTSSAFDNSQVKDKRDTINGRFQKIKSMAASRRAKLNESHRLHQFFRDMAVHAGSPGIQGSTAQLLVGSSRHYGRAPQLACQHTCRHSKHTAAGNAELAAHAAGSFRVVLDTWTRQLVRMTNTHRGKQADPDSGWRQSCRRHWQQSCKPAGQNAQGSARWKSPWQSSAVSRQMWKQARSLASMQNMHLVAQRRHPGRDSCRHPRGLPARTMDSSLDQTSTAPQGIRRATDVLAPRGTRHSIHDEACTHAGSTSSLHSMTRPERGQATDPERNKKGDPTKDTGQTHRNAHPGHVNYANTSRHRRQMANQHATQGTRRTDGTPEAYGTDTSTRVQTHTTHKQTAK

SEQ ID NO: 971722 - protein, 506 aa, Homo sapiens
IIIIYILLYYIYFYMRGKGAQNADGEEVRIEGATHNTTTEEQGEEERGEWRARREGGGPSRTTNTRQRGRKERRGDVQHTQEEASTQREHTKWRHRENKKRATILITKDTGGETETQRREQRGGEEEERRPKRKNNREGGQRTKTQKREQENTTRRGLTKKKEGDSKKKNILTKKTTRERHGGKTKGEGEGKEREKIEEKERETENNKKKRMSDTHEEHNKREKRDGGKRQEETATAKERDEKKAKEHTNGEKKKGGGMEEKKKEKEKSKKTMREKRSNKKKQKKKEEQRGKKKTVRPKTERGRKTKKKKEEKKKRQNKKKQRRKQKKKKTTNKKKRKIGKKKTKRERRAERQERKTKEKGEQKTRREREETQQQDRATGKKQKIGRRARERRTPETRGEERKGTVQHTKKKAFRRRKTTEDKRDGEAAQQGKGKPTPPEQKQQKAKRTTTKTKHDRQERRNTEGKEKDDRRERAKHSAEDKQKGMQDKIERQPKQEDEQNDTPSG

SEQ ID NO: 971723 - protein, 508 aa, Homo sapiens
YCLYILLIYILLTPLGREKRERRGEEEEGERERERERGRADLSSGNTPQNKNTTNASTKTKNRRERERESEQPHTPKRESTTKRERCGCASVTKRERERERRRASEERRDAQRERVDAGDETRKERVKKTQKRRQEKRDDESRKHNNNIQTRERKRERKKGSTAPTREQKTEEQEEKKSESTHTNMRESRKKQKRVETEGRAAGAATRKSEKNRERKTSEEKDTRHEQRREATKRQQETQTQGRERRRDEERDESEERVDRRKREEKRREKRKRKKRRKETTNEREKEENDEEKKEERKRQAQEEQEREHEKQEPKQQRKKTEARQQVTQRGETKEDARDRDGGGESDTKERKERENTRRRKNTTRNNNKKQKTEKKRTKQRIKNKERRAKDNTTRQGNTTEGKEERKREERRRSTTHKNRRTQTRRKQTQDAEREEHAKKTKQKRATRKQEKEHTREQDRVKLTDERKDKARKEKKKNDTRSERREGRDDTKTKSTRKREPNRMGSK

SEQ ID NO: 971724 - protein, 158 aa, Homo sapiens
MPGGIVLLVKSLRRYRAEMSFSMWYPHPAHEKALHQVLWHHLQTCPHFGPRLRSHMVPCKGAAACTAPGGGVNTRQAGKKPRKRKLVLKRERRPANTPAQAHHCVPVKKETYADNSEKHGMRDKYQNRPSAPQPRRHHHQDRYSASHTNNGNTQGRCR

SEQ ID NO: 971725 - protein, 244 aa, Homo sapiens
MGGLFYPFNTQWGKLQCVGLGHSPLPTFIGHVLCPTRALHNFSHSIFPNYSCITQRRPSIWPITHVGRGKLIPHVKYVAHRTLWHPSNLPNSHTTPWHLRTHSGDRDTNPHHSDQTVTAREATHMEQHRGTIPGIQGARSPPNFRKLPIGRGTLHHKHAPHSTPTPRSLPAHPSVKTGEPHSLHQQAALQQPIEPTTHSQKTAATTITTTIEENQTTTHSPTAPPQPARQPQPNSATNPTNTHT

SEQ ID NO: 971726 - protein, 172 aa, Homo sapiens
MKQALGVGHTKVAPPGVNPLVVRGSPKEPGKKDQHTHGGIHLEGIFLFHPMKSNMATLVATAIFWGTFPKDYFSHPNGNGTRHHNGGPREGMWAHQVFAPRGRFSGDSKVSSSVTHNQELTSCEHPSDRPNEKIFLRENNFSGGRTKRAGDDTTNHDTDDMQQQEATTNNMH

SEQ ID NO: 971727 - protein, 281 aa, Homo sapiens
YFQRWLGGPGVVGPCLRRELKLSSPSSTGAERFRIASACLDELSCEFLLVGPELVPWRGPGLDRISPHGGRCLGILSASTATSGSNTLLCPPNLIGGGHDEPLTWAAVLERLVAHRSRGNTLGYLQHLKRTHSSDPGGNLSYNLLSASQNVGECWNQPFASKTRGHTRGGNGVFQTDREIEENALKGAQEKKFRFTYDLAREGRAQAERQKKIVKDCWAWDKRKSLGIPKEEHIKRHPEARIYLHLRARVRIVRPMYGRIKRPRDYGGPEFHGGTMRQLVT

SEQ ID NO: 971728 - protein, 260 aa, Homo sapiens
MEELDQAPLVSSSDSHPGRSPRSKYQFVREPEDEQEQEEGGRGRHEAEDCRSLEVLERKPARVLSRGPQCPNWALARPGVPPEWDLSGQLTFVPGGGPRGGPRCGDGYPAVCDAGGGARFLGDPAGRGGVRRNWVPRCISRVCMVAAVLSSFQGFLEGTKGGLPGPGPVRTCRPRGYNAQDPYEEILLLGTAAKRRGCPSLAPCLPGQEGRAGPLDSTEHEQLKEKEGTRKGHGAQKGVKRENNEQVGRTEIYNREAREL

SEQ ID NO: 971729 - protein, 258 aa, Homo sapiens
FKNPKHYIGLTNRDILKKNGMLQQLPPGVKGWCPSRNSIAVKSRRLIKNFKGAFIFRPSLRGVFSVLIALGTLQYNTLLIAAGQGYPTFCHRVRLSLKVVAPIRRPSGRATHCVWRVLKLETVYPQQQIRLFPLYSLYLTLIWRRLGETPPCLERARTLSGRPGEKGVSPSAAPGIESARPLVVLAASTVAHWGAAKNHKDLLGYDACPDSKHQVDSWRVDLLRVATSALGRGEPCPQRDKHNRHEYEPPAKIDRATH

SEQ ID NO: 971730 - protein, 120 aa, Homo sapiens
MAILVGNLPTTNPRLCPGTWLGGLYPELPLPLMQESRRFISELLTTPWVLNKEVLNCKIAVVATDTIVAEKNGGPPGFLESSGGGTRKKVRPIKLWPKGDKTTARKSGPPEDKKERHTII

SEQ ID NO: 971731 - protein, 268 aa, Homo sapiens
MCCITPSPSVCVCTNPGLCFCAPHPDVHGFRVLKNLPRGTCAPYKFDKSNVFYTPASRMCLPMCPSGPKISVFVGIRPNKKIFRLVVKNISFYNCGRVYTPERTEASSFLSLGGQFPPAGVRIVRHNGVPAGEKRLPLGLPTIMYRCGGPNAAKCGTPGFGPKTFSNTRDYTTHNPGGVFENLFQGGTFSRQEGVSTRGRPSHGVESLSSGFWSPSHAFYQRFSSLNPWVVANHPHVTRVAQQLISGFIHISFPPEQLSSMWGLLWSL

SEQ ID NO: 971732 - protein, 176 aa, Homo sapiens
GAPVKEGDILLEGSRGQGAGAGGWPFKGKEQPYLDLLLGTAGGGCGPHFFWRQWNSQREGAEGEVYENLGGRIILVSQVCIFGAKSWAEEEEVSISGHSGRGRKHRGGRGCGTSFAWEWCDEFVDEEGGGHSLTGVVWARHKYQNAVGGARRVGEITLPVGSWQLGGLLANFFKRA

SEQ ID NO: 971733 - protein, 30 aa, Homo sapiens
MAERPCNLTSDPTRSTLGIYVLGDIGAGHA

SEQ ID NO: 971734 - protein, 288 aa, Homo sapiens
MQPLFCCATDNTNAATPRARAARNISAKQPVENHNYYNALWCDAAPPTQQPKMCGPRAVGTPPAVKTVVSTHKNAPTRGASQQRVEQQGLLLLPHKTQCSLFFLHTKTKRLFYMHGGSNPQNKLFCGMKTSPLLPHHNIDNYIACEVLAPARLISELLVGHTPIIHYRPSAVVTNPPALAYNNATSPPTDRFPHRWVIKRPPPKTVVAPQSQRASRHSLHPPLYRSHNQATLSYEHNHLLSGPHRCVPTNERESPNHTWEYYRPHSTRNNATLARHPPPVVANNKQQP

SEQ ID NO: 971735 - protein, 450 aa, Homo sapiens
MQSFTFVGHTHSPAWRCKQEATWCKEAKFSLYVPEEDSSNKHISGEARDEGTIYTGSPNVEAVRLEAQAPSVQAFLSPSRGSPRRLSVGGGNAVCGGGRLGCVYGLGDLRNHSHRPAHGSRPCAYVCKNKRVSVGPQRLFLKPHKPRRMCVSTRPSWGVSSLSRADASRALNGRGLEVLGALGHMRPVCAISVGPFSEKIPLGGGTTRETATGHRGAPQYTSYARERTLPSGNSRGGTHRTTRGEMCITHLAGSADLAGATTSPLQKSLHYSPGAHNPLPSKKQRPSPLPPEETAADHGRQQQRAENLWVVRSHAATPTASPGCQPHPHRDGGPEKQLNGGDTCRHQRRHCGVELVVPPGEREIRGGTTTPPQTVDWGATQQHHETKEKKKTRKTTTAVDTTSRDRNREKDTPDTEPAKTASGEQSTLPTETCEHKKAQPSDTPSRAVSH

SEQ ID NO: 971736 - protein, 124 aa, Homo sapiens
YKQGGVHQAGPGHITGGQGVQRSAGPTGQNSVSTKNTKLGRGMGGHMASRSHLTVGRAWSPGKMGWNLGRVQRVAQWSARVHGHLGTPRPGSGVERTRASSKTTKTQNNRGAGARLKRENTPRE

SEQ ID NO: 971737 - protein, 137 aa, Homo sapiens
MGHADIEPPSKCFNEFLRYQAVYDNLHYIKTQSSLDGLARTDDPADEIILSEFLIALDNWQPAEYGTIGTNLPVKQSLTSPIRLTGQHYILKRSTSLACAVIRWGLTALLMCASKHLVRNIAEQPEHTEKNHTRITG

SEQ ID NO: 971738 - protein, 459 aa, Homo sapiens
ARALIAGSVFFLLLPGTFCGRMQTAQQGAHKSTVQGVIIDLTQFVSMTACQAWVHLLVSFGKALYPHTTDGITFLVAISITGAAPGILAYEHNEHTFPSVVIEGTIHASQARQHIPPRGQHGHQAGTSSTSSRVQSAYPTEQQKTSTHLTRTYGDLDMRPDAMRHNDRPKEQHKRTVHTESYPYDDTVTAQTLGQKHLRHTPLGRMITANNATIRTRTVGKASGMRETRRRRRTPAHQEQEHSPARHNKTPRWKRGTGATINYRPRNHDVHKRKSGKRHGEQHKATTHEDTNSSTDKGVRINEEAAPRAATPTLVTISKQRSSTTRQRVQQASHHVGKAIPRDHTRTGGDNTMSNTQATMGAPPEACKWATTHRAMDDAAEARDRSTHSHGKLSAAKEAPKGEQRPHTRGYTQERRYINEDMGAKKQNTKQCRKEEKTTDQHNRKNKKTKHTKNCTTQH

SEQ ID NO: 971739 - protein, 108 aa, Homo sapiens
THFFLLVETFCTVLRQHRATHGLLVAAAISNTVKDLHYNQPPPAEDFSPQTSTQFIQTRLLAETSVVYNGMKPESTIWLNCTACLIYIWLFWCTFELSLICKVKMPTF

SEQ ID NO: 971740 - protein, 67 aa, Homo sapiens
DAKSVKIKKKLRTNVKFSSDAQQIPFTPLVITDKEKAEKPEASPLLPRFGSEGTEMNPDTLIGTVLY

SEQ ID NO: 971741 - protein, 40 aa, Homo sapiens
AAAYYYFTGCKKTTEKIGQFPKGPKNPRPLGLTPLKIVIS

SEQ ID NO: 971742 - protein, 210 aa, Homo sapiens
MVGRNSAIAAGVCGALFIGYCIYFDRKRRSDPNFKNRLRERRKKQKLAKERAGLSKLPDLKDAEAVQKFFLEEIQLGVKSLLASSVNYVEAAVDPSDNMLRGGCADNAHTAPYTSQVSLQANFLSHPPGVSQDGFRDITLSTQFRSRRIVVEVIHEARVLDKIRLSRNRRHTHIVHTIILDRCVQVYAHTTSQNNTNQSNINILAGEKGV

SEQ ID NO: 971743 - protein, 107 aa, Homo sapiens
RPPTTTKFAAASTARVLGAHWGCISVMPVCWGLTGGCISVMPCAGGSLGAHWGCISVMPCAGGSLGAHWGLHKCDARVLGAHWGCISVMPVCWGLTGGSLGLHKCDA

SEQ ID NO: 971744 - protein, 143 aa, Homo sapiens
RPHTTTKFAAASTYHELVDVGLPLVLVNGYSPSITVPQISDDDVSAMDQAVAHLVGLGHTHLGLAIGPRRYVPVQRKEQGLRAAVDRHLEGRGRVTVSNTVFSVDGEARAAVDVLGQRVNALNFGGSNLLALGAIFAARAQGI

SEQ ID NO: 971745 - protein, 73 aa, Homo sapiens
AAAYYYKIRGRVDAWPRTSAAHSTPSLSTLRGLNMERTPGEGQSEFIIDTGGERASGTWDAVELEAVEGRADL

SEQ ID NO: 971746 - protein, 42 aa, Homo sapiens
LVRVDAAASTLARANNSMSVQVSQGLNATAAKAFASEIERNP

SEQ ID NO: 971747 - protein, 129 aa, Homo sapiens
RPPTTTKFAAASTVPFHSCFPFHLTPFHFTPLHSLTFHSVSIPFHSIAFHSFLSTSYHCVTQAGVQWHNLSSHYMSTFHCIAFSSVAFHYIAFHSSQFHSIPLHSTPLHYTAVHSIPFIPFYSIPLHCT

SEQ ID NO: 971748 - protein, 39 aa, Homo sapiens
AAAYYYYYIRGRVDVKLNEAMLMRVRREWSEQSGVSGGW

SEQ ID NO: 971749 - protein, 65 aa, Homo sapiens
AAAYYYKIRGRVDIRFGTRNLLVHGHSQGGAIAYLITAWLRMQQQSGSLPADLRIKTYCSAAPKP

SEQ ID NO: 971750 - protein, 90 aa, Homo sapiens
RTTRDRLTFSSMPLPESRCKVSINLNSISPNADVNIIERRAFASNLRLLIFELVLSIIIRANSKRHSLRQSSEAVGVVPFQTGQGVLSHE

SEQ ID NO: 971751 - protein, 102 aa, Homo sapiens
SGGSLIALLIIAIMPFAGCRPTQAARVTTTTPRACYKDCAPDECSVKMGIYFSPFLFNLLRIEEKQKRTLRTVLSLFFASPSLNTWKLWKLPGIRLERIHLD

SEQ ID NO: 971752 - protein, 134 aa, Homo sapiens
MRLAAEQNGHVAGAALTATTGGHDAHVDGIHADQPPHAKAGDHHCGHGGDDGDHVLHREGAGELVPGRHGDADGEQQRIGHGGAEELVDREGARLEAGGKNPAELQQDRDEQHGHRSRPGPQLLRQGAHEVERH

SEQ ID NO: 971753 - protein, 100 aa, Homo sapiens
CPAMLHPRAQGTPMRALASLPLITDPRVSPLPNRTTELQQARPRRAFKPAKGHAAVRLHTPTHSLGSRARPFPSSVERDQTRGPAPAQSAAPSEAGMQAA

SEQ ID NO: 971754 - protein, 79 aa, Homo sapiens
METKAGQGGPRGRGFFIQVGDLLVKSALRFQRPIPPKKPVGVHVSLCLPGIRRRMWRGRAGGSQSHAGCVVPRVSPEGG

SEQ ID NO: 971755 - protein, 164 aa, Homo sapiens
GRRRARAKPFLGQYSPFLGTACPLRPGHPGSRAPGPSPAGAPPHPISAPGAEPPVSAAGPRAPQRHLGAGRRLPPSGAPPLLRKDSGSPQFSRQPDPPSLGRRAALRIPSPPPVPPRGRTGSEERLGEGAQRRPSPGLGAGAEGVRAGAAGGQGEPGDGSGGRP

SEQ ID NO: 971756 - protein, 127 aa, Homo sapiens
GCLLAEWHWRAREVAPVPGRRPEDTDALPARGIAPAPGEGPAPLGGGTGARRTPDDQDAQPAREVAPTPSEGQTTRMPSPPVRWHKRPAKARRPGCPARSWSGTRGWRRPSPLVKWHRRPAEARGPH

SEQ ID NO: 971757 - protein, 182 aa, Homo sapiens
SFAGPAEVPRRLCPEGVHPNNRRISGRHSQAQRTPGNPKEHKRTLKWGRTLSCGERAGGRVTEGPEPHSDQALSTLTSPGPGAGDRQRRPGQSLPFPLPVPSPASTEANSGPAPELPPGAPSPKGGSFLRSPALGRRRRGAAAAAPFVEELLEQGRGHDAAAAAPAVALGGPAAQRAAGGGG

SEQ ID NO: 971758 - protein, 109 aa, Homo sapiens
GHPQPGARQQVPAPERSMHLLVGGTSLTLRSTPPTFICKAAVRRLRLTLGPARLLSASSAATAQARPSGSRQLRQPRGAAVPVSPSDAYSPDDLRSQTPGTRARRGVAA

SEQ ID NO: 971759 - protein, 52 aa, Homo sapiens
SVCEELGHMSSVTGFSYDLFIFLFIIFIIWIAQGVVSVCIKARVVAGVDLAA

SEQ ID NO: 971760 - protein, 66 aa, Homo sapiens
FGETTMNAEIVRVNNAAFSWHPEQSGWDTAQVVSHRNEPWFTSDDCFVALAPGDGSTTFGDAGAVS

SEQ ID NO: 971761 - protein, 64 aa, Homo sapiens
KPHATRAHGVSMCAQCVRDRTKRAFLIEPPKIVVKVLKTQAQSQKAKEKNETFLSNKNEKTLEK

SEQ ID NO: 971762 - protein, 36 aa, Homo sapiens
MSPTAYALMLLTVMSSHLQRTQSHGECHNKETCSVD

SEQ ID NO: 971763 - protein, 52 aa, Homo sapiens
GHLMQNQIGAPPPQQNFSDPKKKAWLFQIITIVAVVSLGWYLFNNTQTNLQS

SEQ ID NO: 971764 - protein, 177 aa, Homo sapiens
EVKPHPAPPGVGRNGCFGPQGSGPGMAWAASPTPSSLSFPASSLHRPHTCRHRERPDQGVTLRRVGPHLFPYLKGKEAAAPAPGPDPAPGECARSVHGAGRVSDVLESAAGTMQLLVRVPSLPERGELDCNICYRPFNLGCRAPRRLPGTARARCGHTICTACLRELAARGDGGGAA

SEQ ID NO: 971765 - protein, 43 aa, Homo sapiens
PNTGLGHNSMILMIEAQVTYILDALQQMQRHRIATVDVKPTVD

SEQ ID NO: 971766 - protein, 88 aa, Homo sapiens
VDNVSKMNSVCLIILGTVILLVGLFMLVGGGYLITLGGSWYFAIAGLGLTLSAVFVIQRRLIGAVLYLVVFAASIIWSLWDVGFAFWS

SEQ ID NO: 971767 - protein, 34 aa, Homo sapiens
MRPPQQANCLCLLSFTTEQVTAAVPACVMLCFRR

SEQ ID NO: 971768 - protein, 46 aa, Homo sapiens
LLLNRLIARGNLVNVTSLFYLVPAVTAVMDYLICRRGREFSSSRGP

SEQ ID NO: 971769 - protein, 140 aa, Homo sapiens
RTELYAMSRIFQQQVVDALKFTSFSQPQGVPGYPWAKIPVFDPPQKDDLYPNRALNFDGLYEQPHDNYHGWIGGDMADNAYTAFDPVFSSYHANIDRMLEVWIRANPAAQYTTQCLLQPFAGSEASTVTFTSADAWRYSR

SEQ ID NO: 971770 - protein, 174 aa, Homo sapiens
IIGKAHADIVHVPARPSRVLNKSFPNQKWALKEDLSGIAEMFKTPVKEQPQLTSTCHIAISNSENLLGKQFQGTDSGEEPLLPTSESFGGNVFFSAQNAAKQPCDKCSASPPLRRQCIRENGNVAKTPRNTYKMTSVETKTSDPETEPSGPVSFCKQVRKVGRVQEYSEGACAK

SEQ ID NO: 971771 - protein, 101 aa, Homo sapiens
PGSCSEDSIYGCDVGNHPLLSMGEVCDRQHLWTLTVGAGGVTMWAMGRSEVLCPREWQVCKMIEDPGQIKFDPKSPAQIRIIRGPFDDDLSGLPAVPTDYK

SEQ ID NO: 971772 - protein, 191 aa, Homo sapiens
MQTIKCVVVGDGAVGKTCLLISYTTNKFPSEYVRAVFDNYAVTVMIGGEPYTLGLFDTAGQEDYDRLRPLSYPQTDVFIVCFSVVSPSSFENVKEKWVPEITHHCPKTPFLLVGTQIDLRDDPSTIQKLAKSNLKRIAPDSVEKMGGPFKDVEYVECYALTEQGIKNELGEATVGAVERGERKECRRCASI

SEQ ID NO: 971773 - protein, 78 aa, Homo sapiens
NKQKKNQTKKPKNKQETKYNPPPKTTRQCTWLVHFTAPDATFPDGRGSRQASMHFMWRQLAPPVASCSAGRPAPTIGP

SEQ ID NO: 971774 - protein, 71 aa, Homo sapiens
MLVLIGKMIYSRESSLSACTSKGMKHSIGRLTLGVCSLMVSLRILVVGLASSASGLGSRPGLQQVGHRYPS

SEQ ID NO: 971775 - protein, 91 aa, Homo sapiens
MKNGQNRPNEQAASGARYLAREQKGEFANMDVTAVPINGHRYSQVKTLKVFSNQCPLHNSAFQRKHPSNKIKQILKEWDHYCILSAQINQE

SEQ ID NO: 971776 - protein, 68 aa, Homo sapiens
RSVLRRLPGLLIGVVRLFSFQGLFWTGARSVLQPQVLLAADPQGYGVGECEKVGLQTLEEVLALGIPL

SEQ ID NO: 971777 - protein, 170 aa, Homo sapiens
ENVKRRVVVTTNVRGRDLGTFVTEARERIATQVKLPTGYWIGYGGTFEQLASAAKRLQVVVPLSLLMIFGLLFMTFNSAKDALVVFSGVPHALTGGIAALWLRDIPLSISAGIGFITLSGVAAVTSVVMVERNRDLRAQGMAIDEAIETGALMRLRPILMVALDASLGLP

SEQ ID NO: 971778 - protein, 31 aa, Homo sapiens
CIPTITIITSTTISTTNIIIIATNSFAHAFS

SEQ ID NO: 971779 - protein, 59 aa, Homo sapiens
YLLEKEAERERNRQLEREKRREHMSWRGTGREREKGSGTVGTDDRRKGNGTDELRQWKW

SEQ ID NO: 971780 - protein, 74 aa, Homo sapiens
RRLNAHQERVVPVHVVRRQHVLAYRSLRMSTSHFMIGVEGGLADRARFHTQEGRLEQRLRTPEPLIANGDDLAI

SEQ ID NO: 971781 - protein, 40 aa, Homo sapiens
MLAMHESQQDYSKGFWREVWWCRMDLDVIMNAVNLLRIVT

SEQ ID NO: 971782 - protein, 51 aa, Homo sapiens
ECWGTALLVSRPDCRALLLFMRSMQAAGEAKVDEVSIDALELVLLLLQDEH

SEQ ID NO: 971783 - protein, 80 aa, Homo sapiens
GVTGYTYWQGEQRKEQAHQTAQTFVEALENQDHEQLSAMLSASSLEEAAYTREEVVERYETIYGGIGASEFQAADIRLAE

SEQ ID NO: 971784 - protein, 44 aa, Homo sapiens
LPSVLCGIAIPHIRELTQWLDVGGCWLGKSCACVAISVTPMGGH

SEQ ID NO: 971785 - protein, 45 aa, Homo sapiens
MEVSVTTLQATYQAVYSSRTWSSSTPSILQQKEQAGVSSMEEFLR

SEQ ID NO: 971786 - protein, 38 aa, Homo sapiens
MLDRCAVMNDGTGPVPEECSAAKAWCTKYGVRYSIFKR

SEQ ID NO: 971787 - protein, 66 aa, Homo sapiens
VAVSRELTDSVSHNATGLVSEFTVRQMSQSLIFRSVSMFSGRMTGSTGKQLKMTPLSTEYQKSLEG

SEQ ID NO: 971788 - protein, 84 aa, Homo sapiens
VSKIRDRCVYLLRQKIVVCLDLHSTLGSITSLAYGGGESVDQVVYGVLMVKDNTIYLEAKLYVLIPREIEVLITMTDELEDTGI

SEQ ID NO: 971789 - protein, 42 aa, Homo sapiens
RILESWCCFSLFPVDTNCASRCVDLLFPVGVVIGQLLASVQD

SEQ ID NO: 971790 - protein, 41 aa, Homo sapiens
MKLTSCAKKLLVLAGTVYNICRFRYQEAEMSRKQHFTNSLV

SEQ ID NO: 971791 - protein, 37 aa, Homo sapiens
SKTLATRSRLHSLTRHKHWQSLPAVAIHCHEAGGNPK

SEQ ID NO: 971792 - protein, 96 aa, Homo sapiens
DVEDPGGDEDSAELQASDRVSEYTVSVVALTRMICESQPLWNPDPQLIPCTNWTKKFTQCHTPQALSAHVDTHPIFSIIWIFDVRGDPPSEKTWNQ

SEQ ID NO: 971793 - protein, 40 aa, Homo sapiens
MAWIPHCYGCGIGQRLQLRFDPYVWEPPYATGAALEKAKD

SEQ ID NO: 971794 - protein, 56 aa, Homo sapiens
TGRAVYPCSVWKFPARVKSELQPPAYTTATATSDPSCICNLHPSSRQRWILNQTAL

SEQ ID NO: 971795 - protein, 37 aa, Homo sapiens
EDRRMSQWILKTLYVYLQRMDTHEDASGTEAGGHDHV

SEQ ID NO: 971796 - protein, 60 aa, Homo sapiens
DSRVYDGSLSALCVPHENGYTSSDAMPQYMATLLQASGGSCAGSFLVCQQDLVTPIVAYC

SEQ ID NO: 971797 - protein, 56 aa, Homo sapiens
LTYALLELVASLPDGVHVHMECVRCHPTSLKKLTMDGNGRSPPRKSSQTYIHAQVA

SEQ ID NO: 971798 - protein, 122 aa, Homo sapiens
ANPVERLLQKYIRKTISVGKRTTIAASTSMLVLGSRSSHSDSSELFVSLMGSMRKGEEREIVRTQAALAREQGELERSTDNGKSGREKRGAVKVGCISPSAAACSFREEEAGIVYSRSSHRK

SEQ ID NO: 971799 - protein, 126 aa, Homo sapiens
AADQDWRQSGSSEATLVNMLNISPFSLGLVIQRGVRQVAASTTREVLDITGNSAFSLPGGCPQVLPCVVSCRWATQSVASCTPIHIIKRCTKRCPWPLSCERRDYTFPILLKSVKAFGVIHRALCG

SEQ ID NO: 971800 - protein, 66 aa, Homo sapiens
GPVRDHRPPESISPSFDFAPAKHEIMVAPDIDYFLIVIQNPPEVAKGRPEERDVLKDEARRGGSLL

SEQ ID NO: 971801 - protein, 73 aa, Homo sapiens
TFLYVWLGRFVATVERACGRQVCWLGESVWPAASDLCMVLIVSRAEVFWDFSRGWREPVVLSCGSVRVGKSKP

SEQ ID NO: 971802 - protein, 68 aa, Homo sapiens
EPSLRCCLGHTVFPGFATVMHKEIIVLASMHDADQDQFAPPERKSSVWIGGSFLSSLSTFLLLLINRQ

SEQ ID NO: 971803 - protein, 86 aa, Homo sapiens
PLHLPVTNGKCVILTEHLTTPALADSLHMSTPIRLVVVKYAPSGFYIASGDVSGKLRISVYHAEQEHLLNYEYQPFAGKYQRLCLD

SEQ ID NO: 971804 - protein, 102 aa, Homo sapiens
ALYSRVGIDEWPWARSLSSPRCSQVLGNPKSDERNVMVLDFELFLPMLQTVALIKDQWHLGAIMSKRLRVFDKVGNCTVVGAEIRHVLVTLGDKMTGRWLGV

SEQ ID NO: 971805 - protein, 69 aa, Homo sapiens
SRGSPSVSRCGDVTEGPGPEPYQRRVAQGPGRIPTRDEMNVKVLDFDHFLPMLHTVATNNDQATYYDYA

SEQ ID NO: 971806 - protein, 109 aa, Homo sapiens
MSLFRLLFIVSYRMTGTGCLSRPCYAGWCPHNTSTVMVCHCMVLGVVVTGAEDMHTATLRYCYQEVTSVTLYVNRLHIYLLNIITYNDLECDYLRISKPSTVKVATGVP

SEQ ID NO: 971807 - protein, 50 aa, Homo sapiens
RTLMSYHCLYRLSADEMNSISRVLRCTLRLQLNNPNMSDMFAFLTSETGS

SEQ ID NO: 971808 - protein, 205 aa, Homo sapiens
LEKCILGWDNAGKTTLLHMLKDDKMGPTCSNTTSDIREMQIKTTMRYHLTPVRMANIKKSGNNRSWRGCREIGILLHCGWDCKLVQPWWKTVWRFLKDLEQEIPFDPAIPLLGIYPEDYKSCCCKDTCIHMFIAALFTIAKTWNQPKCPSIIDWIKKMWHIYTVEYYAAIQKDEFMSSVGTWMKLETSSQQTVAGQKPNTHVSLI

SEQ ID NO: 971809 - protein, 52 aa, Homo sapiens
VPTCERKVELGVGLAYWADINYNYGKCTSCWASYRGGQVWLLSVYQMLDILY

SEQ ID NO: 971810 - protein, 33 aa, Homo sapiens
MNVPESEEQDSTQATTQQAQLAGSSLKLMNEPV

SEQ ID NO: 971811 - protein, 30 aa, Homo sapiens
MLLLIGHSGSELQRIMCRCSSRLSQLMQFA

SEQ ID NO: 971812 - protein, 49 aa, Homo sapiens
LPYHYWWSSRLGLALLFDTFACDMTNSMFLTYKSVSSIPYSSLSSWWEL

SEQ ID NO: 971813 - protein, 37 aa, Homo sapiens
MNTLPYYTCCPRYDVGVYSVPKAVAYLHSMQPKALIH

SEQ ID NO: 971814 - protein, 34 aa, Homo sapiens
MYKLEEQDSTQATTQQCPAGWQQLKLIEEPVSKC

SEQ ID NO: 971815 - protein, 67 aa, Homo sapiens
TGNTIVKSVPELEDQDTTQENTQQAQLAAAAEIEEEPVSKAKQSRSETTARKAMSKRGLRQVTGVTR

SEQ ID NO: 971816 - protein, 67 aa, Homo sapiens
SGCSRGSQHCLSLLYTWSVLAAVICVAMSLSQVLDLGLPVPADSTGGVAWPGMEAWHGLVVGTPLLD

SEQ ID NO: 971817 - protein, 69 aa, Homo sapiens
MWSLLLPPQPRTPTSSTTSYFRSFRAAYSSTFSFFSFRSLALNSAAASRLISDMVPGVRGRGWRGEARR

SEQ ID NO: 971818 - protein, 48 aa, Homo sapiens
VRKSSTPEEVTKRKAAVLFCLSECTRRTIILEEGQRKILVGDVGQTVD

SEQ ID NO: 971819 - protein, 37 aa, Homo sapiens
RVGLPLISVRLGRVDHAVEQAPVPVPLQIAHLAAWEE

SEQ ID NO: 971820 - protein, 36 aa, Homo sapiens
VGEAPDEESAYVAGEKSQHFRQDVIVSIDRLVRRGF

SEQ ID NO: 971821 - protein, 53 aa, Homo sapiens
MACRLSSNRSLRSIGGLQLVLQLFQLASIISSTCCSRARLDYLQLVDTLAPHH

SEQ ID NO: 971822 - protein, 39 aa, Homo sapiens
DVGLVIVGASQDGLKSSKCGLQGLHLLLDALQGGSQVLG

SEQ ID NO: 971823 - protein, 47 aa, Homo sapiens
FLLEVLEGDVYETRDSTASGLSRISLYVDQHLAGSGPVPHLEGTGSH

SEQ ID NO: 971824 - protein, 51 aa, Homo sapiens
MQLQAFYCNVECQKEDWPVHNGWEMFSHVLFFGGNNLCKSLRKIWEDDLIA

SEQ ID NO: 971825 - protein, 46 aa, Homo sapiens
SNLSFPDMPTLDTSRSASSVSQHCGESCSGLMCNLRKHRVQQDHEF

SEQ ID NO: 971826 - protein, 71 aa, Homo sapiens
VHLLFNSSSSSDHLVLGVSSLSTTDESPPASDKASVCLGNKACLIWFVFITFFLFLFFLRILHQTWFQVPT

SEQ ID NO: 971827 - protein, 75 aa, Homo sapiens
MWTQCDEISICGYVDIAIPCKNEGISLSVVRCAMDAGVGKFCAWVAPFPVNTHGRSCLICTSTEILQCSLKKKDA

SEQ ID NO: 971828 - protein, 51 aa, Homo sapiens
MQCHTMGHKIHQNDICIIHNFIKVLFVSNNGGSIYESDRAVTCNACALGLS

SEQ ID NO: 971829 - protein, 65 aa, Homo sapiens
EDTKTVDSSERKEYGRGHQSPWAPYHSPDLNLRLGTPTWDLPGKRRGVAEWAADRAMLLHFGPAQ

SEQ ID NO: 971830 - protein, 70 aa, Homo sapiens
STVIMTGFCLSSTQHQDLRTNGTDVILSSSFHLDCASIWSGGISIQAPTCHVRLSTGSHASKLIETRMPL

SEQ ID NO: 971831 - protein, 45 aa, Homo sapiens
SSYPTLQMLVYEVKEGLCVDIMHLPFLESMNPELGNETKCQELTG

SEQ ID NO: 971832 - protein, 69 aa, Homo sapiens
HDAPRSSWLAVTFQQMWISKQEYDESGPSSRPPYSASRRTMTYVALHPFLDKHLNLRQKTQMTIGTGFI

SEQ ID NO: 971833 - protein, 56 aa, Homo sapiens
LTRLTFGEQEHNLTGSFWNDSFARLSLTYERVFGTTVTFTFLLANQLYPVSCPGTG

SEQ ID NO: 971834 - protein, 59 aa, Homo sapiens
RYPHAKILSGEDSPDGLDAGDDLAGDDTIREHICLFIIGLISENLRYIQNGEPTTASFS

SEQ ID NO: 971835 - protein, 58 aa, Homo sapiens
MRAQIHRHAVCFVGRLEEDSSHRQDMFILSDGEGKIWNQSNGWRAPWMNEISVNSGKW

SEQ ID NO: 971836 - protein, 34 aa, Homo sapiens
MSKNAIPLPHSTVGYIAENNEEIASLARGIFKVT

SEQ ID NO: 971837 - protein, 36 aa, Homo sapiens
MEQRSLIFDILLADISQNKEISLRFLSLSMCRNLHT

SEQ ID NO: 971838 - protein, 55 aa, Homo sapiens
PALFASSESAADLYLWTYAPAPGADRFQIYYKSITSSSSSSICLCIYPPQTTNVL

SEQ ID NO: 971839 - protein, 72 aa, Homo sapiens
KVEQYDVKSWKPVATKNVDAVNAVEKWLNGETSNVTTERLLGVVKLEHPAKSCNYSTCLTLFAFRLVLLLDY

SEQ ID NO: 971840 - protein, 88 aa, Homo sapiens
DVDRAACLHPCHWPVISVPPGLEKPLRDGCFGLTVHQVNEDRTSSSTPFVLILINFPLVINPYKLISSTHCKLVGIGRIHIDSYRGTE

SEQ ID NO: 971841 - protein, 84 aa, Homo sapiens
HKERPPKCGTSRCSIPVEYSDSVYTERYMGLPTPEDNLEHYMNFNIMSRAENYKQVEYLLIHGPADDNVHLQQSAQISKDLDTM

SEQ ID NO: 971842 - protein, 41 aa, Homo sapiens
MWTQRKIQRADFSPTCVHADVRSGHGKVPGLKRWDTDLSLK

SEQ ID NO: 971843 - protein, 97 aa, Homo sapiens
MSPCVILVSYHLARSLHLLVMEESVHLIPPCSIMSMDRKSIRTNTFARRFSQIDPIACASDTCSYYLHIVSVLVKPLCGTGQEADKENDYDGVIMKG

SEQ ID NO: 971844 - protein, 59 aa, Homo sapiens
MTTTTPSLPFKHHQHNHIYHHYHQISTPGPITDLLHTIASNTNVVISTTMPYHCYYVHT

SEQ ID NO: 971845 - protein, 49 aa, Homo sapiens
PLVHIEPGTRAVLYCFLDCKNPFRQSSRQSRRFFCRCAFFRALRATYAP

SEQ ID NO: 971846 - protein, 34 aa, Homo sapiens
KSVDSATGRTITLEVEPSDTIENDGLTSQGLHED

SEQ ID NO: 971847 - protein, 44 aa, Homo sapiens
CVESGRLGILAGKLTLQTSRWFRSPYSLDQLQLLVGDEISRKGL

SEQ ID NO: 971848 - protein, 39 aa, Homo sapiens
SWGDGKMAARRAFGAVCRRLWQGLGNFSVNTSKAQYPKM

SEQ ID NO: 971849 - protein, 44 aa, Homo sapiens
CVRVPGGLGSWQGKFDPPDLTLVPEPILADQLQLLVETRFLEGS

SEQ ID NO: 971850 - protein, 87 aa, Homo sapiens
GLRDGATTWSVPTPLGPRGSLRGPGQPGEALGGIAEYTESMCLLESELEAQLGEFHLRMKGLAVFARLCVGDQYEICMKLWASGVEN

SEQ ID NO: 971851 - protein, 101 aa, Homo sapiens
AHLTCRYAGSVSPLCTSRTLVSAFRRKLLLWICNPRWNSLKQFAGDRGLGQRHPGIPCKQSPVHLAAGSGLACFLLWPAANGPLTFNQQVTRVTCRCVFPG

SEQ ID NO: 971852 - protein, 183 aa, Homo sapiens
MSVSCCWERQSAALSVSVILERLYGELLTYLKWCVGRVSPGDPSCELTFDVLNKSYVVGMELYNWTIVRYVVVDWKRRGQGQLVLGLWLQGRFFADHPMLESTSMPALTYQAFKDYGHCGLTLNRETDDTLVLSFVGQTRVLMLNGEEVEETELMGFVDDQQTFFCGNVAHQQLIQITPAGCT

SEQ ID NO: 971853 - protein, 37 aa, Homo sapiens
MESSLREDQAEHNKPLTDFWVSATAQVHIQVNGRSET

SEQ ID NO: 971854 - protein, 102 aa, Homo sapiens
VVCSILSMELVSVLGNLLIILTITSDSHLHTPMYYFLSHLSFSDICVNSSVVPKVLVNIQTESKAITYAGCITQMFFFLSICVLDNLLLSVMAYDRFVAICH

SEQ ID NO: 971855 - protein, 96 aa, Homo sapiens
MYDKAVAKVIPELKGKLTGHGLVSPTAKVSVLDLTWRSRKNLPNYDDIKKGVRSKASGGPPSGAFRGIHVTTRLVSFVISTANTHFFNRALSAGYG

SEQ ID NO: 971856 - protein, 58 aa, Homo sapiens
TSMLLNGSYLMDCHLNGCYLNGCYLNGCTSNGWYLKWQLVHRQHPAAIKVTAIEVGYL

SEQ ID NO: 971857 - protein, 33 aa, Homo sapiens
MRTMDEISSESYQWPIDNGYLLIIIGSSFFRLK

SEQ ID NO: 971858 - protein, 63 aa, Homo sapiens
MPATWLILERREVCRLWRHSDKDTRRLEKLSMYINVSGRYVHAQCRTCEASSNSLMHLAQSLS

SEQ ID NO: 971859 - protein, 60 aa, Homo sapiens
LYEDPRYFRDLSSMNQYQSLKNSDSTRGNHTTMPSLAGSLKSDDEPVSNSKTESGVKEKA

SEQ ID NO: 971860 - protein, 55 aa, Homo sapiens
KEARRAREERLQAMREEIIKNFIQGGGDQEIKPPICVCTSWPLCFLRSAIKIKQA

SEQ ID NO: 971861 - protein, 76 aa, Homo sapiens
SVTRLRPAGLGTKKARKRGEERLQAKKEEIITNFIQGGRDQKIKPPTWSVHTGLCNYLDQPLKKTSLIGAYLICGG

SEQ ID NO: 971862 - protein, 58 aa, Homo sapiens
MYQSLNEQDSTQATTQQCPACWHVVEIDEEPVSKAKQSRSENEGTEAYVQMWVFGRLH

SEQ ID NO: 971863 - protein, 54 aa, Homo sapiens
TLVSASLVGLDDLLLLGLWRSSRCWRASLVLALRASAWSARRFLRAFSAGLRSS

SEQ ID NO: 971864 - protein, 39 aa, Homo sapiens
SSLALRRSSRRMRAPCVLDLRASAWSARKHARRCEERLQ

SEQ ID NO: 971865 - protein, 105 aa, Homo sapiens
LTSDYASGARVTHVGGERITATSHRSVELSHSFSPQYGKFRVESRKEKTQETPNNNNNKNNNNNGNNNNNNNKNPKGCMNGFKLSRPGDHGSGLAYISTVNKTSF

SEQ ID NO: 971866 - protein, 43 aa, Homo sapiens
QSAQAKKEEIIKTLSKGGRGQEIKPPTWSGTYWASVITLDQPL

SEQ ID NO: 971867 - protein, 36 aa, Homo sapiens
RGSRGLTRARCTVHAYIISSLKKEMPNVFGKESKKK

SEQ ID NO: 971868 - protein, 85 aa, Homo sapiens
ELRADQVEARRSKTKEARKRGEERLKATREEIIKILSKEDETKKIKPPSWSVLTGPLVITIDQPIKIKQALSGAIPYLALCHYLA

SEQ ID NO: 971869 - protein, 44 aa, Homo sapiens
MISSFLAGRRSSRALACFLGLRPAGLSRVSQELLAGLYLRRGTE

SEQ ID NO: 971870 - protein, 48 aa, Homo sapiens
LICPCLICGANKAGKKLLADQAEARRSKTIDARKRGEERPPGQEGGDH

SEQ ID NO: 971871 - protein, 35 aa, Homo sapiens
LKAEAAGLKTKEARKRVKSAPGQKEEITQDFIPRE

SEQ ID NO: 971872 - protein, 44 aa, Homo sapiens
MARNSPVVILEDQTTPIGITLPFLIKSPSTLTTQSKTPTDYYVH

SEQ ID NO: 971873 - protein, 32 aa, Homo sapiens
MSRWHAVMLAVRRRPGRWLNESAYGFDNTSMG

SEQ ID NO: 971874 - protein, 85 aa, Homo sapiens
MYDMSSLNYTDASPPSTATAPVDESTTYHRSPGSTPTTHFPARLHNLRATVEKSTIFHTQPSMQDGTTPIICPIHNHQRRGRIHN

SEQ ID NO: 971875 - protein, 46 aa, Homo sapiens
ADKAAKNLADQAEAAGSKTKEARKAPVKSASRPRRSEIHQGTLSKG

SEQ ID NO: 971876 - protein, 52 aa, Homo sapiens
HFLFNASNNCGQCNRQPKLAVCPFEYQHLSFLLNFPHYFSRYSVKLLWPSFM

SEQ ID NO: 971877 - protein, 51 aa, Homo sapiens
PDPKDMVLSFDFKRQAGKQQYRMSLRVSAQKQYILECPKQGSDATSISTER

SEQ ID NO: 971878 - protein, 62 aa, Homo sapiens
VKNFLLLSLARSSLCCSAGKLAQPGAGAVQHSPRGSVRPSVVSGPILTACCHMLQSCVLYYI

SEQ ID NO: 971879 - protein, 139 aa, Homo sapiens
RGKILPQKFLPSGVKIGRRMVVIPKIMVAPTTSKMASIITKSIIAIPMATNINNHQGLPPKATKDNGSFLNGPEVVIPNGNHLQDQPPKFPEPLRPLGLDEALAISGLEKGLSNFTVVAIHSMVLLNDNLIQGAWVVKG

SEQ ID NO: 971880 - protein, 108 aa, Homo sapiens
MAKATQLLKEAEKESGYRSASTANIFPDSPGGTSYERYDGYKVPDGCLDDWHPSEKARYPDYLAKRERCKKRRRESGDREVKQLQEETPPGGPLTEAWPPARREGAVG

SEQ ID NO: 971881 - protein, 39 aa, Homo sapiens
TTKNSDEFANTMPVRPPTEKRKMNPRAQTTAQEQNLSRP

SEQ ID NO: 971882 - protein, 107 aa, Homo sapiens
SGRASLSLLPVLHLSSCSSVVMRGIVVGFLRRPQEVAGASSQILNSQVVATERDICDAVEHSQTWSILHVSSTVAEIFSGLLSGLPYSRTRQRTLIRVQEHKLSTSI

SEQ ID NO: 971883 - protein, 42 aa, Homo sapiens
LLMLFKRIPLQRLNYRLGGGSRAECEILTQEHHNIAPKGRAE

SEQ ID NO: 971884 - protein, 81 aa, Homo sapiens
MEGPNSSYPCLLIHICCKVDSEPRIGPADSTRSILRSGGAMILISIVLGARAVISFGIPVAMPGYIVLPPDSTVGNPLKST

SEQ ID NO: 971885 - protein, 127 aa, Homo sapiens
FACDQRIPTYSAVRLELINDVPPSISAPGSYRANGVDAYRPALSYPGALMNPGPLEITGKNNKFPSPPALIFMMEVSYNAIRTGLVRLLGEELKSLVDFLPREGGAEESAIGVGLVTYNKALQVGYR

SEQ ID NO: 971886 - protein, 83 aa, Homo sapiens
YLLGFSCYGSWGCSRWSPCFGGLGGRGRLDGVHCREVVSHGVASRVDPFHGCRKSSWSHTHDAGGISVCGTIELRMNGWRVNN

SEQ ID NO: 971887 - protein, 166 aa, Homo sapiens
KVGNPPGAQSCGTRKTGIIDVVYNASINERVRTKTRVKIGFVLIDSTRYRQGYESHYALPRGRKRGAKLIPVRKKRFNQKRIYKIQRNYDEGKRIAKISSLREEQSQRGKLLACFVSGPGQWGRADGYVLEGKEWESYLRKFRARKVKGAVGKGAEGKGAEGKGAV

SEQ ID NO: 971888 - protein, 68 aa, Homo sapiens
MLYPEDPTYSAYIEGSYYLSQSGQCCVDGMLSEQHPPRPQGHTHYCPIPCGHGSRELNQQKWRWSAHN

SEQ ID NO: 971889 - protein, 49 aa, Homo sapiens
MLIYPRVLLHAMLQYRSADEPMTTFYKCCNAQCGHRCEGLEAEDVPVCP

SEQ ID NO: 971890 - protein, 50 aa, Homo sapiens
PLALSTFYLPSTLIISTILILLDYPKKSAGRPESKAYVSTLSSKALSGAY

SEQ ID NO: 971891 - protein, 70 aa, Homo sapiens
LFNGLIYVITEASMYSHSGRFNSSVSSSLDKVLMISSFLGREALFRALACSLGLRLGGLSRVSQELLAGL

SEQ ID NO: 971892 - protein, 77 aa, Homo sapiens
WVDQAEARRSKTKEACKRGEERLQARKEEIIKNFIQVRKRPRKENLPLCVCTYGASVDNIDSAFKIKTRPNLAGVPE

SEQ ID NO: 971893 - protein, 58 aa, Homo sapiens
LVKSTGDTGLDKVLDIQVVVSDATYLGQLPTCPVKSSVCSSLNSVNSSDSRSSGSHSH

SEQ ID NO: 971894 - protein, 57 aa, Homo sapiens
MNYLDSTFSNLVSASNKGLLGNVLATKFPKYANIYKKDRFFIIIEFPHNLPISQSII

SEQ ID NO: 971895 - protein, 52 aa, Homo sapiens
MMNVFDDFYSSLTVALPPRLLTYWENVSVLVTTYSCINTITTPYYRGHTTIA

SEQ ID NO: 971896 - protein, 92 aa, Homo sapiens
NMMNSKGAEMNKDFQELNYSGIRNESTDLEDQQVYNKIVTCLSHPVNQTLYLFPFKKQVSWINYILFYGCAKFVTGALFFAFSQTIPYQNFP

SEQ ID NO: 971897 - protein, 105 aa, Homo sapiens
SSRMTNDPDSREDIRKQRAQLVTDYGLQPKMDKGKGSQKLHPLEVHKRKRWLGGHILFLSEDRYGQQMKGPAEEAGEGGLGHNGGASPEKHGKACPEPPAMHRET

SEQ ID NO: 971898 - protein, 43 aa, Homo sapiens
PNGRITFIPKKTICPIEAVKVIRVHKVSSFSTKAFSFSARETH

SEQ ID NO: 971899 - protein, 62 aa, Homo sapiens
DGTDPFLGDSGAMFTFGLNQQQYMVSRICEMLSVRLKDALIQTLGTYQQIRLFKTHGFQCHL

SEQ ID NO: 971900 - protein, 68 aa, Homo sapiens
RYVQSIQVYSRHPAEHGKSNFLNCYVSGSSSITTLKIDYTRRMERVIEKRGAFTTCLSDKDLVFLIYL

SEQ ID NO: 971901 - protein, 128 aa, Homo sapiens
VSGEMDNTETRLHVQSGTSRHLVLSRVSSLLLATSFTHRVSRTTEGIRNSKFSKQLQYFQYIVGDYYNWFMARKGSAPPTHRHWSRFLYLASLYFVGPTQTATLRLFSAAISWQDSTSLPIPWLIRGG

SEQ ID NO: 971902 - protein, 67 aa, Homo sapiens
MTSEIWLCGFVNLLKTWRKLELTGLKVFGNEIKLRETNKEKTVRKQRDAMNTFGAKQSPVYRCSNFV

SEQ ID NO: 971903 - protein, 46 aa, Homo sapiens
IAAHEGLRSSSVKRYSEYHSDQPSLSKYSNEDTLSVALPYFWEHFD

SEQ ID NO: 971904 - protein, 43 aa, Homo sapiens
YIYELELVPCDLGHILVAEGALLGEVSEDEGLFSGTNLSFSTR

SEQ ID NO: 971905 - protein, 114 aa, Homo sapiens
CEVTVPPQNTGLGPEKTSGGQASGITTKISRGTIEILSDVQLSKTGGQVGAGEATLLNMLDISPFSCGLVIQQVSDNGSIYNPEVLDITEETLHSRFLEGVRDVASVCLQIGYP

SEQ ID NO: 971906 - protein, 113 aa, Homo sapiens
PVQGTGNGHPGIWRSNSATELTNGKNICQCLVEMGRAKDDQLKVQGFKVLVAHCSLSEDFLAMEENFPSLPGHRFKNLTAGLMVTIGGPLVTGTSGTCLHELLFSRVTGRGSE

SEQ ID NO: 971907 - protein, 71 aa, Homo sapiens
AADDNDKKKLVRAFKKKLAGKGTGNGGIRNIGEVIQLQGDQRKNICQSLVEMGRAKDDQLKVQGFEVLVAH

SEQ ID NO: 971908 - protein, 56 aa, Homo sapiens
MECEHEVKSDGCFRAPVPMCPSRLQVECRAPMGRDGVVMGHDPDPGMSSPLEQGHH

SEQ ID NO: 971909 - protein, 36 aa, Homo sapiens
MSQSVEWRCFYIVHNSAPAIFYGYMLVQQVNRVDWQ

SEQ ID NO: 971910 - protein, 113 aa, Homo sapiens
TGHVTHCVRGPSEDKTISTCPSSCRDGVLNTDGMILVHVLDPCRHTSPCPRWLQPVTSLTHTSGVQLSASPETGFVLLGTGFASLGDQPAFLGDTRGPRIASEEPQNKHRPVD

SEQ ID NO: 971911 - protein, 51 aa, Homo sapiens
LGSSAEALDDLGGVAQLPARLSPIICEEQRSTALLLVSRSGGLCFPQNSPM

SEQ ID NO: 971912 - protein, 44 aa, Homo sapiens
RLVTSCKGSTTSTRGSLMDTSLMHDMSKPSRSPTSGSSSLCTDV

SEQ ID NO: 971913 - protein, 51 aa, Homo sapiens
MISFLSSKPAVIINSPQLRSISKLACGKTDPGTVFVMNKNISTPYSCAMHL

SEQ ID NO: 971914 - protein, 47 aa, Homo sapiens
MRCSRFICSYSTAYMPYFMSPRTPGVAVKGELLTSRWSLARSFRIVS

SEQ ID NO: 971915 - protein, 54 aa, Homo sapiens
TCALVVHTGLAVHLPADVISKQEYDEYGPSIVHRKYFQADYNLVCVTPFLDKTY

SEQ ID NO: 971916 - protein, 82 aa, Homo sapiens
PSNTKRVYMLVCCKKPETEYKDDVTLIKFQNEGNTASEKQSVAEDARVSDAMYQNIPQATHHKPSCAPQRYPRCCSILPRSP

SEQ ID NO: 971917 - protein, 63 aa, Homo sapiens
SLAPDKSNVFPGITNGQQMNEQLSDCSFCSRLTIQKTSCQKHRKEPPPLLTPALVPSAAVPAA

SEQ ID NO: 971918 - protein, 34 aa, Homo sapiens
GGIMSPSRYTVGNGGGAREHGILGIKPGQLLDFF

SEQ ID NO: 971919 - protein, 32 aa, Homo sapiens
LILSVEGTIDSDSLGLKEETVYQEGRYKLWLV

SEQ ID NO: 971920 - protein, 81 aa, Homo sapiens
SIGSPANSGAADSSFLRALDILVKAAQKSAAFEEQENETVVPKEKMSCIAQIIAAQEEMLRKERELEEALKKLSQIRQQHH

SEQ ID NO: 971921 - protein, 86 aa, Homo sapiens
DIRVLLSCKYDPGQGFVHREALQKVQWRGSGATEESPLPTRTPNMKSRPQGLPPFFLQQRELPLLSQALFWRLTLVPGECAPPPSL

SEQ ID NO: 971922 - protein, 79 aa, Homo sapiens
MAGLKHTRISPKDQQVFIPCMTSQTLLLLLRLYSDYPRNDGGNATSKSNLSAAPNSPMLLIEVVAWSPVRLLRQYVRQR

SEQ ID NO: 971923 - protein, 48 aa, Homo sapiens
DKAGDTYFTKKAPGQPGETHSNLIEASEEVLSKSHRKKKSRLVRPREG

SEQ ID NO: 971924 - protein, 49 aa, Homo sapiens
MRANEVCSKAKAVTKNKSTGHYEYEPSTKAPARIPLAPARIPLAPARIP

SEQ ID NO: 971925 - protein, 51 aa, Homo sapiens
GVVIITEQAPLEEYEAPPGPWSLKLVARSGLGEQFWWIKLVEVNGLSMGYR

SEQ ID NO: 971926 - protein, 173 aa, Homo sapiens
IADRVIGECNWIWQGLILDHNLPENSKIKGRVSSQMEAPEMRHINHTNRTESVGPLPKSREDLQLTHNRITKRGSLEGWVNLTFIHLQHNRLKEDAVPAAFKGLKSLDYLDWSFNQKPDGLRVSRSLYKLLLERDQYAPDVAELIGSLMEIGNIRLKVARTYLLDPYRIWSGV

SEQ ID NO: 971927 - protein, 95 aa, Homo sapiens
MGHQPRGDVSDIYKIGEIAAGGAWEVEGKRVSRTEGNMDDSLMGGNASVEGPEGEGPESTVFTGVDMVMNQFTGGKQVFTKEAYKRYFIDYMKPI

SEQ ID NO: 971928 - protein, 101 aa, Homo sapiens
VRDGGRIAHQKVVRLLRPGLDDGKPRLGVPGKVVMQGGMAGVGKMAKYGREYFRSLEELVSGMYRIYDMENVRLGHHFTNFQDSIQYVQKNAGKLTTTMGK

SEQ ID NO: 971929 - protein, 82 aa, Homo sapiens
GVSRQLCNYEGGFSEFHSRYWLNWNLVFLDSVLVNSKISLMVSSFSLLAGGKLAVSGVIMPSLGLRAASNPGNWLAVLQSHR

SEQ ID NO: 971930 - protein, 95 aa, Homo sapiens
TDPLLYDGRKLQRTTCTALSYLQRSLSLYTLEAVTTLSVPPNYRDIMVRHIWYKGHFKSNYMVLPYFKTWMSQRGVKYVRRRCKVSVSVCYESSK

SEQ ID NO: 971931 - protein, 164 aa, Homo sapiens
KRQGRLKKMNLGSLKATIEDMRFKAKRKRVLEHQGQVRLGMMRHLYVVVDGSRTREDQDLKPNRRTCTLKWWEYLVEEYLDQNPVSQMGIMVTKSKRAEKWTELSGNPRKHIASWKEAVDMTGQGEPSLYNSLSRAMQTLKHMPGHTSREVLIIFSSLTTGDPS

SEQ ID NO: 971932 - protein, 73 aa, Homo sapiens
TNRLLLEGYEAPPGPLSLKLVARSVLGEQFWWIKLVEVKWQSIVGVSKSQLWVLSYVCIQYMLKATSGSQSTG

SEQ ID NO: 971933 - protein, 84 aa, Homo sapiens
LTIHILPPSSFRKKGSWQRQKGGGVGIIHHLQVYHPGYPGLGSQASRRDALRGNRGKVKGGSHFTDKEAFLTFFPSTNNSLHGQ

SEQ ID NO: 971934 - protein, 49 aa, Homo sapiens
TLETRLPLPKSTIEAEPNQSFQGEGRLLLVHNLPQKSVLANIWVTKCAN

SEQ ID NO: 971935 - protein, 169 aa, Homo sapiens
EKYMEYLDAVTYSGDPAPGPDPFSLMGESTINWWVTIQGGVVLLQRVKGSNVDFQSRKGKTDIRIGKKILLQSNSYVGMREGFYLDGSDTMVCDSNSTGDPPVPKCLKGPRPTYKPPVSNNPGYPKPEEGILDSWDVGVMAVMVMAIVVVAVICVVPYRYLQRRKKKGK

SEQ ID NO: 971936 - protein, 33 aa, Homo sapiens
MIVIVHRASVGSVERMIAILTENYGGKWPFWLS

SEQ ID NO: 971937 - protein, 34 aa, Homo sapiens
GWSDDDVGAFVTARGGSEVANTLERCNWEALYHY

SEQ ID NO: 971938 - protein, 46 aa, Homo sapiens
LCCKHGLSGCSRTLVMVKALYALTGLCQEGLLQKPQVIRNRPDDIG

SEQ ID NO: 971939 - protein, 136 aa, Homo sapiens
MGAKKKKERKKERLAEYRGVNDKRNREGEDIGLCKDFRTKTPKAIVTKAKLDKGDLIKELRHSKGNDHQSEQAIYRRGEKFGNLTTYKGLISRIYKELKQTYKKKKQLHKRGGEGYDQTYVDGSYIQNPSYLILSK

SEQ ID NO: 971940 - protein, 88 aa, Homo sapiens
TYKSSILANSGHPHSEHSVGPGHFIGHTFLWGGHQGYGAIGSSGSVFTQENQGYKEKKAEAKEVGGETIVGEGNRYPLRTRIPLKCVL

SEQ ID NO: 971941 - protein, 149 aa, Homo sapiens
MLYQEDPFSTLSTTDISRLDNLTGMRGDDEGSVVKRDMGFWEATQGFNERYVHTHERVSSSSSKNSRVLLIYHKDNIAGLQSGSWVSFNRECNLRAIFHALVNDELLKFSSLELSSFRGSFYIYLKDGSAPQGPGTPGTQTKGAEGYRS

SEQ ID NO: 971942 - protein, 114 aa, Homo sapiens
MDPSSNISLTPLIKTLSSRQIWGPTTWAAPLAILKAKGFSGQALEIPHLYRGGLVERAAVSKADLANRFPKLASIFISNTGEITKKVSKTMATVTTNIGSTGYPQVGLKVLKGT

SEQ ID NO: 971943 - protein, 61 aa, Homo sapiens
MAYLLWVVTKARCYGLSALVHTRDPGYKRKSRGQELEGEIVGEKPVSIKTRSHQMVRGTEL

SEQ ID NO: 971944 - protein, 71 aa, Homo sapiens
MTLIVQHVLCIRLPGGAGPSPGGGFINGGGSNLKMSGNPGDPPGQDRRSEAAVKPISHSQRYAPGTLRLNV

SEQ ID NO: 971945 - protein, 37 aa, Homo sapiens
MGRDVDDWYCDLRIENGSRVGYGPAFSRCPDTGLSFW

SEQ ID NO: 971946 - protein, 81 aa, Homo sapiens
MKEKVHVDLNSYVQSPGIPFTSRRPLSLHLGFSSSSAIFTAKQEQQRGFWGKKGHTGVGITGNNDMLLEPGVLLEMDPIPI

SEQ ID NO: 971947 - protein, 123 aa, Homo sapiens
ISIKPGHQVLQGMAGFKQVHLEGSKNPFRSQTGSLTFLKKFWYYQGTFHSRFFLRVTVQEDGRWTSKNPMVSSFNFLGLVPFQWIPKGFKKGSQSIQRERGDFLQVSSRQISGSSKANSFLDL

SEQ ID NO: 971948 - protein, 69 aa, Homo sapiens
SVIFTVNTQGPRAFYRHTFLWLVTKLGAIGHLLWFTPENQATREKAEAKSWREKYVGEEPGIPLKTRHN

SEQ ID NO: 971949 - protein, 34 aa, Homo sapiens
MGERDIKMDDIQKWKVRANFIYESLRYQPCREVG

SEQ ID NO: 971950 - protein, 66 aa, Homo sapiens
SDMKQSYVDGSRYTNSTHYDEIELYTLLGIRGKNPLVSWHWIVPLDVYKLPIGQGNLKDHMCIPCV

SEQ ID NO: 971951 - protein, 178 aa, Homo sapiens
MVWALASGVGFKSENGGDRTGEKVTQCYGKGWIAAPDTRSVSWFSRLIPHGKAPYCGGGNIKGNPDGQWVERDIKMDDIQNLRVRETFIYESMRYQPVGSWVRRKALEDDVIEGNPVKRGTNIILNMGGMHRLEFSPKPIEFTLDNMAKYVPNRYFQPLGYGPGGCAEKYIGMVMMKA

SEQ ID NO: 971952 - protein, 68 aa, Homo sapiens
IAISAGSLCSVTHHLTPGIYCPETDNCMETSTDRMMPVTSSAVGSVMSDAAQAPADIEDLVCMPDVKL

SEQ ID NO: 971953 - protein, 45 aa, Homo sapiens
TRYNAHSLPWPPWGLKFAAGRCRACGVSKYKVKVKCRICYLVASP

SEQ ID NO: 971954 - protein, 73 aa, Homo sapiens
TYRTWKRVSHHRLSHTSREGGTGGEGIIQKDQGEQGDDMIKIKGEGCSLFCRQEVSFNGMGTSFPFLAAFMKK

SEQ ID NO: 971955 - protein, 73 aa, Homo sapiens
GVAVFRSNTAEVSLHSSRVSVSSISTAEEILPMVDSFPVSLQGGVWEPAVGPSELAIEAVVQSVNGVVHDDSW

SEQ ID NO: 971956 - protein, 163 aa, Homo sapiens
VNSSGVLKLCMGYHELYSAAAGRLHTIEVRADEVPMPGRRSIRSSVARQQLETEKKRREIVEREKEQMMREKEELMLWLQDYEEKTKKAVRELSEQIQSGPADGGGDGSGHRRSGELPRCVDRMAELRAKEELERQAVDQIKSHEQLAVEAEEYTAKICLLEE

SEQ ID NO: 971957 - protein, 79 aa, Homo sapiens
VVIKSRYEKSGDRVSPMKHGDSMQAVVKWAGSVLPEDEDEKEDQEEEEQEEEDDDEDDDDTDNSDELDTAQLLEAELEE

SEQ ID NO: 971958 - protein, 49 aa, Homo sapiens
RSWLAALGIGPLISHAMIPVEEIGSACSYYNRENGESMRDWISAEETLI

SEQ ID NO: 971959 - protein, 30 aa, Homo sapiens
MSSPIAGSIVLAEYSKTSGMYIARFISTLK

SEQ ID NO: 971960 - protein, 36 aa, Homo sapiens
MYLVQADDAVHILPQLRDKLVRGLVEQCGDVVILDL

SEQ ID NO: 971961 - protein, 93 aa, Homo sapiens
QEMLGTSSFSQPATSTSTGLGLGTSTGTAITWLGTASTGTSLFSSQNNALAQNKPTGLGSKGDITGVLHLIIGLAYGMCGLFSVFLCSSTFFS

SEQ ID NO: 971962 - protein, 38 aa, Homo sapiens
MHFDEPDCEHSFGLDKAPVLLSSVNRRGFGTTSRRDGK

SEQ ID NO: 971963 - protein, 147 aa, Homo sapiens
HFLRLTFEKTKLVVAAIDDSGAVRTSKDVGVKKEERKSPQLRVGWGAQESPFLAVAQQTVSQLLDAQSRKCAPFSQVHRRYWATPQEVVIQDGEELISPPIISFVHVVQQEGNFKIRAEMSVQRPRAQRGDSPWRSPNGVMSKQATS

SEQ ID NO: 971964 - protein, 64 aa, Homo sapiens
VPEDCCNQDFITNVVFQDVGKFLGISQESAPFSWWQGSKNRISIYQPLASLQLYDLDTLLLLQR

SEQ ID NO: 971965 - protein, 37 aa, Homo sapiens
MINMMNRKGAEMVKDFQELNYYWNKERINIDLGPDRF

SEQ ID NO: 971966 - protein, 92 aa, Homo sapiens
LRIAVFVSLGLEISGVVISLKEHAAFKHLFNKAHLALPLIHLTLSGHSTCFREHRVGGQVVGLQHSFYEQEVICSFPAAKILGHLKWLFTLL

SEQ ID NO: 971967 - protein, 33 aa, Homo sapiens
PSPSVLTSRWHPHVLWFLLTAPSDGLSFTHSNE

SEQ ID NO: 971968 - protein, 53 aa, Homo sapiens
MYRNRIFTVSMELRLRSTFCGPLTLVVHTHLQPANFGNFYPPASIVASLRKYV

SEQ ID NO: 971969 - protein, 117 aa, Homo sapiens
MLDTDTSYSGKGLIGNDIATIVFQDRGALPFTPNSIRSHFQHVFVIVKVHNPCTENVCYSVGVSRSKDVPPFGPPIPKGVTFPKSAVLRDFLLAKVINADNAAHKSEKFRAVTELDI

SEQ ID NO: 971970 - protein, 36 aa, Homo sapiens
ILALRERYFSGLIYTYSGLFCVVVNPYKHLPIYSEK

SEQ ID NO: 971971 - protein, 85 aa, Homo sapiens
TQTVVLTLPRVLHVCPVNPGLRAKEAQDVSPEKLAYESLEYPSIFSAKYSSFETEITLAGIEDSARLLLWAPSRLHLLTSTPKQE

SEQ ID NO: 971972 - protein, 105 aa, Homo sapiens
MLLSNRTGSIHALDEQQGACGDTLDGISVAFPPCRRGVGIDSEQTEGGLGSHAGMNDYLVLWDIGIFKLLVGVNGQMVRAMSLEHSVVKKPGSRTGLDGTSLLKP

SEQ ID NO: 971973 - protein, 63 aa, Homo sapiens
LLKASQYLNSVVEHSKSVTVQARYDRCRDWAHMHLHHGSIETLTWLSRNSRRSFHGKPAPEYP

SEQ ID NO: 971974 - protein, 42 aa, Homo sapiens
IADDPVTLNVLYGPDLTQNYTYHITYYRNREKSYYLILFQRH

SEQ ID NO: 971975 - protein, 90 aa, Homo sapiens
LGIKRGAVIATVMKNNSYKFGPVDLLCFRWAGSEYLKLGYVSRYHVKDPSRHVILGTQQFKPDEFASQINLSVYACLAAFNGCRLKSTIS

SEQ ID NO: 971976 - protein, 125 aa, Homo sapiens
MTEASFHSVIENLEMLKYQRRQQQQSWTRRVLDQGDGLSTSVAGVVNGESLEDIRKNLLKKQVETRTADGGRRITPLCIAQLDTGDFSTAFFNSIPLSGSLAGTMLSSHSSPQVLALDSSTPNSF

SEQ ID NO: 971977 - protein, 70 aa, Homo sapiens
MIDNYPDVDGQKVLPKDDIECPLRWKWEHEEWSTDLYDRAVYDQGCEYSITIPPERKPNHWVPADKMYYT

SEQ ID NO: 971978 - protein, 66 aa, Homo sapiens
IYKAKEPHPQAISWVKYQRVHAVVCQFEESYSVGNAWKQSTLLETNSFICIKKCATKESLWLAYSY

SEQ ID NO: 971979 - protein, 48 aa, Homo sapiens
QLIEHRPGIHPGLNSDHVGLYSLNKRTFNSGCTMDCPRSNIEVVNPYV

SEQ ID NO: 971980 - protein, 69 aa, Homo sapiens
MPSAITGLISSLVQFTAIHDHGVADVSQAGCLKVCILDEHKVHDIIVAVTPREGSCLRSVDVLFTTMSL

SEQ ID NO: 971981 - protein, 52 aa, Homo sapiens
SNRYTPIILTTSSGFLSDFYINCVSFVLFLSPHRLVNSCPIIQSSILSIFFF

SEQ ID NO: 971982 - protein, 36 aa, Homo sapiens
REGDAPSRSGSVTVYSRVEEEVITEVEYVVQLRVGL

SEQ ID NO: 971983 - protein, 101 aa, Homo sapiens
IGFSGRLGKESVDQAPETSPGPSVNRRTMLEVKKYNVLMAGKMYTFVIPDKEQCRADWLRGGLPALQPLTATSAGLERYLEKLSSAGYRINTTHRALHKCH

SEQ ID NO: 971984 - protein, 42 aa, Homo sapiens
LSYSALTLCSGVLYFGGRLVVALEVCYGGGLGGGYGGAPMEV

SEQ ID NO: 971985 - protein, 70 aa, Homo sapiens
IKRVKENIGNQTAALNNVGEQCNFEIVRACSGKPCTEAGHTDLVVYLAEHVTKSRRGGLGAPVSRGVGVS

SEQ ID NO: 971986 - protein, 107 aa, Homo sapiens
GDMSHVSDEGAFLNLHQPQQLLGSHGFAAFVPGDPGAFCYTFYGQRLVTYGSTLKAGNGIAYTTKNTWKRHQEYEEEEKRRYKTLMADGWELHQEMSLGRTSSLPPY

SEQ ID NO: 971987 - protein, 51 aa, Homo sapiens
SRGSSDLGRDFGGLTAASDICRQNSWRIGRTLSDYNIQKESTLHLVFAPSE

SEQ ID NO: 971988 - protein, 110 aa, Homo sapiens
DALLASPGGRKKAILARDTLFLGLGGACVHLLTLATALKSTHSSDFSTMVRSRSSSDYITLEYCTSRAEISSRTSLKVRIDSCRWLKCCEEQLAGTRDQRRIVVHGEVDE

SEQ ID NO: 971989 - protein, 113 aa, Homo sapiens
PPTGDLVFRVSKLLLTMQLWPKTELQPREKFGEDLSDNTGEYISAIDLLCCHQKWIWSHDNIIGLVILLIYIKICYCKVELLITESRLESFLSFKCVRQMKHLQITPFLFYKS

SEQ ID NO: 971990 - protein, 130 aa, Homo sapiens
RGRKEDYASILIFVATHDDASCKTEHTVNPKIINAKYSMYIWTHHYELLVAGCHFSSSTQIPHPRWTLTLSRIYLIHDRRRSGIIGRRISYLTEKCSVPPARARDILTLLYPDQWRDRCQASGAARPGAS

SEQ ID NO: 971991 - protein, 88 aa, Homo sapiens
YNHIRGHNQKNHILRYPGQQAALSTPTLLADITKNNIPSTQCKIYRGQLPTGCMILSNTTRLLLALPSTSNPYPSPTEIRVVPISTLD

SEQ ID NO: 971992 - protein, 74 aa, Homo sapiens
MPHHLKHVIALSCHIGVDHDKCNTEVSMMITRWGATFMPQQRLREANTNWIAPELKKLLHQASLHGAEPLMQVA

SEQ ID NO: 971993 - protein, 62 aa, Homo sapiens
MTKEIAAYRAKGTSEAGEKAPWQANRLTEEAHAPEDEAGRQAGKKKHAKMQAGSRHVAYSKS

SEQ ID NO: 971994 - protein, 66 aa, Homo sapiens
MVMEMTASISTQGSGRACESQAWRVAGVNMKELNKVKHEMDFDAEWLFENHDEKDSRVYASKTADS

SEQ ID NO: 971995 - protein, 49 aa, Homo sapiens
CWLLSERRLRLHRVCVTEFGPEVEPEFGTKVEPEFETQLEPEFETQLEP

SEQ ID NO: 971996 - protein, 105 aa, Homo sapiens
MYFIKSFLFYNILIVLVYLIFSFFDPSSSSSHHPPRHLSQVLPGPLGHSSCFVETGEELEDTLSVVIQVGNLTVKEVQAFQTFNFFKGSKVLISFSLFPLKFRCV

SEQ ID NO: 971997 - protein, 38 aa, Homo sapiens
ARYQNTRFMRGTNDNLLAIAAFVSAASLSHGPATRAGL

SEQ ID NO: 971998 - protein, 67 aa, Homo sapiens
IELGPGVSSGVRGVNFSHDSDKYVSTWWAVKPPGNVISVIQYTNSLSRSNSFERSESVELVACTQDK

SEQ ID NO: 971999 - protein, 104 aa, Homo sapiens
TTLYVATEVLHHDPHTSAGAAIAETASESPKKCCRIRPLRSLIYCSTKGSRVSASHSLVPCLLHQVPLGIQLLCLLLQEPHLVDEGGKLVVEGLDLLTLLGPHP

SEQ ID NO: 972000 - protein, 198 aa, Homo sapiens
WLGPRFVVGGVCLAVGQWAGEHCSRSVYAIVRRHVEDVLGCCPVRWCGIPPAAACWGLGLWLTARCPSRGKLVCLSQASTNTEGWPPFVAESPFTANMEVVYREVCGSCSPRLMKNGCFMASSAEIRFRPSNCNSLVEELSAPSLSSRGAWLKRASARYLRYLYVLNSSLDRMPGHVSSVGVPKIRKMILAVLHRGAG

SEQ ID NO: 972001 - protein, 40 aa, Homo sapiens
SSSVPECRRLVFLMWVAKDTDDADNLVQASHTVRDVAGVT

SEQ ID NO: 972002 - protein, 200 aa, Homo sapiens
ARYRECSSLDLMSYYYDSLHGDWLAVRENPTEPGSDGTDEDKEITHDVKAVCSLVRAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKASEKEAASEKQQLVETHL

SEQ ID NO: 972003 - protein, 41 aa, Homo sapiens
EPGAWPVLLQQVGLNVGAHDVLGNIKVDADEFAESGGVLIL

SEQ ID NO: 972004 - protein, 100 aa, Homo sapiens
MSWCVANPVIDEEGEVNGFVGAMREKDGEAECPPCIPPPSAFLKAWVYWPGEDTEEEEDEEEDEVTVTLDQMRKREKLRLPLPLLLHGVFLKSWVYQPGE

SEQ ID NO: 972005 - protein, 176 aa, Homo sapiens
MIMIYRNEQTNERMTAFVSKLEEAKKKKRGCPNVRPGSQRQGWRSSQECAIETMMVLWEECQPWLKQTCMKFYCSVCGSGSGLVGRQLEEFLNQSSPFYFWMNGERIDSLLENEREETHMLDVMQDRIQPRYSIIDELFQDRFFTREPHDTYHYLAFRLPHRRPHFFFPKSRIVRS

SEQ ID NO: 972006 - protein, 110 aa, Homo sapiens
MSATASCASSLEFARQTSNEDVRPWAIMRMTILPSQTQTTQRGSQCCESSIVLSSCIALSWNAISTLLSHSQSYTSSVPQSHNSTFSMKHFLIISDQSESLPLPILMVLY

SEQ ID NO: 972007 - protein, 55 aa, Homo sapiens
YFWMRRLFFGGFSIFKVHSSVLLLMPVRCSWPWISGCACRVPAAPRLAAKTEHSL

SEQ ID NO: 972008 - protein, 94 aa, Homo sapiens
VYLLEEDGDGLPVVVLLVAFLEEELGMASLIGVVLVASPEEVVDLVAAGLLVGVALSEGHHSGSHHQQRVEIAVLPKVMSVLTLLIYELLRVSS

SEQ ID NO: 972009 - protein, 94 aa, Homo sapiens
WRVKYTPSSDFFFVLLRGAGVVSQCTLSCSLGAARGEAPLTCGDSLPLCACVSPSDRHKHCTSKLFRPSRLPLESSSVMMVRMGLRYMPPMQEQ

SEQ ID NO: 972010 - protein, 42 aa, Homo sapiens
NLSLFRICSSDSCTSMKDWPWWKLFTTERLLIEVQLSEEQIR

SEQ ID NO: 972011 - protein, 69 aa, Homo sapiens
CCCTINLSGQKDSGISLETGVYAALCCLEALLLQTVSLAVGDRICCCINGIALDNKSLNECESLLRSCQ

SEQ ID NO: 972012 - protein, 74 aa, Homo sapiens
IRHYYRITYYSTINIQNHNPTTISHLKQDNMTNTLIIPSTLHSLGGLPPLTGFKTKWAFIEKFTKNNSLIIPTA

SEQ ID NO: 972013 - protein, 41 aa, Homo sapiens
MSLSEFLRPRARHFYYLDELVTCIDSTAGRTNWQQKHMLDV

SEQ ID NO: 972014 - protein, 30 aa, Homo sapiens
MDEVQMPHFHAFTPSKEPHEEPQASSKNHT

SEQ ID NO: 972015 - protein, 94 aa, Homo sapiens
MDGDELRTSQQPHQAVMPTMVTHDFLIATARSSCKATGNNTFLLRTRSSYCKSVNGWGLLSANIEQTLTVPGDVLGPKPFPDPALALTEIQLGS

SEQ ID NO: 972016 - protein, 99 aa, Homo sapiens
QSSRYQECRLWFLTPQPKFLARPCIRALAARSTQISYNSCRDRISSALVLRTRSAIAPGRCLDLLSLEAGMVSSITRVVIIYIAIRICPLLVDEVLHTL

SEQ ID NO: 972017 - protein, 55 aa, Homo sapiens
QQSYRFEESFQQYGKVVGAKVVTNARSPGARCYGLSRCPQQKRPQNALTTSTRTT

SEQ ID NO: 972018 - protein, 61 aa, Homo sapiens
RQRAEDGGRLYTWPAPKSSGWGQCCLGKNCFFNSLTTATTITQISLSLYFQFFCCYPATNH

SEQ ID NO: 972019 - protein, 41 aa, Homo sapiens
ASCARVVLVMVILLPKKRTLLSSALLGYYPSKELGTCALNS

SEQ ID NO: 972020 - protein, 36 aa, Homo sapiens
ACMSCMYGRAWRSSLHPCEITALSQSLQPLRKLPFR

SEQ ID NO: 972021 - protein, 123 aa, Homo sapiens
ADQDGRLPLVDVFVTSSLAFTLGGPWRWLLAVPLVSWRKTHEYSPHWASDYTLNSVIWTEAVASSFSNKPPFSQRCPVTSVALSFKEQVEEYLGAKVFYGSEDCAGSPGGSVGAQQRESQHKN

SEQ ID NO: 972022 - protein, 40 aa, Homo sapiens
RTLYLRSPGDSGNQDDGPSGRYHQYQEAISAIAPPPPFQN

SEQ ID NO: 972023 - protein, 33 aa, Homo sapiens
MSQGFMYREGEIGHRYIEVFKSSQEEVRSYSDP

SEQ ID NO: 972024 - protein, 75 aa, Homo sapiens
IVEKIYRVRRHTYRSLVIACCRNVLIEVQHILSPVIPLTRVLNVSGESTEARLFGHSEKTSGRESKKFNTHSGPK

SEQ ID NO: 972025 - protein, 42 aa, Homo sapiens
HCPSEDGLAQEELPVHSQLTKHRWMRCNQWLQRLALGPGTCN

SEQ ID NO: 972026 - protein, 36 aa, Homo sapiens
GEFVVLLGEFVVLLGEFVVLLGEFVVLLRRVCWRCS

SEQ ID NO: 972027 - protein, 73 aa, Homo sapiens
EYHRWSSVGVLQEEVIWVSLIWSLTGVLYIWYGDKSRLRQFTSLSVHLRCSSSSQQGTHMRSQDQQPPRHSPG

SEQ ID NO: 972028 - protein, 45 aa, Homo sapiens
LFVGEALCEVAISLVLSYRQEFEVDRNRPGLLRSETQFTVHYMQS

SEQ ID NO: 972029 - protein, 34 aa, Homo sapiens
MSGDVWEAGQLGKGSTKVEDEALPSKLCPVHARG

SEQ ID NO: 972030 - protein, 71 aa, Homo sapiens
RAQVVCSVVQQDDHECGPPYACFTTFLYVILFAGCARRQVRSNTDTLAVGTRKAMPVSFPFSSGMSVAHSL

SEQ ID NO: 972031 - protein, 96 aa, Homo sapiens
MRSRYCKDNVWSLALAHCVLIIIILTGKSSDVGWRFEAGEALTLFGFLLEAVPFAVIFVTLATISRYMQACMYRACMLPGCTGIQTPPGINYHSDK

SEQ ID NO: 972032 - protein, 49 aa, Homo sapiens
SDFGLAKKYAGRPQPGGDIPYRENKNLIGTARYASIKTVLLLASPDDQQ

SEQ ID NO: 972033 - protein, 48 aa, Homo sapiens
KRSSGVPYLVSDLVLYIRYGESKVLTSTTPYLCSELSGGARRPPDEQD

SEQ ID NO: 972034 - protein, 33 aa, Homo sapiens
SGGVGDRCMNMKVFSRVNEVFYDSNVVGEIASL

SEQ ID NO: 972035 - protein, 72 aa, Homo sapiens
RYRRTFTMGERIGAIKQEFQEPPTKKNRMPLLDDERHFTCRDLISFPFLGPDPHQASFWLAFYLIPPLTTGY

SEQ ID NO: 972036 - protein, 55 aa, Homo sapiens
PSKGSPAATDAQYYGEIGIRTPPQCFTIVFDTGSSKLWVPFIHWKLLDIACWIHH

SEQ ID NO: 972037 - protein, 97 aa, Homo sapiens
VLSNHVDRGAVYSSSWCQEYDVLVAGEFTRVGAGIRHGQSTGVFITMKRGWGSLAGGMPRGVIISAPSTDAPMFVMGVKHEKYDNSLYIISNASCTT

SEQ ID NO: 972038 - protein, 54 aa, Homo sapiens
ATDASSFHPGLWWGQKDHGFEGASTSPEDEYPGSNPQPDATPFHEGLRTFYQLD

SEQ ID NO: 972039 - protein, 61 aa, Homo sapiens
MVIIGGCCHTSSWVTPVMKHGGVSRGGRDDDPYGSPLQMSPSLLHGGEDASGLHDDEFRHH

SEQ ID NO: 972040 - protein, 67 aa, Homo sapiens
MVYAICLVYSDDDHYEFGDDHEEFRHDDDEFRHEDDEFQHDDDEFVVVVHGRFLVGGAICLVHSDND

SEQ ID NO: 972041 - protein, 66 aa, Homo sapiens
ATDAAQNQARFSDHTCSIGISPTLSPQSRSPSLFEVLFSKRILGDSFPSSLGSFKWLEDTNQKYIK

SEQ ID NO: 972042 - protein, 86 aa, Homo sapiens
MCACGIVVVVSEEADDRGFRYDFFMGAGEVVAQASGEQAPPMGSRFRDGPPLRWIQAWISGEPTRRGKSTVDHDVQLKPSDDGEIR

SEQ ID NO: 972043 - protein, 145 aa, Homo sapiens
RYGRLISGYFNLSTLIINTITPMITPAIMTVGHYMIYVHTAETNRTGFELEEGESELDSGFNIEYAACPFSLFFIAEYTNIILVCTLSDTIFLGTTYDALCPEHYTTYFATKTHTSNLPALMNTNRIPPIPLRPTHPPSYEKTFY

SEQ ID NO: 972044 - protein, 45 aa, Homo sapiens
MITSDDLQFASALKAHREAAVHVLFKGSQEHVGVASHFHHISFDD

SEQ ID NO: 972045 - protein, 136 aa, Homo sapiens
MATGPAADSTLKPATGADSPSARAKRDHMVSAGDDSKNIMAKGRDGMRDQRCTGPLIREEKIKEPLMRNVYNIMRATATSSQIGGATDRNAPPKAKIEFAAHPDQRIEKTGPLRRSETQLPSSNMEIWAYRVTVCN

SEQ ID NO: 972046 - protein, 60 aa, Homo sapiens
MRQTGALTVCGGGLQKLLQGPWAHEDVRDTVVLHLQVLVGPRTGVRKGIRAGDHHALSAV

SEQ ID NO: 972047 - protein, 35 aa, Homo sapiens
IALSTPGWVGDVHSGDGTLHLAVDLSRILNEMRDH

SEQ ID NO: 972048 - protein, 44 aa, Homo sapiens
LGCSFGGGFAGGDGLLVVQLIRCDHAEPQLTCAPTVDNGAVLCE

SEQ ID NO: 972049 - protein, 132 aa, Homo sapiens
YSALLLLAPLLGPALLRAIILVPITGRGLRLLSSQSWTLTLLIYELLKSPPSDITKGTSSWLTSSSKSWAELKASRATDSRIRSILQKALLSLPTVCSTYSALTYSFVTLPEEVDLVAAGLLAVVVPADAII

SEQ ID NO: 972050 - protein, 48 aa, Homo sapiens
MGLLSPHLTMGPHSQLIVLVSSSELLRHSLQCSTYLSHSHSPMLCMAT

SEQ ID NO: 972051 - protein, 86 aa, Homo sapiens
MVSKSSGTIFGTWLTRLIRKRPIVLSADTFPDSTSSAYCNTVLRASWMRPDAPPTWCKSLESPITLLGLKQVFMIMVNSDAFSVVV

SEQ ID NO: 972052 - protein, 43 aa, Homo sapiens
MGLLKAYTNFDAELDASNIETDIKTKGVDEVTIVNILDQRAAM

SEQ ID NO: 972053 - protein, 172 aa, Homo sapiens
SPKLTRYDHPPLPGFVLYVNFQQPADAELALDTMTFDVISESHIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEEDDESLKEL

SEQ ID NO: 972054 - protein, 121 aa, Homo sapiens
MYAVAIVREIGAALTQELQRHARTWWRTSRTTYEDEINKRTEAENEYVTLKKDVLLAYMNKVELQGPGQTTTPRDEINFLRALYGEELSLGCRPHISRHNLWCLSMDNNRKLDLDSIIARG

SEQ ID NO: 972055 - protein, 55 aa, Homo sapiens
GVLSQAAYSSMLMHMPKTPGQERVARVGWHMYRGTGGHPTVVQAVHNLILAIHVP

SEQ ID NO: 972056 - protein, 51 aa, Homo sapiens
ANPTSTLGIYFEVVNHAQLPRSPKEAEEPSMFVTHYQHSSYPENCIRVTTI

SEQ ID NO: 972057 - protein, 38 aa, Homo sapiens
AVHELWVSEGTPPSDCQILRLPRDIIENYLYENENKTH

SEQ ID NO: 972058 - protein, 37 aa, Homo sapiens
MYEPQSWDRAGRGSLLHSYTPKMAVIPSTPPNSLILR

SEQ ID NO: 972059 - protein, 35 aa, Homo sapiens
LYQLSNYLRGIKREEWVAPMPGPAMLYGLVGDGEL

SEQ ID NO: 972060 - protein, 31 aa, Homo sapiens
MVEQHISKLKKKQQQLEEEAAKACPSHEKPV

SEQ ID NO: 972061 - protein, 102 aa, Homo sapiens
SDYTALLRWSRSVYPQAGPGPVAGMEGNGPVAVHYQPAAPRGRLVYSKQYCEENIGKLCEYIKNHDQYPLEECDAVFISNGEEDDTNLETTGETLEMDLRSG

SEQ ID NO: 972062 - protein, 67 aa, Homo sapiens
AEFSRDMERSSAISTAMNIQLVHVTLSSMSPVNGLVTTVTSTGACCSAQILTFTLVKEPGLPVQNLG

SEQ ID NO: 972063 - protein, 102 aa, Homo sapiens
MPAAGDKGMSQTGGDEQLCLFVVTLSKLVVENVCYDQSFPISHVRYLGPEQIIFVSVPTLLYLAHVFSVMRKEEHLNKKEEALQVAQTDGVNVDMHLKQYCI

SEQ ID NO: 972064 - protein, 37 aa, Homo sapiens
TASGDGRLYRYPHFTCAVYSEIIRALCSMTVVTAFLA

SEQ ID NO: 972065 - protein, 56 aa, Homo sapiens
FRTNRQDLKRYQSTILDNLNGPAYTKLIYISMSCKRLLFLESGRSSRIDFLRFFQF

SEQ ID NO: 972066 - protein, 72 aa, Homo sapiens
HVYYEQKSEGREGYDQRSHVEKGHSDMSEVVEEGMGTFSRNLQCPLAQRLCLLVLAPFAIEHSQIVECGSHL

SEQ ID NO: 972067 - protein, 41 aa, Homo sapiens
RALSPLDNKCLFKGYDGKKKISTVVSSQEVSKVSAWSYSTP

SEQ ID NO: 972068 - protein, 58 aa, Homo sapiens
VVLKTKSIDVKQEHVRVAMVVMCAKCVRDRIKRGFAYRGGENLRGPIYVGNLRGTARI

SEQ ID NO: 972069 - protein, 84 aa, Homo sapiens
MQLAGGSVSGRGTPEQYQILKENYGQKEAEKVCRVKALYEELDLAAVFLEPEEDRYSAHYGSHWTVRRNPCPRRLSGGWAQNLT

SEQ ID NO: 972070 - protein, 131 aa, Homo sapiens
DRMNRETQRKRERSKKSRPHASHKKKQLLSIKDIQESIQLHHEAWERHHLRKELRSKNQIAPDSRPEENFFSRLDSSLKKNTAFVKKLKTITEQQRDSLSHDFNGLNLSKYIAEAVASIVEAKLKISDVNC

SEQ ID NO: 972071 - protein, 75 aa, Homo sapiens
ITRINPYLSSNITKYSLPTPINTYTIITNPSYSSHPQSAILTSIADPSKTLTKTSTLDPPCRMILLNSHRCSISK

SEQ ID NO: 972072 - protein, 56 aa, Homo sapiens
DILADGKAGEMETTLGTITTTATTIFKKETWEEEWDPEYTPTNARSITCMIDRISV

SEQ ID NO: 972073 - protein, 65 aa, Homo sapiens
PLISSPGSLGPKMGDSSAEELKLATQLDRDLVMPVRKVYKREKARVITEDEKIFKRFDSLRIGSG

SEQ ID NO: 972074 - protein, 71 aa, Homo sapiens
IGLGVISDFNHSPSTDSQETMVNDIKPLLTLSLMQTTIQNEYKNSIDTDYKALCIVSETWGVSAQQMGTIQ

SEQ ID NO: 972075 - protein, 46 aa, Homo sapiens
LFSQGKGLDLTIELAWNGMVGELVYGRADVAVAPLTITLVREEVID

SEQ ID NO: 972076 - protein, 41 aa, Homo sapiens
MRARYRHPMVQPLLRSFVTIKVLRDLSSDRSIQVGFYLLQS

SEQ ID NO: 972077 - protein, 71 aa, Homo sapiens
SRTEDAALLIPESNVCTRCDEYVTQLDEGEFELDSHSEQSVQFISKLRHGFQAGDLGVAVDGGEFGTGEGV

SEQ ID NO: 972078 - protein, 54 aa, Homo sapiens
MVNQRYYRHIVLSLRLKVLLLRSVLYAYLDLFALIFLQLQNYVSDFFSLLSNNL

SEQ ID NO: 972079 - protein, 40 aa, Homo sapiens
DTSSHLMCVEHGLKVIGNYFRYLVNQDSSVKRPTVLLSAS

SEQ ID NO: 972080 - protein, 34 aa, Homo sapiens
GPKYPIMRGTKITPAIAPSSPRPRCPTARHARRF

SEQ ID NO: 972081 - protein, 41 aa, Homo sapiens
MTVIPENQNERKSSNASFICPHNPKAYPPQYQIISINPLLY

SEQ ID NO: 972082 - protein, 36 aa, Homo sapiens
ARYPNLFDDDDIEEGYYFQQANELSKLVNQQLLADP

SEQ ID NO: 972083 - protein, 102 aa, Homo sapiens
MAMDGSWIITMSSEACCYPWVESFMLVTCNVAKMKILERHILDIEAHIVPAEKSFDSKLHVALSDRINFRCNVDWIQRCPPYRVRELQSSTRTPGTVSIPRN

SEQ ID NO: 972084 - protein, 48 aa, Homo sapiens
LEDLTRTPSKTPSLSQVSTRATFLKTVTETHLSLASLTIEVLNSALTK

SEQ ID NO: 972085 - protein, 142 aa, Homo sapiens
MTRAVSSVQISSVTRMWACVLYLGAAVVQRDWGLSEQYSQSAGECHLARAEASGGLRQLQRENQELNAINQELNNRLVAEITRLRTLLTGDGGGEATGSPLAQGRDAYELEVLLRVTESEIQYLKQEISSLKDELQTALRDK

SEQ ID NO: 972086 - protein, 107 aa, Homo sapiens
LTTHSTLLYSHRAEGHPRTYEKGACQIMIRGEGSVKKVRLGRKIARCCPEKMRHFMPCVTANTMVNVQKAVAQIRNILKQGIEIPEDQNDLRKMQLRELARLNGTLR

SEQ ID NO: 972087 - protein, 72 aa, Homo sapiens
MWYVDVKWCIVLWEDVSLAAGECVQEQGYGWSAQFVTGAWPIAGVQDTVQISRGGIPGMARVDDTSKHFRVS

SEQ ID NO: 972088 - protein, 60 aa, Homo sapiens
MTFSGYISSKHNRSQQIRSFIWLRVPQAPVDTHRIVALCLSHLVELDVLCGGEQGVNNGY

SEQ ID NO: 972089 - protein, 55 aa, Homo sapiens
LERNVARRKITGICYLNKKVKQAETLYTEISLVHMKGSLVLEIDENKPICCMLKK

SEQ ID NO: 972090 - protein, 44 aa, Homo sapiens
YCRCLYSGSSTLPVPLLRFLYSAGSSTEQDYHGNNTSSVEATGS

SEQ ID NO: 972091 - protein, 183 aa, Homo sapiens
LVCSLRIPYWRCLYYGKVFIVAEDGPGFYLSQVSCAHHVCDVFRILHEAELTRLMLGSLCTSFGFPVGAGSLINEVRPYVPRINASHKIWAKSLRETVLRSEHRRIADTSIVSTGYHYVSVLWNLVGIYQEGVKRKDLNSDMDSILASLKLPPKSEVSSDEDIQFRLVTRFVNEAVMCLQEGI

SEQ ID NO: 972092 - protein, 43 aa, Homo sapiens
SASCHIVVVLGDTLADTHEQAILRLQVTNVLSQPLTQATVKLE

SEQ ID NO: 972093 - protein, 107 aa, Homo sapiens
RLVQTGGLTGEDQLHGGQERDRGGGSELRPTTALQPGQQSETPPQKKNKKRKNDPKERTQLYNNFLKLRHGGTWQPLGRPRWEDNLSPRVQGYNKLRSHHYTPAGVT

SEQ ID NO: 972094 - protein, 64 aa, Homo sapiens
MDVISEEKAFSQKGSLIVHIRVHTGLKPYACTQCGESFHTRGNCILHGKIHTGETPYLCGQCGE

SEQ ID NO: 972095 - protein, 71 aa, Homo sapiens
SPHWTETLRSVRIVRSFRNQSSLAVHRRVHSGEKPYRCDQCGKAFSQKGSLIVHIRVHTGLKPYACTQCGE

SEQ ID NO: 972096 - protein, 72 aa, Homo sapiens
LCTIVTSSSLRGTGLQYKGVLSSVQVEELPENYQSSVQVESHCVWDRCAPENSYLRHQKEAAGAPGTETASG

SEQ ID NO: 972097 - protein, 34 aa, Homo sapiens
SSSIGHKRDQSMNRKVMQFMGKKVDETVLDKIVR

SEQ ID NO: 972098 - protein, 47 aa, Homo sapiens
MGIVKSDEERGKVMDETPKIFNEEIIICTNLGDVNVSVMGTRARNSV

SEQ ID NO: 972099 - protein, 83 aa, Homo sapiens
MGPIPEVRNSIRYNVTDITARLWAVEPAADGNGVCVCVIKRRSGQRKPDNSYVRTTINKNARATLSSIRHMLLQEQVPPPTCA

SEQ ID NO: 972100 - protein, 81 aa, Homo sapiens
GGNGPRAHGVSAEKMLQVVTHSPVVQSRSPGPGIPGLLCEVGWCRWGLLVEAPGKKLTTVKGIACLTVNAGLTSSLLCIPS

SEQ ID NO: 972101 - protein, 38 aa, Homo sapiens
MGEWSFCSWRSHPPADMGRRKSKLKAASQEEDDMAPSR

SEQ ID NO: 972102 - protein, 114 aa, Homo sapiens
SVLLSGVGLFLYQHHRLLAAQDGCWTCGWHAMRRSGRYYVLADHVSDACERGSEHSCMMVVRTYGVWPASCLCLDLRLMTNTTPLPSAAGSTAHSLEVESVRSSGRELRAFKVI

SEQ ID NO: 972103 - protein, 80 aa, Homo sapiens
MRPQSWCNLSLPLWPPPPLLPKAVYSTFATSPLNPVHPLCTSQCRWVGKASSHTPELRVTESQGHSPSPLLHQSSTRASE

SEQ ID NO: 972104 - protein, 78 aa, Homo sapiens
PNNLNDRISFRYNGLIHRKTVGCGAWQPDLQMVSVVVIKAGDPGHVECLPPSYVAGPHINNECSLALLMQHHDTLILQ

SEQ ID NO: 972105 - protein, 102 aa, Homo sapiens
IELGPSLITTTETTFTQILHSLSSAIITTETRSHSPPIFTSSITTTETTSHSPPSFTSLITTTETTSRSLAVFPRVLRESFSRSSCARVHSVHMCALCFHSL

SEQ ID NO: 972106 - protein, 53 aa, Homo sapiens
TVLGHFLGIGALIWSLCAQPRVAIDACTICQCQLCCYASCPLYEDYRRGMNEL

SEQ ID NO: 972107 - protein, 62 aa, Homo sapiens
LKHWVLELVTAPAELCYPAWSGQTESTGHCSDLGVSSWVVDAALITSECMLLCVCPVSEWPA

SEQ ID NO: 972108 - protein, 35 aa, Homo sapiens
MYPNGPSVRLRDSKLSHPHLRMYFPMSCSIHWYMK

SEQ ID NO: 972109 - protein, 100 aa, Homo sapiens
AGPMVGGPKRAAEFVLHMLKTLEGNAELKGLECRILVVIETYPSESKHLTMRRRDLQELMARIKTQYMRLSRADIEEDPLRENGTGLFLKPRRVRVAHLR

SEQ ID NO: 972110 - protein, 39 aa, Homo sapiens
ANERYLGHGGGSHMNSGLRTVRVLLMDLHMSVHVPTCDI

SEQ ID NO: 972111 - protein, 46 aa, Homo sapiens
FEYEEGINTLGHQYTVEVKEIIDEKIYKSDLVCCQTMADLNSPRLN

SEQ ID NO: 972112 - protein, 55 aa, Homo sapiens
SAEAIMTWQGLCPDNLHMIREPSNRNHFPAEYPFKPPKITCKTKIYHPNSRVLSS

SEQ ID NO: 972113 - protein, 35 aa, Homo sapiens
MRDSSCSTDSGSRFCAVALIIIASSSGCTCAGPAK

SEQ ID NO: 972114 - protein, 49 aa, Homo sapiens
KVEDLFLTIAKKAFCLTTAGYEPAEEDLTDPVRCNILGKKYKARVTTPR

SEQ ID NO: 972115 - protein, 40 aa, Homo sapiens
IVLEQKLQVTPATMEDAAAMEAFDNLKPKRVQKASDSVGE

SEQ ID NO: 972116 - protein, 44 aa, Homo sapiens
DLEDRLVQTHSMSGQTGTGCGQSSGTAPRCPVKSYFAVSPRLNS

SEQ ID NO: 972117 - protein, 46 aa, Homo sapiens
MKLREWQYRDLKKPRHDMVEITGVLPLVMTASLVPATPLLNIGGTE

SEQ ID NO: 972118 - protein, 38 aa, Homo sapiens
SCGIVERGCEAPVGQAEWQVVVGESVARVVKNLGEKAR

SEQ ID NO: 972119 - protein, 78 aa, Homo sapiens
ADYRILRVMREYYSIVTVKEVTGRLVLGISGGRYVGVEDEAADESVYSYVHNHWWPTDVMRKGGIESSAVMSRLRSDG

SEQ ID NO: 972120 - protein, 118 aa, Homo sapiens
LSGEISCEVRPHRRQGQKREEDTVTLEVLVGPAVPSCEVPSAALSGTVVELRCQDKEGNPAPEYTWLKDGVRWLENPRLGSQSSNSSYTMNTKTGTLQLNTVSKLETGECSWEPRLES

SEQ ID NO: 972121 - protein, 42 aa, Homo sapiens
MKPRSISPALNSHLKQANMNKILNSIHPPRERRVDGIKGVPS

SEQ ID NO: 972122 - protein, 47 aa, Homo sapiens
AGDYDHLPEQAFYIVGPLNEAVAKADKLAEEALIVKGLCPRVCFSPC

SEQ ID NO: 972123 - protein, 49 aa, Homo sapiens
RIPASDAGNKQGTRNRTKGSPTCALITVIVDVSTKIAFSQEISDASVVA

SEQ ID NO: 972124 - protein, 49 aa, Homo sapiens
RAYEYTAMGAKEYVRQGYYSFTHLEQVVNVVPLVPWAPLDWLDPAGVFL

SEQ ID NO: 972125 - protein, 50 aa, Homo sapiens
YVVFYESMINTVNYARDTWLAPDGLIFPDRATLVCDRPSEDPAVHKTTMI

SEQ ID NO: 972126 - protein, 41 aa, Homo sapiens
VIIHSGWSEAYVVARVEACQKVLSSMVQALPQDIGTGRCAL

SEQ ID NO: 972127 - protein, 65 aa, Homo sapiens
AGLYQATETLMLEEMKLKLNKMLRLYFRPENLNGGQMKKSLSPIFGTRMGVSFGDRVLDKVHDLY

SEQ ID NO: 972128 - protein, 81 aa, Homo sapiens
MYSQHRAVVCVLRCECNHLEAGGVHNIGKRLLLEYGCGMNLWASFGGAPPAHRQASTIAEMPCCRKVCLIAAAGLDVFGSF

SEQ ID NO: 972129 - protein, 107 aa, Homo sapiens
DPTRPKTEILMSLSVSVTEGWTACQKLTSSWSLTTDSYPAQKNDVCRLDAITNSQIMESSTTQNVPANSNRTQLGKLSGIWGTSTHYGYCTGQPCVFIKMNRVSSGR

SEQ ID NO: 972130 - protein, 58 aa, Homo sapiens
MRALATLTSEVLRSWEPKSDEINVKVLDFEHFLAMLQTVAKNKDQCTYEDYVEGLRGV

SEQ ID NO: 972131 - protein, 119 aa, Homo sapiens
MGTPTRRFDSCWHRACVRDLLTGDYYNAKERCSIKHLADPIDDLLLAASKIPGISSTGVGDGGNELGMGKVKEAVRRHIRHGDVIACNVQADYDVIADVSNWGGYAMAMRTLHPVLMCC

SEQ ID NO: 972132 - protein, 61 aa, Homo sapiens
RLTGLWEGSQSKLEGVWCFHLETGEVVRELLVDLVEATSNFLKLSAQVERATSGRRLLTVI

SEQ ID NO: 972133 - protein, 70 aa, Homo sapiens
LEDLNDPKDIIRAKEESSCVLRTSLYICYTQIQLFSIVRSFTFYHLIMDTSVFCIKVFSMIGCSLFRSYW

SEQ ID NO: 972134 - protein, 39 aa, Homo sapiens
DPFEDDRKKENKPVYFSSNITKKLLSPPGCTAFKKCDTS

SEQ ID NO: 972135 - protein, 81 aa, Homo sapiens
DSEIRNIGPPQSRQQEPHPAPSNVLHFFNAPVEVTGGELLLEILRMSLGSWKRAIFCEKYSSGLKVGAAVPSGNWLDVGNP

SEQ ID NO: 972136 - protein, 114 aa, Homo sapiens
KIYTCDSTLEDFIRHLMQTIVNGSYTLTIQAHSQEYEEAETNINALYDEEAHSPGIHITITTDKALVGHVKERKEIPFLYTTVAIFLPLYRTRVHSREIVGAGLQTKNTLLWYF

SEQ ID NO: 972137 - protein, 120 aa, Homo sapiens
PNYGPFTLSSDQDEHHTQDYALIGALRAVSPDNLIVKSPYAIILRSTLQIKWLHLNIIHPLSQTQEHTHEYTSMTIMNPRANNSEYIITTKTETKPRPPIRTIAERESPNLDLRASNIEI

SEQ ID NO: 972138 - protein, 36 aa, Homo sapiens
YGYVVLKSGSELVGLLVASSDKAQPDGRERVQGFLN

SEQ ID NO: 972139 - protein, 63 aa, Homo sapiens
VVSSIFTGRTLAARCISWSTSQRPGGIRRCSRRSLSWDGLLVEQSTDKISRHLSYWSFIRIRP

SEQ ID NO: 972140 - protein, 84 aa, Homo sapiens
MTGEDSAEEEHGRVSHEEIQPSHLWERRMSGGSDELSDNITQQQTAPREIKDPKSVDMSTCNAWERNGDHGPFPLMRKIHMPYP

SEQ ID NO: 972141 - protein, 35 aa, Homo sapiens
SRIHTIRDPDPVIKVPDTVQIDIGTGKIIKLYQYL

SEQ ID NO: 972142 - protein, 38 aa, Homo sapiens
SSHTTPADSYSRARRGPTRNPTPSTSLRDEYSRGYSTS

SEQ ID NO: 972143 - protein, 42 aa, Homo sapiens
MHIYYVDQFPLGNFSKVKTTRTSYPIYSYIIARKIVYLEAVH

SEQ ID NO: 972144 - protein, 105 aa, Homo sapiens
VFVLCDGVAEMIVAAYSRIFLQHPFSAPHMGQVAHSEVNSMSEVRALKLALLLSVQQPSPLYPNCINESQVRGDIGRSMVLLQVVGSHTDKLGLSGIASAQGIPL

SEQ ID NO: 972145 - protein, 81 aa, Homo sapiens
YTHQSPVLKLRSSARRVVHTHPRPDELWHGNSGLMHTTCYQKHQHVWYSSPAITDQYLLQTSCSENYGIFPGTARQASYSR

SEQ ID NO: 972146 - protein, 104 aa, Homo sapiens
MLLQEPPAGTITCNMVQSICMYTLNKKDQYGKLWCQLAQASTLSLEPKNQKNTSTFQQIRLCLTTSLHCSVLLAAGNPVATPRGALLFSLFPLVTVRCEALGWR

SEQ ID NO: 972147 - protein, 141 aa, Homo sapiens
MRESHCNTLVHCSIVLILLGLLLFNNVTPLMSDDVRRQNKKALQALRDEASSSGCSETDSTELASILSGPATLPEATMQKATEGIQDLSAGLLSSWTAGVEEGNLRLKEVAQDTCCAHCGAGCSVASCLPSACLWGQALGL

SEQ ID NO: 972148 - protein, 130 aa, Homo sapiens
VELERCTHSRNHVLGKPESDEMNVKVLDFEHLLPYAAELANEQGPGYLLGSCRRTSGVLTRKEMAPIMGAEIRHVLFTLGEKITDDEVEMLVAGHEDSDGCINYKSVSEAYPVVVTVPSGADLVRMVLNG

SEQ ID NO: 972149 - protein, 53 aa, Homo sapiens
ACVSRDPHDIRSVMHSRSHPCERTIHLNGALKEPIHIPKTCSRHNDRQGMEVM

SEQ ID NO: 972150 - protein, 35 aa, Homo sapiens
LRWTRNGYQFNIVLQRIYTVNLRGQAGFHMLLLPY

SEQ ID NO: 972151 - protein, 36 aa, Homo sapiens
MTSIIDVGTPLVVRTCEVLQSCGILCLIVYHNVRCT

SEQ ID NO: 972152 - protein, 75 aa, Homo sapiens
SALTVAIDICVASTPDRADCLKLGRACDDKGVTGDATTCSGAEVSLRMWITVDIGVAESWGAPSIATSCSSLSIS

SEQ ID NO: 972153 - protein, 102 aa, Homo sapiens
MHTLASHTRSEVPRSRPTYEPKPAPTPPRPNLTRTAMAKTSPQHRISTSIISSTQKGIIELYFLSFFFPILILLTILVNRCRLYPSLRFHTVVVSLYLRDNT

SEQ ID NO: 972154 - protein, 36 aa, Homo sapiens
TWQVSDACLESQILLLVISFDKQQGGVILIYLKKTS

SEQ ID NO: 972155 - protein, 77 aa, Homo sapiens
AARMVYGPVTTMRDVRRQNARSSMPLGLRPPCTFSGFERLRLFMVTGRLSKRKRPRGGEKEQSIFGDHRNKEDETHI

SEQ ID NO: 972156 - protein, 46 aa, Homo sapiens
PASNRHPARINPALLSFSRYAASYTIKVYRKHHPIISFTYSTDPTS

SEQ ID NO: 972157 - protein, 66 aa, Homo sapiens
VQRSVGLPGLKCLNTSYQSQLIKPSRMRRLPQMRPSKTAPPHERSCACPVESCDRRYSRSDELTRP

SEQ ID NO: 972158 - protein, 63 aa, Homo sapiens
MSFSSSSLSVSLICSASSSSRSSVFPGPSVHPFCTKIALSYPVHSKKLPLPPAWLFLPARFLS

SEQ ID NO: 972159 - protein, 149 aa, Homo sapiens
YLLERGQVLGDQTVSDNELQAMSKQERKDGNRKSKKRQRGEQIKTLMEETNEERKTLLSNLEEAKKKKEDALDETRESETKLKKLPGVCNETMMALWEECKPCLKQTCMKFYARVCRSGSPGGRQLEEFLNQSSPFYFWMNGDRIDSLL

SEQ ID NO: 972160 - protein, 42 aa, Homo sapiens
YCAQNGFYCLVYGFLPNGSLEDRLHCETQACPPLSWPQQVAT

SEQ ID NO: 972161 - protein, 68 aa, Homo sapiens
CHLRSVFSGPWVCVRLFGAVGMQGSGSDGSLGVCARASAQLRGRGLVDRAVLQCWGSRSVQAGSSTTN

SEQ ID NO: 972162 - protein, 50 aa, Homo sapiens
MEPTDERMLHVGYASGIDPSNSGAVPDRPTKVSREETLAFTASKHHEIRR

SEQ ID NO: 972163 - protein, 43 aa, Homo sapiens
ENGDSSNPGDQDVGTKAHTSAVLVAEEGQRHTLPKPTAQPTQH

SEQ ID NO: 972164 - protein, 55 aa, Homo sapiens
TTELDGVYSSIFRGHLGISQLDGKSAVKSNSFCPKPQLREAHWLGPTPSSTTTYE

SEQ ID NO: 972165 - protein, 48 aa, Homo sapiens
MRQAREAQAYTPDVLRACETACSGTSPCGSSTKYLVEGPPHASTQTAP

SEQ ID NO: 972166 - protein, 63 aa, Homo sapiens
SPESVSVSVIAASWGNGHAALSHGPDSLVLEPARIPFSTSTNSAPARIPLAPARIPLAPARIP

SEQ ID NO: 972167 - protein, 74 aa, Homo sapiens
VSTVARGVASSRSSVASKFWTVVLTLRCPSKDFLSEQILLVAEQDHRDGAQPSVVPDALEEVQSLLQNSLSTRT

SEQ ID NO: 972168 - protein, 40 aa, Homo sapiens
MHPAVGSEGPPDIRKAMSEQQDTHHGQEITIDDPLWWLVL

SEQ ID NO: 972169 - protein, 146 aa, Homo sapiens
MVHGLLLLLHVSLASSVPEPRSTSGYTTTHIFWLTSVSSSMKSLKHLGFVASKHPGNRQALLSAVMAMACHYYQPALYHMADRPRRQGPVTAQYMMGNTQVDSGLAAGDYHGFFHAKDYLVQHTVTPIERGVDEAHIVDECVHVAG

SEQ ID NO: 972170 - protein, 67 aa, Homo sapiens
RSCLTGSCNYPYDAISRCPFPLVSAFLCLLSDARFDSRCSVSYCLTGGSWRFQLYGHRPIILNVHQH

SEQ ID NO: 972171 - protein, 54 aa, Homo sapiens
MRAVLFFFEVPAQQAAGFLLARSVSSISTLAGAVCCCSKSGCLLLQGFQLQDIT

SEQ ID NO: 972172 - protein, 42 aa, Homo sapiens
DWNLYWNQLCYVSLETETGPPNGDRIPESCRDPGDCLGDFTI

SEQ ID NO: 972173 - protein, 52 aa, Homo sapiens
FSTDHLLLPLGPKLLQSGCAVPCVFQLLSLRPPAPARIPLAQARIQHQHEYP

SEQ ID NO: 972174 - protein, 101 aa, Homo sapiens
TLAAVSYMLAGHWGSVVSPVVPFSDWYMITEICTRNLCDPHRYNILEDVDSLHGPVYPDHLVPVERQGSRCKSTMRRAAQLPASPYVTIVDHLATASGLFH

SEQ ID NO: 972175 - protein, 44 aa, Homo sapiens
IWGRGYPRIYYLSPLITPFEQTHHKIDFFRSKILDAAISTLGPG

SEQ ID NO: 972176 - protein, 49 aa, Homo sapiens
ASRASPGEESDEQTHSCTHMASRWDGGCRQLIIHNWHVIRHDVIRLLLD

SEQ ID NO: 972177 - protein, 102 aa, Homo sapiens
SDHKAWNKEVFIEAETVFWAGTVDFTWGNGTSTGSSWHLIGQQHVPVISEEDPPCVNTIALHSPVICRQQISPRAGVVFHGALEMALRSHVCSMRNHLPGNS

SEQ ID NO: 972178 - protein, 52 aa, Homo sapiens
MATQQPYQAILYYRLGDIGYILDREHDYIRTLHTHRDPQQIALLNAISKGDP

SEQ ID NO: 972179 - protein, 96 aa, Homo sapiens
LSTPDFYPSGSVRTLNMCHWAGSASNTGDARGDVLGKQAGIRFAEFLILFLTFPYAASCVGLTVQGQSMTGLLALVDIGLYICPASSAPNLHAGFM

SEQ ID NO: 972180 - protein, 51 aa, Homo sapiens
KISLHDQDAECVRAQTSSSTSWYMLVHKHTMLGPCEPPRPRGHLPFLGTSE

SEQ ID NO: 972181 - protein, 103 aa, Homo sapiens
ISTINVGLNSIANYTKVKETIKKLELSDNRVSGGLEVSAEKSPNLTHLNFSGNKIKALSTIEPLNPLSPLKSYTLFHCEVTNLNDSPRKCVPSSSRNSHISTA

SEQ ID NO: 972182 - protein, 80 aa, Homo sapiens
MSLQVYREGSSTIRTYRFEAKASQIMKLINITADREMNEPTDDRMSHVVSAVGVVRVHRRGIPDTARETCRGKNFLAYRR

SEQ ID NO: 972183 - protein, 57 aa, Homo sapiens
MPPRRPQHQVPGWTLYLGCSSTRESAAILQLFAGKYQTLLVRWDTLLVFEYMAFDIS

SEQ ID NO: 972184 - protein, 36 aa, Homo sapiens
MVSNSYVVNPVTLSEDEEVDNLIALDSKYYMYQLYS

SEQ ID NO: 972185 - protein, 64 aa, Homo sapiens
VSALPVYTGVAHRRLKTPVGLLPVVVSALVLGAEALQTQTSYGDLIAACCCSMDLAECGVWLPL

SEQ ID NO: 972186 - protein, 97 aa, Homo sapiens
TRVKAAEISGGTAKSDESCMARGEKAEAVHLMDLHALVFCPDWIPISVTSVETHFLDERSECLSMKMGDHSDQASTVLVWPVRLWLGRVSRSKRLTS

SEQ ID NO: 972187 - protein, 33 aa, Homo sapiens
DEGMTAGSHAVIFQDRGQELVDGLKVCLQAALR

SEQ ID NO: 972188 - protein, 63 aa, Homo sapiens
KNRMSSPVGDQPTRPRLAPPITIHKWPVSNWIKWIIVPVPKSICTVSFTLYDRIWVARWFRAS

SEQ ID NO: 972189 - protein, 103 aa, Homo sapiens
YRRISHVAVQIYCIFLQEQGISAPPAAAEAGGHIRAGGHIVRNSPDPCSPGPHGTDFVIRGRLLSLKFHSPPGASLSLAENQSPIAAPGFPQRWSQRSSMVCG

SEQ ID NO: 972190 - protein, 59 aa, Homo sapiens
VAVVALFNRVPAPSSTIADAMRGVGEREEESEANVVYAGKRRYSVVHRFHIGATMSVAK

SEQ ID NO: 972191 - protein, 94 aa, Homo sapiens
KEPTKALDTASSVIVENEDGDFMVYECPGLAPTGEIGGAQAYLYDHAALYLRPYRPPATPPALAMTWRQTDPNYSPTYEAPWKAQALELPTQNM

SEQ ID NO: 972192 - protein, 89 aa, Homo sapiens
RGCRYGVCLPPGHGMCRRVSWGPAGARTVRRDRTEGCAPPFPRSGPVPGHSYTVKSPSSFSSSEEAVSSSLSGYYMPLQAQHLLPLMLD

SEQ ID NO: 972193 - protein, 49 aa, Homo sapiens
EQDVFPVGDHTTRPRLAPPITIHKLPVSNLIKLIILPVHYLTCAESLHL

SEQ ID NO: 972194 - protein, 48 aa, Homo sapiens
YARTVRPVSWLLLHSVAEQWELQTSLPVADSAAPQPHIEGTSHVLYLK

SEQ ID NO: 972195 - protein, 69 aa, Homo sapiens
WAKHNEDHDHCSILSASTPVWIWLAPYLGSMSRFQQMWISKQEYDESGPSIVHRICFQADYDLVAYTLS

SEQ ID NO: 972196 - protein, 81 aa, Homo sapiens
MAIQTAYNRQYSTLSRGTLTPAKPYRQKQEYPSFHSLINLRIHCEPFTNLSLHTHLIGCPTARLLPYALTSLSLALRLVTL

SEQ ID NO: 972197 - protein, 116 aa, Homo sapiens
MLCWRRDARVCVARLPEYTRGKTHNARVGYREPSMLLHTGGRRLLRPADFGNVVMLRECVQVSVKSSTLCLWVLDAFFRILSICRFSCIFSKAAWAGVRLSRPRRFSSSFFLLVPL

SEQ ID NO: 972198 - protein, 42 aa, Homo sapiens
SWMYLGYMRPHGEAGRRLMTVHLGIYVTKKKEREGKHWRAES

SEQ ID NO: 972199 - protein, 82 aa, Homo sapiens
YSPTDQSSCPWLLTHKFIPFTSSLLSKSCISITSLQLFITEFLYSFPQISYYQSYFLCYSYDTLIAGESGSRALPLVYPPQY

SEQ ID NO: 972200 - protein, 91 aa, Homo sapiens
MFFIDSSDIGQQQKNTGVLFAEPLVCLEDRYYEYLMTLHGVVNESTVCLMGHERRQTLILITMLAIRVLADQVVIPVVANVTCYYQPAPYV

SEQ ID NO: 972201 - protein, 107 aa, Homo sapiens
MIVIERIECVNQSPRSHCELRGMLAPTDCCHRSPFQFLNPESSQKKKKNPKQKQKKQIRPVPFSFGFWGQVRVGLKKGCTAIKLIVRPKSFGGGDEERGGTRHTPAG

SEQ ID NO: 972202 - protein, 81 aa, Homo sapiens
SPLVSTCSIQVCAIEDKMSSVLWSPRSNSVCDFQKAYKLTEEEALDVSDHFPVEFKLQSSRAFTNSTTSVTLRKKTKSKRS

SEQ ID NO: 972203 - protein, 128 aa, Homo sapiens
LVEYVRILRSALRLRLWACWSTRGAIASVWVPPEPATSSVMVPTITAVLSSLGEESFIFLDHPVKGREEDWLLRLINELFKTILVECGVGSSGLKPVSFEQEPQVHILALGLLAQNLSVLVMADVHVH

SEQ ID NO: 972204 - protein, 83 aa, Homo sapiens
RAKYETDWNDGDHPESKKLATQGRLNQFSTWTHPSSPKDYNDRRVHGSQTAWVGLIIGRGGEHINEIQQDSGCIVQTSPDCGV

SEQ ID NO: 972205 - protein, 67 aa, Homo sapiens
MYPGIADRMQKEITALAPSTMKIKIIMLLHERKYSSSGYGGSIRGLDCPPIQTDVDQPSSEYARVLA

SEQ ID NO: 972206 - protein, 51 aa, Homo sapiens
LAFVEKVEQQPFQYFGISVHSGSSSSATTGILRRWHPDWTRVSLLLQYSCI

SEQ ID NO: 972207 - protein, 102 aa, Homo sapiens
TGDFYVAISNKFIGDLMPVTIMRLMINNTKAFIHHELLANLYSSEDHSRLMERVADQAQRWDDMLCIYHALQGGAQESSVTVMTSRCVHVRYGDPESEPSGH

SEQ ID NO: 972208 - protein, 68 aa, Homo sapiens
KCKCIRISILNSKRAEFGIHPIHYAASSNLHDAAYISRSHLTILGCDKVTWFTRAGILISFQWGVNSV

SEQ ID NO: 972209 - protein, 137 aa, Homo sapiens
RTWHFPELGQIISDHYNILATVFTVNVGIGRTMPLPSFLSCCQKKLEAEVKAAAEISMGTGVSEEDVCNILHLCSLVIAQSLNIEPQLYEYLLDRMMAIAPNVTVMDGESVRARFIAHAGSLLNLATHAASTVQILG

SEQ ID NO: 972210 - protein, 43 aa, Homo sapiens
MILPDGRSRLLLPRMHRPLRHLISAKQLLKASHILDTHRKTLQ

SEQ ID NO: 972211 - protein, 45 aa, Homo sapiens
RIPVTGIHCGHRVIEFLNDSIASTSAVESNNSQTCQIEISRPQVT

SEQ ID NO: 972212 - protein, 53 aa, Homo sapiens
DIEEEVVLIFLYSKRSKGARRGINSNALKFQLDLLQKSAQTAKLVFPDHYVRL

SEQ ID NO: 972213 - protein, 75 aa, Homo sapiens
KRRRFSSRIYTMDSENLIIEINLYSYIIYQEHHSQFVHLLREPHFLLDPIGGHRLAVGVQLACQGLLEHFGLCLR

SEQ ID NO: 972214 - protein, 56 aa, Homo sapiens
IAVDVQDTPKCLCHLQLTCVMNSRVTVDCSRLGPVSIPHDHDLYPGLQQPEEGKAV

SEQ ID NO: 972215 - protein, 43 aa, Homo sapiens
HLLEKRCENGHSDSAPYLVLWKSGSTVRLGAKHFIDVGAGVID

SEQ ID NO: 972216 - protein, 31 aa, Homo sapiens
MSWEMGTEGDENFMLDEGFTTVMDLLLEYEV

SEQ ID NO: 972217 - protein, 67 aa, Homo sapiens
RTAERAKRTTAINMGTGVEISWIGVGLRQKMAGRIVNLVVQKLERETTHCNISHSIILNSEDREILH

SEQ ID NO: 972218 - protein, 40 aa, Homo sapiens
VVPVYPHQELCSETAVQELLPRRTIFSPSRSTETSLEEFR

SEQ ID NO: 972219 - protein, 59 aa, Homo sapiens
HSQKKRKYIKNEVEEWCVSEPAQHGRDFRLPSRMSGCIGLLGVSVYLDLEQHLNELMLD

SEQ ID NO: 972220 - protein, 81 aa, Homo sapiens
FQRIPSSASRQQMLCLERHKEPPKELDTASSDEENEDWRLHVCTECPGPWPLTWGNGVCATRLFDHAVTVLRPCSAPSLTC

SEQ ID NO: 972221 - protein, 95 aa, Homo sapiens
VSLNLVILIVLISEAGKHMQHIHRLLISNIHHHPHHSSSINPPHPPHMTYHQKTGKKAAATSAKKVVSFPNKTGCRCHTSQARSCHSRLQGSSNT

SEQ ID NO: 972222 - protein, 35 aa, Homo sapiens
DPPRPVIMNLKCGVDIGRSTGIAAGRWCHTDKLVS

SEQ ID NO: 972223 - protein, 49 aa, Homo sapiens
ATKLPTVSQHYKKDRSIILIEFPQTSPITSILSGRTNSHFTDLKLVFNI

SEQ ID NO: 972224 - protein, 134 aa, Homo sapiens
NIQSKQNEYTDTYGANIRHEPQYDTAHESTSVFSIKKFSGTSKTTAKAFEVNHNNFFSCPYQFLRHIALTRFHWVSSSKGQHSSQSIHSHQPHGSPTQQVTIHSKGGQLANHLGSTILIGMSAGIPLSSLHLPG

SEQ ID NO: 972225 - protein, 120 aa, Homo sapiens
PKSPLLYCDADQLRWRKVCSPGDVTGLVFQSNHSTYEPVLLAKTRSSESIPHLGADAGLHAALHATVVQDHGACTDGIQRVLFGNNLNYWLHKLVFVDAVAFLTGKLPLPAIGPLHPWWT

SEQ ID NO: 972226 - protein, 42 aa, Homo sapiens
IDDSLIGGNASAEGPEGEGTESTVLTGVDIVMNHHLQDTSFT

SEQ ID NO: 972227 - protein, 35 aa, Homo sapiens
MGLFVEHDGKLSWELFSIVLWILGLKPSSGGALKP

SEQ ID NO: 972228 - protein, 85 aa, Homo sapiens
MNRVRHEVGALVRACKANGVTDLLVVHGAIGATPVGLIGQPPALRSYCLLHACAIVVMRHDIPGEEERLRRALKENRLIPTELRR

SEQ ID NO: 972229 - protein, 58 aa, Homo sapiens
CIIFVVQQQLSHGHRTAQTTLQEALKLFKSSVQQMVRTISVILSYTKQDLLAEKVLAG

SEQ ID NO: 972230 - protein, 76 aa, Homo sapiens
RSADLKEEKKEVLIIVTKLEHKDGFILPEVSHKGSRREVLGTRRNEFGREKVTMGGEGSQGKRTTRGTREEVPGAQ

SEQ ID NO: 972231 - protein, 67 aa, Homo sapiens
KGKQTNLLLILGGDASCRDLFFCHFEFYLIAHEAELSPTKNVRENIIHATTSAAAFPKTLLSNQSII

SEQ ID NO: 972232 - protein, 56 aa, Homo sapiens
VPPFHQRRVVGEQLWGWAGPLLSPYSLPGSVPDFCGARRLPSLSRPPTSLGELVKW

SEQ ID NO: 972233 - protein, 114 aa, Homo sapiens
KKNDKTIPIRPNWRAHWWKKREHFSRLRMIHPVFSQCLQEEEGKTWMHLALNPLGPSLLLRSWGWKELPLGTHLQRRARRSEDGYCWSRHTANYILLERASVTWLEQQRQQRKP

SEQ ID NO: 972234 - protein, 61 aa, Homo sapiens
TEDKEETIQKLETLEEEEEVTSEEDEEKEEEEDEEEEEEEEYDEEEHEEELIHHVYFDNGE

SEQ ID NO: 972235 - protein, 67 aa, Homo sapiens
GNVAYTEADYYHTELWMEQCPNGNWMNGEISHRYSLCSRIILSYAGISCRDDLDNGTFCSQMKLLEL

SEQ ID NO: 972236 - protein, 114 aa, Homo sapiens
CRRRTEYLQRGFNLPYQDARKCLGLFGHGEIMPITIQLSKLSGGQKARVVCAELACREPDVLILARAKPITWYIKSIDALGEAIKKYKGAVIVVSHDARLITETNCQLWLVEGE

SEQ ID NO: 972237 - protein, 107 aa, Homo sapiens
MYFSFRMMADVMVFYESSCAWLVPLTIRLCWWMRVMVCHDHSVVCENPLATHPLIPKHSASVHTPHFQVFKRWEISSGGPQVIIPMVTDQAWFFSFLSSFVAHVARV

SEQ ID NO: 972238 - protein, 118 aa, Homo sapiens
TTYFRGAGAAVGEFGCCGGAGTLTVGNSDNKLTSSCGKPSSKRRSLQGTAVATFLYAGVFVVLLLCIPFISPKRWQKMFKSRLVEEWVSYGEIFFVVLMVIAVQLVIDAVREIRKYVV

SEQ ID NO: 972239 - protein, 56 aa, Homo sapiens
CIHRCKQISSPAALVNADGNALILHSSSAFGYMPSVGSQLVQAKTVSKRQAYKPQA

SEQ ID NO: 972240 - protein, 199 aa, Homo sapiens
MWSLTELVKSVVTVGKWRISQSTVEENTARHSSNKLIDYYSRSHMECHDGDQSTHVTGIRRGPLIIIIRRKRQSRAAFQTPSVSCRPMFCIVYIIIQASKNRLSSILVVHRTQYRSETHHQVFPNFVCNIYVRLTFPLYIIPIPAFVLTLYDFWGIRITTSCASNTFQLWDGIQPAGGGIAVIVEGKAFTSRSNILSGS

SEQ ID NO: 972241 - protein, 168 aa, Homo sapiens
NPAWVLCVWTSDWLASDDLAGGGCHHSQSYPARCATPTFQLVALVHVAVGCQPNTLGSASPAAEQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEDSAAP

SEQ ID NO: 972242 - protein, 68 aa, Homo sapiens
NDIRDELQVSEDSDSITQVCKVTTAETSLPAGYSDKIDVLSMKSSGAFSPCLLSQMPRIEASARRLLL

SEQ ID NO: 972243 - protein, 105 aa, Homo sapiens
MEDSMDMDMIPLRPQNYSYSDVDTKGPSERVITFQGGIMYENEHQFIFRNGQFRGCCKGVRLHIVEAEAMYLRRQIHIDIVNTWQAFDTYVAVIEAKRGFTLCVA

SEQ ID NO: 972244 - protein, 78 aa, Homo sapiens
PRLWNHLENTTTLNVASYETADYAGTGEFGRSSPGVDYRDEGSMLLPQMESPEEELSSLIMMSHHFHAVRHSSTGPSC

SEQ ID NO: 972245 - protein, 41 aa, Homo sapiens
SLARVRSDYEEEHELLWTWKPSTWTGDAEDVDLNHYRIGKI

SEQ ID NO: 972246 - protein, 106 aa, Homo sapiens
MSVYEPFNKGNWITDIVSDTKTNIAIFCETRAVWIIAAQACIMYQFAVDDSYMPVVGGPASSACIEDETEVTNIITSKELLQTKLKDIVSLVPRLRHIITVDGKPP

SEQ ID NO: 972247 - protein, 50 aa, Homo sapiens
LPLISTVLHPRPNLLPKSISLIIYIGVNLTFFPTNFLGYPECSDVTRTTR

SEQ ID NO: 972248 - protein, 36 aa, Homo sapiens
HRRLHSLISPILRLHLDRLRKIIHIISSGNYFSQFS

SEQ ID NO: 972249 - protein, 56 aa, Homo sapiens
RCRIPSNIFVRPVGEKDTWSGMRTRVNSGSPMASDQRRTRTLVYKPILRQKKHFNS

SEQ ID NO: 972250 - protein, 103 aa, Homo sapiens
TLPLQDIKKGKKKDPNAPNCHHLPYSCIALNIALKIISEHPGLSIGDTAKKWGEMWSEQPAKDKQPYEQMAAELQAKSEKDIDAYRAKGKSEARKKGPGRPTR

SEQ ID NO: 972251 - protein, 50 aa, Homo sapiens
DLSQLTKLHSFLGDEVFLRELAKTKQENKLKFSQFLETEHKDEDQPILHG

SEQ ID NO: 972252 - protein, 68 aa, Homo sapiens
EAYSIPRLFKPRFFPKDNLSPATQGENQQNLEDLIQKLTFSMVIRLLFIFKISFCFTGKEKMMLRSKR

SEQ ID NO: 972253 - protein, 99 aa, Homo sapiens
VEKNEASHHGRPVGNISRNSKRTYRQATRENLRPMIERKIPEAVQAIYSECESQKRDSFHRSSVMEDVKAIVTWAAKEKPSSFVETVARAIPGEGLAGT

SEQ ID NO: 972254 - protein, 157 aa, Homo sapiens
MMSVTCSRGGSDYDWTMDSESPHECTTGSLSILGLLKRTQAEEHEFDHVLMVGLCLIDRNDDSVCYNRVIVNGVRIFVALRVGGRSESLENSAWKALRQIEVQTKAGPKLLVNNCADLVDEMVLGKANGLAIVGGSASERTTKWVFNGGLVLVHVAE

SEQ ID NO: 972255 - protein, 96 aa, Homo sapiens
VCRTTERTHLALAVVDGDEIPITKIGAIRAFRTDLITESSRLQSHLIIRFSLQNDYVKKAKKITHLVSMDTLNRSRPITGLGLSLQNQERKSRSQL

SEQ ID NO: 972256 - protein, 192 aa, Homo sapiens
MQARDPVANTNNDVSEQYRVLINASKPCLLAVHTFKSMCLSVFCSPLFRSSLPQSTQSRQHTTRHYTTTIPTHNRGQAGKGEKEGRTKDRRQGKEQHCREDRQQKNAETEERKRSERRREGNRKENRRRRARQTQTEGTRKALRVTTARQESSKNQHTEERQQRAKNDNEEAATREQRHEQHEEQSDKDDEE

SEQ ID NO: 972257 - protein, 154 aa, Homo sapiens
GDAGFYFSMDIMHDMLVQSLNVRSKSSVARDEHKYIMDSGSLVILGVQEVHGPYEHGIVRCRANYVSRRLSHPYQYHSAILSSERIRDSYVCIKVTTSSITNYIDELSCHGPAIEMRVGWSIHLTQPKVMLAKPSGEHDILRSRPRKMDNSVEA

SEQ ID NO: 972258 - protein, 77 aa, Homo sapiens
ILRARCGLSNLVVQPLFLSRSEKRSILSGSDPIFADECRNGLTIHRLQGMEEDSLVKRSMEKSEEDSSENRGRFVHA

SEQ ID NO: 972259 - protein, 73 aa, Homo sapiens
APPDATAIDMFCSCSILSLKPDTHWMTVMPAGTGEWDQLLGKVPFTSSLISVRKYVGMLLLSFAHPDDICKEA

SEQ ID NO: 972260 - protein, 113 aa, Homo sapiens
TRLPTGSDSEASLVIGVLSCLVLFPFSLVTLLDSYSLSSSDSDSQSEELSSIELHPSFEESEGVHLSFSFSPSPESLFPWAFELLWAALWLSRPDYPPLSLFCSLEESSLLDS

SEQ ID NO: 972261 - protein, 59 aa, Homo sapiens
DIELGPEFPFTNPAVEGTIDNGSKITNFLEGQVAFSHPSVLSPLSWHIGEKFTNPAVKG

SEQ ID NO: 972262 - protein, 111 aa, Homo sapiens
MSVYTEGTAGLVRCRNIKILDPHEPHHRDGLFLVQCHPGTGHAIHQQLVFCSGILYVVHNSQYIDISLSHKSGLQECITLCALHGGDVVYQHVILIEQHLVLRLDVRGGAD

SEQ ID NO: 972263 - protein, 48 aa, Homo sapiens
RAEPLPRWNLPEVGLSCALCDVGLQLTLLCACAAGMLDGVVGAGDERD

SEQ ID NO: 972264 - protein, 209 aa, Homo sapiens
VELKYRGLVKPFTHASGKPWGGTAPQGPQGILATAGQDPGAPQRCRGGTNKERMYSRPVNKYTSGHEGKCNHPGGPTQSNKPWPRPPGYTSSHPLCKGHFHARSGPFWDDTSISARRPRTPLVAGRVFRPLWVLGNTGGSFLLGGPVLTAAFAPRRTVSFPPGVSSVLFLKPTFVTKCGQSSLPSKQGFGGEAALPLQLVFLLRHLLPQ

SEQ ID NO: 972265 - protein, 46 aa, Homo sapiens
CRSLFCNSINPDQASPPLAQPIYRLHQGFAERCAVYRLSNEVVRFT

SEQ ID NO: 972266 - protein, 174 aa, Homo sapiens
APLEVIVGPLLELLCPIYPGAPLRTRCLIPRGGSLPPPASNLLTKFGVTFSQFFFTPLSNKRVFPAKPLSAGLILPRRRQRGVPHALAPSAGATIPYLPSAALAPVVASRQPRSRCIRQTCTPYHTRPYIPREHLFWASSPHGIQNLWPLVPPSRLPHNPSSLNTTGPPPFLHH

SEQ ID NO: 972267 - protein, 72 aa, Homo sapiens
ACLRVPLEKVLKGSPRAEPCEREVGMALDSSTVESRLRKGSGEGFHRTYNMGSHTGQELDQGVQALHHGIDQ

SEQ ID NO: 972268 - protein, 336 aa, Homo sapiens
GFVCEPLFWVPRVCARVMCAARIVSSSEARHNMEHGSQGTFLYIPGQVWVPVDNPFGRPQHPRPWCDSPAFHNGPCPPPLFGVWVPSSSRAARARPLHAGGLSRLCWPEDTYKTPAQQRATTMRTVAQFSSAPRILLRAPLFPRPPELPYGATRCSQSPHLWGPFFPSRPRRMRIPAREPRAAIPQCTITTPLAEFIERHSCLQGAQREPPPSFAPSLVYTREEGRVRARPNTRRAHLWQTAFLLPIPTLGGAHPAQPLRAPDKEGGQTTTKEPTKRDGQNRGRNTPEPASVVRHRRRRLDEMRTWGLRRRTSSTPPTLSPPPAFLKNRFFFPTTK

SEQ ID NO: 972269 - protein, 261 aa, Homo sapiens
GAIPEGWYNPLGYAPGSPRGGSAPPGKDCAPAPRPVSARSRPVGTATTEKPCPPRSWGPTNLWGPRRSPTSPKAGPPKSRLATISPMSTNPSPISVLLRGRPDCLEHHRAPPKSHPSQIPPERGPPINGLLLKGGDITCYPPDRGGHPPNNFQQRAKMMKRSRGPTASNSVSIMPGPLQRESLTAPMGRPPPRASERPGDLTLACCRSPPPKRMLRTGAPPYILPCLMGAHSDETLGVATLETNGEHTNRTCAQGRAGEWR

SEQ ID NO: 972270 - protein, 122 aa, Homo sapiens
YTLLSGTRVPNSSETWHCCLSEVKTKDLPPERQHDTDIVEMKPSITSRPIVYFKNYEIKNEADRTLIYITLYISECLKKLHKCNSKSQGEKEMYTLGITNKPIPGEPGKPLNAIYAKPANKQ

SEQ ID NO: 972271 - protein, 167 aa, Homo sapiens
AGSRPAFQGCHPRVATKGEIGGSALCRPRAGQRGEPPPSWIPGEDALDPSWKDGNTSWPRPQNVGERIAPKDGGPPKGGARQHGHGSLGNTDSLYKSGSRPLICPNICGQTIIVESTLFKGPSLPLLPVYTAVSLHKKPVLFHQYKEKSPPKKLQFFFAQTICQGTS

SEQ ID NO: 972272 - protein, 164 aa, Homo sapiens
TVSISGSRPPSTEVGPPTGGSEKFPARVVPPRNVLCRGATNNWGGHPFLGDENIVWARWYRPRVALPAAVTLALVLVDLQGVFIFLCALQPRELLNQSWPAGVGPTPFRWGRRCPPHERAPQNGARHTAMRRQVGELVYNRQVARTIGRGAGWATGMFPLSHRD

SEQ ID NO: 972273 - protein, 80 aa, Homo sapiens
NILDYNTRIPGSKPTIPVTDIPNTGQQPKRRKNHTSNWWVTNRTVLDIEMFPDSTIADVVAHIGIYSTEGVVQDVDAPVT

SEQ ID NO: 972274 - protein, 118 aa, Homo sapiens
MAFLYVKPPLGEILILAFIAGIKKQFSPHKILSCQWRTTLSFKNESLLQRSGPPNLSFLESNAIHYLTPTTLLLSRETLFCPVEGLQSGQAIYSTNEAHSLGKTADSLGPPTLVIDSY

SEQ ID NO: 972275 - protein, 83 aa, Homo sapiens
MPRNPSLKQQLFSYAILGNTLYEAMGRWAVRWYAFLILFACEAPWGVTGLLLLELQPFLVLGCGQALPLSTTCVKTGNTKENK

SEQ ID NO: 972276 - protein, 98 aa, Homo sapiens
IRCERLTRCNQVYQRIREDILCKLMILPNMRRRNNGRTCGSLMSIHLIILKIHIASIAQLIVPIANIEVYGDAVSMSYWGTIRPHTISLMSNKYGTSK

SEQ ID NO: 972277 - protein, 298 aa, Homo sapiens
LGWKYGARPEGAPFPMVEGMCAPPPLGVVHPLVPGKDPQPKVIVMVVFGAPPCRPPHLRQLPLPLLGSVCYLGALRFASSFSRRKAQNTWARARGEIPRQPEHSATRSPGVLLGNAPARHALCHNPAGVFSGQKGTAREPEPHTAFTAQRSQSPSRSLYISGPTAQHGSPTEMRLHLRRDTPRWLSDSQDTHTNRLGRWNRTTARNTRLARCLSVGIETGTWSRGDTNPCATATNRPACKRGSTHPHTCGDRDRGTLSDDTHQGDESGHQHHYRLFTITCSGGTPPKTARPTRREKQN

SEQ ID NO: 972278 - protein, 256 aa, Homo sapiens
KCSRCAQIVVFPISRGPLPGRSPPFVAACACFSAGVHPFRGARVAPGGPPTEPRVCGTPSGVPRPFPPAGAAPCPLPPDSSLQAAGLPPCVGGRFFPRVVTAVTSPGASPQSGQLHLLFSCTLHAERPTRSLRGVSESSAPERSQLPPWPGPPGSSLTSLPPPIFVPGPHRIGSLLVFRHRNFGVYNKPHDLPAVTTSSQCVPPRPRGFWAHSCRAATQCAQYSAIEENLSLHPDAGVLFILRKNPFGGAKKANKT

SEQ ID NO: 972279 - protein, 160 aa, Homo sapiens
MFVHNMISLRGRTCPGFRPSPRLKKLCCRPRLAPRLVLIQHFASFKGNNLGRPAEHWSSRLLAPAGVFGGQGPRIRGGDSAGGTKTGVPPCVCAYVPLVLALMVPLLPGVGWHKIFACISVCWVKRHRLFGVFQIDSSCLPPRVDLADFASVLLSGTVVL

SEQ ID NO: 972280 - protein, 224 aa, Homo sapiens
LVAGPACPQRLGLIGGSYWAPGRAKQSVDSRLEVLKCQVSQGLQRPAGFYRSSPECPMSISGWVRLSRVSAPSSKGQGSPSGTGECPDPPTGTLVLLGAFAPFVPPWFEKKRGFALFPARGAHVSPTLVGRIVLTEAEGPKGIFSKYYLARRGDKFFKRRNGPNPKMWMTHRALLTNASYVSPRLTSARFPCSVIIRRVSCLSPFLGHEITTVCHPVSLLHQQW

SEQ ID NO: 972281 - protein, 84 aa, Homo sapiens
INDTHIVSVWFSSELFRELFGDPLGVTHECLQQFCMGSACLTTCGRVCGGPPPDLVRPRLCVGGALQVRQCLVSHRKPAVCLAQ

SEQ ID NO: 972282 - protein, 91 aa, Homo sapiens
SLFAFRLYLCGPMLCLFVEVVARVAPRGTPLWGPGVFAARRCSRVIAAFPLESPREPAGLAEILDRAALCPGDLGGEAPPACFFRKPPSFY

SEQ ID NO: 972283 - protein, 65 aa, Homo sapiens
MNKICWGFAVFIDISAGCQCRAAYIAEVLHESSCPPTGPGAWHVCIRAAQVIPPTNKMTPPNPTK

SEQ ID NO: 972284 - protein, 114 aa, Homo sapiens
SRVRCPPLPWYLQGAFKESCPSKTCAPVMPTPKIPPTRRLISGTPREDFFHRTVLVLNVSWQIGKGALSHARNAFLLQDPLYKAMVRETRFEKSIIILTLGCRDLWSSYLPVAN

SEQ ID NO: 972285 - protein, 106 aa, Homo sapiens
MSPSPLLGPASGLGWKNSLEKTEVFKRPLRSLQLEHNNRGECGAPPSGVVKPVARDDPSQASRCPQEPHRIIFFAERHEMERLGRFFYAPRFPRGQPPEEPKPSCS

SEQ ID NO: 972286 - protein, 256 aa, Homo sapiens
SRIALACGCDRPGLCVCARQLFLWVWSPVICPRGAYNLRVRAGFEWFRLSAPVPVADLFDCCHALWPLGLLCWCLQPIGARSGALFVPTSSPWRVWVSPAPGCRVWPPPAPEVPRANGPLFLPSIRGVFTYRGGVPPVVLGVTPLVPPCFVRPMSRSGHNKLSFGRLFVTFVVPAHTAHVLGGLIFPRDLPPRRFSSRGFPREALHPPMVTLSYQSVRRLLSHFSVQPGEIVKNVLMKMCEKRLLPSEKRENRLNM

SEQ ID NO: 972287 - protein, 209 aa, Homo sapiens
CVGLAICFLTRLVCFGAVDGCNYVCPAGRYERNYANYSSVGRKSGSPRGVTTRNGYQGVPRYRAFPSGRPSNILRMGLYPVCPCRKVPTQRWLLFPFSRVPVFAAVDIFCRARHSLVVRAPVQFLSLPLQNRTRVNGMRLRCHPSHGAPPGAVPIRGPPTFGARLMLANCLNKNLFPPLIVPCNPARDLCETSADAVTPLREYGIFPAL

SEQ ID NO: 972288 - protein, 70 aa, Homo sapiens
CSVPADIVFSRVPPGPAHAEVVGVSPGVLKSGIIPAIVCWTPLGVKLLGEGVPTQTRRIAPPRTAGVVNP

SEQ ID NO: 972289 - protein, 72 aa, Homo sapiens
MFLVCWEYWCRKSSTLLVDNFSESAPLKGVFQKYSPLFSCFWPHNTKAKRRGKPKSKKFKGETPWKKILKPK

SEQ ID NO: 972290 - protein, 103 aa, Homo sapiens
SRFVPQVLLPTVSVVPQRVTRESFFGKVTFFCAPPPGAPPRDFLREEPLYVGGERTGPYVAPIIAHSFVGSPAGVFFLSNRPPHIGGQAPHSVTRPPSRPSTL

SEQ ID NO: 972291 - protein, 116 aa, Homo sapiens
CGCAVVGRTFLCSVWSLIFVSCWFCLVLCSPSAAPCGPTVCGDLAGLCPRPEPPGSMLLPFCDRACGVTRPTALCTRAEYLGSPLSLCTAPGAPNLTGRLLRFANQPFMSLRTTFS

SEQ ID NO: 972292 - protein, 197 aa, Homo sapiens
CRLPCSRALMLVVCSAACSCTVCQLASVCGLGPFLSFPPWLASRAVLGVVTVPLSPPTWVPAVILGACFPPWSLAPSFLCLQAFLAASRVVNRIVTQTLRFTVPNNFNIRARDSTPNRIVVCSHNLLISGRSSHRCEYKILLSNRDVPQHLLAHPIKAVVEELFYKTLSDKPLSLISPPRLTAPGEIFCGILNTAFV

SEQ ID NO: 972293 - protein, 90 aa, Homo sapiens
MFQFVAPKEGIGQMNDALGDFPQRTQTRETTRFCTQPRQGIRRPREHLQQNTGGEITKPPGEDAKQTYKPSHQGYYKRQSIKTPRHTASY

SEQ ID NO: 972294 - protein, 163 aa, Homo sapiens
MLCLPHPPPRWAKEHPYHSLSPPAILPVGGRIPSPGNLSHDVVPSRRLASVSQSPAMTAHRVSYRPPRRCPHPAPFFQGSLRTPPRPQVSLVRTLGCPPHLGGSCFLGARELENLRLGASTPLGIARDHPSSCERHRVSSFSTASFCGVFPFGEPLGRLLSEM

SEQ ID NO: 972295 - protein, 117 aa, Homo sapiens
FRVVISRSVRQLPPPKQPKGIAPPRTTKGGKNKHRGIKNRAINKIAVKYLKRNHVPEGVYIYGSACQRDGPHISEPKGGATTEGCLPATRVCIYQAEVKIFGDHGSPNFPLDSPSRD

SEQ ID NO: 972296 - protein, 131 aa, Homo sapiens
MWCRKAREHTVVLYRRSQIMISLPKRGRRHRNINEDIVESQYQIIVWYSILSGRYRGHCGLGFSEVEDRDGDGDVPGRGDDDDDDDFTDLKVQDDSESDSESGERRICWRTPSCEHLMKVEDPHNKDARAY

SEQ ID NO: 972297 - protein, 124 aa, Homo sapiens
MSAQGSRKKRGSSSPPGGTPSSANNVEEIASRSVLSPEAYFQESSLRPVRENLLFIEKSVLDTQKLVKKFSRAYIQSCCNTMKILARPPFIKAEGRFPLRSVVVKCCHRVLISPQKCGVHTAPW

SEQ ID NO: 972298 - protein, 319 aa, Homo sapiens
LAEAGSGAEADMLRCREHRLPMNDERHKICKRVAMALGPCTRMDPGLFALLQYVPGVCLGRRHVISREFVGGSCGHDEEVHGPGGVAAVILVTRGAGGWLALVLLGLVGVSPWREGSLSRRNKILSREYVRVIDRGLLQYHEGILAHGVSLMTDSEGFIEGIRGQRLCFHDADVRLFPMQHSVGGGELVICCPPKYQSREPFKRQRCWECRRKRQAFLTCDLQRKLPGPLQHGNRAPGEWQWSNGHVVWALGALQRRGGKIAPGEAEIARHNRTGMPREKWAGVKVGENIVRHDEPSEQESAATRLASANNKAPSEEPD

SEQ ID NO: 972299 - protein, 122 aa, Homo sapiens
LWAPTGQKGVFSPKASGVYGAYKLWDGDLSRSPPHEVVSFFASKTPPRIVGRRGRALLTPNFEIPPHVVEFPQRFVAEMQYPSKKRETCGKPPPPSEKEWSFLSHPRKRGEIIRSLRGRAKS

SEQ ID NO: 972300 - protein, 105 aa, Homo sapiens
EVYIPPFLPALIPADTHHICPRAKIFCVPHFPPARGTHTLCGRIYRARAPPGICGCMRGEFVWETHPSLGDTEWGAHPVPPLHTVCVTHTESPPPLERVPLARHK

SEQ ID NO: 972301 - protein, 117 aa, Homo sapiens
PECFRAPSFFKFCPPGPQSSHKFCGLAKLHLLTPLPHSASTYTLFSKHLQLVTPPQKTVLKNLLDTSLRLNNFASLSPPSFNPLGKNLSFVYNPPFSRSKIPLSFLLTSYNTMPSCP

SEQ ID NO: 972302 - protein, 108 aa, Homo sapiens
MVALGGHYNTQHLRFAAQCVDPTAFVQTPITLLPPGAPQNPKPLPTGTPPNFAYYVRDFFLKPNNRRQPVKTSPLTNMRKPIHHLHAETLLSSTKRVLSSPNNPSLIS

SEQ ID NO: 972303 - protein, 142 aa, Homo sapiens
MTCLFGPAAAGGRLVHATEKEGGRTNSPLSFSPPPRVDEAPHLTSSVALLIRLHTQIDAFCEEERSNTTLFFPPPTKLVFFFSSKKPGRLAHNASFPCCYPPDSFVIISVISALRIVNYFRSVTILVYHSTPSICSQLNIKQ

SEQ ID NO: 972304 - protein, 256 aa, Homo sapiens
VVVAVSVCRPAIYRGQLSLLSSCANVGGPPSYVLAARRGSLVAPMCWTRPVVWLLPPSLVGLFCTGTSHSSDSVGSPCGGVPSARGVASVGCSLAPLVGTLVFRRGSAFSYLRCGQEVRRLCGPPALVRAFCAGPPWSVAQSRVSDAAYAPPFCAPRRLKLAGLVEPRRAAVVRLYHVPPAVPIVPSNYVSGQPINQPACLKCSPHPPGGAFVPPPCVLPLRLRLVDPLGGHPLFPPFPPFPPSPHPAPFPGPPPK

SEQ ID NO: 972305 - protein, 142 aa, Homo sapiens
LRLSCRLCGAGFVDSSAAVSLPLTPSGQYFPIFNLRLFVPPPFVYARVKAWRPLPGYSLGASFYRACCALAHRSLVCGPLRSAVQSGAAQPSGGVSTPFAFIQNPPECVSSAGTDNFLKFVPPGLKSLHLCILCATANSTIL

SEQ ID NO: 972306 - protein, 110 aa, Homo sapiens
MCAPAPALGVPPAVGPAVAGYHMDPRRGPLFAVQLPRLCTVATPPFCCRHRVTPPDEYGVPLAPIPLPEILLLPAPRVLYSPRSGPTKHFGVTKMELVVRNILVPNFTGQ

SEQ ID NO: 972307 - protein, 119 aa, Homo sapiens
LGDAMGDPPVFYNSADSVGLCPRWLVLPPRHAGDFLVSINGCRENLVPRDVGDSTRVPGCQASLFGGGVSLPTQGQHILVRSPASSSLSQERSSQGGLLSRPQPTRRPLVLLMGVLLKP

SEQ ID NO: 972308 - protein, 169 aa, Homo sapiens
MALVFLEKYGRGGKQPQERRVFPCKPITRVLWAKNAAEISARVAPRYMCLGFLPLSDLYNVGAKARRTKVPPFQTPKGGPEHSRERSPEPHTRVRERIPGEYHNTGSNEFRRTISQQTRRGQPSVYNIEGSRAPPFQKRDATQRATANKLAPISGVTFDSPPCTQRRDS

SEQ ID NO: 972309 - protein, 101 aa, Homo sapiens
MTIQQTVLSEIYEDAVSPPQCRLKTRCHFSRVLTPTPPFFPVQPTPGYYIPRLNPLCETFGAQPHISKPPLVPKIYSPSKIFLKRPLFPLAPPFPPLNPKK

SEQ ID NO: 972310 - protein, 195 aa, Homo sapiens
RVLCVVALPRLIFGPQPACFGPAFFTTIGPCRPNIRVSLFAGVPPPKSGSKAVSSLLAVPLLCSRLYPFSYCVLCPDARLLSNAPRDGALCLSPFSPLRGILSAFLDDFLRAHSILGWSFAALPCPRRSLLNNPGGGSDSAPSRGNPIGAPPMGLGPFRVSPGFAAAPNFLTSPTKQFAPPYGRRTDPGGPADLP

SEQ ID NO: 972311 - protein, 208 aa, Homo sapiens
TGPNIRSFYADLLVRRYCAKTPSLFEGGLLCTLNRVCNTRSRALLQEDPFFMKDLSALETLCFPSSGYLFCAPKYPWEPPIRPKMRGTSLTMSIGERRSIFSWAKRCPRGPGRGDLAAPNLGSPGKSRPPVHKMCFCAPASCEGWASTHTRRIFCQHVIKPRTADTPRVGKNRGEKCLRAPPMCCARTQAPQKHGVFTGRATLPPRLV

SEQ ID NO: 972312 - protein, 111 aa, Homo sapiens
MDRGLYCPLLLLRRGEGLNRASIMISAGLSVPGFNKRAKTHVFRMFDLVVRANWLRTSSCAVPFIGSQAATDGVAPPPCCTARATDEGLANCLSLTKLEAGLSVRVAPPNY

SEQ ID NO: 972313 - protein, 80 aa, Homo sapiens
LLLAISLIMFYSLLYRPELLCDNRYLHAIRRCQPTIQYDYGNNELSYEATAYAAPQCTKTRPSAHHDASESHATPPPDIV

SEQ ID NO: 972314 - protein, 270 aa, Homo sapiens
LPWFLRLRTPLGVRGDKCGRIVCLCGVGGFMFTGSSPPVLGPRESFFRRAGFRVSAGQVEAGGLLSHVRIASVLFARPLVRLVCTRAAHRLAAWFSLLSTQFVGIHPATLFFRPENAPEVERTLGTPLEGSGPPGESQAHTLHTRPARGVNTRGVPREAKPSGGACSGSSGETCSSPREAVGQYEGEPTRTGVQRLQIVDSRTATACGLSLGFERTPLFHAHMASVDGGTQSNWPLPYPSSRVWGGPPFPPVTYTGKKGPPGGNPRNNKT

SEQ ID NO: 972315 - protein, 218 aa, Homo sapiens
DTVWRRVTTTGACVHPKKWVAQKDVRIHSPPPHTLCSRLCRPPPAQGGAHRRKKNRQGENNAHHKRGLRPPAGTNPRGGNAVCASCRNYCHTHATGAVRRCSQGRPPSDCALPLRGAKTRGRTATSGTDPPAGKNMWHTEAGPPRRSSARPQESRQHQRRVGGTHIIRITERLVTHPARGDTPEQFLNMRQENKICAHRREALSRLRNRAVINFFLDL

SEQ ID NO: 972316 - protein, 288 aa, Homo sapiens
LSVPTEKQPDHLSKARREVLLGETGKEKLPRYHKNIGLGFKTPKEAIEGTYIGQEMPLQRGKCVHLEGGILSGRVLTMDEDAEDPLSSGEIIGTYIRQVQRFEKRHKNMSVHLLPCFRLRSMICDIVTTWAECRPLSQGQLRFNVLKVTQGLRHQEGRFQKVQRLGHRAVSPQGYEVVFVIRRRGGLSVRLCLWGNPVTDNLRQQGEERPRDEKPAKWPGNQGPQACGHQVKRGDRDANPVGGRQAQQARVINRAGGCEHRVRGGIRGGTPEPQNARQRAGTAHTQHH

SEQ ID NO: 972317 - protein, 146 aa, Homo sapiens
MTRVHYGGHKRVSRGNCLNKKFGGVIWVTSLACLGPEGEENYVGFSNNSGGIGWEHAFSSHRSEEFNQTGIGHNMLVQEDGQPSEKDFGKKKGVLIPRGDGNGGVFQGVERQLVGLVEGECRDRWETGKLGEKGTRRSKCNGKRQD

SEQ ID NO: 972318 - protein, 67 aa, Homo sapiens
RNDDAVLPWLQNAVLPCAINCVLVEYSGWTIVIRESAKDIDRRMLTVSQESPGCKICHDGTYLLSMA

SEQ ID NO: 972319 - protein, 196 aa, Homo sapiens
SRVGGGARREEGGEGGRRTRGRRAVGGGRRGGEGGVVGAAGGGAASRRGEGGGGEGGGGGGPPGWTQAAQGGEERAGRGAGGGRGRGGGGDALSWRRRRKRVGGAGLAGEAEERGSRKRESRRMLLNPPQNLRETWGNMGEYRRQSVSCCWETLCLPHVLVVRRLLGAPFFRDLKANKKLTPEYSGISRSSAANNK

SEQ ID NO: 972320 - protein, 74 aa, Homo sapiens
SRGSTLLEARGRSPSSNVQADKPLRLPLQGVSTTFGGVLVTCILLAGVDLGGFLENPTGDWGRCNALDVRVRRV

SEQ ID NO: 972321 - protein, 148 aa, Homo sapiens
KTGGSPSRKPPQLRVVGRGAFFHEGSTSTPLGGGATLFPRVLRVNHHGIHRSTCSKEWGVSQSHKAHSRGHTQKSVSVRERCAQQSATMLGAPRDSPPSESALYTRSMYIAPYMLLRAPPPLVESHWGWKKTRLFSQTLSWFVKTVAP

SEQ ID NO: 972322 - protein, 103 aa, Homo sapiens
MKVERLHVLAAYQDLCPGHGEGSFTDSEIDRCNGDLQMVISESRDTLRVRGFSCTHSTDVASGQCRYNWNWSVYMKGRRDCGTCARRTFYQDNEDIARLRQYQ

SEQ ID NO: 972323 - protein, 74 aa, Homo sapiens
MAFKDTVKNDPGARTVVRIAARTCEVDLLTMPQRKILGSGVWLTLITEARRSNKQDLEKLTGGPRFAMAFTKTC

SEQ ID NO: 972324 - protein, 110 aa, Homo sapiens
QQDGMVAGPCELRGLVPAARLSAAIVSMAGTGLWYPGCVGATETIFACRLKGRASKWRNSRRETSAIIGMWEVNIHPSMDIEHGTGQGRQDIVRKRSKESAEELLFADKQ

SEQ ID NO: 972325 - protein, 121 aa, Homo sapiens
GLSLASTVVGDGEQILWYSLSSPPYPSLRISVSVLADLRGTSRSSGASPDFWGPGAGEPVCMGVIGDPFHLAKTREREWEGVLKKLRSEKSVIYAARIVGAGAYVRYKSEALGFQNFGYPL

SEQ ID NO: 972326 - protein, 203 aa, Homo sapiens
PERFPTLTIASNKFFFHGNIVHHGVKGRTGLLCRAFSVSSRFNHSFECPPRMMIVPGDLPSDIGSPAGHRQGMSGVNTPYGRHLEIRPHGSSGERKKESSTAPWAHLMCEQSNTPALRCVYFTPPTRPLLSSLRRCLLGKGSTLSLRHTRGGDRSEPGHLHKQIQSGGSQPPGSRNSSPTRVQWVCPSRDKVGSVRDDYFSVT

SEQ ID NO: 972327 - protein, 151 aa, Homo sapiens
MSIVHYHTLFGRFYFNVSDAISRRFGHYALSANLPPHCFSTPRGEDTLSTLWYVCYPLSSRLESTTARAYDYVLATTDTIFAPPKRSRYLNGFPADVTRGLHHAPPTQVRILGNRPVKPSENLPDILNNSFALDLPHAPTPNLRGFPANMD

SEQ ID NO: 972328 - protein, 126 aa, Homo sapiens
CVTRDHRVVSMTHIVQCFSPVNSGQPPNYEMLKEEQEVVCWGCPRKPCFPRMSTSRSEIRQLRPPCLTMWSRSLFNDPLHEHLLPGLHSIRYSVKSRDRKMVGDVTGPGYAPRQVPETSGALDLKG

SEQ ID NO: 972329 - protein, 292 aa, Homo sapiens
DRYFLRLPDRIWTVRTRATKLRPQYAGFLFAASLWLSVPSPPVLRKHGDTLSWTPPAPNRSWRGRTQAVVLGGCPTNAAPGVLPRGDHSSSGYPATPPRGVDPCYTPFFVIGPCSPRGIKRPTQNCLRDYCATIKRVLTDSAHGARGNESPPAPSGSIKHSCGPLHWWAITFSAQFRPHIAYDALGGPILVPARRVSLGGGTCGTTGSCPRTILCSRCRISANIRPRPLCGHRVPATRHLSLAPFPRRHPPEFVDGLAPPPEHGEEPRTTRTVVSTGARDKRKMFQGPPQHA

SEQ ID NO: 972330 - protein, 108 aa, Homo sapiens
GLSLCFNMCCGTEAESVVDSSSSPPIRPPISSPLASLRDPSSRALPCVRGTVPRHRLYSRFSVPFVCRDQAMLPRFVQRCIPHDRGRASPGFRKTKGPLGGFPKLFVD

SEQ ID NO: 972331 - protein, 162 aa, Homo sapiens
GDLLCSELQLYLGKRGTACGVNPCMYLVEKSWASCRSEELPRGAFLAPIWGPRNLKKKASREGTHGASSPRARGRRTKPKSANSAFNLQTFFVPKRGFEAWGGDPMGGKSGGFSYYGYGGAWGPTRGCLSTNESTHFFINHGEEGGANFNRNHHKAVYYKDL

SEQ ID NO: 972332 - protein, 284 aa, Homo sapiens
SAERAAPLIWGEPPRHRGLRDQTPHVVAPQTKRGGVLSPKEGTGSSSTKTRLFAKPARSAAPLKERRHRGVGPPHKTGLNPVSSSVKVVWKRPRQRPPSTCSNTNTHGAVKESGTPTRSTHAMSGVRLKQEPPPRDGSLRDGTPPHRGGSARVRRAHNIRKIVCRKNNPPLCLHICCGTRSHIRLVLESVTTSSRPNKLLVACHHTTGLLPTQKRNSHPHTLVTLPVLTTLVATPSRRSNSQGLLSPVSTTCSDAPTALIHINSLLFHVGVVNEQVAATDASRK

SEQ ID NO: 972333 - protein, 71 aa, Homo sapiens
AYPRVCAYSQVVHPMIPLSTNRYVALARPLFARDKMIERIMNQEKLAKLQAKVRIGGKGNCLRKNVRKVVS

SEQ ID NO: 972334 - protein, 287 aa, Homo sapiens
CEGRNVVSFSAYQAARSSEKTRSSPLRWRNVSDANSAGSGVQSSSALVTRMPSGGELSRLQLRQREGRQVRTEPETGHLHLSHKKYVHIGFYRGNDSGSERLYRNIYLTTYVEDHLKKQTRALPQDLHLSELAGQTERYTKTTPIVPLACPTPSIQWHSLETDQRLANRGRMGVIFSICIGASHIAWGPSEDNNGSFTEHSVTKKPAFNRVFADQERSGTRVSPNFSMEGHRHISGEHIASTRLPVRQTGNVNRHKHNIRSKPPQHTEQQRQRNSLDSQNTNDDCHD

SEQ ID NO: 972335 - protein, 138 aa, Homo sapiens
ILSRTTISDRRPRASLFFTPSELRTFEQTRGRYYGRGYHITTCSIFRADPPYVCFSRRQWHMAKLLRSTILGTSTHPTAIVLHTAFPWLYQQDVTGRVYNDRLPHTDPGTHRDERHGTSHAQLLDTWLRSYMNSNNVC

SEQ ID NO: 972336 - protein, 188 aa, Homo sapiens
MAPRFGGNVSNSWKSFPPGTHPRAFSGGNISSPLRPHNLWQKLIYYLGPLGPSKYVLVKCSPLSAILSDWGHEVGERFLFDEKRRETTLTKGVIADKSMNCGTTRIGAKTSTATLVCLEEAQNILKGGRRTKRRPTQRLLEKTNGSRGGTTTSHSPKAVVAAKQQDEDHARRKEPPNKIKGGIRPPQT

SEQ ID NO: 972337 - protein, 34 aa, Homo sapiens
MDCTILDGALLYSAIKQTRVYVSLFLSDTTIDRE

SEQ ID NO: 972338 - protein, 135 aa, Homo sapiens
MKTDELPPRCATQQGRPRWVRPPPPPPSSQGNTRRDEGPRDIAAVSMGARRVNKQLPGGALGPQRENSLRATNIFPLTPLVVISPGQAAPWGTRSGLLSLHWGLRRCIFNGRRPASRHPPGDGFHTPPHPPAPPC

SEQ ID NO: 972339 - protein, 174 aa, Homo sapiens
RCGLLCGPCDGSVTLASDFCGLEKERREVFGDLYTSWNPRANGMRCVPESLTRHWGEAVQPPQTTIWDLAIWEAEELGNEAEKPQNVLETYGLQCNMKEHTGDLVNKEITESTSHFRNLGTEDKNLNDTNWQSQYQQSMDSNIIRHALSATIVDLAFSEGSKSHDGSNGDVAGA

SEQ ID NO: 972340 - protein, 128 aa, Homo sapiens
MASPASECKSLENLQEADVSQCEPRTDVGRDTGDKRHPGSTQAEIVWLCLHSTSVMHNVETNDHRMCIACWRKKVLVIEKRIETPFKEGMPMEILMTRKCSALVVIDIGLSILWGTDVHKDEWEVDTE

SEQ ID NO: 972341 - protein, 265 aa, Homo sapiens
MLLVVSLVVAPSVLGCDVCRWAERAMEARPLWVPPNGPTRPIGASPPSQRSSQSFCGSPPRICCVQPNVGIRCPRPEHFPWFLPFPPGGFCLFSQLNIPVAASISSGYPPPGFLLGPALSPKPDFEQSPPPPFGDLFSSSLFSPQKPWVNEHLNWGSYALTLDKYVSNYSPFSRARTDSKGVTTNNSAKSFADTLDQGSNFDDPLYAATRGHGLSVHPHRHRQSDPPPRTVGYSSYGWKVGRRHSSINSLLCGRTPLVTPTLRIR

SEQ ID NO: 972342 - protein, 222 aa, Homo sapiens
AVVRAANQGVSNETASPPGKGTLDSPLRALFPRWERTVGPHSWRVKAVDHHSPPPPGGVQVFTHTAAHKRRSLCPLSTRPAAKNLVRQNPTHAAVSNTHNTCVGRPRHGKDSKEDIFPIRKERALSLEVFRQCLSTYFDATPCVSQSDFKRAPKEVRTVKPPGFIIDEPQVPRLCGHNIKSPRSAPTHPHMAKWDNPPPRCARMQKILSATNPQKGVCYHIT

SEQ ID NO: 972343 - protein, 295 aa, Homo sapiens
IYTVILDMPPDALIFPAMRSSRGFSQTLRCRHGFSPPVGLPFPLNVRESSTPPWEPLFKSCYGGTLKTRFWGKQRATLGPLPGQPVCYTLHTPIRGVFYCFQTRQPVQAIWHHRGRPTIYWWGSGPFSRNGDLSWSSPLPQALRGRPPPQVFWLPRGMHQYTCSLWFGPKTGPHQREFPPTPRCCTKARPPLRLSQREARRRCRSPFARVNNQVQQPFMRQIHHTTPLICSGPDYTPKPLFGASKHPHVAVGPHELCPHNTRLGPDHRCAPGQVGVGKSCFFGGFFSQKKFPPPT

SEQ ID NO: 972344 - protein, 132 aa, Homo sapiens
MGTVPRARKRSPKVHGGKQSGRDNKKKIWLEAEGSLWLENHEASRVGKASNVLARTLNLWTQREKMALLKWGPPMWAGKSGGPLAFGNKEPPPAVEKVKVHLDPGRHDRVRSAPRERSRVGDQLKKAISRLR

SEQ ID NO: 972345 - protein, 185 aa, Homo sapiens
GSFLWVKHSATGRPGGPHVFFGYSGLPIIHGIRSPLPGEKTLGYPLGAPLGAVDEFPLPLASSVAARCFYCSPLFLDPPGVHGTLGVLSPHSLLCLVSAHSAASGAMHVLAHRMGVNAPEPTTLRCFLSAPYVYKGTTCLQKTHGPLLSNAPSLGREGTPLEKIATHWWGSWLDYDTLYTERATQ

SEQ ID NO: 972346 - protein, 185 aa, Homo sapiens
PVVGGVRVDEVGVGDASGALCSFVVRRPWESPSRLTFPRGVVLGGDPFFREAAPGDAPVFSRRSGNYLLGCLRVEPPGAAFLPGGLPRPPLCAGEVMLRKLISGAPSVCRPYILVRSPRFFAPPRTGAAYPPPPGISSSASPLRFFQGTKAPSSQTPGGIPLPAGPPPGGSSWAPLPPWGVPRVP

SEQ ID NO: 972347 - protein, 144 aa, Homo sapiens
DVLRQLLLVDACVRLYCALAVLFQECISCGVYIFATTHFVMGLPCEGVCSHTGCLTGKTLRDPFGGSLPPGWSKGRYQNCAAFPAFPPSGTAIHALLCEPLPYPPLGLPLPSVSSPLGQNFKEPPPMFLTPPVHNAFRHKHVTV

SEQ ID NO: 972348 - protein, 121 aa, Homo sapiens
MLGRRSKGRRREPVELCRCSPCVVCLLAPLGLPSNGVCHTGLRWEWPRLFVPPAGWDQQQLWDGSVVLPLPQEVCCSSSAGDANPPRRCWVPLMQDLLARTLSLCSQEAPAFLSFKPAPRL

SEQ ID NO: 972349 - protein, 114 aa, Homo sapiens
MAVLLGSSACPRVRLAVAPSLSCHAVALLPRDEVPPARIPTGTAPTALSFSTPRSIASSSGDYFGAPTPLILVSTPSSPCVARRTARRGIPPELLLVKNIRVVSPPGPSELHHS

SEQ ID NO: 972350 - protein, 140 aa, Homo sapiens
RCCSPPPCILPCPGVLSVYRLRPSHNAGGFFFTPPPNQSAISGDSLSPSVHAAKGASRQMRGGPQEQLLELSRTPLACRQVHRDAVPHRVDVLSAMGSHGSSLPSGRALVARFSHRSLPCVLLASPRQQVLSPLAHPPAG

SEQ ID NO: 972351 - protein, 296 aa, Homo sapiens
VRAWKTERDEAKTQQRVAYVCITASPRETVVCRGPILVVIPPPFSRRDAIGPLPRYWPFSEFPGFSSVSRAAFKVARMASTLRGVSPFLRGGTLQAVWNCPTTNDGANFSSPCCRSPPLPLLGPTGLRYPQRGALHLRGRTWERRPLAGSPPSAPSPDLGAPLSGGLRSSGTLRTSVVGDALWMHARLDRWVATPCPHCCSRVGGAVVCVLAGQSFFSEDPPSRRPAWLSRDSSRGRSFSPQPSGGGISRVMPNARAKAHVGGLPLTPLYERRPPTHPPSGCRLAPPSQKRIGRPT

SEQ ID NO: 972352 - protein, 271 aa, Homo sapiens
HRRVGRRVREALLQCVVTSTRLRWSPAAVLCPFCDYIDVGHKRIPSRGAHRPVVQGFFRLSMSRVFVALAGSCCCSTSPQAPVCPTLPRPVPVESRFAVVWRYSRLVVNPCPPVSRVVLCAASLVVSLLFKSERGLREPPLPLRNSRRPPRAWTLWIIPVLAAEFFRIRPTSCLPRTSLRSPRGATWWTPLQGAPHPGCTSPSSPPHFKILPPRNSCTTRTFPTHVAFNTESHFPSCLQQDTITPLTPTPGLKTRPTTFAILCGAKPPPFH

SEQ ID NO: 972353 - protein, 325 aa, Homo sapiens
CGVFSPSNESRVIEVGERGRGETRQQKIADATITCMFTVRLSHDTAVGAQPDCVRHSRLSVGAFVHFVNRPAAPRVSPVPPAEKFVSPGPRVPHEASSQNRRTSNGVVDLPKCDAVCFSAQQPSRGRCCFSLLCRPLLGCTPGGITSVLRARMFQSLVPRRVFAPLVRSSRLLHRVRPGSLRLYTDSGLTGFQNLTSCPSVVRRLTECRSPVAVTTWSSSPSMRMLRTSFQTAASAHEFATTRRQVSFFLFLLSRDLNPPIVVAPRLFDTQDSLPQCFCGIPARPRAPPRVGWRHPRFTPRAALLPSTAGGSPGFFLSKPNKTFL

SEQ ID NO: 972354 - protein, 108 aa, Homo sapiens
HPSSLTFPPRLFYPLNIMSLPAPQGFFSHSTESPLSDIMCVSPTGAHPHLPTRHIPFCGTHTPHPSATLCFVSLTGKHTPARGPIFEQSFRPPRYIVFYLPPTHHRTR

SEQ ID NO: 972355 - protein, 154 aa, Homo sapiens
MVRAGTELECPQLGFVFRARNVSRVRTSPALQFFPRLSHAPPLSTHGVFLAPPLVSTHAERHSGLPHPPRGVVLTLAPASRSLAPSMGARMHSRSRKSRSASASPPTILPRPRIFLVKRISPRHVHTLICTLIYLFPSPSTLICRLALLTPPRF

SEQ ID NO: 972356 - protein, 182 aa, Homo sapiens
SLEPFFWGRDTLIWCIQSRGVTQGQRVPCPALCHRRPPQRGDPPSPRPLLPKGGSLHGRTQNIRGKRVRVTRPSNKIAPNRRPHRGGPRSRRTRTGGASPATRAYRVPQTAIILQPAPTRCPDMNRGSETSEYSAKHPRKGVSPGRKGDIKTGGPDALWRPDEGDPPNKHPPGVAPPPVAAP

SEQ ID NO: 972357 - protein, 238 aa, Homo sapiens
MFRIPRWGTRSPTRVTPRLIVIRPLLWAYLAYAKYGAARILWRGSRSPHTSVAATTYNSSVSKLAWVSGKKYCPGNFAPHYDSGGTTSAPATTVLSWGNTLRAHPHTPHGRRNHNAARCDHPPKEEYHDLRRPSQPPTLVPPRGRPRRLEHVGSPVPREGAGTHVWAGKVPCFMQSLCHGAWFNFVSPPLVSHLPLVAPPGADIHQAPPGVSLPPGPPLDRFWVFFFFFWPEVPPHIT

SEQ ID NO: 972358 - protein, 152 aa, Homo sapiens
MPLPLRSGDSESLDGAHTNAALCPAGIRIAVIFPGLGWFQMECTPPRGFYEALAWSPLAFTAGFYRPPGDPELGIILVFKLQTPINTPKSRKPPVNASTTQDMLCRHQFILYNTAQHKVRHGPGYIPIPPPFLQQETTNNNAGFPQRNTRKE

SEQ ID NO: 972359 - protein, 130 aa, Homo sapiens
MALDPFGNKNVRGMTLHVVGCPPSMVSVTNRVQINKPVFAKTFQRNVAQRISAHLRPMTSRFIKAALCTHVLANRQQFMFLDTDPPNFRVQCRQLQTHFSSNISGTPLFSPRSFQKISSTLVDVAPNKRS

SEQ ID NO: 972360 - protein, 156 aa, Homo sapiens
MAVDTSRNYRVAARSLGAPAPGHPMFVTPRFGHTDRPFRGPMFARRNPVAGDKNILGPGMAPTHARFVLATTRQRCGPQRCHRLNPGPTPSAFVPAILRHISWGQPLHQRKLAGPPPIAWGDLHPWSPQRSERPPSSTPECCHIIPITALTKIVGC

SEQ ID NO: 972361 - protein, 210 aa, Homo sapiens
MSVKGEKDIVFLPKAVLHNTLGSLIQSGSTKQKLLKNLIMPASASIHLYEGDILRTSQDEEVLTPMHLCRKTPPSHIFSKDTRPRQLVLTNSVSYEATVATLNMIVGSPTSVFQGAPLEARRVYDISIFEGGVELMSPLNTVLVQRVYTCAHALGNKSVVPTLLCNPPPKPRIRFSRVRVSHTRKSGGVKRKSFGNKTFLKKKKRTRLQN

SEQ ID NO: 972362 - protein, 281 aa, Homo sapiens
QKRNEEQRRQDKVYQRIVAKGPVQPVPHGSPRPWARSALATGPKLRTDLSTLGRKNNTQGGQGNAPKGVTTVGHPRDHARTHGPVPSAPNLGRTPLANHSLGTPPGRKSHPLSSLLAVTPGKVFNDLPGDHLYSARTLVTASNDALSYLTRFVRIADEPHGGALSPHKCNAAQGSGVHISTSRSRGTPQPGGYTLRDSVLFGPHNAQGWVIGRQLYPSGCLATPPPHVGPIAPFPNPLSRGNNTLPLGPPYTKDTHFATGDMWCVTHRDQIFHLGRAFQKK

SEQ ID NO: 972363 - protein, 118 aa, Homo sapiens
VKHAVLHHNTNREPILYATSPFVKPPFEKHDIKQCVSRKTLQTLPVYQGPFAHTVVSTTPRFVPPTVMYHTHKGCFYEASHTQYVRDNTTTSTAFRNIETAFFISTRKIIVNTPSIRI

SEQ ID NO: 972364 - protein, 180 aa, Homo sapiens
MGVNRRERRSYLAEEIDSHSQRDGLFYPTTVGAVDCYCSALVVWSSQQSCVAYCDFRRRESCVMSELQPPCVAYGQLLCGVAASRTTPSVWAVTLEEARQTCIELVLKGEEWYFLLPSRQQLTITAGEYIMYAAILSHYTSWLPHYFLPPSFNFYISDLSVFAVPHPHANNVITRSPSLT

SEQ ID NO: 972365 - protein, 190 aa, Homo sapiens
SCGLARCQVEGDVRHLHCWGKREWWRPPAGCRTREFVRMHRWLPARCSCVFRGSHPCGETLVGRPLFSRKVCCVGQGIERLKVSRQNVPCGEPRAVSLLGSAETPKSGDNSRYVVFYTGRTINGPRPYTSGYKSGPHNASVKASSEPFSRTPRPIQATMLHTSTKPLYQIPTSGRYNTPVSKRYIYDLSL

SEQ ID NO: 972366 - protein, 299 aa, Homo sapiens
AVNSCPGPLVRAPRKWVSGEYTPAVRADGRERPCPASPRGGLTKLANGPALSGKKRMDPLRLQDPNERLLSWGKVQPARGHLPLGDPHVLSRRYDQVMPGARPFKKSPLLPPGWPPETIAPPSGRWSPLQAPRVGPPFSTLTWNRCPTSYSAHFWSESHPPCPTVPPFVRTDDNLPPPHFSASRSQAVSQGATGRSVSAFHHEPPMVHAGRSLRTPPAEENGGCDAVQGVPAIGVVEERIFRLEAATHRRDVAANALLHRCGADCCCLDDPSLAPSRILWSHRFPSGKVGRPKRHSPHD

SEQ ID NO: 972367 - protein, 131 aa, Homo sapiens
WCDCLCDLLVGPAILSAGFSCPGPPSLSVTGKFSCPLFAPPGPRHAGILLLHAGDVCSVCTAPAALCRSWTAAFCRASLAPPQVSWCDGVCPLPPVRPPHSSHLQCEDCYLPRDCPPHGRRLFSIILSTTL

SEQ ID NO: 972368 - protein, 175 aa, Homo sapiens
MSTLRMISAAFCLCGRNTACVYPRPHRGVEISVCESRPQHLALAAPLCVDLGFRLAKCWGSFAHFCVNAVQRYRPPWGWFKQVRPLGVNNYHQGVKHTSSQNSGGSPYGNLNRGPPEHPRAASRHITAEVDALPMRLKGHLIGRSIRRSQHGLPPLLKFPGPPRPKKVSREENTK

SEQ ID NO: 972369 - protein, 274 aa, Homo sapiens
CVCPPPLGVPPFPAAYLPPGAFNMSAPFLYLAGPCYTVPASWVGSALPIADRVPCGVSHPKLSCRHSLFITLGVLIHRCCRGCEKIFGAPRRRPPLGHLMSPPRRLPCSPLPPGVLWPPLRVVIYEASPPKSTRLLYSRAAPGTPRSPVLLRGPPSPMRDELPGLVFPPPSQMSAPLTSSLCAVSPADKHLLCPRSVLPLQGTKKVLFFHTGRRSRCDSLSPAVRVLPPRPGTVAKQADDPNIMAAPHDTRGEQGAPRGKTCEHRVQIPKTRAG

SEQ ID NO: 972370 - protein, 309 aa, Homo sapiens
ALCVGERDYSCALHLFVPCCCVPLSASLDPVFTHRFPLPSLFVGPPFFSPYRFVPPAHIRGSPFPANSGPPRATQSGFQSAPSCVFSATAVANAACGVPGTPLVTGGFYVSCAPSGFPVLPPDGVFTRAAASVFSNYGPARPNMLGSFSPRPCPFPLDIFFIDRGVNSPSKTHKGWATIFRNALPWPPLASPERFCRTTGQALLATLPANILINLHAGHGEVTRLALSLVRKNRGVRTIGGVWSRPLHILRSDPHLWPPQCPHSPSPYRRFLQQHAPFVFVSNEVFNEYENAPSFLKKPKQKSLTTHKT

SEQ ID NO: 972371 - protein, 128 aa, Homo sapiens
MPGPASFGGDPPENFCSAPLYKSSVPAQNSPGFFPFSAPGFFSQDAPPSCVRGLRPHFLLWCPAPAVFIQVLPSNRLPWRSKCSTTTYRARSREEGDLPLILRPANAAPLQLVVRRAFVLDASWVASR

SEQ ID NO: 972372 - protein, 82 aa, Homo sapiens
KLHVGSRPSVVSRVYEVHSVRDLCLRMQRAPWLTTAQGNFRYPGPLFLSPDSEVILGGVSAKYLMWARSITLCDIMPSSPLL

SEQ ID NO: 972373 - protein, 307 aa, Homo sapiens
LEVDQRRRVEQKRTPTANNNSRTSFLASSVSMHSGFPPWFASLGHPLVGPPPVGGRCGTPGARVRYPPWGPSPPRPCVPAASKTHPSWVLFRRHIAPASVAPFFARLSAWDKDFPGFSLSSCVMATTPVGPAPFLSPATHRPPLVQGDGSYPPRPLIAPLAPLGVTLVPPPPSGSITPRGVFAPAGAPPSSWEGSPLGLSLLPRRGGPANPFSQTRLGAPPATAPREWVAPGVGLATYLLWKRPLSQHGVRAPLGAPRKVFLSGAPSLREFGSLPLRHVVPPSGPGGAARSFIVARTRPGCAPVGNI

SEQ ID NO: 972374 - protein, 140 aa, Homo sapiens
MCKATPLDLGSLQQSLTGRANEFPNRGRASEQGPFLGRRVYFLQMPKGSGSNALYEIVFLPLAARNNGKNLASDAINNVPPLFPFGSNLQPSPIMGRLRHRRSVLDPSAENAPIICYPLAIPKRCAPKRPVTRLCNSRPS

SEQ ID NO: 972375 - protein, 127 aa, Homo sapiens
MSFSKQEGAFCEFYRRSRAVSPPTHRGPHVMRAPVEKKDFYFGGLNAVCVHHRIGPTSVPQDLLQCPTAWDGAPHFSPGCFARRRGIEGGTRHPPMPRQGPARESVEVHPQTNKRFFPDKNTLISIC

SEQ ID NO: 972376 - protein, 152 aa, Homo sapiens
YYRNKTRTRYTSISNGLCIPRPYPFMWCHPICPTKLGVFSIKQVFSPTQKWVHYNQQIPGNLRHHFTKLPVVRYNLCVKISLVPRHKYTCWCPHTCTIRAAEVPRAQQCDFAFMFLPQQKPSGGSNPGEIATPKGGKTPLPYQSHLHEEVSL

SEQ ID NO: 972377 - protein, 184 aa, Homo sapiens
MLPTINWGYPPVCYKTWLLLYTLASKILKLGATNKPPAILPPLTPGYNGPFDTPFGGRQEPRTFFSRVLAPPYLLALFLGYVPPRISKSRAPPAPREVLANAMVPPWRASLETATLRSHLVRPPGPLHQSSGRPPRPRFLLFITHTTKGLISVAYPNTYHSFSTQKSAILTSSHTNAISSSPPP

SEQ ID NO: 972378 - protein, 239 aa, Homo sapiens
RRTQQSLAGVPCVVHRVMSLPPRPRFTPGFLSARLCPHFLYHNSSAEFRFHPPALIPGPPPSPLVRALNPGCARFLSAFLQLFFAPSVPPPPLGPGIWPLCPRVVYRATPLPGSHEAPSRVFSPVRVTPRGVCPPPAAFVSTPGVFWFMGQSSSRFRVFLASPPANTKGLRDFFSPEPSQAPTGENGWDTHLALCGLAPPLFAPSAALCSGDPFPHALLFLSLDRSPAPPAPIAVLLCA

SEQ ID NO: 972379 - protein, 37 aa, Homo sapiens
MRYVYHKFSPRTCPVENTPPLANFNPYTLKPFCLPHK

SEQ ID NO: 972380 - protein, 158 aa, Homo sapiens
PPASVCISAPVAYFSRVLPAFPRWCPGSFRVYGFLPEAEARATGFPSEPFLSRAFSPPWLRPFDWGLPALLPGPPWVPSPRESLADSSPVLKRPAGSPPLSSSRFVISAGLPNRVLFRPGHTFPSVGLHPPNAPAPRMVVWAKYVHPPRCSRSPGRSR

SEQ ID NO: 972381 - protein, 295 aa, Homo sapiens
QRDVSQGRPHRRLCARGFARVLTKLRLQWFSGRVETSKVRGPGNESPGDGSLVRGGGLRLCRRLPVWAPPVAPERLLFRQKGFSPSFKPGARPYLLELAVKPPRLMCVLRPPPRLESFSSQATPAAHFGSATIQTRESRGACLQDHEVYQGLWGIGEESPLVWSRISHERVKEIILSPVVCAPPASCESSGVSKTACKTCMDVPMRHLKTVNAVYKRGSMDDHKAMVTAFHRYRRTISGAPWRVFYLCAEADYVDMSVRNTRDRFCDWEGSSAHQIFAVEDSRRTPSKSNGPHDK

SEQ ID NO: 972382 - protein, 293 aa, Homo sapiens
PPLGASLRAASLVGSPGCSSTTHLPLDARMLKGFHEVSIAFAVGAVNARGLFRVSAAASLLPDQQGEGSLPVCALPRSRARLSSPQPGGFPFSPSGAHLVVGDPQRRLLPPGFGEQALVPLPPAGAPLSLPLNGEDFLPGFQGPQRALSQTSVPTGGSVFSERRTVRYHKFVGQKVSAPYVPTSMRTPQSSLSRRPPLSIHEELDRFPLPPVRAQFVPHDALSPRICFAPQNPHLFLGDIQGSAPPLYRSRLDLIIRDSCTAEQDMESGRTQRESSGGPKTTRQTPHLDNSPH

SEQ ID NO: 972383 - protein, 142 aa, Homo sapiens
PAAMSLARSVFLLGAKPVYFFFDAVLVARASPSRLLGPPPLSVGVFPGEGPNCRLHPNWAVISNVGVPAYISAAIFTLPIGETLVSTFRKRVVPTTRVPTEVVSLRKSLVLGRTLSFFLVVPQSVFLTIGLPAIIDYPSFFR

SEQ ID NO: 972384 - protein, 287 aa, Homo sapiens
ARPAMFSVAPPFLVLETPPARFFWDTRRRFVPWCLGPPPFCRRAVPTSGAVTEIARRRSCSSSLYLREPPLLVAHSRGRALCHSAPTTIVARALKEDRRVSSLYARCRRRSRSNLIRANTLLVGTPTHTLPHHNSRAFARTCAGWYVETHHSFFLHPPPIYNHHTCSAFPVPQHVASTSSPRANKLILLHDAPYPHHSPATPTCGEPTSFGAHSSASPPTIILRTEATQKFCATLINSPPPYCRFIDKPLRHFNASQQFYFLYTTTIALNYHMTTHKLQPENNKIDN

SEQ ID NO: 972385 - protein, 203 aa, Homo sapiens
ALVRFGEHVLHLPVASLGARLDLGVLLPVSALAMPLMSPACPPGLLLRVILGRLLLSPWRLFTASCLLAPTIVIPRSVMFVSSTLTPPVGACPGYLRPEVVQPCPYLCVCSIGPGCSSPAWRFLAGSDSSGAGYSTPADPMCALSSRRSQECLDLPSMGCLSWAFFPGRSCKAGACPPRCASPGDKLLRWIHPAFAGHRSCFR

SEQ ID NO: 972386 - protein, 131 aa, Homo sapiens
MRISAWGSVRPHILVSSLTSVVAGFLMGSHMRGSLETRHSFSAFSVPCRSEFPGWSFRREPVGTLRKRRFLCIWPASSVFPLPPQVWPQPTVAGRRDSAYSTLIVPVLPRHSPPLPYFRLYTASSPPAHVP

SEQ ID NO: 972387 - protein, 274 aa, Homo sapiens
LLVVGLSCLSVSSARVVAAVVGSSPPGCSVRPLSVGTAAPGFRAGCFLALFGVFPSTPVRPIFVRRSRAIFLCRPLNQVPCSVPNNYPGLLPLPPGGAASFWVALPHRVFFRLAPPGEIRFPPFPAGGLCRHNQWSAGIIRCPPPAFLSRPRSLPPAADYYVNSGGILGPPRPILLGGVSCPVYSQHRQLCFVAHHIDFPRALWNHTLGGPQRVTVPPVFPTWRGWETNPPDCKEGDSPSFLVRRTRFPYNTGVLRIKGSHPRRPHSARNDSRP

SEQ ID NO: 972388 - protein, 308 aa, Homo sapiens
RFCAEFPHRSGGCGGALVPPPAGWVAQCDFGQGIPVFRGRGPGGPDGRRGGSPVLCAPGLWAGSPAGCPGPPESSRVAAGDVFGPLWLKSRRRPPPFPIVFCVGRPSCHVASPAAPPVLEGFLQEFTPAGAAILVLRYLATPFLSGGLPTHPGAPTRCLGDSSRRSHAVFPGPLRKKALQQRYVFPRLGSASPPPFLSLCGGKTCVSKLSAINRGPSIQQGRVNNQAVYGNEHTSTVQLLCSDESMEMSFVRTPHVEVCTVFGGPRSSARRVLIKHARYLLHGPNPLPPDICTPKFRAPLQNVKNKKT

SEQ ID NO: 972389 - protein, 147 aa, Homo sapiens
MDMPQAPPRGGTLGRAPFSPGLFFALRARSCSWFVSTPGAAAPESGSRRGTGCCPRTFLSLSAAPVLRPPRVCEQPPPLICSPPLKGPPYVCNRLFRYTTIYRVFTPPPVQKTPEMTPFSLIPHGPTPFPPRFTHHVVHSPCRGKIP

SEQ ID NO: 972390 - protein, 75 aa, Homo sapiens
MAPNRATLAYDESGTLNEESVCLRLLWVKAVFVVTNRGRQCSALQIGDRRCVVEYNISPKWGPKNILRDNFTATE

SEQ ID NO: 972391 - protein, 142 aa, Homo sapiens
MVTPATWRGKPARGRNHDEAPHVPQRVTEQVCSPHAHKVMRAAGLLLKSPHDSARGHPPHEETTNSSVAVFVSTIRHNTQRAHEQYPAAYMRGSLHRSTRPFPPHRVCWKDPPQSCPWVGALASDRASFGTRGIPAFFKVVM

SEQ ID NO: 972392 - protein, 266 aa, Homo sapiens
MCSPLENVVQHVTPDMCGYPGAVPPNRGCPKLMVLENTYPWADILGISALSTSGPKFPLSNRKFTLRGNTVCTTRYTAPPRSNTFGGIHKKNSWPPPYPPQYFLREWSKNQEVVHGPVCQNFGPPLTGSGKECRTPQCTTRTFSCPRPRMHTIYLLLAKRFMILLPSNYWREQCTPFRYKKSIWAHIVRVAPGSRLRIEFKSTRSPHLQGSDSYHNPKVVEQWLVQVVAPYTTRVAIRDNIYNTRLGSHSHEGPSPGRINFFVGDR

SEQ ID NO: 972393 - protein, 199 aa, Homo sapiens
SGIKHTHSIHMDYTLLIFPRKIFRVKQYVLPQATDFSSHTFFPLFAFFPGASGLKIWPLLTFRYSGLNPPELVSFLSAPFYTEYLLTPSLFRIISPTYQNPGLRIPGPQNGSKQRALKVPPGTHCDSLHLLRYTDRGGKKPHVGGAPPMLIRGVQWTPRPSHQEQPPVCARSVPTKPPGVGGTLPPREVPPCHDTSIRC

SEQ ID NO: 972394 - protein, 131 aa, Homo sapiens
LTLPLCLLASPVIGVLWRPLLAVSLILIRLPCSYSYNIWPLVPQILAQEGRFICASGKEGVTRTPRLLVPPHVVRSSDTWGFPPKLPCLVSPRLLTRVLLHSSVPECGNILTSRFLGRSPTTLGGEFNSLL

SEQ ID NO: 972395 - protein, 114 aa, Homo sapiens
MGRLFSWHPACRAFPGPRRYCPIIYLSIRRGPDTHMDSAPDIPGIRPPPTGESPTTAPGTSGVKRGTQEEVGLGPPTLVAISWPQGDLPGGMFPPTARYTVNTVEAPKTSHGTN

SEQ ID NO: 972396 - protein, 98 aa, Homo sapiens
VRHSTRQTSIPAAKMGHYLPGAKVQRELRSWGPPRIIVRAPYLLARTLKSGQLIIPERTPGENHAAPAQMRMYKIGISGRRDDPGNETLRPTHPEENL

SEQ ID NO: 972397 - protein, 302 aa, Homo sapiens
AVGDNNNCGGPSKNTNGGGMTPRRLERWKQTRGHKLRADRGGAPKCRKVIGATHKHSLPRCCARLSADPAEKRGVAVKNERVVWHPRSTEPPYVVSERHTSPPRYHLGRDKIREDRAHPPASKMARWPPPLASPRGVLSTHNQVVHPPGGVSSPEEGLLKILLLVTPAPKAPRQTNSVGAPPRRPVSGFVITHTHAAYESVDVTPRTTTMFSLRMARSHKSSNNITFACCAPAEIMRQSCCPPQNGTSYTPRYSFRKHSFRGTKCSRDVGDNARNSNGGRGIPPRTKLTYGAGLERTPANKT

SEQ ID NO: 972398 - protein, 279 aa, Homo sapiens
SAPEKGVFTPKGKVCRKLRANTALGRKPTSRWGETPTGSGANVRTRRVCRKNKCRQGDRQYNAVGVQNGTHIVGRGRPDTDHDMAWGRRHTTPACHHVGPPTYGATTIWGQTACVGSTNAARVEASITVVRAAHGKPTEGYLAGGHPKAANMVRPPRPDRVGEQRRAPRGPPSGGAGPPQEVPLGRVTNAGHHTRALRQVALTAHIGAQKAPWPLPLTKRKTISSRTNNTSRCGGPTNASGWSLCRLSIQTHGHKSLSPPIGGTCNTLPPRAGVCRSKI

SEQ ID NO: 972399 - protein, 140 aa, Homo sapiens
MVSASPVTTPTAQQTQGPTASQCWAPHQAQSVRGRHTAARPHILSSEQQHTTAPADTRHRPQRGTSDTYYHGCREPNNGATTGAHSHLGGTPPEQAPAPTAPNAGTYELNREHRRPHSWHQDSRARKTILNIQRPSDPPT

SEQ ID NO: 972400 - protein, 269 aa, Homo sapiens
MVPLAENTCSRLAVSSRWGLASACKVFAGMYTHTRSAVITPRTMCLWAGAPNFSKRAGIHAGGYVLPRHVLLPSCVSPPFCSPPSTLPPGIIYGGRYPPCALLVAPRLSGIKCVHAVPLVAVVTPACGFSPRGKPPFWLLGFPWQASPPPLKVGVILNASPSHNGGDHPRPQFSRASSGGSRGRVRVCVEAHFSERSRSQPPMEKAPLCSLRPTGCLAAPQVRAYSLGAFARKRLTAVPRIMRGGSYTFSSIPRRSGPKGKKIFEPPHI

SEQ ID NO: 972401 - protein, 281 aa, Homo sapiens
VIHITGAILKANVHKRPQRSRGTLRKPCVTKTLPEKGPPGECGQAGTMAPRPASMCFQGLRHFQFREAKSTSGRAHRIGQPINDLGPKERLSSPLPAHADGSTPPPAIGKTGHAQPVGRRTSTTQMARAFLVTEELIRAICSIVKYAEERWLNTVARAFSGFARFLREPDIFVNKKGGSLQFSHVRAQRAKRIPPHHDKDPTKSVFWKKTSGGGKPPRNTVNRLIVSWLLPAYTLHVRGSSKRPFVTGRSIGHGPSRCQSAGPPGWRPKYFAKKKEPTNMT

SEQ ID NO: 972402 - protein, 307 aa, Homo sapiens
SVSVSRYPLSPDVRSLSLSLWRVVVSLLLCGVLRSVRSGTRSPLRLRAPSCYPPYGVFPSAVPLAVPLVVNPPPLSVRTPFQVPSPRPEQLSRGFLPLLSRVGRLPRFSLPSQNSRCPPRAIWAPPTPFLSSSKVPPSCSRGLKNSPTFLPRVFDMLAHQEPTIPALGELKRAMAPRLWRKELLPHDSQRLDNPPTFKVINLHECSESIYINSVDFILTNPESPPFFSFSHHAALVYLPLRFILSILVLPPLQDPSTKCQPTLYPTRTPTGIHMYGKTMQTAQNPSLGSPPGSPPGGSMEAPFTPHK

SEQ ID NO: 972403 - protein, 307 aa, Homo sapiens
VDQKNRGGKARQRRAQALRSRISRPPSLVWRKVRPARGRTPPSARPLVDTTRALNRAGKDVLNGNQGILLLNGHSAIYTQTVVQCPRQRTAESRVVPYLSPGRGPALLIPPPREGEICHKGGSTASPRPNHVRGRTTLLTQRLGKKCSQQRAEQHDRVSTSAAGTPRSARGGHRKHRPRPTIHTCSLWEYTPHVQHQGQSACPDWYQKPQHFQRNPLTELLECQNNPLSSVVRLKLNKSGVYRPPYSAQKTGIPDNSPGDLEGTYETALIMHYAPEDSFSASRPVVTNFLGETLRGKKIGTKRFSTK

SEQ ID NO: 972404 - protein, 81 aa, Homo sapiens
MSGDSGAITAQGTHPAPSLDRLTLSGAPSGDEVTPTLGGARADEEATEARREQTGSVEPQRQRCDDRGGGPKKTVISPTNM

SEQ ID NO: 972405 - protein, 110 aa, Homo sapiens
MYWTVPGIPGQPTFSGRRYPPVVRLSESRRAPISPNLGHGPSCCDTYPATSPIGGPPPIKRSIWGLPPQPSWQQGVISELVPSPGKDSITLLETVTSTHSTPLFPIPPSR

SEQ ID NO: 972406 - protein, 81 aa, Homo sapiens
LAYQTVRPNSLDSLRGTRRIILLGKKFSRTTVFSTPDVVPQPKGSPCAQGPLIFEEGAQPPLVVIGASHALSQLDTQGLEH

SEQ ID NO: 972407 - protein, 143 aa, Homo sapiens
KALQVAPGPLVCRPPAPRETGGEPPRHGPKRGVAQGKVAHPNLSQEVIDTHTRVLRRCRSLGLDNTYRSSWRVKILRAPSLAIALTIKGFSSWHHTEDHIFPLIDFAYFVPSSTRIVLRFFHSNHLMSPLCLYIANSRFQPHD

SEQ ID NO: 972408 - protein, 302 aa, Homo sapiens
KVQRDRVYCMESSPRMFFSRCVDPRHGGLIKRPFATVARLPQAFGGGQTQGCVLPPFGEFILAASPSVYQGCVPRPDLASLHDTVFVLVTSARMSAPPGPKNRAPRQRENYKADKSSVNGKQAAHLVMPHRVRCLPKAPKEGPQPAKQGETHTSCPPGVMIALMSERLAKALSHEDCNSPKERNLRGRRGGPPPGIPRTHLRRHQGPAIVVLQTLVTYKNATLRGENLGSNPTRDRENATKHKAPRLGGGAPESTEHVVRGPRWTREKIQLQNLRRASEVANRVQVCPPAPTPWVKRIPPHM

SEQ ID NO: 972409 - protein, 231 aa, Homo sapiens
MSETRPADLGVTRDFGRNFWHWTIIHRTCGPRTDAPGVTVNKQGGTPKTIETHLAWTPRRKTFVLSVSSPHSCAFKLCFFDGSTNAAAFWCRPSFLTLGSVCSTRGFNAPLEQRQLFSIDSGSRRTPEIILSRGGGTPPCSMTSPRGGETRQAPDPLWFLEARHTALSFLDPPLAFKSRGIPAAPLQNSVESGLSFPIIAGSIVANGSRYRGPRYACMLGAVKPPFTKNMT

SEQ ID NO: 972410 - protein, 66 aa, Homo sapiens
MIDPPTPLGVHYSPTPPLTKQKIPASHLHTAGHTTHPYWFNTPPFPPLFPDVPKPRNNPGFPLNTK

SEQ ID NO: 972411 - protein, 138 aa, Homo sapiens
MQPKKTVVVTLYLHGRPPLLRLQKVSPGSWRPTIEEGVNKKAGGAFCGRPSPYWGTLCDGGFSNRPNRGVTKVLPRMLARKILSNFWIIGPPTQVILLRTPSIVISAPKSGMFFSVNGRQYTLGPHTPLRARAVSPPR

SEQ ID NO: 972412 - protein, 231 aa, Homo sapiens
ASEKDSQRTERGGKLTGSERRKSRDAVKCPVRPGNHSRLTRIDCKRGYAKPTTTRVLPDAKDMGHSLVKKKRFLKKDACGVNIQGSFQAIWGTNPFKQCGSCPGRHNGWAVHKKAIHTGDNSTVDPGKWEESAPCCGTGRGPREIAVWHKRGGPRGRRPLGTPPWGRRQRGQTHGGEQPQNHHKLSIAYAHANITVFHQGTRGNLTRRRWSTGEHHISATGNAELGFDEYR

SEQ ID NO: 972413 - protein, 58 aa, Homo sapiens
MRQENANRWVHNRGDPYSLFGFSVDKTPEDRFTKVTKFGFFEQNTPIESGKPENNYIT

SEQ ID NO: 972414 - protein, 324 aa, Homo sapiens
QCRAEAAVFRRVAGVVCVRFLWVLCSGREVVVSVDHAVRWTRSPSGSPAGVCNRPMGVFSFRSGALLLGGTPRTTWCSRPLSALPSRALALIPGGFSPFLAPWGSFFPARTEQRGDPRKHGDNAIPDGSGTTLGGYHRDSGPGPPERPVIVPPVGDWPPPTLCGRRHYYLYHVSQVMVSLIKGAPKLTSRVGNHQWPGQGAGCRGIFNEPTLRELSWGTHAPRGSGGAPHMGPPPLSGTWKQTSPTQPRDTPTTRARHKRESYRVTDAGRPLSHGQTTDICWQMEEPRVHEHWDPARVPHTAKPTDPNPAFSGPAQKYFFVPQN

SEQ ID NO: 972415 - protein, 250 aa, Homo sapiens
PLWQGTSRLHMPVRLDYTSPPKNSEATSTLNALGPLPLHGWTVPDIISPERPLQSSSSVANRGDECPSVGNRDKAMATPVPVLNNYGLFRPHLGPRSPVFKYSMSPRRGRNNVTWEVRPRRGSGRIFRAYSYCCTEKKWRPPPQRSPVWRVKHLGSDSTRGDNLPPGATETQGGSSGGSGPKRLLPPLLRESPKAGIVGERPAARKRGGASEDTTGPLKAEKTAPTPRRLWERKRKKSSARAFNKKEPPF

SEQ ID NO: 972416 - protein, 120 aa, Homo sapiens
ERAAQAPPLGRPRGPPLVRQRGMVSPRRPALLRAPARENPRAAPTPVEGSAPPTRGGPHGRKRTRQTGVRGQVSEASESSAREDNSTALSPVWRRQSVEWNRRGMNHHVIVLGAMPQEQL

SEQ ID NO: 972417 - protein, 77 aa, Homo sapiens
MEKWSPPQGEYLNRLLLPPRRMGYGEIPSIPGSGVYNSGGGTQQTYDTTGARQQGMRVTYPRSPGNWAPTKKNGHTT

SEQ ID NO: 972418 - protein, 106 aa, Homo sapiens
RKKQSKRVRTSRVAARSGKSFVMSLRQVHTWISNRTSCGPRVSTEFWSTEGWSLTRLQTTEVVYIQRGITFFERRGIICPINTLTRAGTTSLVSHLASQHASSRSW

SEQ ID NO: 972419 - protein, 271 aa, Homo sapiens
CVERAEVCQNTCGSQTEHRMTARCGRVARGNTEGRLDTTVSRQNKMRGPHKHDVGAGAAAPTARVKRPGTMEPEAAAVPKMGQRTGRNRRRWCRIGTPPEPCPLKKQGDVGKPLGGNTTRRMDSPTEADTHHVLAHTGGESHPGVIKGGEPPPQCAAGMLANESSAPWVPSEEGSVGLRVRARPCPVSKVVGQPGRQHFVRWIYPESFRRDAVASPGNVFPTKVRAVMDYPFEKRRICAVVAPTKTVNVWVISSTRDPDASGTSFGKNTGC

SEQ ID NO: 972420 - protein, 105 aa, Homo sapiens
MSALVDRSPQSGGVGNSGGECTKKVVVAEHKNLETARICGGDHSGPPQWNSSPGVTFKEGRVSPRTPSLSGRNLPSWSAPSVGISIPSAAPSAPTKCCFNSPTRL

SEQ ID NO: 972421 - protein, 102 aa, Homo sapiens
MVGIDDKDTVWFSQPAGGNNEGCMIHQQDKTQVAGAHQFPRGDWFMLLECNNHAGNHRVCGVCISAPQKRLLYEEGVFVPPQRDPRPQSCGVPQQGTRWVKL

SEQ ID NO: 972422 - protein, 35 aa, Homo sapiens
MRCSPTGDRKGGGTRLVPPEGDPRPNGGTFFPKHD

SEQ ID NO: 972423 - protein, 249 aa, Homo sapiens
PGDRRNDPRRLPTQYLRRAWAIEKCAGNDSSGPSMLPPNWPGEKDRPRPRGLGPPVEVKATTGFRKTQEPGRKNHWCLGWRRPPAPQSGNRAVPKRPEPGGWFPNDKKEEGGPPPRQHIDEADKPRRMLIAAKDTPLGRPNWTPPSRVRNTHTLPPARRNQRSLRGAPRGGATEENNNAHLISATQESKHKRVANNKKADIARYKRVATHTSALCGHEPDPDIPCYHNWSPKNWVNKTYSDPSIGQAYQ

SEQ ID NO: 972424 - protein, 300 aa, Homo sapiens
MHDSLAVGGSLCGHFLLALMHASLAAYLFKNLSAHNSSRRLTNTISCLAPPYSFISVYKPEFAVKIRRSGPKRPHVHTALHQCVMTCPNHRCCSTNPILSTEYAPPAEVQKEGIHQGLDPIDKPRRRQVCYVNVICPVLWHILTLYKDAQIDPLFLPTPPTYSSATVLTPGDTRLYNIERFISRGVDKIHYEFPPAVEHIYTSQGRLSPVMSEINPSVPHCVGISSTCSHDSICIERPHHLCLYDSQQALSHAVLSVKKSCNIRGVHLIKKGPAVSWEKSQIFDGAQNSLFRHKKNPLPH

SEQ ID NO: 972425 - protein, 60 aa, Homo sapiens
MQKVSATIADYMMATHTRTINVPPGEAKQGLAPLVVTSHNKQGFTKPQGHTPKNTFHNPT

SEQ ID NO: 972426 - protein, 236 aa, Homo sapiens
MWGKPGQQSLGHACPWPPGTFFQGAKAWRHCSRGAHRVFPVSGNPDSFRMVRGNNHMSPLCGHFHNAALPAPKGIKMAQRLCPNTLGILLTSGVNYSPNGVCNPAHAESRQHTGVLKPAPPRMSAPLFKWNRKGRTTRCPLKGGNMNEITLACIAGTARGSHFLHQAWPPHVLSQPREFRIPALWRILILSAQATPPGWAGDQEIIAPRPLSVPAVVSTFPGHTIKSGTKLFLYKT

SEQ ID NO: 972427 - protein, 261 aa, Homo sapiens
MAHGWRQDQSAHHGEFARRGPIGAPPRGGTHLAGGPTWESDKRGKTQHVGHTPSGLGTPGTGPAPANGMFSPWITQPRRGGASPQGHRQDTGRPATILPPWLRGPTRWVCNLAPPRCMMISPGRSGRIISISTAAPNAFVRVTKGHQHLVPFPQQEQGGLIPLPLAAFCIICYMLAARNDFSLRTYVRSQRRVFRWRTTNSPGVDNLPPEYLPTFKAVANCTGAFVDARLINNHDDRMGYADGQSSRKSIMSHIVLSVDCV

SEQ ID NO: 972428 - protein, 246 aa, Homo sapiens
RKNQIDRETQQRTKGGGSRGPAEFAQWFWTHKCKDPDLGANAAVPGPAGLRAPANARAPLWGPRVTHKSLPYRNSGRPSGPQVRQGPHLYKSGAPPDKGPRHAPLVREVVHQYRTPWGRRRARRTISHTTKRGFQNTWPQQGMVARGAHTAPNRCSPDKIQEREQQSLTPIHVAPALLTTVGGHPFAKQGIVTHWRPMHVESVKTSVVRGTKRLACTLQSRTKRIIYCEAPTWRFTYCARREPGSY

SEQ ID NO: 972429 - protein, 243 aa, Homo sapiens
GVSLIDERQQLELTSRYRSRPLGPFSHNSLPNGSSPVKDCTETVCVKHPRVPSNRVRNHIYGPPEKGNHHHKECRVPEKPGPFPERLVNLQQKLKGKDTPGGEHKSWKTPLRKAPPKWPARKPVYKSGKKQSGKQQRGGNPTRGKQGPKYHQECPPGSHLRKPQTPNGRAQQKMCFNKKFFNNALRIFERTHLLTPGGNPQMCDSPQGHRDFGNLMYLLGSLYRCGQTDLSTNKELIGDRTTI

SEQ ID NO: 972430 - protein, 274 aa, Homo sapiens
VGPNSGMERDKGRKRRERKKKRAKRAGSSGPHEPPWSQEGPLTRGRPPLLRAVPFRFRPSGSAVPGEAKGRWPAQTRGTQPGPGVHVPKRRMSSPQMRSERLGPPVPARGPWRTPRGTPQGTKGGLPYNARVYSGYKQLMPRGTPEAPRDVSPPSAKPPRAREVGVVGARPRTRAIENHRPQSQSLPEQPSACARRLHSSRQEEVLAVSAHHAPRKDSIVDPRIQGQFEYYGHRPQRSAKKLGVPQCVPRKTKRTFFEPREASSRALGVRRAEW

SEQ ID NO: 972431 - protein, 107 aa, Homo sapiens
MYTSALCTLRTRGVRSYLYVRITKFMGCRAPDGWRNNTTVVVSVASLRTFVGYVHRLRVRGSSTTSRRSKGLGNTCLSLSADTVVGGSSSSEFMRWYTDYSTSLKRS

SEQ ID NO: 972432 - protein, 188 aa, Homo sapiens
MYPTRVLLAGLGHDPAVNCWAAVEVWKNNSKGSSGWLNEAICGAQLTLCSCVPTARRHDSRMLLYLMRSRRPCLSYKQPSPMLLRSPQDTSLRGPTLRKTLLERATMLFYDVNAYTGFVEGTETRTSVVVGDSTMRDHRVVGDGHSTKFKASRPSLPPPPLMILGGQEGRPHCLDNSSTVSSDPPPAL

SEQ ID NO: 972433 - protein, 158 aa, Homo sapiens
TGVVAPHHVWRTPLVNFHTTIFVTQISPLLKYLPWCPQTHISRTCSTNYIFRHLHTNIVRSLTLVHLHAPSNNLSHTSTLETPLVTFPTVRHLNMHSSFSASSSPPMLYVTTCDSTNTIFLITKSSPFKHRKEQQSSEVYKLLSLFRHHAKKKYYHGT

SEQ ID NO: 972434 - protein, 115 aa, Homo sapiens
RLLRVVPECLCSGPPRLFVGEHWGGAPRGVVGCRLVFACASASGKRVLSDRVLAPSPFVVWLGVALALPRVQSAVMLASGERLLLVYGSPRRVCARGIDYRWVHDTVLLPPASPR

SEQ ID NO: 972435 - protein, 38 aa, Homo sapiens
MLFGFIKHIIFTTLLFTDNLLTIILSYKKSFFNQPSYT

SEQ ID NO: 972436 - protein, 106 aa, Homo sapiens
MYSPRFLCATITEHLLAAKTTDNVLDKRPSFECHPRGVWLNNGSVSNGLGAFLSHPPEQVLLEKVLVWFHPPKGFKDVSVNQAASTIAACFKNPWEGYESDVFMNS

SEQ ID NO: 972437 - protein, 96 aa, Homo sapiens
VWARGFGVGLRVLVFRVGFAPSVVGPIACVWLLRVALQGCLCCVFSGEYASPLGVGYKLVTFMGDFFPPSLPTPFEQSYINGVQITRCLKLCALEL

SEQ ID NO: 972438 - protein, 155 aa, Homo sapiens
VSSRGRARNPGVFWNSPQSTNAMVPVDNRVGTPPTGLCPKEVTVHFFFHASHSWVKKRSRPRCKQPRSVLQKQPNGTTGRGVAGGPHTKKTSCVAHAPRSYRKNCRGAKNQRGVLPKDNRVKNFGPIVQEPKQLWRLWAHRLHERTPAPLRVVLF

SEQ ID NO: 972439 - protein, 109 aa, Homo sapiens
YRSVCLAFRGCALDIWDCASSSFLASPVFRGWAPSLVRMLLCSGTPMSRSPLCVDPTTPEELPTSLALAGCILIPPAVAVNFGPVTACLPDGGVRSKSWHRCTRWNECR

SEQ ID NO: 972440 - protein, 275 aa, Homo sapiens
PLGAPPPLRAPLVNSRPPQSTEVLHGLSVAASWELSPPLSLCMNGCPSVFSPACFTGQFPPRVCLTALSSPGGAAHLRGGLHGIVLLDEIVGKATPLSSYVSWKHLFAPPGAGLPPFLVGTYDHTVGSRSSRDGPLALSLDHLSSPVPSLLSPPPRHQDRVPLGRLPRERESLRSPQADPAPLMTPESTRDQASYTPRKVFHTLCEIAPPPPLPAYFRFAFYAKPTVCSYAMLLDCTAMHAVTHDYLSADQPLGKCFITREDTQTHKKFYSVPKT

SEQ ID NO: 972441 - protein, 216 aa, Homo sapiens
PYPRSSGCLPGLQRVLPRRDVFHPSVTFGTLVYINPLRVFAPPLGPRRRPGCPALRPGCTVPSPPFPRVTPLLGPPTRVKTHELPVRVKAEDAAPLSCDTWVGGPPHVLEVPGGHHIGEGAFREDHQRAKASTRQHPPRQAQHQSAKKRNPTHITVGWIKPTRTGRKEHALSESSTREPTQFAQEDPPTEGLYTRMIIPEWHRRHPPGVKPRSGRA

SEQ ID NO: 972442 - protein, 180 aa, Homo sapiens
MSGSTEYSLSLSTHHAHKVFAGLEVKLYLSKVSNPPSPHSFFCVRTHCRVHLSYVGKEMSGHSLPLTHMLAGGRPLGDTTQMNASLLRVISRPQAQNLLYSTPRFRGKLILCLYVTPVCAYHAQGRGQPPLMRTCMWWVCCAPRRSTQAHILFGWGSHTAAGICFVIRQHKKIIAETSYS

SEQ ID NO: 972443 - protein, 129 aa, Homo sapiens
MGSQFFHVSGAPPFFLLICYSRPPARTKIINCRKRTSLGDHTYTAVSADSSFGGEFSTDKVFILKDVVKYDIQFAVVEVSLVEHAIIVRVCDENDWGPFIALLDIITSLRLGTHTTTTAINFLPTFTPP

SEQ ID NO: 972444 - protein, 216 aa, Homo sapiens
CRNKLLCVLWYMISWIPREYGNHRSSRGRHTQVICRDLDPPTVIHLYHSRGALPNSPRNLLLSLYICAAAHLVHHALKYTTLVLARQIYLPHRSTHILCGEHHHLHGIAEDISSLYNKLFVSVYNAIRYMSAAGGTLGSHPQQITSSPVLEQGTTPCGFSVNTSFQCRVCYKIGDDTPSHARIVYSLCSDDMTWAALYTSGQKFNHVPTQDTTNGR

SEQ ID NO: 972445 - protein, 249 aa, Homo sapiens
DESRGGAHHFGSKEQCVAMGLYRNRPAEDICGAPDERFGGGRPHASRLFVRTILSQYPPRAPLISAGAKIEPLDMLVAASLRTVADMRKRGVFLVYETKARSGGVYFQPPRGSGPKTGYRPRSAWDIERYLAQAFSQQQFPRTWSSSEAHAQSSRPRVVRRGASWKAPVAVSTSTAYPWAQTWCECTRVLPAALLRRLLREVPHSDGFDSNNCLLIEEAVHGWEITVSVAGKPVRVKHRGPKVFSRQHN

SEQ ID NO: 972446 - protein, 123 aa, Homo sapiens
HFYSLSLLFSTLFSPTSPLRRAQFSSYCTLPHSTHLLSPPRALSFSSLTIRSPHCAKASSHIETQHYTYMVSPLEVLFFFSKPRAPSSPSHHQRDLSLWVVEHGSPRLRVSRLVTITTPRVCC

SEQ ID NO: 972447 - protein, 98 aa, Homo sapiens
MLPSMTPPPTGDSIMNVFMGPPPVFPTKAPLRHSFILFFLQDVFPRLSQGSHPLPRPLRELSHKDAWRRTCEELSSAGSHPAPSFNICRCYSQTTMYQ

SEQ ID NO: 972448 - protein, 116 aa, Homo sapiens
MPVGKISCASLLPRSWVEPLVPFSKDRRLCPGPPQGAPVFLLVKNPSPAALGFARPPGCDNSQRGGSLVPPTVEAPQLLADCIVEDTCGSRQRGRHPPGGNLHILLDTLCKKFPFL

SEQ ID NO: 972449 - protein, 225 aa, Homo sapiens
MTDLKQRGGPPKPRLTDTGVFIPSHLSDCPNLEYNCPKISATTKRAPPRICPPGVTPKIQYCDPVLVYRIGDGYTPPNREKKYGGASKHAEQAYGYIFARRRKKAVILDRDKLSISISFREGNKPRYRATTCAMAFKPPIEQIIIMDICYSVVASCARDSYKIASRWGTPSVGKTTSAQPYRVTGRGTTHRARGKGRGRPHFRDMRYRLRAEKSTYNMTPRPKHR

SEQ ID NO: 972450 - protein, 201 aa, Homo sapiens
RVVRAMSGPFVVNAFPLRVTGAPEFRLLLPYGRFLFSPYKSWSSDSSVVAVTWPPYISGWCQHHLFRVFFLVAVSSGTHLSSGILAPLFPPAGLLKNGLPPLLEVASAHILPHLGNVPRPSPAASLEATHSGSPQAALTPREAVPPCLVHQKLRGKTSLPHMVLSDAPPVVLISDIMWYYSQDLLLWWVQHKTTRRYGTRN

SEQ ID NO: 972451 - protein, 109 aa, Homo sapiens
VLPFRVIIDLNKASRACASKLRVFHTLVATPSHGPMGVGRNSWRNIILLCGRPTNRGSPARISVGVPHYRYLSALHRLIELVYAAIAPSLFFTVCAFMLLAHLHRMVSY

SEQ ID NO: 972452 - protein, 126 aa, Homo sapiens
FGPRGPFCYSWLFLYTVCPRVFCTIIRGPSISPPWFVEVVLSQFLPPCRPQAVRVFIVGPPAPCFAQCAPNVGCLALPSLVGVSHLTHLVLVANRSVGPLQAPPFGGGQWNFAASLPSTFSLLFLY

SEQ ID NO: 972453 - protein, 274 aa, Homo sapiens
SHRGQRAMGIFGGNKGPHTEFQGQQLAAPRRVGPTPRNPEGGHTTIPVAAPQPIRASGPRGPHTKSPFIGGRHTNPGAQITPTEPCCAVRTRGPPKRTVPRTPVFGRRSAPPFPRHTPGGTLEDFVSFRHNSRRFHKRYAFHQLRRLACHSDWPLGTTPPEVPRGGCTPPHHCVPHFFPHGRTLVCETPICFGTIPPSSLSVFPPPSVRRRHLFLPPVLLYSGILPVPPRPQTHHHRVFPSPGHSRVPSASIQPTRCSITPKKIKAEFYRPTIN

SEQ ID NO: 972454 - protein, 117 aa, Homo sapiens
LQVRFPRSLSVGGRILYTGLPRVLACFHCGGFCTRALVVFSPRVFGGGSRPTKTRLFSVATHQLLVGATHIECCSLSVTDGSPRLAKQHVVGCRRRASGVGTFPSAYVGRQNSSPCK

SEQ ID NO: 972455 - protein, 289 aa, Homo sapiens
TTPDGLEKGPSSDGSQGRKTPGLRATYKGGRARRPSLYQARRVSLFDKPPRVTPKGAPHLLVAPGDHARSGRAHRKAHSATPTSTVVDHTHAALKTRHNKAGGIAQQRAQQGTRLGAKDNSRLTLGQPHQRCSPTLWEISTPHGAVYGAPPLRRSLQTPTALPLRARGPRLVGFEASSTSPCAPPSVMRGRRYVRIPSLRALSPLSWRQRITRGLPHVLRSSRSPWGSWQPHQAPAPSQGSGIPVVIALRPTRDAVCPVPTRRHRAPSSVVLAHVSPQRGTLRTVGPNH

SEQ ID NO: 972456 - protein, 67 aa, Homo sapiens
MVENTRYTSPTTGTGATRNADHPSGTPPWGTNEEAPTNPRTGAAHTAVATPPDNPAQQTFSPPPNMT

SEQ ID NO: 972457 - protein, 289 aa, Homo sapiens
LEPSHSAWVPKSPKGPHLPPLHGFTNQWLINPPLSKVKVIPLICKNALYSLKLNNNKGAFFLSRRTNPSPSSQAPSRPRVPLPCGRNKKAFSFRRLHFINRTLSPLVHHWSYTPTCARDCCSHKRWSSGNPLALRIETTTHSTRIALPPKRPHATFVLLSDRHTLEPAFGAPLFQSRTRPLDGWPSRCTPQHSISSKQMCVVTAPIRHNHHMPLRESRRSLDSRLNKDHALSTNTQGVGKKHPTRFIPLAKRYALVSGRHWVPEATRLYQHRSQGGPTPRTSLGKAHPH

SEQ ID NO: 972458 - protein, 296 aa, Homo sapiens
YVRDASRPPLAVVGSPAPKAAAQGSPPAIAQGGDYHRAKKTTGSSGALARRTSVTPAHIQRVGSATTKESNAVLERHTRTKLAHLSSRLLANLCVYQERARPPTRSGENHPTGADHTKSDLLEAHPKNPHQGAPTGVHYIHTEGRGRHSGAHQETCIITHPTGSIIKLRRPPAARRRPVVGAPPAHQSMTGRMMTPCSPGKITTPGKIRRGYIDLPKDDPLFLIDMTSTACLGAHQSQYCARSHPGSPRAVWWQASPLHVEEIPGAFEAMAHNSFWYPQHSLTVDHRADTGNDRPQ

SEQ ID NO: 972459 - protein, 169 aa, Homo sapiens
IEVLPYVDEKCVCPSNGACLFYALSRSGEIMARLPRYKAAWRSLPPERWSVITASAPHEIRGCTLQSPMESFTAICGVLNILCPALSRQNCAPVLGLAQAICLLTTKCFFRYTAAAPLPDTRAAPLSSLARHLFSTQVPGCAPPLLRTPMLITRRKQEYSTFCDRLPFV

SEQ ID NO: 972460 - protein, 173 aa, Homo sapiens
SLGSFFDTEPVEPPWGGAMRQPLSVVKRRPKCICVSHCGRGECVGGGRQHKMAGGGPSHPCGRTLALGAWPHTPTDEGGFRWTDALALLQLRDDCTHRPTSWDPGQSLYRHAWGDEKNSQCPCGGPRKKRSPGTGPKRNNKGACVGRKEHQTCDDQAAGGLNKKKVMMPPQQD

SEQ ID NO: 972461 - protein, 222 aa, Homo sapiens
YPVTGTNRAHGPGPQEGGPPPGFAKWGHTGLAAALSLSLTGSPERGTKPSRTGGPNSNNKDNVPPPGANGDGTPRRGFAAPGPVNTTPLLRIRTVRRWRNEGVVARPPRASGKNDVWRKLSTPSLRNMHWLAPPRDIKTRGKRVGMVSAEISYYKRWPTTPGVGCSLFAGGLVTEECENSDHAFERPRTLLSLRKYYMGARKPARGVNHALESGDPLPISPR

SEQ ID NO: 972462 - protein, 288 aa, Homo sapiens
TAKCVKNAAWGPREAPHGGSAGPSATGVVPGPPPGPLAPRVAPGWVFPPGPPLKQVDRRRAGQEHSDMSPLIGDKPRGGGPPKFHEQSPVAGPATHCGKEGGACRGNHTHVVRWEASFFTAVTTPGVCGATKQVSGRIVGSHAPQSRRGSVTQLSTTRHDTQKGRSWAPKAHRRHHTGSRSLALGSSQQRVTGDSSRPPLDLARPAPPQYTQTGGQHNPLLPKKPRMYSQRAPSYNAVCGQTCRGVQEKTAQQYCFTPRPETGKRNILLGATPPEVSLYRRAASSLLA

SEQ ID NO: 972463 - protein, 117 aa, Homo sapiens
MRYLFLAFVIKGCEPAHSTVPNGGIYTRALATSFCQCQASKNVGQTLYYNVPTFIQHLPNSVSSAYFPPSVQQSKISGVFSDNVCPKSRDVRGESLPIPFLQGSRTLPFKVRPYPQL

SEQ ID NO: 972464 - protein, 250 aa, Homo sapiens
IQRRHKGKEKGRGEMRDRRLASPPRSRGETGEGVPPPIALEILWVEPPPHTWWIRRARGANTHTVWVVELFSRSDSARPAGADNPRSGATKFEHNTHMPLRGFLPESRGVSHNEESFQWVSLIGSTTSYRAPKKSSERGYRRIVFSLMSARPAPPSWYQLRGKHGLSENSWLFRTMGDINGRRSCKTTGFSTKKQTSLGDTSRKWQERYKFLSWPHILSFFNLGAGHDLNAIDIRSNPEQFGCKHGRHHN

SEQ ID NO: 972465 - protein, 200 aa, Homo sapiens
SVALYQFPSVSHIPRFRPSPGPFFPRPMSHSTCSQNNRNILPPTPGAPTSVKWRPLYPPRFYPPFITNRYLPPQSCLSSPTLWLKTWRSVYIMVPRIPRGGTTHHQGVPPHEHGGFFEPHGPVSRRLATLDIKGHSSPCAQAPTGGILAWETTNRRAHSLPLSVGVFHPSVRGAHISLQPVCLPTRWCVFVENNEQTDKD

SEQ ID NO: 972466 - protein, 135 aa, Homo sapiens
MSCFTIKKTVLLLVVLCSKASPLLFCSPTTIKFSVISSSCSAYFAPCAVIFNKKNNVTPPPPYIRMYIIPLFFKKIFFFLLLPALACPISKIFYLIFISSAYIYHLPTASCLPSRTAPSRLFVIAEKRRHLLFKS

SEQ ID NO: 972467 - protein, 88 aa, Homo sapiens
GLGPTGKKECGSSTNTSGSKWTQQGPIDFPVIKGPQETRGDILKRTVIHEQSVNKSSCEETPTGSPPPQECHTSRSPHTENLGERTPP

SEQ ID NO: 972468 - protein, 183 aa, Homo sapiens
MAAAKLVVDTILLPSCPTAQEAVRSEDTPALAGPILVCYYKVLLFRLALREWRQPHSRLAEQISAGVLLPHVLWAGLTKNKVVLVSLNVHARVTKKDKVDKGTVHKKQNSQMARRAICATTPPTTGRADTAVVCIHDWTAATPLGAVGAARQTASSRGPRAEQAAPAPTLGNPPFGEKNHIER

SEQ ID NO: 972469 - protein, 336 aa, Homo sapiens
RQIAFLRSCGFTSDVVQPRSGPGTQGDPLRGVLFLRSWVSPLLMPGFCSARVLFPEHVPRAGIAFLSVLVLPVFSVPARLCATGSFARDLANLCAPPRNPAVWGGRSHDDPHSAGRNPQNSLPPGPPHHMKQVVATSRTPAFFLWVLPQTPVIYGSLCQNIGLMGFPIPPPFLPLLGMSFCVVFKTNTDAALMNSRVRGMARFLVGMYFRRPALGWHRWEIPAPPTTRSLCGRVVPADNPTHVAIFLWGDNLRSSLCKALYYFSVQNLPGMAPPKKYSRACSKRGVVDRANKDGTNDLSGNSSGCFSYRKEIFFTKSPPTNPSSNPGKQDPFPPHN

SEQ ID NO: 972470 - protein, 211 aa, Homo sapiens
HSLRVLFSRAPYDFRPSVQCGEPPFFPRTLSSRRHSPPGVSLRLFFRRALLNHHVMGRPAVFGLPRGLLLLPPPSYTCNEGAEYAPPGPSLSIPPPPVALVGINTAAPCPFLRDFFTAPRGVYFPPPRTPPPPFLGTVPSRGSTPPLSVTREWKIRRVSYPHKQMWGRQPPRRHSSPRTAVGFALRQRLERGGPYFLFEWASSPPHTPGLV

SEQ ID NO: 972471 - protein, 83 aa, Homo sapiens
IPFAPHPQPRKIIVADSSFVGEHHPPAVLCGRLEKISFAPPYMPPPPGKKDVFERRPPSPRNSDINMGGGNTPRESVLYCRRT

SEQ ID NO: 972472 - protein, 186 aa, Homo sapiens
MPALSLATCAACTASPESTHVPAGGEAQCDRYCITQNTQGLESPPVLPPRGSVNDKKAAPSMARGVCPPTVVISRRELGETPATAACIKKKCGVSPSPRAHKPPSGVVEMTSRWRPFSPLPPCPAPLSHTELAGVRSCPYKEPFSSPIWGVFLRKPCGSALPCSRHPPLFLLVEEFPPYIVEIEGD

SEQ ID NO: 972473 - protein, 120 aa, Homo sapiens
MLIIYIGARYLSAIYLLSGTLEDGTFVCGSTHTYVQGHILFVYYCGNTRVVAPTHKEGGYRDVGVAAHHHAVVSTLTPRGTLACRPLVLQKRGFLLVQPLGELDGCRRTYVLPDPRQTMS

SEQ ID NO: 972474 - protein, 296 aa, Homo sapiens
PSVGRRQFLCGPYSFESVGYLPIVPSRGGDHFGTAPPAVRRGTTWRRGLLGNSGSALSVRIFPGSPRTVYSWVRAATPVPSGGPAPGTRISWGRPSPCSGHRLVWPGGPTDRPSWCTTLCRPWGFNKTTWDDFLEHGIVVHRRIASAVMCPGCPAHIAPPPRQCALLKSFWAPSVGGILPWPLVLQPHATPNGGGPRRPQLFLAQSFGARGYDPPERASPGLVWLPDGLPPAPTGATEVFPPSAASVPLVARLPSFGILRPLRGRVSAARPGYPPRLFPGGSPTGKRFSGVAPKHN

SEQ ID NO: 972475 - protein, 71 aa, Homo sapiens
MLIGVTAKVGPRTLCRLYGNALTLVRDYPMDNHIEDPIIGGIIPKKRNNHLSGKLRVKKAKVKTQREDGAP

SEQ ID NO: 972476 - protein, 133 aa, Homo sapiens
SGSKEQREAETKTFHSRGRAGRHHTVHTGPIAPTRAGPPKEAPRPRIDAAQKVAAQACYTKRVVACPPLHGGKKQNRPCNNIQRRHATAGSPTRPAGLVESGMMVSTPPVLARTTQPRADGASGKTNAPPTNT

SEQ ID NO: 972477 - protein, 281 aa, Homo sapiens
LLLAFAVSARCMVVSKCRYGVVRKFCLAGVFLPGWCPDAVPGVACNGLCVAFSPRLRVARGRSLIGLGVPRGPLRFFPRGGTIGPGFPRGSKVISWISDASSGGPSPVGCAFVLFWNLGVPSFVFVTRPRGAHFGASGVCLSALWQSGRTIAQPVVEGVSPPGSRMLLPPDRAPYLPLLGGAAHSRCCPLYCPGRSSSDRTVRASPQIVAILPRLLSARLRSLYRLFYVRPNASFRRIPRVSPRVSLGVIPIALIGSTHSGFSFTSGGGPMFTFVVDTRNR

SEQ ID NO: 972478 - protein, 225 aa, Homo sapiens
MVLGQSENRKATGRVHLIFDRFPPMGPLKPRCQDDPDDQKRRPVVVGIGENPAQVTPPRCGGRRSVTQQFSHEVMGSLHSLRVVRPKPTMTVWDKLIVVGEIYLHYVGWTALQVYDSFLRYLPHAVVNPVTDLLCVVVPYHAAVAASEEKGCQQQAWRRRFPAGVNLCREDSEKWAADTVSPADASSENAGGDVPDSPAPPGAVGRGRPFPCFEPQKENLGPRHK

SEQ ID NO: 972479 - protein, 149 aa, Homo sapiens
MIGQISELRRYSASTVQHRALVGSLNPEQNMASLEMERSIAFYTRTLPCCVVMICCTPRINKMSSTHPHGLSSLGQAGTFGGRIKALPLSTRSYSSVPVPSFTKDRLKQSRAYYAVKFHSANREPGWEILLKGRQSKAVVVPSLRGSWP

SEQ ID NO: 972480 - protein, 37 aa, Homo sapiens
MRVFKTRTSFGDEDHHRDPQIVPAKVRGAPKKTTNKT

SEQ ID NO: 972481 - protein, 32 aa, Homo sapiens
SSNPRNDGIACKSLKEFNEILADIDFSTATIE

SEQ ID NO: 972482 - protein, 112 aa, Homo sapiens
MKWILHKENRIVLMGEALIECRLELDSIREMISPRGLVNLGRSLGLSGFHTWTSETTTRMFGSIVLSQTRGGICGGDTRLIHSYSVGVRTDVTLACVFGPKNRITAVVGPTK

SEQ ID NO: 972483 - protein, 101 aa, Homo sapiens
ARSRRLCGAVPMHIGDRDIDALATARALLYDAREVLAGTSTDADRTDNFDCSTCRAPARIATVVAVPLPILSFFRRMLRRHVCLCPRPALLKQKSNPTATR

SEQ ID NO: 972484 - protein, 82 aa, Homo sapiens
MASEDELLEQVLSSMKEEAKVGIIGKIHTPMEYKGELVSYDMRLRRKLDLFAKREYHVKSLSWGYDSGQQAETVVIIREQTE

SEQ ID NO: 972485 - protein, 111 aa, Homo sapiens
MRLFTHARTHHVCCSRATGRVVLTTHTHRMKNVLGVGRHANRPRVSMSVYNSKGVAFIVGERVFFSSYKNQLCPSSRSVLSQRVIRQTQHRGVVESTPSRGHVRRRKELFQ

SEQ ID NO: 972486 - protein, 189 aa, Homo sapiens
MPSIKLRDVSDGMRYLKWMCEHCQHRLCAPIKHAMWTDLGMDDEGDDDPVPLSNVNAAILKKVIQWCTHHKDEPPPPEDDENREKRRDDIPVGTKKFLKVDQRNTVFELQFWLNSNLDIKGLLECYMQDGCNMIKGKTPEEIRKTSDIKNELTGRGGSPGTPERNQWCDEQVTWLWLDTGNHWYGWSPY

SEQ ID NO: 972487 - protein, 79 aa, Homo sapiens
MIAGPAPQQVCPREDLRRFPEHVLPQRSTNSFSSAFPRAGHRALVARRGGDRGNYYSQPNRGVSNVHRTRICKRRRNKT

SEQ ID NO: 972488 - protein, 215 aa, Homo sapiens
AWTRSWIICALRNFNTRSLTRSASRQPLLATPALAKPSRATALLVLLPGRNLAALLASFLHPPSDPGFSTQALNKSADTTGSLDDSLYTPPYKLLLTSCLAPEARSLALAANFSSLTQLGHLPSFTHHDETYTTTTTTTRTTPKGPRRPSTHTQPPYTFPKISLHPSFLTSTQQHAYNYNSLTASLYDPRVSLLSSHSPATLTPTHHVLYNFAYT

SEQ ID NO: 972489 - protein, 130 aa, Homo sapiens
MRLHGYIPPAHISATICYFSLNLPPCIVLIVEFIKTPPSPVLHPRVNNPNINPPEFPPSPQNLEATLNPPEQVSCRTHSSCAYGVLFLPPRLSTRGSEMEWGAPLLYHNTSPLLWTREYPSEHPQTLLAH

SEQ ID NO: 972490 - protein, 297 aa, Homo sapiens
PKRKSPGPWAKKWEPARGENVSQPAWGLPDARGCVPDAPPLAALQTPRGCGDSKQSNRRGTNSWAFFPRRTTEGRRMWYNDEAPSQGKKLAKVDREECTGPPPKAPHVITRAPQSEGASPKIAPQRGECQERWAHTEAYHPDEIAAHEATSVGVATKPLRATRSSRTPKAALEEAAALEQKVAANKCPEYSSEPRQTDILMGEGTRRSHLHRSSRRGRDHSPPAEERRSARTAHTDTTGAPEEQRDSVRNYQKKDHNALIEKTKKTNIPQRKPPPPGAKEEPTGPKRAKTAKAPPTK

SEQ ID NO: 972491 - protein, 196 aa, Homo sapiens
MGKAPQWGNSSDLGALLAAMMRASPCCTGPTTGGGPLPPVMVLFSPHVVPTRIRGFVPPPACEGRDKVLCIAAGVSLGSLGPSLRTRGILFPCDHWYDEHPPVICHRGGVHRTSQRDLLGASHTYEYRAFLTHVRESPSVLVTKGRESLTHSAFPPYEGPTGYPCRALVETGPISLIFPREAGLIPMIIGTPKEHN

SEQ ID NO: 972492 - protein, 106 aa, Homo sapiens
MHLTPRPFDFTLDATYFEYQEKQLKIFPPNYRSDPIENTHCWRAWAPKNIPTTQPGGGGPRGSATLASFPKNSGHDRVVSPKKHAGHRFYNPRGPGHRLPRAHEPL

SEQ ID NO: 972493 - protein, 102 aa, Homo sapiens
MFGSSRGGPTIGGATLYITKPHGLVVCGKNKVYPENRGDHPGPGRYKILRNCREEELHLYGGVKKKVREHQNTRRHTTGDGTTPTLLNLCETGGPPKATNKM

SEQ ID NO: 972494 - protein, 377 aa, Homo sapiens
SGRRHDRLPISPLTPDRTRLRPVIPVYVCGDTGQEHEARSWRHVCIMELPQLCQGESAQTRVFDIRRLYYERYSYDHVPLECRSVAVFAIDSMHRLPLMRSCEGTGSMRFERWQLEMSSSGAKAVAQGEDPVGWRLTDSEFRFHCSLAVALDGHRFMTLTVDPKRKYCCKTFTLVHLEHQSTGDLWHKLCSNLMDWGASRGNTTRRVGQCVKRGLHKGSRCAGIPLHTTGHNMLDFTKLRSLVGFPFLGFPVHYRDPTPEINRGNAVLSGKVVTGLGPREAHKRYQGDAVETPATKSKRKAGTENNGVATRGAPVNATDRRKVASQERATTVLTNNARCSSHTNQGEKRGGKDRTSRYTMKDNAKRLSETDEQHDRW

SEQ ID NO: 972495 - protein, 77 aa, Homo sapiens
LILRDKPNGSWGGNTVSAGIYSAQFGVPPGSGVFPARPGTQRVFDVNRAELRQSGCKLSGLLTAKIMIHRVLLQTIV

SEQ ID NO: 972496 - protein, 150 aa, Homo sapiens
IVVCRHVPVCMKLVCETVSAVCEQQLLTSPCLLSAVSPRSSLSDSIGFLRPPAFLCHCSYDVAAARARSNCGWGKADHKRQISLAVVVSRGNNIVLSLAGDDHEQNARRYGKIASYQGYCLACPHRVGTGLLRTISRPPSRTVSGALSFY

SEQ ID NO: 972497 - protein, 99 aa, Homo sapiens
MVRECRASNTSCGVSTHTEVCSINICCFLTTGTCTAISVVCSTRNISRLATRPGEVILAPRIAPVRENPGCNTFVGGVVVPQLEIPPPFFCGGYFLPHK

SEQ ID NO: 972498 - protein, 283 aa, Homo sapiens
MLTAPHQSGERIVSDAGGALSASGVRAAQTLTDEELVTGRGGDRLPCNWRPPTNICLDRLENWITSLSENLKLLDPRTKLRNCEELQAKSSPTKGTPLYSTGRCWRRAIVELCRNLMTSASGVERRALMPECIPDRRLVIKTGVQFTTKVRWLVKFPEENYQVMIKVWIERTLGTWQLSEIPEINMLGTNDEQCEPWENPQTELSGEWKLDLRSEMCDWGPSQWRVLIGTTTWPSLGTRVTRQMPKTPAMCPLHEPGALEGQQRFPNRASTRGPKLRKGFRAT

SEQ ID NO: 972499 - protein, 140 aa, Homo sapiens
PCVIGVGSCTRVVIRKYELGSGGEPATGYRPTGTVLAKSRNLYSCDAPPVYWGPTCARRLVCEGRTQRRAVSPEAGLRYYVVGGPKVNQGHLGSQKPITAVNLAPRCSYYNNAGVCGTKSLKQGVTRRPDFGLFNYNGVV

SEQ ID NO: 972500 - protein, 201 aa, Homo sapiens
WFRVPVVVYRATLVFHRAPCVFIPPSSWALVAFEPDGRAAMFCCVRPAPKGLLLHRLLVVGSALAGFVVHVAGVFVPSLAPQGFLPQLPYACWVEPPTAVVVIPSVRVTLRLCCLRSPTALFAIGLDQSSGFPPVAPQVEMPNQCYPSGGVVPPHRGRAWIYIPGFQTVEFRPRVIAIIIRETSDSRRTTARQYYDPALLG

SEQ ID NO: 972501 - protein, 42 aa, Homo sapiens
MPHDRRRMRDCGSRPPRADGLLTEELNTSIAPHVSRHKTDNH

SEQ ID NO: 972502 - protein, 248 aa, Homo sapiens
LSITLCPAAVTLMKPTVSASHNRKLFLAGSTLRGSSVINNWLSTQLFLWRKLVSVEPSRHSLFTCGHRTNGKDCLKTKHSTYPRLGSSGRPHKCTTHITRRGERSQYIDEEPHHVLSAAPPSKKKQGPKNGPPRPYMTSRPVVGNRSRAYTRVPKHMVGTNKSVRPRRARFRREQASPGMFRALLQFSRAKCFCGKKLWVSRGRINKTGKRSQLRRFVLTLLSRSDRLLAESLVLRMVAPINEFSRPH

SEQ ID NO: 972503 - protein, 84 aa, Homo sapiens
MAVYGGVRCEAAGFVALLRVNDCYTTRWRVGVKRSHPRMLYRVGGPHNKDKKALQAVPLMCSVTHFFAVSPNSAAGGFLAAQHG

SEQ ID NO: 972504 - protein, 95 aa, Homo sapiens
MSPASASRDSGDGGGPVTTRGHNFGGIRYEHGVHRVGQEGLDLLDLVIRPGRPPKVRGYGREPPTGPDSRFKNIPTFVGKGRMCPPLTTRFVPVG

SEQ ID NO: 972505 - protein, 284 aa, Homo sapiens
VVSDNVIFVLAGYVPPPFLTVRCIICMAPALLFPDVELSAPVCKVGQPPCVPGVSAAGVSKVLCATRDRMGTRVCFFVIRFIRSTCLYVAARSSRRLDTLHGYADVFGLPSVAISTRVDTRDGVDTPPTVMVLAPFPRSRSALTVKWEAPSLRPPNYDGQFVVTPTRGVALTLFHENWFSLSLPVPLIGRCLNICREPTLLAGLLSTPRLAGYMRCSTLSRRCQPAFICSNCPRHSKISNEFPRGYGYNVLIDGKPPRYNSFPRFGAPTLFVHPEERLHDLVPP

SEQ ID NO: 972506 - protein, 192 aa, Homo sapiens
MDSTTSVVRSREDRDAPALREHTLIFCCVTKQEKGRTIEIKMSVWGAPAKHILFSVRRYITGGAYFISCYRKGVMGQIMCSRLVDNALWVHASPLRTRASNTDVPPLFVCLKRGVLGTTGEQLLWEYFVGASLRFLFIRHQYSESDERKSPGDHVCLTQCFLMCAGSLVAYSPLVEQHIQEVAPPDHNKCPN

SEQ ID NO: 972507 - protein, 62 aa, Homo sapiens
MVNHESHKAAGRRMKKVSARAHTERAPSVWRGISYTGRPMFSVSNLKVFFEDDGPLAPQMSE

SEQ ID NO: 972508 - protein, 276 aa, Homo sapiens
VRFPPPGSLFWVGGPSHGLAARTKRCGLQSRRGGLKYPPALGGVVSPHCSLRAYYLNARDWCRAARITRRGCIYRCDAPRVGALSPTHDLFDIKGSTLNAPMRHPRIYMSGRPTLCVIVPRPDMYTRGVFPRIGLRLPLYANRHSPRLSPLRALFCPAYHALVSRRRDNPFRVSQHIMSSVGRTPHGGSPRVGYNSAIHVVGRAQLMGPSVLGDAPPALGNVPFYHWPTEHRWCGYGRSPPPDNLATCVSKKMGVANYSDMAPRTLLGSGVFQPTD

SEQ ID NO: 972509 - protein, 191 aa, Homo sapiens
MSARRQKHQVARGPYSPQDNTPSQGGVAPLRGTPPQGPNRPYPGETIPRAAKKIAQAKGQHTVVRPPTVLKGCGTRHNDVGATAQEGLLADPRKEFSTDDDNLGNPPRAAGAQAHQRGQQDILRAKPSGRPYTAKYDIPPGTPNIGPRFGGNTVREHVSAAWSAKSGQEITPAVKSRGGGERERDRHGKNT

SEQ ID NO: 972510 - protein, 110 aa, Homo sapiens
MSLPITSSRKHASYDDSPTPYVLLHPISLLPAAPPSYTTGVRNNTRRSLCRHELCVYQGAPYSNSVRPCQAPAFTDATQGLVADPPPLRRKGRQFCFGGPTLPIIMVVTE

SEQ ID NO: 972511 - protein, 144 aa, Homo sapiens
PIIQQAQKVVGWRHTTPSGCPTLLRWEAPRVCLVKPFVRYLIECGPQDYPDVSAKKRRLFGSRQTMALVLPREDSPTAKQIERLSRLVPPRCVNIQLFELAPYETDKTCDHTSSLVGYAEIIRVLRSPHASQWGTSKSVPLVFE

SEQ ID NO: 972512 - protein, 129 aa, Homo sapiens
MDHPRGERRTAIANRKGRIVFAHEIRAPHRVLSAVWGSVGCGEGHSHGGRQVATLRGPLPVCEGRSRPDHPMAEPRHPPTSTQGTLNVPPPRRLRGVYGNMATRQRREAPVREQQQGLRKASATTAETR

SEQ ID NO: 972513 - protein, 303 aa, Homo sapiens
VGPRPRKGRLVSLMEFFAPAKRFIPIAALDRAAHCSRHGLLLLYHTTAQGARYYSSPQARVVRSHNELPRGPPIYGAAPCSLHVPPGDVNAVAGLALDLLASHRETLFQDGGATRPLRKAQASLKSFTNTPRCTHGTRKTTLSCTGVLRREPPHYTHTQWVPRAGSRPPHTHIRGGTHAEVVETAARTRLVLNSAPPPPGRSRVNPARTLCACSVHTRADCVSEGALLSAEHSDEPTCRRAGDERRDSMTSQGVLRTPKPLNEQDGAVGTRGRPQTHPPEQFAPRARHTTLGQPLGHPSPHNR

SEQ ID NO: 972514 - protein, 196 aa, Homo sapiens
MPGALAQSDYGWAPDGTSKACVIVPGLPPRPGKNQDVTNASLLRHVKLPNDVFCLWAGSLQTCTVLDIEPTTLEYMFWREWSHIFTLGDRKHRGWLTEIGLNPPSAPARYNRSHCEAGTWSLHEDHSEQCRAEEPSMVLLNRYLSPPEKAHPATHDVYGLQRDDLETGDARCEAVGRKEITYGSTRGGVNSRPNMT

SEQ ID NO: 972515 - protein, 308 aa, Homo sapiens
EGRAPWKQGPGPHTASPKWRGATCATGAAAARQWYPEEPAFLPTRLRRALDRHTRTGGPTKPRSTGTQGVENLRRSRHDRSAEMYAMRSTRTSGSPEIKPSPDGGVSTSLAGKMGIQPASPPGYTAPQDTPRDGMESKQRDQGPQVRTAPQGAQVPAPRQSALNTKNSWGDRRTFTARLVGRTTAAPHFHAEGENNIGRQSCVSRAGSKCPPEMSLSRQAGSVHREGSPRYRVSKHAGVDMTRPATLLKEGCSSIPHGNYGGYQGGSQRGINIRCGRPRKRRSSCHPEPETIVTLLIVEKLGKKNLHN

SEQ ID NO: 972516 - protein, 55 aa, Homo sapiens
MRSQAIGNVFPAWHARGIPLETEEFQGDHEVTHTRRFKKIDFCPLSILTQTLRNI

SEQ ID NO: 972517 - protein, 73 aa, Homo sapiens
MHARAGARKDSSIIGECGAKPPATRRGPLPPPQTGKKGAGPRRRRATSRDERAPPPPPAGFNEERNIPVSPRR

SEQ ID NO: 972518 - protein, 107 aa, Homo sapiens
MPNPWRNSSSGGLILHTAYRSPRRVHEWPRPPRPWQAGNKRRVEPPNIEQTESERCAQQRDHQGCYTPRPPRRHRWRKRPDADRRGYVTGATRRRHLFSEAPRRNPG

SEQ ID NO: 972519 - protein, 73 aa, Homo sapiens
MMTPPLMWALYHQILFFKRDLLFPTRVYSRHTVRSPHRFPHPSIMRSFDNQGSLHGPGPNKVTDNYRPSNVRK

SEQ ID NO: 972520 - protein, 172 aa, Homo sapiens
MGKEEEVKILEYDYESCPVFLTVWNNQFELMCMSVVIEMKALVCKVEVRFTFGVFEIEKRSSIDVGCNHLWNWVIVGAKGEHSCTRYRGTGRDPPQSGYRGRGAISAERTAATRATPSEGNESTQWGSPKTYDERARKRAEHIVCLQQCTPTRLHKTTTEALSAAFSSPYTS

SEQ ID NO: 972521 - protein, 109 aa, Homo sapiens
ELWDTTFGSSFFQLYSPPPYLLQGVPALAFPDLAPLSPETYCWEHPAAIFPNLLAQTVSSKFLSGTNNVTQKSCPDLRAQNRGNESVGEQEIPMVNTLVSPRHSSDYIL

SEQ ID NO: 972522 - protein, 296 aa, Homo sapiens
QCEWLLEHPLEYTWAALAQGLPGAMSPGTHSPSSRGGLPFHRWCSTKYLVPRCVPQGPPASLWPKVFLIGRAPVGGPSLVWRVTDHRPPLRLECGTTLVFTDAPNIRGVSGSAPPQMARGTTRPPCRGLHAPRPSFSSGKLAARACFRPHKFLGVGGKTRVEPPSAPSRKGVTFSTAAARPTNRPCAQEATDPARAIVMSGCLAQRRPGASKCLVYPAHAVIRAWLFTNASRPTQHGDSPLSPIPITEGPSPPSGEVHQFGLAHGRSFCTSETKLVLVSDSFWKHPTYPLFKGPPQ

SEQ ID NO: 972523 - protein, 237 aa, Homo sapiens
ANMVKPRLYQKKKYNRFSQAWWQAPVVPSGWDYRCVPPCLTNFFGWLVWCFIDAVLKTSRGQHSETRGLYQKKKKRTCVPGGQVFFLGKVPWEGIPVNNLTLKLAGKTNSSGQRGEGSDDGPVIIPLTCKSLVLEPFLVHFIYKNTYWELRRVEKCRLYAGSIKSVKTLAGVHHKTCPKVKGPLQEGVSKNTGSGSWELRNWFQTALIGPSGPSPPLDPPRDANEKEHPLCRRTRRK

SEQ ID NO: 972524 - protein, 320 aa, Homo sapiens
RRGGERKQQVCPNIALGDWHMSISDYSDHTEDAAVQNAGRPAHVVGQDIKWDKKRGGKESAPHAAQVVALLKPPADCSQQRSARERSLWPPPPLGPRPWRTSRPGRKTARPTRSGFGKSAKRPANTRGVSQPAVETNKWAALGNTQYQVAATRSPVTTQANTASDGIVKEPMTRSEEEMFEQPIMGFNTKTPAAHRFTPNIPASGNLRITQGTPPPTRIAVCSTRPVLDKHRQHRVTGRHPRKHAGSGEDELKETPGGDKTGARGIKDRSPLTSPGRPPRARLSPLRLCPAGKSKEALQRPVLMSMRTSALRPVPEDRKV

SEQ ID NO: 972525 - protein, 268 aa, Homo sapiens
MREKPKILWQINKQNPGNGAFDERNEGGEPASTTDDSGSAPNVPRRVVGSKKRPRTRGQLSEHGLTGGTEKKTGANGVENQGNTQAVAFPGGNTINTRPGMSLEDNMKADAGKAQKAGEPPSIVEERPIRREGQNILRAPSSRRRRLVRYTRVPAAPPQRGGPSPLQRNSVESGGQHKRTVTVERPRGRQPPREQGWNHRRETSRRPPGIHPPPGRRTPPRVPAGNRGGTKATIFELGAQVKKTPPMLANSRAAGPKNKTPANSSHMT

SEQ ID NO: 972526 - protein, 278 aa, Homo sapiens
MDTISNESLAEVALMSHSKGTDPAKDCEIDRSVVSWEFSRGRDLTRINVMDPGTRLDIELKITPHICLTDMYECTGSIAGTIMECERSPGIAQGTRVTDARARCPPWYERDSLLVEGDIRQLRVYHILGVDIPGVSNAAGGLNSHVLTVGGYHADRGPYQLPALSGRNLSESAHDARFGDRSLTEVWVPKHGYAGKGPLSAGKRHGATSVPDGRPMLKRANHYKGDKSNSATDATVYKAQNAYPSTTDDYHSKIMDTEHTNKKRLETRDFTLSVTRAQ

SEQ ID NO: 972527 - protein, 269 aa, Homo sapiens
GPEKLWVAVKRRHPMGRPTHTSGQYRGRTSLLHSEGQAWDAAPHVVKGELKEKKYVCRRTPVSAARTGGGATAPAVRDIYARGAGFVQPHQPGMTVNCVRRNKPPHMESDVYMRQTHTDEFLHTYPGETPPPCSQMGGRHTHICIDIEDRMGACRHTRMCSCVRLHFTLRVRRKHVRTGKSPARGIIYIMYVRSHSCYVGYIWVPRRLLCIDATFMMVLPMRFLMMLPCRAHASCGRQSMNVAKTPASGFSGRHDGDMAETRRQMVRLS

SEQ ID NO: 972528 - protein, 225 aa, Homo sapiens
MCHTRAPCGEHTCVADNTSSVYKDHRASYVIQFSYATEWLVGNTKYTVIVSYNYEGSSPYRVDDPTPCGENKDAGPLSARVIFACCRTTHRGLVGEGHHFFFFPRRHAHPPGGGHYIMSLLPSQELSYVFRSVLSSLGEKLVAMGFLTWRGSFNHSGDPQRLLCPRKRPPSGDITLGVSSRFLYMGEHYDDSCSGAFFVSDERCGVDPPCNQVSKIFIIHPGQEY

SEQ ID NO: 972529 - protein, 104 aa, Homo sapiens
RYVGEDQPERDRSDEVAGSIVLSVVSVSVQIRSVIGQYVLIVSDLPMVCVLRHKRNADTSCTSRFETIKDEQANDDDCYDEEIVAYVITNYPQGSEQSGTNNYP

SEQ ID NO: 972530 - protein, 113 aa, Homo sapiens
MMRRFGITTCGRPVACRRCSKVTRMACNVLVAWRYVSQSSRLNPPMLTVTIRPQQLNIREQYRSVAWNYSRVACQRHKWACTSILASGLSFFHYLNTGDESNIYGLSFSTQNR

SEQ ID NO: 972531 - protein, 140 aa, Homo sapiens
PSLLEGPKFVCRSLEVPVSHQANWIVFSGRVPRLARYTLSLRPDRQYVCSEASDEVDAHGCCPGVIVSYHKLSEGAQRKLRNRGCCRDNPSLAPLRTRSVHTMDKPRALYQFFAIGRRYMCVCNGEKSFIMPSTRYFRIV

SEQ ID NO: 972532 - protein, 324 aa, Homo sapiens
LGYYDEQMSFRVAVAVSAFPPFFTVTNRNVDTREKQLAGLVLAGPVLLPSCTNSPAVTGDGSRHGEPGSSTTSKLQRIAYLWMSIQIDYEELREEREPRVVGVRASPASWIMWRRPGRTGGNSVYQVGFQEWAEPTPIFTLYERTEGGMTQRMTEFHGLDEASLLRALTGPTDEHKARSSLSRDGRGVKSGYAGSLVSRWTCVTFTTFSGGFAHGDRPVVPRERSGSLRCKAPGRRGDRGWFPPGCPLGGAGERVYCAPSRQRQYEGTHQQHVYHGSYKNAGKFHPESRSNTRDTALVGSSHSCSPSPRTARANNSHSTAPKRN

SEQ ID NO: 972533 - protein, 189 aa, Homo sapiens
MGSIWATLALATARITGFSLLWPPPPGPIGAIPQAPRDPHAHKAIPLLAEPFVTESPPPDPAEVPRSSSPVQLQKPQGSPSTDISRTNEVTLVTTIRGQKELSPILANSFKRFLRQLARGVVLWLRTPSSVSMHLFCAPSGVCPPQINQTWVRGSLKKEKYTAAIFNLPLSRLPQAMIATRATTSYGYH

SEQ ID NO: 972534 - protein, 242 aa, Homo sapiens
MRATGGAQIPGMCDFPMKYIHPTGTLMGFCTLMIVSTYTPGSKTTGIHPGSYDIATHFILGTPNGGPHKWSDTQYGGGQTLQEVCPPKAGGDTGGPGRHGVTEYPGNLGHSGRLGGASDNSPPQCHSLPRINPHHYKLTPLLRSHVYYFLFVYVYLSLAPSIDRRKAKTRPSDETNDNNAQEDQATEQTTNIKPRNKQHKSNNPKNNEPQKRADRHQQNTHDHQQKHKTEAEEHTTQTTTTR

SEQ ID NO: 972535 - protein, 244 aa, Homo sapiens
PCDAPRCVPPGVPAARGVGAPGQDRQLRREEEAPLLPLSPPSAGGGENILWRPLSSGGAPTKSGKLKSALTPLGGRRQRGVVARRHASACGGLPQQILVCVRSLRDIPVQTPGARGAIYPCGEGPPAFALWVKLSRRRVSSRRRWPTVVCTRHAVLRTGEPCPYVHQIHASPCTASDTPRSGARGTLVLCIENGRHRKWPHAEEALAAPRSPRPDAPPRPLYKPPSYYSPPRVTNRRRRLAHKT

SEQ ID NO: 972536 - protein, 256 aa, Homo sapiens
MEQRLQQKESATKGRVLEKAVGTPAGPDPPGVGDPHHVGGVKPPPRVWERQQRVARDKQAYTGREERHHQHRESHSGEGAGSIFPTKIIEKRGRALPIRCNKRAGGNTTHHSARATMGTEDRLDYVVTDPPSFFLCVVFVFVCLRLPCRLSRKDTEHKQRAGSEQNRSRVSHATGGAGSRRRRRGRTSTDARAGQQAQTTKEQRGTTDSEARGNEQQDRSNATAHGTPGQPSREAGKADSSEGHEGDQRRTRSHAQ

SEQ ID NO: 972537 - protein, 122 aa, Homo sapiens
HVTQAARMRSRCASGELSGTGSPRHSRPAREGAREDAPAQPARGGMCSCWVILKEQNYNHDPKLNWFQVDLFMVLMGRICWSKKYPSCGGLLKSPPIDLHSGHSSSNERQSHAPRDSKANNL

SEQ ID NO: 972538 - protein, 102 aa, Homo sapiens
PPDNVFFSPQSCAGPLQKKRHQAVPGERDDPTPGGSLPPRRGPPPVVVAANKKKEGGPKSPTTVGVLHRRGGAAQNTKWSPHERPRAPRECRSAAHWTPLAP

SEQ ID NO: 972539 - protein, 241 aa, Homo sapiens
IPPPTWFKDVAPPPLLPPTPRSFLGNPPRGRCFWLPPQGGCPPPFGCVITLGEAHPILAAPPPPPYCRRVLYSGQGARPHPLMRRPNLYLAGRQHIILADPQRGFQHHQPPGNSPVGWVPQQRARAQALTQHRREYIYGGQQTICGKKDSGRPERTCRGVPPHSLGLVSPTPSATPRALGIDTRCTHTLIVIVGQNAGATPVRPASEGRMPPWPHPTKKSSSQQSLPKKNQNMCISRDIKT

SEQ ID NO: 972540 - protein, 121 aa, Homo sapiens
MSTELRDTRQSCVDIDYCRELRGLLKCTVDAHSNNWGYLPYARGAIDTNVLRDTMQETVHGQTETDTHDSGTLWTHRHGFGPLHLLGNDKTGAKGNTGPWSLANPFPGAHTKRAGVPVFRP

SEQ ID NO: 972541 - protein, 141 aa, Homo sapiens
MSPRWGFYSFFPPLFFPPRGGVPPGGPQHPWELAGSFLLLIAVPLQGRGPFFRSHLYTARGSLGYISRLPTDGEAHSLCALLTRSMVKHCGFLLYPCGTILAQYPRIPLETYTRHITLDALALEMHPLITPFRGLHLALSL

SEQ ID NO: 972542 - protein, 231 aa, Homo sapiens
GPPGGKAPKKTRGLQGSITKVSREECGEAQNEVWSHAVVMLEPAPRPHKDVVACEEGVINMYIGTVVSNDGREGQKQQVRGERKSPASQEEAPVGETSKKWNIAPLTPNNGVFSLGPHRDHSILRESARRRSRSAGPWANFLAASWNPLHWRFHTPLDLLPRWELKRRVTPIRCVEQRPVRSCNYSTISEVGRVRLARNPERPKRTRRHLVKKTGTVGPHKRRIAYTTTKI

SEQ ID NO: 972543 - protein, 66 aa, Homo sapiens
MATPPIIHKPNPFGTTTKLKGAPQGHPPFVRRKKWKKRARRRTKKNSPQASKKQGTPSNKILGGHN

SEQ ID NO: 972544 - protein, 147 aa, Homo sapiens
FYRPKPFCDLCQKNIGLPPVIALVIEHDFAYHTRELLYLTERVGKAADSSQQRILEYSGFSSDNVLASNGPFLIEKPECLWRDNKEEYGGYNHYRGGQAAVSGSQEADSSPRISLRQETMRSPRRRVITPRVMRANRRKPPEQQYTN

SEQ ID NO: 972545 - protein, 113 aa, Homo sapiens
MVCSASPVESCCFKSGGPTIILGYVCPMGGPVPFEFGQGTLVAPNFSGLRHTQLVSLSRWRPHTSCVGGSSPPPHSVDPSGDYNGLSTRRARTPRSWFTFLGRKINEALIPQI

SEQ ID NO: 972546 - protein, 244 aa, Homo sapiens
VKYTVRSHSGAQMGERTGTVKRSQVSKMAPNFLGNTAGKEAEQHCGHNANREPHRFSVGPPQWRPLTPLATRSTDEVPPQTCTNHARQFLSASSTVTNPGEAFSPDRIKKKSRSGPPPNVGEERETGPRALAEYRRRFTAANTTEGKSRPVDSPPHSLREEGKVAFTLHGATRVMHASLTGRFPTTSANTPSWSGAMEQKERLYFGYSNLARRSHIILIVFALSHSTSYERNQSWEHFLGTTIA

SEQ ID NO: 972547 - protein, 77 aa, Homo sapiens
SGGLSSGILAHPWGFFVGPFPPPVFIPGARPPPRTSGPNVDVALSMSQFSPRRSHDTSLFVVPNQLLCAVFYPSVTK

SEQ ID NO: 972548 - protein, 294 aa, Homo sapiens
MAEPDAMSSKGSDGAGLQWRPGDLVQSSVWLKEQGYDVIAYLANLIAPSKERLRREARKKALQLGAHKGVHLRIVKPREFVDGVQSGRPCQLAAHLYDVTPLTSWCNLPHRQRPLGLCSAKTIGWNIRLQAERMGRPQVNVLTHGTHTGTIGESTHALLALSSAVLLHVDPPQINGSFASPWMDALNFLQPRAIVPVTDLALDVTHTGNGRDYPIRVSMFTKKTVEGSGLMDSSYAHLLTYGWDIPGKRQRKQSASRVSTRNEPGPSHRLAIPCTFRDRVHHGRLGCATLCVAH

SEQ ID NO: 972549 - protein, 164 aa, Homo sapiens
QGRASARGEKPPHIAPPPEGARRRHIKEAPHRPQKTAPLLISGRARSIWGAHVACVCERREHVCLVDPSRGERETKQEAPSLSSGPTWQVCDKYTRLCFLARSCLFTGRWHLLHPGVAMYLHLLAHASFFIIGRRSCFSLPRIRLTSRENKGHNNNNSNPEMVF

SEQ ID NO: 972550 - protein, 70 aa, Homo sapiens
MCWPHVGDMIRRVYLQSPAVLFQGPRHGPPDGSSLVLPPVAPPPLFLCGNKGGPRAGGGNQKEPYTHIDA

SEQ ID NO: 972551 - protein, 179 aa, Homo sapiens
MHATHDPTTTTTERSNVPLSTTTYPASQAGTKNKLLRRSYIGSQQKDDFWLSKRRKKERRWEQQQQHQQQQQQHHSSSSTNTRQQRGEKRAQQQERFHSTTKVTHTRATSHTSQRREKQEESRSSHVRGERERERRARGEKGEGEREREQRHLQQRAEEDRDKTEETPTRKPAHNKEQE

SEQ ID NO: 972552 - protein, 216 aa, Homo sapiens
RPKAQNGTKQSEEMRSNPPPTHQPPMCERDDRAQSGAGSRTIFRVPRGADWTASEKGEGKLIGNAGLRGKDLGADLPPPHHRATRIDEWDLLPSRRGGRCGILARHCRRRCPLVCGMIPGVFLGRCFLLFPPFLTAFPYPSLSFGIFSCIRPRAPVPPPPDPISLRYVPPTLPGAHSSRARRERGRHASGKRQGGKESLSLSVRERELSTTKNAEN

SEQ ID NO: 972553 - protein, 154 aa, Homo sapiens
MAPPARCPQDVTAGNKEASANPRWEASRAPTQGPRRQNRGSSGDNWSPHPVLNARHNDEGENTHQAQRKVFGPAAPQTARGFSLVRTTPPITRAWGAWSPKTTPRFGKTLCWEKQPCPRFSFMWIRRSPAFKGSVCIVARQACHSGADETSRKS

SEQ ID NO: 972554 - protein, 264 aa, Homo sapiens
MCARVFCPALSPGPVGTRCRPSFPGLFKLSVQNSGRCTYLRAHLRTWHVWLTFAVRRHFALFDYPHQPRRPLCSCFGRPSPSVWWQISGVSPRPRFGKEQRLGSPKSAWKVLSTQKTTRNLYASQHTWELPTKMLARHRDKKRSTASPRRWRTDAPPKATTRLWGDVESRAHARGPSDMDPPGRTNNRDPTTLGKEKLGLERIRVVCTDRRPCCVPDTAEKHNGSGERYSASTRRERTLAREAKGDPAPTDPSPASPSFVPPQN

SEQ ID NO: 972555 - protein, 106 aa, Homo sapiens
MGKIPRNCLMEPHTGNSSQAVVSALKKTCTKKFKYPTVFNTEAAFIGGFREKGVACLRQQCWNEPQLGGSYKSSTAPIFNIMKLVLPLNYRGPKNNKNTREHPKKT

SEQ ID NO: 972556 - protein, 295 aa, Homo sapiens
YLRHLVLPLVFGQIRRIAPAPVCVATFSAVGAFTYHKPFRAPPVLPEKMVCFAQLKCNVHKISNRTFFMVNIECAISNLRRAALLSLCGSHVLRLHSPPRHTVCLTTTHQFITVLGKKSHLLGGFGHTRGTISRQENVYRERSLAPAVHPTVASIFTTFYLINSARPSIICGRHNFITVSSVEEYPHLSVTEKQHDDNSTDIGTRNHTSVTYSSTGRPNTRGLREVRGVRTPKEGTNEDCPKEKGIFCHPPPRVNTYAEPVHSGTANSEYKTHVTLFINPLKKRRSESKPARPHD

SEQ ID NO: 972557 - protein, 108 aa, Homo sapiens
MATMLRLHNKSFSSPHRSTAKGHTRQPQLIETEEANHFTHTKDCVHHGDRNHHTPTKGVLGPPLVGNRRLLVAHTQKTPQNLVDIDRITRKASINNDRKSIISSDNTG

SEQ ID NO: 972558 - protein, 236 aa, Homo sapiens
CLVISKSLVSRLFDTSLGLSTTALVEFLPGRHKVFLIEPPLGLISPMGLNSFTNVSLLSYAGCFDTELRALYLSAHLQGLLISLSLPCMSALFKNYSLRTSVLRLYSYTPPLRFYHLLVEKYLSLVCGITPLLSLWCSHKFRLSLHTVTGSTHATQYSPPPENLPLHRGFRDPLGGHYRLPPHCPPQASLLVTPLLRPPQPTIVRHPYARRCIGHDASVINPAILISRGHPVLTIA

SEQ ID NO: 972559 - protein, 152 aa, Homo sapiens
CRKIFLDEGDATGTMESPLQTYSAVPDIGGAHQQTPCGGPPRLGGQYVGFVCVDAPRQADRVSLAPPRGVQYLLVAAPHLFISVGLTFRDTPGALEPLWVAPLSCWNQTQQISTLGERILFETEWFSLSFLYEADLTKSGEQRNGSIYVLHT

SEQ ID NO: 972560 - protein, 211 aa, Homo sapiens
MFVTNCSRDPVISLPAVILKGGPFDESSAHTHFVCPPSLRLPLCLSARHRVCLVHPRARLPPYNPPWPATLAPGCSLDTPHAGVAPHPGSKTGGTHILRGRPPRQTVDSADKNGLHNKWTPVPSYTCSRSPGALPLRTPLCIWRNPTRVVKPRSDKDHNPPGGRIGGRIKYANITGPRPGLFAPNAGATLKRALLAQQSAGTPGSSLAQLG

SEQ ID NO: 972561 - protein, 128 aa, Homo sapiens
SQDGLHGWLIQKEGGTLVGACSIQWMREDGSTPHHQRSLMLCSLRCMRDNETFRPSSSIQEARLEEELRRRKETRLVGLFPACGGAPLVLGGVLLSFSYAVSVKSAGDAFVVVIADDDDDDRQVLCVV

SEQ ID NO: 972562 - protein, 309 aa, Homo sapiens
VGTIFFQISKRGPKKRCCPTLGPGKFSPETPFSGFYTPVGVPDALSVVGPPAIRLWGPSVLHRGAHSPLPPVAFLRCSIPSRGLSRRVSTIPQRCTGCALCPPPERPYWISPQGPSRLPPQRAFCCQKDLLVSPLRSAKKLCTQVLVAPHARKKPPGGDEPPRAGDIIERGIYLVHKLPTHRRPCLSNNVNHRTRSLPGANPWGTAAERYGGTKEGAQQIEEAKAGWVAPADNTQEISGSDQLRAAHYSPGGSLNARGDAHRDEGELTTGGTLETPPKGPRATPIAARWILTPPPPSPVDPNLLSSNIE

SEQ ID NO: 972563 - protein, 127 aa, Homo sapiens
MVGPQTYESTFKQSFGAVIVGPSQQPAHRAQSEFSFRLSSGRFFIYHTTPPTSHILDHKTRPPSFLHNAPPPPPPPSARKKKYNEAEPKHHMINTIVKEITHTQRTDISDHSAVYFSSLSMLLSERV

SEQ ID NO: 972564 - protein, 267 aa, Homo sapiens
TTRSVLEKELVSAFGRSVSRKVASPKGFWGPTYLGRVLPGRKIVVRPPYFWVMRVSPQKVGVGALLMPAVDRRACEYHVGGAATSIVCELCAPSAKQDDSRLSAPIREVSPPPPWTKVVAAQTKTSSLYVKECKSCARKPGFSACNLLYIPYHAPCETYYASEMLTVACDSPPPLPLRSRNTNNAYLFPSCIMSGLIITHRLRIGGSLTFLSDTFLEWWINHLSLETTSGPRNHEGQPEYVRGTCGDRQGKPGVTPFYTVWNIAGQR

SEQ ID NO: 972565 - protein, 142 aa, Homo sapiens
MCPKQVERPRGQTIGTAETPGGRGHTDDTSPLEHKGAKEKIGDHITHYRPGPSPWDNPRPGKRRRNLGNGKKRGVPPAWPMEGTPGRFPRANVERSATGRSRVKIYRRGLGKRIEGETPVAREMIVSVGKPEEGIWGYNPHN

SEQ ID NO: 972566 - protein, 202 aa, Homo sapiens
VCDGQRKGGDVHARYTVSSPRLIAKTGLDALHFLELLHPLRKFGLNYTVVNSGITWPPAGIDFYWLIEKNWDNEYIYDVAYGDSSYVKRFWFKDAHRRLYLLKDDKEVVTGPGVFQKWGEQPCGRGSKAGSNISPGNPFQRKSRIRAPLERVLDKERLRLESLFEICDTTGTAFYLSCKITICNSVNHQAQGRGEQYAPPIM

SEQ ID NO: 972567 - protein, 136 aa, Homo sapiens
IKRARGNNKTHQKNGGGPPRRKMGGEPPRGPQIVHAGICGGPPLPQGSVAPPPSPGEDHDSPILARQTRRPNQSPAGMANPPSLFTPRSFLRVFSPISLPTIFGELLLSAPHFITGPLLPTPREVCWRGTRPPPNC

SEQ ID NO: 972568 - protein, 104 aa, Homo sapiens
MLVQEAYTPTGALPLAVEKQSNGRPWRGGVNQRQGSKKGVQAVVRSSSATSGPRRTTLIGCLVDRSVCTLPLFAGPAPLLIISAGGGTPQYSRIWLVSRWRPTG

SEQ ID NO: 972569 - protein, 79 aa, Homo sapiens
SCENLLLGALCGRKPPGYTGAINTWGAHRTVGKSQTQGQEGETNGPLRRTLSLGGKTRAQVCRRPTRPSGRVGHVNAAG

SEQ ID NO: 972570 - protein, 118 aa, Homo sapiens
HKYAQEHFLGTPRPLAPDTTEIMEGAQRMPHNITYEGMTALAPLGRYACENTAHPWGAIAPRQCPHLQGRGDTDTTRRFANINAGNHHGVLHRRKKLRKIDPAQLCGDAAPRGRTAHT

SEQ ID NO: 972571 - protein, 288 aa, Homo sapiens
ASLPFFYYRGGGFTFYRGKYALWSVFWERFCIFERGKSWGALLLAAHLCLSPSPVLFGVSPPIIYHWLGLIRTAYLAVHPAVSNRPFTWFFLLLPAKFFSSAGIVSGPCSPRSLGWFPAYLVVHWCPHMVSSLGIPLWVPRRTTSLLFCAPGVSNSRWVPPNGFIGPARRPILLARAVSHILWGLYFSLSSSLLAVRLSVPSPIEGIIQGQTIVVKPHGLFPGAFYASTFGVQASPPQSGFIPAAPHMFSPTTPQHNYTRVETPPLHAFFKRLHNFHNFPFLQGGPTK

SEQ ID NO: 972572 - protein, 255 aa, Homo sapiens
AAKQARRKRTGANGRRNARRQRDKRRTTARRGAQIRAQGNAPQRWGGPHVHEAARYTEVRWRPAAARRYRRGHGVPPRRPSPGQDIWANIVGGSAKTQAVCKQGWFVTFSMEIRNVRRHRQGGARPLKTQDQEHASKETRRVTSGSIPNGSTCGSPRVGAPQGRDPQHKHGTYCLTHLGKHGVEIWQTDQVPASMPRRGRCRRRSQFNPPPSPRPYGKGPRDRHHERAWRPQGQPLSGRRLTTSAETTTIRGPFT

SEQ ID NO: 972573 - protein, 294 aa, Homo sapiens
TKAGRANRYTSPEDFSPENPRGTPLVHPGVAPQTVSRHDAFGQKPSSARVANSPGLLWGYPMKTPVSRRAGRWLNISGRLTSKQERLSPTSMERGPRAWPQKGPRLFGGKRGGPAKSSVEPPPQGGSATSTVPANIMESKVLQKRSLQGPEAAIAQRPSFCRLGPPHKGRLHPPTGGSTRRDSEAPPFLVENLTQTAGPYLMQTTPWFRGGETSNTDVAHQRMISHLQRFFPKMGAPLGRYTIGGHFAKKWQHATSFVCLPRSRIPVPPKKQLRSCAPFWKKAPGPGPQHPGDF

SEQ ID NO: 972574 - protein, 243 aa, Homo sapiens
NLCGHGCNCCVQGGPPQFVWGAQKRGSSFGEKSGFLLAHDGNAVPKWVFHRNRIAPSVVLRCKTTPVLPWRASSHQDYWLAAQVVAVPFFVRRAKAALLRGPNVVRLFTDYHHQGRLRCFMKVPRKYGASTRISVESPNGTNYATIVGEDTTRESVSVRKLNTSQALRRLCVYDSPRPLCNDALVKPCVFVSKERGTQDPLVSQRKREHFITKYKEGKQKCGSRPYHNGVCRIIVYYCPPMRV

SEQ ID NO: 972575 - protein, 127 aa, Homo sapiens
MPRLSGLIFPGPPASPLVGTLHRRPNVALHTLAGPPLCVNSQAGCGHLQQWCRPQAGTIVDHRGQTRGSETRRSSEQTLTPPALLGMAPARHWRKNSRGELPPPDTPCPPPSPPFPKKKIFPPPHNK

SEQ ID NO: 972576 - protein, 118 aa, Homo sapiens
MATVLFSLGRGRKPDKRFQIHREGQLVFLRQIDNTGGINNRLLCLFSNRRSNLKSFSHTSTHRGSINPSETDATMIHGPSFHGVYTHLLHEDGSPYPTFGAAPAGAFLPKYSNPKPQT

SEQ ID NO: 972577 - protein, 181 aa, Homo sapiens
CTKPIIRVVIMGCPPSLFRNYQRGSCLVWATLFVSLLVIRERDIRTMLCFKERTPSMFRRATPAINSLRHSLIWSGVAAPKFGETEKSLPNAHTHGGNISRRREKKEQCFSADTTCELSSQVLAVFYRAHTVAPLMCGVVQHKSTHAGSYIFHGGTHVCTASFVYRQIEHVGRVQHARFPS

SEQ ID NO: 972578 - protein, 262 aa, Homo sapiens
AESAGGATRIVIPGCGLDARKSRHEEHKEVGPRKGEEGYGPASETASPLQGACERSEQECVNGEQAESNNRYAVRRPLGGPLLVPPPAAGRGNEDKGEPAFRGTNLAGPKCGDKKFLSEERSFGKVKCFPRGGTPSTCAPRSPRVKRQTFIGGRRKVGNRTRANVFHGGRPPLLARTESKTPDLFTISLAHKVRMGRPIEGNIEGQSIRSAFIDLFENVSLMSCVTLYGAPRVLVKRGCCHRANSIKRRPNCEEKCWRRLHL

SEQ ID NO: 972579 - protein, 116 aa, Homo sapiens
FNAQTMHQRAPSRNSFHSGTFGAPPQFSFQTGFFYNKNIYTRYSSAFCSPPPLNTRALLFYIRRHNKISPLTVKNCPLHPLSQVYNMNNRTRLIKTYRRPPHRMRVITPVLAQIAP

SEQ ID NO: 972580 - protein, 185 aa, Homo sapiens
MCGVQILVLCSSVPAPKLLRHWSLVPPGLSPHSRFLGPLMGPPASFTRLSRARCEPPFCRTGIVRSCRPSNQGGSPRTSTAGGQKLVQPPGCFIHPRFAPWSGKLVMQNQQGAGLFPRTSQGTVPTGGLLMKADSTDRSVFASHDPATLPDIVLFAKKFMAPLQQQRGLLGYKDVDYMGAGSGPP

SEQ ID NO: 972581 - protein, 213 aa, Homo sapiens
MRHTVHQTMLCPIDVANSRGKLVKSHTNVAEIKSWGPHYIGEKLIEKPRFEVALPRIYVAIKRLFNLQGGIVQCEEYKESPRLGVRNNKLLWGRILTLPKCSCHCGDDTLVKSSQDHVSLRPLWPRHHHLGEYSGHLRNSSDRSSTQVVHFFGQPSVIVLNRGGEQVSRPPSKLWSTKRPYSNKFLTPPSLCLGRYSRVSSNGLIDSKEETIS

SEQ ID NO: 972582 - protein, 253 aa, Homo sapiens
DELRRTEWQGGPNRMVRWKGGPTLRAPETTTGGRPQHSCGDTRRARENRGDVAERPKVMPNDGPLWRPSCPRVARPHDNEVCKTVVEAASPTGVVTGGTGPPDGDCPNIPAGLAVAPQGAEPRGAAHPQPCERLRGFYHSGPEQGTTDISPADDGRKHKGRFDTKAGPKGIFLQVHGRPPKDVSQDSGKSLPSSNMGRIQAPQARTVGTRTQGDDRRTKSRGPHSKDPEELRGDGTNTMQPVEMMEQHKPPRG

SEQ ID NO: 972583 - protein, 130 aa, Homo sapiens
MANTSKHGCGLVPEGSFIGNNKGRALAKCVAPDNIVARLFSSGIFFIHSSPRETPCLVSETGLVDLVALSKCYGCAPPPPVDELLGLPGSAVNNLQLLNKAFLVRTTRNGLVYYDRHRMPNLLPKMFPAV

SEQ ID NO: 972584 - protein, 138 aa, Homo sapiens
NGQMAHGGDESAIENPRGAQPKRRRVKDPKSDRDTPRGAHRDKLSERAPEGTRWFTKKLDAPGEEQARQVDPPRCYYHTGSEKAAPALLQEAAKKTAASGSGQRTQPPRARMVALSPAQEEHTHFGAIDHRFCLPTLC

SEQ ID NO: 972585 - protein, 276 aa, Homo sapiens
KISRQIGPLEKARNHRGRKPGMRNSCAPRKAWPNQKPQLSAKSAPQNGQICGGSTDQQDNQGRRVCGPTPPCRPTLGRRPSLARTIKVLDAKSCVADTPGKSVNKKTQHAGGGIETTRLQEGNTCSTKPGTPGTKSSRLAQSRGGIDPERLRGRQGPGTFSQQRWGGSESTIPGGGSEPTVTPRNEGFEIAIVSETMQPPAQRKRETRRERVRRVSPQGGTQRYNRFYRAEHPDISVLLAKASTWQETTPRNTQRCAAKGKKTIWGMKKSKEGGQH

SEQ ID NO: 972586 - protein, 78 aa, Homo sapiens
MYCKQMVSLAELEWSRAHSTLHGPPTVYTHRWIVVANQGWAGKLDRRTSTSPRAPFLRLPRPDSSPKKFLTRLSPQKN

SEQ ID NO: 972587 - protein, 296 aa, Homo sapiens
SGAEQKERKRTEQKDVSRHTTGRSNKQWKAPSYSRRAESAPYRVLANVNRHQVHETDSFEIRDAGVVPGGGSPNFVDWRNRRPEMFPPALRPRKGPLQGGPQQNTNLGPPCDIFGSLAGRPIVKKCGAAAARSPAPVMVTRQELSCRHPCKSRIFIGPTTRASSRLCPRGLSWAPSLHMWARPGEAPVFLDESSRAGNPAGLSDNPTAALPASEIIFTGERHVSSAPLVRALQMGVADSRGMSPDERTRDISNNANDFWPPRKERHWLTTRPKFKGREDKPLSVCCFLVPWNSKWR

SEQ ID NO: 972588 - protein, 108 aa, Homo sapiens
LKQIKQILIFRVYNLCAADDVCTYSPTVDIVAAHLVVFSLLVVYIPHFVVPQFVGVFHKCSQIFIAGVHHKLSRCTHFTRSASRGERIPPSASKELSDGLHPTPGGQM

SEQ ID NO: 972589 - protein, 204 aa, Homo sapiens
MCLFACACVVLYVSGVYVRCCVSLCLLAVVVGGVCWLIGLALDLSRLSGTGSVCASFSKFFPPVFRPPGGGTPFSPLSPGFSPPPPLSLVVTAPPNGRFFAPPSRVDSGPARSLFGRRNSRPRKPFLCDRRPVDFQCSPVARFPEQIPPRDFAPLSCAPGEHTCENWTQLLLPALKYVMAAPLSYGLSSLSRGRAKILLVGPPR

SEQ ID NO: 972590 - protein, 117 aa, Homo sapiens
KDRTGGNHGAYGPPLWTPLSGTNKWAQEEAHSHKGPPTSHRGRKAVLGGKRLNEREVTQTPGVPPLTKDWRPSFRTSRISTFPGGLPPTGMSYGPEGSKTGGITSDFSEDAFGWSPS

SEQ ID NO: 972591 - protein, 174 aa, Homo sapiens
MGTWVETRHGRTAGTNACHKVKARARPERTLILNVCRRPRSSPETERGGARGNTLRRTHNIQVAKRRWCQELHENWHVLRRKQKNGRLRKNTRWKGGLSCTASYSTSPNERGRRCATNLVRSRESSNQKPSKVSLHERSHEDARDGITQGIFSMEQRYRVHEGALTKWEELTRS

SEQ ID NO: 972592 - protein, 173 aa, Homo sapiens
MRADGADCETRPRRSFPRRVETTNNWETAPETTGIIRRRTTKNRGLKETLLTVPADAQQIPPGAYWTKSSRAVAGYTHVLRTLSREVDTPLDHYGKRDNTRLSREEKLSRKLSHVVRPTPGGNDRRASTHHHHKAQERGPPSCQEHTAQQIPAGETQRTCKTLSEVLGRTNNN

SEQ ID NO: 972593 - protein, 293 aa, Homo sapiens
SPDYANKTGHHMHPNVVNKRRVSPPRKYNPPCLKGDHSKPGATPTRGHQRPGAPLGGENAHLSQRRTFTAHKSVLKEPPGHRVFTHTGNSCAATQHYLHGLITAPSLALDKKNCGPAHLGQPPMKAQPPWGGSKHKSMHLREEGYTATTSRRNKPEHPTSCIRRQVAKCIPASHKLARLSPLENPSTTLGARVTTRREREMGTHRGTKASSWPPGVRTTLTSTTPGATSSRDVKGLTENDATNTMQRHVHDADATLKKPAQGGIRHPPPPGVGSPPGVRPQEMEKYKPSTGPL

SEQ ID NO: 972594 - protein, 135 aa, Homo sapiens
HTIGPEGISVPSYGVLVTTPGFQNIGLIVSTDVSLLRSQCPCRRRGVPTWRVTIGIFCPAPPTQFEGSDLSTPRGCPPTVSKPPVGAPHICGSPCDRRYHPFLSCASARRICPAPPDPRKRSSPVSSPLDYIPRR

SEQ ID NO: 972595 - protein, 162 aa, Homo sapiens
MPTPRGGTPLCVLCEKYVGPPVRPRHLFCAELLWCTPPDCLGHEWCRLYYSCLVAHPHVVVNFYAWRLEALFTFRGGIEQNMRAPSGGTTAPHRGHLWDQKGSEHPASHSSRQALPSPPRREHPLGSPRQEEAHRGARRAPTPKGARQPPPLKKKKARQQKQ

SEQ ID NO: 972596 - protein, 86 aa, Homo sapiens
LSRLSALLGHRRCGTTPIWHSLLEAGPPRMPWVHKGTHSCESRRRLASRQRHKISPASTRSAERSNMSASKSTPWVTRQLVRRSYL

SEQ ID NO: 972597 - protein, 95 aa, Homo sapiens
MGVNIALHALLQPPFTGDCGTLACKKIAFTIRPDFSQRYIAHSAPALGDCSESSTAVHALIQQLRRFPHNTNNSFRDEFRKLEPPKKYRQLNPHM

SEQ ID NO: 972598 - protein, 144 aa, Homo sapiens
LPSLLCRVDGARANKVAVLNPSPPGCSRPYEAFISPPRKACQDTLKRFPLGQPDEEKYPVPPYANTVVGARSRLPRPTNWEQGAHVSSLSTKYRGTPYGMGTAEAFPPPYFGPRSPIRATAVPPEYPRLDPDPMCQETPATVTQ

SEQ ID NO: 972599 - protein, 220 aa, Homo sapiens
QEPRAGASKPTLWPAFHKPPEAPQVPSSGQTQASGDILGSDRPGQVHKFLRGRAAHREVPATRRLGPTPAPPEAPPHGRGGPPLTPAVAPPLLRNPRSLAAAMTTVADRLMFRVATARLSEETILHNVLWVVYRPLSMGRAKMRLPRRRPQGEATLLPCSVVPFPFYRTGTAAFSSAAACKKQAFPIGGDEQEALRISEAIAGARGRAVARITPKTHKNN

SEQ ID NO: 972600 - protein, 226 aa, Homo sapiens
ERQATARPIENSTEEWDSPMRAGGIGNPAGSPSNNGGWQHLSLVRASRLPGVQRITGNLVTPPENVTMGKNRGNIAKSGSCALHQQGVGPDPAAGAHAPAVPRGKKFAPNKRATPLRVEKPSLKLGGSKKGHHTLGASIIWETTMAPAAFQERINAARIAPPGEETLGQPALSYVEYSPDNILSTSVCPHPRERSLIGGSHLDPRVFGTPSVFTIFQSPASGLSYK

SEQ ID NO: 972601 - protein, 110 aa, Homo sapiens
MQLFAATVIRILPPIINTRRDLNYFSSTDIVEDTLIRHPFNIETSSSSSFFAISYKRVFNNHPLEFVEQPLTHMKVTFVLIPLARLVVSRYSSFLLEQPVSFYVRPYCAS

SEQ ID NO: 972602 - protein, 141 aa, Homo sapiens
ASPPVGYPRVNRDTVGGTNTSVWAGTPPTERHGPAQNTGRGKHTRPRLCPRKDAPPGELYTRRREKTLILDEDRHSECPPQGGVPRGAPAAREHVCFERHPTACEKPVGARPLNFEPPPRAIVCHAPLFRGGLFPSRGLPE

SEQ ID NO: 972603 - protein, 143 aa, Homo sapiens
MSELAAPPQPIVLPTPLSVLDPSFIGFNPPRMSKYATPLPGGRKPTEGKGDESTFSAPVIPPTNLLCDTNSDPVSGQNTAYGGACSYLLAGVCYPRDLKIDCLRVVSKSGLDRIYLALRSSLPDYVNDCCPPIVYHVLCSRPP

SEQ ID NO: 972604 - protein, 190 aa, Homo sapiens
GVEKPSARALFCGGEPFKARGPGVIPPRAPRLFPPPLVVAKALPEWCDFSERLRQLRLCPQAPGCSPRPAEFLAVVAPRAPLGAVYPTPDEFLVCASNKGGESFKGPLHGEIKPSLPRPRLSTGQTSACFPIHNEPPWTWLSPELCGERVIFFENSGENLTGWYDKQFCWVLGRLLGSSRLESTRNMSKG

SEQ ID NO: 972605 - protein, 148 aa, Homo sapiens
MPDAPKHVNINNGVFQIKLLWSYNTSFSILPKISRSPPPFHCWRLPNGSPFSPGIFCHAPPPFCRPPIAPLKSTGDSPPPCLFFRRRIILGAHKMLSRGLHSHRSPSQHSVAPPQRLPRFLLVQRFNKALTPFHFEPRARRVSPNYHT

SEQ ID NO: 972606 - protein, 76 aa, Homo sapiens
MSFLQRLDTLFNNVLSTYQRKYSFHDKQVVSLNPLLVLVNEDTLISSLALSPSDDGRPTFPHLSKKKFLSKLPNID

SEQ ID NO: 972607 - protein, 132 aa, Homo sapiens
MALPALDVRVISLRTNPRAMAAYVCTTHAGEVSLLERAGGVYSLSTAGVCFPPDCGGVHTTECRSLPLGGGTFLTRVPPSTRRVSRRVLVFGYWRWYLRLVDFLCCVAEESDERAGLSCVFVPHKELTTEET

SEQ ID NO: 972608 - protein, 296 aa, Homo sapiens
MVHSPFDPVGDGLPRAVDVSGLKEPTRRVALWLGDLFPQDVMVPAGVVPVKYLGRGFPHALRSCFLPLIDHRGFPRALVSPRYIHSRAHIAQLFIGSRTSIYRSHARWPPGPGLLLRALTLCFMWPTMQSAVVTPLSVGRPRAPPPRVVHSLSCPPQSPACIKIHAVAPLSRSLAVRCARPVSSRSGSCARTYVLLDRPSWCLGPPRYYEGESMRTLRASSSVGRSSFATGFLFGSPLPAPVRPFGGQPKLAERSLSRGILSVAGVGRDVDRPSRKWAVLPITIHALGLTISNQQN

SEQ ID NO: 972609 - protein, 74 aa, Homo sapiens
MWPDCRNHKGLCSPSGSHPGGHYPDVSPMYAHHSIAAMWWRRTDSAPSLALYVDPCGPPTMIIGRAPPVLPHMT

SEQ ID NO: 972610 - protein, 162 aa, Homo sapiens
MLLCISSYTYTYRVSFVHARVPCRGRTHTRAHHFRVPTLVRKLSRRLGGAGTPPRGSSSSRLYTVQLRSSWPTHTRGGRTLRVSCIPHTPLPLCRAPFVQGSSPTSSHASSRQARRGTERSQRCTPVGAPSPPRTPGIQSCIDTFDSGVSKMFPPLCPINDT

SEQ ID NO: 972611 - protein, 115 aa, Homo sapiens
GLSSPFGVVADPHPLAIPPHRRFAHGTQAAEDDSPCGAPHGVSEGPPTRWWGTPTLGRHFFAFYLFSLIYGQTVRRVLLCRRLFFFAINTLGLCVEVGFKVNTASPIFSLPTCRT

SEQ ID NO: 972612 - protein, 254 aa, Homo sapiens
NILVVSLLHPSWRHCPECGSPSHTSRWEVVPLCPAPSCCPRQRILSLGATHRQCVLALWCLAQNITPRCVVFGDDQHVLSEMALVHNGVRPLSSSMGALTSLPSRVVPSPTSGLPPLRERFDNLPPVCDPPLLVYYKSNSHISPKKHLRSPICNPTSSTTTPSPPFAHMFFPAVYLPLILCIIRSPQPVSAVVTLVRPCRILLEHRTSLMRGSLTLRLAAQPPSRRRKSVCLVRRRLRSALNSTTSITLYEATI

SEQ ID NO: 972613 - protein, 139 aa, Homo sapiens
ARVCVPLRREGFFSGPHRVGPQSRAYPRFSCAPPAAVPLYKTLVGDVCSISVSPPAVQVSVFSAPHGVLAWLAGADFCPRVSPKWALWAAVWVQKYPSGGLGSHSGAPTGVKYVLLVDLLLPPYGPSPCGPPPSGPTRL

SEQ ID NO: 972614 - protein, 139 aa, Homo sapiens
MTTWGVHYAKWAVPSVGTPRPLVRGGAHESVPATIPASFVPAPLLARFCPHNLLQASPRSSFCSACPFPPYLWGALFAARRLFQQSPLSSLLPPPNAFSPATPCVSPRPYFRLPWLSRKLSCPPFRVSLRTSRTPFPRS

SEQ ID NO: 972615 - protein, 309 aa, Homo sapiens
ARLVLKPPSPLCVARGDYLSVGRLSGDVLLPPGVALFGVIYGDFGEFSLGPVFQIVCAPPDTCIASSVWGPTARRCSSNDIGLCDDPTMGRAKRFFSPPPAAGDRGDPTFRHRPPCSGCPQKALRCPTKGALSGPSPAAVLGIKRVLFSRPLSGGRSHCDTRSCRGNAISGKNLVSVIGRRSCTSCCHGRFSSCERAVSCCPLSAVNKGTMFVSHNTGKGTRVNLLFSGADYKMFFYSHVCALSAPYEWFPLDHPVLLDNTQTRSPLIYNSSSAKILRISTRGCIVLLIIRRLRMLPLCPKTTTAAHKT

SEQ ID NO: 972616 - protein, 81 aa, Homo sapiens
IYDDDRISSPRRLVRDIDTIYYIVLYTRDSTRAHTILCSLYIARSLYDKRRDEDNILIPHVVVYQSAAAHYYNFLCVFVST

SEQ ID NO: 972617 - protein, 254 aa, Homo sapiens
FAPFSSGLRPLLGQCGRLSPGGIVLGLLFGPRASSFLWGPGPLLVQKGGAPDCVEFRVALPYCTRVCGRILYISWPLGEFPLRPPVRGAHLEVPPEFVLANVQVLSSAPPWGGTLMRECGAPPDGVSTAGRPTDGLVFHVLPHPACFMWHASPPVLSSSGRRHTQASLRGTFEMPPSRDVFVFSPAARCAVATKSSPSRVCEGSTHIPHLMTTSEWTSFWNNMHAHLTNGHIAAPPDTLVASNPAASFVDPIGN

SEQ ID NO: 972618 - protein, 176 aa, Homo sapiens
GSITNVSRESCGTLVGAHVGPPGTRGVPVPGCSRSRPSPTCARLSRRYGGCPRRFTFASTDCVVYVFQEKSLFPLFWFKTRVDAGAQLFKSLLRAAVATWSGNRSPDEDPRSVCETFSTQAAPTSMEAATVRSLRYNTTNTMPRGEVPSNRHPWATNGWIGAQAKWPLLRPPSAFV

SEQ ID NO: 972619 - protein, 187 aa, Homo sapiens
QFPYGPRGPFESQCWDCNLAPDNSVSIPEGNSPLVTPAFHNYGFLFTGRPLDGGPLGQTLGVACPKTFTRRQCYATFYTARVMCDALNVGASRPNEVLGPLADVEHRYTHCRYHHREVLPGPLPVQEIPGAPPCRLYSSGINLASCARTYFSSSSHVISPPYFHRNPGATEELPYRDAIRCEIISSI

SEQ ID NO: 972620 - protein, 224 aa, Homo sapiens
ASALFALLLPGAIFAPFSSPCGEAQSSRPVLVPPKVHGGPSNGPGLLFSRRLAVVARSRAGISTEVPSVHHSGASCELWIMGPASFRGLCTPILRPRSSGSCVCVPLVYPHPTMCWMHTARPGSFCGYGMNAFAPHATLMADGPSLFSGEKKDFPSHRHFICSGGPLPIRGGATVVLAGTLHSGRIPLPLGDLNKYTCLTHRPPRALKNVRIHIIGVTPHGSLR

SEQ ID NO: 972621 - protein, 83 aa, Homo sapiens
HIVFIKPTNVVVVTPIIVAPPKIFWARQIRVCPPPNYGQNSQRYLRNCMLSLALPRFFPATIYDAPPLVGPPINRRPNINFVT

SEQ ID NO: 972622 - protein, 102 aa, Homo sapiens
MCVPVDVLDPVGSLVLWTPRSRGRPDEWLRPAQNFLCFAPRCCPYEVYVLEMSEYVYGDPSSLIIRLQKDPLDNYLPLIGIVPRVCAYALLYPCCAWRPPHC

SEQ ID NO: 972623 - protein, 104 aa, Homo sapiens
MGTNCSILEVYACSTALGGPSHPLWVPLMTTEFYLERELYANMEFLCTSMENPNAAISFFKGSPPQKFRVSIWVSDIYIQRCPFSIRSSWAPPREKNFPLGPPI

SEQ ID NO: 972624 - protein, 82 aa, Homo sapiens
MALWHRRKNDNCIEEVYLPGDGKESSQVRIRSREGPIFYCTHMDGDIVCDRRRRDLVHPPLGLCHNNIHPVRLSPKTIFQQP

SEQ ID NO: 972625 - protein, 130 aa, Homo sapiens
MVPKRPQGVSCCPQWSKVLFSRGTVLLGWAWLLTIVNAAHMVTDSRGVRIVAPTCSCAIHIKGRIVPPRDVLESLLATVKKVEIKNLFAKHSIRHFSPTFPSNNYFLSPNYDTNNYPIPFHITTGDSLNF

SEQ ID NO: 972626 - protein, 123 aa, Homo sapiens
LEPFSVHQTRMGREPPLKSNGKPFVKAFCPTLKGLPLCPKDRIFSNDHQRALYAPRETQPCPPRFSAHTRLLRNFFPTTPPDQYTLTEHCPPQIVPKITRLCFRTPHSRMWVNHTDPALRLNL

SEQ ID NO: 972627 - protein, 182 aa, Homo sapiens
FWGVGVPRTAPVYAKVGAYEHCLFCVPLQLWGRTPGPNDAAPLLRGYVPPALGGPPLPRRLVRGVKLRSVLILQGTSQSPTSWGVPLAVVTSPEGATSMGEGVWAFEAVFISGATYFPEGVGRAISWLSSALVDQRVLFCAVLTPQLPQPTADRTGQQHPLVARSQCSPRATSGLLAHSRPN

SEQ ID NO: 972628 - protein, 178 aa, Homo sapiens
FAPPWVSRVWFPLARVVGSLPPARCLFARAGSAPVFGVRPRRSRCQLEGSVVVLATKAFGPPLSWSKQLCEDAASCLLEAPRLVRHRCVAITVPGGTPPLFVRAFPGALAPLGLALLRLWQSYSRHPEYRAGVHPQPPRGHQRACCAAVSTGHAPYRWVRPPKLHKRRAYTSVIYCSA

SEQ ID NO: 972629 - protein, 217 aa, Homo sapiens
WGRGLRAVVSDVGAPPVFFVGPQTSVAGLWALCASGVGVPAAGMRRSMRAGYPVIVFPPVGSFVGECTRSGCVVRGRGSHQSSAVAHGLSYSDCLRPRPACRLVLWSTHCRSSWWGINSKELEWCSGVMRICPRGSRFNDAVIVFVGTEQRRFPPGVCETTPHLVDGCVIVSSLEPRSSLRACVLLRPATRSGIKRARSALALLVASRVISHRTVFV

SEQ ID NO: 972630 - protein, 216 aa, Homo sapiens
KGRPCHHTKEAEGARSALLLVRIVYVFCMRTPLVTLLGAVDKRRHVAYSAPPSRVTRAPHSFLFLWGELCLKSPLLTSRAVPPHIIRAQSYTTPLPRSVWNALALAALSPAGLSGGARSLFVCMPARVWSPLACVVMCLQLSLRVVRMPSRVLTRTSVVAFLSSLVVCLAGYLYMHSCDTITIMQTRALKQRESDIYLVSGLSTQVCGNLHYRGVE

SEQ ID NO: 972631 - protein, 151 aa, Homo sapiens
TLNKMFRSFKAPSFQPPRPPKGNHLSLFYDPTYMLVSLPPMIILLSGAPPRFITPLLISAVASLNHLSTLLTKFLSFVRLSIHREYCLSATYASKSSLRECSYYLFLFSPNISMILHPPPWLKDPLPPTRIKRFYICSACLHHTHTCAGSS

SEQ ID NO: 972632 - protein, 119 aa, Homo sapiens
MVLLADPNIVLGAITFLMAQRPRLPPLSLGGPHFSCEEGHNNFRARARPAPIRGELHSQSCSTRPQFPRDHYAVFSSPGPLFARTPCSCLDGTPAGDHLLPTMLLWVPIYRMHRIFLNR

SEQ ID NO: 972633 - protein, 69 aa, Homo sapiens
SPVLSFGAPVFNDVYHSRGTLKMGRAPSSPPKELWAHHRLPTVGKGACPPRVQQFLEFSRFSRCINSRH

SEQ ID NO: 972634 - protein, 146 aa, Homo sapiens
RGTRSTAIDHPPPESFQTPPQVNFSVRLLNQVGNNNINVETRNIPLASLEWVSPPPLPPARSGHVAHLTRVSRLVTALVGSGPRCSPPFKGRCGTDAYDKACVPLGIVCSEPCFVGGQQPLCLLATGMSTLSDPHHSILQPRTKHN

SEQ ID NO: 972635 - protein, 329 aa, Homo sapiens
AATQKHERDREIRKERGDVSERGRIKAAIQSGSTRQEVRKAALSRDNDPGRRPVEGRGTVSGAPAVNAKGRRHTEEGGGGQQIAAGQATAVFPDRNAAQKQVWPGRPMITRVHGECRYSQPLSWGVDSWTKRPPSGARRLVPKRPREGTTTNLGPGTKTRVPTQYSSPTRKGVARPALLGTIAQERALCSSREQHTHQIGWAEPGRDNHREMPTTLLEGEQWVDGAPPKAKGRRKRRPPIGPKKAALPLPMGEENAAAYVPHASAKCVQLCLESTPENGGTLFLYNMRHAAHYSEHSQTSYVVHHEMCAWRNTGYDTWRKHTWGFSDGQ

SEQ ID NO: 972636 - protein, 137 aa, Homo sapiens
DHPGKSSPRHNSVRASAKSPTGGHHQPGAGQQATPRNAPGVTPHRMEQQQGAWRHPKKPTIVPRKESSKRAHNGKNIPPVDARTPHRLKSSGGNKRSRTTVFWTHRAHLQSDVLKQQVSKKSRGFDDPGPERVKIYL

SEQ ID NO: 972637 - protein, 264 aa, Homo sapiens
WHMFVTNVGTNASVGTLGLVCSRTEAVFVTARPLCNKRGGVCHNLLGVWLSPAAEALSCNPRRDVVVRQRSTVFQKGGRRGSPRGKMAPTGWSRRVTGCRQCYRCCRLGPPPNSPAPLFTRAKIILPRGEHIVLYRAANTPASLKLPRCGHGLRRRIPYKKRTGCISHRVAMAGRQEQGRGAPPGEEPPPAEVWRHRGRHKNRGTPQIREDTHPLGDAKRPHSDPVEYHIAHHWRPSRAEHIINGSPRAIFSDSYNSYSAHVRW

SEQ ID NO: 972638 - protein, 187 aa, Homo sapiens
MRMSLLSLLRVYSVCRPGSHSLGRKDPSAAFKTSDRVVSAPSSGTHFCGGLLQRRTVTNKNHSFEGALSLRPRRMWTPVFGPRLGSNHSRPHAPATLPFVLGCTHRAIVIGVLRMRTGALGRQQHHQRVQCRYNAPRGLDCRQESPRGAPSRREEQTTLIVSNKQAKTPVADDRPPDVKMIWATRQE

SEQ ID NO: 972639 - protein, 34 aa, Homo sapiens
MSLTAKFSPEAKRVLTKCMRGQKSKKGRTPLKHD

SEQ ID NO: 972640 - protein, 274 aa, Homo sapiens
RSANPASGVVWAATANRLLRQAARGGAHQVRSPRREGSKSLPPRGDVLPPLDEPTSATEPLGVYNTPRFGELVRKTCWKDKEKSWSLVTKEPTPTAGTQNQQSSVRIASVVTVTLSVVSEQQGKRVTRPARTKCGPCTENLSAGQNREAGSPTRIETCPRKNTWREQTMQKSARARMEFNIGGPRGIENARRSKQTAGHTTNNRRTRLQEPAHNTPILRKRVDEDESTTQRDCADIPNSSYRGLCSESRPHARLRMFMEKHGTFFLTCQGTVFK

SEQ ID NO: 972641 - protein, 123 aa, Homo sapiens
MHVRHGAPNKIVFPATPPPVGGPHNHREGGERGKKTNVVLASNPAKTSWRPQKERAPPVSNTHEDTHVAMPQKRETDTDTAGSPPPGRNPHFGDDEERAGTSCRPPRFETPGAKNKSGDTTNI

SEQ ID NO: 972642 - protein, 347 aa, Homo sapiens
PVQIDKRHVSKTYQIILARRPAACAACTPRVVCGKVSPLAHKLPARVEVVARAGEVFTNRRFRKQKPFSEGDTPFFGQGAPRRGNIPMAPRPPIGVKRGARVKNSEGQNRLCVRHVVSLGWHDNLYITRRVFSEHKDLPEGTTVWCSMGTHRLCGGGAPPVTGPNPRVWCFYEAWVRQSSAENPRWCQRVHRWSKNLLLFTGAFMALTSLLLLRHAPDKLFRPSYRHPGDAHEGSRVMYAPDVYCPRPPEHVLDNSIITRGKLRVFPEDKFQENFREAGRESHSVRPPKMSRVTKIFKTKKVTTALYFTVAHNSLISPYVAGWDNWPGVGRLPRLKNSPHPFCGNKN

SEQ ID NO: 972643 - protein, 103 aa, Homo sapiens
MGAPHPGYNNATKRPGGRDTTRRTIRVGEKNTGGRPLGSTAKTNMLGRPPCDPSAPAFAAVCWDPPQGGPPPPVEGAKETSPGPPPTANQQVVKARVFDLKTS

SEQ ID NO: 972644 - protein, 225 aa, Homo sapiens
MAHARLGTKRGPPLSLITGSAANSLLRHPPGTPFCAGQETNSAGDTTPQDRGVAPRRKWKRPYDPQEDFRKDVAPEPMRQHVPSRHRESNPGPTLRDHHRAVLVKRRNPGLIIISPRPAPPLPTYWKATCSNRYGGNTPERKAKNGFKQGHSKLAGTLRPLLPPDCQPRMVIRTITLRGNYCPFKELCHVLLSILTGLPRPVPKTNATAYNLSGSPPKTIGLLRD

SEQ ID NO: 972645 - protein, 146 aa, Homo sapiens
EATYHTRRRLAVTSTYFSGRGHHIGVTSTMRGLSSSTRSNTNQRGGKPPGGTHDREKIHFLLDKPVCSPEEPPSAPPGEAQQPPQLITQSKRGGTHQRPAPVTASAPTEESPKGWVRPVREDTPEPGVRTHTKNGCGGRYTVTTVY

SEQ ID NO: 972646 - protein, 238 aa, Homo sapiens
MWLPTAVSARPLLMSFTRQWPLGAPLCTPGRCFSPALLWGAFPLCGPPPVRGYRCSPPLHSVENHRLARPHHWGPNLGTLEGHYNPPTCCKNGSHPPQATHRKCSSVGGKPLQSGGVQTRCEPPSRYGEQNTPWYRGAKNNQRTFLWGVTVAPPTVRDPGQDVPRFAFTDVICLDRCFHSAVFIFIVEYNVHKKFQALKARSKPFMHNSGVRRHDWGPQRSSLQPLFEKNMFGPPETT

SEQ ID NO: 972647 - protein, 206 aa, Homo sapiens
MGLGISCGRSTFGRRCCHRPLCLMGKYYFNRKKFLNLEKRKYFLGKHSINPGGNISAGAQRSPPPEELTLRNLEARGTLSEIRRPRKTHRKNRGCETPPQVRGAKKRPASVLAQSHAAKGRRWATNIRARMHPGPENFWNSSTNIGPPPFRKDILHPRLFQKCFGSSPSRSANTATPWGHTKVYQNKYHVDRTTCYSFLGNWQKIS

SEQ ID NO: 972648 - protein, 147 aa, Homo sapiens
MGAALCLTDSGVLGRPPACLLSKGRPTTPLLRNHGGFNKDCYWRPAGGSTHGRRGTPAAQFGERRHPGPHKGETPPPVATEVVEKITAGVPLRKMARKGRYVSPRQGCKHAPPPKHREVGRKHPGASTCCLDRPKVKPSPQGPTPDR

SEQ ID NO: 972649 - protein, 79 aa, Homo sapiens
MVLSLPPPTHFYPPSHSHAWHKNIVFEEKSKAANSHSELFPSSTYLKEIDSKTDLSGHFTHLALSTPKCTIRKTPAHKN

SEQ ID NO: 972650 - protein, 154 aa, Homo sapiens
MICFDRVEFRVPTGLCRALWSTLLITGASAPYGLTRRAASAYGWTKTRYTAVVCTTCMKPCDMAMQTDGDDRGKGGSGNLPVGAAENLAGLQRSVRHLMGNPRPHLSDELVTPGAQAHMCGMRQNPARTNFLDRRAGANIRRVDNIGRAVSAEK

SEQ ID NO: 972651 - protein, 283 aa, Homo sapiens
LAEESRGAGREEAGARHVKAGRRSKGAGRGKREGGVPREGEGGAGRAGGGQRRPGGAGEKADGTTPGGGNNDCWWRGRRENGVGQVGARRRSVAAFVPKGPHERQEERLPHGHEVGGSRITREDEAATGVAGEQEGGGPPQGSNSVGIIWGNKRGALRPPFHTVWENAKGTQSVVVHPRGNTGAPRVGGAVLFTTWVVYAPVGLFFCERKVVGANVVHVHREALCDDREEILGRGEKKCRGKTLCERCQTGNEACALMSQRSIILETRRIILVFFPKHPHKRH

SEQ ID NO: 972652 - protein, 285 aa, Homo sapiens
RTPSHKGGIHGGERQGPPAFKNNTGGMAGENNPAAGIGKGPDTTATAGDYYAGAPLVWRELTRRENLPPRVYYRGLKELLNPPAEIVPRRRAPKTEEDNSLAPFSRQVKGKMWGPRADHAGHGDRRNYGRELRLSPISAQRPGVEGEQKQPRVALPAQGEWKTHTQRRHRATLQYAPAHASNNTRRGTHRYAVSSATGVAHDNEVLPRPPKGCKNPNFHAHALVCKARLLVRRDHKYNGGQLGEFFNESSFQTAVQDPLNGGLRLHVIATRPAFNISKRPPSPQT

SEQ ID NO: 972653 - protein, 201 aa, Homo sapiens
CGAGSVLVYFGGRGGVCGVVRGGVVCFCQGVTMSWWCVASGVVEWPAGGLSVVFFCVRSHSGRGAFVFAVWGGARLRWLQKQWCQCPLGPQGWAPVPRCVEDVLGGAVGLSAVERRISWEGSCERDRGVPVRVLVRAAGPEVTTLRGDHTLIDGVCVLCMCRMTWSHDVAAPLGSGAAFGQSSRPPLDGGFVRDAAWAARL

SEQ ID NO: 972654 - protein, 191 aa, Homo sapiens
MDDTHATCLCLSRYKDIESWRRSLNFSGLHVAHTFANLNELAATCRPSHPGTLGTPPRGGRIDSTPPGWRESEPGTTQRGYTTSQETDTRQLAGTPLGCKDKAHLGRESETQTHLYSKTACTIRYPLTLARKGKKSARYPCARKYWITYESSTDFDEIGTIYVGPYLNAAHGYNQAVEPIFFRKKYHTNER

SEQ ID NO: 972655 - protein, 148 aa, Homo sapiens
MCLRARLLEGPQQFLASQRLFSTGRRVDLPSQWTYAGSTVVIPQRSPNTHQEGGIRAPLPQMVREKEEPTRAAHRCKTDPKQGGPTTHGGGVTTRSRARALTCRQQQSLCPHVIVCLITRTIFRRVAHPLWGGPRAKILVPREASPPT

SEQ ID NO: 972656 - protein, 292 aa, Homo sapiens
PSSWVCPPRKHPSGAKLPFGAVIPLGRRQRGRVQHSLPGSPPPRGSCATRLLSRAAQRNAPHAMGCALTLTLVGLDNAHAVLFSRRKGHALGRYSHPVVSPIYKPGGPHSSRGCAPRRGIQTPGGGIQKRGSAQLETPPLYALQWTASLELTRTNLEPAPLLEDNTLRVRQGAGVSHPTGSTGTARDTPRGGLPESTSWDQSTSRAHDLREPCTHVCTLAAQGRGYRMIGGPHLGGSRPVGAIERGVVVVSAAANWASGGEPPDKGGGTTQGSVRPAAKTEVNNKFRRPNKD

SEQ ID NO: 972657 - protein, 139 aa, Homo sapiens
MWERNQGSKRGGRPPCEHTDDGRVTYVEGAHAAGQKVAFVRNAGGAGWGRRFNSRPKRTDRGASTGQHDCPGVVQPPGRQPPRGGLDGLPSRRRAPLVSRPPSGPSGGHNTGARPISSPPREGQSQYKKNEVLRRPIKD

SEQ ID NO: 972658 - protein, 152 aa, Homo sapiens
MHAALHTTRRGEKFAHNEKDTRVLHTRQCTASVDHSARDQVDERKHPWRSLPNRRVGRPRGVKYRVVGTTKTETEKTQEKKTRYKNIQNKKGITRHGHQRGSMSEADSEDAPRGSSSGALRVCTSASARRLLPQINDNAREGDVPTPKQMTA

SEQ ID NO: 972659 - protein, 32 aa, Homo sapiens
MRARISRGDACPMMTPDIRTPPQYPLRPVRHA

SEQ ID NO: 972660 - protein, 262 aa, Homo sapiens
SGDCLYPKKNTVGGSNVDTNERKWPLLKDKKKVWSTKINEKTIARYERIYIRIVGYITDTRVSIIVGMRPPPCTVTQGARHPPHRDIIGARPLYTGLYYKLHLADLGVAHHKICFISTRYIHLEVTNMYARVIVVITDTCHTHTHINEESGQTIFIRRPHIGLRGVKTYTPLGAHTFFLRREQNNTFWASVHNCGGLHQMKSRGPRRREMGCELKSGAHDVARKSGCAMPSRCCLYGNLVQHQRGEKGVRDKQNEKAAAHIS

SEQ ID NO: 972661 - protein, 173 aa, Homo sapiens
MVKVASYTHTPMPAAWRCSARGSHSPRSGAPAHSCAKPPLGSASHQAAAPREAAAEKRSRTSDTRREAEGERRDWNGYAQHEDSQTPPYRALPRRTAGDTHTKDNVCGLSHRNTHTGPLYVTHREQPRESFTGTKWVRHHRQVPPPPARGESPVHVRHTPEEEQKGGGTTSPR

SEQ ID NO: 972662 - protein, 129 aa, Homo sapiens
GGARDSPRYEVLKGGLYETATTPGGQKIGWWKTPPAVACSVGNNSAHKKMYAPGRLSDRAGAATREGPRTAHTLCGSGGGRAQGRETTFSPHRGGRAEVFAHRPAKSPHPREEPPPLPGRTSSRPPRPL

SEQ ID NO: 972663 - protein, 224 aa, Homo sapiens
GKNVEAPPPLSCIHVRSRTTVAPGDCEGNRDSVSQGECPNTCIKALCFFPLGIVETTIGLSRARQYTVCYDSSDTGGEATSGCCGAAKERCLFPPATLSGQRRTLFVRKKEVPNGVKSVHIASLSRRETKPAAVWSPRERKLIYRMKCTFGGRNASSFCSYSRITGCSLGQGSKGLCALCALAKRNRQSLLEYRLSRGLQPGEHMDVMQNIRHIRSPAEHDKCQ

SEQ ID NO: 972664 - protein, 164 aa, Homo sapiens
MTTPRDGDQMSRRARSLPLGGDDSTPGVEREATRARAGRSARGCAVGGTQRGDHQPGVPARVGHTKWVTACAERGRVACRAARVGPRATATALLPSTRGDRTSEGSHKGRSMLTTTEILHREAGDDPHPGAHSEEDCLTAGQWLLRDSEETIKRVVRRTTYIRR

SEQ ID NO: 972665 - protein, 289 aa, Homo sapiens
QKQNRGAPSPRRGARRIVTPPLGEPGLPPRITRQGQTHRSGPTLGGVIANDKTSLYGPPALACYSTATKKVMRSDIICEQSHPNPCWPKGKFPASYGTRPPPGSYEKVTDVHTKRQPGESLRERDPHRGGHTGKTRYANDAAEETRGVKKPSCGYTKKVVILPAKSLCKAPPKAHGCGKVRATQDVAQARASVITSGEGTLKRLFYNERYLTPSNDTICYEGYRRKAEDRWKTRQVDPNITGEQKTRVGSTEGPKTQSMNKSRKPNGGRVPNGPKCERANMEISPAGMT

SEQ ID NO: 972666 - protein, 262 aa, Homo sapiens
RDKDQRPPPRVNNRAGSKQSGGERTHPAKRGVLSARTSPQRCLTAETRTTRGTPTPTADIFSIAQGQTATNVVTKRHTRPNRRIVLSWGPPTLPSLNTSADEETERGTDGLERNKKEESMQRTHNIQGASHPERPPAGTRPLRGADCVRQSTHPFERIRLDRGRAGSPMAHPQRPHYTICRHRVPTARRNKSGTGRTTRMHAEEDGDRWAARLHAEGDLTSGTPLEGPPSTGDRQYPLTLPRAPTGGEPPSSPTISVDPNIT

SEQ ID NO: 972667 - protein, 109 aa, Homo sapiens
MRGNLCVGESLKSARCRPAGLVFTMWVCRGAAPRLLVYYACVVQSNKHWGESALLCKGKVVRGATLHCFRRHHSEMKGTVCLLYPRQVVCLVYSIEGGERLHRGVTDIE

SEQ ID NO: 972668 - protein, 76 aa, Homo sapiens
YIHIRKRRGSVNTKSFLETISQMEILDSHYCILSQHESKRGSIYKYRLPDTVIQQYKHFLTCQITLFAKKVVFNKL

SEQ ID NO: 972669 - protein, 85 aa, Homo sapiens
CETAGENIILAGLNDVIFDPKIGLLSPLGNAVYYKIFPLCSDELLVPYWRVLPLSLLGDFFLCSVSHTFAFLGYYGLVIPVVCCA

SEQ ID NO: 972670 - protein, 150 aa, Homo sapiens
RLRISLPCSNAIHEAPVGYPREALDLEVDTCHMFEPKRTIITSRIMCAFPSEISLWRPEIEALDIRLCNYHGLAGKASQKGRISAYGPEEVIYALYQEIDREGSLSEINTHTLVPYGMLEFFFSMHYGRYRTKGNGVMSFRSDRGTQGPR

SEQ ID NO: 972671 - protein, 138 aa, Homo sapiens
YRVPAAGPGDAGVQVRWSRAKSRVGLTGYRFGERGAQWLDFDLAKNLCLLTSSRLFLEDKWIIPTIMGMSYMDSNSTMQPSHRSPNHFSLTLRMVEEQQHDDDAYDLLLGFTECGTTVFRLGDQYSWRNGWSFVAVFN

SEQ ID NO: 972672 - protein, 132 aa, Homo sapiens
PGHMLSVQQRHGDGAHGGNTSILSLGREDGGNKADATNTATTLGTGRDGGQPANGRTRRDRDGDRGHTERGGNGKQKRGPPRSRREVNTKNHVCRACGPVHDPGLGVGHLFDPARGTDATKPPEGPQDRSSQ

SEQ ID NO: 972673 - protein, 232 aa, Homo sapiens
YLSRFPCLSSAFWNPFSKLISAAENPIFFCGTLVVRTTSLQRRCTAPAVLQEQSACVSPGNTKWPNGAILVLPYVPSPASLVGSLLFGRTQRGPPPTGSQGPRPMRSLPLLERHKWAAMTMSTPKSSETARGAPNERTLRVRLADPRPHPPPAKSRPQWQAKECLKKINRGAWQSAQLLAHNDSLSRTSVPPDSCPLPDEANVIEREETVVTGRGKMRNEILLKIHLWGAPQ

SEQ ID NO: 972674 - protein, 187 aa, Homo sapiens
APRFSWGPWTRQGDNKKRCPCVSNWAWLLAHPVRRGVSSTLWAPQLCLAVNTGPPPVGCAVYPIFVSNPPSDHNSCPQTLANHPGAPSLWALYGCCGFSVLSPLVHRYWDRLPLFGVCDRPVAEPPSGFYANSSPRRACSLRGHASPAHEVLGEHPCLHRVTGPPQVTCGRKSSTKSLGQKKNTTIK

SEQ ID NO: 972675 - protein, 107 aa, Homo sapiens
PWRGLGSRCKKCACGCCCLNSCAWRTDRRDGGGGCCLRCEVASIVRAPRRGASRAVRGPVSPKVKLQSPGNMRLYLVIETKDFHKTPGGGLSTGLRASVNTKNRSSP

SEQ ID NO: 972676 - protein, 83 aa, Homo sapiens
RGGLARREAGLCSPRRSLLFRLGAEGGSAARGRLVLGRESDGGAFSRYRFRSSSWARGCLRGHSRWPRGRTLDEQQQVKHGQQ

SEQ ID NO: 972677 - protein, 83 aa, Homo sapiens
MGHSERTALGCERRRLAESRATLHVEAAARNGNIVADTPGEITISGPRRVRRTTQTPGPHPTRSSGVQKKGEYVFSTPNKRPR

SEQ ID NO: 972678 - protein, 166 aa, Homo sapiens
MTARRKIRLPPGEKGHIQWAGKSVQLELSSPNLCSLQNKVEPARVNSLGAGSSPCGDEIHPTRPPPGTNLRGYICDTLPLVYLGFESCATRGTSGVRRTISTKNWQSGQTGALDESEKVVQKSRGEALAGATINECFSTLQEAYPCGNTAAPDNKHQLFKRPNNEQ

SEQ ID NO: 972679 - protein, 191 aa, Homo sapiens
PRSSARALRAFSAGIIERKTPAVRPGLASLPTGQEPRRHADSLLRTVCPLRHQLVGVFVAALAPGYSCAPPMSSRIVMGARLSRQRLLQRGPRLAALQLPRVLLPLSPVGAPMVPRRESGWVREQACWHAWYTGPCCQSKLLTRDGKTPQAGHETHSQRGLELQLSGDQVTTASDEGDLQSSSQRGQTPAG

SEQ ID NO: 972680 - protein, 98 aa, Homo sapiens
GAPDVIALKLCVKGGELINFQKIPVRDSPDYHQVDRTHSEKYQGFGYHGSGNEQRIIFFFFGNGVSLCRPGWSCSSVIPVHGNLHLPWFKLFSVPQPP

SEQ ID NO: 972681 - protein, 219 aa, Homo sapiens
GSHPKYGAPFVAALFPVLAVVGWVFLAYRFCPAVITTVTVCFCSFLLLLFGGDASAQLFSLSASPLLGRLFSARSLIVMRRSLSYRVGLHHLAIGGENLLSPHKGGSIKIMEHHCFFISWSVDVVHGNTPRLCQTTQRMDVICYVVVVCVWYVLFTRTHTHIHLCIHIRASTYYKCGAPHFHRAAHYVDTRRVVLCSLDNIVYAADLPYKDRLSSTRAT

SEQ ID NO: 972682 - protein, 121 aa, Homo sapiens
YPRFPAVWLFTVAQRTRVRITPGYVSRLVVSAVVSLLPCPWHLRIVRTPVDRYSSCPAMSVLPPDGPVSRDARALRIGGAPGPQGFPCRRVVAPRVLHRGLSGIGAVIFSGPPHVIHGGAY

SEQ ID NO: 972683 - protein, 108 aa, Homo sapiens
SRVYLFSMFIIEAKTKGPKEKKGVDGVKKKDAKKKLLENSSLKIRFNQEKRQGSCWYWPSLGVQWPTIMGLQQPQTTGAQVILPPPSSKELGTIGTCHHVQLIFQFFG

SEQ ID NO: 972684 - protein, 102 aa, Homo sapiens
MSPHSLGARFPQHHRGRTWSGATCARGSSWLPDLPSCVYPSSAGPSVSPAVVRPPGSPPSRPLVLCAGPAPLALPPRARCVKTHLWRPAVSRLRVIPYIVHI

SEQ ID NO: 972685 - protein, 46 aa, Homo sapiens
MNSLGKGFQRIPTDMGLSMSKPPLAGNSRPRTKAQEQGTKPFHSLN

SEQ ID NO: 972686 - protein, 172 aa, Homo sapiens
RPLPTRRSTTRTRPHAASPPAPAAGTAAAGRCGPATSEPLAGSNVLDFEEHPRSAEGQRPPTVGPPPTPPRQQRSGEQSITTCSPTAAHRPSPPSPLLGPHTPPNSNDRFLLTYTSHRHLTPLTHISYIDTHIYIYTDTHTHNRYTDTQHMHTLWDTRSHMTAHREVAPHEI

SEQ ID NO: 972687 - protein, 237 aa, Homo sapiens
MKETVRRSGGVWAKPFPLRVIGGLVIAIAYIEQLNLVIRFDPRRSKTIHIMARPNRNPRMSVNRWYPQWSLVVSFGSVPKQPSIMPQLTYTCLSHRVLNVTWLCKGEPGQLRVSAESLFRPRTDYERSTNVPVYHDLFVARLARGLHMTARVEHWGLRPARSLNALVRPKSQLQMPETTETVLGALGSWCWAMSANHRGHRTSVIEVSGFDRTPGPGGPVKYVKGDQLSDQKRLRRD

SEQ ID NO: 972688 - protein, 283 aa, Homo sapiens
AQVPLDPVPGLCRDEFAKGQQGSLLRDPIVRGGTKRCSQSFRDEIGSAFRAQESEVSSLYPGVRRRGHFPPWWNTMGSLCSAPLNMAGNSLGLGFSSRCARVWVQYGAPVCEVTRPDFSRSWRRIISPGIFPAPAGGCSLSNPPRYAAQDFSLFIGAPIRCGPGPFLELVAPLALRPRCGPPPVGPLGACTASPAGLSYTSPGRNGETPCPQGNDTNNVIHRVRGHPPRWAPRHWRRRRGTQRRFTTGTTTGEEKKVSPRARIEVRALSSLTPEQHWQYPRPH

SEQ ID NO: 972689 - protein, 259 aa, Homo sapiens
DPRVKRTGAKSRERVRKGTRARPGRRADGLGGSAGLRVRVSPLAMGSAALEILGLVVLAVCARGGREIAGVLLPCGGDRFLDHNIVTGRPPEKGLWMSCVVQSTGHMQCKVYDSGAGSEHRGAGGRALTVSARACWSRCALRDPGGRAVHHCVDPGPARRVWPSPGGVLYPVCAGAAGARATLLGSANMSSDELKRPVCAPGRKKVPSWAQRSTSGGRPHAAENGRREPLSWEAWSDRRRLKCPENQRGGATATGDRQR

SEQ ID NO: 972690 - protein, 314 aa, Homo sapiens
LHGVCQCVPPFSGATSLGGPPAAGVVPLLSPFPQVSLSRRPPPRASQRPLSGSLRCGASLPKSARLGGVYPLGAASDVLLCLFSAVMLLVARSHPWSNSMLVRHAERPADGFPVRFPGRPQAMPLLPRRWRLPPPCLATRGGVMVPFFWSRTPWLPYMGRPGVAYNTRGLVLSPPPPPDPRGGLSPSRSILRPRTAPSALPTGGSIRNPTGSPPRHNCIPRRVCFHALMDVCRGAPGGALAYVWGRVTPHRLLMSPATISSPAQCLCGPPGLVHMGAGVRAALNKASLAYQVRFGPSPRFNKQPIQKDKNKKHK

SEQ ID NO: 972691 - protein, 82 aa, Homo sapiens
MGRKYFFGLLVANHANVPTAWLDADAVSVSRLLSAGAAVERPPRQLTLGGSSRAAHDRSMVCGARRPSPPWRVGGRSPAPHD

SEQ ID NO: 972692 - protein, 65 aa, Homo sapiens
MLTHTRAKKHGHNTSHRAHNTPTTSTNHEHTTHTHHKQQHRTHNKSTTHHCKPTNQPTTQQQTNK

SEQ ID NO: 972693 - protein, 307 aa, Homo sapiens
MRPFQSLQKHHSCPLPSVPCPMDSHCSHFFLFLFSLEAASRSVASGGSAGGMIWVHLQPVRHQCRANFGIFGKDGVPFLFFFFYGGESPPVGPPGGGGAGGSATLRGATVRNTFVPPRAIRGIYPSLHVKDPQKKEGDIKRPAGPTGGPETSNIGGAYTRGRQTAGVLHQELRCTTGGSIETRRTPKRVSPRALTAPQRGRGTTGDVDTKATGPCYLVETQFFPPGVAPGRDNQGGRTMRAGQTYRPRVRKSVRDKPSNSENEGMRHPPEEYEYTREQRARKPRGRTADQEMARRPRRGRGSARDKS

SEQ ID NO: 972694 - protein, 161 aa, Homo sapiens
MAVSPGVTAAASFDGATALQPGRQTKTLFSKKKQNDNKKQHAEHTTHRARKRPGAIVRGAASTTTGAPAEREHVHAGLCTAPLNMGRPSWVDPTAGSQNRLDKHEYTRTDYKSKIRPRRQHKRCGAAQKKHTHVGASPETRRQQVTEDWATHGGLTQKPGQ

SEQ ID NO: 972695 - protein, 200 aa, Homo sapiens
MLARRIEISSVKFNPEHLPCVLLVSSWDTSCSVFTDRVGQLHCGSRYQHDRAAVLGLRLLRCKGMPGRGGLDHQLKMHDSEHVIENHLVGTHDAPVSRCVNTWSRSECDGRLEVGIRQLNCGDAELLCKAGTFSQPDQVYTLSVSWRPAECGNEQAAECRRGNLRNMGYVQQRQGVQLKYRVGATSVQNKPVCITSIEAG

SEQ ID NO: 972696 - protein, 225 aa, Homo sapiens
LNRATLRGISVLVELTSLRKRLCSVFPTPGVFSEDFSAPCFLRLCSPTTCAIMGLPRFPLSEQRRVSRGSPPLAPALCDATLGRSFGAYGQFNSPAVVAIHDAPCVCRGNMPLASTVGLVPPPVDWRRCHAHLLLGRLSWQGSTLRFQGTLSPPCRSTPGSSPLLFCASTPRNLRAHFWAAHPGLSLPFSPGLEQRVISFSPQQEAEGHLAASDAIPLPHPSVIT

SEQ ID NO: 972697 - protein, 220 aa, Homo sapiens
NRKVENDVDVDVLRTYWPCRCAKLSKKKLGEPFVLRQYLFIFNHIHIGSEMTYMTAMLYTICGEKAGTIFLELSNRLELGLAGIAANAHSVRQSNSVVVAWPGLAWLMKTNQMELVATRDRLACSGRLSRRQSDTLEGVLGHWIAGRSYSYFVPVRDLGLACSVDFKRKGLVQPFHEEKCKGIPKFRLCDAKVYTSLAQRGRSVTLLDIALVESRPRTSW

SEQ ID NO: 972698 - protein, 190 aa, Homo sapiens
SSLFLFLASYLLFFFLLLLLSRLVFYLFLVFFSSVLLAFLVCVSVLLLVFSSCCLFSAYLLFRLCILSVHSRFLLVYCVLLSFCFLLSLCFSCSRLLTLKTTTITDMTLYHSTLSVECMRRRERRGEGGAARSAFLSPAVSLCMRLSRRVIDQHSGCLRPYCIWHCAGVCLRLLVVWWDLDLPRRLVGGS

SEQ ID NO: 972699 - protein, 282 aa, Homo sapiens
MPREEKGAPGRARDVNGSARILEEVLLQIWSEYLRMTDRDGHSLGPFFIRWLRQEKEKGQPTQGVCADSSVDGLYEHRYYAYAFRSKEKALLSQLNITLSTRDEVCNWLPHKLRSKAPPLDMLRKDGNRSKSVSSLPGVGPKISETSSVESVMGIKNFMPDSGGDPISFLYMWAKCQARECQMASISRHRPGIKFGPRQIGGFWPETIVIWHLAKMLPDFSLPVRPGVGRNTGYTRIAGKDFQNFPMSRGLELGHVESTGGLNCSPNRATGSMAQMAPGAVI

SEQ ID NO: 972700 - protein, 238 aa, Homo sapiens
TWVSSHLCDSWHIDESEGPQTFPLPLPAQTAGTAVTSCPTTFPRSNHTPRDHTPHPSCLTSLSSSHPLSTQDPRVPRVELYRKECETQWKEYGFRSQAWGEIPALTSTSPVIPATVERLRQARSLESGRWRCSELRSRHCAPAWATERDSVSKKRDWEHRPLGRQRAEGALHWTLLPHFAYGGRTRGRTRLLIPPRGICTLGGDMPEVLVDRRVLEAWRATNGVRVLTISPNTELHET

SEQ ID NO: 972701 - protein, 594 aa, Homo sapiens
WPSSFVFAASSLLSLSSFCCLPRPPPGWGWVVVVCRLPAVHRLLGLLPSRAAGGQLVLPVVCVSSLRGGAASILVVSDSAVAVFMDVLVCCWCVMLRVWFVCPGAGRSASVLAVLRVGFTNSVCIGGSATRGFCSCRFSWRAPRPPRLFVYYLAGWTVSVDLWLCVVGGPPPPPPFGSAVGGGVDMLGGVVRLLLVGVLILTTFAPLCGGWGVVQKMLLLALPPFCCESTSRLCVFAPRQVVLRFRRGWSWSFAPLVVLVLLSLGVGGVVSSFYYVVRAARAAVSSSPLLRELFPSAAPTTWVSCRGCCPPHHVLSRRCGGVFSLHARSHSLVACSSCAPLCGAPPETLGVWVVKLLAFLVCAPHSRNTYTIIMIREIGEGCAPHEGRYNMTGIMCAHESLRAHRVDTRRPHTRVHTQHVAPHLIMVDGYDVVAHGVDVYVRAFLCGVPQHAPCDRNTLTATTLCVGDAPNTVLHREEGVLSALVMGPHSREAFVCGGEDAPFFVLLVVFVRHTINSAQQSCLTPAVVVPHNHTSRYTTDDTRTRVYMHRTAPLCSVRVYVHLVCGVPRATLCEHMGIEESSWSARLRAMRARL

SEQ ID NO: 972702 - protein, 119 aa, Homo sapiens
KAVLAWFLIRLLARRQIALRARASSAGADSGSFIARVPELSLAFEFPLHRSPVVAHTMSRRQPVRQPSVRKFSQAEELNTDERTRTLVGQKAGQMDRDAPAKTGNGLHARNNWRNAAQA

SEQ ID NO: 972703 - protein, 108 aa, Homo sapiens
MAMEMRVPVQVPGVWLLALGPTCVNRECRPIHVMNTKFCDFTTPDTWDTCREIVEMIFEPMELRRRGPLYSGHNRKACTARVNSEALTSSPNRGEKIKGIPPLKKSSP

SEQ ID NO: 972704 - protein, 64 aa, Homo sapiens
VDRSGTAGVISESCLLGITSTMQGRLESILSEDISPMGTSSTVIMPFRGVGFITRVTNSYSSDE

SEQ ID NO: 972705 - protein, 172 aa, Homo sapiens
MVVMNTMGINTIDHKCNTGIHRDIAVSRRLTKCIPSAGFRSSAGSSRMRNCTRQATNRAPYMKPEQAHHIGGQRRVDSTRVYDKKTSCVSNVSWGPQSRRSWDTSMNGMHRENNVASQYYDLMVGMQKSSGEPRTMNCFSHLYKRDSTKRGYYHPEDETCREGLIAICHSAY

SEQ ID NO: 972706 - protein, 248 aa, Homo sapiens
MPNDSSGATIFMLPPGVNFVPLLGTPATFLRATFCAPTICFGNHPRCGENVFGGPSKLGEVFTWGASVWRPPPPAGELLGCSARSKIHCWATPPRGRTFVRHKTRRPYCLRGLGKVLSENYIARPAIFVRAHISGVEDVSPPVSRTHQQGAQTNVDNPPASFLVLHCSKMTLSDACVCEVCPPPELSRPPSSPRRVLITHVMCHSHSGCAKGLMSALKRTHVACCSHTVKSRNFYCRPKLLCLNTKHD

SEQ ID NO: 972707 - protein, 206 aa, Homo sapiens
LGVRDQSWDRSWLGPIAQKKKKKKKNGGEPKNVSHLPRGGIGVFTSVGTRLLLSSVPHVVVSILGAPPRASGVSTPVVTPPAGLLCTRLRVCVFFSAGGVPPPSSPPGCCSFHSPSCWPQRGVWVPPEQERERETWLGGTKPGGTQKVSLRTTPGAREEEPPEGGCGAPPPTKGWASTPAKNARPHKKWWCSRQGGGEKEYTPREY

SEQ ID NO: 972708 - protein, 70 aa, Homo sapiens
NRRAENKDTEVVVNTHTRTRGKHVIDHRNKSGRTTPLEWSPACSYERVGGKEAACVDARSTTPRRCPPAG

SEQ ID NO: 972709 - protein, 96 aa, Homo sapiens
KCHFRMIGRPCVTPAPPVPGVSHHQLFISFLLVPPRPALAAPHVVHIIFHPLRGDYKARGCFPPYYSHTAGREKSPGGNHPKSPPPFGGTTLANTS

SEQ ID NO: 972710 - protein, 314 aa, Homo sapiens
CCSRVLLGSSSRTPFGLDTDGVSDYQKMVATVVFSTRTCSQQNSMVYMEHVVAGHELQSVFLGVITRWNTRVVVHPSYVGWGRGSSPTAGLVVEMFPPGGELLPTVPLGGQPRVLEPPISGGVRGHPSCRVAARASIAVAVGVCSLGSVSFLCGLGPLFSSLSKKELHSKDGALLATVKALLGTSICEHRRDGGRLAVDLVRNPLAGVPSPTKVVPAAVRSVVSTVVPPRRRRSLLTRCRVNGPPRDVSLCVPPPKVARRGIIVFSRRRSPRTFSRSGLRATVSVLSFRCPHGVSFVILGSLTLVRKRGALKHH

SEQ ID NO: 972711 - protein, 154 aa, Homo sapiens
TASLDRRERDVACSATIGGTVALQCPRPEVCLAAMVQTRQRDCARPREKAIDPRKYLDRGCITLEREIRRGPPPLKSLAAEPKKWVPRRQNPTRAPETRWFRRNTRPRSWRGTTTSGPPERGLSVRPSPPPRVVDSPANGAPGVGDPQPARKCS

SEQ ID NO: 972712 - protein, 289 aa, Homo sapiens
PEIMCLRRLWYFSGPMRYNPELLVGDFLPRHWEAECAPGAPCRPPRCILSPPALCPRVPPLYGAPTGSRKQKMPVRLNTMDSSPLLRPTKLGEGPPPMCGEFWESNPHWVNASLSAEQPKACWRAFSGQQPNQGRGPAQVLAREEGPHANSAGGTKTTPAGAQRTVSDESAHKEPNRVVPQIRIKRRLLQADMISPRGIRRARPPLCKRQGRRGEDVVHEARLWEYKQAALKCSNVGYKSGALYVRNTPRASGLLRLTHREQWRKSCIFGGDTPRGCSLCAGECRILES

SEQ ID NO: 972713 - protein, 109 aa, Homo sapiens
VPLWDCPRTRVWLPYAISAAFVAGFCRCRLRFSGCGTIPLGRRPPAVPALSVSPVAHVWHRDARAIAFWGGPPGAHHFWGAFLPSLHRCQPLPPGVRLKGKPKVPAGFH

SEQ ID NO: 972714 - protein, 319 aa, Homo sapiens
MGIYRWALDQDIGEDTVVVKKSAVTRMPRGSARAPSHGGYTSPRPNSGPALGPPGEQLQQHPKGSPNATIVRLAPSKGKPQISPAQARPTHRAPRYLAKSGCETPQQCAATKGLKPPGFEKNGSNDKKAGRNNQRPPKELAGATTKGGGGAHPQAHRIFKRRLHQTNSWRRTKLRISEGCKQSPGGSSLMGPAPLGVKPPGNSPDNTMGIAEDGGVPTVIRRTGQATPPGTKRGATPPPALLNKPTKLNPAGQFGGRPADTAHSQYLLETADEPPDEIRAVKHPREAGRAPDHTAAREMTPAPGHTHTARGAREHPFPK

SEQ ID NO: 972715 - protein, 132 aa, Homo sapiens
MGRPVGRPENCAPQRTSEKWGARPEDTQIGGRIHPPRVGSHIVTNRECMFFKQRPKKLNYGRSPRRSDNRVLVGATRDDNVEKFAVGPFAEKKINGTESLKTVVEWTAIVDLLVYQTLVVAPEGALRVQIVG

SEQ ID NO: 972716 - protein, 335 aa, Homo sapiens
LVVVSSKRGFCVPLISRPRLCLCKSQDVVFVLSGCADPGELCPQFGRVLNNAQWWERCFCTAAPRPLWCLVGIPPVWAMYSGIERSEWGSQGSKRVLGDSMGPVLRAPFDGVSIPPGVGSILSSSIVWLVLLRYPPPIRGASLGYQEILVIGMPPLSFEGLNIANGWLHHWHSPPPSPPHCLPLKVGGASPPDARSLRPSAFAAGYADEYMRNAACFSARPPRANPILKWTSVRLTPASCPSTTPRCEADAQQGNHCPPANGCPLSGRLYAGRQTHARRATISATAKKTCVGDHTLGGARKREEEEGEGEGVTKTGAPGPLLGLKKNRSLLAPKK

SEQ ID NO: 972717 - protein, 74 aa, Homo sapiens
AEKEVSGGRGVTHDATQKLTRTAYACVRPSMLHTRQNSFPSIHPVVNKQRPVVLDKHHREGYTRIGHMRDEPKY

SEQ ID NO: 972718 - protein, 133 aa, Homo sapiens
MGRPRALTFNWVAHLFSTLPAPPGQKSDSRAKWGEGVPQFATPIRRGPINIGDHRYTVGAVSQHRRTVGPNHPPPVGNKTPTEMTGPPQRRGEGPLTPPAPIRRAQQNLRRRNKRTRTEKGRVRGSASPHTGR

SEQ ID NO: 972719 - protein, 148 aa, Homo sapiens
MVLRPMLNPSKFLETSSKHSVPDLYPSSLSERLLKRLVSCSPAKDKAALARTISTHNPLFYTLARWLPPPPSFGLPLGDPSSGKKPACVPGVKRHRVRAYGRPTKNGARPKIRGAKKCPPTTRFGAPPPPGRRRHTMTPAFSTRGNQP

SEQ ID NO: 972720 - protein, 221 aa, Homo sapiens
NDLALSQAVLGPLVDALSFKHLTCWPAGSIVSPGVFQCDSLSTNIITLGAVNNQAHEVCRTPTPVQWDDPFCECTLSLPRRPVTRQSTMSTQTRTQATSSTGQAAVAPKESGSTQPGTTERTCPVNATLDCVLTMGEDEELCCSLRLEHSTLNGQGRLRGTDSHARPRPASVDAPIEAPVPHMNMKEPEQTFLTGELFTLPEDISPATLSGARSTCLSIFV

SEQ ID NO: 972721 - protein, 155 aa, Homo sapiens
ENKGGDKQLGTPNQWPPPPKWGPCPENPKHWHETVVHTEKPHRQERHKKKRQQQETRESPPYLSRAIIAPFCSSTSKAAYEDPTTRRYLGSGKTDDYRPVPPEWGAKGPDEVTGLRVKRSRGRKNKRCCPRTSPKIGGRSGMAPRTAARKTVIGA

SEQ ID NO: 972722 - protein, 299 aa, Homo sapiens
IAHSCWIRFYRVLRPFEGTFGAFWGYPVRHTIGVIRVGGGHLMSAVRLRALTTIGTFGNYNKVKTQHGDEVTTQLYRVCTLGYRQRAWPPLSLAHLSRPPIGQSRAGEIARTWGNTLVNGKEVLQEGAGRDDGEPTSGQPAFWRPLFHRLCLPSIRPNILGSLNCRRVPIIRGQTHMGGAPRYSPLAEEPLLERESSSPRARTSLLTYVSQMILMTVIHGLRLNTANIMVLRHNSLGPTLRRTGPALGPPKRANTLVEHIIEKDWQHRVCYLNCNKALQKSGTFRLAVSPLAATLLRTS

SEQ ID NO: 972723 - protein, 68 aa, Homo sapiens
HVIHKLLRPALIQVSPPPWTRKSFGGGEKELPHCNSAHRMLQDRSSLHKSKNASSPLYWLQILPHARA

SEQ ID NO: 972724 - protein, 111 aa, Homo sapiens
HTETEEVGDGSLAQPSRVLQLSSVIFWFRCVLSEVFLSALNLPPPACVLSAFKEESAPLPHNWRVLAFSKEETSLPFETKDPLVSESHRLGQSKRNSAGNTPVFRAFPSTC

SEQ ID NO: 972725 - protein, 101 aa, Homo sapiens
TRKSKKRHRSRKPTTQVAIWFISPYFSFTLSAFPAEIVKKLHPEESSLFGQWVLKFLPVLCPNFAGNIQERAHFVKKLVPLSVPVFPHGELGPACHTSPRV

SEQ ID NO: 972726 - protein, 239 aa, Homo sapiens
LLGGVPCQLCVFVVSICFGRHLFMGGAPVVPSLCVSRPVSLWVFSAREGFRGIPAPYRLWVTRPHFRMVYPRCPYTWALPRALMLVMFPHATCGNPHAFGPPLNQGAPNVRSSYKNECPPTLLVRGRFTTEYGKFTVGPLKNVVMGGGMDPAPPVDNSGVMVLRTRPVLQRSHLSFAPSTHAGAPPFLPSGKGAMLPRECCTTASGAPFARAPTLCEPLDTPSEVLSHAGHYGLAAAVL

SEQ ID NO: 972727 - protein, 301 aa, Homo sapiens
RVGSPHLFSLSPTTGTPVGPGSLSLCSERYPFSGVPPSYVRFPPPTWNCGRFRTRVGLCSLDWGKTSVAKEGQPLMLCVPPYRGSSSPHACEAVTTPLPFGWLPEVSPPPFWSRESSRGVSPPRPPVVFLCGILGFSFPGRSLDLGLVCPPVGTQAGWWVKAPPTPTRGLPSAAVSPDLALGRMYPASCFVAIIKETRATRWPVGSFLVSRTPLWLPQRRRHLIHVPRYAPTLSGSTRRRNPLASSYLRIFVHCSAPGRWQRAASFAAASGTAEPWNPSTPWEPGVILCHGQAPTTDPGQR

SEQ ID NO: 972728 - protein, 83 aa, Homo sapiens
PLERERASDVTGEGEPTCCTFTIFPRWFPRNHSLNTLSANFWCLKPFVLKGFSKISRCLRSWRNYTWLLKLNPPWGITYAHCE

SEQ ID NO: 972729 - protein, 165 aa, Homo sapiens
RWVGGGGRRDEKEQRQEGQKGGGVGRCGKRGKPGKGHSPQSDLRARVSPPRDGPYIGGNVSHHSTGTWSKRRFALAPRATKEPWGHRREPRGQRLLRPGPPKSGVTLCVPPHPDKVGFPIKYKWGIPPFISDLELLALRCPPPLPVSPQKLDYSGVYSTRTPARL

SEQ ID NO: 972730 - protein, 66 aa, Homo sapiens
ERHPCLVQDDMMSCDSHLRLPRPARVSPLLAAPTYGNAPTEKRCSKCGRYSFGGEVPDERVGFIRL

SEQ ID NO: 972731 - protein, 118 aa, Homo sapiens
MALCPMGARWSRYSGWCPSADTEAEDLSQRPSVHTPQGGASVYSERWAPVLLGTGCHILLTLRAHAAQLQLGTPAATRLLTSHLHRRPSHGSPGGSHPSRGRRPPPKFPPKKQQPQTK

SEQ ID NO: 972732 - protein, 146 aa, Homo sapiens
MFRNIGGFHTGIWSRPLAPKIWLRARGPPSCKTRSPPGKIKMDVLTKHTDFLFHCAWHTPFIHANTNRRFPLCSGTFRAHNPLVAPCHKELTRVVLTPPQKGSNYFFAKPKNTRASTLLCGRPTKKMFTLVQLPASDISVPARRCQ

SEQ ID NO: 972733 - protein, 323 aa, Homo sapiens
CLWLTVLVRGFGRILFVAHMVPLRHVWVFHCGGNAFFPPSVFANTLAFPHLRWAPRPSGAPLRTHRGPLARFSAAWGPRSPRSLVMGAFYHAPCLAFTFGAIMLCSEGPCHSFSRILAPGQHSWVTGGSFCDAKHARPAPPCFFSACLENPPSAHRGGGLAPPSRQECLLALVDNTVIAASFVGMSQTPEEYGLTRTGARPRFWVTRAGIHPLPLQGGDGMINNRNVGSPRQNSPTKVGWSPRGRSLARIIYFARESSLSAELRLREPLSCRDEEILKGRLPTRIVNRGPSCDHRIPLSLTNPNERGSVFTLATTPGPQTNKT

SEQ ID NO: 972734 - protein, 128 aa, Homo sapiens
YRGTKKVDSRFDITCIIAHTDWVSPTSALTILGFRFSRYLALTRLLPLYSDTPATLLYIVRPYLPLSGELKHGFVDHVNFSLVPNPVSACDERLNDDPLFHIGNEPNLLLPLNTETPFFYNTHAPLLV

SEQ ID NO: 972735 - protein, 225 aa, Homo sapiens
EVYVPLRLWLMIAVTVGGFFRMVTGICHVTVPWWPRCIIHGLLPELSVLFLGGTRNFCCSLKVSESGPPTCRLFPSPAVWSSRPPCAIALVVCTGCQGRQFHRRGHAESVIGAATRPRAFLPVGVPHKPRRLFCATPPSGALKRSPATLLVHGNSNTQVMFPQGFLPAVSAHSLFQATYALLHMCQPGRWPLDNSAVSLLGRMAPLQRPWVPGGFPAYARCPTTG

SEQ ID NO: 972736 - protein, 117 aa, Homo sapiens
MRSEWTPLDEKLKLLKWQTVNTHHVIAHISIRQNYRHYVEVNTTFSKNQKTILTPQIRNPKGDSPSMATHKIKGPNAPTLRANLGRYEPKLSKINNVFPQFPKRKTQLNQFWDKQQK

SEQ ID NO: 972737 - protein, 261 aa, Homo sapiens
MSPPPPLSFGVVVSSCPASTTHFLVGLRCVLPPPGDTQTLVGGLCIYVSMLSAPREAWWLSTKRRSPFVSIDVRQVVGSQLRFFSSACGLCSAVRLVTGVKNRLAVLLGLLLCPRKRCSCLTSRWVGPAPLFSQHAWSLVVFAAIEDEHVPSSRVCVVFAMVHVVLPRKYVQPPRAGSVSCRQDAENFVCVPPRSDMVSPALAFTLSGGYLISEIKLRPPPPIVGASHALEYKENTRRSSRVLCVEAHDDYGLRPCDVKCV

SEQ ID NO: 972738 - protein, 191 aa, Homo sapiens
VINEISRTKKQELGESAHPPGVVLVTPLLGVSYFGVYSIRRHLFRGHLQVLTPNAVVGSVTRTCVPAARRFLAVSLKNVVYMEPNPVLKVARGTTGWYRHSQCATLLQAISLGPGPKLWANREAPTKSVGPPGPCDIGIFVSYAEGYLLPQEQGDFSCRESSSFVGRAHGGAATHLLIMRHAVNKTPPPTG

SEQ ID NO: 972739 - protein, 243 aa, Homo sapiens
RVNGAVLLFVPGVVLALSCAVACSSLDGPGPRLCTQGLPAERRFWRTRICGTLFRWRRPEIGRVSLSARDLQIGCHISLWPGPVADGLRLPARVAPGWDPHVQGTAVRAVCPGCVSTVCPQGLRARCGTHCLATHPAGQNFVPGPHLGNAGLPSPPLCDALGQDFAYHDRWRVSVFDTPRGALRTLLFRVGQRSHKHGGLSGSLRGTHRGVCNGRGISGVSSRLRSRLILGHLLGTWEAWGVS

SEQ ID NO: 972740 - protein, 126 aa, Homo sapiens
MGVFFLERVRFWSPTSAGSCTQNSADRGLTPPPMALLGWFVDYRPACPSLNNIISPPFLDPVPPPLVSFFHRVGYPPSFLMTESTLDQRPRNQSFLTGSPGVYFSFCVYLFQWTPQKFSSFLYVYQ

SEQ ID NO: 972741 - protein, 72 aa, Homo sapiens
MSNRDARLPPPHKPQKVLIAFEDPAQTDDGQPASATYTSSTSFSLGAHVYPGYLLSPPLVCRTKNSNDLFTP

SEQ ID NO: 972742 - protein, 157 aa, Homo sapiens
MFPPPPLLGPWVGRPPGQVPTPCRLLRDDPPSLPGRKPALLSSAAHNSVGTPILWSSALPHSPVKAATPWVFKAHYPELFPKGHQGEQGLRKNPRKGPWAHYFLSRGVDLLPRDRRLRFLAWDLRSSVEILSVGGGAVTRKSFGSRPVYAPPRVGTA

SEQ ID NO: 972743 - protein, 280 aa, Homo sapiens
CRPCPVIFRRKKNEIKKRTKEGTSMGRFFVRCYIWQILQVCVVRNTRPWLKIVSSAAFGARVLFYVLVAPFLPYVFVLGSPQFGVVFPPPAGPGGEPVGSGVVVEVSLVAASCQTSLAPMCFGLRLYWSLNVCSWRSGRSTRSSSGAWYRDLHNAGSTDFLNILGPLAVFGLTTKISNFPRSQFSCLSHKRCLLGIHSVRPTSGSFWRRVFKTPLSLPGNFFEERRSPHHSNIKKGLFLFWVCQRRPLIYGSIDEGHLALAIVGDDDFLSKKILFRAPQW

SEQ ID NO: 972744 - protein, 378 aa, Homo sapiens
FALACCVFACMCSVSALVLREVKQTKRDALNKKKRESKRELNCMLSVVMILFVALIFPVALALVFAPHKRVFPVKVSCPSTPPSRCPVLRVMTVTTPLLGGGDPHTCGVAPAGLPHLEGVCAPTRGVPANVCMVFAVVPAREWGKTLGEHHKTGGSQRVSHPMEYVVILNVEASNCRRSTLNEVILRRKSSLFQDVGLYNQGSFHKPAIIDDSHRLCQVVVAPFNIKDLRALVATDFESENICGHMESSVALVGMPPLFGPRTTHLLCWVRRVRFAGMSSNEYYGCVLSFGPSPHGSRHTCILISPTPRYSLPHHHLSCEQRCLATQGRNPGRAIGGDVGGSPRRPKEFPPHYYSSLYEWGPKSSEVTPLSQQIVRKH

SEQ ID NO: 972745 - protein, 280 aa, Homo sapiens
RRRATRALDDIPGGVVGVMLQSLRGPPSRPGPTGSLGHVLAWTIRSAGGFPHPRCSLCDPVALCPLSILALIYRSTKLRVTFRYSILALVTWVVNCLSLRGPSGSPLCLWTPPRSQGGPGQPFRPLWSGRYGRCSPGTSKALVRAHSPSLLPCTLGIIFGTPLCGRPTLWTGPYGFHTGASRSTPTRLLELDPPQVLAPASRTVVVVTPRKVIAPLCVPSCVPSRQARHGTYMVVLGGKAPRMLGSTPTSRPTLGSGALAGATTQPQGDYHISQQELIGS

SEQ ID NO: 972746 - protein, 74 aa, Homo sapiens
FLTTESVPCLEPELSFYPLLKGGGYTPSGKGVETRDNKRSGGRHRAAKTPLCSRGDNRRVSRPRMAAPPLGDYW

SEQ ID NO: 972747 - protein, 180 aa, Homo sapiens
MTFLRRGLPPHSHRRAFLFPIWRGLFRLLRTEGSFWPLEPRGSVLPGNTCQITCRRHPRSYTGTIISPGCETSKPFTGPLMCSKSAAEEFPEHPRGSLPLLNKETRHGVARVHPRATRRLFVPPWRMKPPGVHPTNSGALVHAQMILQARFGSCKGVRGFTLDFRTFDDHALWCTEARLA

SEQ ID NO: 972748 - protein, 169 aa, Homo sapiens
TLSLPRGRTTREYEEGGRGRGEEKRRRQAVSADGVSRLVVSAPSDVIDLPRRVKNTPRLHVYRCVSQHFGLGVFFGHSGSDRKLCSSLLFVEVAKVVFSCPGALCCFFPLCAVRAETGCAPRVPVCFCPGGAPCPGGSSLLCGPPRRAPSVRVSRGAVLLVAFVRPPGG

SEQ ID NO: 972749 - protein, 164 aa, Homo sapiens
LYSIIYKYKYSLYLTSKTSTIRTPPVLTFQNYSARKMFSWVSAHVYWSPPPYASPVSPLLVLPLCPLNFFAQPTNQFAVSTTTFTALHALSKTSITCLPFCSASRGFFSPREFPAVVHLRAVALSPPIMGGSGPLNASSRVISPVCSPRRGYNTRVLSGAQGFF

SEQ ID NO: 972750 - protein, 190 aa, Homo sapiens
VGAVVYCDTRPRVGRKGGSAESERTAREERSLVVCFWYDFSLAVACVQSRQCLFVSLLCRQGCLLVRCVHAIISPAVVCVCTNCSRAARSRFLWVVSPLREVCVGSQGLVVSGRVFSPPRCFLAGPFLPGVAGRILSAPRGRALESTLVGGVFVPGKGRRCVLFSRLDALSFSWGPPAVVPIKAPAVLTT

SEQ ID NO: 972751 - protein, 217 aa, Homo sapiens
TSRKYLINHKTDAPVSLNKLSRALFSGLQTWLNKSPLPPLKPLSSSLPCKFPSFSTTRLLFHLPPASQVLFQVAANLFVDVPHPASSFLRTTNIRGVITQTESHVIGPPTVHKWIDKFLPLTTTRGTPHAYLLRPLLNHPEASKPKIHKGHPTLGRSRMNQLTPPSVPFDKSHPMTPLIPEDNPICPYSGRINAPTSSSQSSAIRNFTSGTSAYYTP

SEQ ID NO: 972752 - protein, 76 aa, Homo sapiens
RRVYVKAAVVLWSSAGFPSLWEVLWRGGVLVFAGGLFQGGALPCLAPSASLTVVREWGLSPPRPRYWLPAFWFFRV

SEQ ID NO: 972753 - protein, 187 aa, Homo sapiens
QERELEWFGDTVLPRAHGWLHIRVGGHLSSGLLVRLFARVPRSTDLCFFLAAPQSPQNVGAADSALLEGVSPPSPGWYFPQKRNAARPRNVVLSRPPNMADGDLHRGRCLTRANTFWVFMPSVSKTGPGLVVQSNQAAAPCWIWGREGPKRAVSESTTIGVGGGKRVAPETVFLFPHNSPTPNIGGY

SEQ ID NO: 972754 - protein, 66 aa, Homo sapiens
VDRVFCDFYCVERYRSARVAAELYGLEERVQFALGRSTTYRIRTLDKRVLTPGCDSGVVRLWAMVS

SEQ ID NO: 972755 - protein, 294 aa, Homo sapiens
WRGAGKEGERTEEDISSCLHCIIAGENGTGLENPLMCGQNLFPQEGVLQVVDPIRHTWVPGAQGYAPLPFRDCDRKLVCDRPLGETCHLTRSRAFFKEENGRHVSLVKECRKTRPPPPFFDEPSTQKLNFGFIPPKDPGFNPDVISPPPDQMSWGQSPFLIKRLSEILPRTKQYLLRPSMSMIGSNVSPSGEISGPPKERPSAKVKDARHYILATIIQYSVPEAPKCEVNMFLNPGFMPEPKLVSLATLQHKENLIKVTGELIKIRAPTSTRHLGDTLERYKRKKYNQVPRSVK

SEQ ID NO: 972756 - protein, 287 aa, Homo sapiens
ISFPSSRGGSLVPFLVGATPFPLRSRGGGGSSPDRRASAQLFSARSSCALLCQRFCSGPTLHIALRFAYPTTDFLVVLHCRLVPLSPAPVRELSSLGQRGSPGGDRSSLFAEPVIVLLGPVAPFCFLFAQLLSSTLSSFPISGWPTCCLFLAALTLHPRALLGHVSIQVVSPPAPRRDLLARVRGPSARARRVCARMYVDSRPARALLPIALCEQCGPPTPAVAPLASHEAHTWLRAAESRVLRGAQSGHDKETLPPLQEERPREPTEARKSNQDDPSGHNRITNTT

SEQ ID NO: 972757 - protein, 104 aa, Homo sapiens
MLLSAFLFPGPLLAEWAPPGRAPGSPHQVSRSLASHRGSSPEELFKAEDWPPPCPRVPRSPLSTAAALSTLVYHRGHTPFHDSSHLSFFYPPLYHPSLIASVSW

SEQ ID NO: 972758 - protein, 179 aa, Homo sapiens
MAVLACRRFYCAAAGFPAGVRAYGALPFGGPRPWAPLPAPRLHVPDFPGGAPSPCAIVSRAPQTNLFLASFSPPQFAVGSGNTFFPDHGLRYMACGFLPPPRISLPLWLGPAPFFSAPPTPLIQWRSPPRAIYPPRVPGEEWLTPRPCASDHSRSGFVPRARPLFVGSPGKLPLCIKAG

SEQ ID NO: 972759 - protein, 205 aa, Homo sapiens
AALQLGNTRRGLLNLSGAETPLLMWQAGGYLCPFAALDQFGCHKPATFCRDPTYWRVLRQKTYLTCTSARPPVFSKRSSTLLHSWESSHYHHDCLYSYPASSFSAAHNHRTTVAASLWTHHANGVNSQNSGTRRETFFPSTQQYCFCYPNHNNLLPAVCVTSHTQRCATSVSFSSLRLFNFVSLLRNTTIFFGANKNPPGFAQHN

SEQ ID NO: 972760 - protein, 107 aa, Homo sapiens
MKKTKSEDETKKKKTAARTVHVPYDVACVSATVVTMRLWISSRSVCRTMVLGTSSPMGGRARTCWWGIDNNWSPESRLLIDEHFWPTECVFPPGTRSGGGAAPFLLR

SEQ ID NO: 972761 - protein, 217 aa, Homo sapiens
TGPRPVGAPPANKVRADTLEGSPDPKHRCATARISTRIHGCVERQQQAPPPPSSPPPPRRAPPENWSPPPPGPQHPFAQTSPARVPSTPPLFPAEVADTVFGRKRKLSEERDSHFAPRCMGKTRAKNSLRVLCLKAELTDYGENQPFHELTQEHDFTHLLLRAHTRLLRNIRGASAERDIFICPPQAMGFQRCAPHETDSLEQHTLHHGQARHTDGL

SEQ ID NO: 972762 - protein, 415 aa, Homo sapiens
RVAGVVRALRGCVPSCSRVVARSFVRLVCLSLCGAPRWCSVFSCRFSAIDCAIRCCCCAVSSGGVVPLVRVLASRVCGSVSGRPRRDVPPASVTAGGESRRASSVLACAGLLVWLAGAWLLACDVLLVMQRSEQDGEGGHDVVIIETRGQKYTCRVAVFAVVSCCGDCVSKRSGLWLTALRWCPDYGLRRAVEAEPFTAGGGVCKTITTGGVAATQYCAPSFGAPPDGPARAWVYGCCVVHLGAEVTHSVLFFSPGDRGVVRSGCHAPPVVTRLCLFIVGRLAPFPGRGLLFICGAGSVSYPAVPVWWGTKRVLYACWQYVVGADRGKGVIFHEGELSLNGVSYVVFRGPIHRVRGGGISHKQLVSSNKEQLLVCARDKIRGPPRCEISSYTRITQLITRAWLLREEQRLRRKQI

SEQ ID NO: 972763 - protein, 148 aa, Homo sapiens
MASLLTPRWGERQRNNLVRTALRRRVTPSGVFPPAVFPPGRVCRSRSPVGRLLFPTGVMPLNVWSGDALGYTAPRAFMPRGRSVLRTVEERLCLREGHSSLCALVPAQPFGVSPRAPHLAGLWVTPRLCSCWQEATLPRSHLGHDTRV

SEQ ID NO: 972764 - protein, 167 aa, Homo sapiens
CFVVLFFCFLWFVVGEGKGGKKRRCRRTEKTTPPGGGVFCAYAISVSRSLCWVFLLSQCVSFVLRWGRELPRWITLSVHMGAHLPDNKGVKREVFLWATTFDSPGFVPPIYGPPYLLCLTLGPPCGGNQHWPKKLLGAPYAPTKSQSPPVAIPGTHLWRFWGGEHNK

SEQ ID NO: 972765 - protein, 164 aa, Homo sapiens
VALIIVASSVLLVPVSCPRPRFFSSAPPPVGGCTPPIYISSRHTRGGRLFGASFGPPVGDTPLVLCGPVGVSLPPLVSAPPLGGPPNRSGGSHQSALPPWGAHSPLMRGFVYLSARVHHPHKCVSLVPGIFPAALYSFLSDMSRLVVIPRAVVDTHAPPLFLWG

SEQ ID NO: 972766 - protein, 228 aa, Homo sapiens
FRRGGQLFATGSPSLYRALAVRLCTPCLRAAVARRVLVVLWCRPECPMWVRPALFFARCSPGVFSPPGMLGVVCRDRQRWHPGGVLFVACLFRCPLFGGKLRSHDLGGPTEWAPTMGEARCRGHSILSREVLHSPHLVRELSGYSSACGLTGPKPTVLPPLLDLGLFFRPLMPAPPPLRCSGWQSLVFNLPGGLRFARTLRFQEVVYAPPIPPGGTKTTQPCLRLAHK

SEQ ID NO: 972767 - protein, 131 aa, Homo sapiens
MDFARRTPMVETKGGGSRKKKALSKNVCAPAPRRHLKDTSARFYVCHAEAAQKIEGQRHMLARTEAARPTPRVSLVSLNNKGKSTGVHNCGELSLHPVPKPTPQWMCASRFENTAAAPIRERDPVGTEQKM

SEQ ID NO: 972768 - protein, 284 aa, Homo sapiens
VSFLWDVCVVVWFACRSRVWGSAVPLSRVYPPRVSFVSQPTYWPVISAPLVGPVAPPKFFFVRRTPRRQTSGLRHPVFREVRSWRASPGQNIAPRFSAPLQPPGILFWERRPGRIISRPPKKAGPLAPHSREDLRRVNAPPTLLLEVFHRIGRIPPHRAGPPAASSPLRVTILRRRNAHPVGRRSAPTPGISSSLTKRGTQPGRLSRPPPVAPEHVGETNRGQSNNPGETPSDRRLGQRKIIPPDEPALRQLSQPRAPHNRPPHKRREIPARRGGNAGNPPKDV

SEQ ID NO: 972769 - protein, 186 aa, Homo sapiens
QARGMATCQIRLVDSDLSWTLLRFYPLNSGRQSRVHVCLGCTSGGLIHHRWVPPCCQAWHDSSPSLIHAACQIMVVFGTYGQRRQFAFMGFLRAGFQRVFIPLESSKLIRARTVTPEPSGAAQLPPLKTFPSSGSGSPLILGITRAELPVPRRVVAAVTIRNYSCSFPHVLQLPAGLILEYPLPPS

SEQ ID NO: 972770 - protein, 213 aa, Homo sapiens
MIRSKPGAPHRKRKTSHGGPAQGNAFSTQPGDIKGFVGRHTTPKGQIRQERESAATPGAGHNTSGRVPQRKSCRRAPRQQRPPPTGGRTILLHTRPSCKRASSKVQFAHDVFVRNSRPFTREEPTPPGRGDKKNRDSTTTSRGNKNKGAPPRGGTIPQKVGQPPTKEVRPGSTLRNKRQQQEQLQPEATGGENRTLALPTPEQHPPCNSQNID

SEQ ID NO: 972771 - protein, 112 aa, Homo sapiens
SELCLLCTRTWRSLLQCVEFLDAVNSVRHIAHMGLGSYRCAPTKVWRAPEPFLRGANSLNSARAVPKHKGVGTSPPPGWEPPALPPWWKPADQRFRRKPRGFSCALFWCCQN

SEQ ID NO: 972772 - protein, 288 aa, Homo sapiens
MRGLLALSVPGHFPSKGPAGHRAPTRWVVFRGIFCSDVFRALFHLGCRHHVRWAKNSYHHRDFGIIILRRPAATRSLSELPGGVKDSSGDAPEGLVATNSCYDFVTSDGTPFSPPVVQQTNLGPTESYSTRVPSCAVFISEDAILRRLLQHTDKCNTCLRFLGGSVKSAAPSSAATIGAEKRSPQGTNTNHTGGQALLGPPNRCFHNIYQDGGSPMRGCKRPWRHHPPILPQISRILCPTYAEYGAIQTRKESPSEAFVVSGAKVRPHTILWEKLSGTLSPKKILLQT

SEQ ID NO: 972773 - protein, 123 aa, Homo sapiens
WFARVRSIETDKKKTDDKAKKDVKLVSRCNAAYRRLVNASPVTTMVLREHTTVVGANSALALFSLLGFHKGHKGSYKGLTIVTLVNPQIASVVIILAHWQETFCLLNSGKICFPLDSEVPSSF

SEQ ID NO: 972774 - protein, 32 aa, Homo sapiens
MLVARTICDHQYLHYSTSGRYAAVKSVTTKQQ

SEQ ID NO: 972775 - protein, 193 aa, Homo sapiens
TYSGVFLRRFPQGSCKYSYPCGYFSGENFPPPRGVNDTKLRSLHTGVPPVCTPTNFIDVDHSLSSTINVGSQSFHSSTPHAWYNKMCAYKGVKPCHQPLVAYLPLESPPGLSGITKAFREPVVLEGAPHHWGSTLFLEGTTTIDGVETIHPSTRVFREPSLESQQVDSLPWRLCVPSPQEYLRDLATRIDRKS

SEQ ID NO: 972776 - protein, 260 aa, Homo sapiens
MDVALVQLALCTRLSVSYPGSFSQGTVFRWYTTAGVPLRRVVPARLDFGTPARLQARKSADRSVHSATPPIFCYTPLISLYCPMDLRNKLLSIKSLLLPPSHRTHLNIYSLNSIIMSPPVPSFVFIYITRLPLWPDNPRPPCRYPRSEMLLYPATRWHTPKWCANKASGHKFNKTRPSVLTVLLGHNPLQVQLHSYLPHPLFSFRSNNWHRTTPLLRFLHVNPPAMLDSSSKIYKDQYSMWNPRRPARGRNQGKNRICAN

SEQ ID NO: 972777 - protein, 243 aa, Homo sapiens
FFVRYYNSRSVFGGSLPPSAGPSTCVPQLVLETIFPGDTWRRWVSPVRAALCKFSPPPGVFHPPAPGSRTLMPPGLIGIVGPHRPANSEAWPDESPSRSQYCRRLQPKSGASADKMHVQPWADQPPTLWGNQSASRSESSYEPHTIHGDKGSIVPSPTSLSIPGSLVAAPNPRRQQIVPRVFKNQEEGRYYHPGSRKRVRYVQTPRSTTGRTEDHPPTPRTTGPREITKGCHSPRAPRPPWSL

SEQ ID NO: 972778 - protein, 112 aa, Homo sapiens
MVDPPPKDSKRGCPQGTPNQGEESLLVTNATPQGPHHGERKKGPHDSPRSVTSAMPVRPRPPTKIFEPRGGLIKTTRPKVAHCNSSRNTGSWDSPPPASEQVFIVSRAVIRQ

SEQ ID NO: 972779 - protein, 219 aa, Homo sapiens
LCHRVFWCDQPGAPPVVLLFAAGCSPCVAHKARPFLTHRGPGKMAANAGWRRVAHSLAAPTLVGCLGTPYIGSPAGPLLCDRPARDGLLPTHRVVPTNSAARCADQSVGWGHRKRRGLDTFRRRGGYPPRRVLRCSTLRARLSHKASLSSLAVVWETRVFHTHQGSIAAEPSRLERPHCSALFWRTAVFRHCARTIVLHQQWLSRPPHMLSPPCITVAA

SEQ ID NO: 972780 - protein, 190 aa, Homo sapiens
MGFHHANRPLGTGCPPKGTTNSYGASPDLPRPESTGDLQEMLRKPALRENNRGGAIGFDPRSNIPRGCTPGAGFYPTQLGATETVVDDRMLEDPPRHKATDPNAVGLPGELAVLHTPDAASKSWIISSGLLGYTRQRDDSDIGTGALELGSHYSQRIRLGFHQVNRVFTGVLPPREGAKAEKQAVVNNQT

SEQ ID NO: 972781 - protein, 228 aa, Homo sapiens
YEKIHQSCCVSSETRRSPPVCPLGPPFSQGELLLRPYTSGRPFLPPPVYCVTLPLPGFWARIQPLSGNIVPRFQPPIVTRLISLSGHGTARVLKGNPGALVVCPHTTTVGTIAPFSCGNSPRPFLSPPPPPCKTSQPSSPRACFGRARLTPLIKFGARATPQCSSHFWGTASQTTWGDFRPRITEVRPSPPLREITLNSIADNHHWALVHTPPLKEPGENVNMLLSPR

SEQ ID NO: 972782 - protein, 84 aa, Homo sapiens
RGGLLSMAFSVDPRRLVVVDFQSACAHTYDGCSSLPPPVWGVHHGPPRGISSQQRASLRHHPQLGGLAVLRTKFNPRVAPITAE

SEQ ID NO: 972783 - protein, 110 aa, Homo sapiens
MLPHSPGEAVQRNHSWPAEHKTQWCAAQHAWWRTHTECPTFSLTEEKILHENKNFLHHTTCWDLHHPERLRHAQYCAGKNIAAIMQLDVPHEESPSMCDNIPFISTETPC

SEQ ID NO: 972784 - protein, 150 aa, Homo sapiens
WFAVFNCPAGVSRRVCAKPGESPTLVGPPPFGNPSSRHHTGASVRSPPSVAPRSFPWEVVRGVIKTTVSFGLIFSPDKFCSCNALSPLFSAHCPCCIASGLSNRLLLSMSEPPGIGAPPVFSPRALKTPPQQETAYTPPRLLVGPLPPWN

SEQ ID NO: 972785 - protein, 137 aa, Homo sapiens
TTGPRRVFAEENKWGEKAVRFATKISLSKKKARYPYVKSGQSQLKLHHVNPGPQRPLGVYPPHPGQERGFRILWKSKGVNRPGPPSALWFDPPRLRPGVSVEQTPKAYWRINKGLLAPGGTSAPQAKGEAEPRSSTC

SEQ ID NO: 972786 - protein, 120 aa, Homo sapiens
MLEPDLKRGTPCPGHCFDRGDLRAWSSGRHPCAAVRCAPHMGRDPSSGFRHRRGLLPSRGCASPPEQPRCGILLPQAFWVLQTGTPPPGSFLISGGLFRGRRTPRRCHQADAMVCAPEYL

SEQ ID NO: 972787 - protein, 122 aa, Homo sapiens
ERGPQPPWQGETYRAVSRKVPGLPPRLRGVSREDVDDNGGGGKIPGQKRATTGRKHRGPPLPSRTVSARCASRAKEGRLNYYRNPLGKPCFRARGETRPVGEQRRLPTNHGRGREAFVGRPV

SEQ ID NO: 972788 - protein, 335 aa, Homo sapiens
MGNDRARGSSLRDHRESAPREGALPPEGSHHTDDACERKVAARAKMFAQKGSPHRVPRHPPRASGGWPAVTQRAWPTPRKVITGRKSMNTNSRRPNKTPFVARGSIPPLGRYLAFQHYSNKSYKQADAWFSPGMDGGPNTAYCGPSFHGYALTMVCGAASCNQCRGTLTRHVLHSPHSTVMARACMLTLSIGGEHYKMFVSRRLAQDSGGDDCEIYVHSISPPQADVLVVQVTAGYTSGIPPDGIVMLAYDIVGGEYRKKLNTFWHTGGDLGVDLLDSKTEMRVHSLVYQHRKGHKHDPWLEDDVRVDETARLDGRRIRVTVLVRPNQKTRINRH

SEQ ID NO: 972789 - protein, 269 aa, Homo sapiens
RAPPSLARPRLEKVLPVAGGPNFAPRCRVLPRFSSPPLMECAPPARRRVHSPELSSSCETYSALGSGLTRSLVVTPRSPSRRPVTLSRSARKGLRPVASPTDPPLLLHHSQRTNPVSWSCPPHTACLPGGAFPIDPVFTCAHVYLLDIIFCPPDKAEAAVPCFSPAGTREIGSRFEDYGYGRLLSKVIIFSLLGVLPRTLMVYFGAQLNAPQSMLVSVVSALVLSRRYARRLARCLFMDTTHCLAPLSRIYGSQRAGSMLAPRHMVIIH

SEQ ID NO: 972790 - protein, 104 aa, Homo sapiens
MFGEVFNSGGTLTRVPEAPSWRPETPYLGCPLIFIAPALHFMYLGAFLHVGYYRGLAYGRELFGGFLPGFSGGFRIAGGNSPLGDHLIASPPSDFYKQERKGAV

SEQ ID NO: 972791 - protein, 144 aa, Homo sapiens
MRGSYPPRSVEQPTDMDTCSEPPPQCKHLIKKLSPGKNQEAPFVPSHKQQCAPLVRARVFEKIIIALPEKREFIGEKSTQPTVLVTPSVEKFVFPAEHFLPKSSIGGTQISTNSGHGASNIFGLRFKHLFFFPEKTNTFSSKIT

SEQ ID NO: 972792 - protein, 133 aa, Homo sapiens
MRQYSRSALLWVISTALLVSHLISCVLIASSVCSLTQLSGGPLTHTSEGLCGRESETKHPAVIHTLRGMEDIIEPPADYTTCGKRIVCTYPGVRLVRPQVCITAVGTRSKYIHLCPLGSARIARKTDPDNRQE

SEQ ID NO: 972793 - protein, 101 aa, Homo sapiens
ESIPCGESMERKHPPLLARNIFLSSLALWCDTRGTTSFFSRDICVFSLAPQHRFFCLCGGRDTMSVRERKICDAQREREICVREWLWFTGERGAHSCVVTP

SEQ ID NO: 972794 - protein, 69 aa, Homo sapiens
PVVGGWRKTTTHFLASSSNVLTTSLLVAGWYLVYLCSTPSLLQQQPQQSSSSSPRTVVSTPLLSHALLV

SEQ ID NO: 972795 - protein, 181 aa, Homo sapiens
TSWGKVQPPSMRGEPPVPAQPPRRSRFLPQTSPLAAPPQLNLLRYPGEHTFSEPRPVAPTNPSGGTTTTPRCGRNPAVGKNHLRKDGQYPPGLRAPGVHIPHGAPPENSCDTTRGAPNILPPTYCVGHTHGTPHRVVRKTRTRAPHRGCAVLSPTPGKEKRPICFFSLGEKIKIGAHPPQN

SEQ ID NO: 972796 - protein, 125 aa, Homo sapiens
GPTSLNQRCFATHTPPPRGYNILFWETNPHHRFSVEKTLSDYFLDVADSVSCPYTPVFSLPRGTCARRDMRLFVAASPQRDISFHLLRGTPLLSKTRPLSSLIGRNIFFSGGRFYTSPGSDIVIV

SEQ ID NO: 972797 - protein, 115 aa, Homo sapiens
GFPAQVRLLWTPLFPLTLLTHPRSFAPTPPNISPWEDTQGAALLGGLSTPPRGTASRTYLRPPRGVIPPLSGVVRASCHFPSQGHTALQVPPQRLRLCVAGALIGGYIFSWRPPP

SEQ ID NO: 972798 - protein, 119 aa, Homo sapiens
EVNAHFVAAAMFHALFLGERAKYMGHINELGPPLTALIPPTGEHFSSLFETRAPPRVFSTRSPIYCVVGHVFVVSQHKGCTPQACSHRIIAVGFTHTLLLLGDSSPPPYCAYHTPPCMI

SEQ ID NO: 972799 - protein, 309 aa, Homo sapiens
RVCCGPHAVSCFNSVGAFLTLLRQWAPDAQQGLFSCVTELHKTGLFRCGVGTTCGSRWSPAIRRGGSPLPACLYGAPKPPPFGHSWAALPGQAATGAPCKKVSRQTLGSAFQSTAPLHFSDDVRLKSPSQAAQSGFLDQESLYYKKPMGVPPRRNAKHGKMMGRSSQGGNLPPRKSLGMFNPPPSTQYGPGSPHDLLRARLLGRRDIARRPPTTRPGPTPKWGRHHTGAALNEVSNPRSSGENNPFPWPTRCTGVPSPLPPPSLCSSPQTLPGRPPTVEERSAEIPKTKPHYTERQGAPPVESANPARP

SEQ ID NO: 972800 - protein, 171 aa, Homo sapiens
MPCIADRVFAASGFVLDPRAVLPAVDRYVSGSHPLFLGGCYDPRQVGPPPGVCLQKVIFPIPGSPLPGRRGRVRRTPPPSQAWAWPKAHPHTGLPPLECPASSYRRPQDVYVCRGQPRVRVWLPPQEVRVSRLSPVMGGHPCCRTLGRPLHVHVSCRVLSITPTPSPPGED

SEQ ID NO: 972801 - protein, 302 aa, Homo sapiens
MVPMLPFVGLVFCHYILRPAYPFSFAGFPSGTNHGPWRPPPFSVLLPPGPKSCFPVFVVPELPLFARGRKWTTGVGFPTSAHTWFRIICRPASLEPLLVRPPLGPTQPSLVQTWCAQRALSKFPAWVNKPPFQMSIRLTQKGCFPMPGVEHAVTTTPSHQEQPPLVEPPTGPDMGAGGPHHSRHYCEYRVLTAHPLCARTHNGTHVYLGRARPSAQPFQKYTVPPESKSPHHFIDTGLLNQMPPCCSEILRQQGGVLQKASITHENTWGRKQKPPRSGPLWEQYAGPPASDERAVPSRRPPP

SEQ ID NO: 972802 - protein, 255 aa, Homo sapiens
TREFFEEVGTPRVDPRMGNFVFHPDREKIIGGKLFKPPLSRAGNIKTGFPNHLCKALQKTGVKTHAPDQRHTSRATWSQIRELYFLAIQNYPSGVNFLKLYWSYFPGPGCIIHVTFLGPAFDYTAYDGNGAHMRTGVYDLDIQKLSRSTLLFSFTPMQSRYHRPTPHGTSIHMGTAHLTSRRFPRFPKGLYTSWNLHPREIFAPILMILIITKQSFPIIHMTDRQFGAKAAQHWPNTPVSSFKGTNQKVQATGFW

SEQ ID NO: 972803 - protein, 273 aa, Homo sapiens
CSTIGGQRNVTRVPFIAPFIVPQGHSRGLHKPQWGTTRGVFPRVRGEPQIGAPLASHVFWDPLFRHTSSVVLRHVPSHVPHLLRDCSSGPPPVQARNSLLDAGFYLFYGLLLFSLPVTHPSEDAHPCRRCERSNKSIFIRRGNQQNHGPLAECGSGKKTVGPPAAGPPRPYGRLTCVSAHPHVTGVLYIGAARGELPRRKQDDAGYRPPSVISPVATPPLRVVIHHAKRDQVQPPGRLEKPPSSRTHRIGQKPGKLTLYSLGQCFTEVISSSW

SEQ ID NO: 972804 - protein, 168 aa, Homo sapiens
TQRGNVAGTGPTPVVRQSPAMCSEVLEATRRVRQVLSFILRGSPPPGAPRGALPIGVVFPSAQNAGCQDHPEVQQGAIQPPWGQWFLPTATLPPVAAQPPDGGFSRRLKSGARWAKWGPRALIQVTGGTHGRVELEVRPLRSPQATTCPTQGDGSPREGPPQTAGARE

SEQ ID NO: 972805 - protein, 59 aa, Homo sapiens
MRAREFLSPPANLCEQKNPKTGNMEHHNCQKEVGANKKKYTPVVSRETNFQKTRTNPTK

SEQ ID NO: 972806 - protein, 211 aa, Homo sapiens
MSFGDDCRVRVFFLLPYPRGFGPAPVLRFDEAVSTVFLLALCLASPSTPGAVGPCPPPVKWGSPVSADSVRLSLVSAHPSGALFFCQPILPGWRCVPARLASLVTHVPQRASCDHRTTGLRWGKRQVGRHESSRQNPSVLATRNTPPLAKRGAPRQGTPRLEKMSNAPTRAHTVSAKSDPPPSPPTGGLLPSPKAEPLKDRRRILSVPPVP

SEQ ID NO: 972807 - protein, 107 aa, Homo sapiens
CTLVWGLTNIASLIRFMIPSLVLAPPVFPGGTLCFHTLVGSFSLCKSVALLAALVSSRVAYEGTTLGWFLKEVCSQRSFSKSNRSNSSILGAEMISSRSACPPECDK

SEQ ID NO: 972808 - protein, 214 aa, Homo sapiens
MDLAVSSWYAPPPGVCTVFSSFPAKCAFLWKGIHQTTRGPEAPRRQRVFQTTGKNAREPARDNPPLTRRASKTPPPRGDRRRRAPKLDNNRGVFCPKYPLRSPTAARVPRRGQHNVRECTTEEPPGPWAKNTSLIWHGRTRKTHMVRDSPEGPANARRPQQRIPPFKGPPAARAHTGRLRSKKVFFSHSAPRPDTKLPRRRQTWGQKNLGHKQN

SEQ ID NO: 972809 - protein, 271 aa, Homo sapiens
PPACSKGLVAPSGYSDRELARQYLVLNLLRPSGGPIVAPMRLVLIPVAPAWRCAAPPAPDCGAAGDPAGDDPPGCVYPAAPIEPHGLTLVLGASHPCQRNRVPLSPPSEAAGRSTDPTRRGVRLPVSAHRVRLSLIIQTHLGRHSEGVTVPSLDAPAVPPACLEGGPPASRGVDPSRSSAEHILGPACTPREGPAPHMVCGTGAAYFFSTATDCSHAGAMTRSRTRFCCGQHRWSRSTASGGSRSSGDDVALLARPLASRRKKLALAPPHR

SEQ ID NO: 972810 - protein, 130 aa, Homo sapiens
MRWPRADVWASKKAIGAPIFRIKGISCYGRPSIPEGLGMPLATETTPLGRPVYQSFASCRREWFPPVVRSYVPPSLNSCGITPRRCYANGCGNATGPAPNRSRTVQELGRFSRATGGYLQSCLTRVLVKL

SEQ ID NO: 972811 - protein, 216 aa, Homo sapiens
FGRSRSRPAPCAGDSPESGLVFEATRGRTASGLPLYTPRVYKSLGPGTILYFLAPASQGPVCDTLALDNSPVVPTPMAWQARGPHPPSPGGNDDAVRSVSRPRGSCTSCLLAAAPPRGLQRGWLWARSARGTHPSFDARVPHEPSLGRLFRGTCIVAPRTGSGPEKFLWTPSLGHALPGPVPLGTREIFCAPTSFPRHNCRRGRCCIDLACAPPAR

SEQ ID NO: 972812 - protein, 297 aa, Homo sapiens
MHRSPELIYHICACLSGLPVFLIATRFPPLFCLNRDCQLCGAPTLGCLLPHPVAGVRVFPPWGPPPPLDLVPGVPKPTLLWFNFAPIFCLSMLRPIFRAMPCISSGFYGFSHNLNHRMSCPAFSPGIQEPPSSRVSGLTPSSRLKVSSPVEVNISPGPSLDLSRFVGVPPAGDPPLFRRPLRGYPPFSQNSGRRQPFHNKDGGPPPASATASGGAPKNGGWPRNSLRERSLLSSTEIEAPLSALPEVFKGAPSYVYTVLGPRNEVAPSGPNARRFLSMGVPPTRGPKEEKKFSNTQK

SEQ ID NO: 972813 - protein, 110 aa, Homo sapiens
MLTAPPLSERCPRSPNVSHKGRHRAPPLVGERRACPPGVCQRTKVSQDRRSWFYTLKLFGRRFRPTSPQLGGPTPHNHSMLELPDIHKSTNVKPLGKLVVPPVKCKSNTS

SEQ ID NO: 972814 - protein, 146 aa, Homo sapiens
MYAQNRKPPRRDLLRAVEIERGDDELPCAVGNSRGPHSNIAPEYIGGCWLILFARPLCLIGENRRGPSPLGSQPSSYEYYRSPSQAELRGRAGRIDLPPFYAMSGYFFKADRAPDQFENPATSLVSPTLSRQSDRGAPNKVEFLAQ

SEQ ID NO: 972815 - protein, 167 aa, Homo sapiens
MLTLWAKNTRPAPPISLCPAPPLRCQKAQNQGSPDYGTSRAHAGPGPLVPRTRGPPSWAQGPNQPLGSSGLSPRQPGKQKHAASVGVLILSTGAPNSSFRREQRCARPPPCAVRRIVSSWRPNRLGEAVSACPAWSPQRRNIALLPAGAPVVFALRPQSCGPPITPQ

SEQ ID NO: 972816 - protein, 303 aa, Homo sapiens
KKKRRGDACPSARRPEDSVRPQGVKSLRKHRAGVSNDVKELVANHVGREPQQNKTHVVSHGRHSAVPAGRQGAPHSGRTSRPPSTRTPMGTTTAFLSGKTNAGAPPLNEFSRNRNAGEWPRPPPTGYPGHRGPQQSGYQQEKSGWPPTSGGRAGHPKTAMWTQARLATRTELETPQGRPREQTSRHASGHPDKTKGERLIVRATKTTGPHPQTGTPAAASTASENKGTTPSAPLRGTNSDRCGKQMVRDTRSTAHNYEGTFPIGKHKGALPRLSNTKGESLQAPGATPRGRFPGREHPPKKKD

SEQ ID NO: 972817 - protein, 80 aa, Homo sapiens
RVFRSTLTGPYIYGVFPLGKRSPSVSIKHSFSSCSASAVNFIVQGINGTIVPRLRGGKISAQIGRRPHGFPPKYCCPPCT

SEQ ID NO: 972818 - protein, 287 aa, Homo sapiens
MTEKNTLQYTHATHDVVAAPHPRGATVRTKRCRERRALDRVPRHEPIPAPPSHKANQDNNKAAFEQNLGWARGANYLPRASKLVKFQTRAQELQPPWTTTGNRASVKRPPPYFREGGTPWQTCTAGQEPKLIGNQGHLRMSLPGEPSLRSMGHPVMPRVFGSFTSTHPKCPVTTHKGSPHIPRVWPQGHPHTRQNPGLTHQHGGLTIAVYDKKGRGQNLGAGRALRKKTHTRLAEEHNKSRLFQNSIPKQACPKPEKRRINETISGGIIIEVRFTNATHSGSILTKA

SEQ ID NO: 972819 - protein, 127 aa, Homo sapiens
MWGTHPASSTRASHTPGRGGQKIRCYHPSAPQVIRKRCTHPGEQRPAEFGKKCETPHKRGDILRRGNPCCPTYTGESRMTRSRRGSGKTDPQASDTARWRLCGTPESTGTPPGGFFFSKKEPAANKN

SEQ ID NO: 972820 - protein, 196 aa, Homo sapiens
MVNLGRLSRGALFSSRRARRRFLLSAFSGPRKSPPLVWVLPPHRASPLSSAQPPRSPPPVNSEEHCSAPPAAAPVRSKHLSLPAVFCSMPPTRGRLSHRQHTVGHVRDVEVRNKVSRSLLGSPQRPHVLVGAASRPQVFGGARARYLSQSSERSPRMPRRHISSRLARTTLARPTRVPPTPPPPIKGFPKKRAHMS

SEQ ID NO: 972821 - protein, 117 aa, Homo sapiens
LTVGENRVPDSLPDAYDECGTNRCEGSDRRVCLSKYLIVVALEYVNIIAFAGGVVHRRSGDWRRRVILEDESLTLYWGFQVELKCIEFQSMFVYQIRIRMTRIMWLIVQVVDILAKY

SEQ ID NO: 972822 - protein, 265 aa, Homo sapiens
FVYCASADPGKCVIREGFPGPRFEEQCFPAEETIFWRLLPPPSQSSPPLGAAAHHIRGIVGPSPSRLPPVMTGVLPAHTRPRGGHCSPPTVGLLRGSTPPHSSYSMGGFPKVAMRFPALLSSESERRSPPQGFVSPRVVYPGYLSVTRPLLHHVLCKNVFGLVASLLRRIWPLFAAGFPQTKYVAHSRDHLLYGGMLVDPVLSEARCTTCPTTWMIFEMTTLCVPSQMVVRRPPSNSHVATTLGTLEISRSSKKISTNQKERTTM

SEQ ID NO: 972823 - protein, 195 aa, Homo sapiens
RVVLKYARQCVWGARLSHLPTGVFRPPVLLRTAQFPLRVGPPTFGGPFRHNTRCPGRRNPPCGGPRLPPAAKCPGVLLTTSLGLYTAPILPLLGRHPLFGHLCSSLPPGGSTPLSRQSGPSRCPAPVFLSATLIPPLQVRRGLTPPRSSVGPSPLGVHLGPPAPFGQSSGSACCLPPTRRPPFLGRPSLGPPPSL

SEQ ID NO: 972824 - protein, 257 aa, Homo sapiens
MCLWGPPRAPREGKKFFRTPVALGGGRGPPEGVRWHDGASRPVLPKRENPGAGDMAAWCFPPKIKKAPGGGHRRGGSGTNTSRSGGLPTRAPYGGFYLPSEGVPNGGAPNIPKILPRPPGGRNDKNSDTNDNRHSKIKDRNKEQTQSSRRSETTSGHRQQETGRREEEDDDRRRPHREGRGEVAREGRAGARQSTSENERRQRGQREVREMGDRRRQGRRREEGREDEKHKEKERRETETTREDERHDEEKSRGRRK

SEQ ID NO: 972825 - protein, 103 aa, Homo sapiens
MTFSSTSVRFMALPPRRGQFQHDSIYLWRLPACAKLFVIIQHNTHGVQHPALCFQEELFSSRHLFVNNSLRYTTLQYISEPSSPFLHIQHHRHKIKAFSPPTF

SEQ ID NO: 972826 - protein, 70 aa, Homo sapiens
LTAPDPFNDWPPANGSPTKLEDTSPHVWHLEIGRPRFNYISTETVRITKEGKKSSSRYNAHSKLSSQNKS

SEQ ID NO: 972827 - protein, 229 aa, Homo sapiens
LLHWGFLAPSLGPRLNCSEPRPVLRLCAGPATQPLPQLLGPPHAAPGFSLRRPLACHPASRPCVSWQTQVGLYLSPPGVSPRSPAGLVYYVAPLFLVSLTPLMGGPLRGSSPLAQSASGVTLPLALPTRHDWGEHPPSPATPRRPWRVGCLRLRGDMASWRDYLSADRALLLPERHGMMGPHVYDRSPGIVLQAAHATAILCCSAFLYALGSRMHVPQRIIMAQCAFYC

SEQ ID NO: 972828 - protein, 133 aa, Homo sapiens
MGGHKYVFGQMSVAQNAIAHMSVVGNALCSVNMFQMRGTCVFVKASDTLYQIEVFLISDSCPSTDNVLCAKWSRRQCVVKCGCKDGSYRCLRPLLWLVGPSHPRAAIVATTKGAPGVFAVVPRHKLITAEYIF

SEQ ID NO: 972829 - protein, 70 aa, Homo sapiens
SVLSTCREQYIHHPVGGSATLVVVYYTLWWCSNIRRRCDYDGRPPIYEYNSTIVLYRPNNYSGVSSTLAL

SEQ ID NO: 972830 - protein, 110 aa, Homo sapiens
MVTCNFRFPEAVAPTQFSPGGPPFALGKPTLLADVKCVILGVPPYDPSSMALLPPVGPRVQLVPCLSPGPVFNRPGGPRSREKPPRRDPFYSATPNGGGAPQTAPFKYGG

SEQ ID NO: 972831 - protein, 110 aa, Homo sapiens
MPSKHNIRGAPRAPRVKNTMDNRVPQDIAGQKTRAAVTPHKKPRGGSHRLVTTPHRQGVAKISGGYQHSGSPPTLHKKIPPPVGMTSLQNDTHTTTTTLHSQAITPHTNQ

SEQ ID NO: 972832 - protein, 183 aa, Homo sapiens
VFQCVHHPLARAPSRSSVGVPAHRCRACPTCAGAPPAFSLLARPALFLALVSPSRFAPPSLSVLVAPPSGGYVAVSSRIFVGSLSSPGLCILALRVEVRAPLSVSHRQWCARSLHLMSFVNTSQCRCRGPPLYGFYHLHLILLLSCTCLMSSTTFFLPHITRTAAIKYYSTHQGIPDNICVVS

SEQ ID NO: 972833 - protein, 94 aa, Homo sapiens
RFARAQKYCWNMLCNGAWRVMMMYAHAAQESTERLFKVTDDRLRIAAVVMTVVHVLFLAMMATRAVPSLASYLQPSARSHRFLEAEDVGYCMAI

SEQ ID NO: 972834 - protein, 252 aa, Homo sapiens
LPSGSAPAHLGPVELFPYTSRRSFLRRAFLVLSAVWLFSYMGFCPPTRSSTCSLKGAFFSQPPLCVLYTVCPFVWPTSEVVSPPYFGFVPPTEMGVPPNPRRFTLPAGFPCLRHFSPVSTNPQLGPPHRAFPKGVSPYRGPPLLRLGPLAYLPGVTPPTLCVRHLSCLTATPQGFLDPPLATLLCRDAPDTKWCCPPGGIIGLPPRAFSARTLCISSEDTRYDGCSSRYVPVWRPARAVSRTPLRLQPPQHN

SEQ ID NO: 972835 - protein, 99 aa, Homo sapiens
MSLLAPAGVLRMLVGDSRCGSQSYSVATPMFAVHVLYAGVGHLANAGRPGRPRAWNEPLVSWHFVRGTPRVTTIDGHRGVFSRLRRPGVVLSAPGTRRC

SEQ ID NO: 972836 - protein, 77 aa, Homo sapiens
MTTIYCECVFSPPTVIFEGVVYFINKHYFNLVSCRQSVSYHTPSCPPFPKINPHYPILDSSQIKRSTNSYKLCPTIT

SEQ ID NO: 972837 - protein, 120 aa, Homo sapiens
LAYGLVFAPPPLRRNSVLCGRDTVVHLFTTNVSLLVARHGASQNVPPGLEDTAMRLRLWGSRESFVPPTAAGSLGDTSLLTSELCVWNTPPSSYWLCVVARNRAVIHGRPEPHTRRRPPE

SEQ ID NO: 972838 - protein, 181 aa, Homo sapiens
PLVWCVLFFVGLLFSSSSRRLLGPFFSRCGFVCATHTARRHGWRDRGGGGGRRRVGPGGTGCHGVDLRGFFGETRFFAPASVFSRCFPPPVWLPAPGLCNVSFSVFSRSRIFGRCSRLWGFYGALYVVFEPLWGATLRSSSFVWPANVPPLEVSCGRVWMQAVLPLLGFESPGSKQWHPPL

SEQ ID NO: 972839 - protein, 64 aa, Homo sapiens
MFVGTPPGEIRKGTAGCLGDRITFICWGRCPGARFCFQGEKTTTLSLCRPMAKKPGKPPNGNKT

SEQ ID NO: 972840 - protein, 119 aa, Homo sapiens
MGVDGCVHVVAPRVRRHRAGLQEVSVPWQGSGRPQKDGFRGHTCRQSLRRMMDCCVLPRHVDETDHRKTCMTVVRRNGEKYLQIHVLVGPQVTHRWGPRFPCGLAGMESRFSTMNHGRE

SEQ ID NO: 972841 - protein, 289 aa, Homo sapiens
LVSLFVVKTTTRQKAAGGRRWRRPHESGGSSYISSYIPSLVGGWSPIRVGLFLTALIFLKWPRNVIACPQGATTVSAAWERDVLSPLRVEKTRGCNRPGAFSAVVGGSTYRYESSIILGQQDISAGQVVSCVSPETTVMAGAGVFDPPALYQGRLSSLLVEKIAQGLTYAPPGGESRPALLEAAPPPAGGGARPPSVWWTLPPCGGIYMSGRQSVARPAPFLCPRDQECSSEGRLSPRDYSRCFPPGFVILPPRVIVFVAWTPLFSHRLQIAYKPRAPHCWERDIISGF

SEQ ID NO: 972842 - protein, 227 aa, Homo sapiens
LLFAVSCCVCVFFLSCCCCCLVCLGSLVCVVVLLFLCGFREAPDRLLDLRRAGGGGGHNVLAIRRVYLREVFFTELSLFFHRPTLFLVPPKIKVLRSRFVWPLPPLWGYNRGHKVISCRYFQRTGACFPSPGVVFLRVCRGNQLFPEWAASRCVLMVSFCVSGPPLGSPNLGPLPFRGFVPPTGGPNKGFSPPRVFPDALTRGAFPPPRAVLFWVCPGLLLNKGIGG

SEQ ID NO: 972843 - protein, 114 aa, Homo sapiens
CSFRFVSRVRCSVCFVRVCVVLDVTIWLLFVVCGGRGGEEQSDEGGGRVGAAKEEEEWFMLDCFSIKFFFPSRVFFLVGDSVLNGVRICFRSSPFSSHSGALSFYFNDGGLSPL

SEQ ID NO: 972844 - protein, 74 aa, Homo sapiens
KVSRSLFATSYNIETDSVPFKGDKVTKIWGALYNLYAKGLSHKGHVSSCDNKSYNNYDISVPIFPNIIETDSAE

SEQ ID NO: 972845 - protein, 228 aa, Homo sapiens
PARTVQTSGKSRRETSRPKAYFPAASKNPGATLPPVVGTSAVATPHKRWVAYTQSTCRTHSTAVHPPQGGEYSYHPTQGETRRTRLPREPRGGSTPSCWIPPHAPSGGAHQPGATNRPHTRGPMPCVFLTNTPSRGEQTTAGATPSLLLVQPVQYTPLKVKTPPGAVVWWRSYQAKITHPLPRGGVFATQARESYSRTPSSESRGVSPQLWSVKRLPPWPLFLLLAPR

SEQ ID NO: 972846 - protein, 83 aa, Homo sapiens
ERKSVRFIHCPHNPRPTRRSYCIISISPLIYDPPPSQISPSNNRHNHHPNHMHYLTTNLPTHQMHNPYHTPLHKDATWILLIT

SEQ ID NO: 972847 - protein, 115 aa, Homo sapiens
MSLPRPPPPHRPRFWHTTTRRCVLAESPLGATSPDGSIVSKRERVHRNMSLGVESLQQLSIHPWWRHHSPPTDPTGSPFFSIFHYKLVFPPYLLIRAIFSTNTPLYILPASPRAK

SEQ ID NO: 972848 - protein, 218 aa, Homo sapiens
MAGVLLDFLFRRRGSVRTPLPWYIVSMALPPAPRLPTFLFSGPCRVFRLVRWYGPCLAVAVCALQEFHRGGRVCILVFARVFSGQPPTSLPHRLCYFCLLCAGRCCVPMDSTLCVGEGVLPHSLLPTSHSRHLLGLATMPESAVSCVVQRAHTLSVWYLYVSPGGNPHSFYKKEGALPHEGMIKAFPRRSFYGSQSTYVVCVCTELIPHKTVFLLSHQ

SEQ ID NO: 972849 - protein, 110 aa, Homo sapiens
WFGKKSGGTQEGLEKKSFSLQQFNVRKLLQSSGYLRVQNQVPREISQGMIFWGAIWSTWRFLNNDIPINGAVFSIKTTGLVTSFGILVSGECSSSHPVLIYRNTLYPIKA

SEQ ID NO: 972850 - protein, 407 aa, Homo sapiens
FVFLCVGLVFCFFWVCGVSSSLSVLVLSLAWFSTAGVCLLLLRCSVLLFALACSRRLLSCVFSARWLSSSSLCRSFSALVVLAVFCCVVFWCARFRMEENSAGWTWGGRQPPEVVFCARRVDPPSVGLRVVLSRVSLSLHKWSVKPTLVPVGSPFLFCRPNVGSFFLLSGNPPGVSLSPPRPVVCGAAASIGASSVVMSLSACGVGNIRLLCFVSLPEYTPRGAPPPPYWGGFLKHTSGRLCDRPRYIPFLAGVCAASCLAFPCNPWGVLFGLTWTPRHGSVCSGPAGLHRTRSSPFWGRGDPHILCHGALPLSGAPYGSCLALFLDTWRPPPWLLHRIEHPRRRCGKRRGKEDRSVFLSRKRRERRYFHTGSLLSLTTLDAHRGGVFLCLHPPSREQSSRESVHDE

SEQ ID NO: 972851 - protein, 98 aa, Homo sapiens
LLACSLFGLRLCTFPSGPRLSLSSSLSAASLLRVLVLLFRVLPSCATALSPSLVLLLPPRAGACALLGPLLRSPPPHGRSVGLLWGAAPLPRLILVGH

SEQ ID NO: 972852 - protein, 267 aa, Homo sapiens
MRRHHLRVNRCAPDRRPSSYFGPRVKSSLVERWLLLVRKLGGCRRCARRPHMGFSGCGVSLCAVCLSRSPGLPPGALWCARRRGESPVGFLHKVVSQSDCWLGVARFEGVSMLNTRAIPLVEKLFGVTPDSLRQRRNHLGYKISGGHVVGGRHLLIEKSSGVGGYMEAGSFVQPHTGVHNVACVHFFLSKEAAHSRWCCLHRRGSLSFNGAGIYRWCSPPCWAHHHTRVFHTIVRRSNNQLGRGGIVTTAPLLMDMMRVAHSPGGSP

SEQ ID NO: 972853 - protein, 173 aa, Homo sapiens
SDFCVSVPLFFLLWLLLVSCAFRVSFFLAVFLASASLSLLPGLAVFVALCSFAFLALLVFACPLLPLRVLLLRPVSPRVLPRTLSLLLVCVVCAVCVLLYVLVVVFLVLLSRVLCSVLVLLVGFCGCVKVFSRGRTEAEKEEQWTFFIMFVGNCVPPGILVRELWAPLMSPEV

SEQ ID NO: 972854 - protein, 219 aa, Homo sapiens
LPGGPPWPRGSRGPRVGGPCFDQIRGIASPLFPPVSGSLFGACASFARVVFEGGTFVGPLVRPHLAGRRAPGFHPPPPGVVHARPWKDVLLRSNTSIVQKESYHHKGRRSFMFLFGIELFLRDIEEVAPAFLFRQYGKGFHPLISSTILDDDSSYYCWGAAPGVIIPVSLDKVGATSFGPPTLTLWKCCRAFRPAHHVAVFFPVDTHMALNFPYISEKV

SEQ ID NO: 972855 - protein, 231 aa, Homo sapiens
HPPFCVALFFLLMFLFFGSCVLDCFVATHAYRVQLSSVGWSRTGPGERGEGRGRCRCDLVVRICFFSIRRVDRLSCFLRRSSELFACLRVSLVCALQCRCSSLVVRNDCISAPRWGNYLSFFGGVASPPSSYFATGQFVFDHVGSAPALSSWEYRVFSVWVDKVRRRIPAPVWAASPTNVGGRLPPLWSVLCRSPFGVPPICYLHGVFSPPAGDICGRRECVASHRRLVLV

SEQ ID NO: 972856 - protein, 107 aa, Homo sapiens
TTRLSSFLCLLRLLLCPVLLSPAPTHTLRLCSRRSGRRGEASACGGGGRAGCVWSWDAWPFIDDPRLNTPVGVGVLAVGVSVGLFFGCRHLTATIRTVKKGSRWATG

SEQ ID NO: 972857 - protein, 233 aa, Homo sapiens
GLKKYHVYFSEMKVVNADKSSNQEFYDIISSRCSPYGLSEDSTFLDLTTGDYDSTHNILTGKWVVTENIFLILGTCLLASFRRYDVSIVQSKMGNDSFLPTALYYGWVGHLESPAIIQKVSLLCNLDLSLHVFYAGQVFYWQLHLKAICNQEVCLRLAGEGVLVNEEDKEGFALQGDPFLAYRGRTGSQCMIVLPRRAGWYANEDVHGLMDELGGANSFWRFMAQYLKWTLAL

SEQ ID NO: 972858 - protein, 199 aa, Homo sapiens
MSNNSPDRLTTPFRNPVLLSCSYLNWKTAIKSRSRKLHGHANTQNKNKDHTQHRTHTQTTHTHHPHTHPRNRHGTATKYKRVTREQSTDTREENNNNHIRVITLSGHTETAQQKRTYKQKNTRKENPPNVEQNYTNATNEKRPRAASGRRTRGAARRHPTSTTRGTGKTKIDTTSHASRDSTLDRQCSSSRVYREHKKT

SEQ ID NO: 972859 - protein, 298 aa, Homo sapiens
VYLLRSRVCTVSLIDEVRHPEVSSKRDPNSVDRYVAQGRRVKTNYTRDRLVVYNPDRSEIHVRMQRYMDMSCNEVITRPYTYGNTSCILTSQSVLMGHTYPGTHQVQIRLHVTVLFHDYMLQGSGVILDYDCSPRWTRGIALCTNDLRIIAIKALKECHRGILCIHSLNDYRCGRMIVILAMLDLIDIRRIGGIKNWCWVSTQAGVQARIARTTWVTRHGPGPLEVQLPLKPDGGPERGENGLDNRPENAYHPKGGRDTDREQQYIQRKCTDRHTPHIQKHTRGAKRTKQIRKEHSRL

SEQ ID NO: 972860 - protein, 106 aa, Homo sapiens
MDILCHHSQFAREASVAPGKKGRPEGTKVWMRPGPPSGISDPSGQTGWPVPEERSWHRQTTPRDTHPGMQSAPGAPRHGVFKDLEAGLTATRGHLTRAAPSTLRTS

SEQ ID NO: 972861 - protein, 231 aa, Homo sapiens
SEDLVGQVRGHHVTELEKALNSIIDVYHKYSLIKGNFHAVYRDDLKKLLETECPQYIRENGLRTSGPEIGYHQLIECSMNSSEELTSWRFDMDVAWQTTKNGHERKPQRVAELLGPEAGPLDMYLQNNKVINTTKKKNKKKLKNSGSGAPPAAPEEKVFENNVGWGAAGHPDEVKLEHCCPTASSPRRRHLGTVTYAPGGFSTPFKKSAGGDTDGLSDTNSQGRVRRHRSG

SEQ ID NO: 972862 - protein, 142 aa, Homo sapiens
MLSSKSRVFRLVLFQKGKLLWGYIEKGCFVLASILCSSDRLFLLGGLPPPRCMCFLRLPVVIAQQNTCVNFKGANNSPPVGVYKNMVVRGRSASPMYNYSRGGSIKRLSSAPACFFRQSLSLALAYTHINRACYVHRSGSFR

SEQ ID NO: 972863 - protein, 213 aa, Homo sapiens
MVYWANRDKRTSLIYVCVYIVCNVDIERERHGETDSPERDTERKTAPRRKAYVRETATGEPQRGPGNKQRARGPTYKKKIHTHGEKIYQREEPPRGAQKTLKGCTTWAKIGAHTQNNTSPPETSTSREELTATTPHWCTPQQASTEPPHILYTSTEISFVFFASHTLITRRLVIITTHTRTRHPPPTHTPATTHHPTTRHAHQRTLPHPPHRW

SEQ ID NO: 972864 - protein, 111 aa, Homo sapiens
MGAGLRAAANTCVHAPTIIGPPRPAGVQTARRDLVSCALTRDVYSVSSSYDGPYPVPPRLDAVYPAGPIPDALGRCRGTEALVDVVRPVVLLWDTDQGRIRLIGRYACPRR

SEQ ID NO: 972865 - protein, 82 aa, Homo sapiens
NHIDIFFETALIPTLAIITADEANQPERLKCRRILPMLRPEVGIRFRLLDRHLIYYCEQHPMLNYIIATTALSGAKKLCENS

SEQ ID NO: 972866 - protein, 189 aa, Homo sapiens
MPGKPICNLIFAYLAKASFRQLTLADVQPIKLPFRTKGLSKRCSLPWESAFEKVIFLTVVPCVIRRAAHLPPSSKSPWGTLCIGLGPPECAVAKNLYVLPYSGSDTDLFRRARNMAGRRILFSAQYHSGGAAPPPAPWTNHDSLSFTTAVNDPPLFVENTTSLPPIVRVSYPIVAPRRRSFRVFSPQQD

SEQ ID NO: 972867 - protein, 278 aa, Homo sapiens
LSSGDLHSRVLCSLWCTSRVWLPAFVRRHKHWGLSTGGFNPLPRPRGLGRPLRRLFGSRRTLFKLPGPYSFVSSPFLVGGSRHARGNISCSPRTWFLCRSSRVRYGLWSQRFFIGDGRSVIPLKCALLWSYRRGFPPRVLRLRVTLMLPRDESGYSIVVSTEWEFTYFLKAEGECSGLINAPCLRLHPGSKAGTRLMHALTWPPSIRRRVYFSVSLALIFRTRPCLQHLHLSPRVPKGAWCLTLFWELCPNRILNKRAKPPTTFWAPLFLFPPGKTPK

SEQ ID NO: 972868 - protein, 252 aa, Homo sapiens
MEEILFAQGFLLPVRSLSDWRVPGWGGLKCIATDDLILCYVLFDRPRCRTDVTNDWRCSPVRSWFSGAQDATARSVPKERVCVYTYFIELVHVEAMAFAAGNECEAQNAVNTVYLHGVLCSVGISAATRWTSQGHGVHKALEMTGIAAKRPASEFVVPRSCAGRRQTHGERDWFMYSRTSRSSLRCNCERELGTDEAPGAATGHGGLTRPATSEGNGRNKRGEAPKKDKPREEEKRQNAGKDTQEHVNRHET

SEQ ID NO: 972869 - protein, 248 aa, Homo sapiens
MARLFVATITALCEWFPQPRPYLDGFLPYLSPRGSAHLRRHAPGAHNIRWHVRPLTCFLQHIIPPFSLMLPLIPQCCGLHNQVLLTPEIHAALVGLMKYYNGVHHTQWGAFQDRVTHSLGYSFLRDIVHSIYSNLSEKWCPTPGLVVREIALDLFYADSEIHRPNPCDDKAACSGETTARLSGPHNDPVTTALAMGKIMSMPFNGPPLFLLPGRKPPPLQWLFHWGCKRAPFSFPLPINTLLTTPFMT

SEQ ID NO: 972870 - protein, 322 aa, Homo sapiens
AGAPFMCCGLFEATHVLLYPRWDTTTGFDPNPRAPGPYCSCAKTLRGFVLLHPNLALFVGVGSCPPAAICPESHLGEYPPVVLANQVVPRSPVVHRQPVAPTTCVPAEMGGKTHSRIGASSRQVKTVEAPRAPFWDFQQGQDGNIIGEPHKECQRGLERLCTHKRVATKKRRADPAGTVDDPLCVSTLSELKKLGKRSAEEEETPRRTVAPHNTKRGRRTREAQYGTKGAILQGASSYNKCHLGNREVKKASSNLVRSGSERSGTKVEANRLSGRRAQIPRVCKASNGRPQTEAGGPAPTTRRRKTTRGPPAFKKKNYKPHI

SEQ ID NO: 972871 - protein, 125 aa, Homo sapiens
LGVRPLAPGKICVLVPQTDLSSQNRALGPVAPLSRPFEGIPNRVVVGPLNIWAGGYNTMRGLLHHKHDVVVAPGYYSTPQEGPALTWFHRGWCCPHESYVLLPPPAFLFTTNGGFALPTHGVLRE

SEQ ID NO: 972872 - protein, 206 aa, Homo sapiens
YDDQCRIGLKKIRAIVPRGSLPTKRRTRRGNLGHGPKKRCKKLGKTGGPRHPPGHVAPPGGPRPPAYPPASPLWGAPAPKQKNNPRFGDEKGWPAAFQLQQAAYTSSICWRPPPSVKGLPPRPPAEEAVRRVIHHLGRHTSGSWNKETQATNGEGGNHKTRGTKRGLLGERPQNTQQRRHQKIPTKAANKQKYCMPLVEARPPTLL

SEQ ID NO: 972873 - protein, 119 aa, Homo sapiens
YLGVFSVPQSRGTLFWVFPNNHPGFSHHYWGLSPPRYNPLAPRDIGQASDVFPHECRICTAFYTHESTASSDSSTEEQVPPICTRGFWIKPRVLHPMAPTNGPEKNRASLILLSHQKKC

SEQ ID NO: 972874 - protein, 100 aa, Homo sapiens
DFPEVGNPGSGPSERERFTKANYIFLQEGVSSYFVYTRVVPPLATWGWPPRDHTGSGHTATEVNVAEKKITHNLQGPLTTRLCVCSNPPIWAYLHFGNIE

SEQ ID NO: 972875 - protein, 235 aa, Homo sapiens
RFKEVVKRPLCQFWGKMAASMWGEPLVHTRVGVRPRKDTFAVAPWYAATGVVYPRCCLFQRRDKEYALLSPNSPGGICWGVDKQDVVPTRAGSLLFLESTTGEKWTRVSTTPTSTRAKVSPHRETPRVCLGGREHTTEPELEIMTGHAAGHPARGTRDPPGRDRTSRPVSRATNPRVGTATLTWDTPPAVFKRNTPPRPAQRRNNTPDVFSEHLRTRPPGIAAESPRGAEEDLEG

SEQ ID NO: 972876 - protein, 167 aa, Homo sapiens
RSPKDEARVVTAKSHRQKVGLQTPDDSRHIVQLSVFVKSAPTRCGIAKKTSGPNKSGASHQPAGVPRQGRRAVGTTAVTKVVSRRAEIHAIARRMGSAASKRGGEPLQRLMGTHLVCAITQKLSWEIFLGLDEPKQGGAQAYYPRISLKRAVLTIVRPRNELRAARV

SEQ ID NO: 972877 - protein, 309 aa, Homo sapiens
MDAAQLSPIYIDVSGRKPVTSRLANLSTLGPGSPAHGRPLSHTYPFFVDTDMSGAGHALIAPYFGVQPRNFVTPGAGTPASVGPPVPPLHGGHTVQEIPLCEVVMLNTPHRGLLEQPPEIPNRRPSEYSYPRPRARVVKRRTKPPHLGDAMRPQKEITGSPQGIGDNTRAWQISGRGPSSLRKNYTKRQAVGPTVVSPHGEETPPPGGGPRGRHKPHRRSKGLQGPPPPPQQAVKTPLLWTNKRRRQPAPPLGWAQGTGGSTSTVGADKGTAGNHLRNPRSAHKVIHEYRGPYSHVTPPRGPRPQSRPP

SEQ ID NO: 972878 - protein, 162 aa, Homo sapiens
MACTPSALPSAVPCTIGAAPVRRRDEAHHILTVKGAYKALLWGPPCSSCMIPPSPPLWCHCTGDPRAGNLLLSVGHAGMITWSSREFLGAYPGLFCFSGGPPRGATASARSLPGPPGVMKFLLHLAPNHRCRRRLGAPYTKTDGGPPSPVFIGRARLSWPRF

SEQ ID NO: 972879 - protein, 175 aa, Homo sapiens
ESLQRERWQSRKMVDTYSRASAHLSRGAPPRGSPRESPCCTPHVERPRPWGKQKTGGPPGGYTTRAGDHTKRDTRHSPSGDKRRPSNQRTTVAKRGRNTRGGIPHLHRKERESLLQDSLPIPHDHHLVHRPRKAIRGYRSVVEPRTHLSSLAWEKKTIYAPRCRRHGGRTPAVCW

SEQ ID NO: 972880 - protein, 295 aa, Homo sapiens
ARRDALPDTQYGWGPPRGQTAGGGKGVPPARVAQGCILAPRSPKRGMCAKRVRQIEPNRAPPWVPTLATWNNTWFLPGDTFIRGGDVAPPRHEVRKVNNMVTQGGVRSAPRDDKKGLREMVVQTLFTTRASERGATQDRTTRGRHTPDERPVNTHRGGLGHPHAATLLTEERAQEYYPDRALETDTRCGRHIYNPLGEAGRGGAVRGTQPVERTYGRDELRKHHGGGATQHNAFTPGVVCKRILRKVPTFELGGQEEGDDGLMATAGGAERVPMPPRIRPYLPPHRGAQGGTPFP

SEQ ID NO: 972881 - protein, 105 aa, Homo sapiens
MCAPGISVLKDARRHQARLGDIVWENTPPIIYDDCIRSALTNTIRPDHPLRKHFISPCRSDCTHWGHTPHMPEKVLPSRGEIFNAKSSTQGWETELLSKQQLLKV

SEQ ID NO: 972882 - protein, 55 aa, Homo sapiens
MSIAIPCSFFFLVLSSPTRIEFHVQFGDSREHRHDVDCFSPVTKKPSLNSPPQQN

SEQ ID NO: 972883 - protein, 106 aa, Homo sapiens
MSYRRAHSVLILKEEESSAVIMYSSSSSLWAAQRVLRVVTTSCVREHDNSRPSRRREHRGSPPQRAPADSKLIMYKIKYARATSLIFVVYIFRLLRKHPLRAPHVY

SEQ ID NO: 972884 - protein, 142 aa, Homo sapiens
LVCCVTGSKVALGVSPPGSFLPAISLIADSFLRFISRPVNQPALSPSEMPVDQNENTPGLPGGGTTPTGGVSTCMRLYGMRYPSLCTIVLSSIGLRVLVAPPAAPPAAGRVCDRTLCPDAAAHVLARSGCPGALMANSSRLE

SEQ ID NO: 972885 - protein, 106 aa, Homo sapiens
MLNNLGALVQNSFNRPHIVERAQHPPLSWGSLPVRCIHTPNVWYKHSRADNTYEKLLRALTQAVGSIKTTRLRWSNTSCGSPPPEDAIVTTSLEGNLVGGEKICAV

SEQ ID NO: 972886 - protein, 65 aa, Homo sapiens
MVKKKAPLLKSLGADHCTEGGGANTLKLMLQKQPGSEEEHSCRAIAVGYGPPREKMETNRLGKKN

SEQ ID NO: 972887 - protein, 194 aa, Homo sapiens
ENTPAGDREHRSGGAPPREQGVATENCVGTPQEAAPNRGLRQVGMKHRGANQWGGRRPPSEEHKHVVPPTTVGRAHRRPPLTLSIEEDVSRPRSLEDAGRRATAGRPHVFEDVARAHEKIAAAPLREPVPHTEADDASLRKACTTARGFRTDKSPCYYRAATACVEKEKHTVQGGRDNHGLRMGIHPPLQNDGR

SEQ ID NO: 972888 - protein, 211 aa, Homo sapiens
MRPRRSFSRGVEANDTRGVFDTLAPTPTVFFRQFPRTEGPIDEFGPKKSPRLAGEPLLRARNSLEHFPLIPPGYRRKCFLSPPEYGKKVFLHHTGPPSASVQPVSRPEASRRCYAPPSPCPHKRVSPNWAAGIPVSLPRPGILPGNLQETPSSNNSLKVRKRGVEKSFIVNTPHDLVYGANPGYIKKDYQSKNKRCLEEESTPSQDDYYLP

SEQ ID NO: 972889 - protein, 154 aa, Homo sapiens
CLVDVPLEPAVFSPSGFSLRCCQILVGSRTVVHYKMSVAGRTIRGVLPLCRPRRDFHGLPPASGPGELPSFFPRAPEFRLGLHHTRYRLGRLSISLTGCLLWRASSTLRSHSIGVAFVPLPGSCLLSLGVARAFSEEPPEAQQMSPKCSILRLY

SEQ ID NO: 972890 - protein, 128 aa, Homo sapiens
PLCGGLNRLYRLRRLTGSEPLSDAPRAFVVGAFLPGTKFVPVGYEGVSLDVIEMCSFRGVYERPHIHVYTQQCVNRVQETHPTLAIVVAPQKYLREHKHKEIIYYVHQSVPVLAAIVRVSSSNAGACD

SEQ ID NO: 972891 - protein, 274 aa, Homo sapiens
PGGEVCPHGGPTATAGVTPLGAISCDPPGTKSCAKRHRGDKKGGSTFAARKAYRRYRPGRKRAFAVRSRKRRPRAWGKPSSPLRQAVAGNGTLQEEKTTLACAKVSQSTRICQVWKKNVHRKVGDKEACWTKRKGKENQVGTGSRHRRTWVLQTHARLDRLDDRSLRCMYSLPSPLGQKTPAQEGSMTPKATPGPGLLRRRFSGKMVWLYRPNNRSVSCTYTQDITTVHTRLRNTARQKEKTRYVNLVCIQTHNKVSEFCSNNNKIGYFLCNQI

SEQ ID NO: 972892 - protein, 149 aa, Homo sapiens
CEDIGKNVFSRRGSNPDPGFETTRCRTAGRRPFYGGFLARTTQVKNLSRSAFGDACSTANNWGFLEKGTVPHKQCVYVTNRESGVSPQNAVTMLAHTNRFVCQIGSNGDVFSPKNLLAVCPPPKHSPRSIDFRAEEKPPRVFANTTCLQ

SEQ ID NO: 972893 - protein, 313 aa, Homo sapiens
QDTRGAEQQTIILLPRDCPFTYCRAIRFSAGRITGATKMGRPLLYKVSRTASHASADLYGVHTGGLGKNPLWGHNHILLMLPVHGSVPSMDRGKTITESRFSASAYCRLLSLWWRGPYFRGAPPRGWIVPAPYPVVALRVTPCSQAFGTYAFPAPGETLLRAPRTIFSPLVKHTPPLAFVVFATQRDPCMGPLGNSIQGHFPALPLPLSLGRAPTPSTRGHHHASNPPFWQHPPKGAAPWNTPREGRGPHHAEQHEPVVCIHGRNTNARGLPRGRRHDGSTPLSRGQGKVVCPHKSKRSSGAASGRRFHHNKN

SEQ ID NO: 972894 - protein, 109 aa, Homo sapiens
MTLVDVLCALGHYALCYCCTRSPPVFVCLVGGAFGCLGWCPNTAGFTAVVPPGKSVFPPAEVQVYPLFVFGSKIRTEPVSGALLKGGCQQMSSLLGLFSQKHVVSFRCQ

SEQ ID NO: 972895 - protein, 246 aa, Homo sapiens
PCNVLRPASDKMSCRRTCPLLIRLFLLGVIPARGDRPTCVLVVLEYFAPQRSLVVPPPPLLRVLSVPHRSRVVSRGGLCNTAAPLKVGDTTVLKRPIVQSWAIVSVSCSPVIPNIRGVVSYDIRTGVPPLKRVVLSMLGAAPCAAPQCPPLRLGPIFAAKLGGGPLALTAPRLPWAWNEPALGRCPALGLVPSYCEEASCWLRHAMCSPASAQLLFALLAVFRPPTCCPFAVSRTYSPFQRPLFLD

SEQ ID NO: 972896 - protein, 286 aa, Homo sapiens
TRKGYRTRNCLKIERPLEPGSRRENTSGNCGLQDLHRPRCRCVPPQAEPGSGGGPSIPGPTIAVSPPAKWDGACESQRWLKKIRLHTAGDHQEERPTVAQECGTIRPRLYEDGSCSSRLQCEDPGALMKNLYEPGFENPPVRLCGPPGSLTWCRLRRAGPSPPDVASRRKNTGGERAQSPAHGLCSPVENDTAAQPVAREMICLLDAAPRRKREDEIKLAADSNTCGSPATPDRHAPPGSPPPPAQSAGTTIVVGEQDPKWWGPAPESRGPLGGRGPNKKPSVNNN

SEQ ID NO: 972897 - protein, 217 aa, Homo sapiens
ADSSQAVGAPTMDEKRRTRPGRFGRYHMGVYNTKGDRTIPAVRTISRRPAGVNSGMPPPLRKGRLPPPPRRDWSTKKSGVGVDNARETGVAQDAANVQRVLTNEHTYVAAPRQCRRLEVSTRGGGEGGGNPPRRGHSKGPTPADPELAAQDTQKSLVDVPQEKPTALLDQNSLSAQKKEVVRPHGPPTTMVDKVARQNAAVVGKRWQNHTKQSLIIL

SEQ ID NO: 972898 - protein, 169 aa, Homo sapiens
MLNPALGPKRGGAPRERIAVALSFFKSDLCLLDYTTLYRALSATENGAQTAQTMVISNTSGPPCGKSLRCTQYVLHLRLVHIRENFSAFFQAISKTNVLFPVTSIARHMYYCSTNMRRTPQRGGLEQHIEFRASAIEVKRGILETNDALVYYQWEEAVLKQSNKGDPND

SEQ ID NO: 972899 - protein, 319 aa, Homo sapiens
PCMAVCGVCFRFCSFATSVPVVHVGLATAVLVAVLVHYDCPVELRVSVSGGFLLFSGQPLLVALRPDPAPVCLVSWAALCVRPKSPGCLFASDDRGCVQGGSHSPLRIGAGVCPLVRAAAETPACFPARGPLYFLTWPLFFAAFPPPLRVLPTCRISRGPSLGLLPLLSPALRGLVKAMMHTAVHPYSGGFLYTVDPYPRAGTMPQLAGLSCLPHVFLKFSRQPSGRETGIFCGSGTLWAIPCTMGVRKVDVHCCVAGRQPCVWPDSRISFPYVMPWLSFLLRLLATPMLCLVPDCGVDPHGREFFPPHKTSLKPPAQQ

SEQ ID NO: 972900 - protein, 109 aa, Homo sapiens
EYAGLVYILSCPVVSSRALVVVDSRWAGWSVAVHRCGHGGAGATMCGRLLIAAVGSYWHYVGSVAAPEVLGPWGGTIHLRRILARQAGAATMCAGVMALVAVPALGLHL

SEQ ID NO: 972901 - protein, 100 aa, Homo sapiens
GGTQYSDTIDMGRLGLVVVPPHLPPQLGVMSLAGVMHLAFVGTRCRHGKKSTGSQQRPGCEEGVHVYGQKAPWGQLNSGQARSVCSAQNDDVQLRYKRGN

SEQ ID NO: 972902 - protein, 250 aa, Homo sapiens
RGSNPCPRVLCFAPSPGVLLVRPPRGEFPAGGSRYFTRNSPGGSPHSRYISLWGCTPGSGLTFLLGATPFVVPGAAYAAAPRPSSPPVIVLCPRNAQQQKWGHKVFVNPRRTQLVGAIGPPLVARMCVFRTNRGAHPRLTIRFASSVLWRAFRPPWVDTVQRGSYLGGRFFQPSPKGSISHVLLLWSFFNAGMGPTFFERCHHHRQRLEVKFHFFPRSPPVVTKTHVFRGAKFASLASPDQYRASSQSQK

SEQ ID NO: 972903 - protein, 117 aa, Homo sapiens
FLSYCRDDRVGRDRVRRTIILEGRSFCRCVPYRLLFFSIARISSLRSARIFFPAPLRHASSLFLSPPYTRRFPLFASWLARRVLSLPFVCDLVLVGDNSPLGYPPCPTHVGHNITLR

SEQ ID NO: 972904 - protein, 210 aa, Homo sapiens
GRYPNSSRWQGGGSQSPPWGNGAAHSRLRVCPPSLVGAWPQASGVLRPPWHDVARRLSPLCVKPLSPVHAPEVHCPPQGLIAPNTHSHRAGPYQRVPPRLMAPLLVASRHLLQPGGPEWCLVPPPPRRVEFCPCGVHAANQGGRSPSWGILTIAPLPARTRWESARLRSALRVTRTPPFVVRPLLLNTAPSHSSIFCVSKHCPCSAANSL

SEQ ID NO: 972905 - protein, 107 aa, Homo sapiens
MSVCCPHTLGTPPAWAPPRCFLPPLWGCSPPRQQCPADSFFVGGPPLVFVCWPPTYGVYSFCPAGQYIPRVFAPTPRGGGLFDHTRVGGCTHHIILWGAAPPPWLLV

SEQ ID NO: 972906 - protein, 154 aa, Homo sapiens
MLVREALPFVWRGGESRSLSGRCVICSRRCFHKEAQRGACLLGGCWGDIFKQKRWGGLCWEIRGLSALLFSSSESFVHFVVSSRWSLPYQPTLLLLLDHKDTDVSSPFSPARGLTEIVKLFRVVVFSHTKILYNKESPRVAKGKIILRLPPLYL

SEQ ID NO: 972907 - protein, 108 aa, Homo sapiens
MSRWLMSCVPSLVSLWSPSLEWVQSVKMCVHTKGNPFSPLWDSRPLPPWEQNCVYPVALPPCGVSARHFFGGHIFSTSFYFARNIWAGGAHAAMGPFLCVIFREQPGG

SEQ ID NO: 972908 - protein, 106 aa, Homo sapiens
PTRGGEEQSLREWRVGDSECDHRSWSCSLLLIANGTSIIYAYLCLIFWLLCVRLFCLVYSLFAVCSMYSVLLVGYLLLSSALFCDLLGLLVVTEPSFLFLRFVSYS

SEQ ID NO: 972909 - protein, 133 aa, Homo sapiens
RNTFTGNTFCAHLFISPPSFSKPFDSSPPYFNTFLREKIFRNTTRVCFERKHLSYLRSIFVYPQNSHPTFIPLVVYATSKPAQPSTSLVKLQGVFLKLSSLLSQMYSGPPKPPFSTGSTLVQIYPPPLSNYSP

SEQ ID NO: 972910 - protein, 300 aa, Homo sapiens
MLLSGTQIYSGSATIPGGVQAAYPGAPGGAGNGESGPKAPGVRNPPPRSLCTPWGPHPAAVRRSGRNDQTQGRAYPTRIGGHHQDGSKIPPGRNPDWRRWSTSTHGGVGAARLAPGSRPGIFLCCKQGGPNNADFCRVPPPFVFVTTAPRPATLRWGYTRTPGDSATLNGRVARSDLHSLRGMNQFLRVVVAPRGVSLRRERCRTTRGRWQPAMPLEATDAPLLGARTWAGDPRSRWRDLEAGIRPREASRHARSKGTPTKSQPGETPTHLAPLSHPQEAPPGPPRLGPKKRGLFPSKKK

SEQ ID NO: 972911 - protein, 204 aa, Homo sapiens
QTLWFPQHSGGQNKRVHTPPGPKTGLWVPKGNEGLTSKYARGRGCPRDVPVRALSWILYNNHVSNRRRCIHARVLATRPPVYVAVYFLNRQYRRWPPQGDVKPGTSNGGTFTNKDLCSYQVKCPSRDHPTLSTLSPAVKRPPYRVQAGLEFPLFRKGVATNTGSMFFGFEIAKQQGALLTGKEKQRRKGPKKKKQAKFRPATNQ

SEQ ID NO: 972912 - protein, 299 aa, Homo sapiens
KRTVEVGRQKKVTGPDGHCGTDRGTDPGTGNTPMEERAPDGPYDDSSGAMDGPFNGLRETVPGAQRADSHNTGVMPPHRAVPEIGSKKYAAMRGTTKKGGKPHSHKHAAFSGGHKKAAPLRNGPTSMINGVLHQEEHKRAPRLLLSRPDDYRSEALEGAALHKTRSGGARVPPAAQFLGELPPFEGAHLAPPNAWERRPHRTTHEDVSPPRGESPRPRPPEWITSRPKGRCEKQSTKPRGTTENGNSTSTMREKATHTETAEENPVGHRYNVALGASTTTIRGGYFPQNTKDNYPPNND

SEQ ID NO: 972913 - protein, 107 aa, Homo sapiens
DNVSPIYSCRTPPHSCPRWVGSQVFWATLNILAPPGEWKPEDFLVLGQQYVLVLQPVITGDNPDFWNQGPPRADCLKPPGSTNVPPASRTSAGVQIIIPHAHPRVYV

SEQ ID NO: 972914 - protein, 98 aa, Homo sapiens
RVRSNAGRGGEEKHKRASKRPSTGARARKTLCLVPAGPPDYPGCTVGYPTTGVFACKGQKPPVPREGAPHSFSHARASVGFKTPGARRSLAQRQIVLY

SEQ ID NO: 972915 - protein, 242 aa, Homo sapiens
AQWGGQTPVVENKRPRGVHTRIVTPVLTTTGLTPDVCGSRKTPTTRFAGGHPVGCKKGPPAAECPLGNPSDPGEPTCGDDLPKESHMSCGEPLAQQQVSSEVAPQPPQPVDNKNMYVGSCESTRSRQPKEGVNTSGKSLLRGSNTEGGRNWLKTPANRRIAVGNKHHAWPHENTSPPPTTDRDKSGEQKNNELFGGEKHAGFLSAHSQSPQPPGPTLEDYFLHCTPERALFKRARLFPLNTQ

SEQ ID NO: 972916 - protein, 224 aa, Homo sapiens
MACPPSHSGGGAHRTRVARNVLAGVPPPGMTPVSGEHPEVLGRSPRVMKKGEIGGPGGTITVEQAGSHPPRRWEGYWTEVPTNLAGGDRYKTPEGGFNHPRLEELRPPPPSVRSGKSERTGTLGEHQQTSREPMPRDIPAGGHAKKCVDLTAEARIATINMPLRECIKGYEPWNPPPGNIITQDPRLDITPPCGGPDGREGRAWDHDVKPPGPYGDPPTFAHKT

SEQ ID NO: 972917 - protein, 134 aa, Homo sapiens
CRNTFNYSKYPAGVDASPPPFDEDFQNRLSRKLLVMKKLLVTIFQHRVTSRIEEVMAHIRGHNSCNKPYRRATCLPAAPLNIAAQLEDAPTQLRHSVCGIFIGVAIKRGILCCVFLAQMSKEPPLFSRRKSIIV

SEQ ID NO: 972918 - protein, 75 aa, Homo sapiens
RAHHLGVLAHETLTLLGVPHISGGKHWYLYNKVPLQERGEPPPRIRIVYRCGRRVAISCPHMITHAAIIIAPSNR

SEQ ID NO: 972919 - protein, 162 aa, Homo sapiens
GSFSSPEFIRHPRVSDDIFEGKPQVPPGSCPPVTTPLFVYCPARPAVLGCLSPGGKFGNTGGPPRGGHHYSRRFSTPEVLRRGINALLPPIAAPSLNYGRGPPFDDNWRAAAQHNDEALVTRMFSILSERVALCAVPLDLLSALLTLVSSSAPDRTMLLCLE

SEQ ID NO: 972920 - protein, 152 aa, Homo sapiens
PHMKRAAGGHGRTYLRTLRFFVEEEESSAQFLITPPPLFMRYNTPPFPGVAHIKFVGRERCDDIAPTPHHLLVGGARYICGPPLLLHTFYISPIIFYRAYTCGVNTHASLFIHSHATRVQNRFFSPTRIVSPPPPLYIYMVSTLPSPRCVQW

SEQ ID NO: 972921 - protein, 114 aa, Homo sapiens
MGDRPLHRTSGLRSPAFSPVPPEGEPPVFPSRKGDVSSPRVTHRGFPKNCARLKALFLGNNTLRRHKNQSEVRTNAPRPTFDKEIQQVSSSTHPGNLFEPIPLWTHPTLVVRPR

SEQ ID NO: 972922 - protein, 147 aa, Homo sapiens
LLPLVWSGGPRPSPPPPRCRRLCLCCVLLLSLRPRPALPPRRRPFGLAASPRLARWLGLMPLSLREMGGDESGAPARPAPPAALAPAGRPPRSLPPRLWVAELGAGVVQCNSCYQFCSSFMTEVSAEPMEYLGLAHKKKKRNRKRDK

SEQ ID NO: 972923 - protein, 118 aa, Homo sapiens
RWGRNPPLLRGHPVEVFSPAHRMGRSSPAGGIYSALRKKGTPPRMRGFYLHTQVRGGSPQSVYSCFIGSRRCKPRRTPPPDSWFCSLRKWVRAKLWMVCSCGMSNPGPAPHPVVLTGR

SEQ ID NO: 972924 - protein, 168 aa, Homo sapiens
YLPPWPAATVPATSDTVFSRAVNHLPVFSQAHAFRKCSTSRKSTPELQEACGACRSSAAATSWLVALWAFVPNADRKLPISKTHGTEVSTSAPQHRSDTPLHCTTWARIPRMFAVHERGPRRSTAHRLPSSSTEPVRPSGRTCKGALLMAEGRTSQQTRRDTAGYQKQ

SEQ ID NO: 972925 - protein, 153 aa, Homo sapiens
MAPPPRDCIVRNTISLALSRSARLTPRSARTLSSIVACILYTRLRVPPAFFSGLPWRTTFTHFWCKPPPAVGTLTVPHSLCLYIRYGARSSLNAPRIFCLDITLKQRFAPSVVMDITRSHSIRKTTLCGVEPLSIISAVSATKNHGSRTPAGR

SEQ ID NO: 972926 - protein, 263 aa, Homo sapiens
APLGSTPEFSCAGGFHTAPAPVGVMPLPSLECVQARVPPSAAVLSWSSSTVRLSCFGLPAEVFAPLVCVAATLITVSRGCARTVSSLPSCVCGRTPARLLYVLGRRPLSLRVVYVVCPPPKKHRSLRCRPLSSKCTAFLTICSSLFGYHEELHYEQAILLLLPLPCQHQLAERKNKHSPSSSAVKTYSCFNNSLPADYKYQINEWEVLVKVPARTEPCGHLRRTPATPPPRTVGRAPPPAVGSPPFQLAGDNNQPAGTHTSVV

SEQ ID NO: 972927 - protein, 203 aa, Homo sapiens
MLSRGRTVGCSEPRRGSLSVRHPPFSPHPSVGPPPGGASLDITPTTPCGLPPPDDGGGYIPTEMVLFFSRLNPRTGATFFVCRPADVFHTSHHVYSLCVVHTHVGLPSLPRPRVDTACLVCPTVPPQRGHTPHHAACVCEDHTHTGEATRCTRSCFVKLTFYNAVYPRRLFFFRGKLCDPRPFGGLVGTRPTHILIRLRGDHD

SEQ ID NO: 972928 - protein, 138 aa, Homo sapiens
MTCVGCYHQYLYSVSTTSGLAKAVTKEVRSEGMYPPPVLYEMLAWSVILGRLTYIVTLSGGCRRQPGAPAWVGGLIKNRPGLWRVGVATIDMIEPSPICILFPPSESQHTICVFFTPPAIYIDHYMYFLIIYNVHYIW

SEQ ID NO: 972929 - protein, 116 aa, Homo sapiens
ATIVGLDLLYRNLVTVAKGSYKGVHQVYSRLLFRALSTAVPNNVPNTTQRGPLQHPRVPPLTNSADERFLKHPPPLGAYSPLIILARLSSSGTIPPETQLVFNPQKPRASFSRIRP

SEQ ID NO: 972930 - protein, 223 aa, Homo sapiens
RSSDTVTTAGKLPPWTEAQKHGVIKSQRGPKISPAPVERRPPNWRARTAPNRCRTPPERHFPQGKNYHQGPQTRELLPPRVQPNDRRPSDSTHTTIAICETRTVPNNPPRGEPFGGQMTPSVSNPKSSFAEPNFRLLEISSRGNRVVRDLPAEGCDGISRAPRLLRGSQEIATLLDQGGHASLCSNYEILAAAVWLLPNTSVMSAGQIIANSTPPTSSHHLYQ

SEQ ID NO: 972931 - protein, 124 aa, Homo sapiens
MSPCAYKTPLRVWKEGAYATYGPYRDDQATKTRGWRPVVLGTAWVYHDGYTLGGRLFLMQFKKRARAMTWTVTVACRGRLSQEEGSKSLLISTPPEALCLRECISHGPSSPYAPGEPKPRFGVT

SEQ ID NO: 972932 - protein, 208 aa, Homo sapiens
MPWWKFYSGALCGEQYSYPGLLNNVCVQITLLGADEKGHQPLLSDYNYKSENTTVGRHNTKRGRPRTPCQSVRPGGLSTQLATGSPATAPIVLHPKCEKAPPGAPHEPGFTATGGGHTNGLSASRTVCVMNTNSPLQHRLFDTIAPLLRTPPHQGKTRVYNGLSLTRCGILRVYDVSNVVLYKQISKNKSFRRHHTIFIKGFLNINTL

SEQ ID NO: 972933 - protein, 229 aa, Homo sapiens
RGVKSETGLEGTEVFTKDFAGQGPTRLGVGKDARKRRAPGIGWSTGQSCHDTALGAPRPHGPHWGTTEVVRSRCNTNRATSSIPPRSWAQRDGGDTNTTPWPSQLDPSTELRPPGGVAKTGKCRPRLGHNHHRDKLAPVRAAIKNGRNTSRRQAGPRPGGPTKTHVAAASKSGAFNEGVPQKIVSPPPPLRTEEGAPLSMNNRDDMVEIMPIHNRQCKKIGGKEMRTLT

SEQ ID NO: 972934 - protein, 125 aa, Homo sapiens
LFPPEGGPLVQGLTPSPGQFADLCLLWSKIPPLPASLVDSPSTKLVMLATRTVFALPATVVATIAVAIVERSWTLFVDLVGLRTAYQRGVSSLVSSWRAQPSVCVAPPSTPVPFIGNPNTWKLGD

SEQ ID NO: 972935 - protein, 219 aa, Homo sapiens
ATPRGGPHQEEFPLPPGKYCRIDGCSWNRHVFLFLWRPPVVRVPRGPFVAAALVVTNTLSHKCGGFPINPPPAETHCWRRPIRSDLAPFVIGEGHLCGVPAQTPLSVLPWWAAPPFAPHTGVLTPDYAVSVATNITVAFFYSLVRRLSFQTGPLYIWRPTPRTSLFCVCPLHARPSVVNRGDTRYTRCGPPAVERVGTHHAGSFAVIVNTKHFPITTPL

SEQ ID NO: 972936 - protein, 106 aa, Homo sapiens
MSNPRRQHGGSVIRCVMSNTKVDTPRVSSCKKAHEQSGRQPSSAAVQLDTVRHSYYEGRARCHRSNCMCCLGGAAPVYHHEACADQPTPWMPTPWVVTENPESPVQ

SEQ ID NO: 972937 - protein, 64 aa, Homo sapiens
MLMGIYPEQVLENKLDTSLLIMGNQRMEEVLLQHPLNDPDGFPSALGGRRGAAPPRGPKTPPTY

SEQ ID NO: 972938 - protein, 183 aa, Homo sapiens
PLAVLAGLRGASFAGFGIRIVSFTDGLYRDVSKVVGTCGPKSPGETRFPLQVFCLSPPAPICPGGIAPYLGSQPGSRAMHMSRLRAERRFLPRSVLKTGGQRPHISSVCVSRTVACWVSANAPVVGRLLTAFHPQRPPSRFGVNRPPPSRGACPTTRGSRGSVGSLARGRPSCPPIAFGYGFK

SEQ ID NO: 972939 - protein, 229 aa, Homo sapiens
GAFCHCHLEVFATRSVVSNKRPYFHTPAARPGFPAAPRGGEKSFLPRFSKSSLGSPASSRPPVTTTCLGNTLAVGHSFGLPVTCTPPTGPYLGVARNNPPLSRCHAPRSPRSKCRARPPCFSLTSSRPPGVGPPPNAGVFHAFVRQGGHHIRSKPAKDAETMAGVSGTTLFLGGIFEKGTAFPGIGPSPVAWRATTSPTRPSPSLLSFQSYIPMFPKISGTPPLPITLV

SEQ ID NO: 972940 - protein, 266 aa, Homo sapiens
VFHAGPIWGLALVTALFPPEVFGPRQWAPPCACAKEGFTKHWAHEDVDHMGVNPQAVAADPAPPLVIRAFYGPIYVDTAPPSVFHGAPSLGVGCSPPPADINLAPPPTSRVTIPRPGLLQHRSPASLKGCFEQGAHARKNTLPIPKRPRNLEDSPLRLLLTDDKIFGERTDPLKDSPSRDTAERTPTTPLVKKNCHPSRARFSPTRYNFPQTQITYPSPPPLCTKTLLYNGTPYPLPPLNWEHTNMNSPTPRGLPTSLPPFIFGHY

SEQ ID NO: 972941 - protein, 179 aa, Homo sapiens
SCRSPCPRGPSFWVFRPLDGFFAPPPLLAVRGLPPRCRSVVSLSGDVLSLIYAPPRWRSSPLPIGVLRCFGALRLVLTNFSVLCPPGSVLFPGVSAPPVYSLSAGRVGLLAGHGATLQCHSPSMTTSDCVRRHLFRRGAHFFVAPLICPLSPSYVSVGRNTPPSGSQKSRYPPVPTIDR

SEQ ID NO: 972942 - protein, 111 aa, Homo sapiens
MLLWALRPSPRNSTDYTGISPVRNCLALDASPPLCDSPTHLHQLYDILRRAPRLVVPIMSPMASYETNRGYFPPASSYCSLLLSSIDIDFRCPDGWHSYCYVSSGNTQARP

SEQ ID NO: 972943 - protein, 197 aa, Homo sapiens
MSLLSLCLSGARVGGVLAVPGCSPVGVAPFLSVRSVALAQCDPTGGVLALPLCCDLLGLAFISPCPRVCASLRLFAGSVDRAALVRQFPGDHPYSSGGRPPILARLCDLAAFYTHKSHGALVPAPPVYQGAPSVVSRASIAPPSCRSRCSSRGGPGVFRVPPPVLYSGAKPRIVSLSRGLSDGVATPFASPPEADCS

SEQ ID NO: 972944 - protein, 110 aa, Homo sapiens
ASREFRWGRCPNAGLAWVAVSPHGLPEVVSETEKRCIFAGPSYIRSWLVRTRAFHDLGGIPPALPTHAPHGLSPLQHICGTLLFKKVTPGTQTPTNVRVSPNKPAARPYV

SEQ ID NO: 972945 - protein, 67 aa, Homo sapiens
GACRVAVGCEPHVSSAVWALFVPPPVLLTCAPVPWVVPASGVLCRGSTIWARLGHHDAPGVPSLSTG

SEQ ID NO: 972946 - protein, 248 aa, Homo sapiens
MQVPAPLWRAPPWWGPPSMLLSRASGPTCDQGQATHPCVQPPQGDHKHVLLLLPPAGAPQRPPHLRVAAKKAPAPRADFPQKGTSSVLPRDPLSAWRHTQAQAPHCPRVTQSSTRVAPHGEHRTTPYKGSGTTPDTNISAATLHHLDRHPVGLFRGPFWGTRVWSQRTAGHLRALAPPPPLTQGHPPFHRPPLLGAISCMMHPPSGVYWAPPPPPSPPSPSPPPAPPPGSPPRPCSPQNKNQIPPHKT

SEQ ID NO: 972947 - protein, 112 aa, Homo sapiens
GSHGCDARACDAERQTRDECGGDRAARERYMTERFAPEVVAAHLVFAHHGEAVPPAACERHGNRCNGDDECDEAPPRAEREAGERVGDEHGPCEQQQPDTRIGRDAGQHVVG

SEQ ID NO: 972948 - protein, 69 aa, Homo sapiens
MGTRMCPHLGLVGLTKRSPCYGLEHPSGGQGPYDIPRVIGSHLHARSKVRVYIPSKDQLKEHQCVQDTE

SEQ ID NO: 972949 - protein, 166 aa, Homo sapiens
GPTDGLRSPAVNRYACPVSRREVFLMRIISFNANGIRSAATKGFLDWFRAQDADVLCIQETKAQEDQLTDPMFRPDGHHCFYRDAITKKGYSGVAIYSKREPDQVITSLGWAPFDDEGRYIEARYGNLSVVSFYIPSGSSGDLRQGFKFEVMEWLGRSWRSGHAAA

SEQ ID NO: 972950 - protein, 306 aa, Homo sapiens
MCPGHNGAHAHDGSPMCFRTCLLIAITRNPVFPAALSRLSRLHNQKLGGAAEKEKYVSTQPYVARLSKEQMTRMSRMWSRAWTEIYHTADVLPRSMSMPDLGDKLRMIVHGTQKSPYQPDRWQVEPEEPEAETHSTKPRKERSQAGRNATDGARDDLERPGTPAELEMEPNPEIPAERATMVAGKQNREAPHGLPRHTRRTAEQALTGRRTEKHTNGDNNGPANHLYTAPSGMLAQPVSTTTDTTQKMTGNNYPPEIPLSQEHVPPRLHRAARDHTMNQSRTRQGKNPQLTNTREHQGPYLLQITN

SEQ ID NO: 972951 - protein, 64 aa, Homo sapiens
SVDPTPPAEKRHVGRLRKALLNKYRPLFKRYRAMFALRNAGEEVSLALAEGLHCGSASSATGRY

SEQ ID NO: 972952 - protein, 304 aa, Homo sapiens
MDIMVAFPCRSQGFTLITYQGRDVILRLLQPRSNSDVRIHVRTFRPRKDSACGMLAEAKARHGFCGIPITDTGRMGSRLVGIISSRDIDFLKEEEHDCFLERDNDKEGRLGGSPCRHHTDRRQMKFCSAAQHRRTVAHLYHERWLTLVAIIARHRPEQKNRDYPLASKDAKKPAAVMGQPFGTMSDDKYRLELLAQAGVAATGIAPLPTQIALFQTQYLTPVHFNAPNHPKSPKLTLEATGVNCCPGKNSIGAVGSLQIDIDSFHLAFTEMLRFIAGPRKRQEPISHIFTHINNHNKSSGTPHQ

SEQ ID NO: 972953 - protein, 239 aa, Homo sapiens
PKIKVVNVELPIEANLVWQLGKDLLNMYIETEGKMIMQDKLGTKNGMMLNNAVDGHTVYGRSETSCVEHMTTHLYVSRITQNSTETSSQKLKTGCMNEGEDQAKQAYVDHVWTDLMTQLALQLPFGSQEAEERSKMFEELGQSAADIYANDSSLTFQKLQDEDNTSHTMTDVCNIEPHQHKKKSSGHHNPDAAHQIIVALATWSHNDRRPQIQEKNREDYDDKHQKQTTKTKKKQENPE

SEQ ID NO: 972954 - protein, 97 aa, Homo sapiens
APGKPETVALVSAERHLWTQVVGSSLLTWALCTMSLPKGGMRERSPPGLQTRPCHGLSARHSQAPQEGRLCGEVDHSPESLAILKKQNPPNLKKKKG

SEQ ID NO: 972955 - protein, 425 aa, Homo sapiens
RALSSPTVRRRPSYHHTPVDGCLQLPDAGPHVTITCKPLMLLRPDDPCNACLLTPPCDPDPSMTGTSTDSQDCALGNIIRRANAATHARTPRVGAPAVPADNQHNTEHEPALDTAHSGPKRHRVTSSNPHNSPIRAGQRHPHTSTGAIQTLLTPATKLRVTCACNTLQHTHGSHHLHITLTAAHAAHQLTQPDKHNHIRNSCTPAHNTGNTDNYTSPPNPKVATQPATTISHGTAAERFHHRQADIAYTDQTTIRNEQHQCQPDERIRQQQTAPRHQVAEQPCSAEPASTRHAQTNAHKQDTRAHKSTHHASRSHRVPEIAPQQHTSPAATKQISETQGTADARTQQPTAAYCEPAREARNTQTINQPSPVSKSTKLRQEQRNSNTHNTRHTAITDSAQSTRKRSRDRHARRKHRQLRSITLYRP

SEQ ID NO: 972956 - protein, 202 aa, Homo sapiens
EVLAEMGGAMPEARHPAQAPLPCTWLLPRGYIEVMRLLLQAGYEPELRDRGRMESPVTQRHTGDVEDDWRLLARHGGVHGLTDPCGASVPVTWDEEVLTPVEELARKQEDLRNQTEASQSRGTEPQAPLQTNTEGALLCRPEQSRERFPLQELVQRSAGLVGLGGPPIQDADEGEKMVHRTHRKNRNPLEFLQTDQHYTSVA

SEQ ID NO: 972957 - protein, 442 aa, Homo sapiens
MATLRASIHRRRAHCKLRSQCVSASSSTTVVSGWVSRIGNACWELYCLEQGIQPDEPDGKVEQRVDSGGGRVISCTTTFSQIDNGVALAMACGPGPDVVETMEEPSVDLNDSFSHLGTYNRQDIIATPCSQASLEQSQRERLPANQLYWPGGAHTPVWWNGRISLTPQVSVPQEVPSNRLGIDASMQLGPSRRRIILRYFPTRIYGLGGEHGFVGYTALGWLQGETVISWYDILSEERSKARQFSQYNPGLPPEISTTLDDRCHLTKLRMRTSKPTNQAPGKHFLNRCPFNGKTNWTGPYYGEHDGTVNDKPRISRRLPQSLALNLKQAEYEHRQECTPHQRVTVRHWKGARELVRRTKIPDSLESRTRNHMPVAHRHRDQAGKSTKADVWDGHTSVMWQTNKGKGRHGEKDVEGQGESQKRKAPKHTRGDEETPQERDSKT

SEQ ID NO: 972958 - protein, 380 aa, Homo sapiens
LEDVLRGCSATGILYQYPGPAPDVIPLLSCEHGWCVSSAGGCLDEANTTDLAPRLPVSFSPDLCPACELMCLRADVAEMAELDARISASAVSKVVSSPRAVAPQPLHTLLPGSSRMTCLFTCHEDCQTSFFRIFGQQPNLARHQRLSPPSLGKEYCVLEFSQDSQQLLPAWVIYLSCTSELDRLLSALNSGWKSIYQVDSPTQAIQEASNKQTIRRMPCSLIHRPGSGAKVSAAAEPRDDPGAACRAGGVPGVLGIDRRHLAGTHGKAVVPCCQEAIRPTLSLVVGETPQDVGIKHRVPPSRSPSNMCQRPLDILATTETHDDCGQETQPICAMRAPTLMPQQRTTPRAARHSEGHTRRPTPYCGRCKHAIINRSRRDNM

SEQ ID NO: 972959 - protein, 99 aa, Homo sapiens
SAAGNCVRVVDAVRELAHALLPVSCAACMSVSLWVRALNVRSSVSSCSMLAEMCLMGSIVVGRVTLRCGAVPVTEPLMLCGVLYCTFVSEHGTIYHGIA

SEQ ID NO: 972960 - protein, 285 aa, Homo sapiens
MRVKSCHLQAGQCENQIGAKFVEVISDEHGIDPRGTYQVGQTICSWNCYHLCATMYGPPAGTVQCPRVACSLDLLDARPSMDVRAARWPFGQIFLAGQLRFRSEWVAGNNCARVRYTEGAGAGVLRVLGMFVEDKGSADAPLVDCLTGVSMVIAIPGVDRGAGVLGLGNHVTSSKQRSGKEVPKTGISEARLRCCIAFMTQKMSLKQLVEPLLSPPYSVHLARKKHQDESYCIARPKLLYTFCQNLKAEQPTYGDMNTWGLLHEWVTTCLAFQAIKCGLATRCND

SEQ ID NO: 972961 - protein, 200 aa, Homo sapiens
KAIGTMCRVDRLYLLTRQFYSQVSTLEKGCQRSENDKRAKVHGSLTPKKLETAQMSPVDGAGKLDMKPVKESPLGSAAWMKQRGGGLKKQDTGGCLIPRATLNLGRTLMAAQGAVLAGVGSCQQVGALGAFQGLEMCPVRPFPPGRAAPSSICPGDPHPLAAPTQGISRALTQGTAQKPRVHRAPQLCASPSHGQGDSGR

SEQ ID NO: 972962 - protein, 78 aa, Homo sapiens
RVRSVSGACSMSVPAFHPTIQSKHEIAGCLSFRGFIWKSKASVQDLEAELWQGGTSMLDFDLKLLKALWMMSLREMEG

SEQ ID NO: 972963 - protein, 417 aa, Homo sapiens
IKPREARVGLSVALGRFRGDVMAFTLTVTLGIMTSRADHHAQRPGPSTPKPRTFGRMPRRKQHPTNCAGSGPWVCCKIPGIILGGHPRIPFSLPTPLRPHTEETPTQASIARGWEGTGRMVGQGKHPSQRETPGPTGYHRPRQNRTGRRQKKQREERGNTTREEPREKKPKQKEVRQSGDKIKSKHGRRTTKTKGKHTRKEDKRKDAQGNDVEHKSKSPDANTEKESQAEDTKGPKDTTQKATQTPKPGDGQERNDNRNTSKDHCTNGNREQGKKKRKKRKHTEKQERKPQKKRHQPELKTETAEKEKNQKRPQKRKKEQQKKTKKEYKDQKREVQTEREEDPAQKQKWNDDNTEEKKGETKGRGQHCKGEQQTKERKQRNKGARREKKTREDRGKGSKREKTNNLDTQNEKAERRK

SEQ ID NO: 972964 - protein, 227 aa, Homo sapiens
MRCACCECGDKGKCSRLLAVGQETLRRLEPPPAVCMNVGWACVMLHDANDASGGLDMESGAAGGVMAAGCGRRWPAGVPVLRLPGWPLGDSLSWVASQEDTNLHPASLCIPVMCSVDKEQKLSKRENGPMVAVLETLLLRGVLTQSWLRCTDARPRILITRETCFGSDVKPFEESCLGSSEKQIVSEDKRAFYLESRVELEKSLTQMDDVLKALHMKLWEAESKLSF

SEQ ID NO: 972965 - protein, 465 aa, Homo sapiens
MHSTSPGRAHLPEFSHRWKPLVEQINDMNITTRDTVSDPWKITNGPPNSGPPHQVWRLSSSAYPPLKRLPKGDNQITQSCGRQLNTQKKLSCAPTLFQHPGPDLATNKRHNMRRCGANLTIPSLSSGESSYKHRAAGRTQNTHKPQRCFTQLCAPSVYTGLFVSHTNNKVDTVRSPMGGPNYHWITITLHLSIKLISLEGHKSTHGGTPSLTTITLGHPHLRLKYTTSPRATPLGPQHPYNMACGQYPHPRGSTTADAPDHHDLPTEEHGKRTIKTSTADREPQQWNRNKQRPRWAHTCRRQHKQQNPTAVHTADQLTQRPTAATQKPPKIEATIIKNKGSNERHTGEPHPKPIPLTAPNKTAHNNTTDTNPHIRTYMTPCAKALKIPRGRTTTMKGTIKRQHSQHRIIYKHTERQNTRNSRSTQQARHTRDSTARHNTRTNNTDIVENFLLCSRFLNQRAEIST

SEQ ID NO: 972966 - protein, 136 aa, Homo sapiens
MAQLCPTQGHQCVWSLRDLCGVRRILAEIQTGLGIGLNSHKRVPSRDRKRKEGIHLRSACAPKVLAKDNQVLHKLSDGGGGQRTSSRRRRATNTEEAKNEQARTQGRKTNKREDKNRVGPLNQTRGKREACESEPK

SEQ ID NO: 972967 - protein, 301 aa, Homo sapiens
MDDDIDTRLRSVDKRLLVMCKAGFAGDDAPRAVFPSIVAAPQAPGRRWWCMGQNGFLCRCDEAQSKRGILTREVPHLSTGIVTPTWDDIGDKSGTKPSTMSSVWLPEEHPVLLTECPLNPKATAEKMTQIMFETFNTPAMYVAIQAVLSLYDSGVPLGIADATPGDEGHPHCAHLQRGMPSTHAIHAIGLAGRDIDDLLMQILPERGTVHNRATGNRADIRRSVLRRLDCSRDARCFHSPGQSRLLTAGTTNERKNESVGLFTPLADQDQKTYPYVMNDMTTVCADGPYDRHQNNTNEHTQ

SEQ ID NO: 972968 - protein, 103 aa, Homo sapiens
MIIGGPYPACISAETYGHSQSSTGTLDVFPLLVMWEDVGVRIRRIRLDALRVWSFPRITAKFEMVSGGWEHPGFREGREGPDKKARSTGGYENGGLLSSSFFY

SEQ ID NO: 972969 - protein, 500 aa, Homo sapiens
EEDFVSNVNTLVLIVIWRFFISQTRHKHYGRSYRHPGYAEEELQERAALFTSMCTTHQRIPAPSDGVVVRHTVYLTPTERSDKHTHNVMPDVPVSPTSICGHNIYHLSSGGLSRITCSRAKLTSPYFKNVLYRGRAYTQCHTPQDAGVNVTKQSRTTKTPPPQLPVAQSVYHSSAWASPVCRLAPHRPTPLFLACNMIRSPINMWAPHIIPPTCQKTSYNQVEPTVLTKRPIGVAHNNHIVSGAPQLCVNTTDGHHRRVADTTHTLVNQDYSKKVQTLRDRTYTKTNLCWQTTINLGRPDPHNYLYHGHLLPTTDDTYVAPYNTERTPPRQHNKPAPTQYHQRIATSLPPLRPAYTNDAPPPARGETTKQTPAQHRPLSGDASINNDEPLAHATTHHPPRRGGATTKTDTGVTWGEHHSAPPPGLDQPITETHDCPTNRTIYEQATNTHEHDVTKNHKASRHPRTRSHTTAGWRQHPHRGADTPTQTTDTPLTYKLLHAH

SEQ ID NO: 972970 - protein, 104 aa, Homo sapiens
STEPRLCLILPAVHTQAPCSPLDDDISLRYVSDNCAPGHVQWPGVLLVRLMPPLCAVFPLHLLGAPQGTMWLLICVVCNGVMKEIPYVGLTDVPKKQEEASITH

SEQ ID NO: 972971 - protein, 286 aa, Homo sapiens
MRAWVSVPRYIAGRYRRGGTNVTCGCWSVAKNCHCSVPETCDVGGKLVNLGLSAGQHYGDVLDTTAAYRQRRNMKPSYPTTGVQGTCRPPLTYWDERFYPSRRRTQDNDSTTRGTGHLTWQPGCGADYHYDYYINVPTGTHGCLAEPMGAGRATHSRETPGRCRPTADTGTAEGALTSGDYLRVDTESKNLHTSTGIDTTTKAQNHGHATLNTTGATHGKGAQHTELNRHTTRHPNRNPWTKHPKSTDKPLTKTTPQPHGEGLDRTNRETNPSATGQRNQDTSIDR

SEQ ID NO: 972972 - protein, 322 aa, Homo sapiens
MSDRKQGATMRSIDAPQNPVRPEGQGSAMPYDSKCSSSHLYHGRHLDDDGGMAIQASYTCTVNFSNHLGKKISTVNWGANWTLLAQCEHQDWDNHLVTRGKLTREDNYRHRHYENRGSTSEWARRFTEAHLITCHTTHQQATEHHAPQQSTNRQKHHGDTKRRLSPCYARHVAQPHELRQRHPSPRDTQHNDATRLAERQTRHTRDNGTQTQTCPGLRRHHTPTMPPPGTNALRALTDKDNTQRTRPYTEYPPHTSHEPSKTNLNKNHPERHRSKTHTPHINRHRGDPSTGKPTLKPTTETAQTGAPQRSQTIHRQYNHNDR

SEQ ID NO: 972973 - protein, 356 aa, Homo sapiens
CWRCLGGTRLRKRRDSSIPSCILHTNLDWVGTRLDDDCAGGRGDDDNGSPVSLSSSHSCIPVCISDRYNRIFWHKSHTTHRPTKTIQHAMRSRQPAQGPRSAQHAGHTAKAQAKPRDVKHPHQATVRHDSSGTAEQAQTGKKARKPAKEPNRKNYASHRKSIQTLEGRTICTTTKQLNTNKSQQRKENQHDTAWQRTMGTLPIANNPCPPGRQHRGTNQYLQPEGTRSTPETTVKTTTAPQGTNYLTVRDSSSNNLGAQDRRHAYHTSLIGTDLADTTPHGGKCEGLTSRGTQGPGTKASQNEGDTTRTQAHSQERMKTTDNDGKRGTQTPYTYNNPEPPRHQTARQHRHSYIRVT

SEQ ID NO: 972974 - protein, 255 aa, Homo sapiens
QTSIGPLSLATLPRRIPSRGPEAHVSLRGRKGERLERSSTTNLPCPGGPRSYPRHLCTALAFLASPTPFGSLGTRHSTLPSGELQSPGSDELTWQLPAQHHWRTLRAAAQSILAAGAPEGAIAFRASSACCGLEVKLGGPWMLLLELTLLCSLVPICVLRRPRELTHEGSAFPSEKHLSLAHLPRRGAPSPATRLLDLLPDYLGDIHERPARLDVTPPRYHCTRSYRTCASYLDPVTDTESTAPKPSRHDGHIAP

SEQ ID NO: 972975 - protein, 212 aa, Homo sapiens
MTGLPVKLHGKCDEVMRVPCVLVMRAVTVGSRCAEAERMAPPGDRGAPLARTPSKGAGLAGADKTQQKWKKVTYITCSMKNSWHFADGSVTVKVVFAPTGLGRTELLGDDIFTCDILTHLSLRKPLLLGCTLIRLAIEDTAIGLCVMSGSDFWKRELGFQARLEVRAGLSRSTGSSGHVYYIRKGLRLCGAKGQPSTYSTWGTNNAWHERAT

SEQ ID NO: 972976 - protein, 102 aa, Homo sapiens
SGSIQDKRDPFRSSCPDLIAGIQHGCQDIGARSLSVLRSMMCSGELKLEKRTMSAQIVEVVSMAVLALTVKAAVREEQLVEAEVVEGMQPRVSDLWAQRIPP

SEQ ID NO: 972977 - protein, 276 aa, Homo sapiens
MEWAASELRERTGKRKCARGSVYTQYKWVLTRHRGPTDGDGCFQVGRITPVVRDKRFKRERRESTLENKMMGGSTHMILNILQGEFKREQCEFVNPGESLIMLKNVCVTNIYLVKGTKARIQAVAIRSRHPKTYLRKTTQLTIVVRFKTNLGGERAKNPFSLDFAKEGENGSCNNNKQHASNAATAVYAHRTIHADSGHSQANQHWHTRNGRKNMATRLTKYGSTTRWRWTEKTATWTMESVPNSETEKISIRIRSQTREYATSTQRREKQQHAEK

SEQ ID NO: 972978 - protein, 286 aa, Homo sapiens
MDDDIARARRRRYELAACARGGFSGLMMALRAVCRSIVGRPKQQGDDGGQWGQKDSIWWADEARRAREASVMRMEVTPRSEAGDSVDATWERHGENRGTDTFYNELTVAPEEHPRDCLTEVAPEAQGPSREQDDSRSMFEDFKQPQSMRCYPGLCYPVVSASGRTHWASLMGLRLTVVTTTCEAIYRGVCLSPNAILLLMGPGVGGNLTDYLNEDPSPKRGVTVFHPHGRAGQSCVNIRAKAGLRRAWVSSTRWHACFHLLPGESPSVAEASITLGNAVPSRGLPS

SEQ ID NO: 972979 - protein, 311 aa, Homo sapiens
MRTAEALRTEPAEQPMWCRAGENCGKEIVPRMISTDGSTELEDPVEMFADPFLGLNCVSSVSPVLQDARQKFQYLFWLKTTVKLDELVKKIGRSCGRLQALRGRHGGMAEVRRHAGSLTQSRIARNFQRGHRGAPSRHRRPISPGPSRRGCVEDDMDGIGVRLRLEGDACKSATQRVIDAEQTRTGSELVHQEDGGRYKCARGEWDGWRRRLREHHKVQAYLTRQDYVRVEHVAPTGRLGANDLERRHVAEPGCQRTDGAQAGPDGVEGAHPGRGTAGLAGATPASVVAHAAQNRDTGEPNRHTAGECCSR

SEQ ID NO: 972980 - protein, 135 aa, Homo sapiens
MKKNKVHRDRPRQRVDGDPGIGNISQRSTPVSVATITFLGSSLLLFCLLYSPLFLLLNTLVANPGSFIAVHILFSASCCRCPPIEDIRFKDGSANARPEQAWADQEEKEAGIKKAPYGEEIPVEVITPRHVLLKQ

SEQ ID NO: 972981 - protein, 133 aa, Homo sapiens
VHCRPRCLSEPTDRKRHPARYAAEEGGDRCAVYRVEHGSREELIRRDHRIRVLPRSIERVFAEQSVNFELRSESRVWVRNNRWVMKADCDLSIANVETPERLRQTGRPDEECQTRMTSARQRRQESEAIVDIV

SEQ ID NO: 972982 - protein, 311 aa, Homo sapiens
GAGVPGLAPRRTGAVRRAASDARGAAVPGADPTHPPLRVRKDELRRAPGTHVGIRHAVRCYSADEMNSRLRDNAKRVFWKGVSGGVAVVYQGILANATGAVSPMGVKNSGMPMDPETIFGTSLGFSTSRKTGTWAQVYGVPRGGSLVQKEVDLESDLVQDRHVDQVRMSDLKQSRSDPEEHDVISRVRLCEIPNINLPPWIGELPSNGQGPSDQCLVWVNTELVPDQACSKKTRERPLGPPAVGFHAIAQVRTGSLSLIAANHGRLTTGELNRPLGACPYFPDLQSKPEITDQVDQTFKAKIQDGKALTSV

SEQ ID NO: 972983 - protein, 279 aa, Homo sapiens
MAYVIVDRRVSVDAESALTRLSPTAIPSSLAELHRITQSKRSSDVRSLRPGSPLCLRHMFSCSCPRRPHVPARQCGVAFIALQSPHGRRESLPGHKWLSHVCVCVTELSVMDHDRAACLTRDGAMEEPAWLIEKDLALLLLQMPEVCGPSETRRHFPRSSSSAKSGAVWRGKTCLDGGRARSMQGGTSAARWSSDVGGWAGRTKLSTLWDILDHLRATKVVWHILRGQELCPHGMKLTWLDQFLKGEPEPSKWKEPSPRGRTDRGEVQPRRPRQTEEHP

SEQ ID NO: 972984 - protein, 294 aa, Homo sapiens
GTAWTAGSIERHPSFDYQTAASGGARPGPSAAQRRRLRGKPRSAATVGPAGPDASAAVPAHHICPACLRVDGQGQMSESEHRTVASPAPLGASKAGIQVTGDCRKQGPGARPLRSETSGCVSLGLALWSGDDQVMESQTEMCQNNPNEEPSGARNQIRGKGYTYSYMGLAWHRNPPVQHIHSTHIHEDRDNPYRGVYGTSQIQEVGMNGKVAIGRGQGGITSRQKGKGHIARSAEPKTPLCWRTPNERWALVLDFRFQAVRRWKDKEVIQYPGVKLANKRFCLPGLTTKPVNHE

SEQ ID NO: 972985 - protein, 323 aa, Homo sapiens
RPGAVMSHGPKQPGAGGVPGGREGSGPAWGLRGDCQARARRGSTRGREGVPSRRSRMKKRGMAHGQEAEEDSAELGPRGYRVTGYVQPSVNERREQSPHAPAGSVLSRDHQGCWAPEWSKRAGNVKEQRYLDEGEEREAVKYMRGAGSVPAVCKPSKMCTEKDPGRRRSRKKSRALVLMNTSPEWTPRVWTAMGSPLRCSIFTEEFLDPKKPRVRGDSAALGKNECAAFEGGRTGVLQRHTQSMSEAREREQELGLEELEEAELRRPGVPGSPRLPMRADGEPRGLGIWRSGLGRKGNGVDGRRHGGPLAWPPQGRGACLFSE

SEQ ID NO: 972986 - protein, 405 aa, Homo sapiens
LPGNILLDLNSLACGLVATQPWTLNTLDDVPSTCDGRRMAPDRYRRFVLTHLGQQSPATHTCACHFHTLRFYTVPTAALPNHASVVAPPDQGTVLSAHCGEHRQTRRGQAGPYPISPARVHSCYAMQSCGNFHPSQATHAPHTHCTSSTQTLPQPLGIHSKFSNRFIRPPTQAPIHNPWAQGTKSHNSTHWAQAMRTRCHPFATRHSHTVAWMGHQYSGTHRKNTSNGPQERNIGTPNTQNYTHVALAIVPHPWTYTPFRWTTQHHPPDEHNHTNHNHHRPEHTPQKAQPKEQTEHAELTNHDAAPNEPQPWDTPTWDNHKPSGTKPTVPPPESRRVIRLLSRKNTAGAQTPHTRHAGDSRHRKHNAQAATTRQLQTRKTRRQPDPPDAHYNQTRTTNQWTNSLR

SEQ ID NO: 972987 - protein, 110 aa, Homo sapiens
MRSLCTHNLEFDCGMSQRTDVHKNRSIPAFSRKRQTHRFASFARRKRSRESEYRGTQLSLRKSTDTRCVANYHSYTKTLDPIRFARPEDHPQLAIQPRDNGGGTRKIALT

SEQ ID NO: 972988 - protein, 204 aa, Homo sapiens
DGDLSGFQHLQQAELGRMRHFPVSVPDMSWRKPIIIRNAPTEQVMGRHMQHSVPGPFTVLFSMGALAAPRMRSRRKHCTVCPTPWQINCKTCRVSTMPLSDPRRMAMTQIQDSVTQALVLINDEHANSQHVTHKQYYYTSNMAAERSTTSDAHPRTSYGMLGETTPHLTQLHMLAQHWPGTHTLHTTRELDHHNLAPFWVAKES

SEQ ID NO: 972989 - protein, 178 aa, Homo sapiens
ELSATSGSDYGTQTRVSLDAPGQYELVHTLVAHQRQRGETIPEEDLEVQMSTTEDAAHVLAGTGGNRCTMLSYREVDVCGSHHAKASGPQWMFWVDLEENGSLGLLNKPMQAPTKMNSSERDDAKSFRKSDKYFSFHCILIQRCRQLGSEIHRLLKPGDMESERSRAFNRQRNRPGHI

SEQ ID NO: 972990 - protein, 98 aa, Homo sapiens
DPLISSSPPWISRIYQPCIPMSVCMIFQAPSLAVLTGLSRISPHGTDVLESFARLLLTYRLQIRSLIHSGPTHHFPCRSVTMHGWTHGLSVDAPGANG

SEQ ID NO: 972991 - protein, 191 aa, Homo sapiens
SVHSEVGSGTARSGSCAHADVSVHAVHMLMVLCMLAQLMVRQLACEVCAAVHSLRSAAGSEVGMLLRAVLFRGLCIMCDHGHDGELVARRCNAGAQTRKDMTKVEFETSEAVDVSPTFDTMGLREDLLAWASTLTVFEKPSAIQQRAIKQIIHRREHVIRSSLSPAQETNSQLQYLSPPVVWIFRFVKLKL

SEQ ID NO: 972992 - protein, 248 aa, Homo sapiens
GRRCWGCFPLGPTARLVRPGSSAVWPGGRGRGFGAAAREVDPLFPSWAGFAHVRGVSRSEMVYLGVSWRPLVHARSRGRLVAVLLVSAGVVPHAGILAACSRLRLVGPPLWRPSSLLATAGNLPAGRPPPRRARASPCVYHQVSLRASACTLFRRHLPAREISNLSCGLALRRAPHSLCSAPQFVWGGNSRGRCTALVFSPLGGSAAFSVAVMGCDTCCLMSSHSRRARSLASTAVTAKVVLLRRPQQ

SEQ ID NO: 972993 - protein, 154 aa, Homo sapiens
GADGLVDLGTRGIYGDLVSARASILLGNSFARRDEITVMRFETLAAVAKRIVGRYRTRYHEERACVYVDRQAIAKEIVSIRRYTAQCVRYAMVDIAYSIRVVLLFDAKGPHVRSSAKTWGASRQWSTTNSNDSMTHDFAGDATVTCRDQRKSGS

SEQ ID NO: 972994 - protein, 276 aa, Homo sapiens
PTNLLNYNIHSHRTKSYFISSSKAHLSPPGAYHHPDEAKPSQKAVNAKATIAFLFYTHSRLPSPDSSDYIYTHNTARLTVNILDILHSSAGPKNYRNSVSPTTYEYGAESYTIDLYSERYLLLTDCHFMSSARARCRSPGIAGSIVLAAVLLKLGGYGIIRLTLMLKPLTKHIADPLLVLSLMRHNYEQAPSAVREERPKNRSWHNSSNQPHEAWLVNRPFSFQNPPESLHRGQVILIIRQGLQSHYILLGDSNISIKSRSKTFLRIQSIQNRFGD

SEQ ID NO: 972995 - protein, 185 aa, Homo sapiens
MTGTNAGPRHQIDTRHTHDNPHHADTTQTARTTHAAHTTERPHQPTQSHRDNRREENTPTYRHTTDAHTRGTGNERRRRQAAQTTNDPQQPPPEPPHSTPLSHRAHSAATRQHTDRHNTPNSAEHPADTASHSRAPPTNPQNARDDNGDQRQTTDSHGTPHNSTTPADQAHPATSHRTMTRRDSE

SEQ ID NO: 972996 - protein, 123 aa, Homo sapiens
RREPGWWGAGRSWPCLCLAWRLQSAAGLLPCCLANCPELLAECRGRLSGALHLGRAALPWLSLCPPCMCNAVCCFGPSADSLSLLAFGKPLVGCWLWPCGCACSPGQVQGLWDFPPISPPPFW

SEQ ID NO: 972997 - protein, 283 aa, Homo sapiens
NRFVVAVCRRGGLCVADPGGRFSHVPWGACVHVRLGIFPGAVGPPAVLGVFRGPRPALRVVLQPRWGPIPRCGYPTPRVCVSSNTGCACRPVSPRTYLVARGLSSAAAYLSALGVHPPPRYSLPDSPCFSVWPLRIYLHHQHHYHAAPRFVSRPFLNAGQFWPGTTWRHIPRRVPPTPLKRVDAAGRIYRWSTGWFDDLRPDSTLVEPHFSYPRIPHNYCWAMFAQFPVNPTAIPMSADAHRMNLPLDHPEAPIFPPDPDDYVPLDTPPLGDHGPQTSPLQKN

SEQ ID NO: 972998 - protein, 131 aa, Homo sapiens
MTRNARAVYEIQLTVPCVCQSVENWTTVQISPLELISTDGRLTLACPCMVVLHDPFLKPQLVVCLGFPWLQDARQKFQLCSMLTWKGESGLNLVEEDLAHAVEESKNVLVLHRLVVRRLRWKLRKHEEFQR

SEQ ID NO: 972999 - protein, 284 aa, Homo sapiens
EVGFRRLIITNLSELKEHVLTHRKEAKNLEKILHEWLTRITSVEKSLNDLMELESTLQELREANTSFNSQIRSSRRKDINDEDQINEIKREDKIREKRVKRNEQNLQEIWDYVKRPNLHLTGVPESDRENGTKLENTLQDIMQENFPNLARQANISNSGNTENTTEILLKKSNPRHIIIRFTKVEMNGHNLVYGSERERWVTHKGKAIRLTVDLSEKPTTEKVGQYHILKQESQLEFYQHYVLGGTLLFTTPCGDWPQPLRLGGTRCTVPATLDSDTPGHHKGQ

SEQ ID NO: 973000 - protein, 261 aa, Homo sapiens
MLAPCPFLKCLMDRGLARCGAASYSLTPYTHFDGSWSGTCPYQLFDAIPQLVLPLDIWVCHVESQTHFGQVTPASGGPRVAWKARAFWHNTILSPVNRPRRPGVPRTPKTLDFQKVHAEWHPALDPRENVAHQIPSGELVPCEPTGGGDWRAPSKDGIETNARRDPPQGHEDAPGGKYCSKHHLQDRPFRQSPWEPPKLGSCDPRPKKGPRREHQALPHGSRYLAPPRASTQRARKPRRNGGDEGPTGSSTHGPTWTSDNH

SEQ ID NO: 973001 - protein, 259 aa, Homo sapiens
MATRSMVGVVVSDVVAYMAAPGPGAAPWSCERFLCGSPLRGPLSVTVPPESLRGPRPLFIPTGGEDKSLAPGERLAYPKEPTRTRVVVPRAASPGGVRASMSPPCRSPEVRRTLGVAVAARAWVLNLGGITQVCFAGPRRAEGDLVPHQGRALPRWSLRGRLLDPTGLGPAPGCPAPALDPGPWFTSPLIVLSKYSALIFTPGKETRCNLPMFGSYANTRLPFVTPLNINIVRSNAPLFKSTHSVTHNWGEESTKSTCD

SEQ ID NO: 973002 - protein, 168 aa, Homo sapiens
SLQVLARLWLLRCYPGAIGKSVEDGSCHYCSSGAELVVEVLNWLRRINHSSRIPVRADGFFLRQWGLRCCLPVAVSVYDGDGMTCWLPCVVSMSGRLSSTWAASLVSDIQTPRPGDVDIDVLGAEIAGSRPERRGVEVGASGGRRGVEGGYPGQRPGSGNYYLCRGLA

SEQ ID NO: 973003 - protein, 46 aa, Homo sapiens
MAPVEAPKEGGAQQAQERCRPGDKTGEHAKGGEEPQMWRHRTGGKQ

SEQ ID NO: 973004 - protein, 69 aa, Homo sapiens
RAEMSRSENLGCARALLSLTGLQAIQRTPKMQVCLNVILADRMATVGIVLDISVCVMGFNPIPTIDTLT

SEQ ID NO: 973005 - protein, 291 aa, Homo sapiens
YGRRLRFLLAPRQRCRRLRSLLTLWHRCLTPAGVGQPVSLWPCPVGPSSGQRSRPRVVAAEPSASGTMPPRALLTLRPRLTGRLASSQDSAAAPVRAFLAPCQYGQPRRSLLGSQPPRWSLLAPGSPAVSGSHRADRATSRLHSWARDGEASRSSRSWARSSLPTQAALMGPEQPASPCGAHGPQQALKPSVAPHSQIAFTPGAAGHPAALLVLLCSRGVLMDLVRPYSRSRYWAWASCGPAVRGPTCSRMQRHLYLSCAEPPLVRPGVAGARTGSSGSWNELRGLEGRGR

SEQ ID NO: 973006 - protein, 364 aa, Homo sapiens
VAWPQPAEEQERAEAGWAMPWSVPAVLPSFVDLVLVLLGHLLPSCSDLWHLTCVACLSSMLLCAACYLVWLAAWCLAAACVPGLRVLLACSSALLWLRADPALCLHGVAGPLRPLALAAAAISVLLGVTLYMVAVAVQACCACGACLVVVHAWEDAALEFGLVAYAGLPSPLDIRLCCVLFDDRSWETCSDRSLLVLAIIAAELAWAEVLPVGWHLHILPWASLWALLGYHGPCALAPLQAVLGAWAPPVIYFLVGLVCCGPSLVVACLGSSPYCGLASWACGGLVPGAGVRAELLRDPASGWFSGWRVPPPYIPGYRGWAGPRVAYICRPLVSIWARVEAAEEAPGLETGSGGVTRPYAHERR

SEQ ID NO: 973007 - protein, 338 aa, Homo sapiens
WRRAWDSADPAPPDPHVLNEPDVGLMAVAPDSTACALWPCNRHDLLACCAILAKQGLSKLPAMSHCAIIYLVPYGGMQSTFARHPTQTYVLTLTHECRDVMDVKCARPTLPQESGTRPGHDGLCLTSYADRRWERNRPGHEPPGHPALPRTTASTRAAQTTHPRHGNGDSTHQKTGANPGPDARTQPVQTPTMTTTEDAAKHGRAESPGKTTHKTKPDHTNKNDGPSKWNGNQTTERAGPPQEPWDKGDTRNSDRNGRPRGKKTEAHLPRKPRRPAARTDAHPVRTSNIKGPQTAPRGQERRPGERARGTNGAKRETTGNRQPPQQPRHNTRATEPTD

SEQ ID NO: 973008 - protein, 200 aa, Homo sapiens
MGLRPAVVTWYCKNKPYPKSRFCRGVPDAKIRIFDLGWKKAKVDEFRFVATWCHDEYVKQACPLKALDVLALNLCQEVHGKNVWLAKMAFHILGAAPPLPLSSCITQDVCPVLGVLDSAPNTRACRGAFVKAPVALVGHVFTIVCQVIMSILHHCCRHTEHVIDGPVHGHKFNVSLADRRSTLSTECGASPIVSICLIEF

SEQ ID NO: 973009 - protein, 112 aa, Homo sapiens
EVGFRRLIITNLSELKEHVLTHRKEAKNLEKILHEWLTRITSVEKSLNDLMELESTLQELREANTSFNSRFDQAEERISMIEDQINEIKREDKIREKRVKRKNKTSKKYGTT

SEQ ID NO: 973010 - protein, 164 aa, Homo sapiens
MRQGWSWGDAFTFLPNTSLVMYTPRYRHHPHITYGYGEQSPPEFWCLNAQHITHPLCVLVSLCGTKCRQQYVWSQVCGTKCEGQKGSWGVTLSIRGGVQMGSHNNDEICFRKEKRTCGGEGLYVGARKGCEEHPGRSGDETAAKHQLTKGVFNNTWRGTRPEER

SEQ ID NO: 973011 - protein, 328 aa, Homo sapiens
APVPACSCSNSYRSVDGRVKNMTWRRAPGPKLKTIQQGRLRACRERVDRERDLPDDSTQSYPACRRAASVDGSLHSLCLLYSEVSCLRHLRLLYRLDRVSRTGLTPAVTFEWGHAAILTRGGSDEHVLWMKADLNHSEEVRADVPSRLFSGEIAPQKKRGSWACTRLPRCGRELWRLVSLMLDGVESSLTLDVQAALVLDSLFSFVVFASTTLHSSPRKERMVQKRGPAFPTWEPAAHRGHGRDLVPVFGPALVWCCMSVCHSRPTRSLVMSKVWAPVGKAQDSRQFKSSGWSGVVVGLWWLSCFTGSGRGSPGRGLDSCWRTPKEQS

SEQ ID NO: 973012 - protein, 114 aa, Homo sapiens
LGSASISVALFSPSWYSPPNLGFLHARVASCSTSLSLILVSTSSPGKFPFSRLGLPTRASDFHPSFSLLASDYPPRIPTRHRRATNMLPSPGLGTSSHSPLRHRLGLQLGSVHQ

SEQ ID NO: 973013 - protein, 118 aa, Homo sapiens
MSLVSVGVVSLSPPFSWGLRFSSHRSYFRFLLAYRGTSLLLPITHSPLFRSHSTPILRTASRTLLLYTYQSGALYLDTPQTCPPITLNTPFYHTYIHYSPPYSEPPLQTKPPVFAPTT

SEQ ID NO: 973014 - protein, 57 aa, Homo sapiens
MTRTLTIPRKRQNTLGTEEETTSECRPTTQSRATASPTRQHKPPHGAATQTSTQRQA

SEQ ID NO: 973015 - protein, 178 aa, Homo sapiens
MPKASHARTDSESDLPEERWEILSGSHSFTGKCSWLWLYQKYLSNGSSVWVCLEEGWGHHCTRDIPGSVYSVIPLYKDTLKASSMSVNKSESIRSPHSQSRQQTSAPSNDHGQRDRPQLISQNQQHGITSVQARHPRIASPPSDKRRLTNPVEVIDYVETPEKKIRNYSEQAKPQTTI

SEQ ID NO: 973016 - protein, 263 aa, Homo sapiens
MGDTNDTRLSTRGLLEVEREEWQTNFGNKRSLCPRVLVGQSLCPSVFPVGGGAVIPGSLVCAPRGPRGEPPVAVAWVSVPPLLCSPTGRNRKEKCRQQKAGSESLPGKDSIPDVSINPGGAHVGAPFIRGSTTILAGASPPVPHSHTPLYNTTPVQQQKRQHHNTPRTTRSARERQHTQAHEERRDNTEREKKENTARPTGGKTNAKAHPIENRENIKASNTTSGSNNPELKKSTTPHKRRATQTKYTNVEKTRPAVSTLRNT

SEQ ID NO: 973017 - protein, 141 aa, Homo sapiens
MCSVLLSSEHSFFYWITDHSARFHFFPFFVRTFGPHRVFPGPLIPYIKYTTIYNYYYAVRIAPRVSYTHGAGSDGLVTTPALYWTYCPREDSSAVPNSFPDISVGTNGLRTARTWSPPHIESTAASHTTENLTSRRNPPEC

SEQ ID NO: 973018 - protein, 73 aa, Homo sapiens
MLATRTAKPRSDFVLHRAGRGSPRRRGVAVSLLLRGCVGSWWALSGGAGAAGVRTSGVGGLSFHCCGGCPPLL

SEQ ID NO: 973019 - protein, 194 aa, Homo sapiens
MELHTFGVRKSFSPNTRSLEAIFVPGDAQLLFLIIHLILVVAADNPCNTQNSQFTGFPHKPFVSLVNELDSVIFSHDLKPDICLVEAPHYMGGRIPRPNSSNIAERVADVILNKKEMWVSEHLLITGTLSTRVQYHYYCGIWRVNSVPEALPPLYVVREHKMCSLPVLYIRPATAGGGDARARLPSVVPAQVPC

SEQ ID NO: 973020 - protein, 400 aa, Homo sapiens
FTIQHHGWKTWRPKSMNYNDLTLFDSRFPKQNQTRNCWQNYLDFHLTAQNGNDRYSEAISLCANGYQRVYQIPTDPTYLGYTELVHAANCGLKRHANPAVHSILDTEAAISTYPSSYLRSRILTQRTSVASCERTLGYPWVIHPNATWDPLNIHCTYTKASSRATRYKKGTTHGMTNTHTTNHHNPTTAAHTSAPGKAAPTHTQPAQTRNHTRPHTHAPTDELRSRIHKSRNNPLRQRLTPDGNRPDTTSSSTHASCPFCLPSRQANNTDKYRTLTDLIDIYLGYSPLLATMTDHRPDSINLVARCDLRSSSPTDTIQSLSKSQLDRCPSAPVDPAALHTTEHTTTPRAPRYDVRSLSLVLRVRDTTSMAGARTYGRAPADHSISHFRSHDTHDISYETS

SEQ ID NO: 973021 - protein, 76 aa, Homo sapiens
QGAYLMLTERKILGYIPLRKGPTCRPLRANTTCADAIKLFTKEPLKTRTSTITLYISARLSSHHRSSTMNPPPHAQ

SEQ ID NO: 973022 - protein, 211 aa, Homo sapiens
MPTPPCSSAALLGRFGRPGPRWPPLSPSPAMDNYADLSGYRADTLLARYKSAHWACIRINSWLYEKKIFEVRDPEAAVIAPQLVRVSSYSFSDLNSTRGDADMYDLPKKEELLYQSKGYNDDYMTRATSPPGLMGRPSLPARPGPVPQSSDFNSHDADAFITRCMMTIYCLLLKRSAGKGHAHVKAGQCYQKITTVASCDSLQGAPWDLSY

SEQ ID NO: 973023 - protein, 69 aa, Homo sapiens
SPLAVSYSPQEPRTRLLLSLLWQDEACNAWVKEYHPGNYGNYGYASTWGIVPVNDQNHREVSLKAEKQQ

SEQ ID NO: 973024 - protein, 214 aa, Homo sapiens
MEGAGAKGVPGPRFLVKGEMAGPQIGEVGINCEKKARVTPGLKGTRGTRPREIKPGKKDAGPLGRNEQGPREDTIQDEITRWRKNNKNTGHTAGRKSSRTKKNNTIRSKGTATAEGRINQRGITEPEKATPHNQETATNRGQNSGQEWAKGKVVNGGSDDTEGKQEKGQHTTATNTRTTDERTGKETERQETQQTQDHQKREETKQHEKQENDA

SEQ ID NO: 973025 - protein, 201 aa, Homo sapiens
VRLGSGSLAALAWPRCDLLWHSACSYRRLVLLTSWVRARPLCGPRLVHPIQVAPSPVVQTPALSPGVGPLARLFRAHFPYPAMWATPRGDPQCSDIPPRWCVAPGDPSSLGGPKVHSATSVRNQGPTHCHCPKILVVIKYAFGPSGPWVINLFSLQGGVTNPPVFCPIRLRGLIYDARSGEQQWRLSSWVPAPAPWFALSP

SEQ ID NO: 973026 - protein, 126 aa, Homo sapiens
MILGRPDDAASNCRAKSTERLNFCAAIHAEIGDCRILSLVCMESFNETTRRDAQQGGSWVVKSYVVTRALVRPLTHPDGVVAHARKESAHYTRTIAYCVISAMPVASSDRAGEARQGTDDLLAGKS

SEQ ID NO: 973027 - protein, 595 aa, Homo sapiens
SVYGYPITLFVAAQATCINSKSSACMQAAQHNRHSTHSTAQQHTATHSKQQQQSGTAANPATLHSMLVPRMQAQHTQHRHACTKHSTAQHSTASQVHTQITHPHRQAQQDSQTNKPTSTNTGHPSTHPAHRIIHVTCRSRSRQANLSITRQLLDTQTRTGEHSNPNLGDHDAHANHTHPDTSTRAPDTRHKPTQDHLTTNKRRTQRKRVASRNQTYADSMGSTTQHPRTRQAHRATRNHHNSTYHTQLLAQLESQHQGQELQYHKITSEGNITTMQSQRARTIQSPPLAQVTSRCTPALPNYQRTGGAIEATEQTHRKQQQPPPTHLTHPYNNTTQIRTQIRTEHTPTKKPAQQSYRHRQLHLTQRRHKTPNRARTANNRAHRTHHTDDNTGNTHDTETTKKHNNDETKPNTTRPKYAHRHTNESSPTQHNTKTEKTHTNRHNPQTTRNQNEPNNRATQGTHKTKEPQRSQRQQGHSTTHRNHKETHKRNNTLSNMTTRNNKRNATEHTKKNKKTPEQHTEPPRKGPNKQPKNKTDTKRQQDRDKTTPQHQTHKQEKRRKKNTNGNTIDKTEHTEQQQKATIEQSTQSTHHTHRA

SEQ ID NO: 973028 - protein, 151 aa, Homo sapiens
STFSAGYPPSMRDPRHTPSRNVSRVLGCNNCRHLCHWCRDRYVVEYTFLLMPHAPASDARNPSVVPPLSCTTRSTNTTPRACAHAIAGHTQWVATIGESTPREEKSFLVSTNSIGSINPNPVPPKLDLRLPVQRDGDIASPKAESSFGKLY

SEQ ID NO: 973029 - protein, 226 aa, Homo sapiens
SLPLLLDLKMEKMLAGCFLLILDMIVLLPADANERSRGRSISRGRQLLGPNRRTALLEQFRVITMRRRAGFHHRQLSQGQGPMTYAKVKEFIGDIYAILGHLVLTVTRVGLSTYGATGHCMSSCLKTFKRKSDVERAVAEDAASVQRAAMTELAIQIMRLNDRILQKHKVSAGPMTRRMCHWPHKCIVRWHGRPPGLHDTGLCGKQQGTDTTQRDSRARKPSPSDI

SEQ ID NO: 973030 - protein, 219 aa, Homo sapiens
APIFCPTYNVCCPPRNSRVSPIPRVHLRLYNDVAAFKDATIPTRVSSGVSTTAVPAQVPPKLCSLWRMRAVFDPACWWAPGYVTLSPPWWDSHGSPETRLGGPVAQSWSRPQIGGSLIMRTALCAPPPLSERLPEQGLLPDASLCARRLVGCPHGLSTSRRFPECDLSSDGPLFLRVVARLHYVRHFSQLMRALSLIALLTREQAPLFLRHTRSFATAV

SEQ ID NO: 973031 - protein, 103 aa, Homo sapiens
LAPFFPPGMVFGPTKCVPPPFPSACGGETHPTLLRGMNFLSTVSPHSPHRRAFASALLACKNVRPHSSASPFIRSATPQNGAPPAAPNFRIPRGGPKFGGPPS

SEQ ID NO: 973032 - protein, 189 aa, Homo sapiens
LRRSGPCRCFSESGVVWQTEPMVRGVVTGAAPGGGGLSMLDALWLVEGTAVALLRLLLVLLAAGRFREIAWASAVDRSLGWSSRGVCRVHARDERSFLGLVNPSGWKERAMWIGDSGDPSYASEERAYGKVAGWVRGTSRLLAVNNCHKYLSGREPDGIARNPVIHRRGCGSRSCRENRIVPSERCAEY

SEQ ID NO: 973033 - protein, 109 aa, Homo sapiens
HTRDNKSCVSQNPPQRTGGKKMATPGSVLFSLQCPPHECLFSHLYPPFRRNQRAQPRVTLRPSPHELISWGISSPPSLSPRGNSSHGASRPTLHNCANYSLSPAPRHNK

SEQ ID NO: 973034 - protein, 135 aa, Homo sapiens
MRVAGAAKLVVAVAVFLLTFYVISQVFEIKMDASLGNLFARSAIGHSARSTKPPRYKCGISKACPEKHFVLKWQVEQPSGGTQNLLEDNVNELVLRIMSDRGINVALANWTKTGDVLDTKYLTLWGGDVAPFYEL

SEQ ID NO: 973035 - protein, 40 aa, Homo sapiens
MDEEHICGGNSFLDYWFSVVEQYVVFKKSASHASGAHIYK

SEQ ID NO: 973036 - protein, 132 aa, Homo sapiens
MWDVLMLTERKILGLYTTTPKGPNVVGPYGYYKPSVTRIKLFTKEPLKPATSTITLYITVPYLSSSPSLFYYEPPSRIAKPLVTLNLGLLFILGQLYGLGRVDVNPLDQGEHQSQNYAPDRSTGADSANNRI

SEQ ID NO: 973037 - protein, 174 aa, Homo sapiens
IARSSSQQQVQVRSGLVFVKSGEVQICQLTIGVELITDEVFADQIELPAQQRWWVVFGPGRRFRGKGLKQRFRLQYQWFTIIETLTLSLVSLSLVWSCSSEIVSSAPKPLERPDFSLLSPSDTGLPRVVFFTGVDVMSAHSPALLRLVFFGTVYGSLAGPTPALGYCPQSPHLE

SEQ ID NO: 973038 - protein, 222 aa, Homo sapiens
WVLVQNFIKVLKKRNIQDSQNTGGQGKTLVMAGGERSGSGALWAGRFWVFPPLSGSEQWGVGGDKIFIISWSVFTNKGLTGCVQAQRALLIGAPILITRFEVLHRGHENRYLTPVIRPQENTIVVLRHNPGGRAQRMRHRENDSPTQGHPRERETNTGANTKNLTGIKSPLGHREKDTHKNTKNLQKAWGAPNSSKEENTERKTQKEGPIRKREKPLHRNIG

SEQ ID NO: 973039 - protein, 179 aa, Homo sapiens
PRIKVVNVELPIEAQLGLAVQGSKTFVNHVIIAAQQGQACIMSINIGTTSNRQCMTKTCQLQESVYDVQTTTLCGPYENIYTVSRIINNFLTTPSQKTELTELYEATERTKHKQALMLTQLDRINAKLALQFKVRFQEAEERPKMFEELGQRLQHYAKMQLTSEIKDEKYNHIDESEMK

SEQ ID NO: 973040 - protein, 96 aa, Homo sapiens
KELNAETCTFHADIAQLSERGETNQETILHLLSCVKNNERAGKVTKEQVKAVMDRFTELCREVVRRLIDNGDGVPRRVKNLVVLSQAALGLYTITI

SEQ ID NO: 973041 - protein, 316 aa, Homo sapiens
RGGASRHDSEASPATWNCLLEFAGGPRHTLLPGNHQRRLQNSKDCCLFLPLEASSQMDTCQMPARALLYEVSVNPCQEVSPSQEAQGSGTPLGGAVCPLAELEHCAGRSAVSLGPEAGIFKSVKLHPQRFFPQVLCLREMGVYIYKPLLGLLPFFQRYPAREEESREDIWIQRFAGLWWVHQFRTFLVGFVYPVDGKTPYSSLSNGVIPPSPKLEWSGGLPTCWAGRRFRPGTLATAQGGDRDHNHAADESPPQGGKGWTRVSTSHWSDYTNVGAVSCRTTVNNRQYNEDIDNERLQQHVDTHKRPTDTTHEALRQ

SEQ ID NO: 973042 - protein, 190 aa, Homo sapiens
GATPPGFLGRAPELRHKDYGGRPRDGKNQERRARTHRAPNRRNKGEDIMGFPAPPPPRLRARWNLPRNALRAETSGHTYSGRLVKSFTNADPPPPRDTSDKTSTFARPPRERPHAAGKQKQGNAGQIILGRPPPLVEAHTHTAQIRRGLAAGDRATSFPPRRPHGVHQPDFVAQRTVRTHIATRGWRGKR

SEQ ID NO: 973043 - protein, 84 aa, Homo sapiens
MADNKTHTASTNETCTNTGNVSELTGLAEHSTKKRDTTYDDEQHQPTVQQNIRETRIRVDTQTVRRAKRYKDSQTEGESARARP

SEQ ID NO: 973044 - protein, 172 aa, Homo sapiens
MLCYLKQIGDNCCCLLSPYKCELHHSLLDEERQRVDVSELLITMTLGSLIFASCHCFEIARGRPFTIIGRISGPRYRCHRVPRNVGHVCVKSGCCWYAAEICKQDRTSGEVNRGILPMGRGANGGPREGSQEWKTRGRFTHEAGAPERAPPNETATKRGTHTGRTRNKCDTK

SEQ ID NO: 973045 - protein, 70 aa, Homo sapiens
LWVLTVSRSAFWTPHLRTLRALCACAAFPWGGPVTALLLAQGLCVERKDHRRGLRECSRTSVLKFGLRPV

SEQ ID NO: 973046 - protein, 95 aa, Homo sapiens
VTLGAQRGQRMVSKKPVVHEHVGGTPCSAGARGYKENTVRTLSGASSTRILGRHPKVNEQWRLVITWQHEEALASNAVVGPARGKKKMCGVHTHG

SEQ ID NO: 973047 - protein, 196 aa, Homo sapiens
CLLFERRRFCVRVVPRCSLLRKLFVAAIPVVCRASLEGVLPAPRGLRGPPWLSNRAPDLSPNTVAEAPGRVMAPHTLRATIWGRPLPLLAGISCPVHPVPCVPQQVLVLETPGSYSPARTIAGSWPRYGPHPPGELFFLGCPLPPGVEGAFIFPFRVAQQAPVYSIERRTTRSSFVTKVEPQVLPASCKGAESTHH

SEQ ID NO: 973048 - protein, 213 aa, Homo sapiens
MLTCTRTVDAYVKPIMRHVSSIGKTVKTIALIEGRNRSPKGDKAQHLRRNGRTEVGSPRGPSHFSQRLKPHGLNDSRVAVPPTRGPRSRLPKGSRAKRRLVAPRDFATSLGSIPSYGTSPVRTTGYPSWKSPQGEVNTPVVVSNQEPRGPSPQPSGPYAEEKQAVVLPPMQEHNLSSLTHSALFSEIHPRIDSIYTIVMSKSKAVYRYLNSTN

SEQ ID NO: 973049 - protein, 279 aa, Homo sapiens
MCFIMVLGRSPAVSGHIGVLLSADLAGVSDPVCLVVLQIGRVHMLPRAPHLAHYAELVPVRAFRGTGYFVFSRGPPPACPGRFIVSTPRPGAVGTPQAPLAQMGRSPPEPKNKGALPPMGYMAERVAPEKLLCQEGGQRSGGTTPRGSTPLDVVALPTEALVCVVSKNDPGRPSMRRGPGPQEGNFPGQQNLAPPAQCSQTYHNKRAATRASKRYTGPSSCHITTSSPPEEVCGGPTHATREREGGSSRSPAGEQPPESGTERTPGPGLANDSALQKSL

SEQ ID NO: 973050 - protein, 122 aa, Homo sapiens
TTLEKCCAAAESSMKCYAKVFDEFKASCGRASEDCVIKTKVVRHMFWRRALEEIQHFQECAIRFVTPRKVSPKVVKRPELVVESLKKSLGKSGQTNSDGRNYSLECMKENAPVQKTDRIRGP

SEQ ID NO: 973051 - protein, 145 aa, Homo sapiens
MRNTLQRRVFHTRKEGGPSGPKRPGAKEDPTDVASRIEASNTSHQMAKMTPTVCFSTSRGPPWPVVKTPAILRPPGEDIIGSLDVQTLAENNGQLETPKEGPRLARFRRQTQRLFLRTQELAVPPYGVGLFNLPPKTPFLGTQQD

SEQ ID NO: 973052 - protein, 147 aa, Homo sapiens
GVCFVRGTFAPLYKVRRVPVGRSLCHVCVVFHPGTRTIGGLYSSLPWFRISATVCLPASTDVGLNIPRGARRHPEEDAPSLVGTPTLRIVAALFFAPLFGRMTGTPCMFRRRLPLVVNVLAPRKADCARSFTPPLFRPPPPLLSLPW

SEQ ID NO: 973053 - protein, 290 aa, Homo sapiens
MGLPTWLFSYFMVLLFAGSAVIAINPSRCSSDWPRLKMLPSRHPLAAYIGPFQTSLVPLGPRSSGSSTGGTPPLPGDLWLTQPPGRWDTQFSRANGAVPPRANQGGPTPRALKFLAKTLPGECWPPEWEHHHARGKPPGGHSRIVRAFYQRGPERRWRKETPGGLKEKARRHTRALTRQQEASPRLAVERCYEDPEGIHNVALYKRITTGSHSWPRARPRPPPERARSRPHPPPPRDMRPSRAPRTHSPRQSGTGRHPARVRNERVITRAFTHRSEMRVREKKNPPSEQD

SEQ ID NO: 973054 - protein, 125 aa, Homo sapiens
RRSASRLACRAWQRPAVGGELRLRLRGGPVPLLPPWAPPAACEWRPPAVRCDALCACYCGPSCPPLCSPAAQARVAPARRVNNAASDRPLLARSRRALCLHACWLSSPRGGGGARLLPVSSHVIL

SEQ ID NO: 973055 - protein, 78 aa, Homo sapiens
RDQYFGRPSLAGPGPPVLPTPPGGFPPRRSCLNTQHRALSSLPEVHRGNTLAVAKRTVSPRVLTAPPGVFNMLSCPPT

SEQ ID NO: 973056 - protein, 122 aa, Homo sapiens
MRPRCNRISVRRPRTVVRNRARNWVLVVVQKRPAFKPPKIAFSPRRQLYYEPTLEWRGRDPHSVLGSPSTKDRSHEFASPGPICTTKVHSGLVDPSAPMLEEEQSCRVSGIVMRTRRPTILP

SEQ ID NO: 973057 - protein, 75 aa, Homo sapiens
KKKKSGRERPRGDIEPLGASRSDPGRLVADVLPELGASTCEECAISESSCRYSSKARSSKSQVRVDFKGQCTGRG

SEQ ID NO: 973058 - protein, 543 aa, Homo sapiens
MCNSQHVYFPPVARGKLGAPEVCACERVEDNTSHHVWCLVVCPSCVLRVEVIVPARQHAITCGACIHRGHKSRDVWNLLLYEKHEECDELVRFSCVVTCERPVALCGEPVPAVCDSGVTLCLAACACGRRRLCERVCVRKLWHRPPGAPCAHPAVYLKVRRGPKGDERHTVRRWVGDTPLQRDPHRERQAPQIREDNPSRVESDAPDAQTKPRRKEEPIQLTTHKLQQHEHRRPPKPKGEARAFNTGSTPPESKTLQETHTWCANCEARRTPLPLDTRRLHYPQHMHRGGGTHTLSGYYPTQRRRRGAAPPPSTVGASNPRRPTDISTPPTAALRRQTLDNHHHPRTSTHNYHPPHITDIPHTLIPHSSPPSIQENHTKITLRPIMQGQHHKGAAGAANHSSGDTPSQQHPPGGQRHPQSTRNHTATQTHPRNYMDQTPCGTETNNRTSAETHHRTPHIQTQQPTTPNVLHRGTPQRNTHLQRHNKSVSRPTHNNGRQLIRIHIPKSPTLNQLPDADAIIHEEDNSPTNMTHTPSSTPRSPPS

SEQ ID NO: 973059 - protein, 186 aa, Homo sapiens
VHYATMISGGDNSMGLVLGSSFVCLHASFCSNTLGAAPIGSRREDVSHTRVSLYLVMTPIFAVNSVGVRTIVVDRVITSRNPAACSPPCSVAPVAPLQVVGSLARDFCSPSRPPVAILVPVYIVSCAHICCRYPSSRGGCRRATLVFVLLEKRASFPISFRDHPSWRVPYRSHSGSGAGPPVPRFA

SEQ ID NO: 973060 - protein, 251 aa, Homo sapiens
DLACLLPGVSVFRHRVPIPLVFAAPSSVLCWSQPAVGLLVARVAGLSNHWGRFAPHPGGSTPPMPPRFPGTPLCLPSLLPADSLALLRFLSRGLTSSVFFPKPPVRAYPAIPPRLISGYPSVVIHPHCDNISSYSSLVGPPPLCSHTPPEHLNNLSHTVVRTPLPLSNTPQIASHRVRKTPLLISHAEAPNLEVNPPTHYSHPIFVVNRRNQVIMLFANKRREVIRPPAPSSVCLEPAPAAPLLDICFTID

SEQ ID NO: 973061 - protein, 323 aa, Homo sapiens
WAKGNRGGGPKKPGGFPGLAPRGAGGENPPRGGPPKTRVLAEKKRGRGCTNPERAHQTHAPERATEWRPPTTRYSPGRHSTREAAPTVSPLSVVVKPRGPGAPRGVLRKAPFTTPRKTPGGRGAEITTQRRLSPNLFPSNKLILYRREEDAASSMFPRRGNQSALSSEKEAAEVFPTAAPHAHGGPPRRSPTKAPLYQRGEQHEGRGGGGNASHNIEKPPGGGRRRPRGEPHGDHVCEQPPPGEAARRGEQRWEPTPRLSLVSPKETGRRKKPVLRATEPYTVVGLHTNRGQPGGTPRGPQENPRFCLEGPTAQEKVSWKQDS

SEQ ID NO: 973062 - protein, 295 aa, Homo sapiens
PPKGARAPEASRTAAWKAPRPTGGALCNNYEGGGDNRVKPGQWKKFITAGTTPHRWSGRRTKDAPPRCSETPSHNGLLHSHPGVMETYTGPAKYNKCRRPQLYWPTREVSHSWRRVITKRVLVSLLTFLERALHDGGGVHHVKIIYKRDCYRPPRVPRSSLQHSQYQGETHLTSRQVKNAPHALGMLPAFCVIVCYTPTVDPAPLYADSGRMLGDPAPCGRARGEHRAPVRRRQGSHLFTQHLKTGRCNFSARQHHTHYVTEYNEVGRPTQTETRDRRYTEDTPPPQLLKNKQTK

SEQ ID NO: 973063 - protein, 82 aa, Homo sapiens
LLYGVVVGPPLFCRTDSPSFFLGAVSSSWRSPSCSPACVSLLCRRHSSSGGRCPAQLFASLLFGAKKRGYFILPRPNNSKTS

SEQ ID NO: 973064 - protein, 418 aa, Homo sapiens
QRPLGYPRVQGRERPALHHLAVPDCLACGRGAACPLVLCCMCCLTCVPETLFASIWALLCFSDVLPAMPCTWCPCCDAHWNGVGTCDVNALCCFALCCYPRKSKPLTHSARKAQSHTITHDCQVRGSSLIGAKTREVDPLAHDTEFSFVTATAWRNRVYLNATATDIDKPVLLVKLPLYATAPHENTAPMWFWAMTTFQTGNRTLNLFLTNRGTSFQGTPFAGLACVPKPSPRVTLVIQRQETVPNCTPMDPPSSVPLQFPIGDRRAHGVRLSTPLFDALPICPWAPNSPVETPMDFLSLLERLWHAVPFATRDNFSKPFRPDNKFGWGHFHNRGGPYPNHGETLSAGHQRHILAICDNQPLCRIVPGASPLVNPRCCLRNNNVAQSKGNFPLNGTDFPVEGNTFTALPSVVPPQSGF

SEQ ID NO: 973065 - protein, 148 aa, Homo sapiens
MDARPSCSRQPQVEKPPTCRRRRCDSAWTRTTDPDMCYKSPLPPPFSQTNVEIHFQLNIQVVALVKLPGEFSPEHFFKGLSPPRISVKTGSSTVADEAKIPQECVQRTVRASDDIFCCDLQRSSDVVTVFRRCRSSESLYSMSARNKI

SEQ ID NO: 973066 - protein, 276 aa, Homo sapiens
LPAGRQSVLVFAGVCRGAESLSWGNPRGVFMPLIGPAPCCEVSPRWVESIVPRSRMVAHRRACFLFLRGRPRALPTARFCLEEASGPHPGGTGCPAMRRACVGVSRGGPPLALLTRGGLRYAVGGGAPACLGSPGPLIASCHGLLSKWSQIPRPEAVPLWDPPTGVLSSRRMCFCGQPPWLSPGCRHSVAPRARIFRRTQWDQSQMVCRYTRSCGEGGAFRRSIVTLVCARSEELAVAVSPGAPLLPPQLLGVVIQRVHINFSSRREIIRRPRLLL

SEQ ID NO: 973067 - protein, 159 aa, Homo sapiens
MGLLSYRVCTPVKSVTLFVCAYCIPQLCTPKARTTRNYVQKILHIDKPNLACITAYPLQCADWDGPQKDSPKSSNQIWYENHPRYPGDYTNRLISRKFYKGPSLSVMIIAHDKPATRWDKKAVKLVPHHSRCTRDSFKPTPNEGSISVRGPAHGHNTNR

SEQ ID NO: 973068 - protein, 155 aa, Homo sapiens
LHEGAACLLLITSEIDLAAEEAVMTQQDEKTLWSLNGIRCKQYLTNPQVLNVPRVRALKRSLRVWGEHRELECAVLRVSTLLKTSPSQRRTTILNGSNKLGVNGRSYPRDNSRESYSRVHINNRVLTELDVGSGHPDGAAAIKGSFGKRLKSYVI

SEQ ID NO: 973069 - protein, 74 aa, Homo sapiens
ASLDPLTVALLNSHLPKSFFGNRCPQAIVNCPVRENGESSPSRENVSCGARLIESSLLLLPVKGVPPGADISGI

SEQ ID NO: 973070 - protein, 142 aa, Homo sapiens
TGLVRRRSFSYRDTLCVPIFPPGSRLGPRITMGYNRALEFDVAWVPSQVAGDSLGFSPPGLLEICDYIGNIHISWKPRSWSPVLQDINPSGTSRFSPGFTFPEFGFRPLPSTAVIFKYGRQSQRSQGITPAPYYLNGTISLI

SEQ ID NO: 973071 - protein, 293 aa, Homo sapiens
ACVAPALSCLLGGSLKKSPGPLHCFCTCLISHGCPGDSREIDFMTSLVAQLRTRYFISDKVVDQGDHGTIFCPCALVLGPVRLCLASPDMVPVNCVAWLGDAFGFILRCVTHLRCVIVFRCFSLELDEIAVVCWRQRPGNASGAVKMPAAADADSSVSFPALVPTLGLFMRDKHVGHPWGSRDGSQRLRSRGDSSGNMSRILTLGWHSLVRQAVTLRLAPSRWVQVHQRLRCQGWTQECPWLICTRTLCDRTNPKEGLKHKDDEMEFWRKREESAIITNNKSSHGRVYKSCVV

SEQ ID NO: 973072 - protein, 247 aa, Homo sapiens
MGYYGQKDGPVQVTVVPALIKPGVNLERPPVPVFPQVLSGSRRKFAAPCAVQGYTFSTSRRAPAQTPPPGEPCAITRERRAPKKRRLSRLGSLSKQAITGPNQSRFGDEHTSLETPAVLLAGEYKGNHPIYRRIPPKKPPDPAQGGFNNGKKCAQEPEWGQDNAHRYGWTNDAPKTEYGIARLGICHPDKRLNPLGISKQGGAPQETNQLHETELYAQTPVYRRKIDHEAALGKGKETPLKKSGPQN

SEQ ID NO: 973073 - protein, 103 aa, Homo sapiens
VGICARAGGFSHCPGAVWEGWLSVCARSQGFFGVGSPQFCGGGSPDGGPLFVPLLDFLKRRRPAVASMGRPTGTLVVSAGAETFSSGPARSPSSGLRDDPRLW

SEQ ID NO: 973074 - protein, 297 aa, Homo sapiens
PELRRNRSLSTPYPQTPRGGSPGHCPRRYPAEVTPLPELPFRLPNAPSDKGQEFRAPHTKSKCPACKTGNGAGTKQRRVHKNTCGDNGKACPLEQQPAPRFSRDAAKVAYQGEARVYHGLAAPQGGKAYIPRAPIMLLRAPPPTRWGGGDKISAPKKSAKGANGEETTLVSLSAHQRPPPLPPQGQAKGTPHFSKEGPPREASSNTGGQQHKQSAPRSGSPPGTVDRRRPLFRRTHTTQVLTHGPRETTRAGQQNPPLRLCRRPPETLRTLHFGDKPPFLPPIFYGEKKKPPNRGQK

SEQ ID NO: 973075 - protein, 79 aa, Homo sapiens
GSRLKPKACASGPQTEGPVQTPQGLLETLPCDLLSRRQHWWSGRPPLQALRETWAPHLKSGKKPFPTEGTPHIGKTPGE

SEQ ID NO: 973076 - protein, 164 aa, Homo sapiens
FKFFLGKSSSPKKKIKLKKSKNVATEGTSTQKEFEVKDPELEAQGDDMVGDDPEAGENDIEKIRGPEAGPNIDEEQSGVRNRGLGSRSHKLLLPRVPKKAKTWIPEVHDQKADVSAWKDLFVPRAVLRALSFLGFSGATPIQALTLGPAIRDKLDILGASETGS

SEQ ID NO: 973077 - protein, 217 aa, Homo sapiens
MNRVIYGLEHICGSSPSRVLNVLEVSFVGDTRALTFSVFVAPLRRLFAASFGSPSPVFNRVGIGFLPSLKDGWPRVPSRTEHNRENTGAHQRWVKKPGVNPNAGTTTSGGGPDSHGPPHCEHPPMYDVAHKNGQMQGTPSGGQTIYRCVTPPHSPPVNEAGNENQPRGGTFHRGVVVSQSTNPPIVSGGEQVEKILAQEYGATDNNPGGTTVSKKPR

SEQ ID NO: 973078 - protein, 152 aa, Homo sapiens
PPCSAVSCVRRACALSSLGGAPPGVGDHLFRAGFFPAVCWSAAPVCATMYALSLFGVFCFGVRTPVGHPLRRPPRWSCPRRIAASREVSINSAPRVHPSADDFSLRALTRLLSAACFKRSSHLSISQTTPVFLLQTYSLLNISPSPLFYYRY

SEQ ID NO: 973079 - protein, 110 aa, Homo sapiens
REQKALWINMQICLSTGTCCGGHDQAETSHCRGYSQEMALCKPCHKAQPSTTRLISANGAGGRERQRPASGFPSPGAHGGFPPFQGSGTVPRGEPGDGGREREDRGCLRP

SEQ ID NO: 973080 - protein, 135 aa, Homo sapiens
PRPAAGHVYEQLMQLYVLRQRVAAEPGPACVKQHSLLKCLRKAKNGGADHARSRNLVKYAFCWDSDHRYLDDVWRSYGRAIYNGKELTTTVEINARALTRPRTLVRASPSTYKRRKDGRPDNRGHPLPPAYIPLK

SEQ ID NO: 973081 - protein, 102 aa, Homo sapiens
MLFLAETYICGGPPLHLPAGLWERRKWLHFHYTKAYSVPRFRSQELASPIHSGLHYAHAQTAAIWDRSIPKSIYVNLLPRDFADILESPLPNLVAPPLGLYP

SEQ ID NO: 973082 - protein, 208 aa, Homo sapiens
MYRGFRRLTPCYMRNYIIGNRSPLECGDPASTQHKRITESYSPMSPHINSREWCLSQCAPETGSNWCTARFPLALSNGKPGASHMGHINPLTRSAGNSLFPSSTTNWNIPLAPLDHYLFNPAQHKENVNPVPTTVGHHYYVRCAEHHQVFILACPPLHSPATRIIIVARRARKNISNPVSHTCPPTFTESLFLKNFHTRTYNSLFEHS

SEQ ID NO: 973083 - protein, 317 aa, Homo sapiens
MPDLFLSTSWPLLAALFLLGMAGLGCAVTAGLTSTVDYLRRPADGEAAFIKPAALCLCPEATLPATACPCLPLNCGCHTHASLGVTGPDPVTDPGTGQTWDCPWLVAAASCCGLGLCAVLGGLGERPLCCGVHSVLTMCLGRVVLQDTDRLENMYRSSQAAACERPSRTEYIEQTARQTEHQYYAGSRNVKVDSDQNTDDHNHANQPLTMADTRGTADRPTARRPQPSPRERARTGPKGLMQANDWRNQRQDQHTNKTSANQRQAKHPQQNTSSTAPSQPPSARLLTIEDHYQTEETNQQEHTPDNTTPTQQTTHSN

SEQ ID NO: 973084 - protein, 311 aa, Homo sapiens
PSARLQSTDRTAQRKSHGRVSALTATSNCAPSTTCGPSTRARGVCVRQHTGRASFTRCPHVKSPPNGLGTAPFIDRGNPPNTRGGNRTTLVAGREAHPFTSISAFQGPYKAFLRALLILIRVFLLRTPGVYAPFVGPRSSLEHSVPPYVWRCRMSMGPKRGHASPPLARVSLLPPWTPSTARGVPTHKQATPNHFLSPTPRRCPLWFFLRTNCRGWSIPRGPTHSCLIVLLSPSRPPTYSRTPPATVQGEYTSTPLSSTPGAGEPPLFCPSGRIDPSRGCGQRPEASINDIKWTHPSTFASLRQTAAAHIT

SEQ ID NO: 973085 - protein, 258 aa, Homo sapiens
MNPAAFGKDVTFNLKTQRHLMQHTEAKHRLDRTTKKQTARRHTAHGRPGTFTWETHGYFSLTRLENCWRLLMNHFLQTSWLPATATQARERLHNDPTYLNDSRAHATAPNFTPHPYPVIFPLARRTTLLQLSNSFLTYQLRSLIIERDTLATYLWSAHTLDTNFYSGGNKHIPFISPSCCDSSPELSGHSSSPGTKNNPTTRPPRTKHHPTEMALPSIEPNNNPTTDSLNTPNPTNNFPTLLTYTAFLHPPKPYTAQN

SEQ ID NO: 973086 - protein, 79 aa, Homo sapiens
ILARTGNYEGAVSVWRPLFSKPVVPLMYPLGSLLQITVVLSPLRLCYFAPGGHNGFSKSTVVCMTRPPLGRQLISTGRL

SEQ ID NO: 973087 - protein, 216 aa, Homo sapiens
IEVDDVMELMILCRIRSQRRIGIWHGGTMPIIRDWAERTVLAMYEDDYILSGSSTVRYELYTHLPVSDEQLVQSSSQQLGCSEIVWSLLSGRIPHDALGGAHFTGMTCRGHSLREAPGGATESSLDNFPSQVKHSCTHRLGHPALRYKKTQQDTERSTTDTLSDVHRPLLHSLLTYDQYFFSDTVIVRGTRKTQCSRDNTWYLTWPYYLVGTRILD

SEQ ID NO: 973088 - protein, 130 aa, Homo sapiens
CSFPGPGQSLGPNRSLASDLGPMFPRAVSPLGTLRLHLVLDPPVGQCGHSTTAGLCFLALTRVPFLSPNPGHWSAGLTRPCPVRRLCTSGEPPFLPRTTHNLRILQHWVPPPRLIPSTHVAHKHFSSLQH

SEQ ID NO: 973089 - protein, 293 aa, Homo sapiens
GKSRRAQHTVLLIAPCSLVVVCYPRLTFYPSDASDMYTLRCLCLYTFIPCGEFIVRDYRHYWFCVTRRYRCYTPRLLRIRNPFSGLISHGRLNLRPILSGLRQSGSIIPPRAELLSIAFRKMTPPYGRSPAVARDPPLVFPGAERRFLVISPAVGLNSSLICVRLGTQVCQLSLCQLLAMGKYNCVPLYRVSSDPWFCTPTGTMRSLQRSVMARQASCVKRCAVLPPSTVLTQVAETSCWYSNPSLLATQNRMLSSIECPANKDAPAALVTSRWDIHVRPGTPKGVHSPSPPR

SEQ ID NO: 973090 - protein, 111 aa, Homo sapiens
MTWVLISLRYMELTKCPVNAETNTCKNPSTIVINSSPTLKTMIPPSRTSIIKEKYYPPPHSPRPVFLCREVSSSLCVSTHFLIRLSFFRAPLCPLSKFLFHTHAVLDSHCT

SEQ ID NO: 973091 - protein, 104 aa, Homo sapiens
MHCGCRQKRLVKTIGDNQHEIFLNNNLVDSNIVKNPHRNLEIMQSLKAPNLSRPLLLQAEQDSELMTKFSRWGGPVAVKIGEEGARKELDKRNPLLFASNVGND

SEQ ID NO: 973092 - protein, 165 aa, Homo sapiens
RIGPPPCWGRPFGVLPRGQDFRAWALVRWTILSPACGATKLGSVSHERPVCSALCLREVFFLEGSLSPCRCATPGGPPAKEGHALGVHPLFVDVSSDECSFTQRRRRLPMFWFLRPLSLVKLRSSPLTARVILGGKGTARWRLISVRVKVRPHTVTHRKVWEKIE

SEQ ID NO: 973093 - protein, 74 aa, Homo sapiens
MMSHVASHRSPQFNLWVPSGRYFVEPPIVTQKKFSCRPEFPLPLSGAFWPPRGLLQGPVVFENRRKFFPLRKRG

SEQ ID NO: 973094 - protein, 245 aa, Homo sapiens
APHIRGTKGALPYRLGLRPSQGDRCPLLGPLSLGFPPTFISPPRRSPLPAVPHFGAAPPLGEVSAAQLARVFLSPSRECRSSPLRGVVASRHLRPAAPRVFGGLQRRKQFPWGNILFIAEFPCFNMSRARSPHRNTPPSGSRLRTRCPTAFPHAEVYRPSAERHLVGREGPTPLIESGAGRHTSASRFAHHDRYERQLSLTCEPLAGIPSLPSAGAPPRWVVRAPAFAGLFSICKPHQKTQRSYQ

SEQ ID NO: 973095 - protein, 266 aa, Homo sapiens
GGGAKEKKYEERGGHKQEEMIREPGPESDETSVCAREVNAVALTKEIGVPAQLEVRGCSGNGSAGDRPPAWGGAYRQDVKGGWQTAPGPAGGQENTVVGRPTGCLKALPALGVGHNPHKVNACANSANKEQVHAHEQNIDDWVSPSPGEHEHAEIPRGEGNTTPLGEGSMKPAAREVQYYEQVRTNGRKTPRGGPAGAPTDVQVSEKQPPGREFTRRPVCVVHKRGVPAYKERCHRGPPLAGHQGAQGRRSRHNVTSCRPCARGYA

SEQ ID NO: 973096 - protein, 190 aa, Homo sapiens
IQGQTARYPLNWSRPIEVQEEQRSTAGGTTSRGLDTGRRHAPQAMKSSRTPTNAVKKAEVPSHEIGWTNETIFVEAPPTLWSPNREAHHHLSLPHRHTYMSRAPRVDQRGRHLGPPNYWVVTVTQAAPQKVWCGCTQMNQTQQLKGTANSFNAATTVQSEYPRLGLTVRRLKYNSDAVMSGVGGRHTHIQ

SEQ ID NO: 973097 - protein, 57 aa, Homo sapiens
MVRESADNNARRGFRHTRYAWPLAPVSGRPRQTHPKLVVKKPPPFNPKKRIAPRNKN

SEQ ID NO: 973098 - protein, 103 aa, Homo sapiens
MSIVQYGPMPLGTMGSSHGAARKSRPQGLPDKPRLQAPRPRVSPPPRATKGSATYYRKEAAFKYKQKMEAPLLKLGKGRSSNTEDTPRSSSSAPKALRARQHH

SEQ ID NO: 973099 - protein, 110 aa, Homo sapiens
SNKSQTLTPLTLLCRVLHQHYLIPTSPWGKPPLLSPGTLTKLVITYVNYFSPSICYILLCYTRTIPAENIFFFTRPPLTLTQENRNAFSLSEGGEVFMFKKLLLVLYRQT

SEQ ID NO: 973100 - protein, 326 aa, Homo sapiens
MTLCGVVPPLMCLGRTKLRLCGATTVLFPPAVKVVSSPPAPQGSWGSRPPPGVIASGFRDRGGGAPGMTSVLLHRKGPHSGPVGVRTTACVGAFVLRSEPVNYCLFGPFRSSCLLPQSERVFHSPPQTRSLSYPRGCPPIFPRSHPVGPLTRTPHKTARRGLVYLPAAAISGSVVCAHANTICCARLIRRRGSPTFLVRAPPAMCRCTPSVVRSLLLHTRWRDHTLYCHYNPAYNLLRLFESHLDHLPVESRTELPHQVKNNAFSLTPSGSNTNHGQAPPPYAIHHRLQTPPNTEPFGDHKVEENTTPPPTRGSTPPPGPPKFSPT

SEQ ID NO: 973101 - protein, 202 aa, Homo sapiens
TEVLVAASFGAAVVWVGAWLVGLRAGVPAPHVVVGRRLVVVRALLCVRLRCHLMVALWLVPPSRVWVSSTVARVLYARVGRLFVVGVCAYRRRYVVVRPLIGPDFKSVYAPRADLLIQSFCWYHHKSPPLGNDVTSGEGAPTRRLAYTVARRYVFFCDTPAWVSPLTLDVCCPECSTYVPSPWGPRTFYYTLFPCPTTHPKK

SEQ ID NO: 973102 - protein, 72 aa, Homo sapiens
EFHLTRLDHDRYYVPIAVCAPLYNIISRRKSRSPRGLAPPAFQGTGVGPEMCSLQRVYSSLQSAHGLKMAER

SEQ ID NO: 973103 - protein, 176 aa, Homo sapiens
VLWCKSRTRGRQCRPGRCAMQCCVPVFIHRGFLFGMGTPCCPRGLSHACFLPCRVGIADGLYFLRSCLITGVLFCPPVGHSRVGFPAQYNPCVRSPSHMPLWGKALPNSHAGGSPLTHAGDNFIYSTFPIIEDNLLTEDIHLVQQEVSVCLLTWHLWSLRQLHPSSLSGAQQMPRC

SEQ ID NO: 973104 - protein, 125 aa, Homo sapiens
MENSYARWGSQPTEKSLRSLSRDVSLDLTPPLWVGTLFPPACYGALQGKHAAYSTARAGVRSSRRISVVPTPPSSAGAPPWIVFCHWLVRGLTASLFIKGKRSLAPPHGGEVIINRKGARHVKRA

SEQ ID NO: 973105 - protein, 320 aa, Homo sapiens
SLGVITRFPRIPPPWGGLPLFARGKLFSSRVVPNCCRAFLLSLWPWPRVLSPPSGYVAFLALFPRAAKFSLCRVSNPRGVVSRQSCLPQGEHDNQARPKGGTYLGGPPQEASPPLGSHYWPGAPHSSFPRGPSFSRRLSPPSRVFFRDAGPKLFRCFPHRIRTPGTPVLGALGRVHPFSGERMLAGETPPHRGGHPPLICLFDCCVFSVQMLHWSTPRCSARSSPPPQCRFSVCPVDSTPRWRLSLPPEERGSFLPSHRATTKSTAFNQVWRSPAGHAPWWYIQVRVLPGGRHAYCASYGVVRANPFKTNWAGNKKTNKT

SEQ ID NO: 973106 - protein, 46 aa, Homo sapiens
MSYKKETQSEKAGVQNSRSGIKHSPEHGPPGRPNEGPAPPTPPDPI

SEQ ID NO: 973107 - protein, 152 aa, Homo sapiens
CLRGGAYLWGRRSVVVWWWLEYLSGLGCPECVALAVVVPLCLDFLLFSARLVLCKHWCWGRAVSRGLVRALCVLFPQGERAGVHRLVSRVLSCCAGMGGGGISHYGVRRMCLRVSSARIISLTGNEGFADEFVDYVFCLISVGGAHSAAAGA

SEQ ID NO: 973108 - protein, 152 aa, Homo sapiens
MCPSPPYFSGGTFRPKQFKGPLIQNPVIAHYYNPLLGRKFFNRPFSLPHHYTGKMLSGETSLPELFDPNQDVLTTTSDYNLNNWPPIMGLSAQTFSCRPKWFPNTQIRTQLSPPNYASPNNCDSLMPPPHLLPSSGNENDITRPRIYKIFSG

SEQ ID NO: 973109 - protein, 310 aa, Homo sapiens
FLCCVFLVLGFVVSVSSSFFAGCVVFFCFCFLLVGCTLRVLGVPACLFFVVLIFSLVCCRVCFSSSWSFLACFVVLLLLCVVYYCCLCFFFCFFFCFSPSPLSWLSSNVFGRLPLVFFVSLRLCCARGCIFACLFFFFVFLSPLFSLLCGCTLVSSLLSSLRIFCARFVLLSLLFAVSPLLFLLRVFDVFLLVFGCSSTCFFPVFCCVLLCVFRFSSVGSRLVVFCLCVPVPLRVCVSSLWALAPVLRFFALSSSLVGSSGTLLFSSGLVLTLSWWGARSRPCVCFSCPPLWRSVYFGVGGLFCRRGFVR

SEQ ID NO: 973110 - protein, 203 aa, Homo sapiens
MGPPRCLSKVRVPGGTTGGSVKVGPLYYTEGVSRGPPSSPCGAMVVPPGGCRRKGVGFAPGECSCSGGVRPQNGSLLSWAPPYLGYPRRGSLDTLIFVAPTCALVHSYTAWAQLFYGGGPPPWRSPAVFARGAEVFFLTSSTRVSIPDVLLQNPGESKFWWSALVSFPLGSPGLSFPTSALLRRWCPDSVGLPSSPLWDPPLP

SEQ ID NO: 973111 - protein, 332 aa, Homo sapiens
AVVGVLIWFSHYLGAVLVGGWVGWRVCVVCRLLCRVALLVGGVGGRWWVVVLLLAGGGVVGGGVCCVWFVGLRLVLGGGRLGGVGGWGVCGLGFCVVLSLGVRSDGVSVVALWSGVVALWVGVLGLVRGCCVCLQVGRGGGWSVLVPWFVVLCGWGGGVVMWGVVLVALWLLLCALVGEGGGWAAPVWCGGVLGGVVVGWGGVWWRGGVVVVGRVVLVLVLDCVVCVDGAALVVASCCAGSRSVVWWLLCRGSVWCAERLLGSRFVVSAVWLVVVLRQLIVLGAGEVRFACRVVDFCSARGYCCLWWCGGVLWWCERVGVVVCGGGVRGLTR

SEQ ID NO: 973112 - protein, 242 aa, Homo sapiens
MVPHHLLENLSLVIPAVISPMPLYIIKGLKNTTVHYQTQPSLILYCPPAAIMFLKPPITLRCTTPPKSPSPLWGYPTVRLGFFLEDCFEFQAPLHCGGPPLQLARLWIWTYYHYWRLAGVTHVVTCAPSMLCYPLSVERPATFARAEGSPAQTTRVFLTPLPCAPATGRLLSLFVFRDTPTLFPRSFGWGAPSCVASQSSVAVRCATGVLLCHPLWARSSPRRPVDFVLPVGPVSWGYQQPT

SEQ ID NO: 973113 - protein, 145 aa, Homo sapiens
MCETDVRVAPSSATGPHPGSLPRVLPHGVYFMTFWCIWRSLPLGASDMGEHNRALLHYCVSFDAPFYVVDPLPRALLLAVLEPPMCEPVQPPSLLALRVVPDSVCNAPPFSPTAVLNMNSSTYNYLTETTLTALIYTGDIIYMLF

SEQ ID NO: 973114 - protein, 203 aa, Homo sapiens
CRGARREPPTSRIGPVDPALCRCSPPPRWVAKHQLGGSFNGPSPPSRGVSALLTHLFVRGSNPQAWAIVVCCRHLPRLPPLDLVARLALCPPPPLCSRLPGSRSRGKFSSFRVRPALPSVLLLSPLARLSFTHAPSLAWARPRRLPLCWRVVYSYKPRSHSRLAAYVASKTPRSARSLLCPCWDEDSHPPPPHPDDVYCSPVP

SEQ ID NO: 973115 - protein, 94 aa, Homo sapiens
LGGSRRSSPPVRVVSCSSRGGVCVDLFVEDSAFLLCEVIDWFSASMGAFPYGAVSLSPALFGTPPTGASSPPSRAWMSAPRYVLDPREGSLLSL

SEQ ID NO: 973116 - protein, 165 aa, Homo sapiens
RRVLRAQDYVVPRDRNEGRRVGAHAVTWLPALLLGTLGVPRVPSAGLIPRQGHIRVYLLDSVSPGVTKHRDQTCEGQKKGGSKPLLKYPPGGLFTSCSTLNPVARNYVFPPTEKMPLEFLHPLEARVQGVTPSSLVLPPTPDFSRRPLAPAVNGTLARFPSNSNM

SEQ ID NO: 973117 - protein, 66 aa, Homo sapiens
CGSSAHLFSGGHYIMAPPAAYPIPLGENQRGVKQPPVRVSHKFRGGPPILMLLNGALIASPTSPCA

SEQ ID NO: 973118 - protein, 110 aa, Homo sapiens
MDSCLSLPPWRMDVGPPLALEYNNDAGPPARPPARKAEATGGRGGHLDRASPPCAWLTEARGGVAPWATPLGTLGVPRTSLRTLLSVPPKYALFCLAGTPEQEDKMKTEQ

SEQ ID NO: 973119 - protein, 122 aa, Homo sapiens
SWPGHKALWAPRPPRGFHPPKSPLGVAHPSGLSSSSFTAEPLCWSRPRPHWEPGLFIAFPGRDRQGHPAVFWPTTPVGNSVATPARFYNDNFSCHRRPPFFPHGAPKNPPRDHVLYKTPRNV

SEQ ID NO: 973120 - protein, 126 aa, Homo sapiens
PSPSCQYGPGCPGVSPLSRCRCSPPGMGLVPFSRAVGRASLPDQGFIVALSLLRLAIWADMTPRHGVSEQRPPTWSSAPDLANKVFGRVKPGNARGPTTSLSVSREFPGRSSTHAVGPLVTGPPIV

SEQ ID NO: 973121 - protein, 122 aa, Homo sapiens
ARSFDFKTVLLATPDYSDPALNCLGVVGHGHTGTSHGSPPHGGDDIETSVVSKDVNPPSQWVCERFPLALRTSEALSFQRNSSVPPTLSSQTLYFHTRHCLSTIIKNKMLLSIGLSARRQFG

SEQ ID NO: 973122 - protein, 130 aa, Homo sapiens
MNVIASLRHLSEVRPTHTHKYLTHVGECRAMIRGALLKIASSLMAPTDYLSIMVIYLYSSILFIIGGCEDEQRQILTRGDVAHWPPSNIVSLATQFLSGELFAPVLGENMLADFPTVANAYLGYIYLFSV

SEQ ID NO: 973123 - protein, 178 aa, Homo sapiens
MNLRICRVHLLRSRFLGGYRPQSHIAYALREFRGPRMGSGSPELFRPPDTLGKPDTFAWGLGQKFPEDKGTLLLSPGFSPPSCGGSHLQVIKGQSQLCNTNPFGNTSPHFYPYRVFSPLFQKTARLRIFDFHTPFLPKMSGPKTLATPKPDPHWPSFRFPSLEPCIPPPPLENCCKLS

SEQ ID NO: 973124 - protein, 240 aa, Homo sapiens
SPRGCSAWLTLGPSPPTFSLASRASLGSPWLALSPGACPLLLGEFARGVLAPVTGSSPRGAITWDTLLLCRSLPRVLHAAQPLRRLFPHWGGTSPPGVHPRWRPPPPKVSTHGARPGLELALCATLLAISGGPVVFPGHALVCVEWAHMPRLVFCPPPCGGISVLSLTSCLCLIYSPLAPASFHAVCRRLVIGQHGGISPPDGCLPLCTTHHRPPSAYTVAPLPWWAPIKIGDGRPQNIT

SEQ ID NO: 973125 - protein, 231 aa, Homo sapiens
LVLIVPCARRSLRWGFISCGSAPDCRPSVGLHSVSYFGRCLASVRYIFANFWSATSLCIKCLLVWTTAFHRFELRCMDALLWVAAGRCVVDLNGGCVDFSYVVYACALLSPLVLFGGMLTCSRVDASLFCGAHTLLGLTYGSSRASHGVDSGPTPAPRRRARSPRSPPLLAAPLALAARRARTRIGIAWLCSVAALAASSPRPGFTTTDSTHSPRSSTSSTVHNTHAPHIH

SEQ ID NO: 973126 - protein, 105 aa, Homo sapiens
GHPSGKPFLGTCSGYTRVRDLVYGKHRSASTVPPPLGYVLWGARSISQSIVLSQQSKLAPPGYLSPVVGATLTGYVMARDALFIDRTMLCVREGDLYINGAHTHQ

SEQ ID NO: 973127 - protein, 258 aa, Homo sapiens
VRGGVVEHRGVYVLEAAFLRRGASPPPDSVIEWRVFLEKLVLAGAHIGPLVFRRGTDVGGRSPRVYDRTYRILGGCPLPQPPATPGCGANPTNPTPPDGVGCLPNRSPLGKDPRYARPRSGPPVFVKRYSSAALGMSARSSEALQFSRPPSLVLTRERAFVFPLGFIYSPVALSNAAEPTIYRRPKSTLFLLTERNTHQLPDYPHVLSTQSAVLSPMTHEEITHLVVIWHILIPPCHSILVINTSTVSPRMKTTKAPF

SEQ ID NO: 973128 - protein, 98 aa, Homo sapiens
LGARNPLLCKCPPLFRPALLVVGAPSRSRSLMLPPPWGQPKFHYGARTQGMFVVEDLDLARPRGVIHTRVMCDGGGERNREREIGDVLTHIYRYIKYI

SEQ ID NO: 973129 - protein, 280 aa, Homo sapiens
MAVGVNTLLRGTLSYHWGPSFLAVERLSRQHVPRVAVHTKPVELFLFRPLGNSSCWLSAWKQPGTSAPPLFPALHGGPQASTAVACCPPGVFLPCVSWDVWARGVVAAFIVSPAGALISVPLVIPGRLGPTGGEPSSLLAPPRGAPLQGCHRVGTSAVEACTLSRSLRSGVVDLALYGRSRTQATLLFEAAYTPLCCSLGRVARGMSPHSFVVLYLPGADNPRLVGPLVYRGNNVSLPPHRKDAAHLYVIASTSPCRSHFTVPPPWWTLKKRWYGKQTMT

SEQ ID NO: 973130 - protein, 295 aa, Homo sapiens
PPGLTTVFVGVSTPHLWRFEVRPLVGVPRACCVSPPLGVASSSPPHVGTLFARHVVWSPPLWSQPLWAPPRGCSPPPELPVSLAFCLPQIVLVVRLHTRVASCSGAALLPPNALRRVELRRSPVPPVCHWGGAPRPLTPVFTPDCKTCCGALARSSPRRAGPPVGVTLHVCWSQWSWPGVPRPLFEGVTGGTRSRPLLTPVVPSDPSSRTGERSISLLSRGAPPSFVGVRSAAPPLSRGVTRSTLCFLVLASPSRLPVGPPYNSSALFVGRRVVRHGYLCAPGKKVTIPRRSPHD

SEQ ID NO: 973131 - protein, 295 aa, Homo sapiens
VLALVLLFAFSAPSGGFCVSPLWWSRPIIWGPVPGCSLLLGALLPGVCRYSVAAHSIVCVATSTASLYSRSGQNTHSSISARAAGYEASMVCPSVLVLDFARVLLTTLLQVRWTRCCSPIVWIRISKFCNLPPGSSAPIIFVLPDHPSDIHALPSQYPPSQEVLIPDCPHVFLTYLSIKSVNRGPRPDVVGISPDFSIYDPPLLCYSTPPRPSTVISLSRPSRTLTPRAVLTPKAEHSTPFLDDLVVVGVGHYVLLLDFATRFMARRAEAVRTGMFPLTRCDYCFVLEACSLCSD

SEQ ID NO: 973132 - protein, 267 aa, Homo sapiens
YSLPLRGTTRRRGVCWCSTLSSPESLARFVVNSHAPPFCPRIILVHTAPRGRLVVICCRPTDRASRGRFSFWRHPLGTPSPVVTKSGLFPHGVPLSCGQLPPLYGLPVVRGTPGTPHGGTNFYYGPPSLLLGQYSVGPLVSSARRLVLVLPSQFPRPPITRGPRLPAHISLVCGSAAWDSAVSRRRFLLSSRPPRVGGSRGGGDVPRMEAPRRYLEQPVLSIFRAHYRPGYMQVSPAPRSCCFLLNFPRGLCPPAFLKKKILYVQTK

SEQ ID NO: 973133 - protein, 132 aa, Homo sapiens
MYLQNDSRQSYGRYYRGRTPLLMGVKDCRFRSADPMYLRESPVILRSAQQYFSPSLCSAVTKCFPHPLDVSSAAKPFQRKEVRFIFLATPRKGGRLVMGYLRRSSYEVMTTTGPREDVAIKTAQIGTPKQRQ

SEQ ID NO: 973134 - protein, 58 aa, Homo sapiens
MIMLLSKVVPTPRYCIRTTAGGHQGLPRIPTIVPSVTYPNLGAGRKQKPDPFWFLINN

SEQ ID NO: 973135 - protein, 113 aa, Homo sapiens
MFGGRPCVAPGVPLWDLAGGPLFSLAYTSRPPGSFMPPPGPRGRSVRCWSAPRGVFVSTQWVLARPSRASTWATTFLARTSVPGRAALIFLSLARLRVRLYLHLNSAAECERE

SEQ ID NO: 973136 - protein, 125 aa, Homo sapiens
MLPRAAEPILSPADGWFSRRWTVWFYMVMYSRRFLVSPPPCSHKVAYVTSYSTPFGATSLPCGRMCVCGVALLASWGGASVPMWYCARNPRSAGEYYQAFVGDAPPRRFPILITVGGVVREAIIV

SEQ ID NO: 973137 - protein, 183 aa, Homo sapiens
GDLFFPGPLYWPPCVPRSGARPRCWGTKKSSAPVMVSYKRARCCWFIRRLCMRLVLHARVLIGDAVLPLSVEKSPFMERDLCSRASVCSVSRLRRSLVYTAPSQIFCSHTIHPRKPSVGRINPLSGGPSGPPANASSPAGDVHFARTVFRRADCNCRPVVSVGLSSDTPTYGRLRLIHRIALH

SEQ ID NO: 973138 - protein, 287 aa, Homo sapiens
FRWAPRVFELLLQFSAAHKRCFLSVDLDPALLPLRPWFTPAPLREHLPPLVHTYVRGISQPPPCRRSLHSGLSTPHPAPFRPGRPTLLAVRRTSSRPCVWISAPSYQEGAVLLRSGSTTRTYGPAFCHPLASNVHPGRNCVALSSKNHAGGPKDSFLVPLTEFSQNAPRPTTGWYHFRTRMRMLIEHRRVPLVLYWLPSLSQQYASHVGPLRWEIFSNNYVGCWDTPGTETYCSTPALEKEYCETHCDVPSRITDARGNPMVSGASSYYDTTASSGDESQKSLEDHT

SEQ ID NO: 973139 - protein, 142 aa, Homo sapiens
MAFPSPVLGYRAPFPQVSVPSGRVFPPHQWAPIPLGGLPPDVSPAADHFLRTKPGPPRYSLGVKQCLILLRRGIDIMHLVGHRDTQMVCLSALYSPREAAPPWWKLRGVPSSGYCTPPRSALAPTYHSSVVHYNFCTHPRNT

SEQ ID NO: 973140 - protein, 106 aa, Homo sapiens
MGVSSGTATPFYWPATVALPHKGLVLATPHTRCLPQVDTAAHIKCWVHERHFFHKATCIPSDACSVAPKIISSRGVSPPRGFFHHIYGWKKASATLISRPEPPFGA

SEQ ID NO: 973141 - protein, 177 aa, Homo sapiens
YFCAHMRSRFGVVRDDRPEQTRRTKSATVAEYTSVSHQSPLSVHGILSLASHGLGNSLRFYGALIFLGHCSSDTLRRVPICASAEKKEGGFVLCLLVQEIVWGARLFYIRGREPFCDQKYGKPTRAQRSILPTLLSYGDIWLKKHRRVPGTNKRRPVWERHTMGGSSPCRKTVSVGV

SEQ ID NO: 973142 - protein, 288 aa, Homo sapiens
SPRETETTNKRSSEKTDKPDRTRLFPVAPKVPPRSPLPVFNGVTPGLNPRNKLDCVIKNGRASESMSGAVASPHRYTLPGQYCEKRPQPNKGGRFLLISAFNLISCVQRFPAPLLGDVPQGFGVSKASPLWWSNMPRVGLFSSCYAAKGLKTPLLHNNELHGLSLEPTYVAELAPPARGAIEKVPKCCRHVADTHSNGGSPTGDRLNPLFVLNQTGKSGAEYGHDLPSGTKSLETPKVLPRRFANKRRITGARKGQTYHAHAEVHSLGIPRLNEQEHKRGGEIFWGIF

SEQ ID NO: 973143 - protein, 181 aa, Homo sapiens
FSPRVSCHDDYFSLVPFGSLYTISGRQSGPSRASPSLWRLSILDVLHARFGTVSPSFKGSGPALLRRLLVLSPGSVLRRPLGLSRPGSMFCGRRSSEEVLPYNTLGVLERHYGVNGTSPTPPAGSNLRKPPPAGSSPCARQNPGSHNVGAQRILFWICECPPVIVWTSKQRSWPPLPLGAK

SEQ ID NO: 973144 - protein, 153 aa, Homo sapiens
MSLRSSVSAPGILCAYLYYVYRRRRDHLSGVRSLRGRGCRDQRICRFACGIHSADPPAWLISSLWGSCLVRVVQCVCLCNIGGVVAASRRVLWHHAPMWAARVGPGPLVWCRVPPDVRYAVVPDDYFVVMVAPRCITSRFVLHVCASVRVGRV

SEQ ID NO: 973145 - protein, 212 aa, Homo sapiens
MGANQSLLVMPHGCRDPPRNGGAPAVGFTPVDLSGGPPSPHMVWPADPPGNLLESSTERRKTNPPRFPSSPHLVQRAVKRGAAPPATDLLFRPRRAPVPPTKGDTFCRKKPEVGATPPLAGPQPEPRPRRLNKTRKMIRVSPRRKKPRNYSNHCASGPRHGLGTRTAPALLRQLPGPNKTTTRTPGRTPRTSWQQENNTPPRGMDPLPHQKD

SEQ ID NO: 973146 - protein, 137 aa, Homo sapiens
MAGVSPHSVLSPILVVSVDIRVFPGGSISPRDAASLMLYGSTDCFLDRRGYFNDLIPRKCRNLSVHHGKDCEMSKRDALLSPRVATIMAAGPPLPHHCERPPIRLMMYFATNHSKEYGYPPKGGLARPLAPQSLSKK

SEQ ID NO: 973147 - protein, 166 aa, Homo sapiens
RGAQYLGRPPEYLVGAGVNIFERVAPGQISLGARPQKGSPTLAEKRACALVPEVSNCLIGAISAGSHNPSGLCFRGKIPLLTDVRWSAHRPTLAAPSFCLTTTSALPTTDPCPGSNPQDLRFCKATKTSLRLPELLKILPRQTLNTTEFDCTTSRIIQTFLVKNTP

SEQ ID NO: 973148 - protein, 255 aa, Homo sapiens
VVSCRRWASLWTLVQNGARVSLFHWVSRAAVWRGCEYSRAPDCVWREPIFPARVGAPPADWRRSSVSLLRRGFSTPVSSHRRVHRLQPAPGSSGRSLATISPANIGGGEGRNTQGEATKLVEPGTLAWRQGLKATTVPSTATDWGTPLEEGKITPPRLPHSNPVGQRAPTRPWRQDLPKANRQYVRGQAIIITISRGAPPVINGELPFLHSRFGRLPQNVLSLHLSPVESLTTQAVDYQKTLVFHPPAHSSSYHL

SEQ ID NO: 973149 - protein, 292 aa, Homo sapiens
VCLLPPVGWSLRRAICAYPRSLFGPRFSTGGAPCCDTGCWFRRVAASPPCGPPFWVDANGLPWSPPELRGQSPPLWGAQPSGPPMRGISCVRSGALTRGYPRCLFRHSRLGSGPSVLTLAAYYSNPARGITTSPLRVPLGATARAPMSFPGLGLRTPPDCQGTAPNVLSCISLCSAVSLFDVSPIVTSLKRLPPAAVPALEMQTCCGHSSMHSQRSSRARPVVVGSPPGEATESPPFPLTVSSYGPGPMRRSLACPAPVVRPRPAASSVAFPGPVCPIPAHPGEYSFASHNK

SEQ ID NO: 973150 - protein, 180 aa, Homo sapiens
RKLIPGNAQIRGSPAPCCRTESARPQRGKKQKKSSKQPHDVLPPPMGNVTPMGVPHPRRVSSKAQGHGWKTKQGVTNTRGEQKQPIVGSVRTWGVLSPGAQHTREAFTCRPSDSPPEVQEELVTRRGVVITSRPSCIPAALLIRAHLLQNAGCNLPPPWDQLRTIKDTVAWIQPQYGGQK

SEQ ID NO: 973151 - protein, 110 aa, Homo sapiens
NCSCCRIASPTPLVARFSTPPPCLVAPPLAPPGSSPTPPRYSPRAYFMYVHQGEAAVTHTGGLSGDQPGAHEVPLFLASTHIIISSPSPPRICPSTDILSFIWIRWGILF

SEQ ID NO: 973152 - protein, 199 aa, Homo sapiens
SRVSDGCLCSSGRSCRCCAAVCCHHCGSPLVYCCSLCGRVRNLVLARSIRVSRRGVPRKFPGIAPFAPDVCPVSSAPSWTRAFEWRSLRQRVWRYAHVWRGLSMYGLSYQARQDSWRDSSRQAAEGSPVLLPRGGMKRSAPLAPGWSFLLGGAARRFVLADGRVFPNEVGARPVGGGPRGLLTVCARMGPAYMLCRGSL

SEQ ID NO: 973153 - protein, 265 aa, Homo sapiens
MSPLGQHFPQGPPGLFAPEMALRVPLFTDGPSPPKFDIAGKSPSIEWCRAMCRKIASWHNLPVLAVIIPPPHFAREDWSNLVHDSRSSAYCPPLPMIRRAGFLLICTEHGLPPIMQPVGPQAKMISLAGHPFIVSCSTLCPRDGSLTPECCSRVCLCSPTVASAMATTKRYWEAPLPIEKRVSFEPTRPQHRLPCEIVELLTMVVSPEPLTPSYRETKPSRKFFPLPPPKFLGTSLLTHPFEIRRSNYPQKRHNYTSWVIHPQKT

SEQ ID NO: 973154 - protein, 198 aa, Homo sapiens
LSSKMRYTNGEAPSDDRTAEVGRRKRRRESEIIPTSSSSYSLSRKKILQELRTISACRGGDDFFSPPCYSFFFSLAFCMLPNVSFAGEAQSAQRTQRVCSLCPCIYIKRESRKIIRGHTEREKHSRQRIEKERYTSCVTKPPKRSEDREPEGAALRGAMEKKVRTPLFLMEESELAPPSQKVVVRSPLGRQPRNKQAN

SEQ ID NO: 973155 - protein, 314 aa, Homo sapiens
HTIPRTERYEVRSTRGVWCISGFWFTPAFGPVHSLFRARPEIALQDKTLPGGTSLSTWEPFPGPRVTVSTRPLAAPAGPIRRDEAFANFGPPVSAPPPGSSRRSNPCLLAGTYASAPWCGGLHQQPVAGAPPRVFSPPLPGGELSPIGGPPARNLAPAGPSPVDLSYSQGPGPLVSNRGAHSIRVGPPPEGIPLAGSQARPPVEIVHGGWEKLVCQAIWHKNGVGLYSGLEFFIRRSTPRLIPLVVGRCYPTPGSIINEWGSKHPGCRPSLQGNTWRVSRTDGLQRVCQSRPTPSTHSRGPPRVPKKRGYSPHD

SEQ ID NO: 973156 - protein, 127 aa, Homo sapiens
VRDVRVLSAALSLPLSFCTLRDAPLSYSLLLVVIFLPRAPAFPPAIGPLSPFVVVQRPGAPGRAVPPVCWPRLCNTPFFLEVLRILHGSGPHQHWATLSLRHHTEVPLAKHLLSREPATHVIAGAWA

SEQ ID NO: 973157 - protein, 266 aa, Homo sapiens
MASSTGCLGPLLVGLARQFCVDAFQVSRCGPVNFPGVGPFSPGAGSQGAPSGPLCASFCASHPLTVRHRAVFVSGEVRPPHFRRARVISMAPAPAFVVPPAAMWRSSLSSDTWGGPQGSFFRTPWCDLSGGPPQSEPHGLFVCLSPVHESGTIRLGALFVFICSFSRDSSTHEDHLRAQLLPINLYNVGPLATHTKFVVPTPSGKGMTDSDAPSVRHLLWRWLRKPLARVGAKSTPTRGRTPDGSCSLMPLGLPPLPPQLPHHLYP

SEQ ID NO: 973158 - protein, 116 aa, Homo sapiens
MASAYSTMYPLNPHWDTLYIGMARHQVPGNTDNCPTKNILVIDAPTKWIFVFTWPNERMIYKPHAYKAFFISKALCWIRPQFWKPCDNASQSYHRPPPPNSLNNEDNHPGMCHTPW

SEQ ID NO: 973159 - protein, 199 aa, Homo sapiens
GTRPQRASPYVFFTRALGMSAFSLITSGVNTPQSDVCVVTPRQAFLMVTPDNIWDSALLLSQSGSPHLSRVLAHSISHTCGGTLIFSPKGPLGVLLAINNPDNVDTPEQQSTPMNFVAPTSREVMTPEPNLGVLLIIIAHDSATTPKHFRTVLGPLTENDRRSSFFTSPFTEGFLLSKAPRDPEIPPGGGEPKGILIKL

SEQ ID NO: 973160 - protein, 96 aa, Homo sapiens
LGKPLTAFAEQVRPVFHPPVPSRSFTGLPMKNCSSAPAVPRRESCGGKRAQPGAISSDVFPDGAVCRHVIHTLLVGLFTPALFGHPVEHPAVISHV

SEQ ID NO: 973161 - protein, 207 aa, Homo sapiens
SALCGGPDTSRVWCVLDEKSCRLSPVLAVDRGSAGCVGRCEALRERGLPCRGGVRHAPPPPVAVSVCLAGPRLRGVWVWRLSPSVPVCALPYIGRSSGGDSIVGSQMPLWHEKVIASGAQRRVGRSVLAPLLRWEGALSPHLRLSLSLLVHPGLRWVLVQSTAPVLMVCSGFAPLPGIVCVRRNPPSRAGFVTRCLAVLVDKGSRTY

SEQ ID NO: 973162 - protein, 169 aa, Homo sapiens
NRGSWAPPTNSSPAAKLRGIITTPATVAPLFQTGGANPLPGRPLHTPWHHAPHGEPKGSAPCGTNPPYRRGALPPRRGFRISGTPPAACHYREPAPPPPAKGRTGQGPQLSAPPPALGSSGPLSFTTCRELLHNTPPASLSPLRCTTRVVHTTTTFQRDSSPPPPDLHQ

SEQ ID NO: 973163 - protein, 181 aa, Homo sapiens
SCHIGPLWVSPPWPVVVATTVPLAPTIVCGVLTTALSCAGSLGKRCVIHTAPFCQRGVHNCRSLGMPPPTFCVGSYASHSLLAPGRSSRGGAPLAPPCPRFLFESLPPSCMLPIARLFGPPLSQSSPGWAPQCPPFGPPNGISSPGGPPHNPPHGPCCMVTACSLCRQPTWALLPRSCAAD

SEQ ID NO: 973164 - protein, 317 aa, Homo sapiens
VVPLCTLLRPQLLSSSGGPYTTLRDPSPGLPIQRVEVSPKTEMLLAKQSLFCQPEALLFNSPSLLEIGPGCPTDRLHARGLNTFAALCYLRGKSSGITTVDFPPGGSFSQPQGPPFVASGHLPNKLTSHTLRVPPSAMSTFFYGTCPLKNEVPLRWRFKHAGSAVPPLLSGARFNPRLPLHLRAVNPTALRGSCCVQPPATGGLWILFSLLVLGVFTRIIGHNPTLFSQLDIRLAGLRSLVSPAISLFLKEDLVNNLPFWNINTGAPYSVPLCEMFLRSMQIVSSPDRHSSRFNSRYPLPAKNPIPPKKVGPRPNIT

SEQ ID NO: 973165 - protein, 134 aa, Homo sapiens
CEVFVPAPCVTGVFHPYAAAEGCSSRPCWTSSYTLCQSAESPLPCDELSPSPRGTPTRVLLCLYQGRPRVHKRDKTSVGPPLNKGLASHPVCHRSVSWEPIASLTTRRTLPHGREHGCPNPTVGANVGRGDPPR

SEQ ID NO: 973166 - protein, 93 aa, Homo sapiens
MNHSLLYSKRHLYIMHPREKYIDYAHHYAAHMPRHEEFILLDVIRHLKMTPPIFENTPHHTFFYACSRVYCTIRRSSLITTLASSSTNQTNKT

SEQ ID NO: 973167 - protein, 250 aa, Homo sapiens
LGPFPEGSLLMSPRCAPPLWARANDSEVPPLLLAWYAPLDPLTGPSRQSLPWRRVTLIFPFAGEVKIVAMICLFPNPSNCFFLRRVSFPRELRPTHRPARHPRSLPPRTVALIHTHLPWKHFSLLSLPPDTAHNPLSVFPGTRPPEFIFNRRVSTLPFGTNPLPRFYYSLPLNFTPNEVKEDTPSLHPAVTTKRLVAPRSVTTHFASTPLYTSVLFCALKRGQETLAPPTPGSSPHPHSLGSSHGDSVPT

SEQ ID NO: 973168 - protein, 42 aa, Homo sapiens
MIGRSLYSDYSPWIRFLWCPTILRTATENFEKNSFGVSSHKT

SEQ ID NO: 973169 - protein, 88 aa, Homo sapiens
WKAPSCVHVVRVWWVQLRVGHTRRCRTTKEPGAESDRWVPYTNLPACQLPAGPAPWLFFAGVFHHPGLYGVKRARTACKGGQKGFDPL

SEQ ID NO: 973170 - protein, 304 aa, Homo sapiens
VRGCPGRGGWIVGSGPCLGAEGGPASRRGWRVGRATRAWLLRVPPARCCGAGGRPFGSSGGVWSAPPAQAAQACYFGGSRRLPRAVVARGAGRMPAHCFPREIAGASAPTATLCAVRPGPAFPPRGRPLTSALGHMLGGTIWTLEAPGWWNEDSRGVASLLPGLWAPARWRPLAPVGPPLLAGRVCVSREVLSRERVPGASPHDPRSLCGTPCVCEKRVYSVSSPRAEKQHARVTGDREHTEWMGGHPVHVSTRPLLIRIPQDLRATHCYAPLHAPASWTTHQVFPSAPRPIIIFFLSGTRPHS

SEQ ID NO: 973171 - protein, 201 aa, Homo sapiens
MRSVREDEVLRERLVIGGAPISPCHGVRETRDVPTVFCRRKQVEAPLSSAMSRTLRRIGWDRPVVVALTQVLLPGSTQESATLEFSARSKCECKVLTSASVLTSRSLLPEARKWRQIEGNPLDLFTTDGVCIIRTSCFHDYHEPHVGVLHPPLLKASLLSSLLVEIEMNRHITSSQSSFLRSTSALVSVRPETPPPPMYEK

SEQ ID NO: 973172 - protein, 301 aa, Homo sapiens
PGGCGAAVSRSVGRVARCVFVSGRLSFVVGPVLLRARVVVRLRGLARASGGLCLGVRSCVRVLCVDLGPLGPSWRWAAHAVYSGPDVGSIEAVGRSVCVAARRLLGAFVSRLATRSPPRRGGCDIVLRSRPAPVWVSTHRGGGVPAARHGEARGVTRERNEICVVVGGVHATCRVFVLKHQSERRPRHRLVGALAARGRCVFPLSHAGVGLRAVSCRHQLSCVLTYLSRPQHVDLLVTQFSHHPCYTHTINLLAVPDRRSLNTPSRVYNLCRQHENYAECPLCRTSEHSTRFQNGLKRKHE

SEQ ID NO: 973173 - protein, 207 aa, Homo sapiens
MWPGACWYSRGSVRGVLLGRRSVLGAACAGGGGWSGRCLLLGASVLLRGVCPWGAECVVSWRGVGLGRSVCSWWRDVGLVVVVCEVTRGVEPRVVVGRGVHWAKDVGRGRAMVQGGACCEPTGGGSVADWVSQLVSLQDGGCIEGSVEFGGHHGGDTPRGGLSRWVTARDWMSVVGRGTAEMRPGGVERLGSPASWGGGPHSRLRRE

SEQ ID NO: 973174 - protein, 113 aa, Homo sapiens
MSLGWWFIVLVAAAAMESGSRMRICFPRPGGCGGEVRAAVVVCAAPVGNNPRGLNSPLVVMYAPSLCSGTFPPLFYEGSSHLERIELPALPTRWWEHPTHSVDLLLKSPLSSN

SEQ ID NO: 973175 - protein, 283 aa, Homo sapiens
RVGAHWCGQQRCLQVWRRLCPPPSGGTLVAAVGGELVLSLATRLYQHGRLCAGRVLVAAPPDESVLRLWWAGGWHTFVCSGDSWLRRYRLPRGAFDVGRLLPAMMVSKRPCGEGAPRLVVCAGAPCRHECPRGSVNARLGAFNPPGSARCDESAPGGPRGMKMGPGYRTSLFCCVVMHAPPRAVLLPALAREAPVLSGEGTLSVTAPPLSLIEQGREGNALLLHHSTVGGSDSRADRSSPRGCVGCAPAWGAAGGQLLFRGRCNLLRQAVVEDLSLEPRRQYV

SEQ ID NO: 973176 - protein, 142 aa, Homo sapiens
NYALDVTLLGDDLQRCGLLRQVVLRHRVGIYCYSACASYRVVKLVYDALHGPDRGGQSGVPVIKRFPGGIAGTPCGVVRRSRGTAVSTPLGDYHCSQRANPLPIKVLLKRPSREEQGWFRVQGGIETKWGVNGGHYPTWRDH

SEQ ID NO: 973177 - protein, 108 aa, Homo sapiens
GRATMIVVLVDDSVVIRCCCFCVAVLWLLLFLGCLCSLSCSLGLVWVVLLPLSSCGLCVGASMSLYVLCAPLSCVLVSPCCVAVLCFFGVPSSPSVVLSLYLLACASL

SEQ ID NO: 973178 - protein, 110 aa, Homo sapiens
MAFWFRHSLARAYDGACQSYRSGRATACDGAATMAPVWTLPRTVFSVWRHPSSVVSSNGLTLNSSICSPPAQVEQTGGDVSPPASGLRVRMVPINHHAPPCLVPPPRGPP

SEQ ID NO: 973179 - protein, 286 aa, Homo sapiens
GARCGGGVGVAASGKSWVGEGGMCVERWVSDARWDVVRGGAGVRRRVVALGVAVGPGGGGCWPQGCGEGVGQYAPDAGVWRRVRTGGRGAVSFVWVSPWVFLRACVCGWCPRVVVVEVGGVTRRRRGRVVLAGRDGVLSGARTGSVWRSRGDDGGGAAVCAVCVRGWLPRREEESLGSPGLQGPRGGSPPSEMVCGASHVPAPVGGGARLWAGGLRLCVGGEWRGVGVCVYEGCGRPRVRGGARGARFRVVCWPPASGACALGSLFVRGQRLESEGNPKEYCKKQD

SEQ ID NO: 973180 - protein, 269 aa, Homo sapiens
RVGGGGGGGRGGVAAGGCVVVVGASRVELVVWGPRGVCGGASWGRAGGRGCGRGSGVSGFGCGGGGCGGLPPLVVGSLRRLRVGPHPVCGDVAVNRCCGWSSPVGLRGGGAGVCGGAALRRGVAPPVVAARGVPLGGPRGRGSARVACVCRRAGVGMVRRGWGRPARSLGYVGRWCRSVHQPAVLVCTQLAGGAGCPTRLCGAGDHRGGACARGRGCAGGAAGDAGVAAPRGGVWPAERGFGAICWAARPPCWRPPVSEEGWIPPRIFG

SEQ ID NO: 973181 - protein, 134 aa, Homo sapiens
MIRLRHKADHPGGFPAGRHQVHATTSACSVIFQACFPAAHVRCEESSRAARIAGCPRQIGDHAMGHVLPPILLSRTPMRARPRAMNARFRLSRSCFTTRSNRARASAPTARERPQPGETRPPGVFKKIPKAAHK

SEQ ID NO: 973182 - protein, 270 aa, Homo sapiens
DDPVPRIVFMGASQLVLQNTVPPYAMFTVSTLIAMAPRYNPALSGREFRRHPSVSLDVVSAADIWRGDWLVPHPREFAASSHVSCPPVAPVDSTASRVVVGAAVVVFPTTGLLSLRVLAGVFNSFQSPSGQSLTIRDELVHSHSRSCILLNHSYYLRYMGFKKNLRTYFVPPVSSTPRGALFPLDVTPPFLRQNYHPFGPQHSPTLEKSTNHHPPWRNPTRYETHFTSPFHKDILGILNSPYSATKMKNNLLLLLHHYEPCAEHSQSHIK

SEQ ID NO: 973183 - protein, 55 aa, Homo sapiens
MTTYLPPCAIGEGAPPRRFYSTDHNIMVITSVYNRLCREAPNTPRKAALILDPHK

SEQ ID NO: 973184 - protein, 134 aa, Homo sapiens
TGGVRAPIICGGHVVGQFRPHEVSVCWRKQMIGPLWGEEQLVGSTRPRMLAGGDAPDQRGWLGPTPSTHTVVTKPPLEVCVATTHCVSTKHPRRRMTSCVTLRASRECRKVCVSWFSTQSTTGSERAHLRRRRR

SEQ ID NO: 973185 - protein, 539 aa, Homo sapiens
MRHAAGLCKVERQSPVWAKWTQVPGSRGEAACYSAISLSHESNHAHLCGSFDVASQAVETPYHAKSVLVDQFASRSTLIMANHCVRCRASVESAIDSHGQNSSVTRVSDDREDASHSVLCVVSRNFVTSSKTYHTINARRMPAKHNLWVLSIALCILSLVSHPWCFPAFPPVRTQRLSKFDLERHSGDNVMDRVSEPTGLPLGFHTRVITAYPYTLAPLLKVIDRRSIQLYVPGREEGLKIWNVHKANIHEARLGAKHSRPNDLGTCPEMLPKGNNLEESPEALSEPQQELGGSRISPLSTVGISTRSSLRIGVRELVRTWQRRHVVQHLYGHLSETFKPFGNHTLMGILGNGLESQGGAAGEFSARNKSGPKRTKSRGLGGTIPRSLRVVAVQMNVTKGHTPIPCAETRKKAPSMWNAFQRQQSFGSKDTRGKRYPTLKRARDRHGGYEGQRHVNRIELPEEENSNTYGNPSIRYTEKTATTTGDKQDLENKTQQNTVSQNIKDGTQQKNDTRTDSEDNTCKLLYNDQPLRTKRSQRL

SEQ ID NO: 973186 - protein, 177 aa, Homo sapiens
MLVGPRYVLCRPDSSLDRLGVCIRLQKFEGHVKLIRETQGPRKKGHTPALSSNGSSNETHPPKLADPLQRHGRGRPLSELGLSTQASRLETCPSTDWTHHHGLGRDNNGKGGNSLVVSPRSTPGCGTNPGSTIKFPKNPPRGTVTKSAHRQRELDNGNKSKAPMTANGLVRYKETTY

SEQ ID NO: 973187 - protein, 264 aa, Homo sapiens
AHGPTSMPGTHRHRQRLYQLVSTRRDPDRTFAIEFLDPVSMRTHSLSVEHGRPVIRAPSSTRIPKEQTMNPIPPRDAARDGGAAMLRRIGAIAAGPTVFGFQRIVNSAEPMRTVPAPTLDETPGASHDETAVFAGGCFWGVQGVFEHVKGVKQVTAGYAGGASETAHYALVGSGLTGHAESVRIVYDPTQVTYGRLLQVFFSVAHDPTELNRQGPDDGPQYRSAIFPPPRSNARRDRVHRAARGAHVFPAPVVIARRAYKGSIR

SEQ ID NO: 973188 - protein, 160 aa, Homo sapiens
MPLSCGFLLRNAPPPGRRPGYNGGPGACVSSPFVGGHPGLRRPLSVLWAPWGPPRFSPPVWRSLCPSFSPRVSAGFPECASSALCVGVAPPRESFVRELPPVGPVEEPPQHLGPLWGALGKLFTRATHNLAGDPPPLWRCVSAQKAPARERETHTLERDK

SEQ ID NO: 973189 - protein, 74 aa, Homo sapiens
GRRVNVNVGVLGHIDSGKTALARCAKHHMLHLPAFDNACLQMPAELLAITARSGASRASLVPAALLRLLVCLLP

SEQ ID NO: 973190 - protein, 74 aa, Homo sapiens
VKPDMNMDVGYLPSCCKQLQVHLPGPVTLSSAMYCLYVLEQIPQALVRASQRRTILVNAPGFLESCTPCIIGAH

SEQ ID NO: 973191 - protein, 258 aa, Homo sapiens
IAGAAAVRGSAGRVPEPAGRRLELGTVALFPRATGSCLVWPWEDEVRWSDWLLPVCLLTLPACFCLLPAAWLLPALPACPVWPGAACPECLMCPVDAEPSEDLAYQMWTDVLLGIAWTLLRWLTRPTVVSEGCAAASTAKCLPMMPAASTAWIDLCLDGLREDWWRGACVAQDGWRQVTQMVEGLSWGLPQGTVQGRSLHTMNCASPLLDKSAPLEGQKARPGLPKAPRFCYRTGRLHSLVAVKGSALRADHCGPEGP

SEQ ID NO: 973192 - protein, 64 aa, Homo sapiens
MRAGGTDPQPTRTEGNNRTAARHKRSNGPGGRPANTATRAKGRETRREKNERQREGKLERSHRK

SEQ ID NO: 973193 - protein, 356 aa, Homo sapiens
LNKREHGCCRLQWTLPPTSRGLRSGLSSTATMTCQRHSLRLVHDPCSGPHQLLATMYLTGLRRSGFKVNASCQQPERRSRSGRWMQPPDECGQLRPCACCSHLGLLPVRLDNGLATVTCELRGAQVPDLPVSSSVAQLTTGRWSLHVRGCTGCYFGGTEDRLSCFAQTVSPDEKWSVHIAMHPQVNIYSVNRKRYAHLSARPGDEIRRGPRQCLGRRLAHHLAFQDQSYSVQNREQRFLRHEGAGGGPKPALVPLSPIGRRPPGTWQGSTLSTRCQWNTKGSWPHSGARKRKAWDKKGESVVRAAPTKSTRRAVTSPAAGRPEPTGTADNSADNTNDNQQTRQTQRERAHTHNTER

SEQ ID NO: 973194 - protein, 108 aa, Homo sapiens
EVLLMYQRVTHGSQTVTKPPESSYKCLEMSKRDCRPRQTVHGSGSQGNKTKMKRARLVPNLNMSCITGVPSHTIMNMLVNDRDIMSGGHVVLRSVMRWHEESDQYAAV

SEQ ID NO: 973195 - protein, 56 aa, Homo sapiens
MFGPKLSEPVSCCWRDRGPVVHPWVMPAALGLPALLYSACLTFPGPGGGKREGRHV

SEQ ID NO: 973196 - protein, 497 aa, Homo sapiens
PQRALSSPTAACLCLVTITPLCDGCLHAACMPVPHVTITCNLMMHADVPDDPCMPALLNTINSEQTHTDPYHDNTQRPTQQPLSTYPSDKTSRHTDSKDENTEEDGHSNTPGQDRKCTPAARAPSHHAVHYPTTPDHPSHPGAHPASPPPASPTPGHPRTTAPPPPPTHPNDPAKPARPTGATHLSHNRPTHHTTNSAHPHHRHQHTPTTARGATRPHHPPPPHNDAPTGASNGTLDEPAPAATRHATHHAHEHTSDHPAKASTAPPTPLETADPQGPATTTPQTAQTRTAPQPPPNSDRSPTRPKPPHPNRHPARRDEHATHSGERRLDGQRLRRRRRHESLRLRQEVRRASAREPPQDAPCSARPGTRDTALQRRHRAARRRHPADEGATEERRRRTRAHAQTQGAERQDRRRSRKADSQDTTQDKSHKPTKLQYKTIPNQTSPHNTTNPPSLTHNTQVKKQPYTHHRYHNTNTRSTPRHPTNPHHYKTLPPTPT

SEQ ID NO: 973197 - protein, 342 aa, Homo sapiens
MDMSGLVHLFVSAVVCGCCCAALWVVRGARRFVLFACCWWAFSADVVSPRCVADCLRLGVLKFPLACVGVCLLRGPRALSRAVRLFFLVGVGLHPRVEMFAGELSIGGCVVSRGVVSAAACRCLHGGVVCDWERVCRAANASGVFLRGAYSNGVVLPPWVGALVMYVVLRRGLICRPPGMVLTIGGPLLCVAPVGSSLSLDRLVSGPFVVLVYIDVGGVLFILGREVVGGLSMGVHSVVSPLLKCVPGLPLPARCSAVVVPCAPTFRSPLGDRPLLVPHPHGLVPRYEGPSHRPPLAGFPLPRVVGDLLRVSPCPRRGLESTRGRGGSESGNVPRGLFPLLC

SEQ ID NO: 973198 - protein, 195 aa, Homo sapiens
MRGGRKQATTTVSTARPTLTKRAREHTRSTCAHPPTAGRSHPQAKAKNHHYERQTNTNDPHPHTKDSTAGAEETTNNPRSRQRRFDSTNNQTNAAWLAHKQRSVWSRHHNTEIGCKTTNLGKRNTHEPDVDVGAHTRLKWSGTHMTHKLIQYRNDHLQQDRDSRRGGLATYARPHPSPREDRHTSSHSIARAGRR

SEQ ID NO: 973199 - protein, 438 aa, Homo sapiens
MDGLTMVMTKMWWRLKRNQGMTFLNAEGRPWTKSARSATHVVRKGPPKTSEKVQDAADTLNTVNRNSSTETTKEDKEATNARAHYLQEIPRESRGKKKRTSPQETRAPQSRTPKKQRTNQRATPHPNTRGHHTDRSTGNPWPETNNANKRPTDSHKITTTAPTQTHRRKQTTERRHNSNTAAAPPKQKREHNNKRTPKTNNRSRGEEERKRQQQEQRETTHKNKTEQQTKNNTHTRPTKQRTTKTKKNKTKPQQQQKKTKKNRDKETQQQQQPKTKDKKKNRKQGSSWGLKQRVEGSESGRGEIGEEREEENKEEKEMKRVLSKYSRERMSRWKEGSRRRRESTETEQEEDGEKTEGRQPGGREKRGKRHKEAVRRGDRETGVRRSQHSAVEDNSQKGNCPGSSERLEGGARMRRINAKAEHDTSTGGTRTQQARKRV

SEQ ID NO: 973200 - protein, 107 aa, Homo sapiens
MCVRCRTGCARGGVTSGVGCRLFFLVVRSRWLSSHHRGGVFVVAPLRDICLASLWSSPARVVFVVVGVALPCVGVPRGVLFRRVLRWLVLRSMPFGGVRLPQQCVVV

SEQ ID NO: 973201 - protein, 189 aa, Homo sapiens
DGGEVDLDLEILKDFGFTLYKDNNITTGQIYQHVINKERRGDYLGKTSATVVPLHSLHAVPGSGFMQSKPKVPVAWSHKAKQPPNMRSLSWAGHPLEHHRKECRMWQAFRHIPSFKANNERISLISTLASVPQLRCYRENKNNKATQNSVQRTEGFRPVSRSALSAEVQPPIAMAVTGDAFLMFVHVNP

SEQ ID NO: 973202 - protein, 188 aa, Homo sapiens
RPQLKHIPAALALDSDRRKLPSGAMSAELELPWCMPGGRAMPVDSLCVSNLHFSNNGNGGSVPASVSIYNGDMENILLDAQHESGRSSSKSSHCDSPPRSQTPQDTNRASETDTHSTGEKNSSQSEDADLDRRTDVDRISKTPLPHGYGHRSRSAGHISPPRSSSHPPRPARPTLSMRTHDRPAPPGA

SEQ ID NO: 973203 - protein, 346 aa, Homo sapiens
SARTQTFPNSSGILRTSCRQIDDFQQLQDFPDCKGHNHASNLFKMANGCLRAAFPTGSSHTHHCSVLFSGLWAWHAGRLTQASSSWPPHTQHTHRQLRGPTHILVQMTPSFQLHLQYLLQGHVMHHRGPTNAHTWLPPDFIYPESQSQTGPYLARVLKHRPEAEGVHNRTEIAYGGAFIGKRSQRCTARPNCKTWAHSLCHPLITPHRTTPTGLHRFAHFPPKIHPNPLHAYSIHDTSTRGNGVRHTINPPNKAINSTTTGRKTSPPPTQTQPPYTPPTPAPTSSYQTADGTTNHDHTSSTNNTSSGTRRATRPMARTSQRAPPTLHGKAPNLGTSDIIGTAPAMA

SEQ ID NO: 973204 - protein, 322 aa, Homo sapiens
WVCRDAFALTSASGIPLKPDQSVAQSAGQPLSLRPGEAGQRGRGLGVARGGAQAFRCQAQQCGGICSKQAAAQADLLPSRQQRGAPCWASPGHGILSRRSPLTPCPSRHQSLASSGPQASQGQPLVPRWPLHHRSVRRRRSSGQARQLTHALQRPYTQVDPEPAARVSIPRAHSRARALAASARHLTRRSTLRLTIGAATYTIIHTHLPPYTHSRTTDTRTDLNQKHPHTSREQTTTLYSPRHYPPSPHSTTSELKSITYTSPPTYPTLPRTHSHNLTQHNLNAHNRKQAPVLRHTFTKTELHNAPSTHALTRPAHATITRQ

SEQ ID NO: 973205 - protein, 357 aa, Homo sapiens
MRLVVAMVVNHRGGVSSGSRSLEGGFVAIYVLWVATHSVPLVLLWARWVHTPCTGGKCALCAPRQVVAPTVLGGLTGVATSTECVFWRSLGSVSLMRPPPSLCTTYAYCGPLRVAPQGPLQTGPHVCPPGPGCVGAPWGQLPQGCFVRAADSHPRGFMSVGGDPLWVFRGCGRSGETPCVGVVWACHVWFETVFVGAPHTGGVLFGRVVEGAPPVRGPLVGENIRAVCGAVCGPSWPSVVRCTSAVCCVLMRHRVLFPSACLPQGRQGGCLRRGRSERPTLGGLPVCCHGVSYKGAHGCPRALGGPHCPAPTAGPDREPLGGLEDSCQHPMLWIGPTWVPSPDHAQLREPYVCSWNR

SEQ ID NO: 973206 - protein, 156 aa, Homo sapiens
KPEIRRSTNNRIPIRGDPHILVVGDPGLGKSQMLQAACNVAPRGVYVCGNTTTTSGLTVTLSKDSSSGDFALEAGALVLGDQGICGNRMQSCIKMAAINIKPCRQAMEPATAIQSCSQAGVVLSAFLQATSIHCLLHNPSWRHIHNTSQQPVSRAI

SEQ ID NO: 973207 - protein, 134 aa, Homo sapiens
MCTTHSHPNHHPLETIYTKPNRIRPVDPPTKPTLPDLTSTIDPLAHATSHIETLAFNIGDSNTTDEGRTPPTAKHNHGGHHTQPTYTTMSNSPITQTRSANYPYHTHTTSNELQRMTQSDVPTQQRKNNNATTQ

SEQ ID NO: 973208 - protein, 335 aa, Homo sapiens
CWSFVAAGLAGVSFVLFCRGLWLVWFVALVVCCVVVVVWFCFLCAVFVCLVVVSVVACGVGLIFVGLVSVLFVCQFSLVAGLAYVLRCLVCRFVVSVRCALRWRCVFLVGCPFSGVCALLFVLVVPSVFVLFSSFGPSGSSLRVLVAFSVCLLFVSLCLGCVTFYLVVSCVLPSELCGWCVSLLSLLCASWCLCGCSHRGGCVPPWWGVCLFVVLLLLRFFVVFAGVGVLWGVCSLMCWSCGCVPLSLWFASFSLGACVVAPLSVGGCAVVVLTILVLLFSISVCGGALCWVLVALAPGFDPLFVPLRVNHPHISPACSLVALSFVSARLTRWWL

SEQ ID NO: 973209 - protein, 358 aa, Homo sapiens
MYGCTGGRPPPPPSGGLTHPIYDEGNDPTLGGAIGGRDVLSPPPRWTDSTHQPPRSAGRRSGGRRNNYPPNDGGRKKYVRTYYLAGWWMDVVRSKDGWDHHPTHHPSDDPLAGWSWPPPPCLAAACHSLLALAAAWLAGWFVGWSPLVGAPPPPGGLNHCCSTNNTAAAARGPPPAVRTGAHTLVAAVAAGGTPQPPHTAPLLRSTTPAAASSCATQQQAENKTTTAATLTPRRGRTQVCTPSSSSRGGDDYVQRDRLHTVRDCPAVAWCGDECVSRSEDDPVMLHERRPPRGTTHSRTHSSCAAQGEISTPESTRARAGTHRESPCGSSQQKCARVALTQQTHTQEQSAHYSSHSGA

SEQ ID NO: 973210 - protein, 179 aa, Homo sapiens
MTRSHTHQKRRTTRRGQTRQQNEAHAQLQQTTGREEITTATELTHKNPNRADIRQSQSAPPTAAQSHPQDDTSTTHHPTTTTATSPRGCTKTKKSQGTNNNSKDVASNRGNQTHYVQTNGRRGKTEPNVTRLAGSPNKPWRNRVNQGDRNTDKDRGNRNKQAYTQRNDKQQQTTERVGV

SEQ ID NO: 973211 - protein, 211 aa, Homo sapiens
MRLGTTGGPTRRVYSQRTPRGKAEAGKQQMEGHTLENQPEPHLVNPRVLFTTNKNNTTHHATCTGMCPYDPTDNSEQANARRTTGATTGGDRKQMSKIQHIRHAAANRVTHPVSPNTHNATEETNEKDQHTHADYANRRPNTNHNERAPTHTHTQHQTLTSPHTPHKTATPTHGRCQPRTSAQHTDDSTPTTRRNMDQRTKNDTSKPDYDT

SEQ ID NO: 973212 - protein, 45 aa, Homo sapiens
MTHDRNGAATVREEGSNERQTSKKAQSTRASKGTSNRDDCSRARR

SEQ ID NO: 973213 - protein, 530 aa, Homo sapiens
FSVRGALYSRVQHTHTHRGHGGLGAEERGRDTPHQDTHTGDSGGGAGPEENRASSARGCVPWGSLWVGPGGGSRGDRGRAGGVGATVRAHRGGTHEGARGPRGPRARGRGRERHKHISGSGHGEEALAERWRHTGVGCGVRGRCVHKSKRRSLRERGVCESTQEERNNGHRKEEKTQNNTRHTTSRETQNTTGLSARALRGTLRGGETLQGALSGATTLGGLYTPTERRRQRRDTQYLHTKGPRGSTRADHRGGSHKCLRGPRGPTGRSDVAWGAAAASDKKRGNKHLTTQDVLITPGGQTHTWGSNRASPTGRKKEEHRGEAKQPPPTMMPNPPCQPTNTTEGANDHDRTARPQQGKQRAPPPEKGEQPTPRQDCDPTSEPLTQDGRKTPQPQEKNPPAPTDETPQGGGRNSGAQQVGPTNTTERDKTERHTTTTERPPHTKKGELKSNSHNTHHPQIHHPRQDKQHNEPHKVVTPEELSTHQKLSHFIETPMVDGIAGPPLANTHKRRQIMRPGHKQTHVAHHTEGTT

SEQ ID NO: 973214 - protein, 176 aa, Homo sapiens
LVVRRVEGDGLLQAQHGGQRVLQPLDAAMRDRDAMAEAGRAQALAREQVVGDQRPRHLVVVLEQQAGMFEDAFLAGRIHIHQHIVGGQDGGETVHGRRPVIGGAVGARPEPGDGSSQSSRLWNPGRFGVGGRPWAVENASPGPRMRVFAALQQQPTCHGLRIAKTKRPAGRRGAWP

SEQ ID NO: 973215 - protein, 270 aa, Homo sapiens
MSDDDYFQRLRELRVDALLLCGLLVGIYGRLVIVCIGGRPPRGVTRAVVPLLHVREGVVATNQGGHPPEILAVAGLLVGHPAEAMLPSCGGLPRPRLFRACVVCEAPSPPLGTFGCPVCLPIFVSPPFPGGLPTSPGAPRRVCPGPHRDVVGFWVAEAPLLEEDLLLWELCPCPGVWSLRSLSPRFRPRLSGPLSLGFRRARVCGEEPQATQPLPDRLGPVLAPVGPPSLGGSQGLRRPSVGPPDVRRLACVVLGVVLSSLLHPRLRMVF

SEQ ID NO: 973216 - protein, 337 aa, Homo sapiens
MDGREKARHPVLCASGRPYVWFLPPLRFLYGTVVSAQSPPVLEGPAVGPCTLLPGRDCLSLVLSIHVLPLLPVKVFPPVKGEPCAVSPDVPEQTCRPELPERPIDVWVPPHQPRKIAWRPTFWGTCLVILGASGELFRGNYPPTTLARWRQGLAWPDVGSPDIQSCDPPRDRRPSHPEGLPNIPMAHQGVSHLASYPWLHSGIRGAFGGPSGWLMVHKLHGAPRNGPELALLTLRPVDLPNSSTSVCTLPRGNVGLDVTTRVYLTTGYFSLPRSPWGPPSSTPGVTQHAHWATADTLEKPSHECLPLKKLKELKDEAIEHHEFNEVSREFTRGRAAL

SEQ ID NO: 973217 - protein, 321 aa, Homo sapiens
MAKEAGRSCPRSETRQEQEGQQEQKKGGVCDNMCGPKRSYSVRPWGYTECSTFCRRLSTNHGGPARREHTPLLGFFGGKTPCVKTPRVMCKVSRAPPVKGAPGRKRRRLRSETHEPQRCPDEEGIKGCRSLRSLRGKMGEWDPAPGFCPPVPRPLCFTCAQIPLCWKKLSPSTPMRTPSLVHCHNFGNTLIKDRGPRGTQSIASLENSTQTFMSCHCYPWESSHDWTQLEEEKPLPESYLFGTPPYHSPFLEFGSSEAQTCPFSAESQIGHGGLPSQTHHAGNWSLPARRPPTAWFREYIFPGRGPSRIVGQTFHQGQIFK

SEQ ID NO: 973218 - protein, 138 aa, Homo sapiens
GGRKRRREGATGRRELKTRATLSYQTWASLCSPVFAGSRPGFVCGGGVACSWVCAPFCGAWGPRPPHAEGVPPLRRSRAWPTMGQNQRAPCSCGRLPSGPPRSPAAGEKECCGTQKSNQGGTKVRQGYNSSCVKWLGL

SEQ ID NO: 973219 - protein, 202 aa, Homo sapiens
LCFVFVFGDEEGGGGGEERGEEGLIKMSELRDSFVVFRDVYVCYDEWLALCVFVSAPPGSVRVRVLRWSAALVPVNEEGGQESPVRLLSLVFPPHVARQAAGGEEEGVHQGDLREPARGPPEARAPGPFAVSESSLQGKKVERCPFRLPQEVFFRHDTRRRSREYVARGGPRKKLETIVVGTPRNGSRPTTGYSGTHHACGL

SEQ ID NO: 973220 - protein, 151 aa, Homo sapiens
MGGVRSFVGPPALTKTAGGREDTNTHRGAGVWVVVARTTDTPALVVEQKRCMQLCSVGILALSSHHRGTGSTPSFCGGQRRPLPHHALFVWMEDTTLSQETVVFRPTYRPQRALPRTTDALLSSRKEREREMSLLGDTRERRLHTPSVVSL

SEQ ID NO: 973221 - protein, 161 aa, Homo sapiens
RRNRRRKLSAPPKLEPIAKAFKAQKASVERGPPAPQKKKIPHVYPTFRRPKTTATPETAPISSEERSPEKPAGPTMRIIKFPLTPESAHEEDRRPTNTLVFIVDVEAPPAPRLNQAVKKLYDHVMWPRSTTLIRPDGEKKAYVRLAPDYDALDVAHQIGVI

SEQ ID NO: 973222 - protein, 437 aa, Homo sapiens
VCVVSLLRLCWCVGLRAVPVCCLLCGFGFFGVRCAGCVRLVCLCVCRVWCVFVRASRCCLRLLARCGGACRVLSPAVSLLLLSVCRGVGGCCACLVGLALGPCPSASVSFRASSSAGVVSFGPFRSSACVFCLVLLLLLASARVGLRVLPCSVCWVVLFASVCLSVLLFCVFVFCVGSVVSWLVLLVASVVLCLDGVCFVCLALRLGLFYLVSSIVVSSLCLFVCWLLCCVVVSVVVLCFFFFVVFVVLVLLVVLLLFVVSVVPVLCCAPDMIPSRVGVHTPLLVVRASMLARAWVASPGVGHIKSPACVVDVRPRGSMSPVALMGAACLLGLARYLPSFRWVSVPVLCYVPCHSVALAPCALTKWPLPALGLLLCAPLGALLSPPIVVGVFHEGTSAPPCEVVIGYPEFRVSQSFVVDASHGVFVPSFTCLGASGY

SEQ ID NO: 973223 - protein, 116 aa, Homo sapiens
MVPLSKHGTVKPKTALWRVIKKISYFKKLRMDVLTLWGSTYDNPDTWDDHEVANPGFPHAKGPYCVSIEDPGGDCLRLPQGGKAELERLVVLGAHVNFLKIFFFNSLLFPASQDSP

SEQ ID NO: 973224 - protein, 113 aa, Homo sapiens
MVRPDPLPWGTPIVASCRLLAPLALPHANRRRGDSPPMGLILVDAGSGFAACVAPVSPGTTPGRSMPDLYLFTEILKRLKIEDPGCLLRRPVTQEEFQGEWTAPAPEFTADSA

SEQ ID NO: 973225 - protein, 75 aa, Homo sapiens
LLFFLLLLFCVFSGLLSLDSLLVMLISLYFPNLVFFRLFRFHSAYSFMSSAYYLVSALPSLYSFVSFLRIWCTFF

SEQ ID NO: 973226 - protein, 342 aa, Homo sapiens
QIVGFGSHKFARAPFRVSAVEQDVFGGPVLPGGLFLRVAPLGVFLGLPVAPHGGAPTPCFGGTNPLVSGPQDHWIPQVVYPGVPTLEGTRATLGEVYKVRASPRVARTPFCPGSLACQWQHASPAQMGLTRGDAATTQTHRAIVPPGAPNPTQDGPPCPGVHQSVNGAMLALATWAGPCRGQKSWPMSWRNLPITGHKVLPFWWPSREKEPIAAQAPQRVTLPSVRAQTGSATKIRDIFQTLASPSYLTEGPGECHILWNHNPGDLSDYLPSPRTEARQRRVALERVTGPTPGTCQGRPDVQAPVLGPEEPLWGARPDLASGDPRANQLGPVTPDPRDLRSA

SEQ ID NO: 973227 - protein, 402 aa, Homo sapiens
FVVSDRRGVCWWVGEGQGASRLGRGGGGGGGWDRWMLFLVRVRSVLGRVCCVSPRSVLEWGCCLCDADGVGAVVVWVVCGSGGVGCVVVARASCAGVGLVVALLAVCVVGLWCVSPLETRCAQLRVVALGSLPSRDSVGVASRGLLLVAEVGAVVYLCLLAYGCVARGAGWFSFRDSVCPHDVCGVALSLCCGVFCVVGSLLWGGVTCPPSRVFLDGGGPTALSPGLHGRSSVVGCFVSSLSLSWRGWYSIVVQAARACASTRASRRWRSRVFAAVDTRLLLRLLHALYGVGPSPRARRCPRDVYSSSSFSTVRFPRSLVVSTPLAAPKMSFGGPVSLSHESAQPPRQWLFSTYPALVCVCCFLFGGAALGPHVFLCWLFYTFIFFIVVFVVVILEIKQGPN

SEQ ID NO: 973228 - protein, 255 aa, Homo sapiens
TGWPSGRSVGAMVFLFVLSVRCFLFVFVLFVYVVFSSVSVGFVSCVRVSLPGYSFSLLACPARGISFGGSCRSFPVPVFPVVRLCFVLVCPFAHVMICSSVCPSPGKQLIRTLAQWPPDYGDYDLRDATPGNNPRVAPVHRSPCDPEAPGGPCRRSLPPSALPSGPVLLAPRQSRPWCLGEWGLIPGAASPLSRPHALPILRGFSSPSIRARHIVFARIQHGDHDLVDCCCCVPPLTQPVHLLVLFLTLRCLFVK

SEQ ID NO: 973229 - protein, 168 aa, Homo sapiens
MCEGPTYGGCVSFESGALVVVSGNPWAPVRLAGTPFGKPRGWDFRMGVGKNSSRFHTGHATIVATMPAAVGERLWVLLIIWWSITEFGASNHRGALIHYGSLKGLEGSPQGALSPCGCAWPTPRVGTAWIPKLGFFWDRHTAHTCAQWPATPPCGGFVLDLLLCFFFV

SEQ ID NO: 973230 - protein, 330 aa, Homo sapiens
WVGCGCVFSVYSLCCVVVCGGAAARGDGTFTVAMTARSNACARVFRLSRAWWIARGSAALLHTVRGTRPPAWPEHHCKLGTESFPAPISCRAVDGLFSAGGLQSNPVSYIAHSSVLTHVTPIRRPPFLLSLRLQLLIPRPLADAVTYPAPGSPSLGLDEPPLGPPQPARLVYKEMCYRCTREDPDGRESHPSARRGTLQEGGPSVHPVPMGGMMVSASPFAHLEAPGSSLQSYGYVDATYREGHDPGRVSCQFYCPVLSALALERDGSPWRSDPPGQPLPEIRGRAGQILLGDPDTPIRPCPFTPPLNPGILVCHKRCPCTDAKFNKVCP

SEQ ID NO: 973231 - protein, 119 aa, Homo sapiens
MFYFPLVPPSCESPLAPPYRVGSSAPPRATLPVGIPRGTWRGDSREGTTAWACLGKILLGTLLIDRTTHTAEMSVWASFRELSCTHTSYCYTLKGVERVYVREVEAHLRVGSPLEKEKK

SEQ ID NO: 973232 - protein, 189 aa, Homo sapiens
MKVQSLGILMCVVRPHLRDQRSLEFCPGAFFQRMRVLKSYPRPEARPRCRPSSTQVQGICCYPGTYLWPPSGLGVKCSQRGGPPPSRGGPSITGASISHLSPCPRRLSWGTTDRPAPHLCPLAKVEQGPLRLLCWVTPHPCNPRGNWHLFCRTPWPKKAASLMAGIDDCYTSARGCTCHTWANFAQATL

SEQ ID NO: 973233 - protein, 207 aa, Homo sapiens
HCAHGGHVPLWRVTTVKEHTHEGGSCRPERCHLQLVRLPTVALLPPLFGTLRRLCANMHTVQSCPTRGVKVIYVLPWLVEQKRGVLRRQSTQLDLGASIQMSNQPVCSLLIRTSMTLTWTHLSTHPATRKAPSGYSSRIAVSSDSGGRSPWHDSVLVSPPPHVKLSPVRPRLAMLNTPLRREVGVPRGNRPPCRLRDTVQIRYPGGS

SEQ ID NO: 973234 - protein, 289 aa, Homo sapiens
APAVETEKAQRHPQESVRRTRFSPAPAVGVPDKPALLRQKRCRPVKQRASPISGAALGHQPQGDPPGSESFDGSQNEKDHHGKVVGQTDQVAAKLHQEGAICQSKTLKYPREWERKTTMGPRWETLEPISPERQEPKWKEKEPIKELERMVNAEHQDELQLTSNNPRGRTIRATQKKPFVRKTIDELLPPGHWNWEPGGPGLCDFNSPKCLAKPGPKIVLPAIAASNSVDTSLPARPPLVPLREPPLWENHMTISPIIFNPTPRQSVFTSPLGLIMCGVSFWTPTRFVV

SEQ ID NO: 973235 - protein, 125 aa, Homo sapiens
PSLFSVERRSCIDGGHEAEQEAYISVALSCTSSRQGPETRGACPQSVADPDGGPTLFVNPRPLGSDKMCVNSNVVNPYRRVLRSRLSPWGTLVNVRSHGLPPPGKSGPVGTKGQAAHQPHTLLGT

SEQ ID NO: 973236 - protein, 169 aa, Homo sapiens
KTLDAPLPGTVGVIAPGFPRHHPPLLALPKALGKVIPELTGSSLACLPVSPTAHVSMVDLTRRLEKTCAKFDDIPRKVVKPRPSVRAPSKGHSWANTLRHPRWSPLTFTHAIQPTSSTLLRAGDWHIAPRNEPPCVKRHFPGNEPSEIWLHANTGGGASLAHHWPSHRK

SEQ ID NO: 973237 - protein, 131 aa, Homo sapiens
FFFFFSFGGEEEKRTQGRGTPSADPVGELCPPLWPGPRFSPPHCVAPARPLYLLSYAYSPSSPDCTFGGSKYRRLVAPRGSSPLSRPSRSDRADTCAPNFGRGSLASPRPPPFWLLFAFPVKLCPEALPAG

SEQ ID NO: 973238 - protein, 235 aa, Homo sapiens
LGVKGIGHRGAHKGTHASMGPEAGAVAPKPPEEKMFNKGTKRGPSPVIEQRVWGKPLPGKRGDYKGGTPGEIACSPETTGVPRCLILKDQTAPWYVLLILGVGLLNPMYRAYKGYTCEILRVSWDRRRSHRSVSRQMTDGYTIVVKNIRCLEFPKKKNVPAKCPRWTVLIYTHAYELTLRAGLTPEKTALRVYTSVGVVWQDIASEAPDTHGSRGACHEKWWLTPQAFHSYNTVL

SEQ ID NO: 973239 - protein, 73 aa, Homo sapiens
FFFCVAGEAQSDDEGRAVELYRSPSAPCFSRTSYEGSLLAPRARCRTEVVPPEEAFFINWVGTLGPPPSTRML

SEQ ID NO: 973240 - protein, 108 aa, Homo sapiens
VDVVARPLFVVISYPSRLGCSSSSSLFSRVVSSIVSWLSSSRAWFCAHHCLLWSALIINRASRGPHGVAPPVSWRLLFSNSRSGCCGATPLFPVALFRAPWLSPLCGA

SEQ ID NO: 973241 - protein, 98 aa, Homo sapiens
GRGSATPRPVEERPAPGPSMRKKDVHAALGATDIPPPRNPARGCEGESPPLSPHALKDSRPPGYGQGTRLQPSDESRISRRGPRLRGIFSIQTARVGE

SEQ ID NO: 973242 - protein, 106 aa, Homo sapiens
MALSCNGVTRTGAHVPRGVHHPRFLPSCRFICGTIAPYPMPHPPRGSLPLADGFLNVGGISWLRGKFLPHSLRPHFSRGTPPSGEVHTLYLGDILHQKYPLEEDIV

SEQ ID NO: 973243 - protein, 174 aa, Homo sapiens
MVSVWCSSWCGYSVSALGCLIDTISLHKYDHAVVCRQQPRCVGVHPYFYCGVWVHPRCGVRILQYQRRVVFFSSLPSHVFLSAGSVFVFVVSRLSGGCVYFFGLLSLVVVWGCLVFFLLVAVFRVSVGGPAPVGCLVLLSVRASRSVVSLGLWGTHQSVVRTRLAGGAAPLLCF

SEQ ID NO: 973244 - protein, 483 aa, Homo sapiens
RVAFSCCGVVFSGPALCLYICVGVSLAHAPLVLSVVRGGSQPLGWVAVSSEPVVGGTPGYLLGVDAPLLSVALLVSARRFFWGEELFGRRVTPFLERGGVSGSVLVCTAARVLWGLWLGTTPGGAGLVLSHASCSTSLVWSLWLTPLNVWRPVCPRMCQLVGPTNSVMGVPPRRVDRGPMWGGTLCEGAEHAGGTPASGAGKDEGTPPQQERLRPSRVVYGRTESAPFGGRAPTKAHRRVKKEGGKDSPREEGLSVGLSRPLHGEVYYVRGCFVVVLSPQRIIGGHTTGEAPPAFGPHQDPLLVERTPWSSHRGVLVTPLVGRLCCGVCRPCVLSHNKRPLGGLREKVLRASCSLRRTSCVTCSHHYRGPHTSSPLRYREGHTLCGGTREERPSDFLIDDTSLEPAPLLWVSSQREICERGLSRSCARVAALFVVASCPHEARTRQRVWPSKRLSPFSLRAEMLRTPGDHSRHRGLGRRGGSD

SEQ ID NO: 973245 - protein, 529 aa, Homo sapiens
RVAVCCLKVVVLLTLVVMCSSASCGWLPSSYSWDPISLVVFFFCGVSPRLFHFGGRMIVCATEGGHLFETPCCLPTGCWCDINCLGGVMLIPIMRRASGRCSHTDLCDNRCAAIKLLFMVGGTKVLASRVFLYTSFFSGVLIPSLATALKFVCRFHRVILCVYILPCRGLLSPVVFDAPPSVCVCSTQLVADIILLCGANNLWLTAHSSSVSPPVFVGAARMMFVRGPHQVYVLSSSLFLLLASQWGPPLFYDRHQVGVTLYGWPPVLWHTTRGASLRTTAMFLGSRGGDPRPGQLAVCCRRPVLSLYVVDPPVDTLFILRAPRWWPPVGLVGLCFPRLCSVCFLVSPSRDWFARTPRVCLSMGRTVAPHPHICIVVYDGGACCWGLLHMSRSPRYMFVFIHVFVYSKREICARHTFVPHVCVCFSLCVAPRAHSENIVCVCLTRAVPHSSQKIYIHTQRGFHTHPYITPPHCLVVPTAGNTRHTILCHLRGMFFPVYTPTFVESVCYIPSGRTSHLYELFIREPPRGL

SEQ ID NO: 973246 - protein, 210 aa, Homo sapiens
MLLLVSCRCVAVLVWEVGWLYAPGMLYNRTPLWGGWNKLPTPVVWGGPPSYVYVSRERGSDPHQGGLPDKKIHNRSLVVVFIPPARPLLVCVVCSPRSSLLLCGLIKGSRRLEGGGILLCVLSTARWALAVGVCVYLYFVVGTRTQMCLFCVGGVEHHPPRLLCMLVRGVLARRVFVLSVPDLGGEGVTLVATSSVWVSRHMVCVCVRGR

SEQ ID NO: 973247 - protein, 111 aa, Homo sapiens
VVVIAEVVCVWRPVFLVFCGCLRMFVSAGDGWEMGGCLWVVDGDPLSAVFGVMGEGWLGARVSFGCWVAAFGVWGVLRGWFCSVGWCVAAACLHGEVCGVGVRVRPLGCRI

SEQ ID NO: 973248 - protein, 114 aa, Homo sapiens
MSEERRENMVERSYNHYVGMSPSDAALCLWSLFLFVEVRPPKVGCHHRGRRPPVLLWWCSRPPGGGAPLRGSCTPPCVWVVVVFCAGEFGVVFVCCLCASRTSRLVVGVPHTFG

SEQ ID NO: 973249 - protein, 270 aa, Homo sapiens
MIIAVDEGGVPWWVDKTVFVRLRTEVCGRTELWCPTFVINRCGVGWWPEGGSMSRVLHGVCILGAHHEGGRGLGLGERFVGTLLWVRTSVGGTRTRAAPGVGAGGPPPLCHDVAAGGSAAVRPFSPPRIFPWWSLARLVPRGWMLHLGGVCSWCGGLLFLGSALPLSGVRVEAPATAWPGGLFARGEGRRFLCIWGVATRVSPGEPPGCGARCGVVVHPTPRGLCLVPSGVARLLCGWGPSGAHCRPTLARFSPTRGGGRGDARHSGGVL

SEQ ID NO: 973250 - protein, 36 aa, Homo sapiens
MGANSLLHETRALFLHLKQPLLGEEVGIKLEINHQF

SEQ ID NO: 973251 - protein, 425 aa, Homo sapiens
THRIRVTTQRFDKPADRSISGSIRSSGWVEPSDSGYHRSPGGWTDQPRLSDTRRNHTGVATDTTHVVDSTFLHDTRLGTDCDTRTLLLFHYYTTHYLDTRPLVTTDTRTPTHTCTLTSHRDSVCLTRDVLTDFDTTLTDRLTLRHTLHTLTYLTRLYHGPHTWALTLHASHWDTGTTIPPVTHTLVITRIHHTHTGARRTLTLITLTRFDSSHDLHQSWVSLVTYRTGILVDSGLIPYTHTPSSQHLPSSRRPIAYYPCYRAHTTPSSDTTHSRGHRHGLDVGTPLIDTRTNGVERPTHLNTWTPRHGGVPPYTPCDFAPIHRDLGVPKRTTYEHKRDWGPPGLLVTCRSYNLNWFFTALTTNRVPSLVENETGPKVRDPGGTTAYLGRFTCGRPGQYVFWDTRPLWGTHDHGVDNRLGPSHMTG

SEQ ID NO: 973252 - protein, 296 aa, Homo sapiens
MWCRNTLGGRFSCCVDTPPLCPPRVVWYYVSPPGGSLSSHFVVPPVMCATTTVGGGGHLFFFGRSIVPRLAVGGSHCGAIQFGVVCRIFASLQRRGVALCGAHLGVPPWCATGGAPACFVTPHMGVATNVVLFPVCCACEIGPAGLISPHLCPRLPPMGPPPSRELCSCAHSRLIWVSSPLFVGCLLSLHSALSLSCGIPQQQMLLRAHACEKRISQVRAQSPLCHHAGPLSPHRERECDTQCLAVVPLSHRVAVSLPLVWRTRTRPSSPQCLSLITVWCVPHNPLALLFHRECVV

SEQ ID NO: 973253 - protein, 96 aa, Homo sapiens
RLPKGALCYVIELAPAGGGCYLLSESIMSTATAMGCRLLVSSFFRCLRPLCGIKMGGHATTVFCCSAVGMPLALVVCPSRATLVWVEAHPLKGGVL

SEQ ID NO: 973254 - protein, 50 aa, Homo sapiens
MTSPQHPFGPGQATLLDWAAPAWAELKVPRRTMGVEILSAQKLKFTSELP

SEQ ID NO: 973255 - protein, 357 aa, Homo sapiens
LAATPVCLKKLACCSRGVCAVVEDHRGCTSRLRVCCDGGRCPDSLCAWLPLWMDTLSPQYCFCVVARGGSHHACVGAPLCLVVTPAYCVDVCHRRCPPPRVVATTWGGFSTLRLCEGVVKGAPPPPVGVVIRRGPARVGCVVPTEGEEGGVIVGRTQCVEEDVLPNECGVLLVCCCAVCEDVCGVLVAVCVPPRAPTMLLGAHQYGPLRTLGAVPHPMRRRHYSRGTTSCCVTHIVRWGRLSCVGGWPVVCVSSVYARRRHCWGVCAHMGMDLYSWGALFSSANSRALSHTLAVARPAHVRCGGSPTIVRGIYSQRPLGVALSGALFVSHSAVCVVFARTRSVWSHSALLRTVVVPL

SEQ ID NO: 973256 - protein, 331 aa, Homo sapiens
MVIVFRLVRCVDTVRPLVSMLCVGGAPSWRLRWCLCLYRLASIWVSVWGPFVSFACRNPPAGGEKWGCALSLEFAALLVDANMMFGGCRGSCVCRLFVCPSVCPALACGPSFAVHSAVGLGAPPSLGVSWPPSYYNALLVDHDCVVWWGMLHLRLSSGLPRCCYSPLGFFPPLARWGRIMVSRLCWRTSMVLVGLCHRCSRCGGPAVVEPAFVRLRAACVVPPDVCVRSAVLGVLYCFAHLCAHQRWVEYVLFSVRVPLSVVVCVSKPFVWRCCPARRMCLFSPLGEARPPPSSVCGGLVGVVVSTTMRWCGGGVRYHQRWSSRPHTCWGC

SEQ ID NO: 973257 - protein, 531 aa, Homo sapiens
VCRYAVLVVRRCCGFVFVRVRARSSLCWFGRRAICGSVFLGSSGPHQWGGVSACSALVWVDLVRPLWSLTLSFCSSSCVVRVVGPFVLLCVCSLVCLYHLTRLCFSLSSVGRSGLFVSAWLCWVHRRVSMSVLCFYIALCSIQYLRVWGATYRPSVRLLCGVCVCGVGGCGCFVRRVCVSSVSRVWFVLVGGGNTPVCIRGGFSQLVFVVVAATDVVLRVAVDDGKHQLWLGLGVCQHLVSDSPAGNVPPLGGPLGVASSVPLVCLLFVPAGESPPFMCVNCRLACDSGVIARWVAALRCWPPSSLWSVRLSVACVGRCFYKEVSSCRGYVGVVVLRWSPLRRRFSSIGSTPARAHVGVLFVCSHLCVFVVCPPQYPHSVCGKKSIVCVSVWRYLWACAAHTLLWERDSVCARSLTLRTHTLFRTTVREEMCVPPLSHTGAHTHRVTLSSCCSRHRRPRCVRLFVCCIKSVTPRVSPHCHSHSSRALSHGAPLLTLPTRGPQATQTHSGCFSLSRHSEIWVLGTHTHKGEI

SEQ ID NO: 973258 - protein, 108 aa, Homo sapiens
MMRWMRIFILQQAAGLIIIPTTNIGRLGVPHQHDTLGRCVLSSGALVGATPHRSWVVVAPNSWWERACVFELCGTLSEETLLGLFFVSVFCVVVSHTRLGRAPPLSER

SEQ ID NO: 973259 - protein, 413 aa, Homo sapiens
VSERAPPVWGAFNKLMWGPAAADSTNKQHDQARVCFVLRWLPPLRYVIVPSTRGASLRRGVGLFFVGAAAPPPPGGGMMAALLFGGGQYISPPLGERPRGRTSTGRGVERARAGKEKTRTREGAPTRVGRGSVVGTHQPRCHTWGEAPHHAREPSWQPQPPRGVVPPATRAPTAAAVEEWSRRAPVFITPRGWLQHAPGGAPRGELTPRRSWWALLPACSPRIPAPPRLLASPARTHHGDICSPHADLQHTEKIIGERHTTHATRRSRESPPTSAREKMVAHSKRYYTRTWGGTTVGEEIDPRFPNNHTRESNTHEKRGATQGGHNRPRVSIENGSTETPQPRVCTSIGGARGRGHSLGTRSILKCNKRTRARLCRYTHTRQSSAPSLSRTTRETSPSSAAHAGFSRGFSHFL

SEQ ID NO: 973260 - protein, 164 aa, Homo sapiens
MRPLCAPLGGVLWSWAGPPPGGALGSAWSLSWLKIKLCRALLLRRGKRKRVAWELTLDVLNLETLFTRETWGDNKRLGRGRAARRLCGTPRDRVFLKESLVWSTCGGRLVTVALRVCPFSPRMLLKISQSGCPGQKSVESELEPPRTPAGPVVFLPHSLSCCLS

SEQ ID NO: 973261 - protein, 103 aa, Homo sapiens
MAHIVITRVVEEDWALTHSYSARRSLVWSRSNMCLPGCTPLRVEISARVVWAPRTLVSPTRVLASPAFLVRVCAVCEKRDVCDARVIRVCCVMIVVCVRYISG

SEQ ID NO: 973262 - protein, 375 aa, Homo sapiens
ADVCAGTVEVIDPHSSIGLTLVALRKVGGCVLSLDCLPGSDYYWMGYSVVVPGLLVGCLSALRAVMHCMSDGCRACVLSSPSLGCVVRALREYDGVLFCCWVEWTCFDGLVSVLSSSALYSYVLLFDEHWFSCGVRRFVLVWWWYIAHDPRCLCCLFPDRCVDVVCLIVLSLAAVWFVDLGASNLMGAASIYIYGKDVPPMILVGACVENMCVCVWLMWSLTPLVLSLSWVIPSVDPTELVVGVVVGFILLSRSRYLLLVCTSYGLVDDTTEFRIHPCLVVTHRGGGADSTFGLSASLPPPGGLVTPLYRSGLSRRRRGLFVLGNDDPPGVCSMSVAGIVWCILLLHPSSMWGAHPLCSVGCLLCGVVERRLLLV

SEQ ID NO: 973263 - protein, 209 aa, Homo sapiens
VVCLLRCVVFVLCVWWGCVGALVVAGWLVALWLLLVVVVVCLAACGWVCVHEGLVLVWFVWLVCAACVLVGVLVCAVWLVGVWSGGLGLFCAFLCLPSFFSFARGWVAQRTQLSLFWAARPCVVRLLREGVVHHDKGVFAAQSMPRAVVVIWAALLCLNDPRCCLKSYVVSTPFGGVTKYFSRPIFVVAPSLPALGMVINPPLCCSYGV

SEQ ID NO: 973264 - protein, 347 aa, Homo sapiens
MVFWSVGPLWCGVRPYFSVPLPLVGFVLLGGCAPPVVLIVFGCCSLLQVGGVSSTMSDSLFCWSTVWCSCSGEVFSLLRMVMCDSRRRDESRYARRWGLWHKCVVCCSAPPGRCFSPRGGLLLGVSPPFVFVRDVALVAAGCFVGGSFVYEILFVRATPRGHYSPLGGRPPQRWKSLRISPCGCSLWGALSHRACLEMIDEMCCFSLVRESESDDEMIFVCPPPPGALCALSPRAPWRRHTHLCAHPAVGVCGDPACDFGVAVFRLWWCGSPRRCGGVRCALMCTAPPPPRYVAAGGYCVVQRVVYICVGVWWMTGEVYVAVEYVWRSESSDDCVTMLCVVWLWVLR

SEQ ID NO: 973265 - protein, 107 aa, Homo sapiens
MRLPRSSLGGFVSRVVTVTYSGSSIRLIYIISRRFVEICPRVSYTTQRLFWVPTPHWFVVPQSGEAKFWLRDVLEKGSRFVVREERNMFEFALVGFVPPRLASATRF

SEQ ID NO: 973266 - protein, 147 aa, Homo sapiens
GVLFIVFVVSSRWYSASSACLRVCLVVLLSLVLSLLLLLGYSTSLLLRHFAFAFAVYCGLAIFFSYGWSCSVIFYQLSVSNDGHNRLVGVRSSMLLCVAASSVLISYVLPTGERLFYFCSGCFLVGVFDLPSSACVFWRGSVYHRLI

SEQ ID NO: 973267 - protein, 213 aa, Homo sapiens
MVALIVGVVWFRVLPCMVSSRLLRWGAYGGAALRGGWMCVDEVGALCGFAHGRRCATFASRVGAMGYRLLSRVGDLGACFIIGGGAWCWYGACLLCVRKLRCGVRFLRVSASPRRGGAPPMARVGGSPTVGGVGATVASGVSYTVATVFGGAPLLPRVGAACGAPANEVLLVVGTQRGSPVRALVRRLCAWCGGAATHGWDHRRGCGAPPVGC

SEQ ID NO: 973268 - protein, 149 aa, Homo sapiens
MTRCGGLEFPSRYVLSCVAPETGGGRRTTHVVPPGVLVVITPRGWFEVVAPPMVIPNVAPITSGCPKPRGYKCSTHGDEAANLGGPNREWVQGGGSYIPEGTRVGEEENGEGNNKGGVVVKPARPLSGGVSEEVTRGRLEINASHKVAL

SEQ ID NO: 973269 - protein, 231 aa, Homo sapiens
MICGLYPRWEEPGRRPPIVGCATKVHATECRNFFYSGGHTPPLVKGDTFSDMGGCAHPHKCVGVAPRKRSPQGPCLVVIYPVHAPPIVIHVCCTRGSLYIGYYLEEGTTCGGVCTKNFPPWLNSRGESLVLGRNIERLSLKLWGVPPQWAAHEREPYTVGGINTEIFGRTERPYTHLVSHSGTEVKTQGRLFARALLLACVRALTGPVRNTPEGPHGASGFLRAHLVAPLE

SEQ ID NO: 973270 - protein, 122 aa, Homo sapiens
MVRKTQYVVYTSEDVLKGLSLAHTTLGHEEKLCWWRTFFLRSHLVSLWEGGSHTSCVCESTPLFWAPPLWLTVMSTFLCTARTHTLVSPLCGGVSQAWARTCLCARDREGFFGGESPHHSGG

SEQ ID NO: 973271 - protein, 119 aa, Homo sapiens
LVLLFVLPLFRCFVFSLCLCVCVLSVSSRIRPVFVVVCSRFFAWVCPTGGPPWLFFCPPPSACSSCFGALSCTAGGPPVVALVLDVSHVFWTLGRWRFITGLTALFRGISDSGFKWLLC

SEQ ID NO: 973272 - protein, 126 aa, Homo sapiens
MYITCATSRTHIARTEHTQERHMVRFERPPAAQGAQVHTVSLARPRRIPPFLKERWGFSPKIPIADVICKNTWWLKSGVIPRWLLGSSTISPVPGPLDKWRALHSMRASHSAAPLLILHPINFTSR

SEQ ID NO: 973273 - protein, 109 aa, Homo sapiens
MLGYASVMDGASPHFVVWCPHIQEGCSSRGRKVCPPCGSVWFSPQYACLYGDCLSSGGSFFHCCRPLSGGAPLYCLPHPLFSGVSPCLYSFLFSRSPFLTLGPHIGLGV

SEQ ID NO: 973274 - protein, 315 aa, Homo sapiens
SSSVLSLLLSCLRLSFVFPLDRSCCFGGTSLVVASLYWLLVVCNFFVVFSLPSVGPAHVLLRSVVLTHRWFPPTVVGLLIGSSRLFPAVVVPSRLLVGPLEALSCSTVVTTMGADVSTVGGGCCILAGDPLLPPRCVLSHTAGGVCSSSLRPMCDSLFPSRGMRLCRWAPSWCPHPCCPTEPGSRCSSGSPSPERSPAAPHRLCGGRSPHTCGELFRGPAPMCPPWGVPTDAGFLCLLFNKAPTAECLLWRTAPRNTGDKSFSFVGVPPVVAPRSYLNPHAWRWGKKPRLGATPATCLLGVSPRWVCQRFVGAHL

SEQ ID NO: 973275 - protein, 474 aa, Homo sapiens
MLLYRVRCGFVRFVVGDEVTDRRHSFFYAASRADIALLSVRSWSVAARAFLLWEIMFYSPSVPTVGGSPPAAVGGVFCSINLGRGFLRFLCCVLYVVSCVASSFVVLLFSLPEMWVRPSGGCLLCWCSPSRSLGAVIVGVVSPALVFHTRRHFVRAVFYRVFSLCVLKSGVSMWGARTSSFYLVAGPVFVSVSQPPLCVVVASVVPSGRRRFQYCTPPLFVGTSAVVLLWHRVRICGCPSTRLGGVLPVGVYQNEFGGPPEYSSYLSALILCVFVCSSKCAKNCVPSFSVRSDDFGFYRSCLYCCHKTHGFVAPPTRRDTCIRGCSLTWSTSFLPQYSLSRHFCARPQTTRLLGLLSIDDDMCGDSSPPPRERGKFPRQQPLGRHHTRPLSWTHTEFPQKHSLGRCLLSKESPRAHLFHSRRDLTCALSPLLPRGASLGGVFSPHTKAGPRVKWWPRHTQFEILLTFVASWEPR

SEQ ID NO: 973276 - protein, 275 aa, Homo sapiens
MWVWPQTFVITHSAPWKLGTRGLHRDMWGSGFSTPDKALSKFVTIPFGNLYFGKKSLCPHLLLNLEEEALSIPGLFDPPHTPLPTIAFHRRPPYSLKKLGNATPQTPFPVLKPSPEIGFPSPFNVALGPTIVVVVVFKFLLSKLLYARNLAPHAPPPYPLSVEGELLWKLLGFGFPRDHERDNEWNNFVASGALSPPPTLTTNPCCNPSHQMGKEPMPTPHSPPKGPHTVNFPEPLKFSRTPGHPKTGGLLVSRTPPIRVAVPSLDNYLPRILDH

SEQ ID NO: 973277 - protein, 118 aa, Homo sapiens
MVVVSCSIFGGYSSTFFLGATKYVPPGGALGLSSVCFVGRIYTILCARTRRCVASGPVLRPPDSVKCATVVVILSPRRFIIDGLNRFDVERVPQPTRLCEENFLFRVPFKGKLYLPPG

SEQ ID NO: 973278 - protein, 106 aa, Homo sapiens
PSWASHGVGVRRSSAFCGSRAFLLSSLCCFIISCLLMGGVLWCRGVAGMLDFVLCCSLLCSWLSVVMFLFLSFFFFFDLFFSHGGPSAGVLSFSLLYICVLSSPVR

SEQ ID NO: 973279 - protein, 111 aa, Homo sapiens
LRKTRKLRGHVETPAPAAYGQHPEAPPAAPGIMSGVSAVTHPDSTFDPISTPGYTLGKMWYEALSHLIRGTTSFLPTTVTPLTQFWNLGHVNHEHRVNAAKNPDLGLLPTH

SEQ ID NO: 973280 - protein, 137 aa, Homo sapiens
MSRVFLISHMGRKVVGAHIELRREFVVGSCGYTISVEHTEEAFNTPCKIFVVMASVMDLHHPCKNPLFYTLLYRVYHMRVARHTDVLSLRHTEGVACGASQECIDISCRAPGDTHTWVKNLALKYSPCPVPTVGPFW

SEQ ID NO: 973281 - protein, 255 aa, Homo sapiens
LCCVSPEHKGAPFSFGVAPQSGLWLNNGARYGVIVGVPRVSAYVLRLALLVIGLSPPCGLVLDVFVPNPHVAPKCCGWSFLCSPPGGPPCVGAVGAARPRGLRPTVIFVRGVFYTAALLVYDIWGAPTLRACCAPHVSLFHGCRSPLASRMVPRAFLGAPLSLSGDTLHRGFLGTPLGGPSANRRPLAPHTLELSGPTNYCRGVLLALSTLSQLACVPSVTENVAPLGLTAGCPLCSACWDSPSCSLGPREVALR

SEQ ID NO: 973282 - protein, 118 aa, Homo sapiens
YGCVGTVYFELSVVVEDSFLLRCHLCFCTSLFFFLGELTRSLCVFFSLPSVVWFSLGVALACYVSSPISVAPAHFLGACSIILILSAPVCCFCMLLFIVGPFFFYHGPYVSQKLVVLP

SEQ ID NO: 973283 - protein, 537 aa, Homo sapiens
LCCELRALWLRSVACAELSGWCLRCVVVVACCWLAFCVDVVWWLVFALSLCAVVPAVRVLLLVLCVLVWLGVAGVSAARCEPGVSACSVRFVEWCVMSIGLACVRVWCCCVGCGVVRVLSVFAVLLRPSFCRASVSLFCSRLFVRCVSLFFVVCPSLFLSPLLLRVFSCFWLCCLCVVFVRGRFLLCRVGGCVRCCVVSWCSRVSFVLVRCVESVLPFPYVLIVWVLYCLSVERVLYCVTWRSTICCVSLVSAPSCCWVVCALLPLTVSCLFCFVVGSPRPFCWCFPSLLGGCVRLPHRVCVVEPTQIDGAAGGVGVVYTLSGGPPSGWFCECYRGGVVVNVVFFLVAAPCSVWGLPYSVCAPAARTVGMFCFVCVFSVGGVVLCCRGRRSHCLVLLCGGGGVKMLLPHRGVCGSPPCWSHHTLCGGARSSVLLSLARQSVLPRLVVSPRCLTWSVSFVCGNTQSSRRSYLPYPCGAPLPHVGFARRARRFAGVFCLVCGWSARSCCRWFTPPRGALSGPFVFLAPSVALYDDAVFL

SEQ ID NO: 973284 - protein, 220 aa, Homo sapiens
SLSTVVAAVWLSLVALFGCVVFVFLQLVSSYSYVGLLLFSPLLVVWWWSASCLLSILLELVCVSLWSFLSSICVVFLCSDLSLFFVSLVFALFRCCVRRVSLALLCCGLCSRLLCWWCVLYFCVCPLLLFVGGLIGLLCSVLLSFYFRAGGFFVVFGSSVNSITLLCVVVSVSLCICVYLVFVSSLGRFSSSWCGLCLSCFSLVSASCLFVVVTVIASLL

SEQ ID NO: 973285 - protein, 109 aa, Homo sapiens
MVTHIEPRGGLSTPTTRMFTTSGGDAWRPHRAAPRIGALTTPHTPKERLCFVKVPPLRENHIYVFGADSPQLSRDHLLPPLPQYGPSPRVSPRCTPAICCSRRDGLCFS

SEQ ID NO: 973286 - protein, 210 aa, Homo sapiens
MLLCFDSDRSWNEEYGELSIIEVFFAVHSFGLGFRVLFVCTWLVFFLCGAIVSLASLLVVDVSLMLLVDCCCGCVVLRSLALCCLGRLVMSRVVAHCIMSPGGSHCVGYVVVIDDSALRVWFLFVVFVVSVCAFSGVWSAASVWVDAAARCESGYVLFFSLDLGGNSLASVILLHSGCVMRLLAGLSQTTARVCCGDPPVVSRSAGCVVR

SEQ ID NO: 973287 - protein, 251 aa, Homo sapiens
MLVCPFLPVQIVWPLVVLPGPPCVSCYVSVVRPLYELYVGRSPMSRPLWPPHRPLGGPSSRIEVVFPPARSCWWPTSCAPLVEAFFPAPRPLGCCVFSEAAQRVVVSGGVPPQVDLSVGPPRCRPSLPRGPPRAARVVWGKTPQNGDHRSCWGAPRIELCIASFLSLVGTSCVGDVATLWFCPGAPPLLASTKVSTSGQDVPGQNIWVFASFWVGFLIRSPCIVAHTDSSLFVPVRDTLCNGLEEESLQVN

SEQ ID NO: 973288 - protein, 381 aa, Homo sapiens
MVLLLYPTRCVITTGWHNDMSVLVLKYLLPGAAHIVSLVLPVVGSWSAATSPTQLFPEKCVFCVVPPLAAAPRFCGAHDDTCRSTGETLLLWGANHRWEAPPPQKPPVLQTARCWGNMFDSTMCGVFALATPTDDMFLPVLEEWVRPPRHDVLEECSLSAPSIMLFAPARGVSTSLPSQSPPRVVFCLYRDALSGQNRPCVCAPLLGPAIIFCVLPFVGISGGEKESFHEEVWGVLVCNTLVSHERGETPLFRESLSVLSRREYTRPSRLGSLCATVIPSVCKMAGKKGGAHLFLETHTPRPSLSPRLPPLSHTHTPAHTFAQTPSRPLWRPPHLNTPRECYTSEEEYGYSVLPSAGPRGWNTQSGELGKEALLSSDPPSH

SEQ ID NO: 973289 - protein, 111 aa, Homo sapiens
WCAGSVFETDTGVLLVATRCVYVLFVACVSPDDEELGGVLLSGGPSIYVGRCRLVVGGVLFLRVSGNVGLGRVGKHVCFLSRWSRWCGGGSPIVMSPPLLVGCSLVGRPHQ

SEQ ID NO: 973290 - protein, 243 aa, Homo sapiens
MYQPRQVTSSLRCDVCRSDHFFVVCLPTGRGRPKQMMGVTLRFAQCVTHTARRSRRSSSRVLFDEHTTSSSSGVVLWGRCVMCFIVGAAPQHAADVCVECCVWRATRIALLFLSTVGAPPCGERRAHSGGRLSLWDTQGVFVCERRVSLCVCAPPPTPACVWCLVWARRLSAPRCVCECSVCVWCAHYSHGAWGSIHICVSLSPHHTLCGHTIVSVGDVGEECWCHHISPSLRIYHPHTQRPR

SEQ ID NO: 973291 - protein, 262 aa, Homo sapiens
TVWLIFWLFGSRSGALADDFCCSRGANGFLLCISCARGCCDSAGVSLLFSWGVFYYRREVELFVVIVSPLVGGRSPLCAAPFFRLGCFVSLGGITVLCVPMNVCVVLLPEGGCSSPHGPSGGPPPSKCTRGGPLCCIILFGAAMGASPPGGFSSLGSPLCCREELSADIRFSPVVTLLGGAPTGVLPPPPPLRGPFSALPPRVVVYGPRPVVAPPPRVSNELALSRGFSTNYDALLVHSRVLLWARCELRVSIVAPSENFVV

SEQ ID NO: 973292 - protein, 119 aa, Homo sapiens
GEVVLGVRWFLLRHSFLVLLIFWWALFPALFIVMCVSGGPGSILCVVPSARLSRGLFPHYSSSFSTGSLFCVRSRVGGSRMILSPHRGGSISCCRSHLNIVSPLGGSPGVFSWYEKERW

SEQ ID NO: 973293 - protein, 272 aa, Homo sapiens
MPWAYPPRGGDHQRVCAKTTGSVLVMGCPWPRVGRNAVSRVLDPKGGPPSPRDGPATRRPPPRYPLWEAPRTGVALSRFSLPCVYHEELCPEGEKGWKPTRPFGPLSGKAPCALSADFHASELSPLVCGVNFLSRRDSFPRKKRAALFKLFAAFLLKGYTPRGDHTPLGKAHHSVLGGLFVPLAVVPARGATEFSAPAPQGVLRPGAFGPWARPLGSPPLAPEGPMRSLVLRPRPARAPGIGSHSAAPHPCALRPRNPFSPHPACPPGPGPF

SEQ ID NO: 973294 - protein, 325 aa, Homo sapiens
MNFSSEKWAHTRADDKPLFQSDVPHSLSCGCPQYCVVPPRVGYYPLSVVDDSGSSGGDYLPSPPPVLMYSLGAPERGRRVCWCRKSWLFDSCGGATIIGEAPHRLPTILFVSVVCRACCRVNDFSSVGDASLVCALLLPSGCCFHGGMRPLCSRVLVRHLTGRLCLCFGVWCSLEVLLLPMWGVLVSPLPHSAFVFLAWWSGATSVVDGFIIPLCSHTPFGSASVVCYTPNGVFWRFSGAVYIVCGTHLCAALPPTVLLCHTPHSGELPLTLLTVGGCVRKVVVGDMSTGLSRENCFWAATCRWGTPLLPRCRHTPTRREVSHGL

SEQ ID NO: 973295 - protein, 663 aa, Homo sapiens
VGCVVFCSLGGVRCSVFRSWGVCWLRRVVAARWVVGDALDVGGAGGGVLCVVVVDGTGVRRLWVGYAVVVVGPAVWCWGTRVGVWVVGVYMGASSGSRLGVVCSPGVGVLVVPTGVLCVRGVCGLALGGRGGPPCVCTRAEVGCGVWSLSTCGGGAGGGGCVAAVLMGGVLVRSHGWERLLAGLLGCVWNGDEREVCGGGGCCGGVLLVGGAVARHLVVSFVFGDVVVFGSADLWRRRSGWGLVRWCWCGVRRRWLWLVLVLGPSCCCMCGVWCCPSFGGLVCWWWWCVAGGGVGVLCWFDCCGSLVVPAAGGGLLGWWRCRVSSGCGWEETTPLFWWWGARGCVVFVFSTAVGEVRHFVLSRGGEEWLLYDGAVQVDACGASVSVVCVRRGSFVVRGVGVVCLVWFLLLFWLVGDGEWVAAARVDCSSHLRLVVPPRRVTSARRLVDDEWHHVVVVWVVCVRPRSLCVVGGGHHAVVVCGRDVRGVCVGGAPLTRDERGALCHSLNSGVTVGGGPHVCVVSLMMKRVCLRERVYVCVVFRVSHLSVSHSEREWWGHRGYIRVVGDVWESVWRYLRRCGCVERSHTGATLSAGCVHPARGTHTHTGDPSCTEDPLHSVHREPQVCGERTRRGAPFHPRVHLSIFSHISLVIKTPFVNTFLRTI

SEQ ID NO: 973296 - protein, 506 aa, Homo sapiens
WYVRGDVHASVWGALCQHVVCLVQLLVAYRVYRWIVCSLCDLFLGRGVVCAACPACVAFVSQFVFASRWVFMSLFWWVVVVLFVLLGGALVLSPASASGVGECLVSPCLARRCRVAATRVLCGTLRSRGFCVLVVLPCVVCGISILELLIFSRVVALLGVVFSGPILHSLCVCVWLLCLLPCCGAEYLVFRLVGATSVLWSPFSLGGVGFVSFSLRPYRSVLSGCTSASSCGVVFFSSMSGLVMRPCSPRMFLLGDSSGFLLIRLLSGVCGLLTVRGGILYGCGGISPDLFFVGLPLLWVYVLPVGCAALWSCMMLLLITGIVAPRALFLWGGDFLLSCLRESCVSTWDIDGCVVRFNRPYSLGGVLGERGLTRHWLGPQNLLCDSAPAHIMSLCGGCFSFAHFAGLSPDRALRDITARTASKRGVLPSVPVCGLLGPRALGVLSPPCAHLKAPYVMLCVSFLSHRSSSGSPLVSGRHRLGTPTHCACRPRNPLPHRPCAPDPGPF

SEQ ID NO: 973297 - protein, 172 aa, Homo sapiens
MLYECPPRSPRAPLVRFFSLAVLLFSLRGGYPRSRAPWCDRMVSYEPRSCIYCPPHLLVYTLAWCALLRKIDLSHPHRDIYKKTLGSQRECSCGTHKMKVIVEMRVCVWAPSQRVLPFEFNNAQSFLSSIYLLGHHRGVINIRPREIGVSLSPASTHTLHPRIHTCGVPHKL

SEQ ID NO: 973298 - protein, 110 aa, Homo sapiens
MSVRIPLKGFRLLGKFLGLPPNKSRPGSLEFHRITLFIEEDSPGTPVPGESLPGTNVVREPPMVSENLENVPAYRPFGPFPLNSWPPLNPSPSGIWGIGTHRFRPPPGAK

SEQ ID NO: 973299 - protein, 224 aa, Homo sapiens
LSIWCFCLCVLFARCVCLVFCRVCSSYVGPFARVSDHFSYIGFVSPSCRPLLRWGVLFFSTAVLIGQSSAGGGSGSSPLLRVPWFFPLWLPRFSQVWGAVVSCLVISSWRPVHRGDGFYTFVAPGGVFSWGPWVPYGGMFSHAGDPLWMGPHSLLVWPLLLCAPRVAFLVGSPKLSLCGPCVVVALDMVPPFGGCAPCPFDCPLRFWGPACMPALGGFPVGENV

SEQ ID NO: 973300 - protein, 108 aa, Homo sapiens
MSRWFRGWRWVRLVGECAGCVLWCAARGGVWVWLCSLRSLGAFVSVLASSPSLLRGGGGGVLFVGPLWGFLWGGVAGDDCCCVSIVGRGGWCSGVLKVCSVSACSWGV

SEQ ID NO: 973301 - protein, 179 aa, Homo sapiens
MRLHVCSRLGACRSCMTCSWSAQARYGSLSLTRSTIVVLPERALIYSRCDIVARCLCGVDTARDSRSGDSSSSMSGAGVLRAHDRGGRASTAPRPVVCWCENCVFCVVRCEQTVVVVDDSLQWRTPWESVQHSGWPAAIKTFVGEPQKLIRGELMGWLLVGVPDCAVPQRRDRYVLSDR

SEQ ID NO: 973302 - protein, 158 aa, Homo sapiens
MERFLLLPPPGAHHKNWGGFPHLGVTQQKNIGATQAHTWRSLRWASHTRLEERCPKRAIPADWVVNIWCVLRPLLSLLFWGCLSLYKTRATTISRVSARRHLFYMGSHAHPTMGSPRPESPREEKNEMGESHSDTAEREVAQTTTIVTLVKEKMGSHI

SEQ ID NO: 973303 - protein, 202 aa, Homo sapiens
MTRLRTVRAVVWGLRTRVVRSARWVRLLRCRLRRLHVLHSGTGSSSRRLVFVIFPSTSSSSTSVVCILFPFSAACSFVVCVFASVGSVWLCVVEENRAVTLARALLCLGCVCIDEIAVGVRSLSLLPRSSRGESFAALLLLRAAPLSLSQAPRPLLVSRLAECRSAPSSHSRLISKRGCEGCSPRAWWVFALLRSLMLCRRR

SEQ ID NO: 973304 - protein, 134 aa, Homo sapiens
MPSFRSLGGLVFVIAVSHILFTNTLRGAPTGGYSYTRPLPSIWGVFVGGASVVLVACFPHHEGCRRGRSFRVGVGHPPLYRRLFFGLCLVQPVSHFFVGLTWGVHSGRTEDGWSSRDEEHHFVVVIPFGVFSLC

SEQ ID NO: 973305 - protein, 115 aa, Homo sapiens
ISRADPITTMFGFFSSRLHVFYKCVVGCCALIVFRVLCCTPLVFIFSPGGSFSVSTFLLTAISLCPVTLSAGGDLLEHMGFRWLPFGRPCTQNLWNQDQPLLRMIPAGGEDGEHL

SEQ ID NO: 973306 - protein, 345 aa, Homo sapiens
PGADLFVFCGVCAALCAEVIHCPAACGRPLWFRPLVFFPPLWALCPCSSLRGFRSSLLGHPLWAGSRPPLGLGGWLPGGTLWRPYPTPPPSVQLFVWGFMFGLYEVPSTPVYSSGVSPGVSGRLGGSSPGAWPPGATPFWRFSRWAAPPMGSPTARPLCPLGFVVLLLRVECGKGCLRARSRGDPHAQTHSLRGALISKRLLWHFAPLGFCLPHTRCEHTPRVFPPTMRPVGAPPVSLRSPQSLLSARSVPFEYAPPSILSVRISLSLRSCGGVYAPSRILRYCASLGAPLFWRALLPGLSRYTPSALISLGALCRRASLLRRECSLMRGSRHASSNAPLCGASC

SEQ ID NO: 973307 - protein, 282 aa, Homo sapiens
RFLCGGDLATRDLLLGPSPLILRLIVVVSSHTGGPNGPQSPCLGLLNGDTLHAIVCASTAKFVAPPNPWVWVNIRPHISSNWGNLSSYTRLSDAFLATRAQWAPFQSVFYGDKFSPYRRCGDPPLGLFFGGAALTQSLRSQGPPSTPLGMALLVRVGDPSSLPQNGANGPPPAKEPLTKCPESFPPNRCQTPRCSIDGRPRTWVYALDTCRSHALEMPPPTVETHVAHIHQTPPTPLLAYTKQGATSSHIATPMTPTSTTAQHQGSHPSEAPTLRRPIFSSM

SEQ ID NO: 973308 - protein, 142 aa, Homo sapiens
WGETTWDRFSSPPSRLHAMGVYSGGLSLSLPAAVSGHPFFCPRRLPEFFRLCCRKLSRRLFRVLYPGGVQRHPRFTSAPLLCCGYSPGSSGVPPPPHGCLLREDIKKETFWWEKKAPLENWGIEIPPPLWLIPRGIFLWSEY

SEQ ID NO: 973309 - protein, 147 aa, Homo sapiens
LWVVCVCGVVLFVLSVVCTFIYSDRLVCACRGGAWLFCVIYLCGRLWLVIVLFGDSISRVGFRCLPGWFSLSAGGGPSPLAPGASRPYGRLAFLMPGGSLGGSPVVVMLCADGAGSSCALVCVTAASGLFFGGSPRAPPKSRCVAPL

SEQ ID NO: 973310 - protein, 103 aa, Homo sapiens
MSGCALWIHGWFARHVFARAIHLRVLVPLMLVRGVSHYKDSARVCAHDAGEEVVRSRVHPLRGLFCQQTEKCACVEGRGDVAPSCRGIGDLGERPSTTTRGEE

SEQ ID NO: 973311 - protein, 363 aa, Homo sapiens
MLCGGTPHKCGGGGGLPNEEEMLVVRRLFVCGFTSSRRPLRLLHFHGRRARVWRVVVLWDTPLVVTQRGGCRLIGGPRRCCVAASSSRCPDAVVWWWCRCVVVVHNPPILLSLVAASQRRRHLLTRVVSTTTRRGWWFISRRRGGVFTSHTLVCGAARALPPRDNTPPPALSSVARAGYTRGWSPRSTHTRLSRPPLVDARGGSPARHLVGAPRVCHTPRATRRVRRHTILCGARARAPHTPSFAHSTHSVCVCCARPRRVWPRRHPRATHTPPPTRGEHTTTHVFHTRLNPRHTSGGGEHNTPPVCTKKNTPRRPHPRCVAPRATPPGNTPPPGVCVCGPPPPPLCVCVGGKYIPVCVEKHI

SEQ ID NO: 973312 - protein, 107 aa, Homo sapiens
PYIQLPVWCAEQPTHVVVDPRSSGPCGWSSHTLCVATKTHGLCKLRRPPRFLLFSGLLLRVSEGPLVVSPQNFSLRRRGTIIVVLWPPPTGACFRRYCLGGGLVPPL

SEQ ID NO: 973313 - protein, 109 aa, Homo sapiens
MCENLVCFLPSSSRGDPRVLIYSHCGLTSLSVPPHNTPPLGLSAPVFSLEHLCHKNTDWALGVAHNPLCCVFWKRVHPRKAYRIFFGRQQFLKGPTGTLKGSGKAPKHE

SEQ ID NO: 973314 - protein, 170 aa, Homo sapiens
MSLRRRFVVMSSRAVLFRRALLLSPRGRTPPTGCLRALCLHSHAVLFSRALSRASFGARAFLALSTVSHACVAYVCTRRIAIPSARVAPYHRVHAGYEYSPYVSRPQSPHRNRGVAHTTKDITYTHIHVYVQARPHREGATVGLPHTHDLCVCVEEVGEVHTPNVVGPKV

SEQ ID NO: 973315 - protein, 144 aa, Homo sapiens
MSLCFVGPDMMVGLLPRRFTGVSLRGLFQDVLLVGLPRVGVCCALLPARCGLGVRFDSHGRVPTEEGVCVFLSVGDRSAMCLRGVAGVLLKILFGGESVGSSRVRLRTHCLGVVTNRFSCFVVRYRGRMCFGPRSLTSVVCDRW

SEQ ID NO: 973316 - protein, 88 aa, Homo sapiens
FLMCWCVPPPSRQRSCVWLSRLCGGDECCDSPAWCVPQEFVSPPLRVVDNNLFVRGCPKVWVDAPRQVCVSPKRSAIMLVFFSRCLDE

SEQ ID NO: 973317 - protein, 197 aa, Homo sapiens
MAANGWHKLGWVLGGAERGISQGVSRGVYKKEIIAQNRINASVEPPKCTFDRAPPKVSRVRGISRDWSSHRKSLVGHGDPANQTEPKSVLVGGSIKTENLGPNAKTVPHLSYMVRDTTHLTRMLCDHKRQQPSRHHDLTKNKFRPRHMRMANHLPWASAISAQPRSTVMVKKDNGPAPPRAPEAPCPQSQLNQLAFS

SEQ ID NO: 973318 - protein, 117 aa, Homo sapiens
MTPLSLFLSPQLSILIIYTLKSLHLHYTLFPLLPYSTLTHTLTFTLFTHSRRSHHTYSDHTQTRPPECKERTLHIVLLRLSPPTVDTPPGMCRIVVCLLLWAQRVDLEMFLGVAPTR

SEQ ID NO: 973319 - protein, 274 aa, Homo sapiens
PVCEYPRSSCIMFHALCYLISLPPRGYVFVGAHKRVGSWCACVKVCCVALRVCSPPMWEYSYHHRCSLRLYLCCVLLALVVSINRSSLGGNPGVSRCFMLSVESPTGLDMLLCSPAGCPPLGAFFSFVVVLSRGRSPRTGVLCVHFSRAPLCFPRRRAHLLFLGVFIHASYAYVPLFVRAVWCEETHHSRFFAPLFVRPYNCVGRPLCAHTFPTWSRHTSPSLVGESFHTSPQLGFLCNICGVSRYCTWELLWGDRCFSSPHAGRATRTLCLSR

SEQ ID NO: 973320 - protein, 130 aa, Homo sapiens
MLLLCVLVDCRVCRIVYFHAGVVVIVMWCGWGKHISSVVVCWVGFHRPPTSVLLYMVESCAGACGGPTQHSPRASCWVVAPRCRGVGVLEYLFCVRVRDDYFCVCVVETTHCWSRLIRYSLCSQEREIYR

SEQ ID NO: 973321 - protein, 142 aa, Homo sapiens
MDCGTRVYAGVSAEPEALAPLGQNPHGGHLAPTRVPAHGPREAPWLSTRHSLSRIPHPAWHNNFLQKRFSRVDPGRRKGEYEACNTGVRTSNVSLSLDLTGRQRRFLPDSSLTDKVCPLTLSGNEESPPLDPCLLSVFTCIF

SEQ ID NO: 973322 - protein, 220 aa, Homo sapiens
MCLVTNNDDIKQAALTYVVRIATSYFEVSSDLVLYLECEVYCFAVLLARARECVLMLVCALRWFATLVIWCCACPAGFLPLVVWWLLVLQLSFGTPLVFVSDALLFFTVVVIVRAWVWAGLSWRVAIYLGAIGWVTTVFVFSSLRLWLFSCVGVVVTLVIWWWGFIHQAALGCIPMLWCSHIIVVCVWSQGCFYVVRVLLVVRCFSPPLLWGWRRVGSKL

SEQ ID NO: 973323 - protein, 207 aa, Homo sapiens
MLCVPTPGSTLPRGCFLYAARLASRGGAHLRPCNVSLGALSSSGLCLIPACFTVCVYTSVLSGLSLCLSGLSVHLRCRLSLCVSYRARDIEKCVETHTLSLCHTYHPGENLSVCVTHRERASHLSRRHMSVSTTETCPLCVCERRGVSAVTPDTVGGHTCAELDFEGTPRRLLLYKITTRVSRERTLVWHTAHVITPTGMNCSSKCS

SEQ ID NO: 973324 - protein, 352 aa, Homo sapiens
SSSRSLGSSCGGRPRGNGSGGDHHFELTHHHCGDSFCREKSVFLLAASPATHEGRSYREVFGAHFACHQHPTARSVWGEHANNKPTFCEESTRLPLSVEVTTGGEMLWKKSCGGASQRVGGFFLSRNMTLLIRGPSPLCGDLPRSRVCIKKGDIVIGHQDHTHEGEVPELHVSSGSAHNIIISGEKMCSKKFVVPSRDNRCPPQQSHHMLLWVLCPRHCSSRGERIFLEHPTQWVVYNEAASGGVPPLGNHTGRCHNRSEKGVLLGEEELIYSSLGMRVFAQQLQGVHTRMVVSPLLIIERECRLWTISLYTGDMYAFLSGRHYRQQCLNTQCVCACVREICRGATPQRRTT

SEQ ID NO: 973325 - protein, 119 aa, Homo sapiens
MTSFFTTTTTPPHQHQVGCSSSYNHFISPTTTLPSRHRCYNKKRFLSSALFVGGLRSNSSSRRATQQIISSHHLLLFAAAHRVNNSIVLIREHPRITTHQRLHHTAAENTYSLYIRPHM

SEQ ID NO: 973326 - protein, 94 aa, Homo sapiens
DYSSGEEFSVRRVTATYLGRFPRSIPLLVALRWENALEGGDEALWGPHEVGREIIISIYKMGAPRSGYLAQCIYSKYQRSQHFSSCDGRKLYSL

SEQ ID NO: 973327 - protein, 88 aa, Homo sapiens
LQGNFPGPLFHRLEWDLAPPQLIPVMVKRCDFGESTVGASNTGYARPNVGGLTAPGHRVIVVHPQDCSGVSFPPPTTLVFYSDTLHTL

SEQ ID NO: 973328 - protein, 72 aa, Homo sapiens
SGVLLSDECGESCPGGVVLRSCGRPFSGVLFFVMPDDRMLLHVWCLSFGCGLWGTTKIRGVGVLSHVWTVPA

SEQ ID NO: 973329 - protein, 153 aa, Homo sapiens
MGRSAPLSLQRCRTVVVLSLGCPSVSPGSVCLFLQYIFAYISEPINSQEKLSSTIPRQKTPLVVALVGVLIYSIHTLLYFNPTPFPRHTRGERISGPPHTCLQIRHTPTPIVVVVMSKFCGEFWEHLNPCVWKRPPPAICGKPDRSPVNVNQW

SEQ ID NO: 973330 - protein, 96 aa, Homo sapiens
QWGVPHVAHPSGWCGVVVYCAPRCVVLSAPRRLVKPDAPLCHSPGGRSPGCPVVATRPLCWLGRIAVVSSFFRGVLNKTRVFLPPLLCLRGESPLL

SEQ ID NO: 973331 - protein, 114 aa, Homo sapiens
MFSPQRFSHARVLPTDISLTHIRRGIVLHSPQLFTALLLPGVCHENTLAGTRREAREFPRRNEPQAHSLGACWRKLSRGTPGPAHPGLFPLPSPGSLFTTTLCGFWTQLKASFG

SEQ ID NO: 973332 - protein, 186 aa, Homo sapiens
MCHVDVVFGFVVVWVGLSRLWLLAFVLEVLLVGLGGSCVACGTLLCLPRGGVGFSAPQLVVSMLSPCSGVCDGRPLCRVFFGGPPPRFGGDPFLKGGPPPHTGVVGSHHRETPTGAFVCENPRSAPPLVDRIFYPAGLPNKGCFPQRAPLVGVGARQISSRPPLQSGGVIINRYENIVLCLRPLAP

SEQ ID NO: 973333 - protein, 174 aa, Homo sapiens
MISLGYVLAVFGETTQEKIGGDYHERRPLIIDKIILYNVRAATPVSSTRRALDENLLWGPPRLSILTKMVAHHMWAAVFFFSLVPPHAPRALDSPLVVFSSQENWFYCVSTPLLVFTIWFYGGHHVIAPRVCFIRGVLVVVPQATFSHYTPPICVSTAVLLHREVIKSERSHSL

SEQ ID NO: 973334 - protein, 171 aa, Homo sapiens
MPTGVVARPPHVFPSCDIVAPPRRGVVVCAPRMVGSVLGGFPPRMNICWLWRPPLLGSLRICVFGEPLVARLTSAHRVSSQISSSPPQVCETFCGGGPPPLFIVLRVYNDCSINIVGDIFVLFVVEETLCLQAFNIGGDDLSVVCCGQHTVIQKIVVLSSHQRRPETTTSR

SEQ ID NO: 973335 - protein, 440 aa, Homo sapiens
LSSSYLLIRLYFLFVWWPIVVWLPPLLGGVAPDSWPPRCLCHYLLFVLDDPLSCRDSFVGRALRYTCLRHVSPCCFAPALCVFAPSEVVGVCLLRSNTHERCVCPPCVEGLCCCAVPRCGDGWLCGTTLVAPEEVFRPGHRTTTPLGGWPPLRVSAPAVSVPRCVARRCGPPQSMIVVAPPVADVTCVVAVGRRVSPLSPLCGAPGRCVLCVDRLTEGVPRPLVAALGRCFLKSPHASLIPKDFVVGKQIVFDPSPSRRHIGGVKNYPPWAAFSVRHPCVLCGVPPWCVCDTRWVFLPPSLGCCVLSNERCATPMCAPPPGLCIAPQLVGPQATSPHCFFLCGSMWGVSPRPTWGRLFTSRVLVGRLSTTLCAHTLSSPPPLVWVCPLCCCCEGPSLGPPHRVLTERETLCVCHTSCESTHTRTHSAHFVRESSCGFLPL

SEQ ID NO: 973336 - protein, 143 aa, Homo sapiens
MGISKRFTQPADAYSRPPGCKKVPHRYPGCSVFLPQRPRPQMGPNLVWGPQKSPPCSIWGIGNVFSRDYVCDKHFCLVPLLKAQLPWAPPGVLLRCNTPMGPHTFCCAPPHTHPRIWAFSHGVSCPLRHHYCGPQQTTEAWGL

SEQ ID NO: 973337 - protein, 290 aa, Homo sapiens
HGVGPPQGANHTAVNVVCHRTPHPVPYTGGAEEKMCVGLPPPTPGDVPPQHPHPPPHGGGNTAPPRNRVCPREGPRHPLTVVMNVCGRPHVERKAPQATHVCVCEKTPHVCVRGTPTARGEIYPPPCAPLANVVGSHTPTQHRGRKHGAAACVCVNKESGPPPPSLGDPCAACERKHMSHPCGCGPPKGTHPHVGTTNTPGPTKGRGLPEWPPTGLRRVRVSTKPPVGVLVRENPTPPAPTPYPGPQNTPRGASGTDPEMVKGPVRGKKKRRNKYVSSTAGERECSRWAG

SEQ ID NO: 973338 - protein, 197 aa, Homo sapiens
MCGVLVVIEHHVLCCINNTGEGGVGGPPPLRLVLGEVVEDPPGSWWPHLYATPRLVCLDMRCFLRRRSARLLWVHRVMHLSVVVVRAPPSGDDTSLGLVWVGVYPLLVAPPRRAAGEMIDVVLHHEPSPRSPRSLGCCVKTHDWCGVATTRGEHTIDASGRLFFLLWAGTLLVCCCHTPCALRVFSVGVVSRWLLRK

SEQ ID NO: 973339 - protein, 501 aa, Homo sapiens
CIVGRMVWVGCSPETQPRGCMGVGPPPGGAPRRRCKTVVSPSRGVVGVIYPVVPVLVGRPLLVGTLVFLVRVSSTLVFLLLGAGHHLYSGGPVFLTSGLPRGRYWVVCFCCPQPQGNVVVFLFRLGALEPVFVLAVGVVHHKRPVEVVGAPPRPPTVGGKRPTVLVALFSKHWGFLTRGWEIVMLLPWVHPHRVPSVGRPNYLLLAPLLGPFYYCRPPLWVDLFLGRIFRPPTPHQEPLPSTPKCGHIYDAQGCCLVVWCGPLCTMEGVIIRMKVWWSSPRPAVLLGGLSIIIGPSWYKDISGRSPHEKYSRVEIRFSGVDMRRRPHCGCEILCGCPLWATQAPHWVCVFEREPFFSQTPICPPAPLLGVLALCASLCSVEIILRDPHTHTVCARVGGVSLSHKPTLGRAHTERELLSRESLCATKVVTPQVFSAHSREGSTRERLYNENNYIPANIPRHTPHSLYNPRWVEKNRVLTRTRLWLSQCGPLLKFSMLKDSVI

SEQ ID NO: 973340 - protein, 109 aa, Homo sapiens
MIVTREMLVWANKERPCVVSNPPGGLALQGGYTPQEKVGSTIVRDRGVLPQEGCSAGVGFVEDRWVRGWPLLPSEKLLAPPAKSWYLGEDWWPTSVLWRQKDWCPTEPL

SEQ ID NO: 973341 - protein, 405 aa, Homo sapiens
PPRRVVGMLVGVGTNGWLLGWLPAATKEWFVLQKRDPRSGGWGQTMIIPAGRDDRHVLQPLGGETQKRGGPRRRGDECSVSVEVVEWGGLLSPEGWSTTVVVCLCVHHVGGCFPRNRMVGGGRCWWVATPPAQHTHNKVSGWSNSGWGAASPLPPPGGGRRVYTPQGEWFVYATTAVVLLVSPRRVVETTLVGGSPPPSTVRGRALSTVVCLPAFGQHDTLSSSSPPSSGLPAHTPQHRSVLWWWVMLWGVPPTAAVRLSIRAVVSRQHSTHTGYHYPRSSQHPAVLGRPIRCCEERRHTLPAHQQGLTHSRESTLCGRHTLLLRRRDTTHTTPPPPLLCCVENAAAAAVCLSPALLGHTTHSMVWSRCGAVCSSAHQRSAVWSSLLCVFSRCVRALLRGEERGR

SEQ ID NO: 973342 - protein, 199 aa, Homo sapiens
MACVGRIFSISVRQSSVLLVVVGGVVRSTTTDNSCGIVVEDGGRRGRTSGQGACASVSGCNTDTIIHILIMSRWGGDRDDVEVEEWHEHQPHRLNYWCIGLVVDGVVVVVGGLVWVVEEEAAASSIINSISSVVAVVLVGGRAVWGVRHVVLRSRHSLRGVLSVSLSWCGARGSRGGRLVACRVVFVVSSLQGREVSVL

SEQ ID NO: 973343 - protein, 338 aa, Homo sapiens
MPLLRGGSARAWCLCVAVFERVCPGLCVWVKKGGRCTLVCPRAMVQPPGGGGALCLVPSVEAPGKGEPLVLHRTNWMVSVFPRRVVAFGLIPRLVVVARVSYSWCRCRVARAGVRGVYVPVLVFERKFARVLVRGILCIDTPGVVSENNIAQRVYMWVCHTLWGPQSTLTRREREAAVCSPRVFVEKGDTRDPAKLVTHMVTRAQVDRALATRVSLSHGDVEIYMGGYCDTCLLWGIMGERDVSLGDLSGHRGVCLPHMSPVRQRGELVLCLLTAHLWAPAHTQASVRHCLHLLPLEPRASHLISLSVWRLNCDTHGPLLTTPTALWPCSKARTHRHP

SEQ ID NO: 973344 - protein, 215 aa, Homo sapiens
AWLRPPPLVGGGGVWWVRRGLCLLLGWLFFLVVVGLPTRCRWGLHSYVRVCWVVVPSPRSSWCVFWLVLSSVWGVPVLAPHRRGGERTSFWVGGLAVARLPLGLACRWCSIVMAAYRVSHLVLRPLRRGSVARLFTLLFSVWFTTSTSGVVVVIIITSSPPLCGGGVLLSIFLQLVLLSPLRCFIMRVVPLRLGEESRFVVLLFDLVVVSSRLVY

SEQ ID NO: 973345 - protein, 317 aa, Homo sapiens
RVSCPLLRRLPSGCRLMGVGWPHLACGVVVFVVFGHTTGGRAWLVAFVFGGAPALITGLVSRFLPCVPLEEVWLVSVGVYEEGGPPIFLGGSLSLFRGVCLHMLGAFLTRRCSLDQLGVLRVAPPTMCAVGRRGEGVVRIVSVWARRQLGTVVLGAAARVVRRWSCEMVCCGRKRLVCRRLGFSSSLEDACRVKRVARGGSRRLCLALMGVFVPPPPPPVLRGGEIALRRSARATMGLFMGEIVIGALLFYSSAPVCVLNKQAGGGVGVCPLCFSGGCWYKTVTAVSSPLSVAPPLSGVEKRCLSPPLVLSFGEDRR

SEQ ID NO: 973346 - protein, 210 aa, Homo sapiens
MWRAGSCFCLVFVGALLSHTCVVLRLRLFCGVSFGSCLYLVSRPCWFSSVSPVGWPLSVGECCWVGPYLYIPRVGEPVTWGFFGASRWVVYAYCLLVGRTLVSNVLGVLCCWVVTGSFCLLSCLVFLWAPSCLLRPALCVWAVFIPPVRFNQCGPCVPPSRMIVLWGGRTMRRARLLGEYNSSHTEVVKTPTRWKFPHVEFLGVVGERAL

SEQ ID NO: 973347 - protein, 342 aa, Homo sapiens
CVLLTCASMCLLGVSSVAALLVFVLGEALPYGCGCVVWVGELSCSRAESVRCGGQGYRMWFRAEMVGPPAVGSLPVGRSSVFVVRSAGCVIVSEGRPAASCVRLLGGGAEGVVVRWQVACCERPAHSVCQAVAQPAGVHKLLVGWSQWGALWPVGGLSRYSGDDLRAPVGMRRAVGGAQHKGEDYVSKGGVALRGEHQQERLLSHKSPMCCPLPRGRPLGRQCCRPTQATHRGPTGVAPTRGVSAAREHRSTMWVCTKRVPNDTAGEHAGVCVLSENVCRGRWPPLREIEPPTWGGPQKEVLNGGGVRLFAPADIGEIVGVCPHAQYIRAPQRLGDKMCERG

SEQ ID NO: 973348 - protein, 298 aa, Homo sapiens
RGFYTEMLYNSTHWTTPCFSGCYCGRNDTHYTGIFLGVGNTTVYSRDNSRVRRGMTPHRKDVLGAHQRKYYTAGGVVVKRNPATAPPTRRHLFTPGLLKELNRDALGVSPKYSRHTVEAPRRLSPQCSVDTRRATLHAIAKVCERRPPCATCGAHCCHPMCCAHRCHMCPSHMGAREISPPSPPISQPKNDSPASQPIGPTGGGVFSGGNPGGYIFANPVGATLDISHHLSQQSSWPLLGPDVGGLRWGIPPFFLSSSPAEPEAKERMRQEKMYPTGVTSQTPTQVRETSGIKVYKQI

SEQ ID NO: 973349 - protein, 221 aa, Homo sapiens
MLVPPLGGRHIRATHTHLFTGLKDVLTRHIILGDIKDAPLPQLYKKIYSGATPLEEMLFVVFSRDRCTAHTREIVYRELLVLARGCCGQPRYILERVYTTRCSPLSGKLERWVHADSNDVLAEFLLKRLAKRPTVVFVLFHGSCPRVWIIVSNPYGAPTLSPFFSLNVYLAQRPPLGWCDIAVVIWNRCCHMYTPGGIVICHCCNIIVKGFFCDTPYFGYL

SEQ ID NO: 973350 - protein, 224 aa, Homo sapiens
MGGAKILGGVYTPVGTGFVAVAPGPIGGLVRVAPLCQCVDRGGPNAQEALAPVLEPPVWVRTGARGAHQGDVLVKEGSIYGGVLHPPRVPVFHASLHLVLEGGKSFLLEKEKIGETHPRCCTATLGEDTPGDGLSAASHWVYIVGNIKTTRAPAEEGFGTLKKCCEHTLGEKFSWEERIWLSPRLEKKLKYKKSLYSNLPPGVFLCPPQEMCVTTLKASVCAKP

SEQ ID NO: 973351 - protein, 241 aa, Homo sapiens
MLIGRRGHHHSLAGILPSVGFHSCVVPTYASCALSLPRRDHTHSLALAHTLEIHTHVLAHIEITHHAVCTHLGSDLCSLAGRPGFTTLFCHTTTHDSREACVCERHTWVATDTLCWEPKTQGVSVVRRHPRPLGGPNTAGHPPRLTTHHNVSVHQNTHRYAAGHNCCAIHQGARSTVSDHTGGHTTHTTVCVGTNRRRGACLHRGVCRATPTTTRRTREHPRTTHNAARGETTAPLPPRGP

SEQ ID NO: 973352 - protein, 185 aa, Homo sapiens
MGVRVRSVCSAIRCARRLVRGLSLGVVCVRRSLSLPRLSLCVCQSSALLRGWGWCSFAVRASVFGGGCVSVCLSRLFVVLSFGAQSVGLCGCTLRVDQFYRPLCGGDWLLCVLVWTRLLFFVCSAAGVWVWCFLLFLRVLHSATRLSVFGVEVFVAFVVLCVGRSSCGLRCGEGSALRPTSVVLL

SEQ ID NO: 973353 - protein, 264 aa, Homo sapiens
MRIGEAAASPDPEGPQGLRRVHQGPCVLKRILSDCQNVESCHFRKVPPGFREIFHGVKTALDLTSMATDLTRDQNVFPMVPKTGQHHDVKLTLDVKTYPMVYLASVMILCVVLTYEITCRPIQITGRPLYASSEHQPGPAPNPGRRCMAQSLSPERSPVPMSIAIVYVVPYSHLDSNDSTWNKTLEQGLPTLFILSPDCASLENTYKTAEEAPRLILGRKLTGGFIGERHVVPGKATWGRMYPSAYKLYTRLMRYEPPRRRESV

SEQ ID NO: 973354 - protein, 214 aa, Homo sapiens
GGVVRSVCYSYVFVYIACVLSSSCCWCGVCTWCLLVLCVLSVSWVGGARSLYGVSFVACVWGVVVLWRVGCGSDYLRSGVVASQFVLCVVVAVTARMFVAFSSSQLVVLVGYFSFRPLSMLLVGGCGFDCVASLMVWVFARLSPSFLSTCCGGFVHTSLVCLLSVGWLWVLVAWAAAGLLLCIVLVFVVLCLGVCVCFASPAPCLGGCVCASAQ

SEQ ID NO: 973355 - protein, 309 aa, Homo sapiens
MAAQPEWTMVLNTPTFRQGHVADGGRGHVVFKPSPGTCKIRKTVKARECQGLRRIASVDPDVRVTDPGPHRYAASPQRLRVTDNSKGAADQDCCVSSTWYGALVVGQGNSDKAQCRAPVIASSRASLSMVEFADWECGCENYDRTHCDWSLFANRTHNCWLGRSHDTAESNRASQRHSFLSVYSLMCIWPLTVRPPYETWEDHVCLPLERKSWKSYGHNPNVLGPWDPVSICRWSREQRVLTNQNRGHEKGLRKVQYNLSATRRKWTLFPQNALSAKVLPGRFGPLLARERPWASFLGINWGRRKEAHM

SEQ ID NO: 973356 - protein, 198 aa, Homo sapiens
MWKQLPASWRPHTGVTVMMNNMDAAPPLYLSRRGPALLEEWCVKNVRSSGATDERPHGEVPPLDRHNMTPPRPQRGVFLLLVLRLCPRQRLPPEATMFISIFVFRAFCVGARASLRGVHTADYPHTRLLSQSHTLRQLVSDIETVVNTHSCHIYRRTSSDIYTLTRVNPHLYTLRPHRGHTRFIPSWEIYNTRATFSI

SEQ ID NO: 973357 - protein, 259 aa, Homo sapiens
AFRPPMGPHRVGLVSWAPACSPPGLATAPGHSGSTPPGPVECPPDVWARATQGACLICPGPLHRVPFRHHSVRCHHRFGTPPEKVRRPCPRLPPVRGGSRVARPYRTKKVAPDSIAPYFLLDTSRSAGHTRSQREVPCQTPTVSTPARKVCHTASPAHLISCSPQGMPSGAPRKGDHVLLNERENVAHTQLGPGPGSMRPSRNTFIKERMKASWVHPLREENEFPKAFLLVLRMARCAYAPAFRHTGHKEPREPPDRML

SEQ ID NO: 973358 - protein, 155 aa, Homo sapiens
MILTARRSPLTACVSLSRRGVCLSRWWLCAPRCVCVLSCDICLLESVFSRVGGSSRGRACLAPTVAPRGPAPPVSFPATHALCALSSSSSVMTILLREHLRLGVSNTESGTPALVGASLEEPAPTLSLLHHAPRVCVWRRRVCLVRLRCVVRGGA

SEQ ID NO: 973359 - protein, 35 aa, Homo sapiens
MNGGEDIKTAQKKNTVFVAPKTNSLGKTTIFTEKM

SEQ ID NO: 973360 - protein, 321 aa, Homo sapiens
CSSVVVGVVVVLFLVSFGRFSHCYLSALGWCGGVWAGWCCLLRLVVECAPVRDFAWDAVCELSRLGANVGVLSVNPLVSGDHVWGTLCLWPLSGLGPGAFSFVVPSLVVCWGAHRGCWGRVSSATIVSLCGEVSIGALLFLPVAVFMFALGPGRWGLGGAFVGAPPSLVVILLSRRVLCGPCACCGLLGGWVAGGGPTRLARLWVLSLCGIVCWPCSLASVEVALLPSGVGVVPPLSRWEGSPHKKGGIKLIFFGPPKRRPLGPHVCMWGVGRSHATTALPWCVLFLGVCVNRVGKEYSVSTHMGTTLWCLRDHLTGGSPS

SEQ ID NO: 973361 - protein, 153 aa, Homo sapiens
MYYQCVLGSKLRVLRCGAVVGALRGVVYHCVPSDCSPHTSLLALPCLVGRRYGVVSVAGDGCLSRRMAECVRCCSYSSLLLLSVVCACCTLSSPSSESSSASSATAVSEFSVCFAPSLLAARFSLRCVVCVSLLSLCALLCCAAAVCGVMCSV

SEQ ID NO: 973362 - protein, 172 aa, Homo sapiens
AFCSPVSLVVVRACAVVAFPVGCLGASLCYFLFAGLLCSLSLPLSFISVFFSLRVLRLAALCRLGCVISLFSSLSPSSVFSDLYSLLYCVCWVCVLSLNLFVVTVSVVLSVVVGAFVYLSVASGWVGGRSLRLHDRTYADFVGLLLDPRCMFVRVCDLYTLSNYHISAFLVC

SEQ ID NO: 973363 - protein, 108 aa, Homo sapiens
MPKGYVGAGLHQWSLEALARRPRGRIHHPWGVCYHSCGNGLLRGMWGGTFPQGGLSKPQSMGFCCGPREALPVCDLGQNDGGRSGHGDLGATRLLVGVPAQWGFLTPL

SEQ ID NO: 973364 - protein, 185 aa, Homo sapiens
CGVVEGMNEVVLMAVTCFDTWGGCHGVWMRLVGNHHTMMGPTPIHTHTSMDDWHQLLSGECGWCGAHTTEVGLSLYYLSVMFLLFLWCWSVVRYRCCLLFSGGSTIILFSSLARYIWLVLHSRCCASAPHTRTVSGGVCQRALTTYHDINRSYEVCVHQIVWWWGLLFWVGQNEYSYRGAAITIP

SEQ ID NO: 973365 - protein, 172 aa, Homo sapiens
MGLGPHCVVKKRGRGMEKLVNPLFETRIKSYGMAIYGQSYGSSIEDSSSNARVGRESGPGIVSRLRRGMRGASRRSKAGGIGSARLRIYSDVRPGALGTRTGRSPYIRGVPLTLGLLTRAYQHLRKNAHAREKKKQSQQVLCSECPWVRTSDSHRAVAVEPSMGGADTSFAP

SEQ ID NO: 973366 - protein, 537 aa, Homo sapiens
MLGLAVVVFVGVRLLLECLCSCGAGLCCRSARSVVPAAVIVVWLLSPPPVVLCVLGGDGLTLCGGLVSSCVRCNTLVSAAIRASRLMRVCLSVGEVGPHRCCACLWVWMTWWWPPGGLESPGVCLSVVVRAGVVRPSARVGLTPVAVLSALGCCLCLLRLMVVLLAVSRGCVVCAARGGRSTQYSWWASWCVTMCVDVFWLVFGWRLGVQWGGAPHGRCVMFPPGCRHPHVGVPRWWCRWSAPPAGYVVVRPTLWRVSSAGLSSVVWRLPQGWAPCGMVVEFRVVVPGRVVLAVTTRSPWLCGGCLVRPWVVGGCGYSMQSFVWVCVCGVWCQLGLPLLLRYWRRSRGCVPPVAPQRGAEYCGQLLGEGRDQLWSAGVTPPACRRVEVVLLRRLSSPRCVGDVGRKVVANSCWWCSDTSFDAPTECVEQRATPGWPAVVGSSRGSLAPAPARTWPPRVGEGLSCGGHIDGIPVGAGPCVSLLMSCSQSVRCVVTVSPSACTVLSCLLRACVVDVWCVPFVAHVTRNHTCEHTSHTVC

SEQ ID NO: 973367 - protein, 41 aa, Homo sapiens
MQHARGNERAALHISLSPAAGEASVNPPSLRLGIGMTGRCC

SEQ ID NO: 973368 - protein, 534 aa, Homo sapiens
VVFASAYILVVVFGCWLRMFVVFVDVGGRGGVWVVFFLVRFWLVVSRPRLWLRVLAVWVLSSPPPRGGCLALAGLVVCRCVVCVWLCARQAFVCCSSLVWFVVCFCWFVFLPSVCVDSASLVLFIFCVLGWLVVCGLSTSPFAWWVVCFSLRWLVAGLAVVLCWVGCCLGTFGSVWCGVGGVRSPLRRGPGFSSWCGSCWVSLGAAAPRGGLWLFVVYVGVWWVSGGLVVACCSLFVLCLCLLLSVCWVVFVFAVCLFVRMCVMLIVELSWLVVICRCWCCRRLGGVWWCVVLVVDLPRSWCSVFSCCRGWCCVLSRSSPPPLRLLFLVCGSSRAAPPRACLRWLPSRRACGAVCGVAPRFVVLSHFAPLFLHSLSPSSRRHPLDALPRARAGAALFARSSAVWRPPPLLSLLFRVACVAPTPTAASGGGSPTAACVVLFSLCCCCGVCCVEWCVFVDRPTALVLCCCLRCGGIRCGGVVVWWAAHLHRVCFVVVWCVVMWLGVVLVCVWELDGVVVWCGVMMRISSDSSSNEM

SEQ ID NO: 973369 - protein, 391 aa, Homo sapiens
MVEAPHAWLGSVASGVVVRVRWRKEKVVAAAVGGGGAASRVRWLPALLDEGGLSIDGGSWPRRCLQRGCRHKDALASSFVVWGKCVSKMPLVCAVWGEGRTRVVEIVVHIMGAPPVGNIGRLCVRKDMRVGTAELREVVEDAPTAGVEVVSLIVKLGSMVSRGVKGGEEELGAHRHSGVGTIGEQGRQGLIKFAENGAGIMATGGTGEESSGGVVEENADGGNSANLGIEEGGHGGALAAGGGTEEVVSVVRRDAALGHRGREGHRKGTTTPPTEERPATGSTGPPQRETWPTRGAHATEEAHRHTRGEPRGGPPQQCACVERYRSAVRPSCECHDTTWDTAERENPPRAPHALLGVCCLRKFLHLKPAGTRSRFLTFVLVLLGVCVIIVA

SEQ ID NO: 973370 - protein, 139 aa, Homo sapiens
ILVSRCRSFFVLSVSLLLVVRRRFVCGCGGATHAAVSTFVGGCGGAASGWVGVASCVCWVPLFCLSVPTIPAVRRSSGVCVFFQSLIGRVVVSFGLLDLLCLSVVVGHGSIGRRSGCAALGWCGVCVLAVCYENSVRGF

SEQ ID NO: 973371 - protein, 117 aa, Homo sapiens
MELSKHTKQSGDKQKPLAGPNEKQRGGKITASTPRGGANHHHRGPQLLETSRDHGHKKRQKQPKHRQTEPQSKATTKPHVLDRPHNSLLLNKAGSRKTLIWPAKNPSVATNKEGRQT

SEQ ID NO: 973372 - protein, 190 aa, Homo sapiens
MFVVGASCSCSRSVVDYQLLAPQKVCAFLCSVGYFFFVEVISCTLPFFPQRFLYVVMNIPPRRGVVLVCPRIYIPHLGVPPSADFVERLPPLLSEKIGGCFPFWLVAPPFFFLAPSQTRSSVSTRFMSMRCLSLCGPGGTHTSRGAQQSFMGNTLGAKNCSHDLVIETLYAPTLWGAHTHRADIFENHPR

SEQ ID NO: 973373 - protein, 78 aa, Homo sapiens
SACENVAHPRAVLLPRFYAPRGPWVSLSRCSGFAASLRFYNWCATHMCALSSQVSPTVLYVMNVYAQERASFGALQGL

SEQ ID NO: 973374 - protein, 265 aa, Homo sapiens
MSLGDRTAVARSSAAGAVGGGSQSVCALLTAQVQRGQKKIYQQRSLREDQAELVRGPGTYSLGRRRHGQDRLVGHGTTLRIGIEAVAILPQPGGSKHLPGTRTSAEEADTGRRKPTVDPIAHGMYYNGGGSRSPSEDDDANSYENVLIVEQKSHRDRCPGGGHRWPLQRGPQLSLGLKTGRHFWSLSLCLPGSKMRNLRIIRTQISHQWREFMEGHGANSEREGSPGRWEARRRGGEPDFVMGQGGAGSLGRPRKRARAEGRGWA

SEQ ID NO: 973375 - protein, 102 aa, Homo sapiens
SSSNNGGGGALRAPTIQVRVGRVVVHIRKWGGCLCCIYHVMMCVGFKLALVRSFHNKTKCRYTGARSGCVVVVVCRTVNRGGVGMTVETGNEIVEKCKIDGV

SEQ ID NO: 973376 - protein, 131 aa, Homo sapiens
MTCGAHEAPPGEVGRCTPPCFIIVMSAGIVVVVQEGTLWCLSPVRPLLVVGRREAHQQALFCLGRPTWDQPSFGGRHHKREGLSSPGACTPLWLILGLPVILVPPTGEIFYRELISAWLRTTHKGVSRPTL

SEQ ID NO: 973377 - protein, 138 aa, Homo sapiens
MRVLLARLCRAQRRCVWCETLMLGRTNTLLECVFCIRVGSGVRMIVCHTHSSMVARKCGVRHSHSSARGVRHEEWVRTTHRVGVGCVFGVCVCSILEWVMSVETTDTQNGGVIVLRWSTPQVTHIVVVRHTTMVLSYG

SEQ ID NO: 973378 - protein, 273 aa, Homo sapiens
IALLGFEKRFVPSQHYVAMFLVNMATDLSEKSGLPALHRDLLKFHKTLKEMCPMEAGGSIPENRIMLLEASSSVTKWFDEASVAAEESNQGMTLSRYCGNAHEPCPPEDLPLSPPSLDVLQGAPVIVTSKLTPTDITLRTTKEWLRMDEYVWMSHICMCNEIPEEDNAIAATQSNRMGRRYTQSNVAQTYRGKDARGLAMMALVHGGRGGRFRGGRSREPVGWGLFTIEMHKAEGWISEHTVPASPLVQDLTERKDPWSPIYGRVRHKFAITG

SEQ ID NO: 973379 - protein, 255 aa, Homo sapiens
MTTRFLYATGVVRPPWFRGLGYTTMVWFPSIRFANINLCDGVSSTTHMTIVCCRLVCVGVLFRTTAVTVVGWCGCLYYPLLFEWVSGEMKTIGGECGRVVGKQAQQWLVSLLCWRRVRHVLWCGLRASFGSCWCPDRGGFALLWSVLIVLVLGAPPSLCVLVFQWWLVASRHAPWVGVFYLGVGCTASFLSLIVGDVDENRYCCCFEYPLLSVLCLLMSLTPTLRLLFLWLVRATTNNRCSPSLVWWVVASTTGA

SEQ ID NO: 973380 - protein, 135 aa, Homo sapiens
MAKARFVLVSGVGSDMPLSFGWGRSCGVWSSLGRLFLPYLVQTYFFWVGDINVVAPTPHFVGPSSYLGVGWPSQSNGPSLLVVNVKFAYTPSSGDAPRTPTCVCGEENTCSLSVVQQKEGYRIGCCMYSHRKMYN

SEQ ID NO: 973381 - protein, 81 aa, Homo sapiens
MELRSLVARGSVGGIGCDRKFHTSGDPESDREEKLQAFEYERVSSTMALAFDSGVTVSDGIHGGGPMVLEEEKKFYHMEWT

SEQ ID NO: 973382 - protein, 107 aa, Homo sapiens
SWCGVCCGFCRLCVAWARECCAVVLRAVGVRPAGGVCLSLAVTRVGRVRRPRGRDGGLRRLVFGLWRAWGQFRPGCFHCWGSLPVLGPYGLWGAFPGFWASMDRWRV

SEQ ID NO: 973383 - protein, 513 aa, Homo sapiens
MTDYLLVLFVAGGRAWWVRHLGGVGIQLCGFRTDEIVLFGALVLFVVPGGYVVSTARPSVGGHTNGWAPPKEVLVEVPPKGIDEYVPLPGGISLCSPYGARVFFAVVFFGALDPKCLGLTRPLPAPSLVGTAVVISSFSGGPLPRWAPLLREGPPPGAQGVCFFAGAYVVIGGYTLTRPTPGWGTPAPVPMVALRAHGSLSRGRWSPIVVSFPPVAPALGRTPPPRFASSRVPRPEGFLAALFRTVVRPQAPHHLALRGPPLRAWHPSRRAVATQAGGVPPRRALSVRERESGPPISPVTTDSHFSLPRCTLSALLAGVPFSLHACARYGWWPRRRTTCDHRRQQRARPLSPPRLSPPRCFRVGSTPPLVHAPTACHEKVTPPRTYRAARLAARSPAGCASQRAPRQRPLWMVPPPGCLNTAVPGSPPLDGGLPSRATYLVSPLVPHRVLYASAHTFGYSPPPGGPRTLSGVASRRQRARRVAPITRSIPTPCVSPSLRVTRRDSVLVYRPAQ

SEQ ID NO: 973384 - protein, 595 aa, Homo sapiens
SGLCVQGARRRAQRWCRRAALVVVAPTRVGLVGCACAPAGGRAVVRLRSGDRMAVCGGENTGGGGESVVVRWGVATICLWWAVRVVAVVGLPHQAARPSVVVCRGGEQSSVVLRGVWALAGVGWRLVHVSLVSRVRCVGVRSLVFVYVWLAVLRGGGFGFVDDSRVRGGALLGSASTAWVLRARLVGLLSVVVWVGALLRAGGRAHLVGGGWCSAVRCGWSAGARVGRTTSCVGSMSLRLLGGECWGRPSRPRRLLGGRQNPPSAVGRLVLCWLVSAGVSVHLRTVWVVLLTCIILLLRLSRRGVLRVWRAVIGRLACVLVRPITDGRGGGGVRFAAWSVVGCSDRSSSCAALLPEAGVELWLGRCGVRLCRCRALRLPRPPVQVVVGQQLFLAGGNVGLRPPPPSGGVMMIGWGTDYLEVVVTDVRRTGRGRWSSSVFGSGRDASVCFAAATRARGGVDGVAATPLRCSLASRLPASSASCVTSRRRVDFAAAHHASPRGGARYIVASRAHVRRARWRLYMRVRASTRLVCALSARRVRPLLAVEGARDDACGCGAVVGCAPRAAAVVARAWWVCCLIEVVGVKRVCGVREDNL

SEQ ID NO: 973385 - protein, 373 aa, Homo sapiens
MCWSRGSICVAEDWSSVDDVAVCGRVGELWRCRLDALTARWCSFGGRGNLVCEEPHFLAEEDVLVSVWSPPWCEVVEQFVLVVCAVLAPVGGTSSWGVVNFPFGCSYTAPKGVGVFASRIHAWRREPTVCVVVAHTNGRKKTFLCWGSIEEDTQHMGVVTTTSFYKKIIPHHILLVLFIVNITLVVGYMSIGSDLSSGTERCCVSPSQKNIGWGEDKGPPPPLLWSCPTPPTCWLSPAGVLVEPSSAGVSLASVVGMTTTRRPYLAPRHIISTAPVLTSLWGTALLGGRLFLCTCCVVFPTAGIYIAAPQHKGDICVLRAAFCTIMIDIEMIYVVNTSCVFGKGRYSGGCVLHCAVLWEHRVLTAVLSQRSAL

SEQ ID NO: 973386 - protein, 87 aa, Homo sapiens
VRVASCEVFLTRVYMLSTIGAKADDCTSMDKPRPWRKRWPSYKLIELSLIPTPSYEGPSWYRCLNPVREIESSREAMECVSCERYVL

SEQ ID NO: 973387 - protein, 106 aa, Homo sapiens
MPPWSSAPHVVPSCLFVVRRAFLWFAPSGDWAAVASGHHFFCPPECAHRIRALSVPELCEEHTGYLPQVFVSHIKRVKVPPPSKMGILTRFVLVKRSMDMLVVLFL

SEQ ID NO: 973388 - protein, 233 aa, Homo sapiens
MASRQNPSGRRVPDWKSGVGLDAACLSICSSGSLGIKLIRDAGSTIGAQDCMVGQDVRASGTICEGICGGVVVIPVLPLRGDCYVDSSSPLCECNLRNWWLKGSVTIGMLVLSNADHNVQKGPCDAKDSVMPILSNLLVKARRVLYRMELLHAPFIGIRQSSRQKDRFSHRHGSDGVASEDLLIVVTATIGSATLPVILINMITLAKFGQEDGGIEEAQGIWRGVNSKAKPNE

SEQ ID NO: 973389 - protein, 156 aa, Homo sapiens
TVEAANELLSSFSVVMHSLVQEDRDQHDYKMKQGRDHGRVRRRSKKVGDLGKEGIGAKRNVEPPCESYRMPSDGLMAQVSASPRGEKDITEEKTSDCVWMPYVITVSHGTHHIGTCWICVLSYVARPLVYSCIQTGVVYPHLLLPILHHMCGNEGR

SEQ ID NO: 973390 - protein, 115 aa, Homo sapiens
RVVVVVLWVSVLCVCSVVCGCVVVVCVALSSAVLCVVFAVWLRISHRLGGSAFVVLSAAPVCCCLQPGCFARCCSLCFSARCVSLVVFACALGGMLFMCCARSVLCGVVRSFVVP

SEQ ID NO: 973391 - protein, 153 aa, Homo sapiens
MSRGFASILWLWWGLLRCVVRRRWVLCAGPRWCCVWRAPREWVVVSIWVVCFSFFVWVRAPPSSFFCVGLVVRPRASAFLVVSIVLVVLSPSSVVVCISRCRPSSASLVWFLVPLLLFLLGVVGSSLAASSTVCGCGCGCVYPQQQWGGGCGY

SEQ ID NO: 973392 - protein, 316 aa, Homo sapiens
RAAPPPPPPRTRGWGTDKPRCRGRRKSREPRSSRSRKGERRQRRLRRSPKNGPREGVAGGDLQGPLAGRGALRGGSGPEARAGAGDAGAVHVFRPEEGRCNPRRRDGASRQLSMASRAFRGQEPQGAKSPVSSSWATIGVRDLANAYEETRNMLITESRGTRQRKEDDFWTIPSEKFHNMLCLRHQTRGVAVDRSDYSVFVVHALIQRSARMVFGPTNRLHSPASVVHWQEAKIPTNLLLSSVGGRSMGLHAGLDRGRRRSVGVRAGVNQIKDPGQLVRHALPILDGVKHDIGVRLVAAEEPIEDGLPSGGTGSGA

SEQ ID NO: 973393 - protein, 121 aa, Homo sapiens
MCTPVPRPLCWGGVSVWTDATVPQIFFMSWHTPLLCWGPVSGIKGGCRRPDRGCLGRPQTLSRPPKGLCWLQKILLPAALSRFIRIYSPTGSAIKKGYFPGRGAPIVAVCARDKFFLAPTP

SEQ ID NO: 973394 - protein, 285 aa, Homo sapiens
FFLLPLVWVLCLSLSSVRVCLCYDDLVADCIDVSLCFWFVGSPTIRWFVCVSLCDRASYVLLMECMICCCAAAVSLHLSVGIFFCFFLLLLRVGVVVCGVIIDCLCWVGGLMLSCSLRQGGGGVSLPLLCVVFQCAVLVCVGSQYVLILPSVGWCSFFSSFFFVSSGCFLLVCYMFVLVVFFFGWCVFVVVVGSMFVCCSGGRLLVCFGSLFSMLCLLPFHCFVFVSLLVLWLWWMRSPRCWCRALWCFSGVLFCVGWGGFASFVFVSWVLVLVSHYCVVLGVFC

SEQ ID NO: 973395 - protein, 108 aa, Homo sapiens
MLSYHTASDQTRLSRTPGNRIVYPYTQKVGKAPKICMWCVPRQTSKGFRAVRDPYKLDEELVPQDHKEKHMARTRASLGGVHMWCYKCGRDHGSSVRFLIEDHEKSVV

SEQ ID NO: 973396 - protein, 214 aa, Homo sapiens
MGSPALSPQTVTGNSPRNGHHSAHYSPGLYRRTLHQAHRQALRRAHKSLYDNPTRRKEPQTNAKLHGRRDPTYLMARTNHATDRTVANLRALHRLRRTSTTREPGERHTATMHLSLTSSLGQKHTTPRHKTRNTHAHRSPRLRTESHPPLPIGDPPRHPNPRALNPPRPCRAPRATGAAHQGPPLPPTGSRQATPYGEGMRATHATQDTDTPTA

SEQ ID NO: 973397 - protein, 559 aa, Homo sapiens
GDLGSGLLAPQQGSGDVKGLRLGAGPGSRQGVSKQVVCGTGAAVRPPSQENGGDCGKWSSKVSAPTERSCGPLDSGADWGPGKRARARGAGPRARGPSCGLRAPARNANSKSVLERGERERRGGQPARERGGFSPERGPCGARSAACASRDGPHKSGPQRHTCGTPVRGKDSGRESESLWVRRHPTQRTQHTERRDRKVSELQRHARDTLPRTTPVPTLPTRAHDGPATSGPLPSGRQHTFDEAAHPEDRPQSWSTTQNRPRHTREYASHHGLNNHHVFRNNNAPPKQAHNTHTAGYEYTAITSPTHSPHPAGSPHATPLPPTGPSKYPYYTPRLTAYERRTPLPRRRDQHRPPPQTNNRQHNPPYYSERAPLTQRQLRGRHHSCFCRHIISSTTVPPLVGDTTKGSPQQCEPVGTWTDAAAAAVEPLITIMSRGPSHTTGERSRTIMWSAPTKLHRVATTTSPHTPQLSHTEQPRARAPPGAKPRIVRPPMRTNHQHLRDTGHTGAPHTHRTATHHWRTTHRSTSKPHSLPDGTPAFPQHPPPPPPGGINDLIAPHTL

SEQ ID NO: 973398 - protein, 101 aa, Homo sapiens
MRDVMRGDFRMRSGLSGGTRAEDWWAGADGWARVGRAGLDLGGCCCRRFVGVGPADREAGFGPGPRSGCWGDLEGAAYCLQRARDKVPGGWVVPLAGGQEG

SEQ ID NO: 973399 - protein, 113 aa, Homo sapiens
MCDHQCVLGRKKTCFGAHTSIRCGRSSCRIGRHTTSKVIFVGCVVVDRHEHELGCVLINLEYEACFSRVEDCVTKPCSLSTAQGTPHRVGNITHLGAHAINTRREGGCTHTWM

SEQ ID NO: 973400 - protein, 474 aa, Homo sapiens
GQTAKEQRSGVGEEHLVAHTIRWGAVPTTRRGGPPPTRGGRIHQGRGSSRTLRVWWSMRGVAHKHKECRRGGDRRDDRWSRRIGGRSDRHMRGCGHPKRWGDKHHAVVVLKVRGGWAAPTPPPSPVSEYVVCKCGSGDTTHKGGAYSTPGVGNKTGVGRERAYTQRMKVGCVLNRRMTRGGKKGAWAGAEENTMAGLIVASAVLSAQQPPPPRCEWLLCGERRERVVEEYSHSTSRVRANRECARPKREREGAAREEQHKSSSCWGVCGAAPPRCGESVRDTTVVLGDNESSGGARRESTHRERRSRERPQQCCLPAGCSRVVREELYTLSSIYHRSSRGGRQRMYHTTAIRAPLLVMREQHALRVGGEIESAMRETRHHHARREGGGTHTHRGWRHSHTRVCAHASHTRVCVCDTPPLVGRNHTRCTTARAPSTNERGGTAGALYVTHHHTPLGVCVWCHTTHCARRAADCPV

SEQ ID NO: 973401 - protein, 366 aa, Homo sapiens
RELSQCLTRVQNEAPVPLLNLKWPRSGCELMAHALSVNCQPRASLALCGLHVVCVWLWLLPQPVQGAFPHVSLCADVCAILAAVTCASNGPDIWNPQCDQRSPTPDLRMLDHFTMWPISAMETYVPGAIGGLHQSGEPVTYVTDVAPCGDVTPIVYVHDEHPYIPQMMPRDQGTRPNGAHREFAHRLVRRTIGRKGELAHMHHTHPLLSGCAPILMWWPNGHGHKNRVGDLELRTMEHSSRSRFGRAWRSTITFADIHVNSQSGRSISLCSSGHHGLCEPTRTEMNIGPLGSKWYADSSPLDEPYTDSSSIIPPVTSSKRQSYGWLIRPLEGRATFENPQDTQFAAGTFGNQGIATRQTKEYVEGG

SEQ ID NO: 973402 - protein, 68 aa, Homo sapiens
SVSSCSLDVSLSLRSVGVVVGGVSSIRTRSAVDLSAASVCCGIDITSYELVHHIRGECTCCTAFRHTR

SEQ ID NO: 973403 - protein, 157 aa, Homo sapiens
MCYDTLTRCCAHASHTAHSVDSHTGETPLICPNSSPLGPRASHTLLEKLWCCPREPSESPQATQEFVPTNMFLWGAQPQMSQESRDPGACTHIPCPHLPRKDLFPVTGICFPSCLLAGDLLLEPQNTGSRLPEYFFPDPLSGPTQPRLPSIHKPLFC

SEQ ID NO: 973404 - protein, 179 aa, Homo sapiens
SLAFMYLVTESYEYVLYDDVGAMLLASCRLRFVCGASAVRVDPAGAVDAPSICSCGDGGLFSSVFLTGFCCRLAVVSFPALVGIAGGITSQSLCGSRSMCVDGATLYFPLGVSHITWSLLGMSPDVGISLAWWALVATLMSGCVFFDLLACSLLVCATLVSPSLYHCCCCVGHLQHRGD

SEQ ID NO: 973405 - protein, 352 aa, Homo sapiens
MFKYKKYGRRRSITRHPRNQNCDLMVCKESVLFCKCSLACICEQCMHEICHSQHNISKACHYCTAWFHGSHNSLPDITFQWTMDSYTDEQTVSFQWLNKHGQTDDLKAHCCMSKTTGWLLCFVLFWCLVLHTKDATDQIAERPLHAQTAHRSDKSGRTMMAHHDPRGADTDDLKEVVNHIDSRPALDARHITRLANLLKSYFQESNAGRSVNNCLKKAPTRDIGHSVTGRSQGEKPEILRNEHSRHKTGDNLHEPRNNTNSPTIAKRKTPPEPKTGDRRSHKQEKPPTTNGEQKALPTPQRNQRDQAKRKRQQQDVTAAPRKRTSSNNTNPANSGQTRATARKPSSENNKTA

SEQ ID NO: 973406 - protein, 72 aa, Homo sapiens
VCSPRVVCCCVCWCWLACGCEHVVRVIDLLAGGVVGSSAFGYHDGVSDSYGPACAFFSLLDFVLGVMSGVDS

SEQ ID NO: 973407 - protein, 273 aa, Homo sapiens
MSRWCVFFLLCGCLFRCSLLLCCFFRAFVGCVCVLVVVCVVVFVLLFGCCLLCRVFFGHYLPGLTRGWAVVIVRVGSPGVSKDVFVVLAVRLFCCCFYGWRPSGWALLASRGVLFAGGFFSQVLCGVPHRCVWEIYVEGGPPSLLRVFGRGSPPALLFGGFCRSRCVCVLKCGRFSPGGFYMGYYSGGVSSPPLWTSVSPPVGIIMCGFRLCSLAGVLCLTFFTGALFCCVLPLLVDTPRANDPPRRVGWWLNTQKGGGKFFPVVCVLLNRGK

SEQ ID NO: 973408 - protein, 359 aa, Homo sapiens
MLLVVAARLWWWGVLALTVFSFGQSLLVGGVPPPGWMRGGGAHHLWVCMWVLVCVGDFVCFVFRLRGSFCCWCPFAVDLHCGVFLCYVGGGISFCVLFIVSLYSLVGGGCLSCGGRYFVYAPPLTIFLFTPLWWWGLLVVGASYFIDYWRRYDINIFFVLGEGPPWMDVCLSSPPPGVTIIGRGEDEYELEMKEVLCGKFLCGVLPHSCVCHTEGAPLHITSVPLKKRARSAEKNKPVCCGVLLRPTGPPLLRVVLCFSAGGVVLFTPRGVCCSSVVRRNYCCGGGAAGPAAGAPTAGGWWAAPAISIWWCGYFGEYISCVLYTPHCLFFFISLWRWCIIRTPHSLLLRGYDAADTLCV

SEQ ID NO: 973409 - protein, 319 aa, Homo sapiens
GTTAPCLCIKTTKGCHHNGDMNNILLCCVFGDYGYDLMKGRHKNLSSPPTFLEDQTFNMYVQRCVGSASCRSYSLLEWGAESNSSYYGVSKIGYSAASCVVATTVFAEEKSYYRCMRRLQLFLYIICYEGKHWLFCSYTAATTVMTTWEGPPKHNNKLLLQVRATMLRVNMCCGTTAACHHGAQTNTAEQRSRTTRMVHPTSASRSRTCVFGATHTQIGAHHCRALCVELMCTVSICAHKPHERGISTFCAKLELRQYLGHTDGHVAEIYYHTHWAEKSVRPSGTRRRSSADLCLLNMSVLPGIARALPRIPGATTPSQ

SEQ ID NO: 973410 - protein, 341 aa, Homo sapiens
SRHVSRHVAARLALVLWMAAWLPCDPAWPVVAESVSSLTICRLLFICSLAESSAPDPCRCPAASQEVHLLLSLTAAPITANAWKLDAHLCKHTGGETICFVTMTGCGKAFIRDYHLSRHILTHTGEKPSVCAAKAVITKFNTKSNLQKHFERKHAPQQKQYICRFLTTVTKTFKKHQQLKIHQCQHTNEPPIHVYQDGCGKHFASPSKLKRHAKATRAMYVHTGLFLCWQNIGPEPLTPCDRTHNEAHPMGTRPETFDARFLSHPYTHAPHTAIIVVIRSSACEYQFPGRYLQPIPRHEKTALVVTRVCEAGSTSRVMLTQQHVHPTSRMAIGIPRRSLEQ

SEQ ID NO: 973411 - protein, 102 aa, Homo sapiens
MYQVASTTKSGKCQCFLASTPIPSALPSLFVHTGGTPEPEGGGREILRPLQHAVATATAENEGDEYDDLVVHNNRSHKPAAFTTQPPNLFLTTPPPCELVHW

SEQ ID NO: 973412 - protein, 130 aa, Homo sapiens
PVVWCCWFAVQQETRTRKTGLETYDSAVYRFAADLSIVGVLFVFVSNRVVVLMDHYRLLFHSAGVYKRGLMGSRTHCILITAPTRVSDAAGMCLYTPSGPHYFQRGNCREESPPEEKQLGVSTRKKSGKW

SEQ ID NO: 973413 - protein, 105 aa, Homo sapiens
MQPQETCYGLAWHRGVMPAVPTTGEAEVGGRVWAQEFREQSRKYNETLSSKNRKLEKYKNYKDKTQKSVMIAQVVREDAAVVWEKSEVTVRPDRGLKGDDEEAEL

SEQ ID NO: 973414 - protein, 156 aa, Homo sapiens
MCSFCAALAFLLPLLLLLRVLVLLVIWGPCVFAHLARSSVWGVSYLYAGITSFMAFLVYRVARCVGCLAPQSVVCDDDVKVVCERRRLREDNVCSGSMYNIEAETVVCLVVVFVIVGATPHLDPDYVIDGVSVSCCVLAIRIFTCGGVEQDENKDL

SEQ ID NO: 973415 - protein, 402 aa, Homo sapiens
MSVILLCLTMVRVRRWTARSQTLYREYLTTTLEDICLEFGSDEQWRRKTSYARCQNMGSQLSSARVSSQDTGLLSVLRYSTYIASLIRGDRLGTCSSIFIAFLCTMMLQARPTVAMSLLSMGRNPLMGGELSPQLSVIDQATVAYLSPEDLPGGPLTDISSIDTVFDHGESTFTTKVTCLASFTPIVKVDLLRALGRRKALGNKTVHVAGKLKGLPSLPSRDILQLLANGNHQNWLCHNLGRGGLDTRGPSSNLELASLSARPELPLTYSRKLANPHVETRTLGENIRLISPVPFSFHRIQWAESPVTLLEKLPPDLLYKENEFPPPLCTEKPQLSIYQGGFGHPNVKGRIWSTPLQLERLITTRYHLSRGRPTATCTTQGLLLGAPTVRHKHHSQGAPSYR

SEQ ID NO: 973416 - protein, 77 aa, Homo sapiens
MFSTNNISPRAGAPPANSYVVCGWPPPPPPPPAPPPPTTRGAAPPGRVGGPPPPPPPPPPTKTPPPLKISGGGGGPP

SEQ ID NO: 973417 - protein, 232 aa, Homo sapiens
MFPPTIVCRKRGSRCVHHPLCATGNHDCCGCVSNNGGVSPHPSYRGNDSCREENDHMFLRDLSLLIGGCRPSCCVRVGPSGQLCFAPPGGFNIFWGTPPRCFANYTSVPTAPPRGDLHIVEAGARWPPNMVLCFSLFIVLRALGGHTHRVTPSHTGAHLSARHPSLGHRYPCSVVPTHYTAQHFEPLLFSVSLPTMSPRINSLTHAAHAPLTRERVPPLLRALVWDTYLQRI

SEQ ID NO: 973418 - protein, 176 aa, Homo sapiens
PPTRVEGQEGGRQKRGRHKKEGRERRRGKQTAGPPGGRNRTPEREMCEPHEKPTRGGTTPPCRGSSGPSLALCVQRLSGENSRVRGHSHIRWCPTRGGVWFATPKRRWNEAPHHPLGRVTHREGGGEGHTPPHTHPPRAPPPGGNTTTVYAPPQHTPHTPARDEVWGPTHNPTQPP

SEQ ID NO: 973419 - protein, 358 aa, Homo sapiens
MYSDPFASQSFLTHTLLHINNYRSIYCCLSISTASLHFPGLIHSTVLNLHHHNILTLSHSTSGPVALPALTDHNLLSQAPYDSTNFTLTHIYYKAPSLSYMSSNIHHVYSLTACSMPPQPLNTNDNSVHIPYIRATQLVPFSTPWPFCQIHTYHLHPTNTLSHPTLTTLSAPLHTRLSSIRLDPHSLTTPLVLTLLSSGATQRRCAEPPTTSATPSNQTHPRPNVSRPPPHPHHTNDPPLSPPHSPHRTATHTQDHTTSLATPTTTPHPGATPPTTTRQPDPSTHPLNTSRRRNLQAPNHQATVKHRTAHTRPNTSDNSTDTAYRPSIKAACHKTRRPPFADKQPHLTPTDTTDRTPH

SEQ ID NO: 973420 - protein, 178 aa, Homo sapiens
MYIALLALRTAHTSRCNLSLSLFIRRCFSRLCDSAYIHHSLGGSALHSRYLYREYIYRCSHWAIYRDLIERETPSIRRRCSHARQDWCPQHIWRPRAPSFSPRLSHAERAHNATKGHSVNFLHIFHHLKIPTLHFSLGNWLRHTLGPRPREGPNHEATDRGPCLTLESPTHLHGNSLP

SEQ ID NO: 973421 - protein, 96 aa, Homo sapiens
QICSDVVLPLRSLCASWSVGCVVGARRAEQLRRLSRGLSLGCWIALGSASELCGLEVCLWALCLRVCVSCSGRAVLASPRFASFVLLRPRLLCSWR

SEQ ID NO: 973422 - protein, 172 aa, Homo sapiens
PAWVLALSPLARAVPAPFLCGGCLPLGRPCWERPLGGVPRVSPKVWMLSERGPVFIDRWFVARLVASCANAHSAARSRPRNPPVGCALCCPAAIRVPRRLAHHEIGGRGPPNPPELAHLGPRPRVVTLVVKRKDVARNIVNRPVYDVSHVRTPREPGSPIPPPGAHLGEPPE

SEQ ID NO: 973423 - protein, 63 aa, Homo sapiens
MWFDVVGVPASGQFWHIAVGTIDPVNNHGRFTALDSCTSTQKSCTDIATRHEQMLQKRRLPKV

SEQ ID NO: 973424 - protein, 151 aa, Homo sapiens
PSRKFRGISGRILACTRTVMPFAPRLPRLAETFGSSPETIHVRLEKMEQRGSVTGRVFDVSPNSSYGRSLLSRHYIKEPQDYPSALASWKALMKSLKPITQPPLQHLYKSDVLFDRRSPACTYHKIQTIDEIQSTETLIVLQTQIMRTIKP

SEQ ID NO: 973425 - protein, 481 aa, Homo sapiens
PTLPDLQQQSVFSTQNPGSSETHEIRILFVPHPSCEISFLIFTLRFFGALDEKPYQSNHRWARQTITRTRTDTIGYQWNIADVISLGEICKHSLLCQANSDCSDGKCVLATVLADTCCRRLTRVPLKGTFGRAHSAQCYNDVRTLPGSWLVAGSRTGRRDYAGPKRSCTTNLSLERDTKPQRWTPGRHTDSHELMKTRISQAESIGYGDRRNTKNRPFGSQDTSSLTSGVPSIFEAMRRYARFNTRQVNRYEYEDWIAKKTQGTVDTLHIPSLPNAASGAAKEGTSTHTKRTEDIHGEANPAHDTEGTRTSGPQLPKTADKRAESVPTTQANRTDNDENDTHQQGTRQQQGLHRPPVTRRQTQEGDYSTSPEKPGVASTVRHRSKRRTTNATLPTETTSQTLKREQSSHEPPTQKEERQADTSQQGGAKNLQRSAGTAPNTQTERSHKRDTHETKSVQQRPPNLNTATAGREPRTRQKSSA

SEQ ID NO: 973426 - protein, 227 aa, Homo sapiens
QAARTPQPPRCGPTKGRMLEGCERPWHRYTSQDALGAMHQTKEEGQEPVPTVSPPRRANPVCTPEGAICKEACLPKLLPMAHCLSVQETLARCKDTTPGVSPEDPSSDHARSHTRRVLALNMTVPRCQGWWSKEILSEVLCHHMLCRHPSDQVTTTNSPGLHSNRGKSPQRPVWNSPERPRLTLPKVLELDPNPGACGEPRTAGPGGTDPARRTKRTKTRFPGIFSP

SEQ ID NO: 973427 - protein, 410 aa, Homo sapiens
SQPHCPALGFSTYSCSPGAIAGSPSALRTTMTIPRMILVPCFNHLKHEPHPGATLFVILHHSGCYDWRYMNMNQQLLHACSARPFFCVTTAQYSVTTTRDQAIQVPHIFSTQPNRNLLPDEPLGSASTLVKTALVAVRCNQNLLSLVCTQRGSPVPSEQLATWQLEMGPDGGQNHQMRQHTLRGTATPNNQQPTQPADTPTRYSHTTTRQGNDLSNASLADGHAGALTRHPTVEHLHTKRGRPALHAHPTYPHHNPPGPDTLTQRKQANTSQEPATPTRRHNANAPEPAEHHGTTPRHPATEHTTGPRNTHNTTCRRHTDAPQQPAHGARAPSQHRRGAPRDRTTLHATRPLTRTRNGGADQEDAGSTESMAPRESTGAAPAAPDRPAQRPTRTHPGTPRAAHDEHTSEH

SEQ ID NO: 973428 - protein, 77 aa, Homo sapiens
VPGGPTVLLSTRVDYLFLWLVLVLTPLSVFHHRGACLYTLAPLCIATGGGLVELGAHLRLLLFWVAVGGAPTFFFVD

SEQ ID NO: 973429 - protein, 352 aa, Homo sapiens
MSVSFVCPTKGCPPVFFVNSPPPRSVNIPPECPPPVKMWGGIHPRVFPRRAAPLVGGFPAVGGPPPPPLGVFSRPWWTHHTVPPHVLGPHSPPRKTHPRAFSRAARATARGFPRAPPSQRVWCPRLPRALVAVAPAPITHLLSRGASSLARAHAHDVSHHARAVRTRGRPRRATLSRCTHRRRLTRAGRHTLVLAPRSNMVCCSLLAALCESHPHAFVLAIGREREFRRERYIPREAPPPLYPLLRNSERVSTSFSPHRSPPHSHPPATEETHRSLVAHTPQSLRSERTPSPQVSHTVDHTTHTPRPHHTPPHNSANHAWNPRHNTHRLETHWRNPHLSWPHGSHMERRWNG

SEQ ID NO: 973430 - protein, 113 aa, Homo sapiens
MVWRVDVCWVTVKNAPDGWRRVVVVTNVYPGVVQQFCWVLHCPPEKTWPEMVRALYIVQHTPWARPPPPILRHTFVEVKFCSIPGLKKKIKKTSSIVNSGREEYITVLGGLVV

SEQ ID NO: 973431 - protein, 163 aa, Homo sapiens
MLDVADCWLGCVGATLNGRNLMPAVSARDAVLTVHDETMMCYIYFIVVNASMYGSPIVSWARCLSQNGSATQLDIVLGDLGLLQVVKRSFHKHATHHHRPKVGLRSTRKGRPCVGFRNIRGGTRYSIEGNSFHRLTWPLKCNPRDTSSLCETLYRTPLRHGET

SEQ ID NO: 973432 - protein, 38 aa, Homo sapiens
MPAALTLNYKGNLPEGRNPLLGFLVHIKFYLLNDPWNI

SEQ ID NO: 973433 - protein, 273 aa, Homo sapiens
MEDFPPRFLVGPHTHGGVQRSWDIFGYTSWVLVVGGPPVRGPLSPRKCFVGAPEERDTTWRYYRKGVVGPQKEMGAVCQQKYSRGGTRGISTHHPCPNTGEWSSRKVSAHKDSGVCSPCCLGGRYTQGVFPQHRAHCLRGCPFCENGAPPEGTPGGPQRVSHTWGATDLSQSLHLRALLRVARAPRGAILDLRALARTGASRFSRFLLCAAQKISTISQRKMGLLTPRVLMLDEFEEHMVAVISGAIPRWPLGSKYHLPTPWPFGQMAGPCTP

SEQ ID NO: 973434 - protein, 376 aa, Homo sapiens
MESGNTLADCSSNLALMAPTTSHRFTHECAHKVCMGHLSSLQHLSVEPISSFRPGNTNVTTASASASYRFSKSSHSNALHVHILQTHAMETSRWRRYEFLPGRVLRPLSSLGHHDLPNILHHVLRTSTQWEHFTSWRPNSPGHTLRETPVWTATVTHIGLEEKALRSLLMNLVHALTQRLTLTYPKTHRRTFKSRAWAPQAFTQNAGESANSTPESAPREQATPERHGAPRTRHGRTGTNQRDRRDESTRANASRHAPAAIKPQGEQTQGTTRAAQGRAIRSLPRTVRTIATWTATNIRSRSTKRQRTEERHRLAKRSGAPAAHNQREDKKREEQERKGGTDGKAWPSTEQRARTTGQPSPLSDVTEPSKDSREDA

SEQ ID NO: 973435 - protein, 211 aa, Homo sapiens
MMFNTLGGCPSPTREGEEGIGRQTRGCPHTTRRGVFWDSRLNTQRLSPLVGVKCVLVLTDRSLRCFLHIAKGDPLASLTRLDGGMPNVFLLVCASASWVASRLVVPRLPLKKGVFCSWVENGSPPLATRLSTIHRLHLWVILYPTANLVCVFLPTGHIVCPGGGLLRRLPTRHAHRVAGLSPSPNRRSQHPFCGGIVRLYAHCVVVFSWVI

SEQ ID NO: 973436 - protein, 245 aa, Homo sapiens
MGNLQDFITSTCNRCSHSWSLKLGVPMNNIKVENWFNKMPIYTGQRYKAKKLTLHSLTCTRTKALHTQTHTRGKKGDPTTDSKDTAHTIQRTRQHTPQTNPVPGKNTLPRANGPNSHKRPTRTERHKATHTNEGKQPDKTEAKRQNTQRNERGHQRKSTHETRKQGRNATRQNREGQRPRQTWETKANPKEEAQNSEAKKRKKDKSSEREQREKKTSTNPKTSTRDERRAKQKRHRSHHRDPRIP

SEQ ID NO: 973437 - protein, 189 aa, Homo sapiens
WNHVLFILVTSAAERGVSPRCNRAGHMETRRSWCALPVRVRQAGGQHPCLERNIIASHCHPQTRCVNASGLARCLKLLVHRSTHHRFLFELVVAMNRSRAARVCIECEALEVVGCESIHTHTDRQHRGGLHRTQDIPTLHRPSTRRSREVWHKHIFCGLEETRPCGSYYDPMTAAMPSRVTLVTPIRRY

SEQ ID NO: 973438 - protein, 136 aa, Homo sapiens
MLALQLHGYRYYEPKTCGFDFTGAVDGYFQQYQSECSSLHAWGHHSTGVDPGSGRGALHRGVERDSCVFAASRFAGDGTDLGGPTAALLAAHCELGFLGEANVEEPADEVLRVFPMGVNPKQCGVKRLCPVSFSFS

SEQ ID NO: 973439 - protein, 102 aa, Homo sapiens
MCVYVPLRLCVIYTPRCRYRGKMAIYYWLCYAKVETVEIFPGPEGERCLDAQMRHQIGVIRQVIHQPLKKLIVVFAKRNFIMIYPSPRVLMFPTCIIKGIIV

SEQ ID NO: 973440 - protein, 153 aa, Homo sapiens
MCPIERSAYEETSDSPREERGGDQYTKESKLQQRSSGSHKVPHHLGARVCAPKENYKNHHCENTPTIHDAEKPINAARHIKSDKVEHEPTVDTQREQQETDREDGQTRIHTRATEREATQQNNWTDEKQTNHTDENKTNATYNHPHNDANHTT

SEQ ID NO: 973441 - protein, 254 aa, Homo sapiens
MQCTLDGGACSENAERVSGVCSLAIIMARRVDSFPLRGFRIMPGKRIIPRYKWWRDSTTTVHTVLGVRSTLHSDLWYHVTRVFVLIANRKYMLYAGASIASTDTLFRQREFCCCKIVAWPSSRHTTGCGTVHGRLNELPPMRNVMSGTAMGASDRIETVGAPHRAIVRRSASCANFERGALLSPSRAQTTLSYTTKIALARSPLSLARSAALGTIVLWRLRLSRLMGAWASSMRIFRTGRGLLACLLRITPCSL

SEQ ID NO: 973442 - protein, 350 aa, Homo sapiens
APPSPDVLQAATHRVVDAQAPFPVPLHIQLPQQEEGQEEEGVQGRTDWTRSGDALCIQWTVSSSVMRHHQCGEELPQGGMRVQWPRCRACPPCDRSSSRERANEEEKPMDKSREHMAGPLVATDRRTVPVAVRGALASSSYEHYESRKTNDPDDQGAEHTGKGDEHNKKTARATAQTEHKPITSEPPATSGPKQKRREQRMNPKTDRNETHTATKNTTPGTASTSEHSTPVTTGPTTRPHTPQRTGRENRRNKQTQTRAHKPENQPTSRDARRQSDRPGTGRQSQEKEAAPETRERTTEKREGEQRKADIHPGTNGEKEASNGRTADEGTRAGQRRKQGNDETARVGRWY

SEQ ID NO: 973443 - protein, 203 aa, Homo sapiens
MEDTKRGTRREGLYIEETHHTANRERNMRRPTPAQDKPTQGKNITRSEPRTPRGEKQTEGTEGQQRKKRNRQGTNRSWTHTGATKAITQARPNNEGRATNHNTERPEKEHTDNTTPDTNSRNSGPGTTGDEAANRETGATPHTVEETEAGETRRRKQREKKKNAQRTTTTKTAHQLSKEAKRTPRIHHTTTKNNIKQPSNERN

SEQ ID NO: 973444 - protein, 222 aa, Homo sapiens
HGFCAICEDGLWPKGCSARRALSCELQQKLLGSSRTAKSLWLQSCVCTDRFNQDRFVMVFERKGEIALWFFMSTLRYRRLMSVNSLLISLSGNEICTVIGIVHTSSPLATPRQGSSSNIKLLVSLSFCPKHNQAQTQNETQEERETRGRPCYPWGVSARHSERRSLKRTGRTSVHAKTSSSPGREPPYRLVSDATGLELYLRTGGLRTVLRGLRKYQPFVTI

SEQ ID NO: 973445 - protein, 88 aa, Homo sapiens
GAEPADWYCHVYELDKNLNPIKPSKFLGDEETVRKADVSCGCPGKAKKEGRRGGYCPQEHASLPVLSRLRPPDRAHVDTDHICRHLEL

SEQ ID NO: 973446 - protein, 241 aa, Homo sapiens
MSFPFSAYFFLAGPPPKTLLLSSRDWGAQRVSHIISPAPRCCWGDVVYTRAVRLFPPPLCCPSSRDPQGVRSGGAIKRVSPHGGAPLTRGERGTHGVSSLVVNSARAGEIGFTERLSSAPHPARDSLWRETQVCGVFAYLCVHSVFPHKCHQSVSKESPTHTGDHETLFSVYEREYSRSPVGPRPPPRVCPVETPGTHSLHLGSSKDHSWYTRCNPTGFNFDPCLDQQGQTPYINPDIIQY

SEQ ID NO: 973447 - protein, 68 aa, Homo sapiens
LAGDRTRRYRTRWRDNKSGMAWYTEDGLCSLQFIALDGRGYAIIVLLGDKTIPGVSRFQVIKDKLMLR

SEQ ID NO: 973448 - protein, 240 aa, Homo sapiens
ASSMLSHSVVYGVFSPSLVNRGCAHICGKVLFLVGESPPGLFLFVGLLGGVCERPLLAPRGMLIFGGPPRQVVAHQPWWVRGCPVCATVGARRLSFCRERIVGAWWLFRGPARWPHYGGLANEGFVLWGLVPPVYDGAPPPEGPPPVLPQLVCPPRPRGRPLSLSPTWGSPPRGDSRRFSFRVHTPSGDHQEPPEPPRFAGTHPPQMVTPQMRHAHSAPPCVAPQRCFPTVCGHTPQGAR

SEQ ID NO: 973449 - protein, 68 aa, Homo sapiens
MDGSATTPAPISCPQKSNAQDGGTRTQEETRAAQTSQKEQPLNNGEEVTRATTGPMSEHKRSGTTYER

SEQ ID NO: 973450 - protein, 148 aa, Homo sapiens
MIGLPMWWILIGIGAIIINAEEGGYQLMIGATLKVVRHKIGGAHQHLRGQQRALHMQHHLRRRTTQAAHRLSHTSVFCTNFTRGCCSSQRHTTPHSAERNHWGDLSTQRALYEETQHTLGALIDTRAYTQCGAHHTAALSPALSSSVE

SEQ ID NO: 973451 - protein, 154 aa, Homo sapiens
MRQVTRAIGQTYALRNSTPNVTPKWGIITEPILVPDGMDQLEPYVSLDPGHICQKSRARTHACHPVLLTTELSSGVYIHRALSGWRGNLGFMARFKASPKPSMEKAGTPSRFELIAPTERCPTAWGTVPAQFLHPRGNRPKGFIPNGLVRLEGP

SEQ ID NO: 973452 - protein, 246 aa, Homo sapiens
MAWDPTLGFSPPPNREGSQRYALATPRRPPPQICREPHHSALPATIHTRVLPAKFGLSPHLLALFTQVFWHLLTRCLTALFSAPAVLGCLFCVCERDSLVLTQRYTQTDSSGVCSHVFDGLTHSHHSRPLALESAPLRASLPWRHTHTECVTTPVHVTLSTERVPSLCITSVNTEVEAREWKGYEPRRSLSTEVHTFDKNNRPVPPRRMVIHSTRNALWFVGVFWYEKEEGLRGEDTATERRISRV

SEQ ID NO: 973453 - protein, 217 aa, Homo sapiens
RLLAQKRTQRKESTSDHDEEGLQLNAVHTAPPPTRTQIAGRRSSDFSPTGGGPPAPTRAPRPWTRFPAPPRRRWYTGFSFHATGSRLPGVSPRRAPFVPLADARTKQDVPFPDFLAFLERLNTIVWRLDLAFPRQPSLVGQRGPQTAVPGACSTLWAPPPPGILELSGRAGWDTFSVRQSFCQRGLTGPAEAAFSRLEPRKARAPKGGTRLAGPPGL

SEQ ID NO: 973454 - protein, 119 aa, Homo sapiens
FFFLVQATKTTRVRRHESREYEALTWWWVHSHTQLARDSQCRCMSPLPSLFLQSSFLVSVLPFSSFARQDVRHPGQILVISGEPTGLCPRPVAPRGMTLVFQARVSVSKRFPVYHVCRV

SEQ ID NO: 973455 - protein, 275 aa, Homo sapiens
MFFVVYVVFLFCLSVIVLFVFIWRRPNRRRARAADADGGKQRGGDDSQTEEGDARSGLCSLVRRHSVSLDSLSVESSTSFLSLVALFTHMCEAAILAPSSSVWRRTRPVWGVVVPPTAPAGPPTPRYLRRHLTIAVCSPATLGEDALFLVLWVCTTHPDSLGAHSRQLWRPHHEVGFFKIRPTPTQGTTFSWAPLQPPRPFSPIVPTRGPRSPMRPPGAWRLFVPPLGPRPNPVWDRQITKPARPLLPQSSHLVQQGPRGPQEVAHKRRPDPPFS

SEQ ID NO: 973456 - protein, 104 aa, Homo sapiens
GPPAPAPDSPLFALPEGPSVTEARAQQPLAFKDTGKTPRLEPRGGQFTRIRITPYQPPTLNPLEKVCADLIRGPKEKGISQVKGPVRMPTQTLRITYPEKTPLW

SEQ ID NO: 973457 - protein, 224 aa, Homo sapiens
MWLSVCADSPSEGLFCRSILCVHPGGNSLLRGWAHHSVWCSYIPPLCVRAVSLSLFTIPCCVTGPCVCAVCVWLVVTPLQCGRCVCPVWCVHPLSSRVVRTVVPLLSLLPPCGEHAVCFVAAHVRGGVACVSPTACGRWGGGRTHRKHQRWCVLWSATVLCALVCRRVLVVVCCLSLFFSPREREKRSPLTAPARHTVVRWEPPAALPVVCPPTQNYYPWAPPP

SEQ ID NO: 973458 - protein, 147 aa, Homo sapiens
MVHGRDPLYNVCESLLRLTSHPGPGPQTATQLLKLAPQYRPETKPEKNRDCWPGPRRRLLAKGTSPRRDPRVLRAGVNTVTPLVENPESSAGGDCTRRGSHSKLVVFLPALCRKMGVPYCIIRERPDWDVLVHHRRDLHPPVAFTPR

SEQ ID NO: 973459 - protein, 305 aa, Homo sapiens
MRGTEEEEAINYHRGYSRVSAEFSVSARWVCAPVRPESFQKVSWPDPSIARGLQNRFSTRDPISGPLLSRIVGSLFRNWSTHEMVNDVHSALARAVLRFSCPTIALPMLLQAPALSQEYRVPVLASETVLNLAFAPAHSWNPRTGLKSSPPGPEPLLADGAILDQGRAHVFSGPVPRWLQPASYDPAEDSQKLWRLPSRTSMKPRTILPRLTAKSASGTSFTSRPRLYPYPGEDPGEEPGVRLALPASCIRSCPLMGYPLINPSLERTSLLGCCAEYKILDLFMSPLSPINDVFVTPYLVHKPPS

SEQ ID NO: 973460 - protein, 230 aa, Homo sapiens
MSGNASRKPGREPSPRRNILGAHCPPQIAPPHPPRPFGEVPEIPCPEVDLGIFPWGSEFVLVNQDHSMLSTKHLINELVRTQSPGEELHSCSIDSTPVPTQWYRGPPNGCPLGPQEREPQAELLRERKKSFKPKTSLKKFTRENMSEKGKECPKQHVSWREPRSTARASFLRAHRFQGRDHVWPRAQMAIVLEGQEIGVLFFREIQAPQGQINTLFCLHPSNKGVYCFVP

SEQ ID NO: 973461 - protein, 245 aa, Homo sapiens
VSCLFCSSFCAFFFFCFLFFSVNSLFSFFRSTSFLPSSFSFLLVLVLASLALLPFSPLSCCVVCVGLVREEERGKKHEDPGRTPPAGLRPHTGFLPRHMATPAFRLPHVAPPGSRRGLENSSSTSLSGGTTTQTGPSPHPERYGSEAAPAGPWSGANISGDPRLTTILDKVICPRFRRLGPPGAVPDPRPENVRCPPRRATISARACAHRASRKWLHHHPSFHISGHFAWALAYHRELGFIDALE

SEQ ID NO: 973462 - protein, 192 aa, Homo sapiens
MKRQYSHEDTHLCGPALNFWEHFDKDGLVPWWYIKSISPSLEDSTLRPFHEPANLNPPGIVPNRLDQTEEDALLPSVYPFWDPTNSQRPIFGDLGLLEARELAFPAEIPDCARWTYEIYNTLAGNMDPGQRGDTQNAGSRVHFPWEGAFPDKMGQNLPSGPDFQVNNLLPSPSCLHLPFQGDGGPLKETEPL

SEQ ID NO: 973463 - protein, 228 aa, Homo sapiens
PPPGDERSIVERRRAPLTGFVSHARRPIRACAHPPVCLVLYCRLLFSQEHHVGIPLIAETPRSNRGAFFLGETLVGKCSSVSPGFIAFGLSFLGNLRGRNVRHNEPPGPRLWGPALQAFRDPTRGTTGSEARLLSTGLRDQTPRNPDGSPRHPCETPLADTCCFGNVLSLPCLRILHSLPPRPTSGTLCSWGQGTALPWLSTPTRVLPAPFSYMPPHACSHPLHMLWF

SEQ ID NO: 973464 - protein, 113 aa, Homo sapiens
SVLFFFSCVFVFRLSLMCLLLRVACLPPRVFVCSSVAACVDRSLCSRRCRCLVFLALSSYAPRFVLCCSALSVGGAVALLIGVSSFCSCGLSYCLVLSVSCRSGVESVLSRSF

SEQ ID NO: 973465 - protein, 77 aa, Homo sapiens
LLPLLSCSPSEGFYRPRRHVLKGVPSPQKKKIRTSAPLSGGRRQLRLRRQPQYPRRERSPEKQQLDPYAIIKFLADP

SEQ ID NO: 973466 - protein, 124 aa, Homo sapiens
MPLHFLPPARSCALPPLRPYARPRELARPRTYKGSGEGESETCEEPHTRKGRRLTTKNTYHDRRVLCHHPGPTPQRRPRLGLGPATEFPHLEADLVVDVVHPPSRYKLERIFLPLEYTFYHAPK

SEQ ID NO: 973467 - protein, 96 aa, Homo sapiens
MCRIEATIIATLIEPEIASPENTCEGEMIQRKENEAPRERGTLGSNIKRRPTPCVPPEKTYFVRTHGKEPETAGTSSLWIHGIIRCLKKKLRTFWA

SEQ ID NO: 973468 - protein, 358 aa, Homo sapiens
MRTIRKCNIDEVQTSCTTCTLIFVRSGVINTGCNTLSRLFLSQRPLVVVAPVTPMGWRSPPRVFWCAPPAKLGGLFRSMFLQNRGLWGPPPPQGVSSRDSLSWCIYPAAVLFYFSPRGAYLSRRHQVVGCFRPLEAPTVAKIGQKGVSPLGAHPHTACGGTKIGGGVLVGEKTPSVGDPVATKCVSRVHIEGIIDPPVVYFPPPLGVPTISNPVVMILASLALPPQEVVLFFLPHPEDGGVCGVCGVCGRVGPCVATPSVVVIERCGGRADTTHKRRSHKEENLLAHRGARVWGHKKDSSGENIILWGGGRRHTTTTLRHSSPPIPHRRRALLVAPPMGVFCVSPPTVDSFPGTPTCS

SEQ ID NO: 973469 - protein, 105 aa, Homo sapiens
MRLRRLLTCWLPWGPTPPPSAQDHPEDFGPRWVIEADDDRLHQVIQGAEWENTIEDSPLPRVLAKLAQCTLHGGAVSPSSCCPQALASPLLLVLAPCCQPEEKKR

SEQ ID NO: 973470 - protein, 217 aa, Homo sapiens
RALATHAPTPEWHGLERHFPPRTGTARGHVVQPAGPLDPQTLAPHPGARIAPRPARVPSGPSCAAPRFGTPRRCAPAPASRLEGSSGWPAITRRWPGPSAYSVDTEEAGPSPRSPCQTHVQRLKEYRSQTSILFPRKPSGPPEGRPVLAEELKLAQPQLTGPGHARPGRPIRRRKLESSTEEEKNFQAFASLRMARAHARLFGIRAKRAQESPQTGC

SEQ ID NO: 973471 - protein, 165 aa, Homo sapiens
MTRRSVSGHQGGPTAHQVQSSAGPGHLPEPQPRPTHLLQLFPRPPPLKVIDLRVSNIRPVFRAHGFQMWLLTGPKTVFSPDRKLCHWPAPVMGPLNIWECGHPGELETTTTTGPPLAAVNAAGLVLTPAEPPLVSAGHPGPRKGCALAPRATDLACLGSELLPEA

SEQ ID NO: 973472 - protein, 107 aa, Homo sapiens
LQPAKPREGDWRWRWPPETGWLATEGSRSPHGAEKELSGGERRGHETEAPAEALWRLSPRLSRNAHTVRPRSTYPPGLFPDLHHFLTGFPPSSHSTSQVKTWPLKGQ

SEQ ID NO: 973473 - protein, 247 aa, Homo sapiens
RCSVTRWSLTSSGAPGVFPDVASRLCCLCSPQHNPTSRVGHPVGFLRPLLLCCLEALCGLFGRLRQRLDPLRLLVHTCWVVPPPLLPPCLPTSLVVNITFSTNGVGFLWLLPLWLLSTVTHTVVCVSRHLLCTFVVKCPHPPPLCSYLPSLGHSLSPLVSHILPLGGARVPPLVSMAEMSSTGADPSSPLEKCGKSERYTEVFHQSPVFSKRSALTPYIPFSQFCALCLQGSIPSITTPSLWVLWGE

SEQ ID NO: 973474 - protein, 101 aa, Homo sapiens
RPTPREMHETNARARFGGARNVPRRMLRYHIASLGAQDHRIHSTMKRGRRLNKVTTGTVYMATFKNFNAILRGHIRKEMGESRLDSLLRLAQADGIVSKNF

SEQ ID NO: 973475 - protein, 244 aa, Homo sapiens
LFPARSSFFLLFVFFSSFVFLFFSYCRLAFLSLARFCWHLSLVLLSLFLSHFLCGLSGPSFLVVLLPLFISFLFCFFFFVLFFFFIVIFFFIFCFLFCFVLVCFAFFLFYEEERFRNKRREANTRSPVSLRLLLHKFCQRLPEPTTGGVLLPVSPGLFPQVRLSATHLLLLCMVFPRQLMNSGVSDGQIENWGGSTGLIQMGLDRPDLVKLETRVLWMEKFTPGPVGHPSVMSPLHQMEMESPV

SEQ ID NO: 973476 - protein, 98 aa, Homo sapiens
LCVGGGSCCLLGPGLIMHATVSVPPFLLAPGIRRTPLLYPPVSSGLFPLLLSSFHGVLPAVLFFILAFYPAVTDTRWPMYPGALPKAPHTPPVRKGLR

SEQ ID NO: 973477 - protein, 106 aa, Homo sapiens
MPRPPRASPRVMLSGKCEVHAATRGPPPTGKVYMSKWIPGHPERVPRGAPGSTEPDHPPRSPTKLWSHMARKQRPLGKALWQPRLPTHFEAATVGCTPRQATTARG

SEQ ID NO: 973478 - protein, 141 aa, Homo sapiens
PPPRRRYERNRKEKEKETRRDDQRGYVAYTAGSQPQNSQALSPHSGGAPPMAKPAGTPPGAQGVQWGFSPAARKIWGTTKWWRQHQKGAPPHGPNEERCVKGTARPPRCPWSAPVGAPHVVCGMGHPPDGSPQGPPFLQAS

SEQ ID NO: 973479 - protein, 113 aa, Homo sapiens
MTSWAFRGTLEAVSAGRMRRTKDDRVNPGRPDGRTDGRRRRQAQAKAWTNAGPNNTGEDAPPQESRLSRGGETSTTARASESPAQQRHNFENGLPTMHVNEGSLLHTWGDMGV

SEQ ID NO: 973480 - protein, 154 aa, Homo sapiens
MDYCVVGRRLYVIDDMHDVLKEKIIQMWLKGPCADGVSAYIPFMPLGNFRAHMVRFVLWGAIFVVFVLLFFACRPPFPEVGSAHPGFSCCSPLFAPPRNVFSAPFIMFLARHPPLWPKDIFWSRDHRDGGVLRLFFFWFLCVCCWVFFVVLFVA

SEQ ID NO: 973481 - protein, 177 aa, Homo sapiens
MRRVKQRVKEDLLKIPTAIISKEPVEDRVSVLPWRWWKDALDQLRGPVMIVYPLGLPPYDPLRLEFENKEDLSGTPGRAQRPLKRQRRQLWWATQELRRYEEAFQTTWGRMKKPKLSAQIPAKGTGSSQPESLLLASEEPEASCCCTITRRPEELQRLEENDDDAYLNSTLGRITLL

SEQ ID NO: 973482 - protein, 138 aa, Homo sapiens
WCSTPTPDQAWAVRNPLGAWHLAWRLPLPSPPPLCLGALSASAVALRTYSGTPFHGGSLKALFSECLFLLKEACRERGFGLCPPLLGTLGILMSSSQPRLDPSPRGPPRAPSPFPLLSPCHPAFHHPVLLPIVVPPHG

SEQ ID NO: 973483 - protein, 316 aa, Homo sapiens
MSSLVSNSYDRDENIVRYQHVHGSRDDGVPPFTSRSRTAWGHSPGYTPNGGRKHRPFDRRLKGPRRKGGTHFRKSGYEGTPGEGPIYEFGKNARPPDPGTPMASEVSKAVFGKESSGFAEWMNVPFRKFQLITEDVPGKNCLTNFPGMDLYPGPKGFPGPKNGQTMIEAHLDVQTTDGYFFVCFCVGFTKKRPPIQIRKTFFAQHPNTVRPNPEEDDGNHEPAEVQTNELEKKWSINVIPRPAIGKDIEKALPIYLSSSHEVFVRKVKMLKKPQFELGKLMELHGEGRSFGKAPGDETGAKVERADGYEPPGPESV

SEQ ID NO: 973484 - protein, 363 aa, Homo sapiens
LSVSSRCVVFVCTARFFARAWCGCGMSVPSYSYLVGCPRLRRCLLSLEWGGSSVGNLLLPRLGPLCVACSRSTVRLFFFGGPDAHTPPCCCCPGGPLWVVVTAGGSSRSQGGVVLSSRPPGGLLLSSVRPLVVGGFLRGCACFARSSLSLRVGWSHMIYFLPAALCVIIIIVGGAIINYMRVGASSTSGGGPQLVCSDAPQSIGGGDFPSHSHGGCLLLASVFLLGAPSSPHLVLVRLPSRHNIGVSFVLSSGAASSSREEMARCGPSVLSCRNTRGGIIFCREDIVEKYGGGGPLGGAIWAPSHALSLGRIASPSRAIFSREYIAPLSREVEKILCVSLSRESLLWICLEMIYPHTLVEIVV

SEQ ID NO: 973485 - protein, 214 aa, Homo sapiens
GFPVARVPSGDPGSLGGGPCRIFFAAPKGAVCAVVYKGADRATKFPRGNLIPIFRSQQRGNVKWGAKRGKVCGGKPNLKRNREPWRASSPLGDSSTGSIEIFGRNKIHPHRAVYPHVAQGAPSPAGRSPVVTPEKNPPGVGPTKGDERESAHLERAFGAKNVNSADPQRMGVGPAMWVLIEKNFSLEFSTLSLTRGPPLGTLTLARHHTRVVPH

SEQ ID NO: 973486 - protein, 534 aa, Homo sapiens
NGFCRDSFVYEYSIVRACICRRTRSLKVGGALSEPLQVGGLSTTYSPRHTPVCVAPTRLRGDNREYGGVPRRWERLRSSIKRGPIYISPPHTGDAPQERRGVVFVARPVFGPPTGHHQIQLGAVAKPWGPHHGAHGGDPTCNHPGVVKDDPREKCVNLKVVVPQHLPHEAAAQREPTTEKVCVNPPALGVLSSHPGRGPSRDAHGPFDMGSHTAAFLTGGHTASTTSVAPPTGNPLVWRWHSHTPWRATKHFRATDLPWERHTPFVKGSFPPSCAPSGAITIPKGVCTHTNTKTLAPLWVLPGRPLRFRHTPASPQGRSPTMGPRRNTPTRSCVTTLSRASTLPTHTGLAGDSLAAPSPTEGESRLVRSASTSRLETVPHAVRTRPLSLGRDHGPPLFVLSRFTLFSCLSVPFPFHSHHTPRGARLGDEGPASARGRATLSWLPREAWDHSCLFLVGVFYGPPLLRVLGWGKPAAPEAPGLCWEGCEDESPGWRPRRCCSPRALRFFLTCSASLSDGCPPVIDLKDCHKCRVEV

SEQ ID NO: 973487 - protein, 254 aa, Homo sapiens
MVGLVVYVLCMCVDCLWLVVLWLLCALSCAVCCWFCRDACICVCVCWCCVRAPSLLSLLVCFVSPARVPQCYVCPLHSSPRSFVWGVFGQRKPTPHQPRTFFLRGGQPPPPVCVGGILVSAQGGVLLPQHQEVVGRPQDKIRPLTAVFLGCYKPAVPGRSSPCCILDLFTPGGSALIKRGKFPSRRRAPSWGGFVPAEKEFFSGAPPRRAPPPPHYVWSPPGKCAARSRNGSRGPPPKGGYRKGMKRPPPRINK

SEQ ID NO: 973488 - protein, 181 aa, Homo sapiens
MSGVVFCQQPAGDNFGGVVPPPLFASRMVVIYCGAGAPAPPPLYGGGLLRRYYDLPLLLPPPRWMMSVGHTPTFVGGRPLPCSGPPHNGENAFLRGVLFSYKGAAPTQQPTRGGRLPTIGRGRLLTNDFFLPPRSWRKQILVVLEAATGRRPPPHVWPRHNYYNSFLRGESLFSTTGGESL

SEQ ID NO: 973489 - protein, 222 aa, Homo sapiens
PDTHIGYLCGQGDSSIRYFEITSEAPVRHYALPGPFPRSPQRGLGYKPQRGPEVNTVGDLPGSTNCTSGGVSPIAQDQCLESRTLFPEDPVTPPHRRALTLPSRLRNAGGPDLGPSSISLKDGYVPPKSPGAEGPTGAMDHRAPEGQHPRPNGTSPARMPVSRLEEEMPEAPGPGAGAPEALGPAGGDHPGPVEPPRASHRVSPSHPSPHLPFPAPWPRKKS

SEQ ID NO: 973490 - protein, 465 aa, Homo sapiens
VGRKPLVWEGGRGAPPRVVFRISSCPAGAPLCRGGCGWVGQHPHTSAHHLLGLFLLSGGRPPPPGVSAPHTTVVLVEEGAPTCPRRKEGPPAVVFLLATSSNVGARRGPNVGSAQQPQHGVDDHQDVLLFLLGRRPPLLVRRPPPLHLAAAAWSPRPNIGVVARDPPPLWVEGRLRELVPPTWGEEAPPSWVAPLWAFSSCGGCVTAPLWGEEHKRRPYNASPTGFAEDTPSPREWRHASRGDEAQEGPPSAWGAATNSLAPTSLGWARHTGVRPCERLSHTREKCGAAPQEAQDDTGVSPRCVSRDTLTHSTALSHTHTHSALTTEDLKGLSLGTQREMGRSAHTQRERKGENTPLTHTLTETPQAARDTHRLETRCALSTLPTATLGAPLALFCNALNLTLAQALRATSLLSLFRPRTHLPTHRKESPLCFATPTNPLSADTLVPSAPTQTWYPAFRALVPPH

SEQ ID NO: 973491 - protein, 127 aa, Homo sapiens
MRRIEKWATHTRGDTHTCARHAFPRDERVPLSSREGRNERELRFFATRRRKEIIGYRRVSISWKNLWPSVIRVAPLGLPTSHSLSRVAPLSPLASPLLVVYVFFSLSLSLVLKAPVNYKGVQAPIPF

SEQ ID NO: 973492 - protein, 203 aa, Homo sapiens
PRGVHRGDPTLGAPTWHNGSRRPCGVLAPLLRHAVSPRVALTRTSGRAPQPPVAHTRARVDPLAWSRPTPSVHSQRDFARGPHTRCAQTSGASGHTHQTPDGHRAPHRGILSDGPMSALSSAERPFPCPRPPHAHTAERRPELSLLAASSRPWPREGFFCGMGPGHAALSSSRAGPPTSRPPTPRQPGRGREETRPPPRRTQK

SEQ ID NO: 973493 - protein, 107 aa, Homo sapiens
AHSVWCPLYGLWAPLALGSPPLGLGCYTSSGGIYFSWGGAPHGCDYHQSVSVLGQSCVNHPAICLVGPQELFSYNCLFFAHRTLNIVHLSTTGVYIYFILHGSVIRE

SEQ ID NO: 973494 - protein, 269 aa, Homo sapiens
CGVSCVVGGEKYVVVWYVLFVPALLCRPPWVVCRAPARVWFVCGRVRVGGGPRRRLPPPVRCFLYNEVDHYSTVFRWICLSPALCVRWWGYGSALYAGALATVFEYGVFCFCVGGPQLFFLVITAFLLVVSVFCCQPLVFRPSTYWLLVLGRKRQGGVSPCEGSPADPSLGCLLSPPPPQSRRVGCFFVSFCVEGGGGTNKHRRGGWLVASYFWGEGRRIWLSTFPPPPAGGGVAPPPPSCFNLLLVLLMEKRGSSLSHHRLVVGDKHN

SEQ ID NO: 973495 - protein, 140 aa, Homo sapiens
MLYLGKIKELTFRIPMKRQAIKKERRAEAFCPAEPWNSTLPLEKRSGYRHCPNVEEALYVNTRPQGRQSVYGDKNTFLQEKARFLFDHLIYEGQCALKNWPSTALAATHIAHTTCTANPREGHTHGWGRACLCEVLFLPV

SEQ ID NO: 973496 - protein, 204 aa, Homo sapiens
RRLGLFPPFHAHVGPLSLAPGTFHGVLGGLEELSGEPHFRPHFTRYPRSPSTGVEDPPPLGYLRCLAPREGTSAVFAPLSPTPTGAPTLGESYIYSRVALSTESSRENVALFRLLLLSPKATPRHYPEVEGGVQASLPGMLCSGYSHTHTLGQTEDPSPYLAMRLIRLCPPFALEELNRSGRAPRRLFGLWTPPECVGQGIWAK

SEQ ID NO: 973497 - protein, 136 aa, Homo sapiens
FFLLTCPRFYFAPPPEPPSLIFPPLLFDNDPTTWVPTPSLLFSPPRRGILLRMFYPPPWWRLSVAPAAWPLAPKRVVYTPPKETLFVFFFSGEFSLSEDMAPLFSRPRFFLIPLTRVYIPPLSHMWHTTEFFLSRA

SEQ ID NO: 973498 - protein, 200 aa, Homo sapiens
MIVCPPVGECVWAAPVCSFLPLRCEPTWPPGSTQEVVGVPSSPGEFSSPGREIVCDTPLRCPQRSFFFGGRFNPPLGGAGCLVWRPTQVEPQHVVCSPRGNLLEEAPPRRPPTRKVVCVVFLFLVCVAPPRLCFFGASPSRPQGYWSVQPPVSCASIRCSSPPCLPSVGNPPKAWVPPKGLFGRTPLAGLIYVSTPRLGR

SEQ ID NO: 973499 - protein, 202 aa, Homo sapiens
MLLPPGPPMLVCFLAPHVLVLSPLGSPLSKSLGGGRPTRGGGFGGCRLLSADVVWVPAFWGPPTRCALVWTPAEVYNCPPKGSALRSLSVCFWWNPPLVGPPKYTAGRRFVVGAPQGPPPYWIVVLSVPPLAGLPAWRFPPGDPLCLGGPPTSALVSRVRCTACWPPPTLSGDPQRHHTPPQGERHLSVIDTLGGACYKNWV

SEQ ID NO: 973500 - protein, 100 aa, Homo sapiens
MLAHYTLRQQYHTRLFEESRPPKNTHRVCNTPRSPLLYGNVHDPVTIVTHTGRECRPLLSQTVRFNVLKVTKAAGPQNPVSRNFEAGHRPPPPHEIKLFS

SEQ ID NO: 973501 - protein, 141 aa, Homo sapiens
QAPNFSRPAYSPPVIWIAHPRRPPCAKAQFAEDCIGTRIVSPRSWYKKPGQYGPYNSLRSSLVDSSPLLEYWFPGQPPMCVEELSHDYSTLLGPLVWFRDIEDHDHACRVGVTPKPRGPKKAGWSSAKVTPVCPRKLHEAL

SEQ ID NO: 973502 - protein, 158 aa, Homo sapiens
MYIMTTDLAAHQAALLEEMVLVSLMVEILCSLIRRGGAACSQQRNPSPAVWLMLVGWSSLTARLSFRAQRRACEITVSPTHGLIGKTRTSLCCPPVFDTSEMSVALVGRTGDNHTRLRVAPLYLRCLEEVSGEPGCVATYTPPSVENCDRSTFFKFNM

SEQ ID NO: 973503 - protein, 93 aa, Homo sapiens
PGKSNFAQIRALPRIFPKTIRPTSHEFVFILTTLSHPLWLKPTTRVKSFNPAGKWTTPSTPKGVYRENEAPYVSTPTLELPHPSPLHQQRRDK

SEQ ID NO: 973504 - protein, 233 aa, Homo sapiens
PHHWMLDPWSDGKELPQVVWAEGLRARLRVLFQYRPLEAGLTPDILIPPEGIPRLGPNTVTQVDRDTILVSFERCVRIVNKQGEPTATLAPELTFDFPLETVVACTDRVLAFWSPGMPGRSLDTHEVTPEITDETRIFRVLGPTRDIILESIPPDNPRGAQQPLHPHGPPEHLLRARGPVTGLPAPPHALAAGPFGPRGPLLGHSLPFCSTIPFYSFCPEPAPAHLSWENPGI

SEQ ID NO: 973505 - protein, 166 aa, Homo sapiens
CAPHGSMFTCLRKWETVTPGVSETSSCPGKTPLFRKCPLSSPSCPPAEDVYDSVVDPWGLDDLFSSPGSLMLPALSPRLRDVVCALGLTVGLVGIHYWDPSSINPGIASQCQPDPGGLCLGHLEVMVFLREKIPERNFCFNGFTKLAILPSLTSSEARHLQPFPAL

SEQ ID NO: 973506 - protein, 438 aa, Homo sapiens
LSFLWAFSSPPPPHQRCGRLLYNFVVSPHHGICELWIYIAPVVHNSCLFSATSVVSFFGAYALSLRPPKQVLWAVRIGGAPPPLGFWCLGAPRGGMEDRLRPPVCVSLEVSPFYKHPRAGAFEMCFRSPQQGASHHNQTGSPQLVRPLRVCAGVGVAPPSRQPPLVSLGPLLYHPFWGGVTTGGAPNATNGAAFVLLGGLFSFRPHEEKIWRVSMEVPPVPPPSFLVVKPPRPLRKSFVGYAPRLPPSSAHQSGTTCVGKHNKVGCVVICCWWVVRIFPSFPPHYWFFAEESLERRYCPPVSHPLSRGSLSPVVCASVHSPLAHPQGGTHTRGAQHTTVCSVCVSALCGGPRCVDTHVDPPRGGSETLSVFLTPLRSCLEKLFEVPRPSCCLVGSLLVARCSLALLLRKSSRAGSTKCTTWKLSTPTNCFFTKWRGLP

SEQ ID NO: 973507 - protein, 210 aa, Homo sapiens
MGCVALSPGFLKSHLGKTILGAPNKKSSSLGEGFFLVCSLWGKPLSREGHTERPSINSPLVEFFLELCALGDGVPTTPRGAPPRLYYTITNTPVEHTLRALWAAPHTLGCVAPHRTHTAGFGVLGATYQGVKNHMLPRGRPNTLSIKRLGPPYKRGPLASRPHAEATVENPTRMRILAHPPPTSSRDHERVWKPRAALPLPHSHSLHTTH

SEQ ID NO: 973508 - protein, 255 aa, Homo sapiens
PHLGGPPHLSFLLWGPHCRPIQYFSLGDPPFVIKGPRLGAPPVWVKPLPRELLPRFGPPCEGISPLSRPALSTMGPAAPICATAHSGEIGFPRGVLETHNFEREKEIMPPLVRAPPAVVFDQAPFLLLLWGGPPHPHLEHGAHLFLEFWVLSEAHRSLPLSPESTDMRHTWETNEFITHTGRRNLEFLGTAKEEPRTLGFEEYSFSSREGAPSPKWAKPSIRARFSNGHFLPSPSCLHLPFQGDGGPLRELHPLE

SEQ ID NO: 973509 - protein, 320 aa, Homo sapiens
MEAGLSPPTKVRSFKRRIIISGVENYYCWAPTQRCQHDNSAPMVENTQMWDAPRVPHRSTHHGGPTTATSSSWGATCVTHSSQHRKYRQHTCCDTREEGSCARTKGDTSHNAEEFVGVYTHTHTLSDMLSHHIGGTTSLVLSVRRFLAPQLSERLSGGVSLRRLLSENISMCVPREHTLETTRVFSHPRRLSVEYTAYEAHRALNPQDSPRPAHPRYHTGARVGAHFPLVRATVGKIFVFKPHALPSENPPALHTHSPRGDPTLGWVAPSLLSPSLPPGDLGAFVHTQFLSPHLSAYPPPPKELFFLPPHPPINPPRFWE

SEQ ID NO: 973510 - protein, 165 aa, Homo sapiens
MSRAPRPTDRGPPRVKMCVVVFHTTKRPNSRRGRPPPREERDVSLVVGRACFVDPQSFPPRLTLLSLALAHSRLSAPPLFLSPRRAHAATPSSHFYHSCRLSAREFGGARREKKERRALSHLLESYSALSLGEEPAETSPRWRHTARPLSSLYSTPLLSLAATLS

SEQ ID NO: 973511 - protein, 107 aa, Homo sapiens
MHGAFSPSWWLVSICPLCLVRAASPLSPLRAPLRVFSSALLLVGALFLPLWGPRGGHKVPPLEIRFSRGYSPLWGDKEVILKMESNRVRNKNHSGVLRVSILGDFPH

SEQ ID NO: 973512 - protein, 141 aa, Homo sapiens
MEITHPRGCVHTSATKKENGLNAETVHGEEIHKATLFINGEEPQARPAPHMLENTPRLKGKGLRWLELNTAPRGGPTLTGCHAFFTCTFIFPRRELTRSKEGHREKALPPELQVEGHPSTPAREEAEVAKKTWANLFKPKN

SEQ ID NO: 973513 - protein, 211 aa, Homo sapiens
MTHVEGAVVCVWGREGSARPLNRGVTRAPTTPVVGWLKPLRAPHSVCPSGGEPVLYHTGAHTQRGRHTSYPHALLSRALLKEGPPPVGRAPLCVVSFPTPRVLRLHALLILLWGENVERFFCVPNIRYTHMGPIYGTHIYVRLFDTHMRIPHTAHTCGRHTQKGTQLWWCPAGDTRWVCLREVWAPVGDSSRHTLRVCGRHTVGEGPRGHT

SEQ ID NO: 973514 - protein, 407 aa, Homo sapiens
MSSFACFIIYLPSRGENYMLVRPCFWVVFCHHTTKCGWSSLLLLLDVIFLYGGIHKRFGWWGRPQNKRGVPPRTSLLGHNTSDDVGATTQIGPALPPRSGGGVLHTCEGAAADTPTQGKNNSIGVVLTEGAPPAECSVTSLCLLFLQQSLFFKGDSPPPTFMMISSSPEGGAPTKMCGKYSLVRVWIVRPQLCVPEETLGRTHKKSGGTPPIRGSAHTRVCGTQWCSHTRFVSPLFFLASGGCVSNSHHTEVFCDQQHGDRRSVSHTPPEKCLLDNSHTEREIFSAICPRVPLERVVPAHSVCATVCVSVYSTECVAYTHTLCVRTSQERSTLLIHSQPGEHTTRFPWPLFSLENPGGKPSSQLLCRKGSKASFWGKNHTLASCGCCPSWLLPHHQAASCCLLQAPR

SEQ ID NO: 973515 - protein, 209 aa, Homo sapiens
MRCALCVARDGRALHRGPRTAVDIHSGHGECRLSVDSPRGRTTAHTRVSVSVLHTHTRLRARCETAARTRARARGRCRAQRAAHSTALCGGRGQRHARRVYSCAHTQHTHHTDARARRARAPVCALVSPPHTTRKPPHARGSHTTARGASARGSVTGVGGPTTNTHSHRSSRRPHHRRDKRWGGGGARTPPPGGPPPVCGGRCVCVSPH

SEQ ID NO: 973516 - protein, 101 aa, Homo sapiens
MCAEIVKRIAPLAHERYIYREMYITPKYPGPLLHPRPRGWRGKSPETTYGVQNKKHVPSTLSQEPTPDCQKHATGDRGSHPSPPDQDNLGWPNGAPERPGS

SEQ ID NO: 973517 - protein, 76 aa, Homo sapiens
VSARLCFHAVCCAGYLDAFFFGGCAICSCRLPLFVVRLSLRLVVKKVVFSPPGCLSLVGVLYDKAPRPPAWRLYRA

SEQ ID NO: 973518 - protein, 128 aa, Homo sapiens
CLGACYFVRVYVLARPVVSLIFAHWGSQHTHILSDFPSRVHRGGGPRAAPLLWPSGCWGNPAPRVFLLGRFFRATWIHSPGDPGGFSGAPVVIAGGHPRGPTEEPPPGGAVFPVKGQITPGEGLNGKL

SEQ ID NO: 973519 - protein, 130 aa, Homo sapiens
MGTSNLCTPPSKSGFEYFPQRGNSSHFLRFLLEGVVPTMLPTVVLFSHRVGLTHTLVCNPRNPHLLITSNGYPNESWPLSVEDRITPPTLAEKKVQGLFLAKSTLASCGCCPRGCCHTTTLLLLLLHAPR

SEQ ID NO: 973520 - protein, 125 aa, Homo sapiens
CGGRTTPHVLGCDRIRKEDSGLLIGRTDQCVLFTAQEGRVLLQQKVIEHRTSKVVGVVAATAQRVARLLVWPPPSRHHRCFTGRALSVYLWVRGKKSSGRKIPRGLVEEKKEMWAATHTGCSVEC

SEQ ID NO: 973521 - protein, 246 aa, Homo sapiens
CSQQTRRYVSSQTQSRSGRVRSASSSAQSTRCLRPRLLLSESACCGACMLPCRVFITRTLGDVFCPSSVWSWADIASVSCGGQHKGWGVAPSPPLGVCCCVWPPPPGDRYSILGGHILVRAPHMLLQPAPVLRRPLQCCPRSVGVDYNLCPVARCVTVVVLAVCCEEQVLFTRLCERRPTGYLMDCDHQEYWWAFFVAPFSRGPKCIYRFPPGGAHSTPRGGPKNPPFVRIVWAEPQKPPYKPGLG

SEQ ID NO: 973522 - protein, 128 aa, Homo sapiens
MSHPPVWGVPLLVWFPLELFERPTTHSFDRVGWVQSPQRHSGDPTEKGWPRESLWPKGCHTHKCLGPPRNKVPREGYKMEIILVPLILTLAHPPPCLNVTVWLERDRVSSKRTRVCCSQLAPHLNRFM

SEQ ID NO: 973523 - protein, 134 aa, Homo sapiens
MEGNTLWFCVSVFSVLFVVCYSINKPPPAHLLRYISREEPFFICALWRAPPQRSPPNISPEKRRDVCVKNYRSPEERCHRAQNELVKERWVSIKWRFHRRTHIVEKNTIGKGCSTLFLFLFFHMRGFLVETRLK

SEQ ID NO: 973524 - protein, 249 aa, Homo sapiens
AGYCVDRPPQVVLLTIFYCVSRGPPRLFLCGPVSTHGGWLRSPRRAPSLLVGPPIVAGVGARGYPPSQRALCSEGSFMVRPPPLSGRETNISGEPSLSVYTHNTNICFFKNILYPNARLWAPAPHTRGALTRALRVEILLMAHSLGERTTAACAAGSFTRSVSHSESVSRDPTLSRGSNTHARRNTHAVCLVVSDNSVTHKLVWAAAPLCVWTARPSPLACLRAISLAERVSRGHRENNRACVHLAERV

SEQ ID NO: 973525 - protein, 171 aa, Homo sapiens
MSSTVGWTVCCSPLLWGVFSGSSELFRGVLFLCPAPPQCLHRVVAEVACLLQHPTHPLGARAIVPFHWGAHLVLLFWDHLALPGPFDLCVFSLSLFAVALFARAVGPRVCVRRPFHTRFVFGRFFARGRPPTKGGGRSGHGGFPTSRDTLWVAPDTPADRYQRCPTVGRTP

SEQ ID NO: 973526 - protein, 241 aa, Homo sapiens
MSSVGRFSHMDATALCVEHHACAIPGPFPGVLGSFFSFHGAPGCAPPPGGLSAFGRPPLLGSPHIGGAPGSHLSRDSLPPRPLLSPPHGVFRVEHRNPREGPPQEMVNTSPRSFASHFAPLGGLAPPLGPHSRKTTVSCTARGDNREFWLNGVLQNRLGKYLSHPLIHEYHRTPWCTPVSTLAARVSFHQRGESRGGVFFHPSSFLPLFHHTTLPSATLFPKGGASGNTSATYILDPTPVL

SEQ ID NO: 973527 - protein, 333 aa, Homo sapiens
VVCFRGPHFGLYVRPPARFLLPAHTAFGVSLGEDIWDSTAPRSDLEPSRYSTGVTGHGALGGWLCRPPLFAVRPLEATLGPTLAAGPTGRDIPPLWGHEDFFLFTRWGPPELINPSWSLTRLCFSLQAGEVMWVLFNGARSCLVPPCVVPLSHTAPEVNCATGVRTHPHLLTLPRGEPLVGETPTPRVFTTLEGTGPLLEKPPGNPRVVSTTHGGYTPRATGKHTAPGPIALSPRPRYKHTPLPQSRASPRITPPCHKPCLAHTTHGFTRCTVHRKGPEKEALYSVALTDLTKPFWATWSTFPGTHVTEATAGEPCGMSPQKPLACPHVEKGI

SEQ ID NO: 973528 - protein, 113 aa, Homo sapiens
GECAAVSLASLRCCISPSESNQDRGVRDPLTLVGDSAGGWHQTAASFFEPRRAPLIFSPRFNWCSAAAFVGEQLFCGQPGAEGTAAPHQRPVRLARKRTTARFLFLANRAALQ

SEQ ID NO: 973529 - protein, 139 aa, Homo sapiens
EGSPAEAPQEFSLPRTHLRAHTRHTNRSAEKPQTHREGGMHFRRACVGRVNLVERRAHSLSLCVFSPLPLLVSSLALISTEKEILRTPPQRGEAQHPQRVASALRSTDHAHFGRNLALFLSQGSAWRAQLLCTAPQPGD

SEQ ID NO: 973530 - protein, 321 aa, Homo sapiens
MGGSTVGIIVVRLVGGKAPHIIWASPSLVRTARFSISRCMKRRGCITSGEDHRWVKRENPPGCWLCCWGACGELCGVPTHQRHHGDFFFLEGAPTHEGSLGPKQMVGRRMAPTRRQEDGPAGFVWMDDKRFSFGDYERRSYNRHDEGCNATGVFVLVGGGAASCATGGSLQEGAALSLRPTLLCAARPPVWSSLTVVATVERGPPAGCALRGRVFVWGHTALGETQRAHTRNRVSGRHTRNREDTHWGTDTKRPLGGAPTLCVRALSGCHTHRGALERCPHARSGGHTKGREPQMSPLCLSRHSHARHSLSTTHQRVSTRT

SEQ ID NO: 973531 - protein, 151 aa, Homo sapiens
RTPFGPMRPTLRVLALCFLPFRRSTLDLHRDGEGPKLRTLSFVGDPDLAGDRTFQKWATWWCLLEKSRDTHAMYSMRGCRSPFYPENGSRLFPVPPSPHRGPLFAWPGCLQPDCGLSETVVAAVIVLERKKLQVAPNRAEEAIYLQRCVSA

SEQ ID NO: 973532 - protein, 117 aa, Homo sapiens
GGRIICWCDINIIDVCSLTVVRRQLTRTQKYEPTSGGLYDDFVSHSTPVWLCDDLCLVHQRVGSSPKSIVGGPQSIIVRFRSRHPLRQWVGFCNNPNSMGGRRRISLCFILNSALQI

SEQ ID NO: 973533 - protein, 118 aa, Homo sapiens
MNGEVLHTTYGCCCGHRTDKYNPTGGFCWSMKKTWNLGARHRGVLPLFYSPRSSLLIRGLITWKSALIYVVIAPLKNFSGTPEWGEPPLGNDPLNERNVCELPPYIETTLPGSLSPHL

SEQ ID NO: 973534 - protein, 225 aa, Homo sapiens
MGWRPTHEGFPYEPLSCIRGRRPGGGPHFWRVLGAHNRNFWGGRLNMCERPSPTPGPPTFQRGLAPPLPPHVICAYRATPCSCPTSLSARCAVFPSRESPIRGHHTVRHCSHLALIESLYCHDSVWVFSGESVVVDTAGPLRQRVTRASVWATNSALGGAPPQETHTPRESPPPSVDSPTHHRHSCLSGAPRERDLRGTQRFVVYYSAWATHSGSRELSRAVCWV

SEQ ID NO: 973535 - protein, 169 aa, Homo sapiens
MEKVSHEPTPRVYTLHEENHKMVHIEWSLHPRGEGRPRCSIDHEKFAEKNYGPQMYPEPPPRNVNFFGKFGIHENSHFGGGTRHNWALAHEFIEISLEINAQEKNENPNTYDSAKNTWPVMKKEKRASQEKHTKRKRTETENEENQQGELHKGHNVGAGQKTEGVKVLP

SEQ ID NO: 973536 - protein, 159 aa, Homo sapiens
WFPPRESCVCFPSTPGGCVEGRAFFSALQRVPPAVLAGYSTVACSCSVPVFVYNQARKAFCWVGSEFLRVLVRGRVCLWDKGLVTIHGGSSFFSYRGGDLSPGAIVLVVMWWVLPPLSGGALRGGAHSVLCVGLFGVVFFRAPGGYISSLGGSSLGRRE

SEQ ID NO: 973537 - protein, 163 aa, Homo sapiens
MVNTRDRLTPLPALVVNHTEFFSSCRFYVGTHLRPSPPKRTHTHTEGDSLTPQMGCLIVGCDNLWASGGGFLPHIAVRAPHCLPCNHTPWGESQVLWISVTFFTQREISWKREIEKERPRLLLGESASAPKGGIFQGEEDMLSRSWRFHMRTPHDLEVRQNMV

SEQ ID NO: 973538 - protein, 150 aa, Homo sapiens
MEKVIHAHSTGPTRRVCHNTHFSPRLCLSRKSLYTHQRPHGLSGTHKDSRLGALSLGRPFTTRHTRECFAGVSTGSFLVSFTEHTHRVEKRHPLVCGETTAGYSLTPPRNGVNFTFTPSTKVRNFSNTCEKGHTEFHHFAGDTQGSPTGA

SEQ ID NO: 973539 - protein, 185 aa, Homo sapiens
MILPYWAPQEFACGCFSQPRRLNRMPLTPVAWTDPPPRCVPPAAVPQKRWCVHAKKREGVAERLRVGVTPRGAPPHRRGIGGNAARVSETTTIISWGGGQHIWVGTEERVAHKCLLLTGAVSYPPEFFQWGSRFSSTGGHILGGPHNTPLVWGRLLNILCRHDTHSGWPHPFGGSLLTRAHVAVC

SEQ ID NO: 973540 - protein, 109 aa, Homo sapiens
MAVGCRPCRRVYEKKGLVKLIVRYARVELACSSHTREPTVWVGEDCCGKRLRLFGAERDIVPRRPDPLFHRLNLVYDSGVLREEFVFTLLVGCLSAGEFGTAFFRLKGF

SEQ ID NO: 973541 - protein, 121 aa, Homo sapiens
MFHMSLSLFPWALRDTPLSGDTHICQRAHFTEGHHRGSRGHRIGHRTPLHIGESPTGAPGTHRHTQGLFTQWRGHTRTGAPWGLESHRFFRVVFTGTADIAHLCCLVLLCVIVCVVFVGVF

SEQ ID NO: 973542 - protein, 98 aa, Homo sapiens
MPQWRHNYISGRKWEMLSPHKRIDRLETAREKREVATQEELYGAIVIDVNARGVSYARIKALIVLAISINKNFLDFIRLQALSGLEGTPLLKHMDFAT

SEQ ID NO: 973543 - protein, 146 aa, Homo sapiens
MLPLVGGKPYFHPGGKFPTGRFSPGASAHYGESLALPISTGGPPRDLVSHKRPLFSLGREICLWLWSPLIGERALWALSESSRESGEVAASGEWGEVREDHLEISYKYPQLFPLLEKFACTELCSLYKREEWKFLSRMRRSHNPHF

SEQ ID NO: 973544 - protein, 118 aa, Homo sapiens
QLRSGDEYTTSYGLLSIVARAAHTRRGWFREYAVALPQTTEGSPECCKKAVSAKGGAVASGLPPQMGSTWSPQGNKGAIRLVFVKEGEVTSPPPSIGDEVPLPRAPAGSTKQSEEGRS

SEQ ID NO: 973545 - protein, 103 aa, Homo sapiens
FKAFGKFETGCAQLFCLLGAPQWWSGCARQAFVSNWQHTPRKQHGVLVKMLNHSWCKPPFSLLSRHHCVPSFAVPTHFWVCCWGCLVFTTAQKLGGAKEVVWS

SEQ ID NO: 973546 - protein, 215 aa, Homo sapiens
SPMLGEKQVRSRTGGGHPPTQKGGGGQETSSKPDVLGVVQRTTRGAQGSPGVGKTCPPQSGGGDTPYSSDLLSLFIYAPPSSPPPGSKGEWFPTKHWPYTIGPRVVSTHNSWAGLNSTTTFGGGASPPRRGVGYRGDTPRCYPFIGDTEAGINKKEPLLKEGGPYNRVEYSTNICSSCGGFSAGYNRVGDVEQRREGFFTPLVRGFSHRESVPTL

SEQ ID NO: 973547 - protein, 233 aa, Homo sapiens
MNTPPACLYNISQRLSEPRQRSGETQSHADSLWRVPRLCTHLVACPSFLFPRATSLVREVLCTQRALIGRGCWRLRPSPPLGLSHRSLSLSHSVCVWLREVGRSCVSHCVPLACTLSTHPLTTLLPAPLGSPLLGATPSLKFERHRRNSLHTPHGFSTENFHRPRTPTESVELGEWVSPHSLLHAQPSSLLHRRGWKFPRVNALPLPQLLGFQEDKGTFPLGTAFNLAILIWF

SEQ ID NO: 973548 - protein, 446 aa, Homo sapiens
MCDFCSRGEDPTHRLGGGPPTSSSDENTTLGGVFFFFWRGPPHLLQGGEFVHPPPGRVVVVKHHKAGGPPPTKGVVLLPSSSWGGGRLTGRVSTNVGSEEILWGACMMRMNDTDAALVGTLPPRIVGGERYTHFSQEEYFSSSTSSSGRERLYIIYESSAREELNLERRVISSRPEKEMRGCSRGVIITAHTHYSSRATRWLFSTTTTPSVCAAAPRWRDTHSHQRESLTQESCLVSQHNRETLLRRHTLHDTLSLLLYSNNLEIISLTHSHCGTPSMVKGGTHKRCSRTFTQRNTQNTHVLHSHIFCSLTHSGRTRASTLSREYCVSSLVVIRWERGPQQCFLNTLAQRFIREHRCRKSYVCISRPPGFVGDHTRDTRCVLRVERPPQRGHTQRAESINTSLGVTQTLSFTVKSILLWLKEETTQDPWGKTLDTQTRRFFGWEEK

SEQ ID NO: 973549 - protein, 210 aa, Homo sapiens
MRVGVFGGSPTPAHHPPEMGWVTNLVGDRPPRPPHWGGEKHTLGRSFPCSPLLCGAPPRVGETRGVSPTQQRVGHHSRRVAPTRVAPPPTLSRTPHTVGNRHTPHWFCVEYLWCAPHCGGLHKECVRRLSHTLYPTPPLPHTLWVCALCVWRDTLCAPHSVTHRERVSVCGHTGWRVTHTLHTLPSLVMRGPRAFLSSGDHTHSVGDPLR

SEQ ID NO: 973550 - protein, 206 aa, Homo sapiens
MWWRRTTVLAHTQCCERNLVRTRRARVYMCGLLFLFVCVFCGVFVFVCVCCGLLRPPTAEIFIKNICGDPRCKKGGHTAHTSRLGEARQLLPSKVSHTHGVPRERDLLRLHHSLGLVFCYNKGPQFSHNNERDAVCLPQEKFPLATSPIIATSHRSSFIREEMCATGLSLLHKFSHTHRGEVNKHTCVSGENIMDNAKIFLNLSRP

SEQ ID NO: 973551 - protein, 393 aa, Homo sapiens
MSTECKEWRHLGKAGRKRAGSQRKRAKSRAPLEGPPAPLVFSFKHPGTRQTRGKNAPKETVEFLGRPRNTAPQGDTRRAHKWGIGAPPLPLGSIEPFFKEPLDKAQMFSGFFFSVGVKRLAPLPFLSGKNVRVFLEGPTVLIQSSRGTFGTQEEFPDVLGLFCLLLGPPKPAPGGKEVLSRLFTQLAWRSLKRDTRTPGGPPQSISHFPPRIPQRLGVFATFKKKKFAHIKMEIFVSPTEEHEPPLFQTVETPGGHVFSQKTPDVKELEEDKMGALFSGAEIASPLSLLRRGELLYPCVPCLLAKGLLGEQKLGNLFSVVEIFATNFLNQERVDTETLSPEALGLCTFNLNTVPCSAPTHPPQSPTAQPSHTRPRERESVRRLGMTYKIGNVI

SEQ ID NO: 973552 - protein, 146 aa, Homo sapiens
MSRQSPPRCVGCGARDHTHTDGGGFFLGRRHRLMLWRERCSWGRWCPPPPRGFGAPAEDLPPGAFGFGITAARPPLPLVPFYFARGALFKEVLSRERPLVGGGARKLWRPGGREDIVRAGRYSSRRAVWDAGRSIPHERRETPDAL

SEQ ID NO: 973553 - protein, 130 aa, Homo sapiens
MFVADICECLLCVERQHNGARAYTTCLHCRCAFLHGVQMGAVSRRAATAVLTLMWRVQREPSAWATTLTGTPHFSTRSPADLFLTPADVREETRELPTPPLALVFLWCPSGRDCGMIKPPRGHALVGFGL

SEQ ID NO: 973554 - protein, 219 aa, Homo sapiens
MCNVCGDRLLFQRGTPTVWRKEIALGTFPPWPCWVLWWSLGHTYESFYISPHSHKVSHPGLRAPDALETTAATHSSHSRASHATPRREWEIHRFYMNIPLEITPAANTVAPAGSSPKKMWHAHFHAPPRLSAQPILLRGDKARVGKSTATATERSPRTTETCDPLKPTGILTLVGPPSVTPSAVSFSRSHFWNEVSRPPLSRNARAQEPPHGWSDSDVG

SEQ ID NO: 973555 - protein, 351 aa, Homo sapiens
GCLPSAASLACCFVSLFPPARLLGFAACLSLPSPSLPLRGVLDVCFYQHMFAGGSPCRPLVWVFPPRGSSFSPPGVFPPAFCNPFVLAPLYFRGYLAPVLAFPGRHPSDRGDGLFRPASFWGQTQWPDVCTRNPRVPVWLVVITLLVHPRSSQSEPPVLRRGPRTPWRVEMEPLPAPGPGTTLPPPPVAAPPLPAGELLAEFIATSLLLLGGPIEPHRATLYMAPLLLSLFPKVHLRPSVGVTTASSASLPSAPPPPLVLHHIATAPLPTRPPSAHKCPTGVYAKPPPYTCLVVSRRWRISSPLCVPSATFLRPLRRSTLGKVLAFPPTLFVSTYLLLLVVPHTTGKAGNF

SEQ ID NO: 973556 - protein, 110 aa, Homo sapiens
MYFCGVFLALLGYMTHRSPPPLLTARSLACYIFPPPQRRTSYSPQRHRGVFRDMAPLHSPYYTGDRYIWSSTQYIAPHIVGYETRHTLRTYIAHTISSRILCPRTVTPPW

SEQ ID NO: 973557 - protein, 108 aa, Homo sapiens
MRTFFVRWGEPQMMGRFPKMCQKRIVWSVSKRGKCFCFWLREKHISCGLVPPPLSKWCCPHPKLGEAKSWCFSILWLPQGLSLFSLGPNSPGRPNIMARPGVSCPPPG

SEQ ID NO: 973558 - protein, 184 aa, Homo sapiens
LLWMSFVSLVLVLFLVGGCLPLVGRRWFLILVGSVFYSGFALLCALGFLVWDVFRVLFFLGSPVVIFLCVILGDSLVMSLFSRVSPRGVFFWCLFLSPRVSSGGLLLRCVFPALFVVEFLRVFGGDCIFFILGWFFSLKGGVLLEAPLCFVECSSFDTALLVRLKCAPTPKIVVLLCSLVCFFY

SEQ ID NO: 973559 - protein, 110 aa, Homo sapiens
MSTLCFSLVDVVVFARSLVCGLPCMFVCCYVGLLESLLFFCCSSPPRMVVLFLGAIYVAPSLFCPHSGGVPILPVCLFAALYFGCVTTFAGGGIVISSTPLCYYNTFSVI

SEQ ID NO: 973560 - protein, 171 aa, Homo sapiens
ADVPAPFAGIIRFIVVRHRFPSPVSTGCCVTAQCVLWGPLSHEVLRIQSGVISPPGAECSGSYPGGHPPGRLGDPLSHTLGREAPSREASRCPGLVCYFYRELLWGAPLGCGDSLRQHVGTWAPHLGGNPGFSHGRWGKRPNLGVLFLGLVTRGDKISGTPVYNGETWEKL

SEQ ID NO: 973561 - protein, 100 aa, Homo sapiens
APNSVGFSVLCYGVGACSFWFVAAPLDIVCTCFYPGGYLETPGFMNYWVKIPSCACPDYLSSDGFYTGALCTTLCIKLGIYPPLWKMLCPHIYGPQIVLK

SEQ ID NO: 973562 - protein, 237 aa, Homo sapiens
SWCLMVEPISWAPWRHIVAKPVLLGPKVVVVRCEGHHTYFGQIFTRNQIEVTWLSSPKRYGHPTLSEGPYHTSGPPQPQLLLGVAVREVYAAPPNSTRRPQAAFWTASPKCFERHFPPGLFDPRDKAEMVVSSLPSKVRGVLKPTHKKVCLIWGALAHRGLAVRVPRHVTRHTLERRKRKRGKAQESTYPEKKETTLMRLRKPAEKNAGEENVTQLPPRSLQTPGLLVLSPIKTVNS

SEQ ID NO: 973563 - protein, 188 aa, Homo sapiens
LAFVVWCFVSLVDVVMLLPHAVLCVFVSLFRGVCVLLVVAAFAVLARCVVLVVARLLPSWVGLLPGFCGVLPPLLPPLIAGDHFWFGQGSDFFPKNVVSQQWFPHMLAQEVFPGGSSLMGLLVLLWEKLCAPLGHNICCVIWYARLFRLYSRHMLSHQGAMYTRVFAKGLVAQNCSPVVPFQALPLRF

SEQ ID NO: 973564 - protein, 145 aa, Homo sapiens
MFASCGDVHQCVADKGGIILPPLSRFVDRSPPRQCYGTLCKLPHCVESSLFCASRPPFFPGSSRYHIPMPWLFLCLSCLEGLGAGKPPGGRREAKHPGVKNPAVWSSNSWSQDPPFLWAPNEAPPVMSYMSAPPLFKVRRPPPPL

SEQ ID NO: 973565 - protein, 457 aa, Homo sapiens
WFVPTLAQLLFVPGVVYIFLFCVSCEWCLPSSPARWVLLSRLLLMCVAPALCSVARFVFARSVLLVCVDARSVVLRGPPGVWGPSVPYFCCVSRRCDFLSCARYLSTPPRVCFQGGGNPPTVRSPLPSCSCDPIAVVAQTPIRGAPGGNPTPRGPCALGGAPCDHPACPVHDNVCVGLLLKPVWSRHNRERAQRFLVVNRRLGNFSWCHSCPRPVGLSGEDFGGALNLVWAYLPNRVGAMGHACVVNPGGEASISPFEILPPICSRPLTPLRYVWIFSWRCKGPKVTPLVVVSASHGALHSPHPVSKEDVMCEHPLEHWFFPRTTWKGPGNLSGTPPFSWKEMLACLVGMGTTCYTGCDQREFCPTVSPTNFLWTTRAREHSCFEVHTPPIPSFLENHGKVVDGLGEGHFNKGPRHTKHGPCLPPRPPFSGSFNPRLVLKVPQNVLLLSLLRLRAVS

SEQ ID NO: 973566 - protein, 478 aa, Homo sapiens
HLQLVNHSVCVCWGAYSPTTTSLFSLSWMIVLLSSSLSPARGFADTKVGWCSWWSAVSLVVSHRRWKTLRVCLLYTTPPAVVWGGSPLLGPRTQYRRVVTHRGGRLNNLPGARRMAPARREPFVRGGKPFSFPTRGGHTKYGGALYNKCFTKKMGGPLVYNGDVFFVPWGTKTAFALGCRRRPPRDVEAPPAIWERTTAWGLIQHSIQRCEVLVRVGNPMSQGARTILGPPRFIAPPVNLGVWAQHTRGRHTPHVALAQRFFFLETLYKAYIRQTLEFSARLFLRVYTRLSCKRMGPAERCVFEKFLGLEMSSPHIGLNIWGFPSGTRAPHRCVFEREPFSPRLYAHPLWGSPCCRCGFLGEIYERTHRAHSVCRACGCVHMHRSHSCEHTQRRGLFCERLVPKVLPPRGLARPRERLHEKGYKWRYLFPLIYTSPHRHTLSIIHSWWEKNRVSPQRHSLCVHNWPHLKSLGSKKDWL

SEQ ID NO: 973567 - protein, 114 aa, Homo sapiens
TDVFSVLQPHAVCCFRCCGGAPPHSPRVVDKLRAARPVLPYMWMPSGVICYLSHWGWRVYYSLPTNRYGWGSNTFVLIPRGRPSSRGLLSLRLWVSPPILLLLVGRLFRVCVFC

SEQ ID NO: 973568 - protein, 118 aa, Homo sapiens
MATLWKFHQEDICRQMCKPLDKFVRPITFREPGDFPYNNGDSGHPNCLSCYPVPVGVRNLVYRGKGTPIFFQPRGVPQVHPPVGVLVDVPRVFRDPTLNVPPFKTAWCDPRNFAREMV

SEQ ID NO: 973569 - protein, 411 aa, Homo sapiens
MLPLACRGATVNSVGLPPPSITRAFSGRRPWVIIRARLISALWSGSCGLRSPPSLCSSLPPSAFCRFRHTCTVCAARVFVCAPRSPPCNGFYVVRCLHNHCARSSGTTTGGGWPTCRAIWCVGDHRGLFPVVGVILYWPPVSGTHLGGLVLLQSEVRDISSPALSPQFVGQKKFSGTESSTQHKWEEIDYKRHEGWCARPAAKCVSTARTTNFSGKEESLWEKEVHSRRLRLFVEGLPTPPIWVPKHHSDSYIVVGPLVLYIHRRGKYVVEGEIVVRPLLSLWRDGTHNMGEECTNTTVGAHRNFRTHMGIPGDKVGGDISLRHHMAPQSPTVIWFADTRVWPHRYIWVPPTSGRYTIRLWYGEPVWREKRGGPTPTSPSHRDLSHENWVGRKYTYTRTVVVHTHTVGPPV

SEQ ID NO: 973570 - protein, 269 aa, Homo sapiens
MSLQEKKGFLRYNIENVGKNATTPGHNNDSRNNNLYTRNNVEGKEPRFLVQRPRETPHKGAPRQKVVATIFGNEGFSLKRRVFLWFVFLEKMEKISLALEIFAPREIGIGKDVRTVLERKFSQKLGYYLVKEIDVPRGCKKTRPRDINMCTLGANRDICYTPGAHTKMMGVPTEGAPQKIRAQHPHRIWEDSPPVRKVPKKTLPRVGVYNFACLVSGFSSGLGFFTCIINPPTQFSDIPGEELSLMAFTHPNTRWSRPKISREKRRYEL

SEQ ID NO: 973571 - protein, 403 aa, Homo sapiens
SCPPPPVDLYFPRRSLIRGFYPQGPLWVGRKIFAAHRRCVRGKFRGCSYTKSAHYVVPPREPWRVFCWPTKIVYSWWSPPPPGGGPPLFGGKILSQLFVRPPRRRCINCVFFAPENIIGAFSGGPQYTLCKGSLLRGAHTKLVSPLGPPNDVSRYKGPSSPGGDLLLFDTRLLIVRGDGSSPRGRVLCFSRKRARAPASRGLCDVGAALLGATDHYCVGVCPLVRLERAAQQDMERVLWGEENNYLFWGPSLEKNIKESDILSSQGEDEIAALCHKRRTRRCALFTNWGSFVAHKMSHIPHPRCRAWLLGYPRHGAHYIHTRVSRTQTHDGGCKTIPLLSSLVFPPCVFPRKTHSTFLLLSLLPTTGWPPTAAAAVRREEIFPERGHTRVGHGASENARERRD

SEQ ID NO: 973572 - protein, 482 aa, Homo sapiens
WGCAVQTIVGFVVCVALEHAVVVGSWVSRVLCCVPHHSGGPPLRSAAGGVRPFEEVVSCWGLGAPFCCGLVGPLLPLSWWCSLPPPPAANIWGGGLSYLYGGGSTLTGGVPSLGGVPQPDFVGPRLVGGSVVLAVCVAHPASSSLPRVDTGGLLFFRGVAHWGCLFPPPGEWCASLGGCWWGLPTDGRLCHRRHFASGADHIWVGLYLPCFLLEGGRNVVHTWGGPRGVGPTRVVFSRRPLLAHTRGRPPARRHTGLFVRARAPSFSRAPRARAPQSDPLSGRHSSSLSVGDMLAPSTEGFFQTEAGARLSPLFQHTLCSLPLCVCPSLRGGDTHGCAPRVRSTAHTRACGLLLVCVSLRYPRPTHSTSCVCGCAAGRLLPADEPPPPPRVVLLRSSSSVEYYPSAHAVLYYSAGATLLRVSARGGQREGSSEETRRRECVPPTVLCPQRHRELRESTLSLEKRHDSRAQRAREALGSVSNW

SEQ ID NO: 973573 - protein, 215 aa, Homo sapiens
MWAACRCHQLIFVLVVLIGFFKYTPPMGERVGRLHFIPGGDTHYYGGTNQLLFSTHPIWCFDFPHTTWFVINSGCVTTPLEEVFGRTPAPVRQWVVIETIVAVVSMKRKKAECGVQQNQVGQKDETHNGPNLCGDFWVKGTSMAHPEAERPIRRATANERALLGNGPPLPEGYLLALIAPPGRIFPGNSSIRMALYNGCLPKGLFGQRVYLPGVL

SEQ ID NO: 973574 - protein, 224 aa, Homo sapiens
MFGGGRVSPHPPLLLPPRWGAPLRPLVILSAALVCGPPPPWGSACVVVCPLWPPPFSGGHPPVWPTRVFLFWPPLPGGTPEGHPRAPKEPRSWGPRLLSQTLSPPAIVCPSASPRGGGGTPPVYTLLCTPPVLCGESCESGWGALSMGAPGRPPCAPPGVVLLCVFAPTTCVFSLSLGSLPSASPPRRPGVAPSFGAPTQRPLPRRLGESLKMCAPPTPPPQCV

SEQ ID NO: 973575 - protein, 114 aa, Homo sapiens
MLAGGNQAPPGGETLSPWGPTKGSGPSPVVENNAYTCGKRHNKHYSGGFLGREVLFTHRGHSTRRKVLNSPMKGGEPSCVGDMLRAPYRRAPSTVPPCGDGATHTKNPIPLGGS

SEQ ID NO: 973576 - protein, 115 aa, Homo sapiens
MWRERTGRNKLPPCHRVHGHNAREIFFRCFEPQELFRVLSPMVVLNLTTPFGGLLRFHRERPHPLSRDHRMGKHTPHPRWNKWCVTLGHEIFWWLEILIRTWRICWVILSLFLFL

SEQ ID NO: 973577 - protein, 443 aa, Homo sapiens
DDTIVCGAPWCPVVGTCGSSAAPFCPAGVLLPPGCYLGATCPLAPYLGAPHYHRGCAGARPRWIAVCPPRRVLCERPPLCLCAPGEPEELGGKDIFSHCGRHTGRTGGPSSGEVFSLGGKHTKVLLSPPPLFRGTRRVLPPGMSPRMWARHTGVFEPRRDPSMGTPPRGRGGHPPGEPPGKPSCVGAHAADLSLVSPTRAPLHARGIAPPRPCGRPRDGDHVFVSRRAPNSGWAADPFALLLPLSLAERPSLYLCGHTPTEIFSRTPSDVTLCHRWDTHLTPTAPRGGEWCGVWRGHASVWVFTLCVWNFCDPPDGLGTWKYRPPEPLSGVSLFRLYIGLFSPERLSPSGICVLARFQKPNVDPGLMEEVLEYNTWLKTAQGGEPLPQHHIVGDTSPGRPREKRQERPATGQLTREGPRSLSPTPGRPTQNATPRHATPTRFV

SEQ ID NO: 973578 - protein, 69 aa, Homo sapiens
LVRSAVTVVVLSVRRLRKFCACRPLILAVVFAGDVSPPAPLLFCRVAVSSAPAVATFVLPPAALLPGCE

SEQ ID NO: 973579 - protein, 308 aa, Homo sapiens
LPVVRLCCCVSLVGEQDKQEKDYEQQTSCEILYVIARYVRHTLASPLDVEGRAVTYYASYCYVLLYAPDIYPLPIPLAGVVVERQHDAWVLLRFHVCVSACFALVLPREGRFSFLCEKLILLLCGWRPVLCELLVFCRPLVGVSPPPFAPPLCEICVLWRKRWWGQKYGGGYQQHDERCMLRTSRLSVLGPHNPSRGWVAPPVYLYWLLPLAICVASFELLFFAHIYINIAVRFFGREVVHLRGRTKGSRSIDGACVRWTDQNLVVLTTTTQGCCCLSSATFEPPWGGEPTTECCVHHKDIVRCCVAE

SEQ ID NO: 973580 - protein, 451 aa, Homo sapiens
MCACLCIGSLLRLCICSPPLVWLWHQDRLCVVFWGATAFVLRPFRQGGVPHTTGVCSAEQVLLVVLLLNTLLSGPLSLDSVYPAVSLLQGVYFCEAAPFGGCGPDICFPRTRKALPETNYYVDVCGICPPGLTPKKVFGGPARFGVSEKGNPTCGIGIPIGCPPSCERGRDVSEMLSCLCCSPLPRALYYGGSFSKRGVPILWRCLLLFSSRGGGPTPFLFLREVVRGFCGQRSFICRNKRWPSGDVSGTTRGGPTWRIRRAHTQGGFSKSRNIVCCPMISGGSSHTQMVAHTHSRVSRCGVYREGPPTQREVWRAPSRDTILPVWAHTHYPLWRTQRSVSTSRVSLPGVATQRGFILWRGDNTQKFPRHKTPLTHTCVSPSLTTAEVDTHGAVFVAVSLCGVWYTARSLSSPHTHTGGDTLRTLFLRAHLGVRYRDTLCVHMICGVCISQ

SEQ ID NO: 973581 - protein, 109 aa, Homo sapiens
HHCLSCGPIYFRRGVFCPAAPDHNVRPMSLVVVDPPPVLLWVRFLHRERLVLVRFYYRGFLVAPSVGAFFYFVRFYFESDSFYCLRPTCGPHPRCGPHHAQRPTFWGPS

SEQ ID NO: 973582 - protein, 127 aa, Homo sapiens
MNAFSIFLRAREPGANVYTTGSPRNPLMAPPLPPMFPSPAPVNVAPGHTSLLPVNTLFNPPFAWSPPPSHFPLGNPHVAACPCCCHPFPPGTWGFCPQSSCPHLSASPPPQDYFSPQPPNKSPAFLV

SEQ ID NO: 973583 - protein, 213 aa, Homo sapiens
VWLFVGFVFPPFVLSLRLVFAYLFVFVVLSSFAVFVVVYLLLFLFCVLCVGSPVFGVRVCCVCWLAPLCVFGLSFVFPICCVFSFRVGCDYHLFGSLVLSAASEVLVGVLVCCVCFAYGASSCLFVLLCLVLPVLLLFSALSGKYVCLFVCVGCCLCVDSCFVFVLCWWWCVVCVVGVCCCVVCVLGAPPALCGGVVRRALPKFVKGRSATPA

SEQ ID NO: 973584 - protein, 198 aa, Homo sapiens
GAGAARVGCVTSESMLVCLFGLGCGAVSSVVLYVLGVWLALLLFVVRSDRLSLLAVCLLGLSSVRRVCLYRPRVGPCCSGGPTVGCHTARFLLAAPLYVVGFLCLCRLPLWAADFCRTRGVLLVGAGWLGVVAAFCTDLAWFFSLRDIRRLRVSLLVSENSWGPTNNLVGVRLGVKYRLILGRRHDDKAKHCASGKRC

SEQ ID NO: 973585 - protein, 522 aa, Homo sapiens
PACVSVSVGAVVLLLSIGVMVAVWGFCVSPLSLLCEWVTSSSQLCRRPPCVCRPYLCEVEGVLSLISFSRRPSAGTSTLVGGDPPLCGLFPLRVGTTVVLLVFLRRGIMMCWWRRSAVAALRLLPHQGVAPLGGGRRRFCFVMLRAQVYECDAKFGVGRHAWEGARSCFSSRHQTACMLMPLPSTEVILLLGDPARGGRLVVFEKACWCLRRRPPLWGGAPPSPHNVGLGGPQLFSISDRPGRPPVSDASGPPRFPQRQPLSLGDAHQGDFSLCVVYLLNPHPRGWWSPTPRETLVSHSGMDYFLCMMVIADYPLSHDVAALVVYTHTEMFFRSGRSYMCGDTTCGHTVPHMAHTHTHGGGSHTPRVGGFKMFVCECLWPLRRNFFVHTCRWHTTCSRVRTHTTWEGYMSVNLVTFTTEEFPERRIVKKRRPRACLSLRKRQCTQGGISRVNGLLPAPWSSHMLTSTLEVPQNMVCKVYQVPSVPILANSLLKNWSAQPAHGRLVSPAPHCSRPTEWVRTNP

SEQ ID NO: 973586 - protein, 108 aa, Homo sapiens
MFVRCCFAKFFIVRTDELCVSFTTGGEFSLLDGSPLTSRGGFVDLTLSLLSEELFGVQSIEHRGAYVVGVPCGVDAILVLMIGFGGVAIQGGHSTMMWNPRGSMGIFR

SEQ ID NO: 973587 - protein, 123 aa, Homo sapiens
MNVGGHPLGREFLIRGEKTLSLHTGKIYLVGKRSTRPLWGRNASRTGIHRASLWKHHGPTFNSHGPRKPSLTLLGKKRAWISCLPHTAPPLVKNISPSWFTPLVRQNVFSRGRNSRAHIGALD

SEQ ID NO: 973588 - protein, 257 aa, Homo sapiens
MTFVPVTDGGPVSHPALYVVFLVGRGGGYSGLTILVAGGVAFRPGGPAVSLTRRKYANLGLFFFPYRRRAWSDRPIGGGCTSPIEEGRNYSEGGRPPPVEQQRGGDRGMEACLGGRRHAPTAPNDKEAARGGRGAQKSAHARGERALERALEHTIGRPPHARIELCGGSTAGFFITRCSPTRAHPFEHIFSGSSRCAHSLEALSRESASTQQISRRRLTRGRPPREELPAEGAHTSSSERDPGVSQEALPQRGEEII

SEQ ID NO: 973589 - protein, 116 aa, Homo sapiens
MSPRACPQCAPTEKRRYLSPQREISQEIIYLFVCERVVITSHYLPYNAPTQVSLVEIYPPWSQTVCHNIRRCLSRDLLRLLNHKAPNGRATRSKFERENTRTGQTPWFFPGTAVLE

SEQ ID NO: 973590 - protein, 231 aa, Homo sapiens
CRPSPGWSDLSQGNCATIYSEGTPQLIVKAPPEEPLREGSSDPPPMWGTPAFFGIDVLIIEVSRVAPNGGVTRKELAHPFGLVCSPCHQHHDPGCLPLGFPFTKMRSVYAPHSPIQPVVIPENGSLVEIRNFLGVKNTLPTGSDETPVVAWSNVILQPREDDINPSEGNDPWSLFPIPAALIQPAPNRLKPRISGNFWMVSMSLKKELFSPADEYRSKSYPGYRKKIPDDP

SEQ ID NO: 973591 - protein, 157 aa, Homo sapiens
MVSCFYHSDSILCMSLLRHSMVMVHHYKKEIFSRVFFVGVDRQIYIYLFVVLWSHPPTWWVFVSVHSIIVCVWCGVCLLPPGVGGSSAPCLRSFVSVGWLSASLHGTCCIRCLVVVLDRLSFFIIDVWRGGGSTHPHSCGGWCGAGPASLHLRLACF

SEQ ID NO: 973592 - protein, 116 aa, Homo sapiens
LVGHAFLLGGVCLAVVLPGFRVFCCARLRFACVLAAFAGCVAVYQFVVCGCSRGGGFACLGGSVVGQVVHCLCRPGFWAPGAQFLFAALVLTRVAVGACASVLSVVRDCRVLVWVF

SEQ ID NO: 973593 - protein, 179 aa, Homo sapiens
VAVGVCVVGSDALRRRLVVFVVLLTYDVLLCLGWCCLLLLSSRCLLWVRWWYEIFPVLSPVVVGVGVVWSVQCALPGSFLCALPCVAVCPSLGGCVVPRVGVSLLLFRPVWWVCAYSGLMCGAAFSPGFLRGRQGGPLLRLVCVSIYIAGVHIGDITSQGAPSSGRRACRVGSCTFWSF

SEQ ID NO: 973594 - protein, 316 aa, Homo sapiens
PLVSPGATGVGLALLSSLGVCIFSVSLPPACKAFFGALGLCPWCAPSGCGGHISICWFLRNRKYVYRAAPWGNLILTPTVPLPSRSPRGPTLRGLGISTLGEVGPDGRGTCLRTWEKLVPCPFRVAISGPWRVFPRLPGLLLGCPSDCKRRVKRPRYPLLMIRTPETPLIGPERCAFPLKVSCPFLLAFWARARPRPPSQGPWDPALLLGFQPAFSHRRITHGPGGAEAPASPPAARAQIPGHRLTGPPFCPLFPALTPRPCLPPLSLCPHVHDHRPEAQAVATHPSRSFCCCKRLPWRPPWEALAETHWFAYTLY

SEQ ID NO: 973595 - protein, 233 aa, Homo sapiens
MLGCPTSALMGVVSNRRFFLLDEVCVCLNSVVPRTLWGVYIFGGMIFGVVLVGPPPAPMGVRPPSRSCAMAPLARDESLGEYNAPLFRGRKRDCVPLCEAVDILEYFTPPREFCRGHSRVDLIFLGPLGVGEVCTSVSPLRVLYNACPRGLEVCFLGELSFLERARGQRTQLCVLCLGRGSCVRGVGKVPETSWGTPLCTLLCNWEVLLGPETPVGCDLAFEVENRFAIYSPV

SEQ ID NO: 973596 - protein, 134 aa, Homo sapiens
MCVSHICFCAAHISRVVIIVAVDACCIHTSARTHMCSNLSLFVRLSLCVCVTPRDLSLSLSHRDISLFLCVVRRERALWRTLCTEGVWRAAAYTPQLPTSARRVGPSPLIGELSRHREGEHQEGPRELRPQKEG

SEQ ID NO: 973597 - protein, 119 aa, Homo sapiens
MKLGEYSLTTRPHCVNKRGLFEHLAAFSGKIFWDISQHQKGALLCHIWCPPRGALCKKHPHTRVSPHSFWGPRVWQHSASVLSLLSLVGISLGVSHSLNDSWVLLCVVLSGCTTHTWVK

SEQ ID NO: 973598 - protein, 122 aa, Homo sapiens
MHDIFREKALYTGERALHPSRGVKPSRIRIEENVKATDPRIRKEFLPDPPRDSYSLLASTLEDGRYSCLTDHIPKEFTSSFSVLRLRGGVLEKDSKIVLTPLPQIVIKPQRKKVIAGCPEIL

SEQ ID NO: 973599 - protein, 270 aa, Homo sapiens
MGCSVCREQLRLWWVPRGGAPSFPTSCGGTLGVSHTLSSVARVYCASLVGAWSVVEYISLCADRCDGFLPRFRPRQCAPWGGELRPPRGAPHCKHVGDQAPPWKSLFCPTTTKSCVTKDVGLFSGVLNLIWILFFGVPTGAFWAPRDNQFSLSHVPTGTMLGPTPRECCKELFPQCCHSGENTSGVPREGTPCVSAQAPHCGPPIWGWVFPHGWRVTSSVGHTLRFGYTVSPPREPLSTGPLAVVAPARHPPRECLTHFCPFHMCWRSPP

SEQ ID NO: 973600 - protein, 113 aa, Homo sapiens
VVPRRCTSGCGWCSGGVAVVGAPAFWVVLGGLLSSVERCVCSGKSPPLFATVVGAPRQPAPGVTGVPACFRVLLSASRLLVDSPGCLLPVCCGRPPVKEYWRTFLHALGRSRR

SEQ ID NO: 973601 - protein, 218 aa, Homo sapiens
VRPSAKLCLVWVLVRVLLSPPRASSVVGVRSFHFGFYLVVVSVFGGRGLCLSCERGVVLLCGRYGVLCFSSRCWRVVSSPLLFFLFVDGFALSPSLLLLLLEVRARGVRGGGILPPLRGGGRARIGERAAWLSASWGWCAPLCGDTPTHALTRRLCFLTRDGSLACDTLSCSVSSLLLLLRALGSLSLSPRCVVSSHRRAWCGVASRRWAVVSLSRVR

SEQ ID NO: 973602 - protein, 56 aa, Homo sapiens
MIGEKFFGTKLLVYHLPLTSRGTLIMESFGAPFFFGKYPAPPPPNIEEMKPFKREK

SEQ ID NO: 973603 - protein, 242 aa, Homo sapiens
MSLVTCAPPTTALPRRCLLCCPVQGLSIARPCPHCCHRPCIRALSHCRTPRCLGLLVSCTPLWDHRSTIPKSGITSRVDPLSRSRGPSCPPILPHLCTTRGLRFPRRVRPKVYDTSPRFLTLLTHASNHTRVPRTYGLHWTENVDGTHGRMGLSLITPRAPRAGHTAELSSPLQPLALAFLCLFYLQAEATLFPFSQHHSPRREPMFSTHNPFCRPLVPSAPTQLVISFSGPWFTFELKVVI

SEQ ID NO: 973604 - protein, 424 aa, Homo sapiens
MGWCMFVFVAVCLRRWVDRSYFSLVVCVLPPVCILVPPRARMCCWVRDVSTGRSVKCPVVFYSHYFVEGRFVRVSLYECFFRPRRLSLLGGCPLHHGGFPPSRRSFLWWEPGGGSSRLVKGQLCDSQDGNFCCTGRMRPPAVLLLIVYTSAGPKKMFVMGSGVMSRVYVRRPPPGVVVSAGRTPRPTWNWVPLKRPFSRDDYSPPREEWESSFALDRTLPPFGVKGLMESANNTPLFVPKPPHTTRLGEGPPRRGDATTFVGKYIEARQYIIVFPWFRCGIMATPHYSRIFLARIPPDSLSQRSGPHSRFFLVHERPTFVKKALCGPTRGPPNTNKDVLANRVLSHTREFGPPPREDFAHQTFGRSRRILIQQERLVGAHHTGATHGLETRLPQRVRTWVKTHPQCETHCSPKDLGQNFLPVPN

SEQ ID NO: 973605 - protein, 142 aa, Homo sapiens
MCGGLSRPLLTAGLFSVPEVLLRGPPVRHYRAPPRPPRNALVFLTGEVSHCHRRCLRVCPILCAWPQWWRFIYCVGRNNREDYLWRPPTTGTKYIAHSTHPSSSHVATGPLSSGGHLLRVEINTAAPFRRRKYNKTMLASLL

SEQ ID NO: 973606 - protein, 145 aa, Homo sapiens
MVTALSREGTTGPPRREGHPRGTHTWWPRCFYTHETTAWGVPRLFVGVGVSAVFSHTTPHSVFLPGALSASSTPLCSFPLPLAGAPSKCVGGHPTRALSLASLTPTLPTPAAHAGSNPTTGWRERATLLEIFGCCKERLGGFHKW

SEQ ID NO: 973607 - protein, 148 aa, Homo sapiens
MSSFDCVSCGLGALWVAGMCVLMFRSYTSMWYYTRVWVTHVDAAVVPTSVGSANAAGRCDRCSRPPFGRRPVLQGVAEVTLGVWSYVFVVARGAHSTTSHVAGGGATVATKLLLLVSELGVGPYNRGRPLKVEKELGVDPPLFVRKEK

SEQ ID NO: 973608 - protein, 111 aa, Homo sapiens
MRAVSPALFVDNGSPLGYITGCCCRSCGCPAVLLYAGACRWGLLWRGVSTSVTPTGPLGPALLAGVYSTAGGVRMWAPPKVITSLRGPYTSMMRNTHGGLFFGPSGLAIIL

SEQ ID NO: 973609 - protein, 434 aa, Homo sapiens
LLNVMLRFRVVFRSLFCVVFARRGVCCFVTYASAVFLVARIIDEVVVCSSLVCELFIRLGLIVWCVVRWGGGVLHEWSLIRLGVVSARVSLFPSLAFMLLVSTRGSYIRVMFRCTWSALNTCRLRVASLLSTLFFLGALWMGVSCVRPVCHDGLPRCRNGGSHLVCRSSWFLRWKWLRPLVCPTTVFRPLLLMGASNPARGFVVPKLVLTPVCAWGLFRGADYSPSFRVFSGKLRESLLLKGWQHTNLWPRALVEIGNVPLLSRGCVHTPCLNQPWGTAAPSHKMGVYRERPSSVVFHKRGPTTLGGPRGKHSSSLGLLALYTGRWLSHAGCPSFRRGFLVPRLPLGGHSSWEKDPLCIRCVHPLSVAYFPPRVCPSRVSPPCLYRPISPLFPQYFSADTHTLFSRLPRGCPPTRCCVTPRPSFARGRVSAHPS

SEQ ID NO: 973610 - protein, 501 aa, Homo sapiens
VVMSCPRCVRGCSFPSVGGWAGGVLSDVCSLPLLFSFGFNIHWAVVDVLAPRGRVVVLPLALLTVGPPSCLFPVLLVPCLTGAQCKYHRAALLCVSLPLSVCLWSLVGGVWGTCFVAVCIVLVLESVSSSRSFVFRSHPRRVSPHRCVYERSGDPLLQVRWSTISVHARVDRHHYFGAEVYIFLVVELIESLSVVRVVVVCDHNKTNYHYLNYTMALHPYHSGANNSPPRDPCGGCTHYYSQRRLLYHGVFDAAMWALNGATVSYEFVPQLHFCWSTTGGSTGHYSPEGVPHGSTHIQATTPTIVAILVIKGTILGPTKNRWGPPTFYRGGRFSTSNDLYLYVTLCGSLYTVTLSLCAQHAVYSRGGGRMFWIRDCNIVIDLCFVWNMKPGTTLGRVPTRGCAHSHRVFFGANNTRRRHNRRLHHSPLVAAGFSALAYIRSKFQPRIETQRGAPQALNHLAALLRSAIYGANRDHEDGHPNSRTKHEDNRPFSNRKILCVS

SEQ ID NO: 973611 - protein, 125 aa, Homo sapiens
LRSTTATVDLVAYMCCRSSLYIWYARSLRSVIERFAVVVIPPGRCFSGLVSLFMAELYLSSCRRVVWVLSLWEGRRSSYLVLYCVRVTTYWGAHNLSVCFPLLVAPLTLLYIKTERSVWLRIIFL

SEQ ID NO: 973612 - protein, 398 aa, Homo sapiens
RGCRVVGCAVCRCLAGRWSVSQRGPYVELVSVTVLLRLFASGRLWLCAVVFAAPRVGVLVLMVCVILGAHGASPLRGFAGFTGVLVSYSFFLVPRLFSGEVEFSLPAGVSPPFVVTDYFGVMFSGLFCGALGRDLLRPELFGVLLSLRGPSPWRVWSGRQSSPSHVLLPTGIRLFGVLGFGAFLGAAVSAAGVCHALMVNACWPPRPRKGRPCEPRNEPWFVVGTTRWHECSVTPGRHVQVPQWCLWNGTHGRITKLLGFLCLHPDRVVSVIVKTWTPSPESLGGMPGEVDPAPTLNGEHVLQILPKNWGTHTQPWHTVSGPHLWEWKATRSWILAPGSIAPLTGGSGGLLLLGASIILVGMGHPSHATREEPRKEFSTRYLAHKTRVLLTISPGKEH

SEQ ID NO: 973613 - protein, 102 aa, Homo sapiens
MRDPPGVFGRRPYDPPQRLLETTHGGFSGRHHEKYLWPNVCGWGICSVFLPGTSCGRNQRGCFLHRPTGLFFIPSLIHMAPTTLVVRAQHPRPLGVYYSPLV

SEQ ID NO: 973614 - protein, 355 aa, Homo sapiens
CVAVCVGLFLWLFVLVGALLFVCVVCWFVLFGGGWGVWVGWGGGGVCGVGVVVWVVWGGVGGGGALNTPWVNHQPCWAPLEPRVSPVSKNQACDSPPRTCAGPYSYLALCGANFATEVCRLGESCCCFSCPRRSMPPIGSAPLRLWPPFQLKVRRVPTRDLNPGVWPELYLAKEVFEKTQRAPVPRGPRPTWATVWDYGFAVVHLPEVPQAWPYTGPDGLHPGHDADWNHDGRSDQEALGTGLLKLSPLWGMRPLPGSSMRANPGWEGGSSVTCEARPCAGTCVRTLAGACGFRGLYPVWPSWTAREHVRRKVLCTHSCANVRDLRLAQTGCLHTGRATPVHWQAFPGTSARCSP

SEQ ID NO: 973615 - protein, 129 aa, Homo sapiens
PVHAVVYVPFEPLPPCATLPRSGPDWKEEVVTLENLHRGLHSKPPAYYGQLPQVPRTAGPSPLYHGPSTTPCVHPGPPTHLGSLLGKDPRHGGHAPRVDHMGEMTAPCEGPSRAATNTLLPSVYHPHLL

SEQ ID NO: 973616 - protein, 247 aa, Homo sapiens
MRGLSAGSTVLEPRARVWPLGDALAAFRGARCGGSSDARCVAQLAGRSRSFQKALGGSHAAPDFLAVTDPWTSSRPDTVCFRIVRFWIPARVDVRGHWCPYWEDHQSALIFQRRPPQVDISPRTQLTSTHWADPGGPARRWSRLKPEPGFATLSTGVFRRPPLSSPLWNPMNGKEGFLEMFLRYSHPETGMYLLFQHPCCLGKRAFEKNLGTRPSFLFGGEDDSRMPLPELKASTQKGEEFRERALK

SEQ ID NO: 973617 - protein, 530 aa, Homo sapiens
MKEECASFCAVVVLVYRVCSYQVRGVLLARGGGQYFSYHVVPRRGCLRVACVFNTCFVGQRVQGTNTPGVTPWGLVVNRVLRLVCLLSVCHKPNRWGSPSVHLYRPRRLPPVVVGPELMSSVATIVGASPFGGDEKTCCAPVVLPPLCLVGARFLSRVAIQGVLPPREGNPSVCAPLTLFGDCEKAWGGEIIGCDMVHLRCPSKWKGRFGSHELSVTPRPARLCCTVTPWAPPGAPPPLVVIASGPPTRVRTPLARSASRGVFSNAGPPVPLPTRGVLRASSSRGVFLCRTYVFSCRVRTNLRTQKGATRLGALPTRARNVLYTPSVSQCVLHGDSYPFARARTARPLAQHVEHMGREYSCEKMISHARSRERDLEGTPTERVMVSHSCAALSLWGTPVSYTPADHTLSGSVPCVVWRECLTGYGVSSPPEHHDLAPLWDLSDLTTTLVCTPGPSWGTPRERSRHERLRSPRHVESCSIGHSGGHSPPQSAGKPPLQCTDKTPVFRGFSLSYLAHELALYSTPVKEIGAH

SEQ ID NO: 973618 - protein, 231 aa, Homo sapiens
MLVAVGVLFVTACFCFVCVMSVVPLSLLAFVGVECLVCSSVACIVHYLWQGAGFFCYRVRFFSTPFFCSWRMFLVLRASFLWPPSCFHASPFCVMVWRRASSLLGQGSVVYASNTRGCFSAGADRTHHPMVLFAGALCSPLSWLCPVESGCFPLPFLGSLPPLPPSWGCCSYGFPLSPRLPLLRGVPRNMVNSSAVWWEFSLWGLPTLPLWGPRPPRGPRTPRVPPAAKND

SEQ ID NO: 973619 - protein, 261 aa, Homo sapiens
MPCSEVRGRVDWQALCFVVSDRAGSVDGCPAEFEQLPACCVGNHTTTVLVGAAPFYEISAGGPPTTRGCARHKRKQQRRCGFDDRRPPPWLIVVSRAGRLIKGLAEGRPLGALAAGEFLAPTQHGGAPLALLLVCEMRPSEAPPPKGCFVLCGATPPRFVVSRPRCFSVGESLSLPPAGDPPPRLHYGGAPTRVFSSLRRGPPCGELMSATEVVYAASSCMKRHSIVGSSPLLPERGAPTTAASLVFVAGRDTDSLLRRRL

SEQ ID NO: 973620 - protein, 135 aa, Homo sapiens
VCQRPGFMLFKEYTCGLLFVNTGAHVFTAFFLLGFPQGWSPTPRVVCANHLFYDVVSPHSPTGGPTPIGGARKKDRPPGVCDPRIGFPPPGVVPLLLPIAAPSFVLFGVFPTVVAGTTPNWLLMWVGTQTGESAR

SEQ ID NO: 973621 - protein, 142 aa, Homo sapiens
MSLLSAGALYSLLDDTLLCLSGTLVCLSPPERALLSLSHTLWRHTPRRRGHLGAAAREERVISARGARERPHTLGGTLSLSLSLERYSHPCSPRRETHPQHRERERERESILAGEGGPQREGALRGRGHHPLHPPRCSECPL

SEQ ID NO: 973622 - protein, 104 aa, Homo sapiens
MIVSVVCSLLLLVCLCCLSSLHVGCLVVSPPASWCVSSSPLPLPLVVVGGSDSLTVGLLHTYGGCSPPPPLVLWLGSCPSPFLGRGVFLQQCSPESGASQSYGV

SEQ ID NO: 973623 - protein, 522 aa, Homo sapiens
TALCVCDVCCRSSGIYVFVCSCCFWCCRVLVGRSLWRRFVYLPHASGLLSLRGGVVSYSGGGFACPTTHPAHRVLFASVLPSLYRVIIKVVGSPPSWWFSLCDRLVSLRGYYTRGFPSSPPRGGDTPPLLEGFCGVVLSHRTHHVRVPDDMCCCPPPQLWWNGPPPPPLCCSLTRGPRCVMGSNPYFFWWGNFWCAPHTQKAAKMVHPTSRYWRAPSLFGRPAPLLFSVACLPRRHPKGGRFRSCLSHTGPLVVCVVCPHIGGAPQGPNGRGCAPPPLCVLHPRLAAPPGVFYDPLLFWGCFFLVLFSVLPHPDGGHTFWWWFSYKGEEIFSGSALGPTRGAPPLVCHLLRPFCGGRTHGVFFLARSTSEPHSSVTARPPSAASQRERVVWGDTLWAAHAPLVCSPLRESHFTPLSHPHLLCGVRHTFHLSTPQSVHTHHRGVTERSPLSTVCLLGTTCVAQRWRKSPHKKCFAGFPNTPTPSLLRAHTLPFNSKPFSPRDPPTLSLVSVESVPLSPTPDPL

SEQ ID NO: 973624 - protein, 330 aa, Homo sapiens
MRSAACGRRPNSRAPRGGHHTRARVWPQRAHLARPYIPRKCAAPSYMGGDPQQRKKKVGCDSQPTCVLATEKEFSVYIKKLGVKTPPPVAENGLPQNIMRHNIFCGEKKAPALCCVTPNGAAPHGGTPNRVWPHSLEMGSSTTKVFLHGGVFRNRGGGFLLAPWKLSCPNRRKLVSGKRISPPHCLREKIVAPHRAALESLSRLVEEKNWVSSTGGVINKKASSPLLGSPNKHLSPHWGANWGDLFLIPPRRGAHTHKMWWGVPHMGVSPPEKNGAHQSPHMEDVRRASHTRVEMGLTEKSSSPAAWVLSHLGASYRLLSFSRLVFWVCV

SEQ ID NO: 973625 - protein, 209 aa, Homo sapiens
MFRLSTRLESVASLVRVSSPVFVSLFHCFLCFCCCVLLVVRWILVLFGRFVLVSFVFSVSPLLLCVFVLFLVFVLSCVLCLLPFLLCVALCVVSVFRLFLFLFLVRVLVSWQILLVLAYLVHTLLCDHVPWSSLACRTSLRFGVERVPPPLWGCQIRTPRLLCSTPPLGGVIAPSPVFLGVGTVVARLVGPAVVRAPTRQQLVHTSSPS

SEQ ID NO: 973626 - protein, 336 aa, Homo sapiens
MDERPSAVFSTRGGHHHAWWGAAGTPLCSCWWRSCLNTRRCCPRLGVSSPPRVFVFPQSPPWERPHSRRRHPLVTLWHSRVGSYTPGSVSPPSPPRRCYSPLSPSLCFTTNCLWGNTPLFSRPTRGVHTPRRLVPPLARLSRERESGAPLEKRRGSGGRRARTRGPSGPHTARLSQHHSQERRSAVVCRLGALPQRGFTHSESLSPRERESIPSRLGTIPRHRRATHPTGAHHHTHFLLVRPRTTGALAHPKETGERRGNTLFFLAQVGPERALAPGLSHTHRRRATSSPLAGENPPHSPQCLLLLAEGGAAPRYLRAPPLFPTPWITPPWSPHAQ

SEQ ID NO: 973627 - protein, 271 aa, Homo sapiens
QPRVFPAALRTFSLVQNEPYGHPCPPFRVAPGVTLHLGPPLNGERLLFQETPSSVTFCGFVNSVFPISSPGCSAKPWDHSGSTLHMHCCLTPQFPDPPFRPPFPNIPVHLFRARRSPSAALPPFGRRLAPERRCVTLDVPGTRRFQPPGPCVGSAGCQGLTELPPREVHLTWPISAKSPTPRATHPPFCCDPRHTARGTPEDWKKGEPPFFPHRGAPQAPPRALNPQKTLDPLGGEPPPGQGSVSQAEVAPPATETPPPAPPPDYSPLPPK

SEQ ID NO: 973628 - protein, 599 aa, Homo sapiens
MCRARCFITVVWVHPLTIVAGSEVVCRHMRRLLLLPSSWEMNMLGDHRFGCVITTGLRFVVCFLRLTHCVWLVTHHHPPLLRWGGVFTPTLVVLAHHIHVMWGGVYQTKLSSSSVFSRWVDANVQKNDGSFCLRSQLWVATTEQNRGVVPPCFSPTTVCSTHYVVVYYTARRRMVVVPLPMLLYYRPAPSGGGYVSPPSPRVVLDEGLVVSSTTAAAPSWGVIVLPSPHTTTRGGVSVDEVRPLHRKTHRLVLGSVLPPRWGKTSPPRLHSLAPRSYLAPLHHTRWGVDKLVCAFIHTGGGGRGRGVAPPPLLRARRVGFSAAVERHPTRVWVRVYYHPRVRAMITTSEYHRTRAVYSFLCDEKVEECSPPPTTLLLFFYQQSYTRALLCGGGQHFHPPCFGGVVTHHSSSVSTRSSPLLSALAPTQVPHPLFPQRESLSLAGHSLSRETHCFLSLHTHILLPAPRETLSSLSHSVRHTHARARALSGPERVRECVSSARALRERPHTLGADLSLLSLELSTPRSPRREPPHHKEREGERCFRAGEGGSAREGPLRARTPPHPTPQVFSAVHPLTLLLYSPAPSSLSPPAEIVGFSPSL

SEQ ID NO: 973629 - protein, 194 aa, Homo sapiens
HGPVSPRTFFMPAFAPLTHRANPPVPGLTVPELTQQMFDAQTMMAACDPRPGRYLTVAPVFRGRMSLKEVDEPMLIPKPNRSYFLSGSPTNVKTAVCDIPPSGAIKCPPPSLATSTAIPELFKRISRASSRPMFRRKAFLHMVHGARAMDRDGVHRGREPTMNDPGVRVPTAVPGCPPTEEEGEFEEEAEEEVA

SEQ ID NO: 973630 - protein, 125 aa, Homo sapiens
MFLPRGVWFLLLVDVAPAGGSLCVCVCGPPSLIEEALCGDVLSLSVCVCVASLSLLSLSLCCVCLPLCRLYFFALCLPSRVVLISPRDFCVSLRLVSLSRAALPRPSWESTSSGREIFFGCASFT

SEQ ID NO: 973631 - protein, 149 aa, Homo sapiens
VLVVVVALFFLLVCGLLFVSLPLVVVLCFLLCFLFSSPAVFFSRFGLSLFFLGGSFPNFLSVLCALFFSFHSVACVYEMFVFVPFIMFLSVCVRSYSHRCSSVLVVARSAPCIYLVVSFTLFLFSILFSPCGALSVCRFFNCRLCLFPV

SEQ ID NO: 973632 - protein, 240 aa, Homo sapiens
RLIGWGVVSRCPSWVLFCYHRRCVWKQVVFSRHWLMTCLCVASTCRPLPGGDNQRLVIPPGLFLEAMFFSSPLSGVGPSLLRVVPLLPAGLAPHFVGDSPPAVVSLRGDRPTQPRVCYNDMGGKFPPGGHTFPPVQGFSWEMGHSVPPFWVVFSPEREPPPPAEAGIFVGRHNTTENCCLEMLGLLCLVVDPHPAPKIGSLSEFSLGEIITPPSPKLLWENNPPGGVVGHKETHTVSPRE

SEQ ID NO: 973633 - protein, 129 aa, Homo sapiens
MLCDVGMCYGVLLCKKTVLDQHRTLGVAHSIFLRRGAAQVVVTKSPACVFFTASASCFYLPVLLSGNRAPRGAQIFLAHEMVGDRRTHIGRGWHKEPNAASFLYNAPPHQKGGHHTKEKRGMGTTTFVC

SEQ ID NO: 973634 - protein, 160 aa, Homo sapiens
MGVVCCLLLVGAPACSLVLWCFTEVSSGGRASSPRWWASPHGVLISCPCWLVDYLVPGESTNNLRGGVLITRGGAHDPVVRRARKLCEVFIRRPSRGGDFDRGVLSCAPSLSILGLPPAARKCALFISARERYFYTYIELGAVYTHPPLCFVEHHTQERA

SEQ ID NO: 973635 - protein, 102 aa, Homo sapiens
FILCIKDTVTHHAHERVLVSQRLSLASTSLHKSSREKLEKCPPNMGCEIYTVPKLWRQRATKEALRPLHDVRTRFLTPPKLLSTTRRHPVTSRGWRLGVGSH

SEQ ID NO: 973636 - protein, 282 aa, Homo sapiens
PLPICVLFCTAARLLGRVVVAPLLCGILCGSIVGRGFCLAGGGATTRCSPSLGFFPRMGWCCLVGGEPTLGLAYCSPRGGTRAGSTTLLLPGVHVVGAPASALYLWLLRSRTPCCCRGHRRGSVLHLDRSVIPCSPWVAPNMGGVRPAPACGRGGVFLVCVPPQWCAARFFNPPSFGEWIILWGEVAPAWLVLCRRPIGVLLLLRRMCRLPTIFCLWGAHLVYLLVSSAHRFRGMLCFSSFGEKHPPVRDFQLLRRRSPSVVVFRRFVCSARRIVCVGEEEK

SEQ ID NO: 973637 - protein, 230 aa, Homo sapiens
TYLCYPPWCVVVPQAGVFAVHPCFVTPSGRGGSSRTTCGDPRSQRPGALVWFRPRSCALAVYLYFCPRGLSLIWGYSPRRGPPLWGGVGPADYSSGPHLEGGEWAYISSPLGLTLYVYAAHVGGRDAPPPPRAGVFLLLRAPQLCALVLCKPGPRSGRLLFGGARRPSLLSSLFGMTLFFCASRPTGGVPPQRLTAHREILFFSAGFSLRPTSRRRGEIIRGEFFWAVII

SEQ ID NO: 973638 - protein, 416 aa, Homo sapiens
TPAGGAPHTADDSLLFVGPDEGCLCLLPLTCWFTCALALMCVAHALLLLRQPGDISSRWRAPPLFWAVSIVDERVPPPLFPHTLSGPPLCVWVVGPPPLRCVLFFELSWCAPSEGEICPRDECLKRIPPAAVGEKMCAARRCGERYRPRARVSSLERGFFLPPALPREIFPRARFFSAQGASRMTHALSPARLPTRWWTSFLLRARDTPRCPARETLFSLVIPPRSLPPRASRLTHLLSSESAPTPPPGVSHKTHPCVSGETHTECFTTHTRGARALSLERGATSRARAPARPSLPALFSLRASRSPPSRAGSFHPHPPPRGITPRASRAGLFPATPSLFGPTPPVPPPPPPPGAGPLPSSLPPPPAPPRPPPPRAPPPRFPPRGPPPPLPPPPPPPPPDPWVWASPPPPGSSPPL

SEQ ID NO: 973639 - protein, 232 aa, Homo sapiens
CVSAGVSGCVCDVVWECVALFAGGADDSLLEYNPHPVGLPRQQAHPFFGADHPFGTPLEREFSTTQWVGAPHENDAHGASIVYTAASRASSRVTLCYPRGLLIKGVCPDGRTLWVWPEKIFFRRTMSGLLGGFPRPHWGAPCPAAAPRAPPGGGLPPRCCCGCKGEPHGPWCGRPPKRWCVAVFFVPARGGSPPRNWSPTTRICSPHHFVVGTHSWGCRVYIKRRHHNKMGG

SEQ ID NO: 973640 - protein, 106 aa, Homo sapiens
MGEQLAAKVGGQMPSRNRGFSLSHNRVFSPSFCVFGKKHAKDFLLLPRKVCPPRQELANREQEFPNYLMTQRKFSQQPLRNFTPAEHNKCFPQRRFKKYTLAPPEP

SEQ ID NO: 973641 - protein, 341 aa, Homo sapiens
SLVWVSRVGVAGPLLIGAGFVLRRPPYSVFRVGMLTCPPEFLSALLSFVMSRCSTPRRFCGAPSFAPGLFPPVLPGGCSARHACWCGCAPGGDSPGGGSPPTNGFNAVWGSQEMPNVQGGFHPPGVSRHSRGGKSSHIGGGNSNGPLFLTPGGRNKDGVCLLISTKPVIVGWFHEGAPTPWGREPSHTPFLWEGWELGPHPEFKENCGKSPKGPPETPRARPCGTPRVPPPRRYLVTVSFFGAPLVVEHCSGPLCPLALGAHSVSTHSCHPVSPRYTLATVALSLPQRIWRDPTEIERNPPHTLLGSLVTHLRTSTWRNTWYMRLETTPQRVSCPTGGEIY

SEQ ID NO: 973642 - protein, 467 aa, Homo sapiens
MHPFGAPTSTSRGCASGGARHPNCPEGVVPPPRRTVVGCVPPPGGGYCLTMVFVFFFLRRAVLFFLVVDLWGPHPGGCVSLSTMGGYAPLVVTGGSYTHHLSRRPFVHQDGLCGNFVPERGVVPRSAGFPRSFFFSEAATPRARLYTTGVLHNGAPKAPQSCGKTVLAPHQLCWGNPTSILPLPLTYCGSSRTYLRATKWAPPLLRTQECGALVAVERPYSEESLDIVRTSQPFGESPTCVEGLWAPHTRTSCLYFLMSGAHTTIVESLFGVSPPTALPLLISAALQVVSLLFSSSQHSSSHLSQHSSLAAPRHTLSLCVSVATHTLWGRPPQTLTLAPECSLRATRARPRVLWGPALFLVRHALASRENSVVARLGPRDLSRSRVHTHHPRPRWALSQPRFFGTFPFTTLSPDVSSHGTFLFGPTATLPLECPLGVALGSSGELHGGLPSISSWGTPGFRARASLE

SEQ ID NO: 973643 - protein, 351 aa, Homo sapiens
MLVVWHRLCGSPHTGGGHPPPPPVYCDALLPPSYSVLGVCRVAPRLVLSFVCWPRCFSWWAHQRCMAPPLVPPVETPSSYPHPPGRLVSSHGLFSLFSESHSGEKFFGRDLVVTHTPSSQRVLSVSHMCPLCPPRETSRFAQRAHTPLSGPSVVCVSHSGPQGSSLSHPTGVPAHTTLCWGCLFLCVHSLSPLWHPHTVCLCVTLGRLLSLSVGETFPLCPRALTERPLSDTGVFCVCHTVCLLCLTVCVTHTLFPSAHSLCITPVALYYSVLRCREDTLCVVGTPLCTHSLSLRGVATHRPGVCLFSPDPTRVVLPPTLGYATTRHQHHDESTRNLAPDAQRLPVPWDIS

SEQ ID NO: 973644 - protein, 119 aa, Homo sapiens
MCSHSRRLVTHTVVRERERMSPSLHRVCTPLSCGDHHTTIARLTTSFSESSREFSSAAATARASGLLFPPVESPTGRLCHGRLGDYHESHKHTLGAEKLGVLWHSREEETHETPRCSKK

SEQ ID NO: 973645 - protein, 469 aa, Homo sapiens
YQRLVVCSPLCCWCGASPQWLPQRTARVLFTPASPCFYFLLRSFIVVCRPPLGGAKFSRHTGGSCGPPLLGRSALRGMWGPHCNPVGAAPPQGKGALGCFLGSRPRVFFKAGPPPPALPVVVVFGSLWAGPYICGAIIFTACWAALWGPPACGCVHTNGRAQGLCVHPHFRRSSYSPLESCVHRARSRPSARGIGLWSFFLLGPLLRDPTGCHPLVWFCEGVSPRRPSFLPPRSVREMRSYCECWGTPPWDTPGCFFLEPPLGREEPRVFLCPARPRPFLSLGRKFVGPSSVREKREPRLAISGAVAHTLMFLAPVVGAHELFSWAPPLGAAESTPCLLEVGPTTWPPLSCSLGDTPRRGVVWPGPRKKGHFYTKGPRHRREHTGPLELAPPRAPTLSRVSLLHTPALGELEKVPRTWLPPDPLLRAPAAVVPINAKAPPSAPRASRPLDHCYTLSSENCTHTSELFLF

SEQ ID NO: 973646 - protein, 113 aa, Homo sapiens
MTYVLYPAGVFHLNRGLWAVRGAPLWGVGAPASSFFFVAHYPKRGRSLIRTSLGGQAFRGASGNSVPLLIFLSPSWGCKLAVYTASSSVLPPATSSGLAPTPCFAPHPLLLDA

SEQ ID NO: 973647 - protein, 127 aa, Homo sapiens
MAHVGAPHTAHTPQHSPKCAWPTNTPGPMAPAQVPARDIPLAPAPNPQGAGNAPIGHPPVQPAPHHQREATAPPEYDSTHAVPRSGSAGAPTHTPTIAQQLHSQIPTTSSDSLHPFLILSSPTPRYP

SEQ ID NO: 973648 - protein, 134 aa, Homo sapiens
MFSRTTERLRPHTTSGRRPACCSHPHTSPRVEKERGARRAPRVIIISSYREKDIFLHTRRALSDTTRSTFSPHTRRHTQGARCVCCAEREIFSPHTLYLSSRPHIYRPFSRTQHTEYYYSQRVYSVSHRAQSLR

SEQ ID NO: 973649 - protein, 325 aa, Homo sapiens
SLLGMLLIPCAECDYRCGVSGGGIPPRGFVLLPLVVWLFVRSQLCLLCQLMTVLFCHTVFLRWDADVSPLVVVGNNYCCFPPHVCFSRRVLSWLPLLFLITRGAAGSPCFVVVECLPQVVSCGPPEFPYALPLWVHRGRPLRLVVRSAPHRVVPEGRFFSVCGVYIRRVCAPTVVGVFHVVRARSTVCPPPAKLGGSRNVRLVCTPKPPGLSLLLSERIVLLLRATTLFVGLFFVIKPSACCSSLRPFLLEGYAAHTSCNTSAPRCDSVVGRRVRERLAPRAVWKNNFLGAFWGSYTTQVLHSVEYYVLSPTARRVRTQPFVSSH

SEQ ID NO: 973650 - protein, 429 aa, Homo sapiens
ILSCVEWVPTSSSVFCWRPALCRIKKGGCVVCRPGVLRSLSPLAAPLCGCALPPGDIITLRRMFVGVGLFSHACGRPPLSEDGLSLWRVCLLISVRPLLSYGGTKVCCRRLNFLSWGGAPILWVLYQPQRGFLCLWWKRCVPPTRTRGGATDRPSPPPLGVAEDKDVGENEWVYVLPTGWSSTPYSPRGEYEIMDNPTGCFTTREGGYPGGITHHGPPLEMIGDPRGEKIVEKNIFEPTREVVPTTEEGVSLSPTEAPPPSGRLFSSVGFLESRPPIFIKEHPVVEDCSSFYMVLGCVSLVSTLSSLSHFVVLSPPCEEVCTRGDPHSGPQHTSRSPQRVSHTHGRHPPPVRRHTTERSLCVRHTQRDKRGVCMCLPLSLSLRRRVCLCDIAHTLWEREFVCHAWFTRYILCEPTYRRRGTPRCFSYRE

SEQ ID NO: 973651 - protein, 336 aa, Homo sapiens
MVVCLVVSLGTLLGALLSFFCSRPAFVWPPSFCVWYLILLVSQGGGPPPFLGGSPLGLFLLDAPSVCHYVCPSAGTTFFHRVVLPVALLVFPPLFPVVFRVLLFHPGGVVALTDSPLGDLGFCSPQVSGVACSPHGGSPVLQLVCPPREVGPLVDFSLFWLCPPLAGEFTRALFLCPIPHLGAQVFWPPLFVFFGHQRAPPDAPLLGPTYVGPAVHTLGAAFDRAPHNSCVVVLPREVGARAAPLWCDTPLCAPPLSQREGCVPLALGRAPPTLWALSPHSGRTPPPQRCCLCALRAPPHTLSRVSCGPHSSLRETSVRARRCALFFSLTRGERNI

SEQ ID NO: 973652 - protein, 126 aa, Homo sapiens
MVFDNPTTVLAAHKRFVRSGDHNDGLHQLGCAAPSPTGARGPPALGVSRPTRGVKYAPSAPRSVCGGRSTECEASLCWAPHPWAAHTHTLGRTWRECDITSAVIYSAPSVWGASLSLEFRVPPRRG

SEQ ID NO: 973653 - protein, 189 aa, Homo sapiens
MLRRLPGRGKSPPQRVLGTPRKNPTALLCYKTDLAPHVYHYLHPGLLKRYCLKAHSGCGRKYSRSHARGDRGKIFSLLSSLSLIETRRAPQHGAIEASLNRALTREKSPRFCEREWVPTHSLTPNKEKKEFPAHRFTPHTLFPRRAPQRDHLGEISPRETHAPHTIFSLSREERRALTGRNTPQRWRPH

SEQ ID NO: 973654 - protein, 115 aa, Homo sapiens
MVPPRPCVAAAHDTTRLWYNFALCSRSTAPCVRSAVYMPSSTTHGDVLARDWEYKQTRGAPPATIGHIRCATQQPSAGVLLSAHTRGIQHARSCYILLRECFLPTVLPPQNIVLY

SEQ ID NO: 973655 - protein, 224 aa, Homo sapiens
MLLWAPLLSPLLGIIAALRPYYASPAPSLLYCSFLFGGFPKSYLAASPPLFGATWGTAPRGGTGTQYPSGFTWGYTLFDQIALFNPNFWPPPRGVRIAPPLSPADMFSHEYARAVGTHTPGAPSHRGSIGDTFPPPRWETAPSGSLGGPHTTHRAPRDHTTLGEMSSLSLSETSLSPTLGHMSPPPRGASHSSRVLSPRGSHPRVLYLCLSALVYRRGRPLLSL

SEQ ID NO: 973656 - protein, 112 aa, Homo sapiens
MAPPTSGVFFCAPLPRCRTTPHMGDVIIPVVNAPRTSGFSLFLRGRVFPLSRNPSVVGPSLFKKPSPFSSSPSLEENAHPKLEPSPLVRPGRDNSTPPPRLGKNNFGGVWGI

SEQ ID NO: 973657 - protein, 263 aa, Homo sapiens
ALCRLPLGPKKGPCVCAMAIVGVPFGPLLQMPRRSVVTPFVRSTPVCRAVCLCALSSRAGGRCGGGRTRGSPVILRCGGLPPLCLVISRGGLWAPVGHCRLSVGALSGGTRGVPLGSPLPRDSPRGASSPGCPPLCCLGLGDRLGWPSHRHESHGVGTRACGGALCGPPHFGDSRDWVCPFLSLAAPAEEGSPCCAHGFVWGGECALRTPPPLFQGESAPSKSASLHRRPPPPEPPELGLGLSFPRPRTPLPATSKIAHTPPS

SEQ ID NO: 973658 - protein, 152 aa, Homo sapiens
VPVFTARASGMSGLHTRFDSPPVCFTTYEVSPSFSLGVLFSPLAFFLLTVISVPLLIFYPPGPPRVCSYLARVPLRVSLISRPPPGGPQGTPPGPKTRIFFFSPRVAPLFSLPFVWGLFFIALPKNLVCRPPRTQVCYPRPRSRAPLRTQPF

SEQ ID NO: 973659 - protein, 103 aa, Homo sapiens
MGQYLPTRSPHGAVPVGERGSSPEKGPPQEEGCSLLGGEPPTLGGLATNGGESPLFGEVSRYNGRGKGPFPARRPKYGGAPPPGGCSPEEGESSPPLLWERVE

SEQ ID NO: 973660 - protein, 231 aa, Homo sapiens
MRAVLLLSLFAPATSRGSPSPPRGETAPRAPLYKYILRLLPLSLSLLRHTPLSHRAPHNVFGAPRGAPSARARARPPPPPFLPLSSPHRDTPPHTHTPHPGPLTLNTPPPHTPPLTTHATHTLPRGHPRAALFWEGQRALPPPPPPPPPPRHPPPSPPLSPPPAQPPPPPRHPPRGAPHPPPRAPPHTKTTPPGPPLESFSPPPFKPNSPLPPPPPLFPPPHPIKFFSPPH

SEQ ID NO: 973661 - protein, 445 aa, Homo sapiens
MRTSHHTVACRRSHAGSGYCPPPPTFWGRAPALRRCSPRPGGVVFSFGPAVPDVPFVLVAKEVVFYTPGGGPQLPSPKGFASVCFNFGVLSEGAPPSFHLPPLEGKRGSPRPSTTTLVPEEKSFPPREGPRPLGACCRKGVCAPPRAHFSRFSLLYTRPFLCTREHSSRAVRTPVVCTLTPHFHHACPRPTPPPLCERHTGNTHASTRRVLVVCPPRFDDTPPPQRVGERLESCGSTPPILKFLPRAHIHGHRRTHFERPLWGAVHAHCEPPRETPRHLSGDHTGDWGGDTPTHPLPPPQFCLTKAFFPREERVSAHRDLWRGHRPLVVATGKKAPRPTEMAPGPAHRSIYSCEKERTGRASPRGNTRALQLPGWKGSFRPCPTQGSNPSPRQCVPRSGEGPRPDTGARENPVLSAGPLDGCPVLHHDVPIVNSPRPLKRSLLPK

SEQ ID NO: 973662 - protein, 167 aa, Homo sapiens
MREETPPPAWSLSLVQHPQRECDTHTRVSPTPRCCGWERDTHSRESSTSSARCVWVCECGDTHSTHSWEISPSAERCGVCFCVCPRAPLLCVCVRKREEVSPLSLATVYTHRERKHTHTRVRTLCMSSTHAQNNSRHHTSLCALSHTHTRGDTLRAKHTQRRALCVL

SEQ ID NO: 973663 - protein, 144 aa, Homo sapiens
MWVCGAVWCVRSASVAGVGAVLSLPRCVWWCARYIGGGVLLSVVGGAARLVFGLWGRPPLVLMVGERGGAVVVLVGRCVFVGRRHVTARRSVGVRVCGGRGALSRRLGSGGGGVGFASPPARGRHLLWGCVSSLSLRMAPLPLR

SEQ ID NO: 973664 - protein, 244 aa, Homo sapiens
MRGGFGVVFCAPPSDNCKEGGLVVVKIVGAPPATPSVFCVKYCVKTGGCNTQQQGGFLSPPQTTGRHFGLSFAHHFVCAPQTQTLGSVVLRAPHRILLPSPPLCPFGGVFMRNEKEAAPAVCPPSPRRARQDFGGGLVPHDTAPVWTTHHSGESIFLVVCVLCVAFWWENSEPLYGSSLGTQRGEISPGLYSAGAHNTAHPLAVVRRPTPYTHIWGEWCVEKNDRVVNCRAPWCVRPLLLRVII

SEQ ID NO: 973665 - protein, 293 aa, Homo sapiens
RRLSRMGEYSTASPLVLCSAHSRAVGVEERELFGSSSHVSGGCSPPPAPPLLVVPPERGRHTRIMVRWAVAAAKSSAPRLSSWGGVWVVPNKRAAHHLVRIYLLVCVFDKEDSALVAFYEEVFVVIHPRNNKYLGGHLIFLVEVGVIDDSPVAAPITRGGRRLLDEEEVSGTIRGRRTTTTRAFLFWVVVDAHNKETVDDPSVEKEDVAPPARCCQHESCVWESVVVHSWVVLIRRRSLYMVGGGYCRNTAPPLVVDDDLVPLAGRLQEEAVVVGRPVGVRPPPTSLMRRRRV

SEQ ID NO: 973666 - protein, 123 aa, Homo sapiens
VIVLLCSLLTTVFCSRVGGCVTATGCLRRICTHLFVPKLLASVCSLLIDLRSSVSFHEVCVVWRKYLFFVFVSPPHFLLGGVDVIHPRGLFGFYTLARITNVGTHTLFLWPPPRVFSPPLGAL

SEQ ID NO: 973667 - protein, 394 aa, Homo sapiens
GDTFCVAGTTAEAGDTQQFFPPTPRVSRGDVILTCGTHLVSLSRAPNSVCYSGRCLLEQAFPPGVLHSSSRVFSPPRRVWVLVVRPSTRAVPLVSLFTLFAPHCVRPIMVRDRGSPTRCCPRAKCVATHPPRRVGSKVWLTRDSSGPPFPWGGPAFAFFFEVFSSLKNRGNTFNGGHNTLVSPRPSLLRRGVSPSPEGGCQPPVVGDPGGGRAPLLPTIGGGKEGAPLLVFSTRGDHTPPWVAPLVEHLFFVGGRSRYYPRRQLVFHTQRECPLFSRGLFLSPRRRPTMGGHTPLGERRPLSYTVWRHMAVVSVILSLEGSPHRSLLSSAVLSSRAPAGCLSTISSRGDHPRFLSRPQRVSHTLALSLPPLSLARGRVSGAPRDNAADSGWTPL

SEQ ID NO: 973668 - protein, 194 aa, Homo sapiens
PLPGGRFCLSPHFLWYIGGLVSPNSGNPWDHPVCILRARTPKLTALVPSGFSPAVLPTFSLCGIGLKTGAVCVRMLLANIPPEMLWGCAHGGPTTWSSGSQTPLCHPGPEGPVPVRHTAPNKWCSTLGPRPPARSRDRGPAQVAPVTQPAGSKVSPGCHKAFFGSNLSPRKEGVRASAGPARPFFRPSASFAHE

SEQ ID NO: 973669 - protein, 273 aa, Homo sapiens
MCGYEYLASSYFFFVVDLVVPYQFYFTPRHRLRRRLLLGGGFSSGFGLVPMLSSRVRHAWRRRGVGVLGSTSRGERACWMHAALRPLALSHPEGPLRGRRGITECTAYSLFAVLFVSCVLRGFLCSLVVTRAALALGRLCLLCLLFSSLLSPCCVRAEVSPLARHTPTSAIIPHSHTQRTHLARGRQCTAMWLSRRARASRARTRTHHHSPTGTEHQDCPAGDKHTPHHPRVFLPLVHTQRIALGPPPTPRHRRPRPPPGGTDTPPPVPYDNT

SEQ ID NO: 973670 - protein, 119 aa, Homo sapiens
PVLLSVGLQTTLVFWLLLLLPLLWWCVDRYTPTCLPFVLWCGAASPSCCGILFSCVWEWSPPPTHGGWGWVLTLNINIFLPAVSCLCLLINLRVVWLSPPRVCFFVTPGGVFLISGVFL

SEQ ID NO: 973671 - protein, 226 aa, Homo sapiens
LVPFPFPVLEHMWSLCSAKTSLIRCGSPRVAFGKWLHLHYRRNVLAFGGPQPPPVYQVSEYAPALLVFPVILMEESQMWVILRSLGPLGPPPVMMGSLHGCPPTEAPGEYFFSLMGSRLKKYPGMGSLDALDQHLSSPTRYFSEADQNPSGPEECLVLCRTKGPSHQFVPYLIAGIPHSCPDLGAQSLTPVRALMYSGELKFEKRRPPPRWKVASLASLRMRNGLF

SEQ ID NO: 973672 - protein, 298 aa, Homo sapiens
MISASGVAPGGLSPPFVVLSLLVVASLLGGAFLLPLPLYFARSAGVVHTQGGGVPRHSLAPLNRLPYPLVGVLYSEGCLFSSPPLAAVGGVSFLSPPAVLPSLPWVYVTIHLMSGGLPSRSMGGGAPPPSILVSWEGVFYLFSPSGVVSPSFCGGGGVEFSLLCALSPLLRPSGGGDSFFSLRGSRMSVVLPPRLGRQLGGAPPTYRCAEMLFGVVATLECALTERGGLCLHALFDTWGGNFARTHTFLFLWPPSLTEGPSVLVVSPLLFSPLWRGLCPLSLSLRGCARARLSLSFLL

SEQ ID NO: 973673 - protein, 326 aa, Homo sapiens
HLWSLSRVHIGLLCPHTWFLLPLLSLPRLVHPGVSYGHPAFNMPDFEDDGGPYGASVGSLRPSGPEQPAWPLFASPGTLLRVLFPRASEESLSVSVGRLILGCPRLEPFAEDSVSARRISGYSSDARANTQRHALRWRASPHRSSNVAAWLSTGYPPWNTEPAICASRLTLPPSVVDEGRKACLPPLVASQRRVCLPHTGLAPFPAALLPPPGILQPTAPSAHALCARNGHRALKPWQPAWPTHTRAPPHSGPLPAQSCKPALRRKCNGAAPPWNLEKGDLRNALETANALHLLPPPPTRLPLMSWSRAWPRGPFTSPLPFYKFPI

SEQ ID NO: 973674 - protein, 105 aa, Homo sapiens
VARLMIDDGRAGLIDELLFRRSIRLLRLDRPESSVWCLVSCSSGSPSSVVVIMPRYRLPFGGDDTHNGGELQNRVATDSFPPTVLPLFGWKAFLFFSMGRHSNPP

SEQ ID NO: 973675 - protein, 176 aa, Homo sapiens
MGCPRRLLFEKWGPGWNPPNLCVNFVLWRKAFLVGATEESLPCRRHASLGWYKRIGEKRVYIHWGPSREIPKVGWGNPDPKTHNGVFPPPHVRHHKGGVCPVTPPHWGPRGPPPAAGRYAWRGNIGRHIVLLWGYPESPTTGREILGRDIREREGIYFTLCPGVWTPLVGRDHKIS

SEQ ID NO: 973676 - protein, 122 aa, Homo sapiens
PPESKMISCSAVVTSDAAPPPAEICVESTRGPLLCPDRVVCCAPDNDTINNVVGPPSLVWCRPRSQQSWWRPQNCVSPQTPRRVCENHLGMCCLRETMSSLFGGVCRSPPMCCKTPHCIGLG

SEQ ID NO: 973677 - protein, 296 aa, Homo sapiens
HRRVTPRCCLGPLGHWLYSRWNPLPPIYPAGPQTAPPPKSRLNLCWGGATKCPPSGDNTGGALHQAPGPLGGSSQENPAPTGIPPPQDPPQVPGHNGFATPHPQEKHGGAPTPTEVLNLLDAPLDHPPGASGNPPHRSRPCWRPPTRSWVCPHRHPPASLPRAPRRPPGDNPLWRGGTPTDRDCLTPTARVPPRRARAPRQSVNPRAAGDTPRKEGVSRRLEGGPSTPRERCGPATPPARRKKYVCKRTVGVVITEGPPPPRVPPGAPPPPKKRGGGGPGAPRNPRGARAPPPGGL

SEQ ID NO: 973678 - protein, 361 aa, Homo sapiens
VLYSVVDWVASDRDQLLCVGVYFTQVLACSSVFRLFFTRGGVAYNVVLSASSPRRGVPHFCGWLPPWFDLPRGVTKFFPRHFVGGGILMRGPRTYILWWHYRGCFTPLGGYNFLPPRHRKVCVLLKGTSTSGRFFGSSLQCSMCVSDGCPTHPFVECVINVGNCVVALFLIWGPPFLMCPDTSVIWRPPRLTYVGCDRPSFFGPIISVGPSLLYLPSEFVGGMLVFIVRTPPDQEFVAGPHHQQQRWEWGPPLRTFSAGDFVFVRARRLCVETLPRLLVRRVGDNIIVRVGEYIWWEVDASSSCGEEKHNMGGAAPHKHNRVVLRLSVVQRLFNTVLSTIGRFLHNNGGGVSDSSIVFTLL

SEQ ID NO: 973679 - protein, 214 aa, Homo sapiens
PRAHPFRGSPIGFSDHTAPMLATVCPLLCRLCAPPVECALLSAWADVHLVGLGEKGVLPPDGTFLTEGSQTLICPPELGAVSEAWAKPPNLPRQPGSSRPTGLSGAPLSRQATVCSEPPVDRLNFQGNPRGSCSKRASHQHLSLQTLEGGRARACVCVARVYSARVFDGERREGSMVSPAPPPFGEPPQLPPFTLHWTACPKILSVGQQRAFCT

SEQ ID NO: 973680 - protein, 106 aa, Homo sapiens
MDCLREKSADGARRSALLYLIPIDSKLLSRTVGCRLGSMEQSIDYMRTVTTIPRGMSHSYTEEQNLEKRSVLIHWPIVVRTLRPRSRCNTKLIARGRGSASMQHAS

SEQ ID NO: 973681 - protein, 65 aa, Homo sapiens
MTDRVSTPLKPPFYNNYITRRLALMSCPHIRLKNRCNSRTSKPPVFHRHDRGYTTVNALKSVEQT

SEQ ID NO: 973682 - protein, 202 aa, Homo sapiens
MKPESADARKSRHHVCSAHLPANYTTLCTKCDGHTSARASDTHTVRYPAHFSATTSQRSNTKYSQTHTPVAGWQHKAFRNSPKERHTSWRHHGTLSAEHEQQRNISILSQYTNEMFHHHNPNTAPYDTVNERRGNAKHTFHRQVLPQGRVYISRCKPTLAYIRTAPWIPQNTVIIPFMGARHTHAFTTLYTFADIGALHGRT

SEQ ID NO: 973683 - protein, 79 aa, Homo sapiens
AYGGWADLLSRWWSLAIYRYTGSYQSTLIAYEEVRPIAGVQCVTCMWSDPDDRGGWRSVISSRSVVYTCWRKYIAVRHV

SEQ ID NO: 973684 - protein, 68 aa, Homo sapiens
GGGIRDHTVVWNPLTSYIVYPLLEGSQMKESHNVNKRMAYASCRNRTRSLILTLSAAVDLTCMADQTE

SEQ ID NO: 973685 - protein, 45 aa, Homo sapiens
MRLVEERAKTNNSKHVLVNKFELGRRILSRPYKPQSTSSLAFDIF

SEQ ID NO: 973686 - protein, 225 aa, Homo sapiens
AGRRPWTCGGLSWVGGRSASALPSSSRVRSCLLGSRGTARGPVRSRADMSAKQQRLDALTGTRAYSARIYLSSSSGVAKGPGPEPGAGGRAGGGPGQVPRLTSPWGRGAPQLFPRGGVASGAYRGAVLFQHPEQQQRPEESQDSVHSSPEDGGRRTGGGLSPGGVLVIGSLQSPLTAHVEVRTLSKRRARSYRGAVGVADGIYRLLKSSPDRRCYGKRRFNGKNG

SEQ ID NO: 973687 - protein, 149 aa, Homo sapiens
MCVAGARRGPPRKKLSQKPHSRWGRAGAHQGGKGGNRGPQARGSLAGNRGPREQEGGGEILSHPNIKKARGGETPESGSGRTQTPERGRVRERGAQYGGDSISKRGGAHKGRSAPENQKYYTAPVTGGDNENNKTQQRRNQTQTRTESN

SEQ ID NO: 973688 - protein, 321 aa, Homo sapiens
EATIDMMADVLRRDLKECGALVSDEDSRSRLMSHQDSLGWWLWYPEGKARWAATKTRGVLALRGERRWSSGKRSKQRHTRHHSKRRQTHREESAARIQRKGRRGEKRRGLSNQDTGESAQRDEPHDTDLMWDHTARESAKHADTCPSAVPHIRRASGTTDSSRGERGEPARVGGTHICDGVEMTRTDAKGQAARAGEQPTGEREENPPPTLQWVGEPEKQTRTANRHKTDSRGTTAHTRERRKRHNEEREATTRKAKQRGDTKAEPTIAAREGNNKKDKTRRNHETRHVADAQGETTTETRAQQREQRGRNKNTPQGEKNR

SEQ ID NO: 973689 - protein, 319 aa, Homo sapiens
SPASPIVGVIAELVSLRQLVIAGAVVAVVMWMRGRRASRSREQEGAQSSRPGKRQVTSEPKGLLIVVLLDTRGRSVDESLARCGATEHGTDFFRAPSSFCDFEPNPWTSLFAVHMGIRGMKSVLPCWSIEDARRTGEANEPTSRPLMIRSQCTPSSHELGLMPSRSTKLFLAMVPPEEPTEVSSIPWSQHSWVQPETCKMSFLPLVKSETACSYNLGLLYAHCWAMETLSDVTSPGKDLLTICDDHLHGPTVTTCGEHRGPWKTPKEPANCIPQNEKETLGARPTKANRGMPLPPTRGQTGGDPKKTPGHPERERTGKA

SEQ ID NO: 973690 - protein, 75 aa, Homo sapiens
ESLLFLAINRVCDWRQIARESSLLQTHRDTTPSDSSLHTRMVTIGRASNSVHVLRVHTRVHFLGDLVHSNARFCD

SEQ ID NO: 973691 - protein, 102 aa, Homo sapiens
APEDGSGVRWLLPSVCCPTCECHYLGRIPATADLRPAAMWKPTDDLMNTLLVVLGSKFKRRTIHVERIMFLDGHGTLLSNRSDATPIIYAVHAVVRWRVHQT

SEQ ID NO: 973692 - protein, 127 aa, Homo sapiens
LAFGGRIERCSREIVLIPKPVLGKYSPAEKANAASYERQRSMKAPKWRAQAGRISYSGRSPRALSENVEYGMCEELEGCETPGELELLTERLRRMEDWWVVRERLGHNLSSRVLHTDYLFRITSESG

SEQ ID NO: 973693 - protein, 182 aa, Homo sapiens
MTFLKTNCAGGGRGPQERGKRRTRGPKAGSPREEKPGPKRTRGAGNSLSHKIKKRPRGGHTPERVLWNTNSPERGRFSEEAPKRGGLSITQERRAHKRERRPRIYSNIRAPGPRGGGNNKTNRANKLRGAAHHTPRQPTTRKHNKEKQPTGRTTTPDPHNDTPTHNRHRGERHTHDERAKKP

SEQ ID NO: 973694 - protein, 212 aa, Homo sapiens
IAQVKDVYVVTDQIPVSVTMFQKKDRNSSDEDLPVKESRPVMFDVLIAMILAHCLNYSTSVSYKWSFGDNTGLLVCSNHTVNQRYGASNGTIQPLDLNVEKHACTRWTVWSDYRPARTARAFINPRPRSFRQLVVKSYGFNSRPKDLLVITPVELSGFLDEETAWHSTDMATFEPSSTICSRESQQVNIIQMTEVRDAGAMAEKLLIDLVVT

SEQ ID NO: 973695 - protein, 107 aa, Homo sapiens
MKKRPGGRDRTGAKIKAAIEGSAPEEGSANGETHIYIARERSKGGALRDISTKFSAPPVVVGKAGAHKQGKNDKNKGTEQRRGTQKKKHTGVNQETEQSAEKNPPRR

SEQ ID NO: 973696 - protein, 323 aa, Homo sapiens
ELEHSQDTDADDGALQKAVLTWSNGDQQVKGIVRQAIERGTQTLDASPRSGLPECKCMGENGSLISHNAFQPGASVLCRWSYCLLLPHEPSLSALPGQRESTGVSPYTPPPQEHSQAGFGANTVGGGPQGRGPLTTKRDESQKKNNNKNKREQNTVCRRSIRAPQKALKDNIKMGHTAGTNIAATQTRAQDRDQEKRGKTRERDTPPTITSGRGDTARWTPPQGRLERQQEAETHEDNNERNKNATRRNKQTEAEITEPSMKHAQTGTTQYLLTQTSWQQQTTSNAHENYPEIADQQTHSTKPRITTAYHKLGDEPTTVMIAD

SEQ ID NO: 973697 - protein, 193 aa, Homo sapiens
LTHAPMSNNMAFSAKKKKKKKKKTGGAGRGPGKVFKTHSGWGSGGPKYEVYGRTGAKRRCSQEENPGPMDKEGRRTFFHTNIKKSGRGGDHAREAFDGTTKSREGGRYEGKGQIAGELYYTRGESHKRARSARRIYTKSIKTPETGGGNMTYRKKGTNQQENIQQPQEQHNNNEEPTNTNKKQNTSSKNGESS

SEQ ID NO: 973698 - protein, 270 aa, Homo sapiens
MFDRHMRAHVNRCRPRQIAPIRAPVLKSRKVCIVSDNAGEKDEITWWNEWGIIYLKESGVMLGDFRVSVAWLVWLTGNCTLIRSDLSHNGDAVMCSDLRYCLAFEFNEEHVAVRRAIVVDGYSIRLRDCESHRADSTFENQGDERPASMLVPAWDAASVEGWEDMNRLIAVLDWLDTEVRVIAAIKVHAQYKMYYHKKKHSGERTRPSGKFWHPKSWEQRPMGPGDRWERPRETGGQRSVDLPGWKPPGKQGGEHRWTHRGGRERATRSA

SEQ ID NO: 973699 - protein, 46 aa, Homo sapiens
MSVTDESFTGFYRHGVQGDVRILTIYGPRVVIDYFWYVSILLDEGS

SEQ ID NO: 973700 - protein, 301 aa, Homo sapiens
SIEWKAAVRLPLMDVRVDDSGCAEGDGREEHFEECGSTPREERSRCDLNTYKRLAHLSWPDDQMPKTNCNVAVINVEGTQRVGGTQSYSPVVRVALLPDGHGMLLPSMMAFDGFANGPDHKNSAGPDVVCGLASGAMQCSDVLGTPGRNPRGKILRERDRPYMMRTHSINVRCDHRRIRRLPEELLELSSRPGRSTNAVLSPQVTGPAHVLKQRCRVRIAASAHTNGQMTIRTPCGRIRRVATEHKRRRKHLENPVRHLGTSTKQTEPQHDKNPYTHEHSQKDDRREGSQKSTPPPHSTET

SEQ ID NO: 973701 - protein, 255 aa, Homo sapiens
VCLLTSSVVWNRTHDPGDSLPCLLTCPPDFLSCCQSPGTIFSSISCFLATCQHRFLWFGSFLPNQLMSSQILSGIIPPDCVSAAVNMPVSNLYLQSASYNYLSLGFYFDRDDVRSGRRDATSSANCAELRTRERLRASPEDANPAVSAALVFPVTSKKPRLKDEVGVKPQTPGTACHVPLVINKADTRPFLDLHASGVCPQGPPISVTSWRDLTFLDKELDLLTKMGDRLPTSQGLMPGVGLREFLRKARPDDSR

SEQ ID NO: 973702 - protein, 134 aa, Homo sapiens
MVMFKRYQSLSLDYERSTMFVFIFYPLDFTFCVAPLEIICLHGDSGQNDILQETQPCPNVDLDASSGFSLLVIYSMGQYYLPNERAGLGPMNIPLVSDPKRTIAQDNGRLTRLDARASRSVRLSIICMISGILT

SEQ ID NO: 973703 - protein, 159 aa, Homo sapiens
YSVSLVVVGTQAPPMRQRCVGSPDVLQDAEDPPERPAADLCSLRFCGRSPVCRFLRAYRRGRLRAALQEEPGVPARPGTRCRCIWMLRAWRPIWLDAFVVDEEALFDVWNSYSHAMRRSRLRDEELALSLQDALQNILNVRSGGPAVSERAECRLRAPL

SEQ ID NO: 973704 - protein, 126 aa, Homo sapiens
LCFQRCNGGPAFPPRPGLALAPTLQLLVEMGSAMSVPVTPARSPPRQARHLASSGGTPVHLGAGILRYSHPGGRALHSQAYQQGEQLEGLKGCPGLRSPSPTLGIARTPMIDQQWRSLQGSLVKTC

SEQ ID NO: 973705 - protein, 137 aa, Homo sapiens
KIGSDRRLGRVGVYGAGVMGYGMLFGDLCFKRCLAFWGRVFIGGMQRVRLFSATCFCSSCDLLGTVQPAFQLDPDLQRMLVQAGSHNLRSRKNAGIAREASFLWHRPWWACTNFAGTLVPLSKFPKVLFRVGSQTPG

SEQ ID NO: 973706 - protein, 183 aa, Homo sapiens
MRKKPFTIIHLNPQYWNELNPRNAGSKLNRHGLYDSCHCRVIMYDKCIGDVGVPMSIPDVFDTRTFALHGTKDFENGPPEHIHTFYAAKVSYNCFIRCRILYPPSVGGFSFMPSTGVNKRKEYMVRWAPARFPAPVPPLNLKTPCTVSPRSRPPLAGASAGLGFPGERLNPFSHLWHRPRGEG

SEQ ID NO: 973707 - protein, 73 aa, Homo sapiens
AGVTGEAGDGVLYCSAVEAAVQVESVRVLGCNPGPHDPAKAPIIYTMCGSRPRGESSIDYWMNQSIPRLHSAV

SEQ ID NO: 973708 - protein, 105 aa, Homo sapiens
MRSKTRGPDLVVELVRTYNLLTRYTVTIPNVDTFRSAEASSDVRGHFRIFEKVVPRKTGHNGLSIRIPRYVILVSNGFLCTVCAFREYLRGTSSRVLFYLIPETL

SEQ ID NO: 973709 - protein, 297 aa, Homo sapiens
MAPEKSFPETIRVGGGGGPEEDIEGKVGLIDVGSLEEKPGARNIVGVGIPHPNKKKGARGERHGTGSVNQTPKKGAVSRRGTNQGENSSPAATSHTRTRKLIKIIAPAQGDTLRNTRTKDNTATRQTNKRKPQQTNDHHDNQRNQRDDHDRQTDTRQTRQTHEPPNNKTLTHNPPPTNAAHTTDKTPTNPHNKRSSLIVHSRSGEEVTAKQAKRPRGAGGTDVGESQRGKYVRELKEGSNSRQQAQEATRRRCKNRGPPSNQRRTHDKKTHDRDPDPVTPRHGCFGATGPGARTPST

SEQ ID NO: 973710 - protein, 138 aa, Homo sapiens
MRLIYSTVNSAIRPQYLNTRQPEQVTGRPYQNPPSPHQRSSALPSTPTYFTLVSTTSTTTDTTQQHIERHRTHTDLHPSASSPQAQNGPRATETRHIRAPNKNTAPTQHQARARTTRDPPPGTAHSATTRTPHHDNQP

SEQ ID NO: 973711 - protein, 269 aa, Homo sapiens
MAIVTDRDDLSWHPSDRRRGVRKAVYVKAYRSSVSAVQMENTREIPSGSKLDCSSPEAEDFHSGEVEGPIVADRHKSPNLGVHLRLEGVREQGWDSWLSRNLYTECRRVTECDHSVCGRSTPIRKYPVMHRRGLSTSQTENEGLRRFNVVGSKDMRRRRLINGAQRTLCNLEHTVRCLRSEFKKTLYDRTTSDSLEENWDASPPSGPDTCWCTDATQSPRRSDLESLRRALNRQLHYRPGDRPSPPPPSPAPPSPTPPHTWPSPHNSLN

SEQ ID NO: 973712 - protein, 147 aa, Homo sapiens
MLTSSDYWLFDECKMWSETPWLVDAERSYRKTRYRPWSCSDETIVHKAQHIAEMRQLLIRAVAGNMAVRNSVKEPWSSYLHKYLINYRVQELSALSLEEQTPSDLTKQAYGFRLARQMSYVSDGAASATSRLYTVCCGAPSMAVKSC

SEQ ID NO: 973713 - protein, 281 aa, Homo sapiens
MVNTCRPLAVSQRKNRGPGTKGGDSYTKITKRRGRHPERFRETKHPRRELRKAQTRGSHPTRESSTGGRINKIKPPAVGTQQKTQQSVNTRRKSQPTNTHRTPQRCSHTSAPPHPQPTAPATLLGASSATIPRSHTDTQTTKLSRHDHTSHHSTSCQATSSATGRSPDGAVRCGVTAWFRLREGGARGAWAGNASCARRVKHKDRLRLQLDREALDKTEGSVNRGRPREADANYTRRPEEAHHAMCGGVHAGYVRVSSRKHAHARHHDPTSRHPRCTSRSA

SEQ ID NO: 973714 - protein, 268 aa, Homo sapiens
FCSGAACGPLRGCKLLVCGWEERRERFGRFVGIPGKDEMLPESLTRHGVKRSASPDDDLGSSNLVEAATTCGKMKMSKQKVLETYGLHVTQKEPYWSSCYRTITNSTSHFRTGEEDNEQITEELESQYQQSMDSTIIRTIIADIVRLGFREVGRTMMDELVMWLEHDADVTLMIPPDPVKSNDESCQAFDAYDLPRHLAKKLPAAERPGLPVDGSHGAIKMAKAYPPLRRNPWFLVPPLTCVNRATVSTPGACTPALYSQQAHITRVP

SEQ ID NO: 973715 - protein, 82 aa, Homo sapiens
MRKEDLHYQGSQQTRGTTVLYLQAGTISPKPGISTRRGAPITVRNAETKGFAEREVSEAQGNRNIGAEKGGQKAQPGKKYTA

SEQ ID NO: 973716 - protein, 35 aa, Homo sapiens
MHINGHWDISQASQLIKRLTTHKVKPGDKRNVKKR

SEQ ID NO: 973717 - protein, 115 aa, Homo sapiens
MTDVTSKGISEPGLCKFDRLALEQRYEGKGTTAPMPTAQSPRIRPAIKHPGQRDSDPGTGHGGHGSAGTHKGVPTSHREPHPSPGRRRHPTATTHHPHATQRNHRPRTHNTHSGP

SEQ ID NO: 973718 - protein, 117 aa, Homo sapiens
SATGESAESSLHKYRRKVILSTPVPSPLDLKPGGHAVCSLIPYRGGWLIYTHYDGPVSESVDLPGMSGRPPSLCSSFRSTQTPDSYLKLVDHRFNEITRTEIMTLAFFRSYTDKTEG

SEQ ID NO: 973719 - protein, 275 aa, Homo sapiens
MHRSLMVSNAYAKQDTYKSFHVCYNAQMSNSHTPPTSCTPQTLLSCHPPTNPNRLSSETITYSRTASALLGVYFKRAVEPLLPAKKDPQGRSDEGIRIRSHMKNATRAGAERQRYITPEKMEYAQHYTQRGAAPNAQSPRRPPCPRHGPTVWTQHAPTRTPMTRVLPAPTGTPAPTADPHTYGTTIPWNRRLTNTHEERQTTRTHYHQSSTAGGSAPPRTHHTPHKPHSILYGPAPTAHTRTRPHNTTAQNIQTQKYPPHNAHRKNTTSTTPTKH

SEQ ID NO: 973720 - protein, 259 aa, Homo sapiens
SGERRQACAKPSPGSNKLAPMMPILGLGTWKIPSRAGDLRPVKVAIDVVVPATSDLCPMSSPSNAECSVAGVAHSGQQAQGSQCGCTACRQLSPLCRRKPVRARYPLRPGACVHKDDLSRKDTQTEPDKLGTYPVTLITLYFQLWPGPRHFIEPLETRGHLFSPIMRHAGSRATLGLGSHTRCTTPMHPSRTTMGAGPHGNSSHGRRLATRAWLRHRLLGPLVPHLHTPNLPVLRSLPRYKKHVGLAPYHDLPFHPELR

SEQ ID NO: 973721 - protein, 293 aa, Homo sapiens
IDAAAFNRPWSSAGSKKKQDLDKLYELTVQRLGEIMNQLGPIQAVINLFQVSHPKKRGRPVSTPPQGSMANSTAVEEIPGTPGAGGRLSPENNQVLTKKKLQDLVREVDPNEQWDEDVEDDAAARLLNDLYRECGDSRLSACAAIAVLAPWRCNDVQLHLELQWNMWIQDLALKKSDLEKRLPQRRTNREWHDPEDNPEVHTGQGPVMAGTDLEILSRDQPVIPDITKRIQKGNINNGHNIHMRRCKRRRPTAFRPKREDSAKRATQNARMRNNTNRGPQRNTNGKHKANETP

SEQ ID NO: 973722 - protein, 111 aa, Homo sapiens
MSPGGKDPPSFGARGTGGPRLAVLEDSARPSKAGSPDASPHTRGLLRLLRAPPRVPPPRSRLLRVGAPNSTVGINRRSADSPPCLLRERSFGSEASTTGSPHTLLCGPARP

SEQ ID NO: 973723 - protein, 211 aa, Homo sapiens
VWSLAVNSVGTEQIRWTLLPALTSRPRDFASSVLQCIRRPSSRAISCFLGPGQQRCVVVELPVLPNQTMERPRIRAELLHRTLRGRPIKQAWSNYVACEVAIHTAYRVVSWSFQLSDPATDVSSSEGVSLRSLREMDEEKRCWATSVLRDRCKDQSCDGRRSLPGHQEASGMMSGVKPRGHESCHGRGEKAEPGLMDLHALGSCRREPHIC

SEQ ID NO: 973724 - protein, 99 aa, Homo sapiens
ALDGIWLHDARYLPSCPTMSSQLVELRATLGILLKDIAMKMRQLCIRARLGLKCVPVTGAYLMNGEPCKRRSDYMADGIALLGAGRRSILIIPSTHVTR

SEQ ID NO: 973725 - protein, 119 aa, Homo sapiens
MYVYWLTSRSSILYTVSRIQMWAMSVLLIGLISTYSIREKISVYTGSMGIHYTVNNSLGSRIVVMGSSRPLIHIGDHKCPNEKPPVYARFSYNLFGGGLFYLPHTTVLSRTHNARCTFE

SEQ ID NO: 973726 - protein, 155 aa, Homo sapiens
MTSEDFFGSTIGMIIHGFCFKLEEKWLPYEVPLTPEFSSLFMCHVFILFYKRGLRLSPGLQSCILHVSHTPTNSAGINSAVRPTTPWFICSFFSGLRAISQSRCYDMFSVLSCRFLFHGSHEEYCVEHTSDVSKEYHVYCTQLSLRKANVLRARF

SEQ ID NO: 973727 - protein, 241 aa, Homo sapiens
QKRLKKLRGKEKPKKKKKKKKKNLGAARAPAKKTCSRTPIALWGARGPQGEVRGDTRGPKSGFPIRKHRGPEAMRVARDSPDPNKKRAPRGGKAREGLGKKSTKRGFARRAQQAGDTIITQGASSQEGDLRSITKYIPRPRHRGGANKQEETTKTKEERTKEKKNETRKKKTEESTKSTTKVEHRATRRPMRATQSATRADTSDTYRTPSRTHQAPQPQTTNKRRPTKQNIEKNRRQDTAR

SEQ ID NO: 973728 - protein, 272 aa, Homo sapiens
MHSERHSTQGLTGSITIPIQLIIHASSSSRTNRSVLRRGPRFPKRSRISQRTNRRVGGMTLRISRVVTCEREIRESSYENTDSWYSPKMKFTALDAQEMATDHRCQEAVRHARRQKLVQNIMNMLMRGPQSDLLARSMSVGSAVISQQENYERPFQIIGRRSASISQRRALKLAQDLNGEWVSQNCSKLQSEEHRSHTPADVTHCTTGTGKSRITKTLEQYAYTAQYCARIQTKNKWGITRNPIRTKDKWNTNKCGRNTTHQPQTVNTLKQT

SEQ ID NO: 973729 - protein, 76 aa, Homo sapiens
LEAEMPEMQVPWRPRLVSAIELQMAQTCIDSLSHLLQRPTHIPGMVCDVQPQYDCDRPEPRILDSRGLTIIIRAVT

SEQ ID NO: 973730 - protein, 148 aa, Homo sapiens
LTHAPMSNNMAFSAKKKKKKKKKIWGPPGPPEKASWKTIRVVGRAAGPQRGHSGTGAPNAVFPERRNRGAQRTRAWAISHNIRKAPRGETRGVSSENTNSQERRGSERAHKRGNPYSNEESPKRRSPKIFQIIRAPGPWGEKTKKRQR

SEQ ID NO: 973731 - protein, 188 aa, Homo sapiens
LQTINSTMSLVKLLHERGISAKVYHSQFRSKPRVQPRPLNSHGYRTSITNNVQLSQSAWPLLLHLFEPRVAFSLRIERPLDSSDIPPGDVWLETSPETILMVGQLKMNLGGQAVTRLCGYARVVKNPGAQENGRCQEAEIGPQKSDSAVYLNSGSSLLGGLRRTQSLPVIMGSFDDPVCTSHPNNGCP

SEQ ID NO: 973732 - protein, 144 aa, Homo sapiens
MRGADCWDPSVSTYVCDGCDIPHVVPAFSKHANHGCLGARCGPLVGWRGDRSIACAEPFGLQCNMLYDCARILSSRLSRSGFHSRHSYHCTGLLVMLLSTYYGKNQQRYLESNYPLNCPYKGSDLPVRWAPGCTSLSQKCRVRS

SEQ ID NO: 973733 - protein, 454 aa, Homo sapiens
MPKETEARLKFCTLKKEQHGLSYLSKCWWSTLRHIFKTSQKLSIHYHIVVIFTISIFGGQIPSSWCTAIASPEQSITLVLVHHSTVFNMDHHHTVTHISQYTHQPFQTQRHGFHTSATGRGRSKQGVTLVIYGTRFNYNMKPPTSVRAHLATCPSGGNRHHSQTWSHSHLGTNLPLKRRFWRLPPSWRHNTNSKNQLSTHPITLLVVGPRHNNTGPVLPHRVYTFTIANLRNTSVDIGHWAHILPRPLHVACPPSRTTQLGFQRSGAAHPSPTDTDAPRAATPQRTAPTTHTQNPHPHTLHSQHNTPHYSNEQAEEHRVPRSQHRRHHFRKTDHNTNKNAPVVSLNQTTALNSKLQPSKSAGTTQHKNRLESRPPLYATTPRTRDPHTDTKQPLTGDDADLEHTPPNRQRRITQRRTLHRRPNTTTDYVPHKYDTTISSTAPTTHTSKIHYSQN

SEQ ID NO: 973734 - protein, 145 aa, Homo sapiens
KQWLPGLGLDVPGVEVDKQFKWAIVDLEGALRIMEMALVAEAVPRGCKWPSWSCEVPLGIWVGHQLLGLARPGPAWPIHIGGPPGFASSSGKPGPTVIKVQNMPFTGVYDEILDSFMAIKYIPGSVCPQYTCQQVCPTGEAMVAF

SEQ ID NO: 973735 - protein, 122 aa, Homo sapiens
MPERKPQELRLLQAELLQADPYNNWLRGGGIKQHKDEVKTSAEIMGIPYLDAPSEGTSQCEPGKMAQLILRVPTKWDANIRSRAYGNDATKHSANTDTLSRLTTGRQETAGRDRKADRTNSE

SEQ ID NO: 973736 - protein, 162 aa, Homo sapiens
MLLRYREVAVRLGLNMTHLGEYLYWEVYEVEQVMIGPGLYDRTSHHECKEYSRHICQEIEEMVQDSAFDRSMHFVILTYMALIYGIGELLRSIDTRMNGFPVSVRANNATTMTGFLCTWGSCPRVACVHLIKLLKTMTPNFTCPPFTTERRRLICVQTQRSR

SEQ ID NO: 973737 - protein, 217 aa, Homo sapiens
DLWTRVHEHEPRPQYRYSRSVLVPRGQWRLPVFYMHTGQKMPLIWSGYLEECRLAHGKTQLLSMPLAEATANIDCAAIYGNEPEIGEALNDARGHQARPVPREELLVTSNACGTTKQHPEDVLSLPPEDSWLTSSWTYLDLYLDALALTCLLSGEKTPLAPRHADGALIMLRNTATTKENLEGPARHMPGITGAWCKEPGDLYKLPTDRQDRMTITQ

SEQ ID NO: 973738 - protein, 295 aa, Homo sapiens
MPHQKAYNTKSRKPPPLKHTHPSPSSKTERKRINLCTFTNPYITRMTMRQAQIDKRSFQQMTPHPNVPARTHNPTHPAHTIHTVSITCKTSLDADSQTSYQSENMKHNPLPREEASKATSNSHTTRNSMQPHSELHTAVNCRPPMRLKHPRPELERTTPEANPRPAKMRQRRTHTALRRSTPAKSEAHRTPDTPTEQDHTRDLTEQPPHKQPSTHKQLNLTYCRPRTTNHLTNHTKKNQDKTTKKTSHQPQEQTDHSTDTHLTSINTLHTPREGKDTSHRRKKKYSNTPYTTHTQ

SEQ ID NO: 973739 - protein, 78 aa, Homo sapiens
MNVVSTLPTVEFAEARVSRTKALNCRLSVSKEFDTRPESRTLRRVLLEVNGNASPGSRGSWAGEGALGLGPGCALVLR

SEQ ID NO: 973740 - protein, 170 aa, Homo sapiens
MPCGGARAPKVGARGTHGCKTWVPYKEKPWAPIGNERDVGGSSLYPPSIINSAPPGRNKREERFRGNHTSHQKMKERIIAKTRPTTIRGRAIPYTTSGRRDFPPKGAGSYRPYNYPTNIAAARRARCRGYRHIRREPTQPNRPKAMTNYRTERYNEQNEATQRNRKRQHL

SEQ ID NO: 973741 - protein, 148 aa, Homo sapiens
MYLSILLLTPSLLLPTYALATELTTYSLGSTLVRILPHYTRPTPYIPTYSPNYSAALTAPTHLSSISAPAHSRNAQDLSMRDPTPPYRTRTININLKATSSLATLRSLAATHYNALHTAYHRTLAYQSLHIDYPNPTYHYSTYPTCTH

SEQ ID NO: 973742 - protein, 72 aa, Homo sapiens
MRKRGTKGVVSTEEKCGVQDIGGGDSPPIKKERAGGTEERVGNTSKREQCGGHGGSYKGGSRETEYHSPAGG

SEQ ID NO: 973743 - protein, 71 aa, Homo sapiens
VAACLGGTYVDSEADVSTPFPSGNEDNIYKPYNKARADELIGKQVYGSHMHRKIWTLDRHTATLISYSSKR

SEQ ID NO: 973744 - protein, 185 aa, Homo sapiens
MSLTCVAQAWKCTGAGDRESGEKSSCLTKDTSRHHEALGTHTARSRKHKRATRKHEMRKNTGREDKERTKKQRKKKPTRKTSHGHPAGTRQQRGHQQPDRQPPHQHNREIDRHPPPNTRLTQKPETQPQHQTPAQRTHTTLESGAQTRHSRHKPTHNTTRTNKTTGHNWPQRRRKHTGEQNRTKR

SEQ ID NO: 973745 - protein, 113 aa, Homo sapiens
MTIPDHDYVFVICTRSLKRPEASEQFRSYPDGVTDGHLQESDHTGSSHCEHRIIGITDIVLIAILFNNNSPDNETITNTKQSILIINNHNGYRIKLGIAPFILSPRGYPRHPV

SEQ ID NO: 973746 - protein, 102 aa, Homo sapiens
MAEIEKIRVRSKLKIGQRRKRKIHCLPTETSGGRRSRDRRSRNEACARQVVHCDMSTSSCLLYFTSVSCLTWEDAKRLDEDLNDLCCRLHDQENLLTNEGRA

SEQ ID NO: 973747 - protein, 182 aa, Homo sapiens
MEAVECSRDSYGASIASIKKSSAIREIAKRSRPEEAQYVKRLLGMVAFRNTVSTNAHGWKTPQLKMRVNSQQEEVRQTEVSWHLYTPGTKGLSVTGRAESNQPPVWRLTWIKSDQKYRGDCGRMNIVWEDLANGWSKGVNPAQRGQSPARKAQGKERKDKFGEEKREPETKGGKVKTNKRKR

SEQ ID NO: 973748 - protein, 199 aa, Homo sapiens
MGRIFGLPPCIAESGGSHWVMAKVQKLVINNNAIDHGRRIYTRRYRLAIDSKFPTTGFWVNCVNSYQARTPAIDTGVSLRVEQPSLLPVFVDFVFVEAALARLHALTLCVLALRFPRGRLFSEGPCVNWRPLECVVCPQWAIGPSMGRVVCLSLSITFLHCALGMGCILNIPRLGASRRRFRARILSCRSVPGGSTHNS

SEQ ID NO: 973749 - protein, 142 aa, Homo sapiens
MLGGGGGGPQEGERKKAGTKGVFPRGKTGGQETEEGGDFPPQYKKRAAGGKTERVCWETTTQREGGFREGLKGGDHQKRGDHKRGNEAKNTKIITPPGGGGLNKKQKKREERDTTKKQEHEKRKRRKTMTTEKKTTEEREEE

SEQ ID NO: 973750 - protein, 72 aa, Homo sapiens
SAGKSVTFSPLLSSCVNMVRTKADRVPGDLQKEWWLLEPPERCWVLPTSGTEFDISIIEEMSMFLCKLITTQ

SEQ ID NO: 973751 - protein, 43 aa, Homo sapiens
VVTAEKKRNTNAQEKKTGTIHRRHDNVNNKQTTAINNTKLTDT

SEQ ID NO: 973752 - protein, 104 aa, Homo sapiens
MGVYYNRTLTNSEVQQLHKYAHPRLARVAYTGGPENNFEKKQVTFVYSRLFTNYLMPDVFSPGIFPNVTSAFFVFSNKGQTFYTFDQIVISYVGHLVYCQSLRL

SEQ ID NO: 973753 - protein, 222 aa, Homo sapiens
MCVRARAPARPLAKEAFYKNTHRAVGRARAGHQEGKGETVGAKDACFSIRENTAGAERTRGRGGISPHPKYKKSAARGDNTQRGVSRRHTNTLPRERGESLERERSIYTRGGALYIHTQEGESPPRRRDAPSRKYHTTEYIITARPRVHSRGGGGPTQQTQNHKTKKQQKSTTQPTYYSTKTKNTNNRPNHHTHNSDPTTSQKHNQQNKPKKNHTPPAPPAP

SEQ ID NO: 973754 - protein, 107 aa, Homo sapiens
SGESPHVKVVLAAAVFDGSSSDSQLVTWSFTSETVCPRKKEDHHQYDCPKDICLGSSENLGSSEIMVRPVGDPAWWVSVRVPQQFPEESGDINSGLGPRGLPVRRNE

SEQ ID NO: 973755 - protein, 102 aa, Homo sapiens
MPLQNTPARGARRGPQWGKGKTVGQKAGVPIGDTRGAKRKGGGEISPPTKKNRPGEKPEGCFENKFHKGGDLREGSLRGIFIERRNPKGKLRNLNLTPGRVG

SEQ ID NO: 973756 - protein, 72 aa, Homo sapiens
MNPFAQRVLFSCEHLLCLAVLLGARDTEPDGQDVNKEESRFRVLTEEQCKDCGRHGLGNCRPSVGSVHLQLT

SEQ ID NO: 973757 - protein, 102 aa, Homo sapiens
QLVVVNRLTEELGCDEIIAVESSLDAVKREGENYLRRDPTFPYILWVRVRNSYGAMDRELDPIIGKFVVHEVESTIGECTAAAVQSMEEKCSSQGKRHIRDI

SEQ ID NO: 973758 - protein, 114 aa, Homo sapiens
VVPCSLARVSLGGRTWTLQADNVIQVRNMGTLKDITRRLRVHQEIHPGKCTKVYENGSGSEICLVAERELVNQTSESMMDLGIFSSVMRKAEYEGELKYEKEKTFIIWWCPQDR

SEQ ID NO: 973759 - protein, 264 aa, Homo sapiens
MRRRPQMGAPPSHVSVPCSVVPKPRFAPHNIRAAKMKDEGRQKLKTWGMKNSGPPLHATPVGSASPHLSVRNPSAMSKQVVAAVPPPPWVISSSPPDSGRNLSVTLPPEHIMGANVAKKGENQGGAPKETETMSPRINRGVTPKITHHRAPDERKKRSGPTQGHKSKHKRERDNFLAPPRRTMDTTQETLSQPPSDGTTTQQFSAPTQHTTTERDMSDPGETPSQTREPRSAQPPADSEPAAPSRCSFPGSTAKNLITITQQQS

SEQ ID NO: 973760 - protein, 127 aa, Homo sapiens
DEDEDEDEIEPAAMKAAAAAPASEDEDEEEEEEEEEEEEEEEEEEEEEEEEEEEEEEEKKKRRRRRRRRRRRRRRTKTKTNEDDEEERRRRRRKKKDGEDVNAEERHATRGGRETEGEPPYETEDTR

SEQ ID NO: 973761 - protein, 233 aa, Homo sapiens
GERHSRDGRVLMIRATRHISRTPGIHTVFELKRIDRRASSSGVLTSSGCTRVTNLLVDGKTTGRVWLHQGQTARHRPQPQWGCSSGQSDTLRPCASSRFPARQSCRCDEAPGLGKQANEQAVQGDPKRPISPNKRDLGHNNTCKFSDTPSSCTKKDNRVVRDPRSICEEAFPKPTRVEERAAHRCVGRPWTQGLARGKTAQKGAVSHKKRRGERRLRTNKGCETRVTQDPLLN

SEQ ID NO: 973762 - protein, 82 aa, Homo sapiens
EGPGGLGRLRLLIQSRVSLPQIVLRQYHRFKAKYSIRRLVSPSSYCYLYGNMGDYMVAMTWYPHGRSGHRFIIQDAMLGQEN

SEQ ID NO: 973763 - protein, 129 aa, Homo sapiens
WCSKCGKIKARDLRGKNKEELLKQLDDLKVELVPDLRVRQSDMADGASKARLGYRSAPEIALARVLTVINPDSEEKTSGNILSKGQEVGKAPGPAGLRRARAVRSRFNKHEEEAVKTKKQQRKGAAVPA

SEQ ID NO: 973764 - protein, 194 aa, Homo sapiens
RNCTLYVHRKDCTCGTSIHGAPEPQVSLRPDHESVASESQYPVCSLLQACYRPVIYPNSYRCSNLWDERLCLIGTRACSAGTEVYRNTVRMKKYRKCKVECRHESSKFMCVETSLWLPPEKKAVLVPCLKAGHVGVVSVEFIALSLGGRRILPIGGLISQRPAIWVSGLVQYHSRSFPLRREPDNIDKGMIMSA

SEQ ID NO: 973765 - protein, 295 aa, Homo sapiens
VCLSLLVDLCATLYTCLPLRSSLLPLCICSDDVFFRCTTVLLPLAVPVPGGPFRPCVFTPPRFGFAPPIAGFSPAPDDLGARVSFGEGLPAHILFVKPLLYCRILSLGLVPGKYPPVFAPLRPRGSAPKFPPRLCHHTPHTPRVRVYFPGDRTLQGRSFPTPAWAPPYKVCDPPPPGGVSPPIMHDGVCPPPNYVLAARGSFRGIPLSPWLTPRLVARSPRYYLSPRSLSTWPKTSNSLETPWLSIPPVPIAPRVLRRHHEWAPAYFPAGPLPGRRRPAYPPRSSPVHPPRGPLP

SEQ ID NO: 973766 - protein, 291 aa, Homo sapiens
MRAFLYSARRCAGPRYLSVAYAFLRSEEPSLFSWWRSVARAAFVFSGVSPLAGANAHSPGVRPRRSSLSRFWGARFSPQPGFVSLTPPWASCARGATLSPMLPPAFDARGVPFPQWRAPVPPSKLRASLSRYGLPHHGAYFHSPFSAPGAGRLPLTRHTSRYTPCPGHYVCHASDCPSRAFPGQSRPARPFYYFGKRKRLVARHSGVHESCHPAFVRQDDVVLPKYASFCLFNEGQLPPRLGTLYIPSWRGHTGTRYYYVVALQHWKFAGTPGTNPPLHRNPGFQTEPHVA

SEQ ID NO: 973767 - protein, 83 aa, Homo sapiens
MVGSYRAWCQTFFALIWAVSVWALYSSLLGGPEKVVCDHKAQGIDEQYALGVLLLEGPSLCVLTMVDAHGTGYHRNLMLKKIR

SEQ ID NO: 973768 - protein, 115 aa, Homo sapiens
MYIIPGSYGANVSGNSHLHQTYDRTGSKTTWGMCRTVFIKAIAGEPQYCPRRTKHTTEPGAKATNPKAQKASPSAADTAKTRAEQSDNTKRDHTYAQYKHATEQAKKQKQQTPQT

SEQ ID NO: 973769 - protein, 255 aa, Homo sapiens
AVGREDCLRGGAPNWSGRPAVVPPPLPAGVLVGPPPVANEVAPEGFHVVKGRGPQWLYGCRPFVQEAFAFSRPPLILWDRRACRGARTRRAVARVGKREGARKSKTQQLQEGGWQQTPGKIGAKRGAPPISGARARCPKRRFQEDTPEAYRLTRRATHRSHTLCTTEGNLDSPWRTLHSWAPFPPPVISVPSTGGDYVRGCWPHTLPPGSARRGPRCHYATSPGPNSKAPFDDSRPWVPFPFAPGAPPDPSPNIT

SEQ ID NO: 973770 - protein, 427 aa, Homo sapiens
RGFPASTVLWHGSPALVPHPRPGRTHSQPSDHLFTAPSDCPKDPRAPIQQHRRKNTAGRPTTHPLGRRHDERVHLAGAPELPPGHQTAAHQPPDQPGALRHPTIYPCSTVFHVLQTAMHVCFEATCAKYLDSPISGATQGHTAEKHDDDLENYRGVDAVFLQDITETSTAHHPGTAGADMHTERAYTIVTHKTVQYRHQRERQKQGNAQHRTHNWCDIPEQPTPTDQAQAQKMAASDKLRMRDHETEGRKLRRRAGESDRQQASNTGRGRTCQQGLSEQVIVQTKMGATAAYMSLCLLLASLVLAATPHDTLHLPHLRADDPHDTYENKKGEGRRERKKARRKTERMAQEEHEDAKRKSGQQREQTETGEQGEERKVKREGKDREKRDRQNRKATNRKRKRRKSKREEEAEENKSKKRKKEEEANIE

SEQ ID NO: 973771 - protein, 372 aa, Homo sapiens
HWQQGSGTVTRKAWANDQLGTDAALIASWTSQVPYRYPTSDAQLDQSLLQALTHSKELFNNYLGRGYGTLVPVVVARTAASTGDGALNTTPGLEWGWDPPMRGIPRIQAPLNTPGNGVKQNTATDKWQTKGESAIVLAGLNTSRSYFPLETPESTAGLARPFSKMASNENNLVGSCGSNSGNCAPGLRGGQQRVYGPWRFGNQGAYNGRHVNRPNPKNSGEPWPNVHGAIVHDLMGRSQGGFATLKFRARKKREFTHYGGPETQVEWLWPGGTFTEDTPPLVQTRRGIWGATQTGAHSNAISGPSWATSASYRPPGTCLRMHSVRTHRPDSRRTITGTRDWPIDGFTHNEGSCAAHSTVSGSLTSKTTFPRG

SEQ ID NO: 973772 - protein, 329 aa, Homo sapiens
WGGCLAAPSVIVLRVPDVVLSLCAVVYRCVVLRHAAIIEVRKCPGRLVAHICPPDRVVILLSVSAVSPPIVPPPKPRVVGSHPGRVLKASSVSGSASPFRLRVVFNLGAARPISCGLLRGAAPLYLAVLWRRAPLLVRKCLCKQGTPHGGWPLRGAARESWPTRPQHTGWASLRHNPLGPDRSVFGVWVTASLPAFLLSRQRLPQCLHGINFPPPDIPPPPLLSITCCKDSFFHNLFSHQLPYYYNFCALSEYPVLLIDTPTRVYNPSHKNKNVEYFIQGPPCRLVFKDITSKIYSIIVSSSNLAIVYPYSLTVPTLPPGILGTPFKPN

SEQ ID NO: 973773 - protein, 500 aa, Homo sapiens
MAGVKPRAYWRPWSDEALPEYDACRGDMLRKQRSLPEADYHWALPVTCSPKWPLHLDVGNCTAPDDSTHTAPCEDIIDINSPCLKVIVAHCNRIIAHHNLQLELQQDLNTRNIAMHCQPYLDPASMSIASSSVSQLLAPRPASQVGMPHSTTKLAAQSTPSCRQRCTNLFLMATRRLHIPPGWTDCLYKHLNPRRPMLSSHNSPHGHCAAPGPSSSLYGGLCHLAFLAQPRTPSNPDLTDAGYRRDPRRNPSDTLAHPRRKTTQRVISERRKDKLTVICVLFFSPFSIKTTISRQKPKQQRVGRNTRREGSQIEQKQPETAEHQKEKTPRTSQHPQDQKGDTSDERERRAQQREAADAARASNAQGESERGNEKRKKKRRGSEEAAKRGEQKERAEGEARRKAPEEEDETPQERTDEQGYKAQQEAPGARTAGGGRSGEGAGTHTEGRRREETRQKGETGGELASDQNEEREQSEGPTSEGPRGDGTRGAKPEGRTSEED

SEQ ID NO: 973774 - protein, 302 aa, Homo sapiens
MRYQSDNREPTERQHGTFEWRTSPLAQNAGPPWQRTTNTRSIVPRPTNNIEETPRKRAPQQRPGPDTEAPIHDNEPAARRREAPTTDTPQHTPNSRIEQPEHAHGATTSRPPGAQHDPSRQPRHTAKHKEREQQGETAHTKRHTENAQRHEHTDISTQKTTHQWRHDTSNRPEQNTKAAPPSNKGRHTSLQTAPTIERRTKGDTEPRGNTHSEKYNVREKHIALGNGATEALPEKDMRREEGKDETHNHNSKDNEKTNRTTEDTNKQYKRKGPEERENADTDARGKQDATKGHPTHEHKGGT

SEQ ID NO: 973775 - protein, 599 aa, Homo sapiens
MDGGGSPTGGTVAPFYYDYETVRNGGLIIRWTGLHRGAPHPSSDRRYRKMRGNKKRRQTQLKMSRNSSTQAGRHPMNLGPAGNDKLAHDYLEAHPNNPGPKHLCTTTLTEPGHDRKLQTQCDHQGGISTTNCLVQPHAHYIQPATQTADSLTDHNTHHAPPNPRPATTDLDNDSTTRKQPTQINTHEHSPQRQAPNDASNKNRGTKANTAKNDNQTHTKTHGKTTTRHTHNEPKQDHINGAQCRRNINDRKKTTTQHTTHQPKPATPTNTRTQTNKNDNKTTQTQHSPPTTRQTAHKRPARHEDKNQRRGGRAGRKGRAAESHSRRTHEKQKWREKSEVNRQEPCADARDGEERQSQNASDEERQREARREGTETTEGTEDSVMNPRRSRRSRTRHAPNPRATRTHRHPALTPRSEAAETRRQHHTRPYSGAATHRPRTPHQRSARRASITANTSSNATETARHQTEEGDDRAQATRRRRRRALERQRHNELQSRSNRRPGSQHRGRRLEAARVASGGKPKRKALTAERRVGSERDARGQNEEASNSTSSAPRTARAPDESRKTSGRKAQRDERATRRVESRQDSQRRHHASSQTEQKR

SEQ ID NO: 973776 - protein, 414 aa, Homo sapiens
MQLPVPWTCGCCPGELSLYLEHQVRVGFYRLGGGLIPYPAASAVAYALLIPEDSIAKKPQLVTGGESFSPTSFKTTCPVVPDTYYPTVLVLGRVGGQTLLSDLSSLPKAHGASTGLHLINTCSMDGQITLDCLDPDQQYRDNMRCQKPRANYQMVTGTNGHTRKEYKLSIMKQHNRKLGQRSAGYKQHKTGSTILPPHNVGITTTTNQPMTADQHTHVREDQQPRGIATGLCHYLKTPPSSTPATTHHTQSKTNHARRPRMREEKRQTQTDHTQEAMNQTRHEQGPHDYDMTSMHTHADHHTHHSQQATRPTTTKKARARHDNAETRRRATEEDRGMRRDRPIAREYTTPTTTEQRQDATGHKQGGRANMRWEEELRNEESGRQRGMEETKEERTGERREQNEARATYTMQPPE

SEQ ID NO: 973777 - protein, 106 aa, Homo sapiens
MYLRVVRSINLLELARWHSLGRMFLSTRVTSTMLCVQCRDIMRSYRTNLQLLVTEGRRFSSKIQFGWRNHDTAQSCWHVDQGVRAIYISEYSATVHIGSCTEDVND

SEQ ID NO: 973778 - protein, 70 aa, Homo sapiens
RAASGLVESPPSAAVVLTLSPSFPQRMSGLPDQLNPLKEPLGFIKVLEWIASIFAFPPVDGFKGQTDNST

SEQ ID NO: 973779 - protein, 79 aa, Homo sapiens
MSWWGRAAQEWDLRDERRYWGFTRGTPWQKKTGADPHTKKTPRGRHRAVVSKHPETEVQEAQRGLNTEGPKQRVKQNCA

SEQ ID NO: 973780 - protein, 663 aa, Homo sapiens
RRGFLLQQCLDWNPCCSVPHPGRTQHSQPSVTLHRTLGLPQGPRRRSSAAQTTTDDSRLSLVAASDDRVNLAGAPELPPGLRGRHINRQINPGATTPSYVLPVHVHTTYRPPMMRLRHTLRHHTSFTNPMTRRDHCPQTTDWSRSNPTPVADIIPPGTPPHAPALTPQSALTRNRQSALSILAHNTGTTLPTLDLHNQATLPTNDTQTVSTTPETAIPALPKLSSTKHLAPTSNKRNIERRTRGQQTLAKPTGNRDTPHSPTQPHRTYLTCRNDPPHSASTPNHIRVCYIPVVHSHIHQHNDTTQLTTNTYQRKLLYILLYTLRLHTPPSTTIHKQLTLKPTTTQLPPSALPPQPHSSNTTPPREDQDTGATDHTNAERRTTTTRHSMTCKARTHSGRTPHEQLERNEAGDFRTRQTNTHHATQTPQNRTHKDDRQPTNGAYEPRPIRESTPERHAQPSPEPARTRAESRRARHGARTAHVPHNRGTREHGSAETAAGLEKCRSGSTSGAVVAQSVASTVVASMSEGRAREGSRGAEQRAEGRERGGGRRGEGGASLECRETSMGKRTIDKAGASEQVIALRPLARPESHKSDAEGYRVSHVERHSWEPTHAQRAEKAPIRCTQHAQDRERPPNSTTPAHPQPRTTADAQLQNSGTGQSESIK

SEQ ID NO: 973781 - protein, 356 aa, Homo sapiens
MRTPAVIQSPSPGAKFKNVTRAAGWISETETKFGPWALLPGASRIPQRAEQPGTDPFSRQFTAGDWQATSGPCGSPEDLRRDPRESRPGTANGTAWQMQLETKRANGTPGKTTVYPMAFQELVNTRIGSARGMHNHGGYNVSSYTPGHTPPGPRETGHQSNLWFTTSWSHNKAACSRPSHRLFHARKDSQHLELILTFHYSSHPPGRDLPTIVGPNLALPTLQTEGTTQYAPISAETDGAGTQPLDHSRSRNNREPTRPLGGATTGTRKPHNHATEKRQPTQPPTIQTRKTQQRAPRGLQGRKSTGQQSGQKGQRANLRTPRPPARTTATEAHSTTQQHTHKTDDETHTVEYYRAP

SEQ ID NO: 973782 - protein, 122 aa, Homo sapiens
PEDLSAETSGKRRWLNVVEATVMGDLSSIQLDVWIGTVGMGWWLLDSPHEQSSQPGTQCLLEFCALIWMLIEGYELWRRLNSMQNFVDRGRHLRIFQVSWEECYGMECGRVGKSLRYWSPSC

SEQ ID NO: 973783 - protein, 113 aa, Homo sapiens
MAFTFSRTLLARCLTLVCHCRAIIIHCADGERYIAYDVLMTDLAGNPGKPGGKYTLNALVLPDELIHAFFCVMFLCAAEWLTLGLNMPLLAYHIGGYEETSDEVARIYDPTTS

SEQ ID NO: 973784 - protein, 131 aa, Homo sapiens
TAEKQKHDGRVKIGHYILGDTLVVGTFVKVKVGKLMKLTWRKVAVRILNRRKIREPVSVVGKIRGEYSEAQAFSGILDIINTVARSSVHHRDIFMVMEYVSGGELLDYICKNGRGKLFGFNVCMYFVNSTL

SEQ ID NO: 973785 - protein, 377 aa, Homo sapiens
TTDTQCRWVLLTRSPQELSTLPVLYLCEFCLKYGRSLKCSSASLTKCDLQTSIQAMRFTSQGQPIIHSFEIDGRKNKSHSQNLCLSGTSVSYNHKTLYYDTAPLYSYYVMTEYDWYTGFHIVGYYLQGDRINGQTTHSGLHPNPELPTRRRGYGTLTDRRNIIMKLSTRGQGTHQGTHEEAPLPAHIGTHYPIEQLTVTKTTPEILNGGMKYAQTDNRTTDPPNNSDQAQQQHRQTRHQTSNTTNTHQTNHNNKSRQATPGKEKHREEPKPRPPDTPRHTTAPHAVYTPTAGATTRRTDDTTTGPEQANQPTARQKKNPTHEHTQPPRHGGADRRQTKQPSRHTQTAAPPTTNNATNDKRTKNRRSAARLPQPSSSH

SEQ ID NO: 973786 - protein, 556 aa, Homo sapiens
MVLKAHSLCQSCAALVAPSHSPTASPSASNIRHTHNNVAFFIPALHEFMYRIHMLHQSIQHTAGHNVLHMSHHISADAWSSAQSVVHSIEHHPSASQHIATQSNTSHTRLSLGYRHGSNQPHCIATGSSTQHRSVSRSVIHLRPQRVTCSSTGTQHIQSSQHTADQGTWLGSSQSIVSAPHPQRFNPITTQSRNKHNTQGHLHSHILKGAIAHAFPKHTWAPRANSYAFDIPMVAGLSQYLPTFLAPHYPTNWRNPIWQFARQGHKAMAATLLNPRRKTISRRDAQFPTSSWVSTRNLSLHWQLTHTPYRPTGTPLGDTTFTTHIHAVPLSLHSTVGSAIRRRHSTPHSQESGQTRETRPQDPNGGPWSDLPHGQLLRKTHLRDQRTHSVQQHNNYQGSVTTTDNAQHTDINKTRETTGDRMRTEANITSANQHMNTTQKHMTTQVQTRETRGAKRCTNRESYIPPQETTRASKKSKQTYTRRETQDHTPVETGNRDNRGHSNTTKINRCTKQAEEYPQRNHTTSSTHNQHTNQQTHEKRQNQPESTTTDRNRTIH

SEQ ID NO: 973787 - protein, 138 aa, Homo sapiens
SEKPDYAAGLFKADAGSFATVFATMSRSYNDELQVLWRRSIKTVGGSREGFVPKIMQVTGVFYVNDALEKWMWEELGNALSEVVVWGVPAKPMETSLWQCGKPCWIVSSIYGGFLDGPFQGYGLGYGGTWQLGDMNDP

SEQ ID NO: 973788 - protein, 117 aa, Homo sapiens
MRPILSDIRTEPVIAEAVLDRSKQQSNRSTIRNSEESKSSAPSRKHSETPNCRGAKAPNKMDITLVDRRYRESTRNQDRRQSITDTTDDREPNDERHDNTAGAATEDNARSTTVKQL

SEQ ID NO: 973789 - protein, 70 aa, Homo sapiens
MTTVVHTRFTQRKTGGDEHIGGWGIPPTKKRERRGDHGVVLDNNPQRESRGNKEGLLKTGHDERTTKKQP

SEQ ID NO: 973790 - protein, 265 aa, Homo sapiens
FYRSILLTPPGSPIGVFYNDRRSIAPLCSLLVDISSVTVGGVSPPRGRMFLGFAPSAPCLAPCALWGPHQGGKPPLLKSPSPVPRIARLLSYTFCRAAPLLFVNNSGGAPSSPNGPRNDPPLSPLMTRAKRVSRHAVFSSAILLLAVAPQFSAGCSLRRHRNCLSPSSRRAPPAFGATVRARWFPPLLAMRRRRESVVCECVSPQSLDSHYTVDPATHASLSKRCIVKIILLLGRLHCAWIDEDQDVPSLRPQGVKNEYRYPPLP

SEQ ID NO: 973791 - protein, 81 aa, Homo sapiens
RCPKKPPPSSNYRTPTPHNHGKPTPLYPGEPLSRRKISSSLIRKSPVQISFKLIAFSRHRTNHINIFFENTTYAATGIITR

SEQ ID NO: 973792 - protein, 102 aa, Homo sapiens
RRGFLLQQVLWTEPGARSPPRSAAHSQPSVTSSPYPRTGPRAPLRSSAAQTPSRRRISLVAAMTDRVHLAGAPELPARTQRPPSTARSTCELYASYVYLSMS

SEQ ID NO: 973793 - protein, 195 aa, Homo sapiens
HWSGYLRCTLEALRTVSYCGAQTRVWHACAPFVLPVVCVQYLRIPMLVPVYPAVRGWLHPRPWGDDCDPHLGFSQHGIVFRQHTHCQDLVPLPELGVNGRPPPVFQKSAPAFSAPKQFCQGDPNPFTMGLEIPKHSYGTWGSPPTGVDYISRPPPIGRLQSRRTHYSGTTLLPFALAINGGGNSSTHSFLTMSIR

SEQ ID NO: 973794 - protein, 164 aa, Homo sapiens
MRVWGLRAARGPQMGVKGDNVWANSAVSHRKKTRGGIQAKRKKADGGILPHPTYINNRARAGGEAPPRKSVVFVRTHTNHAREGRDARERGPNYRGGGTLYNHTEGGVPPKKGERPAKYTPKYDRAPRDDEGGTIDDNDKSISSTQDNNTKSQQRPTEQQQNNS

SEQ ID NO: 973795 - protein, 104 aa, Homo sapiens
MDVAKFLSTIKKHVLLHSHLGATRLERKTGLLDLPHQGKNIWCARVRKNRCGVSPQDLTNICVQRRAPACQSLFFRVHSTLFFPHRYEHPLRLAPCYSFQAGFF

SEQ ID NO: 973796 - protein, 110 aa, Homo sapiens
EKPLPCARRMRRNCSVVVPTWLNCHGGFLRAWVGSCRHLFSVVGCRLCSLVVICSSPWRSPRVNCAASRRYDWDGHFLVRELGIPFSISGLTGQHVFHGWELPTTTSASV

SEQ ID NO: 973797 - protein, 251 aa, Homo sapiens
RGGVLWAGCVPRSCVRDRAEWTEAIEGAVVAGDIARGVGRLVVAGVGVRRPGGGGEREVVGRGWDAGVEASASCGVSRLPAQCLSGGGRGGPVMLPRSPPVWVRALAPITALQFLAIRWAACVRGPPPAVVYCCDVPASSRCHCGWGGQTARGLWRRVFFVPRAWVPICSWSPTRLTVRQACAPSLRDNSPPRSSLRRLSRPEEKPRGRPAPYFVVAYITNGLARPHNGVLAPRAIFAQPMKKRELLSIKN

SEQ ID NO: 973798 - protein, 323 aa, Homo sapiens
GSRRRAGWVGGERWGGERGGSGGPLGERRAGVDVWVGGRNSTVWREGAGGGAVEGWAERGGRERGAGKGGRRGWWGAREEGGGGLERGGREGGGSERGTGTDGRAGGDGRGGEVEGEESGSGVGGVWGAGVAGEHAAGVEGGGGGVFGGGGARGGVWEERRGGGVGAGWARVGGGWVGPLGGAGVWGVCVVGQVVWCGRRAAVWWCGWGVGCGLARGWGARVGWGGAEEEGGGWLRQQGEVRGCGGQAPLWVGERCVAVVGMVRMVEGGPRGMRWCLVVVSTLSRWLEGECITLPRLDEEVLTRTPFSHLCSPLLCGGGRAGV

SEQ ID NO: 973799 - protein, 98 aa, Homo sapiens
FYQTTEGVPGKPLRVASTEDYFSIGITRPPEGEREIKVNFSRLDDKANLTEKQRFKNKFSISASTAAASTAKLLLHSVFMVNGECESFCRVESNAFRN

SEQ ID NO: 973800 - protein, 194 aa, Homo sapiens
GGAPPPRQSVSRTSAGATHPPVVDAPWTLEQQHVWRPIPPGSRSGLLSPVTPPARYYYSVRNHPSEECPAIYLVLGLTKDSHNKSFDLSHFCSGCEKPFGGVAAPTTKDKKNTVVLPPSPARMIPPRSKQGYIAVFFLKNLSNGESRTAPTFLVAPFRDKEPSFAMRNLSSRGSFIVDTVPCCETIIVRPKVMC

SEQ ID NO: 973801 - protein, 188 aa, Homo sapiens
CYDVCVESGWQTFKCYYYVLQANKNKNKTKKQHIVLGPPAGPLERAPRKTFSNPSGWGAPRAPIGIGAHVVPMTVSQREHSGSTRNERLQAVPQRLSTTTSPRGEHTDAVSAKHISRKGTPRRRTTKKRDSSTNRRSFPPGDDCVYSTLKSAPRSEDQHHDTDRNDTKSTHTTDTTTTHDDVIHHLHI

SEQ ID NO: 973802 - protein, 88 aa, Homo sapiens
MFCDAASGARLCRCGPRVLTDECVPPHGGAILITRGPPQVCLPPVAEDRLGVCFLRRVLVARTRPTSLFSSQAPGRKRVKNGPPPPHE

SEQ ID NO: 973803 - protein, 206 aa, Homo sapiens
GRLGASMSGRRVHARCCLAEGGRAGGCVSAGPRVAQRWSVLPRVVRGVVTHPTLVRYDGRWPLFTAYSVLPRAYCGPLTCVRWGRASSARIGGPVHIAPVLQQGLNHGDCKEARLGARIDPVLTALSAYDPRAVLQSRRAFPSEEVQFTNGRDLPPSVRVISCWVLPACYATGDYLAFSVLVQFRKQSGTFSHNGGEFTTGEDPFL

SEQ ID NO: 973804 - protein, 316 aa, Homo sapiens
TLLILGLLTNTLTIYQKKKKKKKKKIGGGGPKKIKTCGARGPAERYTVDSVRHTDAPHKKNRGHQQQRCCGSLPPSVKQRRAETGRVCEKNSRGKSRKRSNAGHVNNRGLQSKPAIITNNRPRRGKDGSRKRAELTERRRKHEREGEKKGRTSRGGGKTREDKEKGRKGRRQDGEDRERGRQEEREGRRNLDRERADNVRHTRPRETSGDGNRRERRDAEERTRKQGNRHNTKRKQTRARGEREHETQGTRRGERRESEEGKDEKETEEEEGEDKEEKKKEEWTQTQRRTAEKKKEDRKKKEEKESKRGGQGRTEE

SEQ ID NO: 973805 - protein, 166 aa, Homo sapiens
RPLSSAGTPCVGNTSLKGAKCSCPPYWPLFYRGNFFWHAVRGYSTGVLLAIVSCPPHRRGTLCAPPQLTPGVIKGILPRRCAHKIICGPPRHLREYIEEAVKHAADRKRSGTVPLNKCFRGNMFLPEQLAPQPNPLGPHRVYAHLGLEIILERTLKASHKVPFVAN

SEQ ID NO: 973806 - protein, 221 aa, Homo sapiens
MCAGAGGGGGRVGGCVRGCGGVPRAVWAGGGGLLGSCGAGVVGVVWGVGGGVVFRRGGGGADALGGGWAWSGACGWCFGGVLGCAVGGACCFSLGLARLWAWCVWFAAVSCGVVCFWCGVVGVVACVAEGALGGGRRVRLPAGGEVVVGLGGAGGGLWQRLVGVCCCVGVSGGPVAAHLPLLFPRRGGAPLMGLFDLLHPRPRRRSGVRSHFLRVRVRSSA

SEQ ID NO: 973807 - protein, 168 aa, Homo sapiens
MCRQSGCAHNIVGAVKLAVVGEQACCAVLSRNVVQERPVSFVVGQVSPAYVWAVLTTYQRGSKNTLWWFGGSFGLFELARCSLVIGVLPCPVCSFRLIIRPAQIGEKAFKGLIRGFTEEQNFWVATHEWAQMGLGPRLPDSYRVFLRGLQKFILVTPGHVDQRVCLRT

SEQ ID NO: 973808 - protein, 235 aa, Homo sapiens
MNDDTCANLCEKQMAHLEEQRGASDNSGAGVTTHNNKKQPAGETTARMLWRKKNITRGDIAGEKKAVRHRSKAAASKRSSNTLIKIARAAAAGQKTTTRKQRKEHTDDKTTQEAMKQTNRAQKDEEPQQKHHNDNDKRATTRSETPTHDVAGHKKERRASRRRRERTRRKAQQQNKRRRNRSPQHIQPDEIATQGRKRKQHTNKKNTSATRDSTRESKREKKAQSDSTPAARGDQ

SEQ ID NO: 973809 - protein, 34 aa, Homo sapiens
AHGGSVSSWILMLRERFYIIKKKWEVTSKMAKWE

SEQ ID NO: 973810 - protein, 185 aa, Homo sapiens
SSFADTLLSASPVASLSRRGGLGSHLFPCPPLWAAPLQLVCGFCTPPSVRCLFSGSSSHVGGLLAGLHAIAAPLWGTPLPSAPVAISRAPLALCPPVLARSTWLIWRPSPNAVVGGGACPPSPPHPMAPPPSRLASSLRAGSLNSLPSHYLPICFLVANRFFLRVRQVIFPTRAFIPRENPTHIT

SEQ ID NO: 973811 - protein, 75 aa, Homo sapiens
QEKHKHNLTNNVIKSATCACRSASHTLFEPVISSLFRLRCDKYLVHLPIPSNLPLDSTLAVKPCVPYNWFPHTSR

SEQ ID NO: 973812 - protein, 305 aa, Homo sapiens
CAADFFCVDQPPWVRSPLSGYLDASPGARRRVVSCVVSRRLLRCGLRALRPPLSSASRWVAVRAPCGAVPGGRADAGRCVDLVACLARGRLRRPRWRGCAVGGAGSRRRECGVAVVLLSVCSVRSRLYDLRSSAGCVVTSSGPRLFFLCLVGGLGGGWWLRSAGSCSTGRWCVARAVVPPRCVVCEATWLRVARCWLGFDEASRPRGGSGVRVRCDMVGVICGPGARSVAWLVGVYSCDESRVPPRLFVSCHAIWLIVASAIRAGAPEDSIGARMSPFFRAGFYEPGATVAFCYFCSFEDPLPQN

SEQ ID NO: 973813 - protein, 230 aa, Homo sapiens
MPVVHVAGRAVSRWCGGRAVGSAPRCGGGVCGVVSGGAAGLWSGHAGGEWVGGVDTAAVCRVGVVCVLWGCSVRVRGCRGVCGSGRGGGVGVRYEGGAGGWRPPPWWWWGMRSRAEGLAVALRREARGCSPCGGGGGTVVGEKVWRGCGSVDVWSRAGGVPACPSRDGGRPVHHAGHPRGGPWGVACPLVARHVSRMLPPAGPPCCQCPDQRWSVPGCHKSFFVSLTKKT

SEQ ID NO: 973814 - protein, 282 aa, Homo sapiens
MLLALNPPALHVPPEVLYLALCEFNPNFCWLRMILNVEWSGRSWMAGLITCCLIQVPEMGRLRDIEENEEFHEDLHHLLLEVAVIAGHPDSARNLGRMYPISRGIPNMLADVNEDTLRVDYVPGASNLVNDCSITLTHYPEPEVCPSAIPQTTAPTRHPKHTVLTPETRHTHTGKDYSDTRERTQQTGQRRNKTNAHNSLTAAQNTADETATKQNTTRERGEARTHQRQQRDERAEKAREQQEQKTGENKKTREKSPQKQTEREARLHRKADRRAQRHNGNK

SEQ ID NO: 973815 - protein, 224 aa, Homo sapiens
LVGAAPWIARWLRAQGVTEAPGRCQFHIAASIFAAPGPLGGASLPRDVLTAGGWPPPPRRWFTPRPQCEVSSHEQFFGGRTRRSPWGGPRPAVPSVARGSRLVVVQTLPGSSPLPRRALPAGRPCCLSGGDMPDPPCSVIGLSPPVQTVRRSHWGSRRLCPLLSNGLLYMTPPVASLTPLPFFPQPALWRFPPTACPSGSPLPHGSSWAGELPRGPFCPECCIA

SEQ ID NO: 973816 - protein, 49 aa, Homo sapiens
LRQKHRAASRGPPSLLLHEARVRRGGYSRSAGPFPPRPIASAAGERPLE

SEQ ID NO: 973817 - protein, 71 aa, Homo sapiens
RRGLQLPSFNGILGALYYDLFVVSFPICPPGTRIWVSLVFPPSPVSLFMSRPDPPCCDFPWYRPRRSPECC

SEQ ID NO: 973818 - protein, 149 aa, Homo sapiens
MPPCLTTWLSQQKKKKKKKKTVWPGLKVLTTIPEWERPGTPPCPTRHAWRIKGSPTKTTAGRSPWERLGLLTPNQQTNARRRHPGPRCKAQTQTKQSKDDHHGTPSLRASQQYNRVNKTTAHSGSPQEVTQGNRLLTSGPRLPSHMNKN

SEQ ID NO: 973819 - protein, 118 aa, Homo sapiens
MGPKRVVPSEREPRGQRKRGGDISPPNKNSARGGHTREAFREQKPRRGVPEGPTKRGTYHHTGAPKGESRSEIFPKLKRPEPPGGGPQRQANKRQPPNTQTHTTHRDTEHNTPQNPRT

SEQ ID NO: 973820 - protein, 121 aa, Homo sapiens
MRVSLSPTCFHLPTNYPPRRLIPCIHQTFNISWCPHPQTQWFTNPPLITHNLLCTNPSSPLKYRRTTIPIEPSMILLPPNSAISRLLRFTPHSLLEHDEQVESMTAKQPTNIIFSYMITNY

SEQ ID NO: 973821 - protein, 121 aa, Homo sapiens
FGAGVFVVPASNKENSAMDDVENGEARSLDYECVPECRHRCKEGRSKAARLGARSPWSLGAEDRSGPVDNSYTERASNETEGIIWGEDTLMEYAENSPRSDIPGTKNESWSALRRRKTGRT

SEQ ID NO: 973822 - protein, 248 aa, Homo sapiens
QARRQVGRRDGALNKRGTTKLWCPNTAGGKYRLYRRRGRNITQGEKNCVNWPNQGNLGNLRPRCRAPKRGETPPLGRRAPRSPLWPPTNPGNQFRDRVRLFFSIIWTRCLVLLDHNNGCPPRGVSPLDPCPKVSHTPWGWFPPSHLESEPSSPNCLPRILPLWRAACNFLLRLLRGVLHPHLGHEGPRGSPPSGAHAPAQAAFLRTQWPQMSRGRIITLRYSSTTFHSPPRSLFDKLFFWSFLTTSLE

SEQ ID NO: 973823 - protein, 194 aa, Homo sapiens
KKKKKKKFVCGPRLRRPLEETFFENHIRLGARAGPQEGLQWRNVWAHIALVFSYRRESPGLIEPIRGAWEILSTTIYKTHAPRGETPPEARVSWEKISPKMGRSRERGSLYGGDSISKTGGALTSAESASRDISSNIYSAPPGLWVENQRRLNTYFKNNQKNITPKQLQANSTKHNKITTPQNHNNKITPEEDR

SEQ ID NO: 973824 - protein, 155 aa, Homo sapiens
MPLICFLVLYALYLNNVRYRNLTKYSIQLSARVRKSRNRSELVLPRPSVLSLIAPPIPYVILYYNRIEVNVVPSRFIDSDSQFGPSRWYMTRYEVAPIYGGTIILSKLLNISSPVMPRYQASWRLLDVDNRVDTRRWISRPIRDNNGHHKTSCNA

SEQ ID NO: 973825 - protein, 106 aa, Homo sapiens
MPLPVALWTHDLGLADVDAMILVTRLDEAVSVYLFTEAPPNLVTSLFRCLTGDRHRFKRKTPVSHCMPSSPETLQSGLEWLRWMSSLSVAALKIAALPLGAGCQIR

SEQ ID NO: 973826 - protein, 101 aa, Homo sapiens
CGCSLEQRAFISGPLLSYLSGVPDTHDGRFDGHGHEPPVGPGELSVLGVVELKAGRKDIDYIEGGSWIENEHQFIFINGLVLGAGATRTGDCHYSLEARVQ

SEQ ID NO: 973827 - protein, 75 aa, Homo sapiens
ARQEMSVIGGRLPRCCGPSPDVSGLLSEEACAVLCSHDPARQEPYEGGNYNAAPSHRAGPRLEGNQTMTSHSEER

SEQ ID NO: 973828 - protein, 48 aa, Homo sapiens
MRPLHNNNYPNIDPPHRTHASQDETTDQLNSNTIVKSNNDAKRTTTHG

SEQ ID NO: 973829 - protein, 129 aa, Homo sapiens
MSPHGGAWPRTPNDYYVCPDSTTGYYLSDNLYYLWSRDTAHTVCLEAYLWSRPPLTGVLELFIFVRALLSPKMHVKFRNRVDLWYDCIIAASPLLTEELLIRGLSKNSCATQREGGNKTTTGCLYLVKS

SEQ ID NO: 973830 - protein, 168 aa, Homo sapiens
MGLGLLQSMPVVCVDIEPGYSYDDVNRGITIDDLLDAENYETSDSYYCDYLDCIAPKDYEEDFIKNMITGTSQADCAVLMVLLDVVNYEAGISKEWADPRDMPCLAYTLGVKQLNVSVFDNNGFQLSHLRARRDMRKMYGSQGYLRNIGTTRTERVCQFWLEWGLMLD

SEQ ID NO: 973831 - protein, 45 aa, Homo sapiens
MNGATGVKEHSVHDTAGVPKRNRGTGASDHPRGRGARVSQGAQRH

SEQ ID NO: 973832 - protein, 190 aa, Homo sapiens
TALSAPLCRELLWRGLVSAVDSPSCGPGCSHHVALALCPLKGPRGSEMLLLSRYFEGRLVCQRSQGAPSAVSGASPGGPPGVRRPKVWASRPRYTGALWSERCAKDAARKNLFGQGSPPRPFVGLEYPALVLSRGTPSAAWLLMVAPGCRPYQPSREQPPRLGPPLLPKKQRLLRVEHRLSLWVCQHPRG

SEQ ID NO: 973833 - protein, 91 aa, Homo sapiens
MLMNGVRSAPSTVSIFSENIIVSGVPKRRTHVPLARCESIRNRGGGTQLKTTEEEDAHPDVFFYVTTNIHKKNNRQEQEIQQTRKTTPHVR

SEQ ID NO: 973834 - protein, 496 aa, Homo sapiens
GVRCGRGRGRAVVCCVLACAEVDGSCGVCAPRRVWRRAALVRRGVALGLSVSLLSEAGWLCFDWVGFVMGAGQPCGVALHPAVLLRAPVGGCAAAAACVRPHGGGGRPAAWSVAVRGGAAMNLCRAAVLGFVPPACRVGRVGPRALVVGCAGGGGWAGSVRLGGGSCGWWGDVGGGGRGCLWVRYDVVGGVEMAGRPLGGAGVGVAVCGGGGRACVGWDRRSGGACAPQCCCWGRVVFGSAAGCGGPPVGGGAAAGGRRVAAGWILARGAPAREGVARRRGLGALGPGPRVGGSQRQWLCGVEGVRAAPECFAPRGCCAPPTQGRVPPVWGFAYDPGCVCVPPHVICLSPPRRSLSCRLVLFGGQHPSVSSPVSLCAVPALGRALFMIVLSVSVDKDALRGIQCGPSLPRARVRRPSAPGVSCVPFFFVAPLCVGFVLCVSGGPLLVVVICMCCSYRHTARCLVCVCPPLLRPQLVSVPSTFARAPLVQKMYHRKQ

SEQ ID NO: 973835 - protein, 250 aa, Homo sapiens
RSTSLIVAISFAGQSRRIGSIHPLVTPLRGSPPLCVGSPPLCAPPPLGAFAPFNRRASPPLFRNRPPPGGPPASLAKGNLAACEGSPCLLTGAFVAYPEMLKRSPSLSASSIVCAPLLPFLLRVFSLPPYVPPRAHVPTAVERRRPLGAPPRLPQGQRESPSPPPPAYSLVTPPLRPPFARASPPLHRLSRPTYFATRRFASPHVRPPVSPHISKALSQSSLHPRELSYILALGRNTFLYKIFLWTHMVT

SEQ ID NO: 973836 - protein, 177 aa, Homo sapiens
RCLPCPVVITLSLFRPAVLRCAALFPRSSARIAFPRCQYIRSARVLPAISSVRLLVLAVLPRISGTWHGTWGPFFPEAPGRPFHWHLLAATSCALLVFHPFFRPPEGPAVMIYSGGPSGMHPLCFPSELPFCSVIPLSVAFPLRGGHSPPRIDYPYSLALVCPVVTPLFASVISEFP

SEQ ID NO: 973837 - protein, 159 aa, Homo sapiens
MVVFRRIPSCAGSCQGAVLAITAIATSLWCRRPDPVSQRSIMSLHGLMGKVDVPQSVGIVATVSLEHARHSWRPIMLSNHRLACAGGSAGPQYRYRCDIHLDIYSTFVPMGDLGQPLFLGNARRAQITRFYSGAQDCPITTRPLWSIRAFSGPDDLGIA

SEQ ID NO: 973838 - protein, 155 aa, Homo sapiens
WPPSSERFWHNTRCAAICVPTLLEDVPPTLGGGHSLSTGSCRPTSLGTTPWGHQELRHTSCKCVRPHSAVSYSGGPRTPRARPLLARCLSSRRRCPLNPQGVTTGGTTLCRCASKEVGTHLNSTQWVSCPPVNKAPRGGIDGDVKRAPEGVVRVY

SEQ ID NO: 973839 - protein, 245 aa, Homo sapiens
IAELSAVCERRLSSTRLAQRSHHRFSLPVSSRAAAQGPSSHAGGQKPPALRKVIPEFIEVAEFLKKVTQHENEQCRNQSSVRVTTLDAELEFAIQPNTTGKQLCDQVVNNQLVRVEVWVPLGCRYVDSTRLFYMAYPSIQTVTQQDVHAHENPLQFKFRANFFPAPMSLRTYLQGNNPETLLLQVTRSHSYTDDAIWPARNCSLSASYAVQGQYGDPNHRDPSRQANWAQDRLRTPGCLAPLTLT

SEQ ID NO: 973840 - protein, 58 aa, Homo sapiens
MIKHYLTLRHDNPRTSILLFCIYQQLSRLRDKKVFKGPLCPPPSFKSDQQIGKHKQHN

SEQ ID NO: 973841 - protein, 285 aa, Homo sapiens
MSDPRTPNKVVRYMPPTESNVTRPWTDRLPDYMRPAGARSLRMCGLMLKLTWCALGRCLRASFISLCQNLASSEDTEPNDRSSFMLSISASGDCPIVRESSAHDAPIGDPSHIRVAVWDPVLSSIGLGCWLLDLLSSPVILGPSLQGWSSRLPPRWYDGHLAVSLGDTYAQPSCPPSLPDACREHPRHSSYRVSSAPREPWRSLKVRHSCATPRPTLTNTPRPPATNTFVTTRDDPAHASGTDPHSQNAPTHARPPHAAHDRLTTFHGTPPPSRLTDTHPSHTSC

SEQ ID NO: 973842 - protein, 152 aa, Homo sapiens
CLYPVLWSPSFVPHISSTWAGKTSVPRCYKRRLSLPLFILRARHEICVGAPPRKFLWLRVLLLYSGIYWDAPHEGGCFCYHPASPGGLCSLVGPQLLCVGNVVLSARAGKHLAGVHGCHCSVAFKWLAHLSAQMPPPVPKVKPTSFLLSNII

SEQ ID NO: 973843 - protein, 142 aa, Homo sapiens
MLPSQQSRDSTRHMEEMMDNYTRREKTRHQAKTRHSIEATHSTNNKPDTVRYRDAKRGLTEKREEEHNKKRREMRQRQRERQQERDRNELQRAGTADTETVMKAKRQEKREAYRRRIGYEGRRGGDRRGKERKKQADGGWQR

SEQ ID NO: 973844 - protein, 226 aa, Homo sapiens
MAPGCLGFFSTRTAWVVVAPLVRYCFHASVAVDAVCPPRVAPIWNRASRALNHSMSLYNAGLTVYVGKFVLRFFSAQNGRVCLVVAVIKFTPPMGPPLIYRTTTRYAVIDYNTTTTPPLLVVPTNSPLLFAKRFLNIKGPCNIFLIFYEAPPKHLFRQYTPNVGTLDHSPHTVLILVNIPLDSPRISRHPLLNACPNERSSRYCHYYSLYCASSLSAELTERKQTP

SEQ ID NO: 973845 - protein, 179 aa, Homo sapiens
MDQPDPEEVTALPSQQVSRETYSRSGLRSPSVDLPSSEDMPLASQLTWQTIPRHNDRWTVVNLRMMTRGIRNSDSEQFTIYNTEIRLSKRNKTIHRGNDTPSTPCGTFIRYATITTIKSENQKHGCTHTYHTDRTDITIPEPESHTSHKNPYNYGHPTRTYFQFTVVRNRPLCAYPCSI

SEQ ID NO: 973846 - protein, 330 aa, Homo sapiens
MWSIICSEYPSVTDIFSLYTYSYFTTAKVIYSNVYVVHIDWLGVETHKRYDRGHSPVVNAVDACQRNISLLLIPVYVLHLLYMVRLSDRRVLPLAPVSGALAHTPRRSGGLGVGFLSRGVCVPAPSCRRLYGDLLSGGRRPAGGASRVGSCWWLRSLSVPRQSLSPVSLLALLAVSDVSLLSALSVVGVVFSWCLASVVCSGSRRERGVRARSSVLLVSGLAFVRRAGAPALRGPAVLVWVGGRCVGVGGCVGWGGSAGAVVGAGAFLGVVCSARACRVLGVRCPLVVGCARRSSVGSARGSGSCCLLSLRGRLVWSCVLVRRARVVGVA

SEQ ID NO: 973847 - protein, 206 aa, Homo sapiens
MKTITKTRKKRNRLNSVTNCRSAHGGVPLSVAGHLARLCAVNAVEYGAFCLYKRPLVVVNVCSLLKYQVVACCSLFSRVLFVMSGRHESLKCSLPHAKGIVGTHKWGHWYRYSALRAHPCGLHICAQILVVLDVVPTRIVLARKRVPPCDWINKTGEIPKRSEPTLDGSPCRRILSVQYCPLVWSTCAFMKTGTSTTLPRCREPLI

SEQ ID NO: 973848 - protein, 302 aa, Homo sapiens
RRGGDEKKTRERKKRTAARMVRGLTGAPRRGVHHGLREGITQVQSRGPVRQARGGPVRRRVRASAHCPRPPWGPTVNGTGRVARKVCALFVCKLPGALHSLLLLRPLLAMVPRPPPLVGAFSRFPRPGTLPVFDIEGPAAQRRGFCLRPTGHRTALLAGWCHQSVTHGLPHDRSRTGQPHLFSPLGPRPPPLVTLVVSETTRLSHNPCFTNGPIQMVDRISITRGLKNTPTAPFDPPANSKQIILLVAHHIVYNFSASAAFYSYNVFDKLNAIPFSRSTNSAPKTILPQTSGPPIKHLKRPT

SEQ ID NO: 973849 - protein, 150 aa, Homo sapiens
FAVGSPAGGFFRPPFPLGVPNFLICLLAIFQPPTLPLWLSAERYFPVKGRGSADLFLCRRGRPRGACVEALSQGTLGTHLPGPLPGAHQAPLLVCPRTPEQFLFSSLGNHIQEHKSSPEFLAPSRCSTKGNSFTTYCRLFSLWVAESPPI

SEQ ID NO: 973850 - protein, 233 aa, Homo sapiens
TPGCSCAALGATSAPPWAPAAPPSVFSPGPPRSSVPPGLPRLCVVPHRAHKAKSEAALGWDETRFVPAFLWYKFLVEVGRPLCLNPLLGHRPGLYQGSFGGHPPFGWGTLSPGAAHPFGDPFTSCPGYVRPTTPLRVGVLFLTLGAAQSSWLAVTVTQRSPVLLPWHSFVKRCYRYIFYPFISSAPPLFITRAVGMTPLCSPFSSQRPPYLTFSKKSVYPKPTRHLIDSSSTQ

SEQ ID NO: 973851 - protein, 248 aa, Homo sapiens
SSPQALVCVRGLPRGVARPVFTPSGIFRTGPSRGSRVVDALVPERPRSRGLRRGFPALPPFCPRSPPWGSTAPHQRQSCVAVSDKGVAPLLAIKAVEDPPQFFPSASPPPRCQNWVPGQAPLSGAFSDRYPVGGRFHVCSYEAPHPTGGRSLKPGVPKHAFLSGCHKAHHTVGPAQQFLERVATRNHLSPPGERASPPLYIHWLRTNQSSPKTLFVPNAPNIKLSPITLVFKTNPERLLAPPPKRVTR

SEQ ID NO: 973852 - protein, 108 aa, Homo sapiens
MCLVLSSVDRPLRSPAVFTHSYGVSPSLDPSPIFCVRASPSFCDTKYSFPVPSRNYPRALPPLPPRGVLVLFVRRLRNPFIFSRPPGSAFVPPGFLMRPHRFFQRARP

SEQ ID NO: 973853 - protein, 105 aa, Homo sapiens
MEAPGSKQGNGPVLDHRGRISAQGPCPLRPPAASQTRLPGVRSAHFQAAEIGRSHQSLQFLSISVDLPQLFSQTPCRLKWLRKFTRRALPRRASILYISPQISQF

SEQ ID NO: 973854 - protein, 185 aa, Homo sapiens
MGFRLLNSSLESRHWKPPNFQGYPCTCVATDPGNTQEVSSPRPPPRRVAICFSEILLSSIGISSPLLHTPPYANVLLIVRPSVPTTLFPHSPPPTLLRPEATPRSGLPQPALYPLLGDTPPSGGYPCHTCAGRITHLDGFYTLLSARTAPLFPIYPAVLDRPPSPRGDKFTPPLLWQKLHTHSLS

SEQ ID NO: 973855 - protein, 218 aa, Homo sapiens
GSSWTVSLCLTSLRKRVLFVLFSPKWSAAGAPPPVSCCLCFWGPPPHFGLGYYFPCEGILCYPPRVLPSPAKGWFSAFHSDALFSGPPRFTQYRVPRETRACPLPPLGGSPGHPKEAPAEPHQIPRATPVPHNEYRGNAQGDHSLLAVLFQINKDISVFDHPLGVILLILPRRVAARPFPPCFPGGHSACEIPPWRAPPSRRRHHHAAHDPRHVPTTI

SEQ ID NO: 973856 - protein, 117 aa, Homo sapiens
MSTPPPLCFYSHPGWRLQKSAVFHTRCPVSPHEAFTSLGKPSGASNIKSPLRLSPGCFRPPILLAKPIFAGLFGLLLVLSPPPKQLLVDTLLLPSKKDSCRNPHSKGLTYVIGPSSL

SEQ ID NO: 973857 - protein, 279 aa, Homo sapiens
TKDHTKRRQRTGQGASIGPPSRRVEITPRRACPGDPNAGPHKASGPHVMAFAAGDSPPPCPESTKQGPPSRQQPHPANNNGLRRHPRTEENTALWGTSPASFSAGWPQSPPSGPPGEATQRAHSGGGTTKRSRAPPNNWWTHHHRTLHEVITPPHALATAEQLQQTPRAPGGVKPHPAGAKLLLRGKHCTPRRQFRTTEEHMFWREPPRRDSLAGIDYTENRDPPRWSECAHPSPPPREREEHCSPPEVRHRYGQAGGENRTWNGRRPTRKAHGSKPFF

SEQ ID NO: 973858 - protein, 140 aa, Homo sapiens
MGSAQNPHGCGGQPPWVLSASPKPFISECGSVLTVLAYALVPPAGYPPPPRFETQRATHERFWGDISRSVGHALFYEGLPTRSHPFSIGGPHHRTRSPKDGGPKGAPVDHPGVQDKLCNGPRSWNVTTSRLLCRNTTRVC

SEQ ID NO: 973859 - protein, 144 aa, Homo sapiens
CRYHPPIQSRRRINAHPKSLGINGNNLFYRTCGSASPEANDHRPALNSPALRLQGRLFSGIPRGPLEDGGLVKDHPRPANIQYGGHPLAHRRRALAEHHKREGRDKSGETPPCSRRCTISARGVRPRPPPPRDDGCLKPQKMGG

SEQ ID NO: 973860 - protein, 176 aa, Homo sapiens
MAILDGAILIAVLPIIGQIPTDGRQTRHQNLALWTTPANVPPKKGCATHYLIVSPRCLAVCRSFSATPRAYTLNAFAGRISTPSCLFPIFQEASPVHMESYLAKESPSHLDDRDNLHFVWCYSIADSQRWCNPLPPPPCCYEEILAEAKICRRPPPPRSHSFRLGTNPNVVPKPPT

SEQ ID NO: 973861 - protein, 253 aa, Homo sapiens
MAPGRGPAECSRPPRLMPPAPPPGGAPTVSTMQAPGVKKEGPPPGYKRAAAASSMQLGKPPLYVEASLQSHTGAEPVPEIYAPRGAQDPVPEQRTQPAGKGFAQTRRTTKHVGHDETSPDRPPLRQRGPQKVYTPEPPPPAFIGAGGTERDFTLFAVPHGSQMVIQPYPRLGLQQVTHTSVSTRSPVSKKPNYLLGDHPLEDFISPRGPSCMDRELLVGPQLSCIHGRNHAVAPHIGVAKPCGPPFQKTDQHR

SEQ ID NO: 973862 - protein, 296 aa, Homo sapiens
DNGTGLIPFSLLRPSSPLVYNSASTIWRFIIAVVLYSSRVVYPPPLMGALSPPLKMVLLLHAPTSQRGAPCNLLHDASTLSLYNAVSALNVLISRDSSPASGPHQIVPPGWYCMSHFPSQSATVGRNNSRRTLLTAGAAPPRLPPRFCEVPRVIPSVVLGLLLEQRPSSRGNNICEISVLLVPHTLLLLSTRINEARQRLFEMSLPTVDSHPLCFLLPHSGGAHTMCSPYAGVVQAPLFEPLVCVKAFTHTLIENGSWLLPNMKKALQIRRVRDNTTTWLKTVDAPNESKKPPNKT

SEQ ID NO: 973863 - protein, 161 aa, Homo sapiens
MCRRQRPAAKGGLPPHPLGGTTSFQGATFFASPPPGFSSPPTNAPNVALAPASLTGRPPPRGVPPVARTRKRRFVGKKGPSPPRDAPARNFPALQASTPWFNIFPRTSNWGRQEALRLDGSHDATHGAICDSYYPRGVVRTQLRPWGRPPGSSQCERHHNR

SEQ ID NO: 973864 - protein, 217 aa, Homo sapiens
CARPIFKRGREENLRAGEDIFLRGGGERQDVFRCRRGIILPRDPPHLHVWSSPDGYHDGMVVVTVTGMLLPAARCNRHCGPVQANWSGCRYFDASARDAKNLFGRVRVRARPLFVACVVRPPPCRLFKQNARIGSCGGGVRTNCIRANVIVRRVSIVPHHHVPSSHWAVDHAVQVVGRPLALSGYVVLDKAVLPHARGYNNCVCRTPRSRLAPTRSS

SEQ ID NO: 973865 - protein, 161 aa, Homo sapiens
MCAARARVPRDTGVCHCFESWLGTPLLRAFFEWRCPLLQDWTTLLVGRDYPRFLGDLFPLVFRANIVHPVGSPNGGITTPWRRIRSPSGGLLPPRFPQAGAPFAPEGPPGCSSVVPPHNPPFVRQKEELFSHRQRTERVEILMRAMVSLCLLATRWVNQDH

SEQ ID NO: 973866 - protein, 294 aa, Homo sapiens
MKGVGVVPWLLSDTHVFHYRGILHSIAYKLVNLCAHLGAASAHVDAGSSLPVCLAVHPCIVGAVLPSWGPPRTNKGNFLLLKKIMCLPLWLNLDGRPNFLSGSCEPPTLCEAVCQHNGGRALPDLAHVCSKYPSRETGTPTAAARGRIKPGATQASGHGRRIPDRHTTSTIGSPRESSPRASPPAVNRAHVEQTVLHSCFVEHGRHMMDYVYPRSGYQTDHTQIGSTRPSANRPNQFFGRPLLWMMSMLRRARHIRIDYCCKTAVLLLTCEATRGPHIGIANFRAPFKNPANID

SEQ ID NO: 973867 - protein, 298 aa, Homo sapiens
MSVSSQVFSQLVSGGCVTLCDLVRSAMCGYTLRNNYQPYTWWVQPLCHRLERIGPPRGSGVVIFRGFSQSPEHFKLRESGHVDPRSSVVLFYPSGNLITIMVGTQCYRSGSNERTQHRGGSTQGSYVYALPNTLVAVAEVRTATPGRLAQELNPAAPDVGPKNPAGQKRGPQGGSGGAGTVTPPGSDPRYLRSKGLTRHNSVTDEDRYHNRFRNREIRTALRGKTLPQLIWQQTLTPTNGHLTGLFHVGGHVHQNKLYNKGEVFLYYLLVLGVGAIENPQPRVCFQDHKKRKNSRNKH

SEQ ID NO: 973868 - protein, 70 aa, Homo sapiens
MPPPTLFDEDIFCPTPHCPLRSPGRLICDVHGLSCPSAKIAISHLVYGARLPGNVLIDPFKKRTHNAKHD

SEQ ID NO: 973869 - protein, 182 aa, Homo sapiens
MRVSTEDHDEDIVYALCEIPVAYIFLEKVFLPQGGFFNAQAWGARQMVPPLGKSASWIPKECGNPLSSIVGPPGPSNGTPRGFNIHRKAKGKKHPPPRGSVKGKSHFRGPKTQIGRARADPRAPPWDSGATCGPWIYKRPVDRRPRRQRWPSRVALTPGPNNIGIGTPPRLVEPRQSDSMPM

SEQ ID NO: 973870 - protein, 297 aa, Homo sapiens
PPRREEYHERRRQTGDQNSPARTRSGPPFRVLDNGPFKGADSSGTKPWLPPAFVYRAKRVLHGHKGNLVVQAHAQQPSWRFQGPQNQELRLETVVSARGGIAVSCRPRAALGLPKRHPRRRTLAKEAALFLQNEENRLHAISDKHPAFYNTWRGTPAPTRGHCTPPSCQNRASRGKPTLGPTWAKREPKRGDQRTDQVKKTPHVREWVINLPSRSHGTLENARASEATLPYRAPNLRSDARKEPLPPIRVPEDDRTLRRDGRNNDFLTTRPQRKKTVAGKNRAKTIWAPISLYTNKN

SEQ ID NO: 973871 - protein, 149 aa, Homo sapiens
MGPPRLVPQGATGSPVPGCFPRSVLGPVSGTPRAPVTIFQRNSCCYASVPNHPIGVFEAEAPPLLAEHLKARRPKIPPLNAWLTNTSETLLCGRGPQLSPPDSPPSLGGERTCFTHWAESFRALWGYVPPGDTACSPPHRRFSIALTNH

SEQ ID NO: 973872 - protein, 315 aa, Homo sapiens
SLLKAAKTANKKERTTRRLVHCSPLPAPPVTPVQGAPVDPPIPGAGNVPPPILGRTQNGGTKHTAVPSEHTRMWRPQKKGVRRAAPGRVTQRVRTVFKGAKFSEIRVIGHKLCRHPTPEPVFAGVGTPHQHGTRGHSNTPPRGGGNKVAATASMGKPDRANPQGRYHRANVTSPIPRPSVSHEIHHSFHTGIISRGAFAPKKGSHEGQQSTPLDRQAAARFRLSTTGGPPDPTRGGGAVSKRGRTMRRRGAPSTTLLIRGKTRGEHPGADVFIVHSHGLSPGAVLTTRWAEMSAYLPLANPILSGPPPNLVKTQK

SEQ ID NO: 973873 - protein, 119 aa, Homo sapiens
EERETDRTRSFPKCAYLPSKSPAVESGGCSTTLAPLNYAAVVNNADRRASHGVRAPRQSRCGTQGVKPAKNGGRTHPHWVWNPSRKKGNKPHTATKGGEHAPPHSRGRSTPHNSPGGED

SEQ ID NO: 973874 - protein, 130 aa, Homo sapiens
MESERNSKAQATRYRRPDVCRVTELLRPRWQHDPDDQSGPPLTTVGKEARWVYLPPDGGRSRMKMFSRCCEGATVYNKGRALFNLREGGLKLQPYKLLVVVIILNRGKLAPFLAHDDIPRWCRSKSIGPF

SEQ ID NO: 973875 - protein, 104 aa, Homo sapiens
MPRWWHHHSEQGDLRKLRDEPQTPVNEPQHVRARPITRAPPVTLGKRTTLRQRVGKNNNSGARETNTLSPCVIREPPHRVAHQCGPPPDVWGFSPGKVTPFVEW

SEQ ID NO: 973876 - protein, 210 aa, Homo sapiens
FKQLRYKLYPHTYTSLPEQAEFYTQALSPKINDDPPGQSRHSQTLPETNPITPVVTQNLSSVPPTDVSVNLPQKSYKMNCNTGNQLPRVKQTTLHPGRQNTSGFGNLTTMATLAVPPGISSTGVFGSPPVPPCVGIPPAPRTKKPVGKTAVVVKSLGSIYTTLFGQEHTLQCGADYFKTQQCSRGMNTRIDVFQETFLGYPRAMFLHALV

SEQ ID NO: 973877 - protein, 187 aa, Homo sapiens
PHEVGTVGRGSSGEDRQFSLLCNKWVLGRLPCRFAAFAGPVAFARVWLTSGATRLCPQGGFLIPEAKTMLVARTICLGESKPPVPKACAHRVCPRGTPISDGEKYEGTPPRPQGPERSGTTSGPPPGEGPLVWEPREGGHVGGNDEERTTKWGRDEHAPNQNIERHLHGPKPNPGVTRCRAENIALS

SEQ ID NO: 973878 - protein, 210 aa, Homo sapiens
MELQEHSTRQQDGRPGRMVLIHATKRRVVVCNLAEHISRERKRLLPAPRWGPRVSPSLCHTKRAWVGVQYKQLETVTLSDVQRKAIRRKRRQAHRCARCAVPRTAYRVAAEHGLSGEPERQAAWVRADPQREFPKNQGPTKQGVGTPDNSRGRQNAVADETAAGRLKVGQCNNYGGRGPSINRAKQTRCSEDTPDSTAGWRTQRQERPSQ

SEQ ID NO: 973879 - protein, 216 aa, Homo sapiens
LAKKAKVRGGQRRKKPTTWYGTNSDGPSVVMQKSARHPLAHRRKLPSNKGGTPGGKNGWVAQTGIVRAFRVSAAVNRGESPPPGRSVPAVVAVRTNCRCPPSFRQGGAPPQTGQRPLCPRKSRGKQPNSITSRNRAEGAKNRPENPLARRNDRLPHRGPPRRATTRSTKGAPLGNSPQEKLRGAWQHAETCNSSNQVALGNLFPPNKRLGSEIYSG

SEQ ID NO: 973880 - protein, 77 aa, Homo sapiens
MGIVFPGEKFSLRCPAPTGTYPPFSACIFHDPVDSCYEDITYMLRRRINSHAPRPDATESLSEKRPQTSYTYTTQSK

SEQ ID NO: 973881 - protein, 141 aa, Homo sapiens
REEPRKLHKTEVGPPKRRVSRTPSMLERKDPAPRGSHTGYRPFQGPTAWVSKNSVEGAHNGLVHNGGPAPFIGTLWNFHIRGTSPGQTTRTLKPRHPSLLFKKMSPFKGESLKTWGVITPRAVQGRDKPLFSIFPLVRISL

SEQ ID NO: 973882 - protein, 138 aa, Homo sapiens
MARLGYAQPQPPGSSDSPVSASYSSWDYRCMSPCIANLCIFSLEISVFTMLPVGVELLTSSDPPPIPSLGITGGSHHVWPYHSCLTKLRDKEYAIKSFLFEVQWFIVYSRGCTIHQHHLIPELHQSPTQGRAFSPNKT

SEQ ID NO: 973883 - protein, 231 aa, Homo sapiens
AHCRSTANTNTYAPVVVGPSLLEEYMPRTGGSPPGIIPGIPARRSGVFISLGAAVVLFSPPWWCHNHSENSVFSTKGLSWFYMRLSPPPLGGAPMVLGVFYRKQRGVPLAHLAFCGAQGMTKFLTRHDWAGTRALGGCTPRGDFCPPEAHGDSSRHTLVAGGEAAIQKICLHVQERSSRPLTVGAPPVFAPRWCSATEANGTAGLVRKSPHNIWGGILCAVTDKKLYSNPC

SEQ ID NO: 973884 - protein, 155 aa, Homo sapiens
RSIPCFVLSRVYRHWVVFISPVAASCCALIVYRLLPVKFFPALINKIRGEYSGNLQMRAKTRVSFTYRVVVSKSVALISPRPPVCDYGPKSWVAGSKEPNGLSQKNSPLYDSKKGEPNQGTTTFVVGPRPKHFLLANSRPWAILDFKTEHNDPCC

SEQ ID NO: 973885 - protein, 88 aa, Homo sapiens
MAPHSHWETPRRVVSEQRRPTQEGVRWEEKDILAPRRMHTEESSDERGPREEGGTIKKKMIGVNPCAAREISRGVAPRPLKKKIPQHN

SEQ ID NO: 973886 - protein, 317 aa, Homo sapiens
GLWKRTRLLENNRKINQESRPDNKRDRRTPATDGTQRYCVARRSVAPAGLLPRCAHKFWCERAGEVLSRDVPYMKLVVRKALSTPALLRTSMARHRWTPCALRARVFLASPLRGPMWPSPEVAPCLMGPHRRLSITSQSVLVWVGEKHNHVASPPVVSRRTPCGAGAPKVCPKVRVGGRMPHLIYGAALGPKAHSLGRVAALSCHKLEQHPMVEAPLVRAWPIIQETQHPGGWRVSTQSHCGQKAPAGQCGTRVPPTVAPPQIFRQGAQGESLFAAKRAPAPHHNNTRRWKHRRSQKPGVCQQRPLIQCMQFTEQVC

SEQ ID NO: 973887 - protein, 265 aa, Homo sapiens
MTTRYVQEPDTNTNSDGNYAAIHPCDGSCSMQTFRELFGIIINSAGYVSELLTRRKVQHGTGCARPPDFFAYVAVSFNKEVSRNTGLASDCNNYGWKPRGIRRGSAVLGKTPVGGHAKGPPGGMPDAPPPPRVKSPPAKNSSQKPAGPHRGYPEPPAWKRRGDSPSLAATHGLRLNFVERVINPRPPKSKAAITCFVWALDRHPTHQDTVRVRRTYFAIGAQSAVTPASSRGNARQGDVSRPQTREYAEQFLGQNKHLERGSRVQ

SEQ ID NO: 973888 - protein, 132 aa, Homo sapiens
DSLMISPSAVDECFAGCVFPLIGGFVVLYPSGVWSIVCARSGWFAYHRFPVGAPVCSFRRHRVVCFVRSPPQQWVILLLLECALFVAVDRGATLCVGTRVGFLLFHHKSVETATMPSRLLMLWEKSSLSRRE

SEQ ID NO: 973889 - protein, 289 aa, Homo sapiens
CVSVYKTDRRATEQGKLREKRERRKDSSRQRTYSAATWCVSILIDVHLYVVCGSVNRLLSFITTSRESVYAGLSLCFIYNRVLISCWLQEDNGLCASVNIVELHGSCLLWSRCFLFRSSPCVGAHLHLAHMAVQPQKVARLPANCVRVLGHSIIVCRRFNPVLSTTQEPMWGGVCPKDDAWVAFSRQAAILTTVQFAHSYSRVSPLGKSSTRSVQTRSAIDLGEICSPSHAKKAYLRSNCTVPPPVNPRCSHTVQYNTRTTGQVLVTANDEGVPVLCHNSHKSSAATSW

SEQ ID NO: 973890 - protein, 118 aa, Homo sapiens
MFVALLMCEAVVPRAIKMEIVARPPLFVSWGKIVCRLRSCMWLTHWLCRAPSVGTRVYMISITAALSLLRDGWPHNLLLRSFFLSPRGVHLGVRRPLFIVAAKVLTHVVDMISPLFVR

SEQ ID NO: 973891 - protein, 99 aa, Homo sapiens
IWDRPRFIEPLTRDFAPSASNPPAAQCRFCLPEHGGIIRFFLAKSIPRKDIPEVCVPRVITTRALLANIWLSHSVVSKVDVSSIRDVGVAPSPPQADSM

SEQ ID NO: 973892 - protein, 85 aa, Homo sapiens
RIHFKYTGFVCFCSTECPMVGATKNRSYVNSWLQFQVWNEMNRHCNGSWDNKKETCEEQCEKLSKSCRNRSACHFKNTFSPIANT

SEQ ID NO: 973893 - protein, 200 aa, Homo sapiens
DPGRGDRVKRGWYETEAEHINGSRWRGRHLLHDVRGYMVSPRLCPPLCAMGLGLPEVNGPLGGSRRRMGPARWPMCAYAGEDPQTQGGRKNLAAVRRRIKQAVKKRSIHNMCVRQRPTNRGGVSANKFAWGNQNGRRGAVPPALALQLGFGTRLSPPHLGSCFEGVAHRLPASLEKQQGFIIQGSPKHLRAYVLVPRDNF

SEQ ID NO: 973894 - protein, 324 aa, Homo sapiens
FFRTITAEILVDIVDKTERKKDNLVGLDISDNISVSEIVGNTSGCICHFVVPIQAGSHIARKVPLQGTRISTHGLYRLQAKVPVPNFVPLRARASSWSKQKPRYTAPQGGLNYCSATLGRGEPAVAPGAWGIQPRGEVAPPPPGRRKQKYRTPPGRLKKSGCGPPHPEEKYCPPPDALNPVIYRETQNMNPCGADKYESKHDFVGTNQNTRRSDSVAPLIRHPHCGTHPLCFEFYKLVGVFKRTPRVRHLAAHHTITEHIGVLSEKPRDIVSRYRLTPNEIFPDVNTEQGENPCGTQRVMMIWDKPPPERISQILHPFPKREHN

SEQ ID NO: 973895 - protein, 164 aa, Homo sapiens
PDECEAGVEQRKKSNVERERRGHVFLRQHGLRTHKPWGDFSLGSPKIRLHGGKVAPPGLGHITVRWSPHKPASPQSSTRLRRLRSNPAVLCVGKKGSALPVIIQELLSLLSGGPRATRSTGSAPPLTGAYRVSPTRADTTKVSPKEESGRSLGDPTRKNSGHSC

SEQ ID NO: 973896 - protein, 70 aa, Homo sapiens
NNRVVVILIVKTFLHPRGILSFGDLDPAPSPKDDCSRNSRVGDTVSGLVVDCGVRPDSSADIRVSVRTVF

SEQ ID NO: 973897 - protein, 153 aa, Homo sapiens
MSRKTQKGASVPAKQVTTTKAQGPSFPDEEHEDMQSGSPAQGIKTMGAKNRLTRGMVKMQGEYIETFLKSSLNPSSPLLQKGSYTSQYLDVRRFLKKQNLPPRLVCEPARPLTKNICCFFFFIRRQVAGGHDRAEKAPVGPKEKQAFFSKKKK

SEQ ID NO: 973898 - protein, 242 aa, Homo sapiens
SHNYGGGVVDMKPPLRGAKRAHMRFRGEYTKGWETHTQVPVLPEKDSGKHPHALVSRGAKREFCPGDKSTPRKKGVISAKHSGSNETVTRSFKEFIFIVWYPAVCPVKDTAVPSPSCVSPAFWLLSRTLPFLLGVKRTVFSKKSTQNSFVSSDKIAKQRTAHFAQVRIRKNPPLKWCETSEGLEKSHGGSVPQHKQTTTRFLFCVKHGSEPLLLFEKNMSVPHVVRINKSGTFHRCSNQKEH

SEQ ID NO: 973899 - protein, 129 aa, Homo sapiens
FGRDETITNKVKKKYKKRRQDTTFNRPVLEECMALAVLSCDEYLSSDLVFKGPHGPGCDHAREQCVGRQNICGEYFRLPPCHLVRNINTSLQVRRTVLNIVFVINVVGAVRDIVFVSQSGFGLQKNGSP

SEQ ID NO: 973900 - protein, 127 aa, Homo sapiens
CFSPQTKPNTVPQNITINNTTLTTGDSISSVDDPHSSSTNPDASEVPPSSRDDSLPSDKLDKDEAGGDIVYARPHPLSLHSQSSNTTNTPLCGIAPVANNPLDQSTVSEANTTHNDTSSNNVYVPDT

SEQ ID NO: 973901 - protein, 284 aa, Homo sapiens
MRDILRVPVGPCFFPAAAICGMESPKKGFPKGTITRPILPPFGPPSIRGDTSLQAALSWCLPPGNRNSAAASKFLWAEGYQPVPGHAKAISSGRPKWGSCRFTKEPMQGRRPPANKRPQNSGVGKVNASPHRIVFLEQLRSGLDTSLHRVSIKSSTPPSPPVASNPTGGVVFSPGKPRCPLRQSALHTHQELFIARSSPPDVCDPQRVNKTNYRVLLASVDKTTFVFAPINGVLCQRYRLSKRDMWRMKKSWRAKAEEKEHNTGAGRDPHPLGGSPQNGLTPQQ

SEQ ID NO: 973902 - protein, 127 aa, Homo sapiens
RRYISEVTNTSQEDDNPEKRSFASEEFSTFNNYNDDNLFTYSDVYYPTKYTTYVAPSGSLQPRKAYPALSQHPSFNLNAATYTITLPKTASKPDPTSDSYPLQSLTSEDTTVYVEDNYPVSPSPDVA

SEQ ID NO: 973903 - protein, 156 aa, Homo sapiens
TGAQTQGTSSATEKQHGGEPDPGLGARHPKRPKSVGPAGPRPPRSEPHRTKGSHPPLGGIQRRCGRTNYLGPPAVCGAPAESREGAASPPLIRGTHPRCDPVLNTNRTLSEKFRPPPSGYLWGTHSLCQGPSRTIPHGTQEPGPRGTSAEDARTTR

SEQ ID NO: 973904 - protein, 289 aa, Homo sapiens
NPTSEQERLTGNNSGRETIQCRGAVVSRRKQGCAPYAVSAHRLKAQFASTGLSHAPLLRLMAGPANCWRCPTRECGPASPGPGNQTKQELLGGAPRVHKGCQVLSAGGKIFRATPSESRPRGPSSTSGVPKPHITQGGHPPSGRPADEHTITKGGVWRHTTKKTVLLLDDKPPVWRTSIVSIKRRPTSQGSLKSIRMFQTLCNSLSKGGEIIPRGPTNRASPPARGEKAAKSPPPLVQGAMIFGLTRRRRPPRPTGVQLKKRPHTKGASPKYFLPPGGLTNRNQFPNKK

SEQ ID NO: 973905 - protein, 61 aa, Homo sapiens
MGVLVPPVGEHTLCQTGNDVTRSVTAQPGLLEIREVNERSGVADGVPLTTETPVTVDAACL

SEQ ID NO: 973906 - protein, 532 aa, Homo sapiens
VCFVVVRVCVVAVCLLFCCLLACLFLFFSLSLALFFCVFFFFVRLFLFCVSSSLLFSWSSLCLCFLSVFCLLCSLSLLSSCRCVFSVCLAFVVCVLLARSGSAALAASSFARRFIAGVSLSLAPALSSASVVSCLVLSLSRLVLFLSYSFGSCVVSVCRVAVSRLRQCLFVASVLSVSLLLPSRRRSAPLCVFGSGCRVWGVVSVCAFCVCVVFLVCGGGVVCSRGERRGVGGADEAADGAGQRRAILSFCAVLAVVVDLLGVPLIDRGGGSSLVWSALVFYFPRLVAVGGSATKVCPRPLLLGSRALFWSLCVGRWGPPLRWRPDYFFLHPGGCPESARPLWFVLGRAPSPFILPCGGARLHHCWGKKDVVVRRPSAWGVAIQKVGPLSRRSVGAPLWWGSTSRFEDATLFAWWVVRARGVNTASLKRIWVGAATRGAPDSVRGRKCGGRPPLESLGALCDAKYISLCWTKTHHPPCGDTPGVDDEVYKTLYTPLARNIVSADYDACGGYIFSLGLARRRTGDDHFWGVSC

SEQ ID NO: 973907 - protein, 134 aa, Homo sapiens
MGWYHSRIVSLKEAFVVPGLVISALFFASNVQMLSAPRGGVERRFRSCCAKIILGPPGLKLKRLGLKKKATFEFIMVPPPRNGITRLTPCKKDVLTSVCQGPKLSPKWGGPILKTFRRMGLKLELYNPGNLEKI

SEQ ID NO: 973908 - protein, 50 aa, Homo sapiens
MTPVRLPKLYDVVLTIGMNGNVPTVFKKSYMIYAEIASSACLGHVDKRKP

SEQ ID NO: 973909 - protein, 111 aa, Homo sapiens
MSGGRYNTTGWFPQRRRLFLCVKTTVGVARLSLWMVFPLEKGEKYFCVMEIEMSLEMSYSPSFGDTEFGGKVGGTRPLFNPGGAIYISPTESTWLYKFFISWGVTYFCEKM

SEQ ID NO: 973910 - protein, 109 aa, Homo sapiens
VSFWFVFCFSVFLCGFCVVCSVVSLGRRIAVQSGDGVYGKSRGNELDRVEMGSWGRLRTDERGLSARFVYAHPMGPLPGVRPAAHSTNCWRMRIVFRRAWKTGGVVPQF

SEQ ID NO: 973911 - protein, 145 aa, Homo sapiens
MTTTMALMTSGKMRLSGTSLTRVSYSTRTSTHSREPNFTMNSGRLCVVSRFCRRFVRDRCKKEFTDLMIEMEDQTNDVQRGRHPRCLDYKTYTDRVYYLPSKGRRQRTLMITRQAVHPRCRRLARMLEQALYQFSNLLNRNSYLI

SEQ ID NO: 973912 - protein, 191 aa, Homo sapiens
LLFFRLFPLSCRSFFLLSLSSLSLCFCPRLGSAFCLLSRFSLPFSYPSPFLSVLSLLRPSVVFSFRALPSSVSLCSFSLSCLLCLLSLVSFPSSALLPPAAAAVLALFFLSVSFFGLALLFPPSRGRFLLLVFLFVCFALCGLVLVLLSPVSCLPWRSLARLLPRALLSVFSLPSPPGRPPVLACAQEEKY

SEQ ID NO: 973913 - protein, 103 aa, Homo sapiens
MGGLITKHRWGNKKALPLVILCQGGSPHIVCAPQNASYKDPYNVNICIPPLMSRRPPPRFTPLCVDKHAFFQTLCLFAQCGPTFKDYYINNNLWFIDHTTAAL

SEQ ID NO: 973914 - protein, 143 aa, Homo sapiens
SPISGFPFGPPYCLVIALLIVVRWCNAARSRVILLVSGRPRVYAVLCVIIVVRRIAVCVLLRRHRTVCGRGEDNTEGRVKRSPSPGAVQKSIGAPPWVRETLPGGSPVFRRDNFCSHGSNILVPPPLCPRGPPAEHVESPLSA

SEQ ID NO: 973915 - protein, 148 aa, Homo sapiens
SVISLLSCAPLFLLFACAFFFSFRCFGFSLTCGLLALHFVLHACRLLRLLCFPFQSSSSAACLSGCCRSRCPRSTLSFVVLSPGVFLALRICLQCCARGSTPFLAVLDIPSVIFRIVSSMRCLTYCVSVWCHVSGRSSKQKYSHEYIG

SEQ ID NO: 973916 - protein, 60 aa, Homo sapiens
DLGSGLQRIGVGVVRCLVDELAITMASQATKGEKKDDSKGSEHGSRSFHMASVHINGGIP

SEQ ID NO: 973917 - protein, 81 aa, Homo sapiens
WIVFVCLSSRGSYIDRRAGQDDKAEADTTPLDTPPHRPLLTEMFWGCSERLAPTGALEGFDGQCWVPLPVCGAPKRVPTPG

SEQ ID NO: 973918 - protein, 45 aa, Homo sapiens
YNLGPHPLLEHKRIHTREKTYKGEEGGKAYSQAFKPYYPSRGYRG

SEQ ID NO: 973919 - protein, 61 aa, Homo sapiens
SLEDPYVTVNLTTIENSHGKETLQKVKKVAKLLSGSSNLTEHKNIHTEEKPYKCEEGGKAF

SEQ ID NO: 973920 - protein, 33 aa, Homo sapiens
MVALLTRKLYWNSSNGTYGMKLVLTTCQGYRSS

SEQ ID NO: 973921 - protein, 161 aa, Homo sapiens
GNTPAGIICCPQGPLGSYPWRTPLWGPDSAPRRCVGPPQQMLFYPAPFRTPLWGRAPGVVDPPRVNFSRGGSSRRVGGSPLGVLFSPAQLFCCAGGPSEGVLDNLIDKKERLAAPEGTAQCGPTVLPERRSPRRPPLERPRIKEAALSLRPWKKNPTNKGL

SEQ ID NO: 973922 - protein, 73 aa, Homo sapiens
VVEGRPYSYIQHSLLVSSVYSTTEDTQPLHGTTATTGLRPVTVDPTDTTDTREHPDIPPGIQTAAGTLNRSTE

SEQ ID NO: 973923 - protein, 121 aa, Homo sapiens
MSPSKASREGTLLLVLLFLVRRKTHVCSSFPAPAKAALLGAPHVSSRFNTHVSAPRRHNFSGKAIPAPGTLPLRGTERAHKEKNAGGKKIRGVTKGKTTITHTGRLKKGHKKCPGVGYPPR

SEQ ID NO: 973924 - protein, 148 aa, Homo sapiens
ELRAPAETVCVERSPRCFPSPGIRHQLGPLRHAKKECQRSARHLGHQGRPGHRGPPPVFSRPPAHCPRLAPIGAPTPGHSSKCAACKETLGAPALGITVGKWPLNFCKDVGGKTPPLIDKGSEANQTCGLETRSPSTPPVGAALARFQ

SEQ ID NO: 973925 - protein, 253 aa, Homo sapiens
MCLGGPHPEEERGAAAPGRNTGVGRRFNTRGNTGVPKKNGKMGAQLCPDSNSPKARHTPRCVEKCGPHPGLSKRVVAPTLQHTRAHTLVAPVEGGPGPHKVTKETRVRHKYWGAPTAPTAHLHCKAPGGSRWGQPTGGPPGEVNPPQGGARLWPNTEETHWGDSGESDRKNADQFFSTKAPPGKKKWRAALLREKGHLYTENGSSGRNFLKKKRVVGKNEEGDSQIIPSLWARHKVTEVPPNFPCSRYDEPSR

SEQ ID NO: 973926 - protein, 173 aa, Homo sapiens
MFSEKNFSKTFYMEPKCFQQGGKILLKGTSKPRGSSLLKEFYTPFMTAFTNKGPCGILGQTYSHSVCFQLKLPGCLLPLESREFISKGPKLGAWKPHIASLRAPYRRDFLKITCTKRPVLLWYNRRAHANDSPSDDGQLFSTGRSRRLSGRRRAPSYQTEETNTLPPAYNIRS

SEQ ID NO: 973927 - protein, 42 aa, Homo sapiens
SETGVTGRLNATLCITKACKAPELSCQTPPKCKDMFEILDIT

SEQ ID NO: 973928 - protein, 152 aa, Homo sapiens
ASTTAPPVAMDTNRLRQGYNLSEHTIATNQTGISYPTMLRPTPQKLHPQNCSPEHYEPQLKTQRTWRSFIYPLEEPVLYIAKTRSTYNTSSNRLYTDNLTTNPDEGYKVSASPHVKPYGHGVAHEVARNGLHILPPKIQIALMPIKGRRWIK

SEQ ID NO: 973929 - protein, 49 aa, Homo sapiens
LVMSSTHACLIHNIYDRDQFGGGMRSKGDIGNRTTSMKRLNTMLARKGQ

SEQ ID NO: 973930 - protein, 99 aa, Homo sapiens
TPSSHRKMNVLSEGAYRGYMGLYTVNTSQSFFMVNTRQSVEPTSGINLRINSMGSCTQRSWAAVPRMLLKLVLNYQMKGYATIDSEEERVHANTDKTSA

SEQ ID NO: 973931 - protein, 64 aa, Homo sapiens
MVSCTSAHSFPRRDMLALLHLLGAHIVCSHNETLRIIIQELDDLKEVVDFQVALSSLGITAARR

SEQ ID NO: 973932 - protein, 51 aa, Homo sapiens
CFEVLLVQAVISFCICRQCQGTWWCRQYMHCVGVRSLRMSTSHFMGTRSEV

SEQ ID NO: 973933 - protein, 34 aa, Homo sapiens
WMQCPLWMQVSEFQAQPQNYTIFISKVGDTLHPE

SEQ ID NO: 973934 - protein, 30 aa, Homo sapiens
MLILIALPSLRILYISEEVNDSLPYHQHQI

SEQ ID NO: 973935 - protein, 99 aa, Homo sapiens
DTVMTWASLTLSERANLRTNISDAQEIYTGCTILPAIILILIALPSLRILYITEEVNDPSLTIKSKRAPNGTELYEYTELRRSNLQFLHTPPIIPRTRR

SEQ ID NO: 973936 - protein, 58 aa, Homo sapiens
GRLCTPACSALPRVYESLILFLSSPFRGLLYFVCFKEVDLLMHEEWDAFDLKTKDRCQ

SEQ ID NO: 973937 - protein, 58 aa, Homo sapiens
RVYCGLAFARGAVGGRALHLAGLQGIIGNILDECLGCSGDEPNNAGGLRPRSQHGSGS

SEQ ID NO: 973938 - protein, 43 aa, Homo sapiens
YGLNLHAERAVACERATSSTTLLVALAVAAWRRLQYSPCSTCY

SEQ ID NO: 973939 - protein, 32 aa, Homo sapiens
MLDPEITGGPQNLLYTVETLPSWDQKGKNRRG

SEQ ID NO: 973940 - protein, 142 aa, Homo sapiens
NGKPQVVLQKLSSAKTIIRCRLLAYRSAYAIAIANLGFLQSMTIFHAFACPSFFLVFKTEEILHLDLCDGSLELKQRAFRQASRWRRGPSSSNSRPVKAFDVTSSSCPKMPMRRQMATAVPLLSPVVMMTRMPACRHSFTEE

SEQ ID NO: 973941 - protein, 89 aa, Homo sapiens
YKKKIDIYRMQKYHGVNTKNQSWTIYYINRIIDVELSDIKIGLSFELLVRNKSRLSTGRPAAGTQCPSHCGSIRTGVGSPFNSRRLGFW

SEQ ID NO: 973942 - protein, 43 aa, Homo sapiens
LEIHKARRAKATDPTKPDELPKQQLKQPPVYVATIVGKHLSGR

SEQ ID NO: 973943 - protein, 106 aa, Homo sapiens
VQSLSLLRVCIPIVRTRLILQEVSVIQRALLLLLTILSCYTPFPVAVDQCISIKANIIQQAVNPVLCNCSCTRLSCYKCYRCYYLIYPEFYFCPCRQNIKTPGLKA

SEQ ID NO: 973944 - protein, 50 aa, Homo sapiens
EERAKTLSTLCYSSTSEDLAPLARADDYEQVKNVVDYYPEYNAALRGCKV

SEQ ID NO: 973945 - protein, 98 aa, Homo sapiens
VTLQDPSGVASGLCDLLEAGGQDMDVGQEAVLTRCVSLASSLFNSSSLRMASCRWRGIILVFLLSRAALPASSRISAVRYSNTAARYTGAPAESEGSL

SEQ ID NO: 973946 - protein, 89 aa, Homo sapiens
QWRRQDLLLVQVQLAESSSTGAPTLARLMLPRLTLVRCFANQPGREGSAFTPGCFSEGIDLILRDCQLIVVPNEGRVYAGGLESLKAVW

SEQ ID NO: 973947 - protein, 90 aa, Homo sapiens
YYRLTVLGFKACILLESVSHTGHISVMRMTWKGGAAPDMEATLAQLFNHVLIGTNSGSSRASEDSCSYSSDTMWPQSGNHHFAFSAQVKN

SEQ ID NO: 973948 - protein, 63 aa, Homo sapiens
MPQLSYHADLFSYPSPVSSTRFHPSETRVLVDLKRRNGKDLREYMVATHLPNKYLDPPDKNPF

SEQ ID NO: 973949 - protein, 47 aa, Homo sapiens
CLLVSSSSFIVCSPVLSIHPAQHLILNVASWPHLGLPHAWPPGPERK

SEQ ID NO: 973950 - protein, 114 aa, Homo sapiens
MDPGVRGWFFGYECQFLFTISHHPHQSPTTACTYSREIVVCVLLACVGGTNARRLDKWGRNERVAWEWWSSGLWLPRHVLVLRGSGLVHGLLLLLHVLIILLFPEPRSTSGYTT

SEQ ID NO: 973951 - protein, 143 aa, Homo sapiens
ERKCVKSPGDGLSGSGLGRTRARALNLGAQCPGTPVYPTHHAVPRPPFLIPSMISSAEVAGIPNAVLLNPGLYTDVSVRQSLINTLAVALDDHGMMGGLVAIQALAFLQALHEVLFLFCRLTTWRLLRGACAAARVAHADGAA

SEQ ID NO: 973952 - protein, 52 aa, Homo sapiens
ELVTLVHNSSSTCVAAFIAASTSSTVAYVTNPKPLERLVFESLITTQSRIAP

SEQ ID NO: 973953 - protein, 68 aa, Homo sapiens
HDRCYYYINYTTIDALQSCPSSANDQGARCLSEIISNASQSMLNIAHPAPLKSHSPDGMLAQRGPPQC

SEQ ID NO: 973954 - protein, 42 aa, Homo sapiens
NGTLPAQLVPSVRFQKSASMITNLRASSSYFLSCLFCNCGLG

SEQ ID NO: 973955 - protein, 39 aa, Homo sapiens
SSSVPALQAENTSALGGWYLPLATSLVSPPIAHPAESAA

SEQ ID NO: 973956 - protein, 138 aa, Homo sapiens
MSCIKDVAIKEPLVDVVDPKQLVTNACLIKVRGWAWPGAPWVETKERPSPGPGMGLWGPECWPEVSEPDLPARGGARGPGKTLRPLNIFVSAAVGEPCLALGFWRRKHPKLAAKAHSPCTERQDPRSMSGCTCTRATA

SEQ ID NO: 973957 - protein, 40 aa, Homo sapiens
EHGKLAVMPAGSQQVSVRYQVHICTQALIVQYHMQVHWKT

SEQ ID NO: 973958 - protein, 66 aa, Homo sapiens
TDHLNPPKTDANPNPNTLVPPVAIQMLTLRMVSQVETEQEADDGGGSHMNMKGNILSPMYNPRDKL

SEQ ID NO: 973959 - protein, 79 aa, Homo sapiens
MLGVQGACKDNPGANARCLPKCVWNRNDWGIVFNGSIGNRTSSQKSHDTQQVDRSNKQDLQGACTKTDSLTQPDSSELE

SEQ ID NO: 973960 - protein, 48 aa, Homo sapiens
QTCVEETELQQRNSSIRPGSNSIAEKDNKPGPIGKPASEHYDDEAEAG

SEQ ID NO: 973961 - protein, 32 aa, Homo sapiens
MECTAKTIDGRERGFRNGYDELLVRTLASGKE

SEQ ID NO: 973962 - protein, 96 aa, Homo sapiens
AEDAKEISALVSSTMKIEIIAPPERKYSEWIGGSILASLSSFAADSGSAKLEYDESGPSIVQRKCFYADYDLVALQPFLRRPNLRRKQDEIGRSRK

SEQ ID NO: 973963 - protein, 103 aa, Homo sapiens
PDPNIEWPCDVTKSISDGVEQMQHVRTQTWGTRHDVHTEMQQRRTRARSTYTHNIMSHRRGDGIHTDGDDSTHTDTVTTHTMTTTPNKIIGTNIHIACIALFT

SEQ ID NO: 973964 - protein, 53 aa, Homo sapiens
TDLRQEDPCEAALRAQKVISSANRAVVGVCGVEVAEIDKPILKAGRAVPQSIM

SEQ ID NO: 973965 - protein, 60 aa, Homo sapiens
RFCTAPHRPASPWMIRVYRCFPCWYMMATGHQESSADDNGPLMELDDSDFETEDFDGRSR

SEQ ID NO: 973966 - protein, 33 aa, Homo sapiens
YSGIHRYLQINGRSRKQPSYLPEKQTSALAEAG

SEQ ID NO: 973967 - protein, 37 aa, Homo sapiens
DSDIADAGTRTGRDRRNRTAVIRTDHTKRGVRYWVMA

SEQ ID NO: 973968 - protein, 103 aa, Homo sapiens
PEPSADATDICCQWTCMDISSASRHKIEDVDKKTYPWKYQMEETLSRYIDRGASGTTIWRGQQSSNLMLVMGTRMMALSRDHPNKEDSSKQGGLITSLPSSPQ

SEQ ID NO: 973969 - protein, 52 aa, Homo sapiens
IKGIYDLIRHGDTQATIAVNSIKKKVNDKNPHIALKAHEGHLIMNCLATVLY

SEQ ID NO: 973970 - protein, 50 aa, Homo sapiens
MLSPKTQQLYQQKLLARTLRATADNSKDLAVLHIPLRGACSVIDKPQSII

SEQ ID NO: 973971 - protein, 119 aa, Homo sapiens
LQFVSLVLDVIAIISRECLSASEVIPLVFSASEFVVDPLKAHLLLSLMSLALILARFGCSEACAAGTGCPVYPPLAWTYSHPGSSVHLTISSLHLACVSSILGRHQFHHNNYQYKNPCH

SEQ ID NO: 973972 - protein, 164 aa, Homo sapiens
DRARSHYVDGTITPIIAFTHMTSYCIANPSKTLTNELKPLIPMPQDLLNSHRCSISVRQASCPLNNLKQAVKPIISRPIVQNSSMRSGGEGREPCTLQLVGVEHGWWVGPEHTRVHSEVEPLSHCQCQNVSPGMGMSRFLSLPAVQDLHAFETQDSSEEAGVLI

SEQ ID NO: 973973 - protein, 130 aa, Homo sapiens
ISSYPLCDGGMLNVTLQRMATGTVSSQCWFSRPVSWKHGEHRYLDAQAVSGCSSSSTTQVQHDAVWYSPLVVLLDIIVQGLASSLLLNSDLIFNMSTSLRETMILIRTLSRVPLPFMESYSRSAKYRGLF

SEQ ID NO: 973974 - protein, 98 aa, Homo sapiens
MNFLVQIVTVSFIVVILDKICSMAEKCSTMIDAHVDVKTTMVTSFILFSVGFTKKRNNQIRKTSYAQDQQSAKIQKKMMEIMTCEVQTNDLKEVVNKL

SEQ ID NO: 973975 - protein, 41 aa, Homo sapiens
STSIVDLELISPRFVHVELKMHLIVVRYYCSSDRNSTLGVS

SEQ ID NO: 973976 - protein, 35 aa, Homo sapiens
RKEAKSPTSRRTHHKPGVTIWMHPTLPHIRRQPYT

SEQ ID NO: 973977 - protein, 98 aa, Homo sapiens
CDTVAAETQSITSLLVSNTTRFFIGEDMNPDGMVALLDYREDGVYPIYYFLVRMVYKWNNVYTCGVYFGSITCHPDRVYCSVIHNQTRSSDVWRVMSS

SEQ ID NO: 973978 - protein, 51 aa, Homo sapiens
QRDGYSSEEARMRKMRIDTEEAEEDDDEEEEEMTGARDWNGNVFRSSTAER

SEQ ID NO: 973979 - protein, 57 aa, Homo sapiens
WSAEQEYGKEEYVYAKVLLPRLPSDSSRLHLCGQLAVAAGQAPHTREIHTRGTHENP

SEQ ID NO: 973980 - protein, 44 aa, Homo sapiens
GRSTLRELERYVHFLPTVRNPVKPYTIKEACGKDKGGTGRCVAW

SEQ ID NO: 973981 - protein, 115 aa, Homo sapiens
ESPGRLAREIPRGRERPVCTLRVHTQVTRRACAYRRVSRFTHYTSGRTSLTEFNGRECALVEREQRLRYIPRVVPRLSGPPHRPPRSMLCSVWERGEIPELKEGRERGYFFDRQS

SEQ ID NO: 973982 - protein, 44 aa, Homo sapiens
MRCIPIPVSRPFESPRSRGTSIKSRQQFSFRTVKPSHTPTGYSS

SEQ ID NO: 973983 - protein, 71 aa, Homo sapiens
RHEHIPPYYQHTLEHKPIIPNIRDIARIEFWKTLGAYRYRYPEERRDEKFITQCIFIGRGLTPYTLSDILI

SEQ ID NO: 973984 - protein, 109 aa, Homo sapiens
CSGRGELSLVFAVQAFASPAPQTVPTELPAEALLLRAVDWTRPPVPTELISVLILHTGSGQQGQESSLSKSLVSEGPKLRELGLPLRARRPRSNFRPPGRRKQGSNNFN

SEQ ID NO: 973985 - protein, 42 aa, Homo sapiens
CPLETLSTIFQLVIKGNPPHWFDRGFVQCVCNAACWEPWFLQ

SEQ ID NO: 973986 - protein, 39 aa, Homo sapiens
GGAPVPWPQPNPATADIWGDFTKSTGSTFSQTQPGTGWI

SEQ ID NO: 973987 - protein, 102 aa, Homo sapiens
LGEGCVGKTSLVLRYCENQVYRQAHHHFAGIILNKEVKYWWERGKPCHFGIRQVKGDSMHWGPLYYRDSHGAILVYDIHMKIFSEVKTGSQNYGKCWGNEIC

SEQ ID NO: 973988 - protein, 122 aa, Homo sapiens
HRGRRMRGVWALARGPLEARLFLGSYLNQVTFLGFNGRFLKILWEAPGEAGTGFFKFPISGFSHLWGIWDTFHTGFTFSTSPPPTYMGGYFASNCCKMRNNDPKFARRDHGGCLGRAAHPLT

SEQ ID NO: 973989 - protein, 102 aa, Homo sapiens
MRVTAPRTVLLLLWGAVALNQNWGRFHFNVVFLKPPCPRPARGEPFEWKWVRWSETQFVEFLTDSPRVTQKQTAGIWIDKGGAALFGTQTQFYSETQTIFVR

SEQ ID NO: 973990 - protein, 84 aa, Homo sapiens
MAVHGPKALGLCPNAQGGEPKHFFRVQKGLFYRNIQTFKELSKPLVTAYGPHGMNKMVINHFGEMFFDKDAATIFRELEVQHPP

SEQ ID NO: 973991 - protein, 35 aa, Homo sapiens
TAKRSGGDSLGFASRGVSAAAAAWAWYVQVAVGFS

SEQ ID NO: 973992 - protein, 53 aa, Homo sapiens
MARGPKKHLKRAAAPKHWMLDKLTRCVCSGHPPVPTSGESFFPSSIFRRTDLS

SEQ ID NO: 973993 - protein, 69 aa, Homo sapiens
KNSARGTIAGCKNKRLTEGGKKGAKKEGGGPIFKKGLDVVEATFIFNIWNNLESRLQPGPKGPKISPIG

SEQ ID NO: 973994 - protein, 71 aa, Homo sapiens
EKFVVYNVYMAGRQLCSKRYPEFAILHQNLKERFANFTFSGLPGEVGIFIIRQQFRLPTVGIWKDIQEKVC

SEQ ID NO: 973995 - protein, 46 aa, Homo sapiens
PDYGSWEDPGQQHSREMDSVAFEDVAVNFNHEEWALLGSITKRIST

SEQ ID NO: 973996 - protein, 84 aa, Homo sapiens
MSVKTWKSKASNGSHSEIVKDIIDPKTGDTASNDGKVPKIVNSCKVAFEIKMHADGDSHPTDREIYFQVSSLRGQERATIVLCT

SEQ ID NO: 973997 - protein, 36 aa, Homo sapiens
HRRLKPRPAGFVDNKLKQRVIQYLTSNKCWQICWTL

SEQ ID NO: 973998 - protein, 37 aa, Homo sapiens
HEIMIIYRDLISSDEMFSAITRIRGIGGRVLPGGGGE

SEQ ID NO: 973999 - protein, 34 aa, Homo sapiens
LQLLGFFVGFLRNVEPGYTPSQPCSKAPPVGFVF

SEQ ID NO: 974000 - protein, 40 aa, Homo sapiens
QNTGVVKLPQKPNWEREGFISPLFVIGHVDFGQSPPLLAI

SEQ ID NO: 974001 - protein, 54 aa, Homo sapiens
RNARVALIEGIPDDFIPDFPKMMMGAVPGASFSGQAPASSHPQKHLLEKPGPSL

SEQ ID NO: 974002 - protein, 50 aa, Homo sapiens
MRVTAPRTVLLLLWGAVACTENLGRLHSMGYFYTPMSRPGPWEPRLHRSG

SEQ ID NO: 974003 - protein, 71 aa, Homo sapiens
LAAWEERLDSRAAASAFTMALTLFDTDEYRPPCLEILLISATTGRPSSSENYLYLRGGKQTKVLWREFHGM

SEQ ID NO: 974004 - protein, 67 aa, Homo sapiens
GDTASHWVHMWSEQSAKDKPPYEQTAAKLKETYDRILLHIVPRAKVQQASRALAGQQAHSRSAHHKL

SEQ ID NO: 974005 - protein, 36 aa, Homo sapiens
GDQASQEMDLPEVAAVGGASGEEQEFNVPFSARGAC

SEQ ID NO: 974006 - protein, 39 aa, Homo sapiens
VLNHHLLRMSQPEPARKSRFSDPHKERLLQERGGNSQIS

SEQ ID NO: 974007 - protein, 57 aa, Homo sapiens
ETVKIGKVDCTQHYDLCLRKPGSWLSHSNNKNRDGKKVDQSKGKRDLKKLKGVPWSL

SEQ ID NO: 974008 - protein, 38 aa, Homo sapiens
ELPEGLICYCRQFWVEWVSRLSGFLGASFRFSSSDLGP

SEQ ID NO: 974009 - protein, 87 aa, Homo sapiens
MSSTRSFPSFGKITNDFYPEEDGRPKGNIFLEYASPAHVLDAVRNADVYKLHRQHTFRVTLFPDFDMYIASVTIGISQRNSLPKTWG

SEQ ID NO: 974010 - protein, 79 aa, Homo sapiens
GNKMAARKGSLSVRTNLGLRPLLLLTMALAGGFGDRSLEAFDSVLGDTAFCHRACQLTSLLDTPTLGKRSCTHVREVAV

SEQ ID NO: 974011 - protein, 41 aa, Homo sapiens
AAGTLYTYPENLRSSRLSSLLKYKRGSRSACLPNPPNFHFG

SEQ ID NO: 974012 - protein, 77 aa, Homo sapiens
MAETVADNRRLITKPQNLNDGYGTPSNFLEIDVSYPKRLGSAAGAFNTLRNQGQDKSFYFQAVRVYSYEEDTTDSEM

SEQ ID NO: 974013 - protein, 68 aa, Homo sapiens
SSEVELQDLRKELERVRKRAPGSRWETNQCISLLNRGQTERLREQEERLQEQQEKLWEPEKECFSRLP

SEQ ID NO: 974014 - protein, 70 aa, Homo sapiens
EEVRCPEHGTFCFLKTGVRMARIKEQSFYVCPADTCSFVRAPHFLFSIAYCIKVFVEISGLLLQGRRYRF

SEQ ID NO: 974015 - protein, 38 aa, Homo sapiens
FLYDIFFVFISPFLTKSGSSIMVEVATWPSDFKPPGEE

SEQ ID NO: 974016 - protein, 61 aa, Homo sapiens
GATTCTVPIITQYHLWRQLLLKRDIQIALLSGCYGGVAPRSGLAANHFIDVGAGVIDEDYR

SEQ ID NO: 974017 - protein, 66 aa, Homo sapiens
ATSVKPELRFLIVHNGVNHSKLVHFHHPPMPIYQGIIRDENIQEGLAPRPPPSIKRHSYMMFGIQF

SEQ ID NO: 974018 - protein, 99 aa, Homo sapiens
RSASATTAASSSLATPELGSSLKKKKRLFQSDEDVIRLIGQHLNCLGLNQTVGSSNGRSLGCLFENILLSIQISEISVMERDLGIWQKSVPVCNYGHLG

SEQ ID NO: 974019 - protein, 34 aa, Homo sapiens
GVKMAAFSEMGVMPRDFHKLVGRDRIGSFSTLIS

SEQ ID NO: 974020 - protein, 46 aa, Homo sapiens
VPPEASCDKAGYRTGRSEQSDLGTDNNGTVGEEDNFLLYIDVVFNI

SEQ ID NO: 974021 - protein, 40 aa, Homo sapiens
LRLRKYRLRVTAKMLSVRVAAAVVRPLSSAGRYWFSRKCF

SEQ ID NO: 974022 - protein, 106 aa, Homo sapiens
MRAAILHSKVRQNARIVLLCLTQRIWKGTHSFHSQDGQNCKKRRPKSLLGIGILKAIPEVLWIPPILGSWELKSFPSAQGGTFLLLEGIGNGLQILLGKTYFANQN

SEQ ID NO: 974023 - protein, 104 aa, Homo sapiens
RGGGGGGSAIEGDLRLTGRTHEGPVVPGLCCVLLTFGRYRADDEVDVDGTVEEDLGYSREGSRTDDEVVQREEDAIQLDGFKSITIRDLREKSEKFPFQAEDNR

SEQ ID NO: 974024 - protein, 34 aa, Homo sapiens
TERALAASPPLRHALRPQRFPRLRSAPHMAAQGG

SEQ ID NO: 974025 - protein, 36 aa, Homo sapiens
LDIRKDLYANTVFSGGSPPYTQGIATQIAEVRSPPW

SEQ ID NO: 974026 - protein, 74 aa, Homo sapiens
MKFNVDAFKRFNKYINTDCKVPGYFLKQIQQLPWVDFQHCLVLLVVHFCSLDRFENQVDIESCRGTFLIAACSP

SEQ ID NO: 974027 - protein, 36 aa, Homo sapiens
RVTSIEKAECDLPDEKDREANELTMSCGDVDGASCG

SEQ ID NO: 974028 - protein, 89 aa, Homo sapiens
SDIAYTCVHPDDRVMPGRQATGVHYSLGHPLWMISNVHVEQQCGSRVQQSDVLAEAVSDGRHMIEAIQALEPTSFGNCCLFGDWPWLQS

SEQ ID NO: 974029 - protein, 60 aa, Homo sapiens
MAPKGSSKQQSEEDLLLQIFSRNSLGQVPPRSLRERRSSFLPFPIWYYLAIYGYMDLFRS

SEQ ID NO: 974030 - protein, 103 aa, Homo sapiens
RSRSPPEAANGRGDRVELVVLDLPYLPKDKLAQSVQKLQDLTLRDLEKQEREKAPTAWKRSYFRPKSVGRRQQPPTWLTLALWSFLWLLGPIFSTPLPDKLYH

SEQ ID NO: 974031 - protein, 44 aa, Homo sapiens
ALQKGRPFNLTAGSLESTEPIIFSTNDKGQGVTVASNAFGQVGT

SEQ ID NO: 974032 - protein, 36 aa, Homo sapiens
NHSTLLPDTLANIYQIRLGVRIGTWRIVIVPQEKMK

SEQ ID NO: 974033 - protein, 33 aa, Homo sapiens
MERPPCFCSCCLDLGPAAGRPSFPGTPLINDVK

SEQ ID NO: 974034 - protein, 45 aa, Homo sapiens
TQEDEEDEGHSTPPHDTLKQRRHNVEDEMFIGGLSWALQRKSEGY

SEQ ID NO: 974035 - protein, 119 aa, Homo sapiens
LQQQQRPEDAEDGAEGGGKRGEADWEGGYPEIVKENKFEHYYQELKIVSQGELGRFMDALREPLPATLGYTWLRKPAKEILHFFKDTYFMGLEDLEVDGQKVEVHSHSVVSHELSCTQI

SEQ ID NO: 974036 - protein, 34 aa, Homo sapiens
NRLTFPARLLPGPHRPPSLRFLSFPDEVTVPSLP

SEQ ID NO: 974037 - protein, 70 aa, Homo sapiens
TKSPKVTKRTTFQDELIRAITARSARQRSSEYSDDFDRYEIVSLGDFSDTSADENSGLIKKWMTFIYPDG

SEQ ID NO: 974038 - protein, 34 aa, Homo sapiens
PGIGMFEAITTMRILKDDDLYGPVCRRMDYCIFA

SEQ ID NO: 974039 - protein, 36 aa, Homo sapiens
RPPVNFYAEGLQPPLQIPEYYLLYNRESRCLFEGGI

SEQ ID NO: 974040 - protein, 47 aa, Homo sapiens
AETFLGRTAAMAAQGEPKVQFKLKLVGNGGTGKTTFVKRNLDGEFEE

SEQ ID NO: 974041 - protein, 66 aa, Homo sapiens
HIPERLCESKEGGQGEETFSQIPDGILKQENSWSKTRLKAVCLEKLAWVLHHLIRHIKRITLAVTQ

SEQ ID NO: 974042 - protein, 37 aa, Homo sapiens
MADFDDRVSDEERVRIASKINHSCTPRGNLMRYSIDV

SEQ ID NO: 974043 - protein, 44 aa, Homo sapiens
MAVARPALTKAAKGAKEEVVDPFFKKDWYYVKAPPISIIEILEG

SEQ ID NO: 974044 - protein, 44 aa, Homo sapiens
VCRQNTGVRENYPLKAKIVERKRFIFNIFVIGTRRIRASSPILA

SEQ ID NO: 974045 - protein, 41 aa, Homo sapiens
FIYSTIFAGTLITALGSHLIFLPEVGPWKLNMLAFISVLTK

SEQ ID NO: 974046 - protein, 30 aa, Homo sapiens
MADLGGAVVLMKRRFGIAGKNSSFMPLLGE

SEQ ID NO: 974047 - protein, 82 aa, Homo sapiens
MRVTAPRTVLLLLLGASALNQNLGRFHFMREFYNRNVPPRPRESPSHMRSGSTCDDTQLRRGCDSNGRESRGRSPGAPLYRA

SEQ ID NO: 974048 - protein, 38 aa, Homo sapiens
VVQSNVGYVSEPLFQLLGHYSQHSVLLVASSTSGNHEP

SEQ ID NO: 974049 - protein, 36 aa, Homo sapiens
ITGGHYDVDCRLEDPDDGICLCFNSRKLLKVFNRII

SEQ ID NO: 974050 - protein, 43 aa, Homo sapiens
RDDCHLREELREGASVLEAAGGDQEKEEGLEQFLAQVHCYIGP

SEQ ID NO: 974051 - protein, 78 aa, Homo sapiens
LACCSSAPARNRLGRVMLDPPAGTVAGDARKVILTCQNGETEKKSLLRRYPTRTRTKETNPTQLYRQTSRRENQPGPP

SEQ ID NO: 974052 - protein, 33 aa, Homo sapiens
ISSGDVRGKYQTTLLPSPLLSSSLALGHMTFNG

SEQ ID NO: 974053 - protein, 45 aa, Homo sapiens
LGPEQTDLQDQHTDLPERACRNLRGYYNQSRGPGLKIIPEGCMCL

SEQ ID NO: 974054 - protein, 46 aa, Homo sapiens
GVEEKKKEVTAVPETLKKKAKEFPELKVKRLRKEVSHMVLRKARRE

SEQ ID NO: 974055 - protein, 38 aa, Homo sapiens
VLVSLAISAIWSLQAHGLAAHDLADDPRGPLRAQRLGN

SEQ ID NO: 974056 - protein, 35 aa, Homo sapiens
MSNGEKEKCPGGEILDGGVRGSPPEDYTVYARLAL

SEQ ID NO: 974057 - protein, 76 aa, Homo sapiens
CIAGGAWRGMALAPGLEADVLFYYHYLLVTALYILEPWEPTVFNSSRGFHFGIALLHKITTLIPNTNNAIYSLYFK

SEQ ID NO: 974058 - protein, 79 aa, Homo sapiens
PKRPPEHRGTTKAPPQGPRAGRSLPAEPTGAPQEGGGQRKARTKRTGTPRGKGPGPPPPTPNHRHSRGRRSTGAAERRT

SEQ ID NO: 974059 - protein, 34 aa, Homo sapiens
VGKKGVFLTQKVDESSGAEPKEDLRHINSDYHKK

SEQ ID NO: 974060 - protein, 78 aa, Homo sapiens
NETFGFEIQSYRPQNQNACSSEMFTLDMQNTRGQASFNCLGLKVGIVLPNYHWVESKEGLPSTQVVDLYQIVRKPANR

SEQ ID NO: 974061 - protein, 55 aa, Homo sapiens
MREISSGQGSQTFEEDDDGFCVFREQRNIAYYVSNEELRGSTPEAARKVVQLVSL

SEQ ID NO: 974062 - protein, 59 aa, Homo sapiens
PVRMFRRVACSRGCGSSGPGRVATGYSRQRVTDILASRRHASQYCFRVNLSVCYGAGFD

SEQ ID NO: 974063 - protein, 71 aa, Homo sapiens
VSPWLQMLGVQGACKVIPGENPASLPDFLFGPVLLGDFSILAALPPGNLSKGHMFHTRRRSIFTGLQGSFP

SEQ ID NO: 974064 - protein, 39 aa, Homo sapiens
IFGSSPVASLLNYQHSLLIYHLSLLASFACLRLLFDGIA

SEQ ID NO: 974065 - protein, 52 aa, Homo sapiens
GVISSGARPLSSRRARPVNKWARMPYEIKKVFASLPQLERVLLQDYSAANLR

SEQ ID NO: 974066 - protein, 43 aa, Homo sapiens
RRKFRKPRSLEFFEFQKGKPAGFKPGTGAFGVSNLGSGFPGGP

SEQ ID NO: 974067 - protein, 89 aa, Homo sapiens
MANSSFIENTKLPGVVHMPVVPATWEAEMGGFLKPKRSRLQLVEIAPLHYSPGDKDPFTKSCQMDIEVKSRSRLGAFAHTFYTSTFGRP

SEQ ID NO: 974068 - protein, 33 aa, Homo sapiens
KTENWHVAKGSGWKAQQGCPYTLGLEAAHVSTR

SEQ ID NO: 974069 - protein, 46 aa, Homo sapiens
VSFYIRLCAGCHPAVPSAAAGLCLLASKLLPAPLGLKRVFKIGTIL

SEQ ID NO: 974070 - protein, 36 aa, Homo sapiens
IKIPDCVDPEDVDVVDPDERSIMTYVDTVFCKNSKD

SEQ ID NO: 974071 - protein, 32 aa, Homo sapiens
HSTYYQTPLVTIYQISIADRDRNLAQLDIVPQ

SEQ ID NO: 974072 - protein, 36 aa, Homo sapiens
NYLPASSQHFQCYDYHLWLEARVGQPVNQLTLEKNP

SEQ ID NO: 974073 - protein, 47 aa, Homo sapiens
QSSGSPPRSLNRPNNQTEKFNKQRTEGPAGGGRGKAGVSAALPVPIN

SEQ ID NO: 974074 - protein, 31 aa, Homo sapiens
LLGQIGAALRPRWLCSRRQDSGTYERLKTRG

SEQ ID NO: 974075 - protein, 36 aa, Homo sapiens
CAEHRFVKLPYSKWKEDSYHIVVIGHVDSGSSPTTG

SEQ ID NO: 974076 - protein, 88 aa, Homo sapiens
SALAELIARSEVELRAGHYLLDYPAQDLRSPGSVCGFGHFSDEVNPLDSAVSVESPRSDSSLPQHADMVSPLIIRLVDISSAPFKWNH

SEQ ID NO: 974077 - protein, 84 aa, Homo sapiens
ARHRCRETTLKPNGRKDSYQPLSSLDHVDSGQVHHYWPSDSINAGGIAKRTIEKFWGRRLLRMGKGSSKDALGLGKLKADLHVG

SEQ ID NO: 974078 - protein, 34 aa, Homo sapiens
GTAGPASGSSSSSSSSSSSSSSSSSIFITSRRLP

SEQ ID NO: 974079 - protein, 103 aa, Homo sapiens
PGGRGASSKGAPWRTPGAPLTTEIVISFLNSQQHGAQSSNSARAAKRAGTSKKKEKEKAQLQQSLKQANWFFEAGAKPSGEPLSCRPELDWIQHPSSASETKH

SEQ ID NO: 974080 - protein, 32 aa, Homo sapiens
RRQCAYIIHNRVLFAEGTTLGSTVHNLLTGNQ

SEQ ID NO: 974081 - protein, 33 aa, Homo sapiens
RDVYKKVLRSRTWVPRLPASEAQDRNRRKVKAC

SEQ ID NO: 974082 - protein, 56 aa, Homo sapiens
MTFHLKRDISSSTDGYSTSSVIGHSLDRDLISIYAHNNTSSVSISLLLQRIIIRTI

SEQ ID NO: 974083 - protein, 33 aa, Homo sapiens
REVEECRLVYSTFERGFDGYPLLWSHTMISKPI

SEQ ID NO: 974084 - protein, 32 aa, Homo sapiens
HQSFTVARVPLQIEPVLSNQTYSDAFSHFRCY

SEQ ID NO: 974085 - protein, 31 aa, Homo sapiens
MRVDKTAREQGFPFTNPFRGSFPFANRILIC

SEQ ID NO: 974086 - protein, 34 aa, Homo sapiens
RQNKGVVKTTPKAKIGKGKDSYHIVVIGHEDSGE

SEQ ID NO: 974087 - protein, 77 aa, Homo sapiens
MPESASRGTWLPTFEANTNLSAASVSEPFLGDLWGILCSHLGLYPIVHHKGLQACKVAPEFAKGMLSWFPFNCKFRA

SEQ ID NO: 974088 - protein, 36 aa, Homo sapiens
QGGPRWSTPSDRDAQAVFLRMDRSGETARTSGGRET

SEQ ID NO: 974089 - protein, 34 aa, Homo sapiens
LDRLSNLVGSHLRPILSIHSGSVNARDPVTDTNF

SEQ ID NO: 974090 - protein, 37 aa, Homo sapiens
TSWKKTCINNFRVKGHIDSKTQTGRPPREPEDSGKAT

SEQ ID NO: 974091 - protein, 36 aa, Homo sapiens
FEQAELLRPGIAESDGCRPGVSLKDKDVGSICIFLQ

SEQ ID NO: 974092 - protein, 44 aa, Homo sapiens
DVHRKLSVLRHRSLGFLRCKAEQGISGKVEEVSLRIDQSKEGPH

SEQ ID NO: 974093 - protein, 37 aa, Homo sapiens
QVPARKKRPKRLRTSNMVRSGNKADCCADVWTWAFTM

SEQ ID NO: 974094 - protein, 46 aa, Homo sapiens
CLQKGLYVNWITESVQSAKRLLGPELLKKGDQLPGFPSWSMDPGNQ

SEQ ID NO: 974095 - protein, 36 aa, Homo sapiens
MHIYRGTLISPRMQHAFSAQSNKHPGRIAARVCCPG

SEQ ID NO: 974096 - protein, 42 aa, Homo sapiens
MLDVARTQVRVGPLSEKVDAWIIYTRDTVSVTQRDMGRHAQP

SEQ ID NO: 974097 - protein, 98 aa, Homo sapiens
KGGRENEDGRPSQAKNAISPVGGSLGDPCALDGTRVGGHEGLSTANHLAQFFPNSLTVFSPRYNSDPDCIPLSRVSLVSVFGKEYILGGNFTLPQTWR

SEQ ID NO: 974098 - protein, 44 aa, Homo sapiens
IQKKRKGREELIIMPRSHFEKEACPWVWMILLRKTTKLFDADIQ

SEQ ID NO: 974099 - protein, 58 aa, Homo sapiens
MATYLEFIQQNEERDGVRFSWNVWPSSQLEAKRMGFTPGLVFLSFKKTVPNLPPYNNE

SEQ ID NO: 974100 - protein, 78 aa, Homo sapiens
RDGEDQTQDTELVETRPAGDRTFQKLAAVGGASWRRSRSYTMPCPSMDGFPRPFNPRDGSPISQVHHPYRWHIFLACL

SEQ ID NO: 974101 - protein, 35 aa, Homo sapiens
GNYITERVLYYTGRLAKMHEVKVKMGLVLSWVPWD

SEQ ID NO: 974102 - protein, 35 aa, Homo sapiens
GGGTEDRPPDDAVVGDCRHATSPRPKLIFTDGLQR

SEQ ID NO: 974103 - protein, 49 aa, Homo sapiens
SSQLKGKWTQLCEPDQQGVGELPVRRDSIPILGTVGSGALGVYKDTFLG

SEQ ID NO: 974104 - protein, 34 aa, Homo sapiens
CSRQGVRGTHLKLLSRQEAVKYQGPGTFRHIENM

SEQ ID NO: 974105 - protein, 108 aa, Homo sapiens
MRIINEPTAAAIAYGLDKREGEKNILVFDLGCRTLIVAFLNIYNVVFGGVCHSIERLYLWCERDSLTSVSICTLLSHSTQRRTRTDVTGDTRAAAETLRAIEKSTRAS

SEQ ID NO: 974106 - protein, 37 aa, Homo sapiens
MKLMCDGTHIEEDLGKSREGSTEDDVSSTQRGRAIYF

SEQ ID NO: 974107 - protein, 37 aa, Homo sapiens
ITLYITGPDLSSHHRSSTMTPLPIPNPLANLNLGLQL

SEQ ID NO: 974108 - protein, 68 aa, Homo sapiens
VAQAAGRPAGPASSFLAQPGGPMLESRVAMAAGSRVVFSSRRRDPSKRQVSIFWPESLIPRLKVYIPH

SEQ ID NO: 974109 - protein, 59 aa, Homo sapiens
MSAPAPKSVKRSSTSTTDGADETSEKDSKKAFNNLMRTKLIWTDLNDQAIEEVFDSRTQ

SEQ ID NO: 974110 - protein, 53 aa, Homo sapiens
VLVTARRGAPGRELDNAGARDFALVTFLLLYVKTTFNNCFQLLPFLLDPKTAF

SEQ ID NO: 974111 - protein, 37 aa, Homo sapiens
MAPSVQFLGFSVCKNPWYRVRKAFLTSSEPGSETLKL

SEQ ID NO: 974112 - protein, 49 aa, Homo sapiens
NFELHVAQGDHFIKFFAPWCGHCKGLGFHLGADLALGLVNNSELFKVWH

SEQ ID NO: 974113 - protein, 38 aa, Homo sapiens
AVIRTCLGIGKQAYVAHYYGIIPLHIQMPEEVNHGRRG

SEQ ID NO: 974114 - protein, 46 aa, Homo sapiens
DSDAGKVWESGSVAGPAGLHPPRLRTGFATLFRLLSLSFPLPVGNS

SEQ ID NO: 974115 - protein, 71 aa, Homo sapiens
VCRQNTGVVKTTPKSQNWEGKGYFISTIVRSLDHVGFLGQVHHYWPSDSINRGGIAHRTHGKYLRGSLAEM

SEQ ID NO: 974116 - protein, 66 aa, Homo sapiens
EDEDDTEEAEEDDEEEEEEMMVPGMEGKEEPALTVVQQRVALIRGKQFILANAGDFCFLIFRLAKL

SEQ ID NO: 974117 - protein, 109 aa, Homo sapiens
LPGLKKSRAGRFAFLGWRLGGALGFMSSPGGLRVSWVQRGPGVWCRKTFGQPRLGYSRPAAFTRQTLTSSMRCTPSSGFRADQPPRKVLVRNVFEFPDQPVVWREISII

SEQ ID NO: 974118 - protein, 100 aa, Homo sapiens
MADKEAAFDGLESKNRVINGGIQNIGKGPPLSLMIWVMPMALELAHLNFPWASEEYPAQREEIRAYSVCSGDTHIVCTPLSSLEPVLQLHDDDACSMMRH

SEQ ID NO: 974119 - protein, 45 aa, Homo sapiens
SCKQYGITGENVRGELLALVKDPPSQLAEIGAAAQQSLGGKPFYV

SEQ ID NO: 974120 - protein, 36 aa, Homo sapiens
MKVSIPTKALELMDMQTFKAEPPEKLIYLRAFHLNA

SEQ ID NO: 974121 - protein, 100 aa, Homo sapiens
RDTLAVIRHFREPIRLKTVKPGKVINKDLRHYLRLQFQKGSIDPQLQAGDSRDILYFETQSMHYRAPKGMEMSQVLIIISFPLHSHTHWERVEALLESWT

SEQ ID NO: 974122 - protein, 72 aa, Homo sapiens
AALRALCGFPGVAAQGACGLGLGVRFPDSKPSKVFGQLPARIVEWATDSLGGACLCTQGKETPPLEGLPPWE

SEQ ID NO: 974123 - protein, 54 aa, Homo sapiens
EPGFSTRSASWRSRELFKKVKLEQERQNWGIQRATNVTYQAHHVNEDKRGQVVG

SEQ ID NO: 974124 - protein, 73 aa, Homo sapiens
RRLPPPPPCLLSRAAPARELQLVVSGKGYFTISNTSHSHGAWFPSPVHHSQESPSLAACPLQSLRLFQATGAP

SEQ ID NO: 974125 - protein, 85 aa, Homo sapiens
VLEPGYIDSEIGTSDQIVPEYQEDSDISSFFANPQNLRNLIILNNLHFQFYRWARPFALYPPDNDFIKMEALWTLPYVSLSSLFG

SEQ ID NO: 974126 - protein, 38 aa, Homo sapiens
MGPGPQNYGSGMRPPPNFLGPAMPGINMGPGACRTLGQ

SEQ ID NO: 974127 - protein, 37 aa, Homo sapiens
TCVRNSSEPWRPFPLHLLNIFKGKEADEREKQKTTRL

SEQ ID NO: 974128 - protein, 70 aa, Homo sapiens
RNGLGTLHTFIGGVNKHSTSHRAGVGITVIFIFRAHASSRLAAQGTRWRCTSQNALRSPHTLQPGYHKIL

SEQ ID NO: 974129 - protein, 57 aa, Homo sapiens
ISFSWFANYIRAGALIMGSAGLFRINLLGSAKDGLTYAGLEDHLPPPLSTRPRPNGF

SEQ ID NO: 974130 - protein, 51 aa, Homo sapiens
MGASGPPLLVGGGIAGALFVSASCGAGPGDTGQGRGIRPGAKAPLLGDLQF

SEQ ID NO: 974131 - protein, 44 aa, Homo sapiens
IVDCIVASQGAGRAFFWRGNLANVIRYFPLKPQFGFKVRTSSSS

SEQ ID NO: 974132 - protein, 39 aa, Homo sapiens
INPPGVVVVAVVAVIGNQDQSGGGRQPVGYWTSQGPLEP

SEQ ID NO: 974133 - protein, 40 aa, Homo sapiens
EKLIKRHAGILHKLCSNLAMQQVLCPGIRLTYIASYWQCS

SEQ ID NO: 974134 - protein, 107 aa, Homo sapiens
PRHERCHLRFRAFGTSAGWYRAFPGPLLSSTGLPFPRTIAPRFLSPLFSRPSAAAEQQQQQQQEEEPGAAVAGSPLVTVKEAAKKSLLLLHGYMELLLWTGHPMSLI

SEQ ID NO: 974135 - protein, 44 aa, Homo sapiens
TWEKADRVKGASATRCCGFRGVGSGGREPSLHFGHEFSSSTPAI

SEQ ID NO: 974136 - protein, 44 aa, Homo sapiens
SVSRLPERIRRLEEELLQLKSDSNGPEEERKLQETWKAFEGTQA

SEQ ID NO: 974137 - protein, 110 aa, Homo sapiens
NSARGEDGQDRTASTCTRADMFTHGIQSRRHFVMFFAPWCRHCQRLQPPLDDLGDKYTAGDAKVYVAKVDCTATPTCARQGSEIPTLRLFSQARAVKYRSRLPALETGCC

SEQ ID NO: 974138 - protein, 49 aa, Homo sapiens
MDSLVLSERGAAFVPKRSCLGTAKSWEGPAHSYAVLTTQPRVLTLTTPV

SEQ ID NO: 974139 - protein, 111 aa, Homo sapiens
PWRTALPGHRGATPVLFLLLLLGTLGPGAGQALPPEEPPLIIKDVEAHSGPESSHLAKVTPEVVLAHLAGGSTSQSYRFPAAFGAELKPGSRSLRVQIKAEMRNTTVWSVR

SEQ ID NO: 974140 - protein, 65 aa, Homo sapiens
LKSFHISTLQGEDEIAPISFESKWVPEEELSNIANALASATCERCKGGFAPHEKIVNSNGELYPC

SEQ ID NO: 974141 - protein, 34 aa, Homo sapiens
MLTKPLQGPPASPGTPTAAAEARIGKLRGRVSTW

SEQ ID NO: 974142 - protein, 33 aa, Homo sapiens
MRASPSPLQKFRQNARDVLLCYPKGIERDHSFT

SEQ ID NO: 974143 - protein, 34 aa, Homo sapiens
SFRHIRLGSYRKRETVLNTFANPWDPLLPGTYVV

SEQ ID NO: 974144 - protein, 33 aa, Homo sapiens
AGRDVRPSELVGPGVTATGSRPRHKTEKNGFVK

SEQ ID NO: 974145 - protein, 41 aa, Homo sapiens
EDGGGRSTAGVGPWEQLRSEQLPKEGHYQGFSRTRFKFVSC

SEQ ID NO: 974146 - protein, 32 aa, Homo sapiens
RPQFLKNSALLLSVLGAFGDAANLALHSGVGE

SEQ ID NO: 974147 - protein, 39 aa, Homo sapiens
AVKLILHSRCLLIWAPRGLQWRFSHLFQAPRFLATSLPL

SEQ ID NO: 974148 - protein, 71 aa, Homo sapiens
RENKKKKNKKKKSPVPRRNPLKMLKKSKRISNTDLMEIKEEEQVKCYCTDSQQWEAQNEVTQNPKTENCSR

SEQ ID NO: 974149 - protein, 34 aa, Homo sapiens
SSKSGDEFEDILEERRHVSNLKFPMKCYTPIIYK

SEQ ID NO: 974150 - protein, 35 aa, Homo sapiens
RQFRVGEEPGLGGAARGGYCSTGVSVFWSAQNRFS

SEQ ID NO: 974151 - protein, 71 aa, Homo sapiens
FAQVRTLAAGNTQSGLSLFKALSLSKHSVKMNANRMMASSCNEALSQFDRCVAIALLSDLEQIKVPSAGPH

SEQ ID NO: 974152 - protein, 64 aa, Homo sapiens
VYWAAVTLRFQIDNCLKKRLTSTSNKVLGRVFVGLEICSSSAPNPETHGGMGAHTFLGVFFMSP

SEQ ID NO: 974153 - protein, 67 aa, Homo sapiens
ASYDTSAPNAKRKYLDEGETDEDKMEEYKEMNKKCNRDEEIYHMKEEDYQRISSTFFLRDHRALNSP

SEQ ID NO: 974154 - protein, 66 aa, Homo sapiens
TRRYFPYHRRAYHLSMITAFIIIFPIFFLVPVLPFSNNHNNITNTNNSNGQRKWETLSNSYPPATH

SEQ ID NO: 974155 - protein, 34 aa, Homo sapiens
VKYQGPRDFQTLENWMLQTLNEEPVTPEPEVDPP

SEQ ID NO: 974156 - protein, 79 aa, Homo sapiens
ELDSTERACDTLLMCIVTVMNHGLRNGGRVGHILRKPFKDESLFPARVVYYLLFFFIGIIIVLNLIFWVIIDTFAYLRS

SEQ ID NO: 974157 - protein, 37 aa, Homo sapiens
HKKHKSDTHLYEEYVEKPLKLVLKVGGNEVTQLFRGN

SEQ ID NO: 974158 - protein, 34 aa, Homo sapiens
HKSGFLQAMQYREPKRYWEEISCYPENNGAKKLK

SEQ ID NO: 974159 - protein, 48 aa, Homo sapiens
LAAQRPAICRPAAELGRLGHSSSTLAAAARGRKSRNQLERHSLTWHPS

SEQ ID NO: 974160 - protein, 94 aa, Homo sapiens
GVYVKPGNKERGWNAPPQFLYGLQTQAGGPRRSLLTKRVAPPQGLDPPESPHQKLFLGPSPNGASTSFKEGLQGPHLWEVALPLGWSQQVSSES

SEQ ID NO: 974161 - protein, 40 aa, Homo sapiens
IRAEMSCSVALAVLALLSLSGLEAIQAYFQGLRLINVLTD

SEQ ID NO: 974162 - protein, 40 aa, Homo sapiens
PNDLRHFDPEFTEEPVPNFIWQVPLTAFLFTTSVKGSFPR

SEQ ID NO: 974163 - protein, 66 aa, Homo sapiens
EQLDRIQRYKAAALLRLGARNVPLGFGESWKKHLSGEVRETIFHQANGICLQKKESITLFYPPPHQ

SEQ ID NO: 974164 - protein, 72 aa, Homo sapiens
PRVTTSKAYSSAEEEEERGRRRRRVDYSKLELAGRIQRNIIERKPGDFWETRELFFSCWKKAITRGSTDVRK

SEQ ID NO: 974165 - protein, 38 aa, Homo sapiens
QSFASSSQGDTPYFNNFCLRFNLIVSQVRNWIHDIVYP

SEQ ID NO: 974166 - protein, 50 aa, Homo sapiens
EAMSSKDLSDTPVRRRCGKYLHGDTNRKRSQDYSRQIEIAESSFREPMIP

SEQ ID NO: 974167 - protein, 47 aa, Homo sapiens
TPYHLVVLVDILMGPGRFWPATVRRESRLDVAKSVTYGLGYMHCLPQ

SEQ ID NO: 974168 - protein, 56 aa, Homo sapiens
DLPASASQSAGITGVGHHAWPEHPFLIVAEISAAVGAAHILGLTPSSSYPYPLNPT

SEQ ID NO: 974169 - protein, 55 aa, Homo sapiens
GAGGDARSVLLSSSHDLLQEGFKRPSFFLCKNGNSLREKPICTSLREEGGNRFTQ

SEQ ID NO: 974170 - protein, 80 aa, Homo sapiens
MAALDLRAEWDSLVLQLLWDLEELEGKRTVLNARVEEGWLLVGKARITRMGAKSVGPFSILPHRAPGLLSRHTGPRGTPQ

SEQ ID NO: 974171 - protein, 59 aa, Homo sapiens
ELQVEVSGTSALEAFTTSFHTSIDDVFAFIITMPTSYRLACFPGRRGVSWSTCTTGGFI

SEQ ID NO: 974172 - protein, 47 aa, Homo sapiens
FLAFARLWSVVISTLDQVQRAFSLGVAAVVVPPPSPPSPPALRGHGV

SEQ ID NO: 974173 - protein, 41 aa, Homo sapiens
LERYAYALSVTRAGKQARRLGFTVKQSVVALVKYQHFREAG

SEQ ID NO: 974174 - protein, 35 aa, Homo sapiens
RGSALLDDDEFAYETLLADLWLRIFRLDARRFDSL

SEQ ID NO: 974175 - protein, 49 aa, Homo sapiens
NHETAFQGNASETGHQKRRRCEIVCLEVMDPWFFSRRRKQNWGQDCDSP

SEQ ID NO: 974176 - protein, 38 aa, Homo sapiens
AAGLRGAWLSPFSAMGVLATDIGVLRKGEEVILAKNVT

SEQ ID NO: 974177 - protein, 43 aa, Homo sapiens
HQPGQIWNFASTQKPSHVSSQYQSPHFSTQRVTPCPRIFIGIH

SEQ ID NO: 974178 - protein, 65 aa, Homo sapiens
GAFGSRGFIGADMAKSKNHTTHTQFRKIGTEIGIKETPIHTDTESLKGGGPKVPEGHAALPRKHT

SEQ ID NO: 974179 - protein, 80 aa, Homo sapiens
LSSPVPPMVNVTCSEVSEGNITVTCRASSFFPPDYHTDLASGLGVSLSHTTQQVGGYVLPIGVWTYHTWVANRICQGGGA

SEQ ID NO: 974180 - protein, 50 aa, Homo sapiens
TERDATSLSKGKFQELLVGIVVEIDVGRGEITELRQVEGRALVTTPTEKT

SEQ ID NO: 974181 - protein, 35 aa, Homo sapiens
ESRTAEEEFTDSQPQVAFVHNSLDPVLEVACTEGD

SEQ ID NO: 974182 - protein, 95 aa, Homo sapiens
MVAREKQLKPWCWYCNRDFDDEKILYFSTKKQSILNAIYVTRNCIQGPGLAIHCMQVHKNNRCRTKCIPGDSMSWNYCMEVFRKAWMKRALDRTK

SEQ ID NO: 974183 - protein, 42 aa, Homo sapiens
MSSKQALFPSRQQVPLETGTRPFLACIPSLSRGEVGPPWFFG

SEQ ID NO: 974184 - protein, 60 aa, Homo sapiens
ELRFGQERKCSETKTTGKISRAEASTGQDPQGQAQARSWAEQGKAASPEGDESKVSEHLS

SEQ ID NO: 974185 - protein, 54 aa, Homo sapiens
TLLEQQPLRCPGQCPSTCPQAWGHIFANLLQGPFFGKKEIGILMVALDAAGKTT

SEQ ID NO: 974186 - protein, 56 aa, Homo sapiens
EDETLVWEALVNRRSYASTYFDPSSPHSRTFHLSMPRSCCTFVDQYREQLIARVHR

SEQ ID NO: 974187 - protein, 38 aa, Homo sapiens
VLRVLRVGAVECWKPRDVSQFPDGLMLRTSARPIERSV

SEQ ID NO: 974188 - protein, 39 aa, Homo sapiens
HINIVVIGHVVSGKSTTTGHLSLEIAVASHTGPIQNFER

SEQ ID NO: 974189 - protein, 47 aa, Homo sapiens
MTYSYIIGRRCYGYYTCKGTRVHRPYRQFRAGCPVVLRRRLVSQAFP

SEQ ID NO: 974190 - protein, 83 aa, Homo sapiens
RFPLSLPTIQLGQVRPASRRASAKVSTDHNQIASSNWDTGIGNQEWLHISQISLWGYKGSINTRRELKSTHMRKEVSPEIFEN

SEQ ID NO: 974191 - protein, 86 aa, Homo sapiens
NEIPTVPTYYPARPARPASAALGQGLNGPHQIAILNGPGNGNHDVTIYKISLGYKGYYKWRDSEILSWKGEFPWFLRNHKETLVSV

SEQ ID NO: 974192 - protein, 57 aa, Homo sapiens
ARTQVFVKTTPKKAKIGKGKSIISTLFGHWDKEDSGKSHHYLANCILLNAGGIGQKD

SEQ ID NO: 974193 - protein, 64 aa, Homo sapiens
MGFRVFTYGGFTGLLGSAGGSAAVALVLIATWGPASWASSRFLEDQVDSPGKVRGAFGTFCSLV

SEQ ID NO: 974194 - protein, 35 aa, Homo sapiens
APNLYEELMLSGRGPSIVHQGGLPGSVTNLPYSLA

SEQ ID NO: 974195 - protein, 41 aa, Homo sapiens
QFGSWRLTFWMVNQIFKDFAMMIHDQGDLIDSIVANSGKSK

SEQ ID NO: 974196 - protein, 83 aa, Homo sapiens
MSHRKFSAPQDMGPSAFLPSEGASSQAIVGKVERAFPKDEPPTTPGFHPQRPSLGIKRPGNELKIVPGKSKGRESKGETQKEG

SEQ ID NO: 974197 - protein, 38 aa, Homo sapiens
PAPANKRAEPKRCFEFLKRNFFTQMEDWGLKGLRSFIY

SEQ ID NO: 974198 - protein, 35 aa, Homo sapiens
RTSAAQRAMLEIQYENKVGTGLGPTLEFYAVVSQE

SEQ ID NO: 974199 - protein, 79 aa, Homo sapiens
PDWVLSEREQFNEFRDLNKDGKLDKDEIRHLILPQDYYYSQAEAKHLVYESDKNKDERANYKRGIYGETLNKVCAGRQA

SEQ ID NO: 974200 - protein, 35 aa, Homo sapiens
MGAIAASEVLVDSAEEGSLACGGGVAPSRRRGQGG

SEQ ID NO: 974201 - protein, 55 aa, Homo sapiens
FQIFQPPQPHSFCAFAPFLPPAALEAGSGPETRNLKKAGHLLFSLEALRVARKRR

SEQ ID NO: 974202 - protein, 53 aa, Homo sapiens
VADRRQAGVRRHYLYPFNRRLTGGGAQGSSGETRRQVLQLRNKVQETNHRPSA

SEQ ID NO: 974203 - protein, 54 aa, Homo sapiens
MGAGPSLLLAALLLLLSGDGAVCVADTPANLHLIFDLAWEPGASKVGFQPVPRR

SEQ ID NO: 974204 - protein, 36 aa, Homo sapiens
GTSDTGKLDAADTERGASYNRARKVNRPGSPQLKQR

SEQ ID NO: 974205 - protein, 104 aa, Homo sapiens
GQGLLSSLPPLPAVGGPTEYVGRRATWTKAIKGNFPFWEELQLSIGASEGWEAWNGVVPVESLCKGNLLKDRFALKILLDRPKARYEVRLHMMCPNTKHGPDME

SEQ ID NO: 974206 - protein, 76 aa, Homo sapiens
LASTIADIQEHDLEKTRQYSQKLGPADLDNYSSLTLFLQTNLKGRPTQETLLSEYSLSSHPGHTLCLSDRPSLGRL

SEQ ID NO: 974207 - protein, 62 aa, Homo sapiens
KKEENYPVSLELHQNCILAKLCHQEPNQSPCMLEHGKGREGGFLVKVKGALPLVLVQAHEGN

SEQ ID NO: 974208 - protein, 34 aa, Homo sapiens
ESRSHYCTSARRERRKTLCQKQTQERKLFHFPFS

SEQ ID NO: 974209 - protein, 43 aa, Homo sapiens
MRVTAPRTVLLLLLGAVALTQTLAGFHFMRYFYNRMSRPRPRG

SEQ ID NO: 974210 - protein, 70 aa, Homo sapiens
GFVFTREDLTEIRDMLLAKVPAAARAGAIAPCEVTVPAQNHWAPGPRRPAFFQVLGSPLKFPGATIRILE

SEQ ID NO: 974211 - protein, 109 aa, Homo sapiens
RQVRSSSGRSNQTLTHLIQIPPQEENAPHRAFERTVIDAKTKFSTNGFYRIPLGSENRAPSPMWYRKPPQVRCSQSSLIFNTMSTAALDVSSNLEFDEGQISHLAWKDP

SEQ ID NO: 974212 - protein, 68 aa, Homo sapiens
QLEQPGQERNGGAPTVRGNPLRGCFFLSPSRSRRGQEWITIRKSSDTYAIIGKETCEFMYWPDIMKTA

SEQ ID NO: 974213 - protein, 59 aa, Homo sapiens
MLSRNPDNYVRETKVDLQRVPGTYVSSLQSFEGSKEIYIESFNAIHNSETRIFHKPHSL

SEQ ID NO: 974214 - protein, 37 aa, Homo sapiens
MAAFRYFCSCLRFRPLSDGPFLSATAGSGTYPLQVPS

SEQ ID NO: 974215 - protein, 33 aa, Homo sapiens
AHYVCARLHLFSVDVGFHFMAKAYSIALLLWLW

SEQ ID NO: 974216 - protein, 70 aa, Homo sapiens
ALPPGGGGSPHLPRVFCCALGPGGRLLRGCTPIAFERLRFHHPVRGSSLWCQRGLEALYTSASRRQPLGQ

SEQ ID NO: 974217 - protein, 38 aa, Homo sapiens
VSEDPELPYMRPPLSKELWVSDDPNVTKAMRFKQLDGK

SEQ ID NO: 974218 - protein, 59 aa, Homo sapiens
ARQGAEERSVDHEAFSLYDLCPAPAIRPTLYRVHEEPPDHRGPTAFVQPRPIPEAACGH

SEQ ID NO: 974219 - protein, 88 aa, Homo sapiens
MAAVAVAVREDSGSGMKAEFPPGPGAVGREMTKEEKLPASEGKEQAEEERKEERGQTRDLLSVSAANVKEANQRLPDRAFSWHSREKV

SEQ ID NO: 974220 - protein, 83 aa, Homo sapiens
GLQDATSPIIEELITFHDHGLIIIFPICFLLRIPSSYTYHRNLPYSYHLNRSGIGNRLNIPARHILGLIALQSVRILIHNRRG

SEQ ID NO: 974221 - protein, 81 aa, Homo sapiens
YLARRPKLQLSVYNNDRGPTWVLETTIDPGLNLEGFELWGPILKGKVIVSVPKETGNNWDGELLTSFLLTVGVLRDRRKEG

SEQ ID NO: 974222 - protein, 49 aa, Homo sapiens
MSPGTNTTREKPKTLNFSGHLFGLRGFPNRSSPSRSPTMASLTICGLAA

SEQ ID NO: 974223 - protein, 31 aa, Homo sapiens
MPQFRISSAAPFKYQVAYHDSIQRRQLGFWE

SEQ ID NO: 974224 - protein, 38 aa, Homo sapiens
MQGPLLNLTRPGELSIRRVIPHDWAYWGQAYNARRARR

SEQ ID NO: 974225 - protein, 149 aa, Homo sapiens
EGSSLVQQEEEKAEQRKELGLQKKALKKKKKIRGPEKRGQNEDDEKEEGDDEEEQPSKRRRVENSIPAAGETQNVEEQQAPLEMSCRRCGAPSSRRRRQPPKRTCQGLHAAAGSITVFVSTSPQHQDRTSSGHSSGPVSVSRHLSTWDS

SEQ ID NO: 974226 - protein, 110 aa, Homo sapiens
MRAQMSRCVCLSVCSALTSDTKKDREEKIQAVPPKNKKVYITAIPQEKWGKIKIFPKLRIVVLGGSIPPSPHTKGELSRECEREIKKGERSEILFCKEQGLGFLYSSSSP

SEQ ID NO: 974227 - protein, 78 aa, Homo sapiens
YVAIQAVLSLYGSGRTTGIVMDFGDGVTHTVPIYEGVFPSPIAILAVLNLLGRDLTYKPKKVLNERGLQSSTHTGRAG

SEQ ID NO: 974228 - protein, 68 aa, Homo sapiens
GRSVRNSRDKHPVDVDKQLLSSSRKRFWSKGAGVTAKDDIVDRAKWRYLREVFYDQLFYYGGVSGCMT

SEQ ID NO: 974229 - protein, 36 aa, Homo sapiens
TVFTELNDEKVLQELDMSNFEDQLRTKSKGPSLDLA

SEQ ID NO: 974230 - protein, 37 aa, Homo sapiens
QEGKVDSYLQRRRRKGESEGKGDKMASAKMPQPERGP

SEQ ID NO: 974231 - protein, 71 aa, Homo sapiens
ESGKRMDFPALPPGWKKEEVIPKSWLSSGKSHVYYFSPSCKKFKSKLNLQGNLEILFDLNTVLLSETLRDY

SEQ ID NO: 974232 - protein, 91 aa, Homo sapiens
ERQRGSSGCFRFPSSASSASSGFSAAREPENPVYDPPLTPLRDMSTPARRRLMRDFKRLQEDPPAASQRGSVREQHNGVERGHIRASRDPA

SEQ ID NO: 974233 - protein, 62 aa, Homo sapiens
DKMRDHLIAKNVAADIAVQLCESVANKLEGEVNGTVSKVTFTVKQALQESLVQISSDHSACV

SEQ ID NO: 974234 - protein, 62 aa, Homo sapiens
PVRVHLLVRRGKRVEESPVRFRTVAYYGSHRIFFFTTQFISYLTQAGQGSQPKEEFPFFRDQ

SEQ ID NO: 974235 - protein, 39 aa, Homo sapiens
IFTMSVEVDGNSFEAFGPSKKDGPSFTLAFKCLQGMAFP

SEQ ID NO: 974236 - protein, 64 aa, Homo sapiens
ALPITALSQSLPSGRLPIYSCFKSSHSFKFRRFKQLPLSARFVCTSGLPSGATLQFKTTAVPAF

SEQ ID NO: 974237 - protein, 36 aa, Homo sapiens
EFRHARAQEALKSFLHHRALNPLNTNGGICPSSIAS

SEQ ID NO: 974238 - protein, 50 aa, Homo sapiens
KHREPHDSALTYGVELPWFGLEAELESGIVPLAHMLVLFPVSSVVKRFTG

SEQ ID NO: 974239 - protein, 106 aa, Homo sapiens
GKETLQPREHPKTHGDPPSRLSDHEATLGCWGPGFYPAEITLTWQWDGEDQTQDTELVETRPAGDGTFQRWASCGGAFWERSRDTGPIFTRGAPEPSPEMEPLPSH

SEQ ID NO: 974240 - protein, 69 aa, Homo sapiens
SVALLCAFSLAWESPGAVHIHEESGHRWSRQEEQEAQDSTYPIRIEVAGGMILVMAFFLITYTFHSTWV

SEQ ID NO: 974241 - protein, 68 aa, Homo sapiens
GPKKHLKRVAAPKHWMLDKLTRVFAPRPSTGPTRLGECFPLIIFLRTRLRNALQGVREGGFHIRAVTL

SEQ ID NO: 974242 - protein, 77 aa, Homo sapiens
PAEGHLTCGTVPGLQLNLIRPEDCRLGLAPGPPELVLVVQVHTGPNTRFLLDLLRKAQGIDNGPRQFLANDFLVGPG

SEQ ID NO: 974243 - protein, 63 aa, Homo sapiens
LNITPELYEIFLSRAKERLKSFSETSSENYTRGVSFAYREASLGLIKVGISRTISSLYNSSEG

SEQ ID NO: 974244 - protein, 89 aa, Homo sapiens
ECIRGRSFENKLKSACPSMRLERYHRKNLDVMKEAIVQAEEAAPEITEEAVRNRRKKRFKEGKEDGSLHLPSRLSENSSSTPKGCEEMS

SEQ ID NO: 974245 - protein, 40 aa, Homo sapiens
LVDSLDPFSEGIMFSVRPTKKSWKKFFNLSGGEKTFSSMA

SEQ ID NO: 974246 - protein, 66 aa, Homo sapiens
LLTKHDVRDYASLIAFTNGICFYSIVDSAALVLRCQMQRKHVPTSDLTLIQQCGFLFYVPRPARPL

SEQ ID NO: 974247 - protein, 73 aa, Homo sapiens
MHYFTRRLNRLCINRPHHLRRKLLAVSSVPSRQLAFNILYLPLPQNRRGYITDHSLLDLNIGIIISATLAQLH

SEQ ID NO: 974248 - protein, 83 aa, Homo sapiens
LNPKQGAKAQEHGCPRKFVDSFTRGVNVDGKSEKMSTTLSLNYIAVIIVFCAHYRSLLTLLLQFKNLLLFNNFIQNIFELPVG

SEQ ID NO: 974249 - protein, 86 aa, Homo sapiens
LSEGVQEADADGFTHPGHCSLRPAWSMQGAPGGWGGAHMVPLAFIYGHGRPIWAPGYSYPFIFGPSDAPLMHKEAGEGLFFGGSGS

SEQ ID NO: 974250 - protein, 36 aa, Homo sapiens
RGIKKEYIYDADAVSSPPVSQTHRTPPPGVGGSLHR

SEQ ID NO: 974251 - protein, 36 aa, Homo sapiens
GPTKECDTGSETLRVWNWDPHTNSHTPRTGPSETHI

SEQ ID NO: 974252 - protein, 80 aa, Homo sapiens
RRRTFRLSVPTKAADHLSKQGRGSRLGRNLARKKLPRYFKNHRVLGFKNPRGAIKGHLHCTGNAPYTGNVPIRGRISLAW

SEQ ID NO: 974253 - protein, 104 aa, Homo sapiens
AITSMNVFVGPLSVAIVIFCWITMYWGGRLSWGQGERGSTPGGTILVHIDTISLLLEDALEYSALISGTQIRLSTSDCRGADPWSTTCPSLTQADPFLLGGSEA

SEQ ID NO: 974254 - protein, 47 aa, Homo sapiens
RRRVKSSSDVRGTTTTIDRLTDPILGYFRPQKAPPFPEVYLARTIIK

SEQ ID NO: 974255 - protein, 35 aa, Homo sapiens
SRSVALAVLRYSLFLGLEATPRVPTKGFTVYLTVT

SEQ ID NO: 974256 - protein, 34 aa, Homo sapiens
MAEVEVLCFMVEEIFLGGLGKLVGKKVIIGGKVV

SEQ ID NO: 974257 - protein, 34 aa, Homo sapiens
MAVGKNTRLTKGGQKGSQEESSLIHFLRKIGIVW

SEQ ID NO: 974258 - protein, 84 aa, Homo sapiens
GILNVNKHRAQIEAFVRLQGASTKSESLRHGPDVVFSPLATGAPPLEQKLRPPQYAYKSEKSSGFWSAPSLSGAPSLEPPSGSQ

SEQ ID NO: 974259 - protein, 86 aa, Homo sapiens
LDFVKIITILVTATTFNLGAAGIPGCRCSYFLAVFLKQLTFPVEHIFPVYPALWLCSIGARSLTRALKLESSTLFGGRDLADKGRG

SEQ ID NO: 974260 - protein, 78 aa, Homo sapiens
DDANPQILAAFRRLDGLVEPPTGYIESLPRVVKRRVNASKTSKFKFAQIEAKFYEEYMILKGSMLFSISLYVIGDVKL

SEQ ID NO: 974261 - protein, 110 aa, Homo sapiens
AVRRTESPATAAETFKVRTFIIEVLEEILTSIPPPRPPAITNEAWTFSPYDTSYCNPDLKILFWGENSGTFPYALFLIIGPHGSGKSIVMDFYALGVGLWSTKLRSKHFE

SEQ ID NO: 974262 - protein, 94 aa, Homo sapiens
MARGPKKHLKRVAAPKHWMLDKLTRVFAPRPSTGSPQVGESCCPLIHFARGTDLKVALTGVEGKRLCMQGVIENLCGKGPPDSSPPLVGVTGCI

SEQ ID NO: 974263 - protein, 84 aa, Homo sapiens
AWQPGLPPTCDRLPGRAGGPGRSPEPLGKLGRPGLDLFGEEPTKGQKFGPCPSLTGSKFLFLSTRKKPGGPEGNGIGNLFLRKL

SEQ ID NO: 974264 - protein, 45 aa, Homo sapiens
GRGVPAPAAAAAARLVRGRLPKVLQYYLKDYSLNNSYSCGMREND

SEQ ID NO: 974265 - protein, 68 aa, Homo sapiens
KMAAVQAAEVKVDGSEPETEQGMKLKETALKFYKGKEGRKGGPNPERALVWETAKPKATSSFHQPTPL

SEQ ID NO: 974266 - protein, 116 aa, Homo sapiens
LQARAQQLRREERTGEQRLEGDPQKGGGVSPGPWHTLRKRGFKEGHMGNFPPPREGTGGVLRGGWGAADTQALGGNMTRNRSSTVVSGSCGLWANKVEAPLFPPAPPTTSPISPTH

SEQ ID NO: 974267 - protein, 83 aa, Homo sapiens
MAAPKGSLLVEDPTWGFLALLLLTMAFARGSGTPSAEAFDSVLGERRLGHPGLSVDLPLAHTTLKGEELYACQRELQTVFKLS

SEQ ID NO: 974268 - protein, 30 aa, Homo sapiens
MFCKATLDHAHGESVVLAGKELRGVVYTRT

SEQ ID NO: 974269 - protein, 45 aa, Homo sapiens
GDVPAGKGSQTQEGQSRAKLQPQSGLSSFESSSEVQSEPAVPKPE

SEQ ID NO: 974270 - protein, 56 aa, Homo sapiens
MAPLLLQLAVLGAALAARALVLIFIVAFTTSTKMPALHRHEGEKFFLNAKGRERLY

SEQ ID NO: 974271 - protein, 44 aa, Homo sapiens
MGKEMPVTTTWIGMAFPMDCDTLSLKSPTPTYRQTEDVGTRLWE

SEQ ID NO: 974272 - protein, 38 aa, Homo sapiens
MEDMNEYSNIEDSQRDPRSTRARINRVTVKMFNGGLSW

SEQ ID NO: 974273 - protein, 37 aa, Homo sapiens
ALRNFLRKEYGGLDVLVNNAGIAFKVADPHPFIFKAE

SEQ ID NO: 974274 - protein, 101 aa, Homo sapiens
TNALLVVKHRDMNEKELEAQEARKAQLENHGPEEEEEEEIETEEKEAWGSDEEQREGQQQLKEGSEDVHSGSASLREEGDKGEGTYKSRSSEDESSADDDP

SEQ ID NO: 974275 - protein, 54 aa, Homo sapiens
AGGPGVPRASGSWPFRTELLGERQQKTQLGLAKALQVLGLVSHTRKHLGPRGIA

SEQ ID NO: 974276 - protein, 49 aa, Homo sapiens
GPRIKSVIYHALSQKGGEGLRCPSPSGAQRAEAFVEGLSCRRSTAPYGP

SEQ ID NO: 974277 - protein, 33 aa, Homo sapiens
NAFPSSLIQANVTVGTCSGFCSQKEFPLAIFRA

SEQ ID NO: 974278 - protein, 31 aa, Homo sapiens
MHMLVKTPIPLFVSDSNILPFYYSQEPFYTN

SEQ ID NO: 974279 - protein, 77 aa, Homo sapiens
RVSKMPAFLRSALQILFSEDSTKLCNGIKSRGSAYGSSCQEEASGTCMLFRPRSGTVEAMVSLGGDPSGDWADLYRT

SEQ ID NO: 974280 - protein, 37 aa, Homo sapiens
CLRCTGLRSVELVLFTLCDSLSTVQKFLCRSLSSADQ

SEQ ID NO: 974281 - protein, 63 aa, Homo sapiens
MSEYIRVTKDETDEPIEIPSGRRWDRFLLSTVTAQFPGACGLRTGIQCLSVWECRLVEEFFIP

SEQ ID NO: 974282 - protein, 60 aa, Homo sapiens
EAVMRQFEASLVKARAGSVEKLANQKRSFSRKEAEAPFRSLVRTHEKYGWHTPPVPAGLN

SEQ ID NO: 974283 - protein, 61 aa, Homo sapiens
LPPSWSAFLHKCRRHKKPSLLQSRSCRSPRLRTGSGPDSDSDDSVPELKDQGSTQGPTKKA

SEQ ID NO: 974284 - protein, 49 aa, Homo sapiens
MPKLGGFVLPWLQAAAGEQRSLGNMRRAWILLTLGLVASVSAGVESRLT

SEQ ID NO: 974285 - protein, 37 aa, Homo sapiens
LTAIRAENVSLPWPKAVLGAYSLFLASEAYPRVTPKG

SEQ ID NO: 974286 - protein, 82 aa, Homo sapiens
STVKALRVAARLGFSLSGHGYIKGIVKGHQFTTRGRGGPFAKVGLPGIPIRLRRRTEPVNSRQGHYTRPICVYARQEAPSQH

SEQ ID NO: 974287 - protein, 68 aa, Homo sapiens
SLEQRSFISVRLLSYLSAYRHPMEGSMDMDMSPLRAQNYLFGCELKGAQRYIHFKGEVMMKNEHPVYL

SEQ ID NO: 974288 - protein, 129 aa, Homo sapiens
MPKGKKAKGKKVARPQLFVKKQEGKKVVNPLFEKSPKNFGIGTGSIPPQKSPSPRFVKWPPYIMVVAGREPCFYMRLKAASCGFNQFTEAFDRQTVTQLLKVRPHVQTRDRAGEEAESFRPPEKKFACK

SEQ ID NO: 974289 - protein, 124 aa, Homo sapiens
TLYTYPENWRAFKALIAAQYSGAQVRVLSAPPHFPFLAKPTEPLNFLRKFPAGQVPSILGMMLDPVCLRARHFLLCEHGELRGSTLEQQPRWCSRVSSADSDIVPQPVPGCPHWVIMHTSKRPL

SEQ ID NO: 974290 - protein, 33 aa, Homo sapiens
MATGDLAHDGGLSFDEFIKISHGLKSTDVAKPF

SEQ ID NO: 974291 - protein, 44 aa, Homo sapiens
SIRAEMSRSVGPHAPPGATPPLFLGLGRVIQGELPKVQGLLTAS

SEQ ID NO: 974292 - protein, 42 aa, Homo sapiens
HGGLFRRQSTGAFPSPGGVSNPPPENPVNRGTKHTPPLEPRN

SEQ ID NO: 974293 - protein, 36 aa, Homo sapiens
RIHPLVPQVPGPVTSAMATGVSCLTGKVERIFDKKG

SEQ ID NO: 974294 - protein, 121 aa, Homo sapiens
MIDVIGVNTGQRLQRGSPGRWHTKKAAPAGPHRGPVARLALLFGAMAIPFFVLGPSLLGTRLGRKGYPSPPLWIQQGGFFKSWPRLSLSRTGKLYQKHSLHSTISSLTEHQTPWGAFFTMV

SEQ ID NO: 974295 - protein, 76 aa, Homo sapiens
EEILLDLKMQTPAEDVPLNPFKGGPSPLALSLLPYSLAWPGLAPNGKKRPFHGHLKDRWKFVDLVLKVITIIKVQF

SEQ ID NO: 974296 - protein, 44 aa, Homo sapiens
RNTQSLQDQHTDLTERALPEPCGGLTYTQRRGPGSKINSRGIVL

SEQ ID NO: 974297 - protein, 83 aa, Homo sapiens
ITLTWQWDGEDQTQDTELFGDQASRRWNLPEVGNFCGAFLEKSRGYTVPYFTHREGSPETPHTLDMKPCFQTHHTHSGHIFLC

SEQ ID NO: 974298 - protein, 38 aa, Homo sapiens
RPRCRKERKPKGKKVRSGPQSVVKKQEVKKSGESPVLE

SEQ ID NO: 974299 - protein, 52 aa, Homo sapiens
ARRMLGRVQTRVLRRQGTLKINRPVALPKPSFPRPAVRSFPPFGAPFRRRRY

SEQ ID NO: 974300 - protein, 56 aa, Homo sapiens
VLAGKERRLFGLSARLVPCFRTAGFLLAASLGRLLESRNGFHRLGKDPWPNAGDLD

SEQ ID NO: 974301 - protein, 65 aa, Homo sapiens
PESHFYMVLVLFLQVKKEPVSSGGVREFSAKCEVRILERLLQGYHGLMCRDKRQLESFCFLSGRE

SEQ ID NO: 974302 - protein, 119 aa, Homo sapiens
NTGVVKTTPKRQNGEGKGLILTIFVIRHGGLGQFHPILAILSLNSGALLTQSSPCKNFWRGEPSLSGERGSPHSDFLGPLDITLKPVRVTRGLHQCNSSSGYQSRNEAHVSYQLPPTTH

SEQ ID NO: 974303 - protein, 106 aa, Homo sapiens
DQGEKENPMRGTSQFAKLCLNIFFFVRVGGKDLRRGRPRVFGASLKRGQNPLVFFQRARIHLYRTPFWASRGKYKRISLSHSHKILRGPKDREKSLEKGSIRVRGV

SEQ ID NO: 974304 - protein, 33 aa, Homo sapiens
RATCQALQQHRSGLQAPSYKLSVVAWRCQVRVG

SEQ ID NO: 974305 - protein, 41 aa, Homo sapiens
QRSQDISTIGLGLLACFLHPSFNFKGDKGVYGAPVLPLTSN

SEQ ID NO: 974306 - protein, 58 aa, Homo sapiens
VTVSDRPLGVSITKAEVAPEEDERKRGDEKEIRVAAAKCRNKKKEKTEFPSERAEKLE

SEQ ID NO: 974307 - protein, 34 aa, Homo sapiens
MKGFIVLGLVLLLCLRSRARSLQGIELGPDLCKA

SEQ ID NO: 974308 - protein, 71 aa, Homo sapiens
GPREFATPRVGAVVGRRLSDIFLPSSDQFGDILEGEVDHSFFDNYLGRRKGILTLTLVFAKQNDAPREGFG

SEQ ID NO: 974309 - protein, 39 aa, Homo sapiens
DSPPLRAPSGGESDLTLSNNEACKVWRVCPHGPGICPTW

SEQ ID NO: 974310 - protein, 87 aa, Homo sapiens
MAVCGLGSRLWPGEPSLAARVLRRRQGSLYPRFQSRGPQGVEDGDKAKAFLEGNPGSPRFKPKREKKGFLVPSQEKGAPKVAQVFDA

SEQ ID NO: 974311 - protein, 36 aa, Homo sapiens
MGKKGGPVQGESRDFGVNLGSTLELQAPRDQGLDAR

SEQ ID NO: 974312 - protein, 52 aa, Homo sapiens
CVLSCDVGVDLTGALADSEHNLLFGELTEDEWLDISARLDCLIPGTICLGLE

SEQ ID NO: 974313 - protein, 68 aa, Homo sapiens
RTMPSDTMNFDVIKGKPVRINVVSASSITSKSRVGNIFNKNLDKSIDNKALYDTILLLGHIPSCKGRL

SEQ ID NO: 974314 - protein, 38 aa, Homo sapiens
IVSSQHQLNEYFYESVYGLMIFNLDPPPISSIQLYHNS

SEQ ID NO: 974315 - protein, 46 aa, Homo sapiens
RITRNVTFSGYKTWWASQRPGKASLVHLRALVITIFNFIFHGGLLP

SEQ ID NO: 974316 - protein, 75 aa, Homo sapiens
ACVGVELSDNEAVEQHRKLHSGMKTYGFELFGKRFPGEVFGLEFNYLLFNRVPKPFFFINAGHNFSEGFSLDTHR

SEQ ID NO: 974317 - protein, 79 aa, Homo sapiens
YKREHINLRAATWDFDICWGLPCRGALVLRLGGLAGRLPDEFLRLTKSRVTQSNFAVGYKTYEFPASHYCESRDRVSRL

SEQ ID NO: 974318 - protein, 40 aa, Homo sapiens
TGLPEVAKPRERQFRLGALLGGTRVCFPTTFRLRAYAGSD

SEQ ID NO: 974319 - protein, 43 aa, Homo sapiens
PDGGLLRGHDQSAYDGKDYIGLNEDTLAPGAAADNAAQITQRK

SEQ ID NO: 974320 - protein, 86 aa, Homo sapiens
QDCSPLSGDYVIEDVQGDDKRYFRRMISQQQEFGAVRSQVAEGWFLTKPRGAEKDRKSSASDAETSCSPGQSIDKSYLCGDTHAMI

SEQ ID NO: 974321 - protein, 68 aa, Homo sapiens
SLEELGGSERNVACSECIASGEWPTLDVPHVITLGLVGLQHRGQESPGILTSDGSPSQHSIHTGDWVL

SEQ ID NO: 974322 - protein, 58 aa, Homo sapiens
LLLKRSFHTRARSLGRPLLFLPFFFFWFLLTVPSGRIDDPFSIMQPPGEGRCKVYTRD

SEQ ID NO: 974323 - protein, 89 aa, Homo sapiens
ADGPRGRRRGRTGPRQQAPLRPILTHGIQSSPHFVMFFAPWCGHCQRLPADLGLTWGDIYTSMEDATVYVAKVELHAHSDVCSAQGVRG

SEQ ID NO: 974324 - protein, 102 aa, Homo sapiens
MAYQKLAAGVPPDPTGQPAAYNHCLRASPPPAVQLGIECKNLFEVVTVNAWNVNAVEDNCLQNDGEDVNATQPGCDVLLGGPVGELQCFCDVETRMLCLMMR

SEQ ID NO: 974325 - protein, 92 aa, Homo sapiens
RFPGPSPVLQQSASSFNMTECRCVLRQGPSWQVEWPQPISKTAVGPIARVKLAAAGAACQQADHFQISNYKGIIDCVVRISQEQGVLYFSRG

SEQ ID NO: 974326 - protein, 71 aa, Homo sapiens
LRLCTVNSVEEKILVAAKYKLNVVIKVIQAGMFFQKSLRPRAGGDFFGPLWACGGRMGARFRIPPVAGFAA

SEQ ID NO: 974327 - protein, 59 aa, Homo sapiens
MAYRSVVVQASAQDAVVSSAGTPQPEGGYDGIKAAVKIPYRLGKKEEARQDGEASLSRT

SEQ ID NO: 974328 - protein, 49 aa, Homo sapiens
MTSALTQGLEESQTSSATWVLSEGSGPWRQLGTWGMIDQAAKSHSLRLV

SEQ ID NO: 974329 - protein, 39 aa, Homo sapiens
LGSALLLLTCAWQNVGVQLAEDVTVSGVIRSVATGLSIE

SEQ ID NO: 974330 - protein, 41 aa, Homo sapiens
EEKKKEVPSCAKKPLKKKRRNFAELKIKRLRKKFSQKNASK

SEQ ID NO: 974331 - protein, 51 aa, Homo sapiens
MAPHRQPPHAHQVPPSHTALWPLGKSSFLNYLNGPTKVFDMGKQGFNLSLI

SEQ ID NO: 974332 - protein, 54 aa, Homo sapiens
GSNFGGGGSYMILDYTSVSNFGPEGGILKQSLALCRGAILATRPSAMRPRAACC

SEQ ID NO: 974333 - protein, 82 aa, Homo sapiens
KKDLVPLPGCSTRTLTEALAPRFQRAEIHVWTYTTYNPGQEDIRGAPTPDQYISGRHTRALGRTMAIYGFLYTAMINTLETS

SEQ ID NO: 974334 - protein, 79 aa, Homo sapiens
PARSGAESGADSAHSGGVEELIGEHLSLTRDVLTESLRYQDRRASSAPEWRDLISTALLHRVSFTASLRLTALQRMQLT

SEQ ID NO: 974335 - protein, 61 aa, Homo sapiens
DYFARLYLTYDDFLYHSDIQVHSGNVSTQCLPALVYMERLEVHSNCSVAYFNASRSQGPAS

SEQ ID NO: 974336 - protein, 64 aa, Homo sapiens
VARAQAPWAVNISAGGVSGRTKDQPGAQGHMKMLVSALETSNLLKTAMSCFTKCKFTTHSFLIA

SEQ ID NO: 974337 - protein, 61 aa, Homo sapiens
KYFCGCWDFPSAAWRLQRKVVAYWSEEQPAHPLQVGAVYLGEEELYMTRWPGQASREATPS

SEQ ID NO: 974338 - protein, 39 aa, Homo sapiens
SGVLALPNGGFRLGSRGLFTRFGDAPGPKIKAEEIGSPR

SEQ ID NO: 974339 - protein, 61 aa, Homo sapiens
EATYAAFIEKFRSRGRKSLSQTNPSFHVNPSSQICEAKKPTDQTRLSVRSQQVWLLALERH

SEQ ID NO: 974340 - protein, 97 aa, Homo sapiens
RSIWDRETQKYKRQAQADRVNLRELRGYYNQSEDGSYTFQRMFGFDLGPDGRLLRGNTRFAYDGKDTSLNDDLRSGPRETRSDHQRSGGALSDSESY

SEQ ID NO: 974341 - protein, 102 aa, Homo sapiens
GSDIVFKPCVAILTHRRDAREDRATWKSTYFLKIIQLLDDYPKCFIVGADTVVSRRFSRSAFPFAEDFGAYGTRHIIAGHPRHLRTTQLVRTCCFISGGMWA

SEQ ID NO: 974342 - protein, 67 aa, Homo sapiens
MRCKTIERNEERTCIRGRCCTNICEFLQTSRGFERNTTIIYDLRGGYTNTHPFLKGVFETLSGAGTV

SEQ ID NO: 974343 - protein, 38 aa, Homo sapiens
DSAASCSSRFVGPAASRAYGRRTGKLDGSVMRLLDLFQ

SEQ ID NO: 974344 - protein, 49 aa, Homo sapiens
ATTTGASSRQDTGEPVEIPTYISSTNPDACKLRVQAQFVKPGFALDFHP

SEQ ID NO: 974345 - protein, 105 aa, Homo sapiens
SSPGRLETRPQDCPPVGLQRPKGNLLLKYFIKKKQSLNSDHQRFLKPRGGPQLLIKGFPWVFPGVFGFPSKRTPWPSQTPGRAQPWVLWAPFKNNFPKNLLKEFG

SEQ ID NO: 974346 - protein, 40 aa, Homo sapiens
AIPVPSVRSCLLALRITWALHMKRAHISRDGPRPPAARAL

SEQ ID NO: 974347 - protein, 50 aa, Homo sapiens
LSQHGAPQQKRRIRRGKTISLTDLSSPEGWGYLVEEAPMFPNQVSWLCEP

SEQ ID NO: 974348 - protein, 44 aa, Homo sapiens
MLDEDEDERVDEAVLRQFTGDGAFPEDQSPPGPFKLKPHGRLPQ

SEQ ID NO: 974349 - protein, 101 aa, Homo sapiens
ASLNDLPEERLRRNQNRVAVQMPRDRKKARMSQLEQQVVDLEEETQNFCWKIAFREQLMPYVETRSKTDGIDSLVLNGGALVGYVQQSVFVVNVISGTFER

SEQ ID NO: 974350 - protein, 40 aa, Homo sapiens
QTKGKVKLAAVDATVNQGSSSRYGFRGFPTIKIFQKGEFP

SEQ ID NO: 974351 - protein, 49 aa, Homo sapiens
YSGGREPGGYGYWRLVLLLGKTSWERGLRLCPYPSLQGFSKRIGSENSR

SEQ ID NO: 974352 - protein, 45 aa, Homo sapiens
LGLSAAGRRHSRGGMAHCVNLGFKLSNSLGTILIDKGNQLPGLTH

SEQ ID NO: 974353 - protein, 33 aa, Homo sapiens
AAGRFEFCHATALGTPGTHPISHLAMQIKDQMA

SEQ ID NO: 974354 - protein, 82 aa, Homo sapiens
EKDIPEETEETKTYGNLIFWFRNNLFFTIENVKAKIQDKEGILLDQQRLIFAGKQLEDGRTLSYYNITEKSTLTWSSVYEVD

SEQ ID NO: 974355 - protein, 50 aa, Homo sapiens
FGTAFFYARRAKPVVKPSDVGRVYKGGFYALNAKFHAKINGNLSSGKALG

SEQ ID NO: 974356 - protein, 74 aa, Homo sapiens
KCRIRRRSVPDCLSLTAIVFRASRQRLWGIGTRTEPAGPFCSCDFPPYGFQRGVLLLAICWERILQFVGFLILD

SEQ ID NO: 974357 - protein, 35 aa, Homo sapiens
FGYTAATSPFVHATKQFHGLSLQGLSQLGGAGSRG

SEQ ID NO: 974358 - protein, 34 aa, Homo sapiens
MGAKRVFSRVARSVFARSHVSLRSGATTLKRSPY

SEQ ID NO: 974359 - protein, 35 aa, Homo sapiens
MLIPHFKYQTYSIETQRRLYTLFYNQRDIRQRAEK

SEQ ID NO: 974360 - protein, 74 aa, Homo sapiens
HIIQRMYGCDLGPTRLLRGHDQSYDGKDYIALTEDLSSWTAAETGLKIPAKWKAARVATAESLPGGLSVSARDT

SEQ ID NO: 974361 - protein, 101 aa, Homo sapiens
MSCKLKEGGFLKFLAAGTQLKVAPILDFPDGPVPSIKRKSDGIYIIILKETWEKLLWQLVQFVAIETLLMSVVYPPGLLPQACLKFPAALEQSILALIWTS

SEQ ID NO: 974362 - protein, 98 aa, Homo sapiens
VLVEVTSSLNLRGILDAPPCCPGRTGRPGGPPTSLRIIHLLDDYPKCFIVGADIVGSRQMQQIRMSFRGRLWSLMGRTTMMRRPSGGNWRPPSSGELL

SEQ ID NO: 974363 - protein, 58 aa, Homo sapiens
GRTFRLSVPTKAADHLSKQGRGVLLGETGKEKLPRYYKKHRSGLQEHPRRLLRAPTYD

SEQ ID NO: 974364 - protein, 38 aa, Homo sapiens
LHKNMKTPVVLPPAGGQASKIAVLSQVASFMGVWAQGL

SEQ ID NO: 974365 - protein, 66 aa, Homo sapiens
VAQLPALTGVDRGRRWDNPFPLLGGGNLAGPFFGCGLASASWTWAWGYNERILHIQCPGERARWVI

SEQ ID NO: 974366 - protein, 101 aa, Homo sapiens
IQLAAVTEDKYEILQSVDDAAIVIKNTKEPSLFLNIQLTIPVVRGRNWGRFRSGKTLYRVQAPPRRVSGTAQDISSLLLRAPPDTTMWSQDRANGCWSLVI

SEQ ID NO: 974367 - protein, 58 aa, Homo sapiens
MTATLSWYIFLIPDAGAAQGRSHVELPGVVALQEASYYFFGGCNNWWGSNHQLIIHRE

SEQ ID NO: 974368 - protein, 69 aa, Homo sapiens
PKNFGTRQNTGVVKTTPKSQNGEREKNYINIVVIWTRRFGQVHHLLGLLSFNSGAPQKDPFKNLGRESF

SEQ ID NO: 974369 - protein, 41 aa, Homo sapiens
AFTSLSTSTPVYCPGRRPRYLWGTTIDEKGLTWNRSGQAKP

SEQ ID NO: 974370 - protein, 44 aa, Homo sapiens
MGGFSWRGLLLYIGAPPSFLMDSGLLSYMMFRQRFLAPGPHPGV

SEQ ID NO: 974371 - protein, 49 aa, Homo sapiens
MALGSPGVPPETCTLRGVSRVPQENLSPPNRGNIRHYWQGPSLFRSAAE

SEQ ID NO: 974372 - protein, 61 aa, Homo sapiens
HHYRMCPHFAGLKLIPRHTGWTTLIGKGARGLPLSPDYHRLHIWASFWGHGFFKRDMVDPF

SEQ ID NO: 974373 - protein, 48 aa, Homo sapiens
MDYLPGPLIQTTLRMFSDIYKIREKIADGVRAWRLRRKMQKDQKVTFM

SEQ ID NO: 974374 - protein, 44 aa, Homo sapiens
SKEFGTRVCRQNTGVVKTTPKRQNGKGKDYINNVGNWQGGFGKV

SEQ ID NO: 974375 - protein, 59 aa, Homo sapiens
DTWVRKVLVRARAQRASLAMPREEFKDFLFTARRKDAKSVKIKKIMANVKFKVRCSRYL

SEQ ID NO: 974376 - protein, 41 aa, Homo sapiens
RPSGVSCADRSEGSWPNRAFAVPAATVQRLRRFKKRIVGSE

SEQ ID NO: 974377 - protein, 38 aa, Homo sapiens
EYKLQGLQQRSSVLPFGKAIFLRPVRQPPRATGVTPLP

SEQ ID NO: 974378 - protein, 33 aa, Homo sapiens
EYKFKVSTEASVLIEETIFKGQAPGPQVYNLAP

SEQ ID NO: 974379 - protein, 36 aa, Homo sapiens
GYKTYNQCATHNWLQCVTPSQTTFTGITQSHPMRYL

SEQ ID NO: 974380 - protein, 36 aa, Homo sapiens
MLISGNDLNSIPALMYPHGNIREQAEMQLIPIMHLF

SEQ ID NO: 974381 - protein, 42 aa, Homo sapiens
GQRGGRTMPGVTVKDVNQQEFSDFLAACRKEYRELKGPRMGG

SEQ ID NO: 974382 - protein, 41 aa, Homo sapiens
MGEKRHEFESGISQLFWELGDELWPTKASPPGILNNSGHLK

SEQ ID NO: 974383 - protein, 40 aa, Homo sapiens
ESEVDIHLGPLSLSLQGFHLQLTQNFKSTCAHYYSINNGA

SEQ ID NO: 974384 - protein, 44 aa, Homo sapiens
ASFAFFLIRLLPCRRLAHAGVPSFPFFRRNFPPAFIRPEVPETF

SEQ ID NO: 974385 - protein, 35 aa, Homo sapiens
ARIPDPETIGPDGHGARRQSIAEVTSAISDMFDRL

SEQ ID NO: 974386 - protein, 65 aa, Homo sapiens
AEDPGVAMGRRPPVVTGIVRTSPYPKSRFFAEVSLMPRLAFLTWGRKRAKVDEFPILGPWVSMNM

SEQ ID NO: 974387 - protein, 31 aa, Homo sapiens
MVVTIAPRATGNNGSKMYFRHSTTMKAFDVK

SEQ ID NO: 974388 - protein, 88 aa, Homo sapiens
PKLPCKKRRTTVTESLQHKGNQEENNVDLESAVKPEFLTKVKGFEFRFNYSWVPGIGRLSWLRGHSLSRIQEISLVWEDTSLRSGVLT

SEQ ID NO: 974389 - protein, 70 aa, Homo sapiens
SPLPPSAAAAGTALRLPECCKSAWLKVRRPCVRCCPVQVRPCMDVMLTPGAPPMQPTDGRWCVAAHVNKN

SEQ ID NO: 974390 - protein, 96 aa, Homo sapiens
SKEFGTRVTRSPRSVLTRPRFFLFLDSIFGGSLDRPFNGNMQLFVPGPGALNTSQGNRHRERVCARVYKVKCEPYFVGANIPAQRYMCRFSRDAGP

SEQ ID NO: 974391 - protein, 68 aa, Homo sapiens
IQRIRHEAAEPHQKSEFCENPYGEDQLPPEGLTPWKRNEKVKGQEPRKRKEISPDTAETVLFSCQAGP

SEQ ID NO: 974392 - protein, 45 aa, Homo sapiens
SKEFGTRLPLSQYCAYCHTSLCRLRRRVGLALLVSISNKNWLGYG

SEQ ID NO: 974393 - protein, 44 aa, Homo sapiens
RWGFSLKGGTDSPETPPPACVEIFPIFEQGLPFKRAHLYGPYLK

SEQ ID NO: 974394 - protein, 40 aa, Homo sapiens
KFRKFNIPQNVVVNLKFGKNKEFVSLPMRVSCLNAGLFSQ

SEQ ID NO: 974395 - protein, 109 aa, Homo sapiens
MERIKEDRPITIRTTRATFNPFIRERGFRFSYTVQGQACAFEIPPPEDEIQARPRENWMGDHAPHGATSQPDFEGRQTVKTIVQTLYRHVGLQNELDGSKSVKILCGAR

SEQ ID NO: 974396 - protein, 39 aa, Homo sapiens
EDSLAAVPAAVHWVKNDTNISHLKSKLQQYLPKHHQLRC

SEQ ID NO: 974397 - protein, 43 aa, Homo sapiens
RRGTVDAVVSALSSQLKELEDPREGVAASRVPAIKLLQDPGGQ

SEQ ID NO: 974398 - protein, 38 aa, Homo sapiens
PRVGKALANFQVHIRMRVPFLKTKKGFKKFCPNPPGAP

SEQ ID NO: 974399 - protein, 81 aa, Homo sapiens
FLCRVCVLPPPPPSGSTATMAYSGQQSLRQQLAFCSGGRAPRLCSGNPQRLRHGASHGIQQPAFLLTHKDTFELSTFLDSQ

SEQ ID NO: 974400 - protein, 39 aa, Homo sapiens
MTEYNEEKKYGGRGYWPGTKPNDQEPGKGKKQRGGTTEG

SEQ ID NO: 974401 - protein, 110 aa, Homo sapiens
TVDCSVRLRGQSPSAPALNELVSFEDLLFEKKFQSEKAAGSVSKSTQFEYASCLVRKRDNDDIRKGIVLLEELLPKGSKEGQRDYVFYLGRGDYRLKEYEKALKYVLGLK

SEQ ID NO: 974402 - protein, 44 aa, Homo sapiens
MVEAISWAAWPLVAKQVLLAPKVVVVRFEGINIFPEFLQEQVEG

SEQ ID NO: 974403 - protein, 40 aa, Homo sapiens
RGRYCGEHMEVKCAWSAAPARPLSGRLYEGPALRSLRYSV

SEQ ID NO: 974404 - protein, 48 aa, Homo sapiens
KGGRKDISLGAAKLSQQTKGFGPRAEIHHKCRVPGEGNKGNTVPWGLT

SEQ ID NO: 974405 - protein, 65 aa, Homo sapiens
DSQSGALYISKVQTEDNSTYIMLVKRTRQCRHEIERFKAVKSSLPRYPQGLSIKNGEGVDRVYMR

SEQ ID NO: 974406 - protein, 39 aa, Homo sapiens
GFPSPLPIRRGGTYQPVLDPARPGKGGSTEPTVFSGPQK

SEQ ID NO: 974407 - protein, 40 aa, Homo sapiens
RIRHRFSKWLQLLKHPAAGVLSVKDKALLVFKDGGFGQPI

SEQ ID NO: 974408 - protein, 34 aa, Homo sapiens
TDRDSHDEAAVEAEEEASYPKTKVDNNCFGTWGP

SEQ ID NO: 974409 - protein, 52 aa, Homo sapiens
HFAYCEASRSPVGLIRWRCKEPFLLGSLDTPCQLGRQMHYGAVQLAHSGCWA

SEQ ID NO: 974410 - protein, 32 aa, Homo sapiens
KHKKHNTHKKDKRCRFSFFSFLFTPSSHFQLA

SEQ ID NO: 974411 - protein, 70 aa, Homo sapiens
MVTQAKAQRGAHCTAPVFQGLAVSRSAMYTEGMYRGGTQPLNPRLKGKEERFSHCYKPVVVTDGGTGVVI

SEQ ID NO: 974412 - protein, 68 aa, Homo sapiens
DREVTPDQNCCPGDSYQDTGCHGWAERLFPANVANSVYVLEDSICGPTDSDHDYLHLEHNPRPPDGGG

SEQ ID NO: 974413 - protein, 33 aa, Homo sapiens
RVKKLRSQILKEKKTEAKRVDAWVGKVEKGLTS

SEQ ID NO: 974414 - protein, 53 aa, Homo sapiens
VNGKEYKCKVFNKGLPVLHMRKPFLKRKGAAPQSPQSVTHLSPHFPGGGGEPR

SEQ ID NO: 974415 - protein, 40 aa, Homo sapiens
RKRAGFDTNSGATILGIGSPNERAHEKLVSDSALIYRECA

SEQ ID NO: 974416 - protein, 40 aa, Homo sapiens
ELKLSYRSPGEFSTSQILYWQMKEPNPEEYLKKDHGPLGV

SEQ ID NO: 974417 - protein, 46 aa, Homo sapiens
MIEQQKRKGPELPLVTDKRTTELLFGGSSPMRPGQQQAHGREAFLQ

SEQ ID NO: 974418 - protein, 41 aa, Homo sapiens
AVTVLRKKGPSAAQANPGKANLSTRAEGEVVEPPKNMALLA

SEQ ID NO: 974419 - protein, 33 aa, Homo sapiens
MSANFIKHSGLSLAILMQSTTLCRSDPLRSQRS

SEQ ID NO: 974420 - protein, 65 aa, Homo sapiens
AESKMGHQQLYWSHRENSAKVLVSCRVCSNRHGLYTGKYSLNMCPPDVYAQIREGYRFHEVRLNA

SEQ ID NO: 974421 - protein, 75 aa, Homo sapiens
MPHMAVIKYSHSAYTCLLCLEKMLKVQELPPGSAETPDSFEKHIENILHVGLPIQHFETSEKDIALLLKNAFRSS

SEQ ID NO: 974422 - protein, 74 aa, Homo sapiens
AAQHEDIPGLILWSMYRRPMVHPSQNTNLPEEYKVPWRLGHEEDMMSLKTVLPLHLSRRRYILVVVYQEDDGDM

SEQ ID NO: 974423 - protein, 48 aa, Homo sapiens
MYLPVQDAREQRFEYKQKNIQFAHANKPKGRKAKMAFVNSVGKQLVTS

SEQ ID NO: 974424 - protein, 51 aa, Homo sapiens
PHRKFCVWDLQTRSTVTGYVRSIPHMHIEGLKNLTRIKIVKKLAKKYDAFL

SEQ ID NO: 974425 - protein, 51 aa, Homo sapiens
TEQPIWRHREKFKVTYLRKTYELRPRCWTCYQAECDDYVPETNEVPKTAKR

SEQ ID NO: 974426 - protein, 34 aa, Homo sapiens
MANETNLKANDNNTQDKRANLISYTSALVIFIAE

SEQ ID NO: 974427 - protein, 63 aa, Homo sapiens
MFQYDSTHGKSMAPYRLTTGKLVINGNSITMFQERDPFKIKWSDVALSTVVEATGRFTTMMKA

SEQ ID NO: 974428 - protein, 68 aa, Homo sapiens
RVRFPSSPALIFTATMAYEGQQCLRKNWPLQRRQQHQALERETPSGLKHGAFYGIQEAGVAVTDKDTF

SEQ ID NO: 974429 - protein, 69 aa, Homo sapiens
NLNYKGGTEEGTQEKGTNCGAESWPSVQPLGGAGAEAHQKLLVAVVGWDDLARANEDTGAKVKLETAGT

SEQ ID NO: 974430 - protein, 44 aa, Homo sapiens
MKTLELLSLKTYSSRALEHSALQGQDEEDRRPIPRRTTWFASGG

SEQ ID NO: 974431 - protein, 74 aa, Homo sapiens
APTPHCTHSNRNGILMLPTENSRAIYNYAKGPNVLGPLRANTTLRLKAENFFTKGALKTGKITFNPYITARLWV

SEQ ID NO: 974432 - protein, 48 aa, Homo sapiens
GAPLVFSVLGLVLALPRLGLPRVKGLNLDFPAPWDGPQRIWTNFSRDT

SEQ ID NO: 974433 - protein, 50 aa, Homo sapiens
RRGVQVLRLYQLLSRASESTSSSTTLSGSKPPNLGERLSFPGPTGNFRVS

SEQ ID NO: 974434 - protein, 38 aa, Homo sapiens
PVGTWVVIGLMGFELMASDWGTRLSEAPVKHPQNAKTT

SEQ ID NO: 974435 - protein, 44 aa, Homo sapiens
MKDIWFRARYPALSGCARGSSLGGPGDKPAAPPRKGKLYVQNKK

SEQ ID NO: 974436 - protein, 42 aa, Homo sapiens
ALVVLSHCLDRSPLVSLYSQSFVPPIVIPHPPRGFNCPKKGC

SEQ ID NO: 974437 - protein, 58 aa, Homo sapiens
SHTYVCHVYVSQAADSKSQVKAHKGSVSMREQVSAQGDREHTCHTPHLERDTTHIIII

SEQ ID NO: 974438 - protein, 32 aa, Homo sapiens
EDEEEERSRRKEQRKRARQRSRAPKEGGGDEP

SEQ ID NO: 974439 - protein, 71 aa, Homo sapiens
GGSKTNAWLGSSSLWRCPWPVVPSILFHKAWGTIFGQLFFGAFFGKKELRILMVALDAPGRTTILSKSLNL

SEQ ID NO: 974440 - protein, 75 aa, Homo sapiens
RKEGRFAGPNLATPSRGGPLGPFSFPFPLYKPLPSRPFLKPGRAPSPWRPPKEIKPPFSNLTNKFSLTALFNFST

SEQ ID NO: 974441 - protein, 71 aa, Homo sapiens
QQLQRSKQSSRHSKEKIASHLFHWQPFLTIVTPQGYLDQGSGSYCHLFKIIFRCPKIILFFAVCPRNCRRG

SEQ ID NO: 974442 - protein, 75 aa, Homo sapiens
WLLSGGRLFAGVRRAPGGRAPFGVRVSRVFPSPGLFWVAGFVWAFFLSWPSRFPPSLGFVGAFGVCLCLWLACPV

SEQ ID NO: 974443 - protein, 38 aa, Homo sapiens
QPMFDGFFFGPAAAINCDPIWEVLFGKNYNEEKKRGPP

SEQ ID NO: 974444 - protein, 63 aa, Homo sapiens
MRMGGLSLPRVCPLYTVALFCERIIPIIFVKKELLRDRGPNKEPASHTRTFSIFIALNTPNSS

SEQ ID NO: 974445 - protein, 77 aa, Homo sapiens
LDQHYTVDMTETEHSIQHPVTKCHGAAFGPLQGLPGPIPWLTPGSWEPLPLALLPLNLEPYRKPFLAFIGWQENQNG

SEQ ID NO: 974446 - protein, 45 aa, Homo sapiens
EGYALPHAILRLDLACRDLTDYMEDPHRGGAKDLTTRADGGKSWS

SEQ ID NO: 974447 - protein, 35 aa, Homo sapiens
LALATYVLEDRWYLLTPLMPPDVFSMKENNDLNLN

SEQ ID NO: 974448 - protein, 89 aa, Homo sapiens
DLLVSRHQPQMTQVTEQEFPSWKKGIDRRFEVFAAQAGDTSWSSRSGLKIEFSGSTMSIDLKYFGVQLPLAPATSFPFWNPTGPNPASS

SEQ ID NO: 974449 - protein, 35 aa, Homo sapiens
SEVEQKKEADLPQVHYAAWTRTSCWTSPYGAADAA

SEQ ID NO: 974450 - protein, 42 aa, Homo sapiens
MGFSQREKVKLYQCKKQGHNCLRFRAQEFSSYNGNMKRLRWV

SEQ ID NO: 974451 - protein, 41 aa, Homo sapiens
LNEGTMGPKGVNTETCVRMGRAEDLGGGSSDVPQIPMEPEN

SEQ ID NO: 974452 - protein, 43 aa, Homo sapiens
APFPGTGGRSYALAAQLCNPALPPRAAPPFNAAFPFAHPPLGP

SEQ ID NO: 974453 - protein, 51 aa, Homo sapiens
MSAVLLSDQSEKDISKFGVLSPEDFGRYQGLCVIPKGNNWDGMDVGNRGRG

SEQ ID NO: 974454 - protein, 44 aa, Homo sapiens
YGSQTGASELSIQGSIPREVPKGGIPRIGILGTYGAQEAQISSG

SEQ ID NO: 974455 - protein, 51 aa, Homo sapiens
LPVGGNNIGRKSVHSYLQRQARTLVFGASMIDKRPGPPGDSLKRTLLGGQT

SEQ ID NO: 974456 - protein, 42 aa, Homo sapiens
MPRFAFLDLGRKKAKVDKFPLCGHIVSDDISSCTLEALEAVR

SEQ ID NO: 974457 - protein, 59 aa, Homo sapiens
VRDNLTLWTSDMQGDGEEQNKEALQDVEDENQLDMKPTRETIFDQPLLPIPTFGNSPMF

SEQ ID NO: 974458 - protein, 69 aa, Homo sapiens
RASASCSHWREYLFYPALLAQLRICLRVSPAEKSSAGIPHAQVRLVRAKLRFEFAAENYLSRGWPRDGR

SEQ ID NO: 974459 - protein, 50 aa, Homo sapiens
ARVADSRSARQWRPRRPAHRPIKGILKDKTSTTSFMCGVGRHRPQGNVRT

SEQ ID NO: 974460 - protein, 77 aa, Homo sapiens
MVFRRFVEVGRVAMSSFELIAGKLVRDFKIVIDQNQRALVDGTLPLKVKETGPCLFKCIAAHSIFIPQSFPHTCPPR

SEQ ID NO: 974461 - protein, 51 aa, Homo sapiens
ARRALRPSKSLLVATDDGQSNWQFWNEEKAFAGLGRLRPPRAIRGNFQGRN

SEQ ID NO: 974462 - protein, 44 aa, Homo sapiens
FNGDYKASNTRCQRVSAICGPMSIMSSTLVLGGTISLSFSPKTQ

SEQ ID NO: 974463 - protein, 71 aa, Homo sapiens
APRFGTTRRCAPPRLQLEELRVAGIHKKVARTIGISVDPRRRNKSTESLQTNVQRLKEYRSNFILFPRKPS

SEQ ID NO: 974464 - protein, 73 aa, Homo sapiens
LYTAATVVSSVFCWWLTQGPPPRVDNLISYPWGPQGQGWVKLFGGTEVGLSYGNTLVLKSYHILTTRVERGTH

SEQ ID NO: 974465 - protein, 52 aa, Homo sapiens
MVVGTGTSLALFSLLFLLLFAGMQMYSRSWASTELVTIKGGFFGPGFSGLGQ

SEQ ID NO: 974466 - protein, 65 aa, Homo sapiens
FVLITVALALMHWVLIPNHWRLGVTKWPLDSWIPYSGSLIKWVLCLIELSLDVRGPSINPFRVPL

SEQ ID NO: 974467 - protein, 55 aa, Homo sapiens
GSSNVLIRGVAGGLGSLTSSKFRLHGVSRVQRGAPDPCTVTGNSNCGGKSGTLAA

SEQ ID NO: 974468 - protein, 63 aa, Homo sapiens
MPLARSWVCRKPSVTPRRPLGKSGFDQELRLIAENGLRTNRKLWRDKLTLAKDPKAAREPLDA

SEQ ID NO: 974469 - protein, 40 aa, Homo sapiens
ASSWKCIVLNPAWHLDARGIPGKTARPGGPPYSLRITHLW

SEQ ID NO: 974470 - protein, 85 aa, Homo sapiens
FEGWNLINLAFKVYNNRKKLQFLASTVRQTPATSSAHKKFQKPEPQQPGVSPETFFHRSFLHMSRISPLGHGIVPSPGISPKTRA

SEQ ID NO: 974471 - protein, 87 aa, Homo sapiens
LGGAKTHNTMSGVAHRAFENDVDALCNLPDFFNYLPLSRQGPASVPSGPRFPVYRLWFLSFYTHCAPVSHTQVSHQMWDIIHSLVYD

SEQ ID NO: 974472 - protein, 40 aa, Homo sapiens
FESRIFQALLELEMNSDPKAELKELNITAAKEIEGWVCVG

SEQ ID NO: 974473 - protein, 51 aa, Homo sapiens
MTTDVGVVEVLALEQEQLSSDLGGLSLSGREDSQERFFWEPLGLSPWGPQE

SEQ ID NO: 974474 - protein, 61 aa, Homo sapiens
MSRSVALAVLALLSLLAGAIQRTSKDFKVYFTANPGGDWKAKFPGIAHVSLGSTHPQMKVA

SEQ ID NO: 974475 - protein, 88 aa, Homo sapiens
MSRSVVLAVLALLSLSALRLSAYSQRFRFTHVIQQRMGKSNFLLPMCLGFIHPHIEVLTYCRVGERIEKVEQSDLSFSKDSSFYLLYY

SEQ ID NO: 974476 - protein, 34 aa, Homo sapiens
RQNHLKKTMKRKSNQKARILLSYIKPPYGPTHIF

SEQ ID NO: 974477 - protein, 53 aa, Homo sapiens
MCSCNGASQEQVKDTSHTATSADSRADTAAPPSGTFQVLSSALVLCGCLLDSM

SEQ ID NO: 974478 - protein, 37 aa, Homo sapiens
MDRCVYSRYLPAPGVVVPLTVELMATVAKQLVPSCVT

SEQ ID NO: 974479 - protein, 41 aa, Homo sapiens
RDSHLVVWALLVLLQCIYVKMQYAFCYNNKCSLSLIRSQQS

SEQ ID NO: 974480 - protein, 47 aa, Homo sapiens
LWVLLPSSRMSILAIGINSTLAPIEAKPHPNYTRRFSSALGKRGVYN

SEQ ID NO: 974481 - protein, 73 aa, Homo sapiens
EKKEVPAVPETLKKSEEFAELKDQGALEKKVCPKDAFKGKEEALSIKKQSTITGNMADVQPSNSYGEDRKKSS

SEQ ID NO: 974482 - protein, 40 aa, Homo sapiens
DIQTERAYQKQPTIFQNKKEGPSWRNLAREEGFPRVLKGT

SEQ ID NO: 974483 - protein, 65 aa, Homo sapiens
GFSSTVNGVTGIQNEDGILHNSAIAVYSCIHGLHNRNQHYTWEFRPFAWRFQGPDLDKGKITIFG

SEQ ID NO: 974484 - protein, 40 aa, Homo sapiens
ISPNFSFMGQLLQFEQLAPTVRAEAGEPRMALDRAPPPPP

SEQ ID NO: 974485 - protein, 51 aa, Homo sapiens
PRGTTPHPCPARRGEPRCNAAGYVDDTQCVRFDSDAASQRMEPRAPRIEQE

SEQ ID NO: 974486 - protein, 58 aa, Homo sapiens
EPGPQERPRGTYKVDLDEEPKASGGSEERGHFNHPASGYRQRGHRALGTGLGATEGLL

SEQ ID NO: 974487 - protein, 32 aa, Homo sapiens
MLPDPKNTHNGGSRMTAQTVDAVALGVLPLRT

SEQ ID NO: 974488 - protein, 46 aa, Homo sapiens
TKKARKAPKAARAVTQADFEGYGLQDRTAHESAKPKKHGSRAIWEA

SEQ ID NO: 974489 - protein, 50 aa, Homo sapiens
KRLKSDPVEISEPTEGQTEGGPSELSTGLSGGPKCERGGRALSGGKAQAF

SEQ ID NO: 974490 - protein, 40 aa, Homo sapiens
GKPRADTGGPDTQQEGAGQTRPGARKPCWGAPGDQRKPQA

SEQ ID NO: 974491 - protein, 30 aa, Homo sapiens
RRSEAKRKNHLLFWGLAGFKAVHVKAQEDE

SEQ ID NO: 974492 - protein, 89 aa, Homo sapiens
VFLCPSKETGSFLPLPERDLWNFELERDDLAYLVEEISKQQSIQEEAEHKSLENLQPDDVIKKKNQFSREIFKPAAEISISKEEPDINH

SEQ ID NO: 974493 - protein, 32 aa, Homo sapiens
MKVELLKFKRVKDLPRKGEALRKDPRERFFQF

SEQ ID NO: 974494 - protein, 32 aa, Homo sapiens
MRPANDVLSEDAISTREHHLEQRRIALEKEGK

SEQ ID NO: 974495 - protein, 36 aa, Homo sapiens
RDFPEAYKPTVYENTGGGRLMMHQISLGLWEKNRTM

SEQ ID NO: 974496 - protein, 44 aa, Homo sapiens
SGGVSVPALWSEVNRYGQNGDLKGALKTVNKILQINKDDVTPLH

SEQ ID NO: 974497 - protein, 71 aa, Homo sapiens
RGSLGGRTMLDFAIFVLTLLLALVGAVLYPYPGFQTSCRDFRDYSPLKKMDPFETMLKLLLRYQSGGGSLS

SEQ ID NO: 974498 - protein, 55 aa, Homo sapiens
AERSVAVSSLRHGVCSATEYLVYSRKGGVIFAKIVNSGSLYSRLLFDQIIVKLCS

SEQ ID NO: 974499 - protein, 36 aa, Homo sapiens
VNLNSSLGPLNTSIQEQYNEGENPLQSGTPIKFNKA

SEQ ID NO: 974500 - protein, 48 aa, Homo sapiens
QHLVVPKPLAWTVIFLGSFTHRFVTLLCSCLSDPSVSLGPRRDGPGFI

SEQ ID NO: 974501 - protein, 43 aa, Homo sapiens
CCSHVSSVSLKRFQHILRVLNTIIDRAAEYSLFSCAGINGLSG

SEQ ID NO: 974502 - protein, 37 aa, Homo sapiens
CGTLTYNQCIKYRFRACLFSGINPRWGGGKNAATGWP

SEQ ID NO: 974503 - protein, 63 aa, Homo sapiens
YDKIRLRERHRLQNPVSGAPLSTWWGHTICRARLEILQLLKATVGMTCSTTSSTERDAVRPEA

SEQ ID NO: 974504 - protein, 30 aa, Homo sapiens
METIRLLIQPIALGRVTNITAGTYCTYLER

SEQ ID NO: 974505 - protein, 34 aa, Homo sapiens
IPVIIGRTVIIHPPPTGNLPSDAETVIWLNWWVR

SEQ ID NO: 974506 - protein, 48 aa, Homo sapiens
LSADHELLSPTNYHFLSSPKEAGLCKAQITAIISQQGDIFVFDLETSA

SEQ ID NO: 974507 - protein, 34 aa, Homo sapiens
DQRGLKDPDGCTLPAHHICHGRNIYKEGQGPLKP

SEQ ID NO: 974508 - protein, 39 aa, Homo sapiens
HGLVVLSERKLKRVKFRYRYCKHRSVGFLFNRHRFCGSR

SEQ ID NO: 974509 - protein, 47 aa, Homo sapiens
GSANIQGRGRFVADWHLQAELNEFTRGGLAEDGLLLRLRVRGYNQPG

SEQ ID NO: 974510 - protein, 56 aa, Homo sapiens
MAHQGERAALEMIRPTIQAAGASLLLAKSDLLVETSVSVGGWHVARLCSNNAPNKA

SEQ ID NO: 974511 - protein, 77 aa, Homo sapiens
VKILVSPWAAAPPVVTGIVQNKAYPKSRFCRGVPYAKIRIFDPGRKKAKVDNFRSVCHIVSDEYRAAVLSSALRLSR

SEQ ID NO: 974512 - protein, 87 aa, Homo sapiens
DDAERRYEQNGPVEGASRRRTAPGSSGTLREPRENIQKSLLEAQAPGPPSGPAETTGSSRPDCKLEGENQKLRGGGQELEGHLKAGG

SEQ ID NO: 974513 - protein, 89 aa, Homo sapiens
NSNPKGPRLAIGAETGPPAVKAVPLRVKANPKKSTAGNPEEIQLGEDEAEDEMAWSPTRSLEQQSVPAELGAEGRLTRPPPPTPPNTSY

SEQ ID NO: 974514 - protein, 42 aa, Homo sapiens
LAAGLLFGSLGASVLTNCIRIPGTVWVYYAATSVTCVEGYWD

SEQ ID NO: 974515 - protein, 38 aa, Homo sapiens
MAEVQVLVLNGRGHLLGRPWQNQMLNRYFFGRQVGGPY

SEQ ID NO: 974516 - protein, 45 aa, Homo sapiens
MWNPKDFGHRGGSFLPSTHSFCKGTTFNSPRRLKGFRNLVIFFYP

SEQ ID NO: 974517 - protein, 39 aa, Homo sapiens
GGKMAVQIFKKRKFFLIGIFKADLNEFLTLGSLLKMATF

SEQ ID NO: 974518 - protein, 61 aa, Homo sapiens
LFTDSTYDCLKPMSEGPIAGSIVFSAVLLKLGGYWIIRLTLILNPLTKHIAYPFLYIPIRD

SEQ ID NO: 974519 - protein, 66 aa, Homo sapiens
ARLPPKHEQDLTIFPTPGEDIFNLLWEDTAQHSLFFRPARCEPFTSYREEEGEMLLCGVFFYIKRT

SEQ ID NO: 974520 - protein, 75 aa, Homo sapiens
MHLRTHTGEKPFQCHLFWKAFRTQGSLDKHNRTHNRERPLSCEVCEQRFTLEGGPSLGTLPDRHIERGRAPLLSK

SEQ ID NO: 974521 - protein, 108 aa, Homo sapiens
MAAACRSVKGLVAVYPRALPGLATADELFGQGASSVLLDLSQLGVGEAQAKKLGHNFVFSPTNVTSQKGVQTALALAKGKFGPFGFSFQLYRNRGGQQDVQLKGGPTP

SEQ ID NO: 974522 - protein, 37 aa, Homo sapiens
MGRANPYAFAIGELEITLARRNQKKTPGTQDEPKEQG

SEQ ID NO: 974523 - protein, 48 aa, Homo sapiens
IHTEDIQILHRWFQRLERHHRGGMESNLAPGRLGFQAQALALSGTASN

SEQ ID NO: 974524 - protein, 79 aa, Homo sapiens
AQFYLFENVDNAQQFKQLYGQDDSLDLNMKAKERIVEEANKAFEYNMQIFNELDQAGSTLARETFEDGVPCTRWEKRHA

SEQ ID NO: 974525 - protein, 43 aa, Homo sapiens
IRRLAPGPEAPAHSPRMASAPSSLHLLGLILHDEEGQARRRTM

SEQ ID NO: 974526 - protein, 34 aa, Homo sapiens
RVSKLKLRLSAPGSREPKQSHMKHPSILLSTLLI

SEQ ID NO: 974527 - protein, 38 aa, Homo sapiens
TKQNNSLEVAIQTTGLAGGTSRFWFNYRHGANTLSGYR

SEQ ID NO: 974528 - protein, 93 aa, Homo sapiens
FLLLRDLLRREEEGAQSHRKYFDLRIGDEDGRIFGSSGKTVPKTDNFALATGEKGFGTKTANSIGNQGLHDPGGDFTRGDAQGGKSIYGERFP

SEQ ID NO: 974529 - protein, 89 aa, Homo sapiens
GPEGEGTESTGITGALHEPSPAGNKVHKRSLQEIKYMKSIKGELGGPEARRRKPLCRAADKSSTSLFKTTRSLLKMNPGMGALLDYRED

SEQ ID NO: 974530 - protein, 32 aa, Homo sapiens
SVSLCNSVTSVQSSDGCNVSLLIRSVCISRVT

SEQ ID NO: 974531 - protein, 33 aa, Homo sapiens
MVRNLRPTQKQKPLCFLYSLQNCEPIKPHCCTN

SEQ ID NO: 974532 - protein, 39 aa, Homo sapiens
LQLVKRKLRSKMKAPFAFRGGVLGGFYLRLAQFNSPKTG

SEQ ID NO: 974533 - protein, 53 aa, Homo sapiens
HPRGNANYNPSLESEQHALARQDQIALKGTPLTAGDTAGNTGRENAQRGKPGR

SEQ ID NO: 974534 - protein, 46 aa, Homo sapiens
TIEERYVGGGDALPGLAIKGEARKQVQSNLSVPKDPLTHWENDSPQ

SEQ ID NO: 974535 - protein, 56 aa, Homo sapiens
LKILVSPWAAAPPVVTGIVRTSRTQRSRLLPRVFLDAKDSAILELGREKAKVDEVP

SEQ ID NO: 974536 - protein, 41 aa, Homo sapiens
FGTWRNAEDPAEAAESILARPAKGQAEEEHTANHQAEAVLV

SEQ ID NO: 974537 - protein, 41 aa, Homo sapiens
GSNFISTVTAISTSSDLQSLVAAPPSSSPVGPFENQRPLTL

SEQ ID NO: 974538 - protein, 56 aa, Homo sapiens
GIQGWMTHIEREDDRPGSKGNKKEVVEAGTIVRDTTHDGWGHCGYGETPRGGGLQD

SEQ ID NO: 974539 - protein, 42 aa, Homo sapiens
HPAPWRGAGETESTGYPLNLSLKEEEEEEEIQSRELEDGPAD

SEQ ID NO: 974540 - protein, 37 aa, Homo sapiens
MGDSGLPATSNAQGPAVTHLRNYYRGGEPPGGCPLRS

SEQ ID NO: 974541 - protein, 43 aa, Homo sapiens
MQMPLATKLTWRDQACWAPRQDLSGKAASCPPFEFSLPRKEAY

SEQ ID NO: 974542 - protein, 157 aa, Homo sapiens
AYDGKDYIGLNEDLRSWTAADKAQITQRKWEAAREAEKRESLPGGHVRGVAPQIPGEREEDAAAAEHPKTHVTHHPVSDHEATLRCWALGFYPAEITLTWQAGWRGPNKDTELVETPAGDGPSEVAAGGGAFWRREKYTCHVQHEGLPEPLTLRWGH

SEQ ID NO: 974543 - protein, 40 aa, Homo sapiens
AGLDQAPRGEDKAKEGGEEDKGQVLTEGAENGKFLRVRIT

SEQ ID NO: 974544 - protein, 35 aa, Homo sapiens
RRDGESNDPHEKTKGKTREGAEDKMTSGDRAVQPQ

SEQ ID NO: 974545 - protein, 36 aa, Homo sapiens
TIDYQHEPIKPWKSVCERAGGWEPKLRRTATRGRRN

SEQ ID NO: 974546 - protein, 37 aa, Homo sapiens
PIFSCCCGPDMATSGPKIPEVPFEPSKPPVIEGAEPN

SEQ ID NO: 974547 - protein, 36 aa, Homo sapiens
TETSYTYDRNKCYTPVVPLVYWKGGPNGGNRLNPRS

SEQ ID NO: 974548 - protein, 35 aa, Homo sapiens
AGLSLCNPVTTGGAPTGGAKGFNLKGNPRAGFGTS

SEQ ID NO: 974549 - protein, 35 aa, Homo sapiens
GKFQAHKPAKSKTAAAAFLKRIRGPKKRAVVFIGS

SEQ ID NO: 974550 - protein, 39 aa, Homo sapiens
IPGSDGAPKIAPVRHDQGKPYPFAYQGRPGEVLPRQAPQ

SEQ ID NO: 974551 - protein, 92 aa, Homo sapiens
GLELTARTSPAVVLATPKNSSLSWKPRITKQKLKAADEPAYLTVGTDVSARYRGAFCEAKIKTVKRLVKVKVLLTQDITTHLVHDDHVKGPL

SEQ ID NO: 974552 - protein, 41 aa, Homo sapiens
MTPRLILHSTHLRPPLPFREYIYTSSNYTEDLAQGTITPLR

SEQ ID NO: 974553 - protein, 37 aa, Homo sapiens
AKKREKKRGAKIDRASHRPSPPKARGANPPGPGSNER

SEQ ID NO: 974554 - protein, 42 aa, Homo sapiens
SNICYKRHLNLIPGWTEGLSCFFRFGSVITKKLEDVKTSPPF

SEQ ID NO: 974555 - protein, 44 aa, Homo sapiens
MVKLSQGGQAELQASSFKGSQFAIRLGLYPSCDLPRDLRGVQMP

SEQ ID NO: 974556 - protein, 33 aa, Homo sapiens
LPKECQTERREYRISDLQKRGPENNFRVWAEMG

SEQ ID NO: 974557 - protein, 36 aa, Homo sapiens
PPSPSYNLFPFTQGSRSAIQKIPLGKGWAVKCEINL

SEQ ID NO: 974558 - protein, 36 aa, Homo sapiens
MADASHVVHFPVAAFTPGRSSLPAILAVRSLAHKPW

SEQ ID NO: 974559 - protein, 49 aa, Homo sapiens
KVKQDMPPSGGYGPIGYKRDLSASRTFGLQHAGHRGWEPWIYGELEHNV

SEQ ID NO: 974560 - protein, 36 aa, Homo sapiens
LWFLIHGLDRYAARLHNLTVHGCVISLCLQLKPPYG

SEQ ID NO: 974561 - protein, 37 aa, Homo sapiens
VEVTSSLNPAWQSLTDRRDAQGRKGDPEGPLISLGHS

SEQ ID NO: 974562 - protein, 54 aa, Homo sapiens
MAVLAALLRRAARSRSPLLRRLVQEIRYVGRSYVSKPTLKEVVIVKGLQEQPLW

SEQ ID NO: 974563 - protein, 34 aa, Homo sapiens
KTFTSPNDRRALSPFHGSTALHNHFSLIWLPSPR

SEQ ID NO: 974564 - protein, 82 aa, Homo sapiens
KTGPKVTVKVYFDLRLGDEDVGRVIFGLFGKTFPKTVDNLLALVTGEKGFGYKNSQIPSCYQGLHGYRAETFTRGRLAQEGR

SEQ ID NO: 974565 - protein, 50 aa, Homo sapiens
SAEPGSATPIGRRHGLLAKRRDPTTHQGATTVLPGTRKFPRDTELGLESF

SEQ ID NO: 974566 - protein, 36 aa, Homo sapiens
AAQPRGGKLRRCPGGQLRTDVPSSNASCPLPINNRI

SEQ ID NO: 974567 - protein, 42 aa, Homo sapiens
VQFVQGIFVEKYDPTIEDSSQKEVEVRFPYSVISRNSGYCLG

SEQ ID NO: 974568 - protein, 36 aa, Homo sapiens
RKADNYPTKRAGEHTIGIRVTDVNNQHMKNSKPITK

SEQ ID NO: 974569 - protein, 37 aa, Homo sapiens
ETGSKREGGPDSEEQEGREETQKESEPERKWFLYLKG

SEQ ID NO: 974570 - protein, 38 aa, Homo sapiens
GENLVFPSFHWQPLSSIVGHRETIRYALVFPPIAFVPS

SEQ ID NO: 974571 - protein, 36 aa, Homo sapiens
ACYYPRVEYGFQVKVLPEGQQIFFLVSFETKITPSL

SEQ ID NO: 974572 - protein, 33 aa, Homo sapiens
SGPIRPIVRCPTVRYHKEVRAGRAFNLLEELKV

SEQ ID NO: 974573 - protein, 65 aa, Homo sapiens
ELAELRGPRSRARLLGKDGECYLGAAAPLCLEAPIGLGRRLALSTFLYSAGFVRAGECTSATPLK

SEQ ID NO: 974574 - protein, 52 aa, Homo sapiens
SWPVAVKIDPPCLRASCGDATARGGCGRGLDWYPTSVFLEDYSFPCSTCCPC

SEQ ID NO: 974575 - protein, 60 aa, Homo sapiens
MQSFSKQAMTFMTRRQDELNMNQRIYNSYHGKMRHPQVGTSQEDDNTSVGFRRGMRSLKD

SEQ ID NO: 974576 - protein, 49 aa, Homo sapiens
ADIQTERAYQKQPTIFQNKKRVLLGETCKEKLPRYYKNIRFLGFKATQG

SEQ ID NO: 974577 - protein, 39 aa, Homo sapiens
FDFLDCVADLQGEGGEAGSPQNELVECVGSTPGVLNRSP

SEQ ID NO: 974578 - protein, 34 aa, Homo sapiens
MPRRNNTIADHYSYSHNPEHPLPLSQYGAYCHTR

SEQ ID NO: 974579 - protein, 81 aa, Homo sapiens
MDLVKNHLMYAVREEVEIPEGADSENLVGEGPPSLEREEHPCLRTLGKPRASLERFQSVSEPVRSQLPDSTHVPEAPGGLC

SEQ ID NO: 974580 - protein, 39 aa, Homo sapiens
ARLSRSHVCQLLRWKLKGKSNSQGTKAAQGKKQVFIKIW

SEQ ID NO: 974581 - protein, 39 aa, Homo sapiens
WVGRIHSSGNANYNPSLESRVNMSLGKVRAQFFLKGTSF

SEQ ID NO: 974582 - protein, 76 aa, Homo sapiens
FGPPDWRYSSARVALGDSIFPTGQWALLRSRAASVSTGTFREGKGGPSFEPRKPRLLLRGDAGLRLTCESRESALL

SEQ ID NO: 974583 - protein, 36 aa, Homo sapiens
DSPRARVPRYLCALIGSEGQSFCGPPCAANSGGLKT

SEQ ID NO: 974584 - protein, 50 aa, Homo sapiens
LQESLPIWGASLTRVASQATRPANNPPLAGASRQSKKPKLPTTPSEQTTL

SEQ ID NO: 974585 - protein, 37 aa, Homo sapiens
AQIEVTSEIDVHGILRVTAEDTGTGIVQITFTIDQIR

SEQ ID NO: 974586 - protein, 34 aa, Homo sapiens
MSTRYLSVTLHVGRLALHALTQSLKLLDKQCTAP

SEQ ID NO: 974587 - protein, 44 aa, Homo sapiens
TGGDLNHGLDRSTPRTSSLNCHKATVEPPHDTELNDPRGSTGPR

SEQ ID NO: 974588 - protein, 38 aa, Homo sapiens
MSTEGGGRRCQAQVCRRMSFRRGATGFDKALSNAELKS

SEQ ID NO: 974589 - protein, 38 aa, Homo sapiens
GKVDCTQHYELCSDTGSWLSHSSSGFRDGKKVDQYKGK

SEQ ID NO: 974590 - protein, 38 aa, Homo sapiens
GKNKRLTTGGIKGAKKTVVDPFSKTDEYDVKAPAMFNI

SEQ ID NO: 974591 - protein, 63 aa, Homo sapiens
AGEVVVLVSLSHPVPYSSLQLQTVLTAALTEQMTLRGTLKGHRRLGNPDRYYPRSFPDMILLR

SEQ ID NO: 974592 - protein, 37 aa, Homo sapiens
KPTPPYHQTTLAKPLYPKKSIGDRNFTPCALYNSDRK

SEQ ID NO: 974593 - protein, 48 aa, Homo sapiens
LGAECAWPEPCRVMLQGSSEDLDPGCRSKARPSHSALVCLGVIMEGAS

SEQ ID NO: 974594 - protein, 40 aa, Homo sapiens
WWCLSHGLDRSSSRPPLLTGTGLWKPPIVLYSPTPGFTGP

SEQ ID NO: 974595 - protein, 32 aa, Homo sapiens
GRCAAQEKWRLQVGAQGRCPLFVLFYLLSVCL

SEQ ID NO: 974596 - protein, 47 aa, Homo sapiens
GRDHVRVPGRLALLRAPMHEFFARDIDGAHGVTWDKYRGSSCCIVHQ

SEQ ID NO: 974597 - protein, 49 aa, Homo sapiens
TEDIIRCRIQQRNITTVGGKLQVLPPAARECTEIGVERQSVDIHKGYLY

SEQ ID NO: 974598 - protein, 36 aa, Homo sapiens
FTHAQLRKASKPHTPTTSKTPKHNELNYYTTQIETN

SEQ ID NO: 974599 - protein, 39 aa, Homo sapiens
RDSGTPVLFSSSSDPEVMEFSSPSREVLQPLQEQKHVGL

SEQ ID NO: 974600 - protein, 68 aa, Homo sapiens
EKKKEVPAVPETLKEKAREFRRAEDQAPQKEGCPKDASEGKEGAYLIKRPRTYSQGILGRCTGPKFGL

SEQ ID NO: 974601 - protein, 48 aa, Homo sapiens
MWRVSKNKRLTEGGKKGAKGKGVIPIYLKKVCVYDVESISLCLIYKST

SEQ ID NO: 974602 - protein, 46 aa, Homo sapiens
GHRERDQMESTLNYEDHCFSGARTILAENLWPGRLFFVQQILQLSY

SEQ ID NO: 974603 - protein, 39 aa, Homo sapiens
MARGPKEGILRRVGNFQAFGFLDKIYPLFFLPGPFNRFP

SEQ ID NO: 974604 - protein, 84 aa, Homo sapiens
GNSSPSAKDIQEDFGTAWVSRRTTTRFNKVISELNWKKHLRRHFPGYFASFPSCTLLVGAVAVLCLPQGFSAPASLVLPLLAAE

SEQ ID NO: 974605 - protein, 90 aa, Homo sapiens
VENDGYKTIYFFGEKTIPGGNDHEIFTDPRTMGYSVTAPLGHGAGSLNCCSPNVGAGGAGSRLTSQHREFGGQKPRVLPHVLTHPQPRQG

SEQ ID NO: 974606 - protein, 67 aa, Homo sapiens
FATYATEEEVDAATNARATQGWIGGVVEAQESCLKERILKDQMPTLPMEREIWLVALRESTLRDISP

SEQ ID NO: 974607 - protein, 46 aa, Homo sapiens
GRVVYGRVTKTLRLCSQDDPVGDNSTHAVARETQSTHSSLWECEAP

SEQ ID NO: 974608 - protein, 50 aa, Homo sapiens
AAGGVRIRNPGVGGGGGSSDEEDFDYRPHANEGPLGPGPLLRPADLRVGQ

SEQ ID NO: 974609 - protein, 39 aa, Homo sapiens
LHYIRKYNPFEKRTRTCLYNCSPSSGTCQIGGHISHVGA

SEQ ID NO: 974610 - protein, 79 aa, Homo sapiens
LNFQTGLLVPAHIFALGPRQPFTGDTIGLEHHQGAIEEGLFWHGQGSIGYTGVGLTPAGRVGAPGLCPGREIEVVSRQS

SEQ ID NO: 974611 - protein, 76 aa, Homo sapiens
GGARAHRERARRRVELDRVFCQRREFRPPFYNSFNFVPYTGSSQPPFSRNPVTIGQDFSPLNPTGRVYGDIATHTR

SEQ ID NO: 974612 - protein, 36 aa, Homo sapiens
MSRMSQVCNAQVQTGYTMNAYQDMSPAQMTAPLPAS

SEQ ID NO: 974613 - protein, 73 aa, Homo sapiens
LVRRCCSEKEKEKGLTRIHSAPDVGKQGRLGFGPHIGPCARDGGVCGLIPGGKEAPLSGRTCVRRDNPSRRPR

SEQ ID NO: 974614 - protein, 35 aa, Homo sapiens
PIPPPWSPPSLAWRKNGYKLPEHIQKIWFEKFKYD

SEQ ID NO: 974615 - protein, 33 aa, Homo sapiens
ETSLGGNRSRKQEKQLGQAASLGPLRESPYGTI

SEQ ID NO: 974616 - protein, 37 aa, Homo sapiens
MNIFAQEELAVQNKDNCSARLPAVTEGQGPRKKKERE

SEQ ID NO: 974617 - protein, 83 aa, Homo sapiens
YNPSLESRVSMSLDTFRTQFFLKVTSFDRGGQGHLFPFRENDYFVDAGRDFFKSLGQGTLCHPLFAFTKGPYDSPRGVLHEQL

SEQ ID NO: 974618 - protein, 35 aa, Homo sapiens
GQGQRQGILIQNSWTSRSTTGMPLMLCLKEWNNAF

SEQ ID NO: 974619 - protein, 35 aa, Homo sapiens
GAAALEDGGQQEVEQRQSSGRLFFSRVPLNRQPPG

SEQ ID NO: 974620 - protein, 69 aa, Homo sapiens
GRASIQVTLQAARQRFRQFPFIRTCQVPGRPWYQLRELCSPVGYSLRHGLKEQILELLVLEQFLGALSC

SEQ ID NO: 974621 - protein, 66 aa, Homo sapiens
MNDTVTIRTRKFMTTDYFKRKQMGIDVSQPGKATIPKTGIREKLAKMYKATHRCHLCILSQRLIYC

SEQ ID NO: 974622 - protein, 32 aa, Homo sapiens
MALKVRGQNGIAPYGQVRERLKALEGSAAQTP

SEQ ID NO: 974623 - protein, 64 aa, Homo sapiens
PGSRRTLYYQMSGDDTQHIQQFYDLLTCFMEDHSGAWQRKIPCFAELPKADPRTSFWISFLGLC

SEQ ID NO: 974624 - protein, 42 aa, Homo sapiens
VCRQNTGVVKTTPKEPKWGRERLSYRPLSVIGQVDSGKVHTS

SEQ ID NO: 974625 - protein, 48 aa, Homo sapiens
KLVRYFTLTRENPQEIIANSRRVPILSVFQLLRNHFGENFLQGPFKGV

SEQ ID NO: 974626 - protein, 79 aa, Homo sapiens
INQVALEAWRSRRDPEEILLQELEPVIFRAVLDNPHHGFSNSGIMEERLLDAVVSLSSGSAAPQSRTVVLKRALANSGL

SEQ ID NO: 974627 - protein, 56 aa, Homo sapiens
KLPKANGKEAISHFVIDTEIRASHHYFHLIYKCGGIDKRTIEKFEKGAVLDMERAP

SEQ ID NO: 974628 - protein, 41 aa, Homo sapiens
MAAVRRAAVNWPLRGASSPKGPEVASVGPVRGEGKKISQRR

SEQ ID NO: 974629 - protein, 35 aa, Homo sapiens
AWSSGTIAVHCSLDSLGSGKFSNLSFRLEDHHVWL

SEQ ID NO: 974630 - protein, 65 aa, Homo sapiens
SAKLYGSDQEALQKGVLFASGQNFARSIDGRRQSNEMTPTRFVEIFEKNPKVLVSKTEVIFRPKV

SEQ ID NO: 974631 - protein, 104 aa, Homo sapiens
DGEVDAGQDSTDRLTFGVFRECEKAPRPVFQTLPFAWFVAPFDPRPLPPASRKLRSCGWTSFCCPTCLQDEALPCCRDASSSQRGAGRRRRTRRRTLARLVGIY

SEQ ID NO: 974632 - protein, 44 aa, Homo sapiens
PSFAFVPHSASFARRRPAFRRGAFLPAGRGTFRQALFGQESLKP

SEQ ID NO: 974633 - protein, 92 aa, Homo sapiens
DLKVLFSSNGGVVKGFKSLPEDRKTLIPDGLRRGGGPRPSLTSQPRPRGEPPPAGSPSPSPPSKGAGPNGRAPWAKHSINSKSKSPSKNQLE

SEQ ID NO: 974634 - protein, 106 aa, Homo sapiens
QLLEDYVEAIEGVRNAPTAALRSPVSSPLLGACQRPPSVPRWDAWLLGVYHGLSPQPHGAGPRAHGDFLPDEPRRWRRGLVPRIVHLNLYPQPGRRDVEVSQQTGT

SEQ ID NO: 974635 - protein, 73 aa, Homo sapiens
FRVMAPRTLIPSAFGGPWPYTQTLGPLPLHEATAAEVQEGSPGEPLGVEQEGPRDIGTRKNQKVQGPRHKFTR

SEQ ID NO: 974636 - protein, 42 aa, Homo sapiens
DGNEDLRADDLPRPAFESYEFHGGIVLPRLEAQGPTLAVSDG

SEQ ID NO: 974637 - protein, 35 aa, Homo sapiens
KPATSTTLYITPTLALTIALLLNPPSPYPNPPWST

SEQ ID NO: 974638 - protein, 76 aa, Homo sapiens
ELCSFSGYKIYPDTEALRRNHGKVFPVLNARCESAFPFQREFSRRYNSGSLSTERERTKRAHSERFTKRRARRAAD

SEQ ID NO: 974639 - protein, 33 aa, Homo sapiens
SRGTRQEIIIIRGSRHGPLCAFGLTWAYENIGG

SEQ ID NO: 974640 - protein, 32 aa, Homo sapiens
MRDLGHQALSVPFITGLPYVYHHPWHCQERTG

SEQ ID NO: 974641 - protein, 82 aa, Homo sapiens
PKGFSVARRATRAKRRADFVAPGNLRGGRGQGFPPGILGAPFFFTKGFWGGLFFQNSFFSKFWFGGGVAQTLCKFFPFLVLF

SEQ ID NO: 974642 - protein, 37 aa, Homo sapiens
IVVKIRRGGVEIAFRRFRTSRLVTNISSASSGGQLHF

SEQ ID NO: 974643 - protein, 37 aa, Homo sapiens
APHNKGVMKTTPETAKIGKEIRLIIHSYVNPTLIESL

SEQ ID NO: 974644 - protein, 70 aa, Homo sapiens
RRQTLNLISLLALRVLAEQNIMPATNVTFYYQPAPYVSDGNFSNYYVAHPPVTYSQRYPNLGWPVTNLET

SEQ ID NO: 974645 - protein, 58 aa, Homo sapiens
RTRGGKAEDKEWMPVTKLGRLVRDIKIKSLGGDLSFFPSPIKELEIIDFFPGGPFNDE

SEQ ID NO: 974646 - protein, 52 aa, Homo sapiens
MQGWRVSIEDAHNCYFSSWDKLDRPCFLSTHGHRRGREVDLVTVAIYLPDII

SEQ ID NO: 974647 - protein, 35 aa, Homo sapiens
GGLLLRGQADFDGNRRSVFFSFTRHSYNYFKDIVN

SEQ ID NO: 974648 - protein, 85 aa, Homo sapiens
EPPTPHCTHSNRNGIPNAYLTKGYIQLRKGPNVVGPYGLLQPFADGIKLFTYRAPKTRHIYAMTLYITVPPLALTIALLLCSPPP

SEQ ID NO: 974649 - protein, 57 aa, Homo sapiens
MHSSRQGREATCTIRPLFGEAFRGAWHHFRRAFASQAPQAKPSLAFPGHFPLNLLYN

SEQ ID NO: 974650 - protein, 35 aa, Homo sapiens
VKKRNECGRRALYPHAKIISGVNAEVWPQKVSYPP

SEQ ID NO: 974651 - protein, 32 aa, Homo sapiens
MAAGTCTRILKLEGLQDVYIAAQQRGLRYRGS

SEQ ID NO: 974652 - protein, 36 aa, Homo sapiens
RAVRYQRRYHVKISLPEHLMTMNRAVIKGEQVTFYQ

SEQ ID NO: 974653 - protein, 104 aa, Homo sapiens
MHATRSYTHAGHGSSHTLYIPLYSHEKHTALGPQQGSEKRERPLFVKNLGHNVETLLSPQELVVAANGFYLRRVSREFSHFSTEDPLALHLGPTTSVVPLKKPR

SEQ ID NO: 974654 - protein, 36 aa, Homo sapiens
EQQRGRRQDGSTNIQEEEVSRLMASLKTDGVSDSGA

SEQ ID NO: 974655 - protein, 193 aa, Homo sapiens
IWSPPQEVSLAVGGQLSLSVVSPPRSWWFFGGILHNLCDWGVLLAPPTTPSLYGLCGTYAFLCAAGGQTINQLVVCVVFLRQPVELMVLSPSLLVVEILCSQCSSAAGVLGPSCVGHPYFGGGDPYPTLCCSPPSPGGITVCVVVVTRTVWGATAANKEALLYYEGGARCQQPKRRLFSPHTTFGRSISCCVR

SEQ ID NO: 974656 - protein, 231 aa, Homo sapiens
LEGVSPPGVGPAIYPRACVMTLCGAPCVLFCPGLLKGFIPEGALWGLSRKISGAHLWRRGLSSGLRPAWVRPPVGTPPPCGARHAFVAFAWVSTNDGPTALSPHLVRERGAPNERGVQRENVGHIYPRGGRLAARTHPLGVTPSKTVSRPLPGVSHTLSRSRAERAPSPRVSLREPHTVGLLSVGGPRLLWCHTHTPFSGSHGETHPARACPSRGSFPHMAHMFASYTLRV

SEQ ID NO: 974657 - protein, 97 aa, Homo sapiens
TPCQHQGAQTHFVAENVGELGAPPPPESGQTCSRDAVDRVLRPPPQPFQGTGMIMETVKKGANTHKGRDSPVSQSQLTDCRPHFLLNPSWPPLDSPL

SEQ ID NO: 974658 - protein, 31 aa, Homo sapiens
IFLICFLVLYALFLTLTTKTYLLPINLKTRQ

SEQ ID NO: 974659 - protein, 271 aa, Homo sapiens
TGPPGDFWPLPRDFLMWPFSSGPPARFSLDLGDSTLLAFGDYPRGVGPNIHRCPGVETPPRRSGVFFVSRVLLPPTQPASTPNLDLVFPVAWDHTWSKVLGTLALYCQAVMAPPPIWPTPQAYSCDPGEPVLLPTSWESPSLLRSLEAKDGPRPLLNEEFSRRKANTPYTAMSGGDTQLHAPSCFTPLSAYTGCVAATPAPRTPRLWEFNVKGEESLVDEPVSPRKLYPVPHPQAGPPPCPFLAWFADGPTLFAGYPDHLVRVWPGTLGTR

SEQ ID NO: 974660 - protein, 427 aa, Homo sapiens
GCCVHAARPSWVRVSVVYAEFAEGGGVFAAGDGFLFLGGQYKGREVPPRTVGLSTTQVVPEGGAPPTAPPSCGVFVGGGHLLLVVAVPPSLGENSPPTFGKYVLRTFVLCWWPTQQRHLGEKCSCRRSSQPASVCGPSLGARDPRGLGVFLRRRQVFRAPLLCGPTCLRAVLVPPSAGGRDEDLLSSRSARWWCCVRKNIFSAAFYSSRGGRSAPDEEHPTWCVFWEQHLLNEWLKFVGGPPHAHCWGPHIGPSRLGSRIAFLLRPPPVCVRHRGSRETPGLIGHNIKGLNTLIGCTRALLRKVVFLSTVYTLSIHMGLFRTIYLARSKCERALSPRGSPGLTEGCSPPTCPCEKRGTLVGLPRRPRGHSRHTRPLGPSSPLFPLTHPRGFLPLLVRWGSLWDPRGPLLTSPGPVVPWFKRQTPPAP

SEQ ID NO: 974661 - protein, 34 aa, Homo sapiens
SCTRTLKHLLVLPPGLAASQSVVPRTQASFQEFG

SEQ ID NO: 974662 - protein, 100 aa, Homo sapiens
HWRGAPPLLSPLGVWVGPGPARGAHRGPLLPDLTSASAHGLPCPGGTLAKGSRIGLTHRALTASTTEHGDATFSLLGPKPGCRVASLCDPLGASLPGGAV

SEQ ID NO: 974663 - protein, 170 aa, Homo sapiens
RAWLRRDSRRSFAGMLQGPELFSQKEDVVIVLHRMPPWFRDSYHTPCCGCSLVPLMAPQGASPANPLVTRHHCSPDPSLFEPRPQALLELTLDCYVATGRLGPPRARKISTPLLKHDMCLPPCFYMGPAPSLGVPHPWEPPRPIIGIDRRTSGLEAPGAQMAKGCTSFLS

SEQ ID NO: 974664 - protein, 30 aa, Homo sapiens
ERTDPVPEDGEDVSCHDQCTETLSEEQEEL

SEQ ID NO: 974665 - protein, 131 aa, Homo sapiens
MGVRRPVVGAVVHRGTLWATTGGLMPPHVRPPLEIGRGVSYWRFGWGDYKGAFKGTFVPPGGPLLLRHPGALVVVSLEGAHSPPQGDPPFWAPEFCAHGVFPRALANFEGVLGAPWCAHKAPTVRLSTTVS

SEQ ID NO: 974666 - protein, 167 aa, Homo sapiens
MLCLPAAPLVSLTSVRCINAPGTLPEYEDRGRCACEPRVPAADPISYSRRGEYIGLDMSVPKAQLSLRSTPDTAYSTERLRRKTHHSVHQRVLSSVHTWGTSLADLLYASTGYEYQLHPSLVTRCMPLAHASLVNEARTSFVTMLAEYDRHWYINHIHVEERLSRLS

SEQ ID NO: 974667 - protein, 157 aa, Homo sapiens
RGAFPFTICLSGVSRGQNTRVFVGARRAICTCPGLWGISPEEWFVAPPGGPPPMYTWRRWTRCVDARGRPSVFLRGGPGTFHGTQTTTAGCPNHSAPNSRVELDTQAGPAPRFATGARPFVFLAVGFALPRGFTACALRYAPPGPTAYALEIGWCHP

SEQ ID NO: 974668 - protein, 34 aa, Homo sapiens
MPAVRGYRPVSYRHQKEFYCSPPRHTVRDEQAAQ

SEQ ID NO: 974669 - protein, 102 aa, Homo sapiens
SIGDISQDPPLEVSKPGREVLQRASCSKSQQMASVTESLQASSWPRPMLGALIGVSSLRGRLGDTFIADLVVGGSTTGPDPDWCPLARSERLAQYQPSSLQN

SEQ ID NO: 974670 - protein, 110 aa, Homo sapiens
MGQKGVPRGLINQICYEMASPPSAFSQILTSSVPFPFYPLPHQHLHPLSLPNTPPPTLLFFGPLPPTPYCCPNPLGWGPGLDGPDPSPLPLSLPCVVGKPFVFWGFFFPE

SEQ ID NO: 974671 - protein, 450 aa, Homo sapiens
GLARAGVACVVRARLVGTRWVCRVGWRPGVVWGVACGCVVAVRSVVGPRLGVCAVWGAWGLSERVFWCSAGEQGGGVWCVWWGGAWGNVRGGVWGRGCCGDGVGGVCGGAPALCLPVGVCVPAYPEFWGGPPELGARVGIRAQGWSPSEARAWVYKRGEAPVVVSLPGPFRGYSEGPSGVVAESFWAYRWGHPFPQGNIPPGRPFCGAPEFPGRFPPGREALSREACVAEDGELGAPWGPPASRFFSGEICGAYPPTNVSREVVVLGAPPTPGGLAQRLDLFCGEVICGACHVCRCLLVFLSVHPRVSVTRSLPPLTEGPPFGSPGMPSVRHPGGVRLAFRGAWGTCRAPPPPLLYPFFFLVTPLHNSGDLAHGSFCESTQYTPLFIPMEGPQKNLKGSLPQDAHAEMKGYEAHFWGPRLPAATPVASLVEWEEGGICSEALEAHPSVPP

SEQ ID NO: 974672 - protein, 344 aa, Homo sapiens
VLLWVAYLLRVSTLVLWGSLPSCSSCWVGLLSLSAGVPPRCGCLPGGSFRCLSLSGGRSLLSRALFCCPVLLPVCPRRPLLFHGWVSDCSWGAPFWCRLCDSRQHVRGGTPRGGAPHVCCIVLAPLVFVAAVCVSPYARPVVITVLVGPGMSPGFSEAPHPGFAPRFLMKRSSWGETGFPPPLLCPPPRGGFAKHGLWLHPIGGFFFRPEGVSSLLVCSPLSGASFLGGEKGHLPTWRLYAPCVVPPTCLKGERKRLSSPGMPTLFCWVSPPMWDAAARVSSWFALCWRLLFLFAHSSSGGAHMGPCSRGPLERGVLYVPICPTRVGSRYPAALVCSTPPRVWV

SEQ ID NO: 974673 - protein, 147 aa, Homo sapiens
MGRGRGGGINSKLSYKGEVPLLLKYPPLWERHQSFGGGPPISPPRGGRLIVVSQPSSVCPIAAAASSMGGDKTPLVGAVSPPPPCCVMLAAVSDGQIMVVEALLASWADYLLVGEADSVGARHKKEPFVARREKGRLCFLPRRGGAT

SEQ ID NO: 974674 - protein, 147 aa, Homo sapiens
MRDVAHTERRQTVSALRETCFPLSQYTPTSWCTLQRVYSACVCVACALRARVLCVCVVLCVCSKNVPTPQKESTPRGVKRLLQPQKGSPSPEKPPGPEKPAPVSPKDFQKGSQKLSQPRKPLLPRHLAQKAISGHPLKVIKVFFDPV

SEQ ID NO: 974675 - protein, 223 aa, Homo sapiens
MACRGSCTRELLFPRFFNQMKTQRGTRCNTTQRSEKFPMPGRIGLQEHHRGPTGRGTGSHRLGGTSPKAPLEFNPLSSFGIGEASQGQVFPNLSFGACEFGTQPRPRVNHPGFPPGGLPLLPRGPFWARGWGSPQGAPLESFPQGVLSWGTTPHSGSCGVKGPKPKTVVAFRGTQGVPLNLPIGDPLWRSLETNQPLFGASIGGEPLHLVVNDEARERPHTHF

SEQ ID NO: 974676 - protein, 546 aa, Homo sapiens
CLRRGRGGGRPRLLDEGGCPVPVWGVSFLLRRWSVAVPSVCCRWCVCCRPTVVGGALSVWLGQCRGPVGAGCCGGARRSDRAPGVAVWWRVCGGGDVVAPGVWCGGWPVGTPCWWRAFRRSGCRGVASRPRRGVVRAVAGVALRGLFEVRLAAVRAGGVPLLCVPSLGVVAWCVFGGPQCAIVCCSAGVPSAVAPRGLASVSVAVGQVRVGCVVARGGGWLGRVVVLVVRSLPLGGGCAGAPRAELSFARGVQLCVVLIAGRGCGAPVWRCGPGLRLLRQACWESDVLSVVSRCGCMSLPLVFVVRLAIGSVPVVAALMWCLLVSVLRVCPLALCFSDCVVLVFSLFWRFSRCDLKCWCGAVFVCGGRPVSGGEVTAGRDLSLWWGMSLSWRFICLLCCCGRLYSSVMGFLLLRFLSRSGAASLCPRVVVRRPPTPRGKFTWHICGASPPPLHGSLSKVLPFGPLGLNGPPRLPRTSLALVATVPGPSLSHSRPYHPFWCHHLFTGWPPLVGAPRRALGFHWCKGPWNCDYPGPIRNLPGKPVFFW

SEQ ID NO: 974677 - protein, 148 aa, Homo sapiens
LRCGNLAGDMVMWIVVRELGSSVPKRMRVKKTGPEKSAILPAGATPPRCCHDNGISMCGYCPLRRSRCGQSAHEIPARAEVQWSRRPKVPSSLGCMLHSALPGVELLGSGVQACASHRFQRCVVPWRIHHRIVWHPDLLVRHPGIVNR

SEQ ID NO: 974678 - protein, 215 aa, Homo sapiens
LSSRAPCSCRSVCGPGVCLVVSCVRLSCGGCPAAGCVEFYSRDFLLWGGAPTQSGGHHPHARWRPLMIPSVFSFPRDVPCWGVLGLGRTCRPPPLVVCVIGAHFARGGPPRLGDAKSPPACLCGSMTSAAVRPSNLSPPGGGIIGWALLFVGVSTATTGEVLLLLLLVVIRRGDQHVVGLAPPKIEGGRPKAIVRWAAPEVPIVVRTPAFVRPHD

SEQ ID NO: 974679 - protein, 275 aa, Homo sapiens
GCAPGVRLPSVSSPWTRTTPGPQGLLAEVPGDTSPGPARPSGADQRGDAQGMNAAVRAVLRMGIYSGGQGVLHLRGLPGHGGQEAQTSQRPTGRGVSSILQVRGDDHWQCAVARTSARWGLAARNGLALPNRARHALAHSTQPLCCRIELGNRRRHSNEQANTSFTGNRMWAMGAYMRATHSEHMDNGDHAHPTHTGQARMTTHNTGPYPAQTRWRRPTAWRASPSPDTNRNELLAGPTRNNGNHIRHTDDTSRTADHQGIHISQRSAPKQPTTT

SEQ ID NO: 974680 - protein, 440 aa, Homo sapiens
WRHRVVFLWCARGEVLLVFARGVDGCRAFCILGGLSRVVASAVVVSVGCYVGWGPPAVFVSVALCAGCLVVWFACGVFRGYFVRGTLSGVACFCECVGIAPAWGFAEGGGAVLVRRVRRVGAGECPLGRAGCWGGRWGVVVVQAVRGGVGSICGLEEGASRPLGGVAPVFSRDSGWVCSPAYNFPLCSGRRPRRGSASSRTGVPPWSLGRRLCVGAPIGRGSLFGEAGGDGALRRAIFVGLALRSLYGVGAAGVCLAAARRRGRVDAPRVPLLSSFPPERGGFSHASLIPRARGGCCIECGVSQACCVSHAALADIFSLLGVGRLSGALRGVWGSPPRALSLGAPTPLFLSWELIGHLAYIHPLSCPRVGVYFGEGFVWLFFQKKKGPSKSRKEYHLHRDTMFLCGGEVILTPPAGPHAGTLPLFPRPALVPRFSVPPVD

SEQ ID NO: 974681 - protein, 112 aa, Homo sapiens
MGSVGETVPATEAFTPTGATSSHRGPCTASVLRRRSVENLGTQRPGGHPKLTIARGGTLVSSPCAHRPFYLPILCAVLCPMRGVSPIGIAWCTLDNEYSLQVVPEVPTTTNQ

SEQ ID NO: 974682 - protein, 94 aa, Homo sapiens
SGVVPNSGAYSFVDKTQVFLRELNVCFDIYPLEHELFSKPRSRSSRLTPRVHYRSGVVTNDFFGGVLRLPLPRGAAHQKNYYGVAPPSGGFVQQ

SEQ ID NO: 974683 - protein, 310 aa, Homo sapiens
GSCILLSAGASWLLLPFGAVWVWCCCRTRLRRSLVCGLSVSVLSCVWADRVVACSGGCVPGCWISLPAFCLLLLSSHSTSSGGGVTPPRVCFVVRSWGGSSPSFLVCCMLERVVWLFPCSRLSVSRTQSLLFRARGVCLPRLPTEGAVSVCLVVSIGDVPVVCLPRPFVMGGVVFVAPVFFFTSMVGVGLRRGWWCVFVVSSPLDGVFFLAVRGGRCSVVPLWGSCCDCRLLMCARVLCYRVRSVVGLDDPTGVCLSSSVAPMVVVPPPARCDLPPPLLLVWGLLLHMAGERRVLPHLRECWAVSSLRGN

SEQ ID NO: 974684 - protein, 270 aa, Homo sapiens
EKQADFLDKQMSRDEHRARAMKIPFTNDKIIKPCLWTEFNDTACPKYQLSEAQSEPHPEDIRAPGLGELKMAALVTAVKRKLDLPILNLERDVEDLQLLTKPGCCGQKVEFLRSSGQMKQKVREPVPGGVWAGAEMRTDGPSFARVSMRLQYCLGTGEVSVRHPPHDGRDSRPGQERKPRDRRKVSLGKKGVLKAQIKELNRCEKGWMCDLELDLQGGLDAFLSNISSQDWDDWAVSVQEEEGWWLSHSGGVEVHGHLKGKVYLTFCEKV

SEQ ID NO: 974685 - protein, 45 aa, Homo sapiens
MLVLRQKVKLERLDPPRKEYKVLAMMLAVAPVDFSPEPFINLKPS

SEQ ID NO: 974686 - protein, 107 aa, Homo sapiens
MYDETHVYSTYAMLVVLYHMVETPLGLRRFPNYTVGSRAILDQWDLAAQLISRRYNYIDNGGRSNNALSEEVLIQWKLKILTKDDGIYGPQHRSSKKRRVGRVRTKE

SEQ ID NO: 974687 - protein, 268 aa, Homo sapiens
RLVVGGMRCVRAGCSTGIGGSRFPGRVSRRSFPGLVFFRLLRGTPSALPYGGFTWAYLPWRLVRPHPEAFSGGQPPPMWFRAIGCPTDASKGVSSPPGRPCALCVGPRFLSLPSRGVPSFLRCGISVASHPWARFPGPPRSPGQDGGIFAPLPVSFPPEFRGPLPESGPPRPENAVLLSPGTFSPSIAVTPIVRAQMGVIFEENLGEILPPWAPRCRNPPPYAVGLSSAEHWSNYALSREIGKIVPLKASVISENIRHLEIGMKTLLA

SEQ ID NO: 974688 - protein, 107 aa, Homo sapiens
MGITGQGFQPAGAHFPMVWSVNWEGPELVSKSHPQSGPTGEGHSQVDLAERIPLSSMIKRAPEQRCLHQPLRPHNPEQGWRLGSGYQGTGPWGPSPPGFLGVWTHAR

SEQ ID NO: 974689 - protein, 307 aa, Homo sapiens
SSCSRGVGCFRGVLLGCSSCPLCGSPLEGSWSPRWLCRQVRECGLLLFRVVQERWLDSCCVLYVVGWWGPPEIVCLLCAGCPSVGGPGALCVEGGEGFQGFCPHPGGFSGAPVVSLVRAPCFRAHPGDVGPPEQFPGGVTTGCGRQEVGRHGLTPGGRDAELFVPRVGVCHSRTEVWPVRTFCLHPTDSVSGVGGGLICILACRGWWASPALPHLWRHSPGGDVSLPTGVHACGGGAVYSLVVVFSCGERPVDVLLPLAVEGRPWGVVPTRTQGCDGLSLRLSVINEGRGSPPPTLLWRGLSLLSRE

SEQ ID NO: 974690 - protein, 126 aa, Homo sapiens
VCVCVRVCVCTFPCLSTEHTSAQATVPPPHGLPVATMRRAEATALAQQDEGLVTRGGSRAGSVCLVTPGGGQSRVCVPRDPCGGGQSRVCVLRDPWGVGRAGSVCRVPCQARGSTEELALWVARTP

SEQ ID NO: 974691 - protein, 247 aa, Homo sapiens
FKWRMTPVQRGGPGAPGGPGMGNRGVFRGGFGRVVRVRGRGRGRWSWPGSVARGGPVVESWSWHGRTLIAGADLGSRGQLNDSGSRGGKSPNLFSSGVLYREIPVSLLSVAWRSPFLKCNEGVWREVSVQCGNAIRLRSCRHRVVQGLVVAFGGATVATLVLGAWFPLAAWVGVDVGHVRWCHSSPGLELSHSSPSDCADGFPGGTSCGRAPECPLGHVTSAVVGSVLVRLVPAHQGHLDRCRLPVV

SEQ ID NO: 974692 - protein, 219 aa, Homo sapiens
SVCYPVAAYFLFLPRRDGCGTFVVALSCDVGTRLLSCRNKLRFGSLSVLDWRGVFCVISHSLAGGVMHLLPPVFRKEVWVPSIYLCCWRESMCVVGLWAVHRCGYVTISLSFFTRRVPTDVEWLSPTLLFWFVWFTPTYRRPSEMHPDRNEESVVSVLYGVEGKRGAAAPQRRISSSGHISVGTFLSLVCLSPRKREEECLLRVFPHPKRSAQQIVLLG

SEQ ID NO: 974693 - protein, 333 aa, Homo sapiens
MYGETGHNTSWAFGGNPKGEQGGTNTQFWTVPNTGISANAIASERGQGAYPCGLADLGGRIPTFFSPLPNNKSSLKAGPCCGQLPRFTRNGSFPTRQYTKTNGVLQYEFGAENAPMEISAAFLRTTYKGEMLPPEPNTLRIYFERAPKFPQIVRWTLRRREAREPPTNGTVPHVSTNYSGLDSARGHMNKLPVHTTPNRERERWAEKENIPGNALAPAACASRAADNTTRRAAKGAQSNSPASRTVLPRRNLPHGGRPRRYYILAGTNYESLHNRSQVKTGANLHEAYSVRFIRYTHKYKSPWSVRPRGVLLMETTPVQIVVASAPRVIHHEG

SEQ ID NO: 974694 - protein, 216 aa, Homo sapiens
AVFDDLIFFVPRFSRSSAAAWHPAAAFLALSSPLYPVLPPSSVGLPLSGLVVARLSGSHRCFCLRVCLAPRVFSWMPPVAAVGSVLSCLCGWLPGSPRGSVLVCLFCVLSVAACCSRCRLSPFAGLLFCWCVVHLFSVLFSCCCLLLSFSWSYASSAVALVVLGLWVGSSYSSCRDCCVSPVQMLVFTLYPRLWGVSERDPTMFPEFFRGRATPLL

SEQ ID NO: 974695 - protein, 362 aa, Homo sapiens
MGTHLGKTAVVRWSHCGEYDRWGVLGQYMGKTLSPRLCWAVVLLLREEQPEAFVWGVHGGGLSPGGRVSRYFPGGGAVPPRGGAMGAPAKRGGLIFPWGTQGPTPPQGAGLYPLGARRPLGGGCVLPPGGDPFAPRPWSMFLTATRGPPTQWGALWGGGLYTQAFVLEDRALSVAPSWEGHSGFVPSLGGPLIVRVPPRGGRGPLVVCWRSLLRPCALWSHERRGSGTTPRDGRDLRPPFVCVTVMVNAPNEVLDDTNVCCVNSFPHKAGEYIVAALPQFYPPGFRCQATPRDEHHVVVRQTGGATTGRSGLTQKQGEFQIIKRGETAITYHLLELDHSSSTWISINQSGIIRRSYTAHDDH

SEQ ID NO: 974696 - protein, 546 aa, Homo sapiens
VVVCERRRPGWGSRWLRDSLKRWGCCCCPPSDIGGVLYGGSVTRLQLLGATGFGVSHVSTCGPHLRVGGFLCVRRLASTWLLLFWGWAHKCVRWRARGPTGVVGHTSAGCPGWVGATHCPGFVWGTTSSTGCFSGVCWSQGTLFVGGPTAKGLSSVASMRVASCWVEHPCGIPAMRVAWCPERVSGEWGPSGVVKPSLGHPLPVDPRTEVVSCAWSPPWEVAAHAWVGATKVFVGGATPLQCPALRGVCGQDANRAPPPHLGGGLARWILSPPRRVHNPTLIGDKGKWGVARDGRGCSTGQQMGDSTCAPPGPHRAGCPQRVCFTGISPLIACVTHTRRVPGTVEEDTRGYSRLRGPLWSLDHFFPSEFGHTHTQLSGDSFTVHGPTLRERGPPWDRHSGAVESSRRSHTYWLPELAGPRATNKRALSAAFLRVTVGHTPTSAGTLPTKATRTAGLVCAFLKAKRPPRKLLAYDKALRARALRPSLPYPCSGTLSRGSPRNPPSAPPFLDFLWPHTRRLPMSPAPPAPQPPVGNPIKAPFPLNKNK

SEQ ID NO: 974697 - protein, 114 aa, Homo sapiens
MDLWSFNTRSYRGVCYTRPVVRFAVRGIFVWGLFSPSYNKWGAISGPTAHKHCFFPPPPYYDAPVCISCGIVFEANRSSKLPLSLMELWSRLCGPPYIGGERTPTRPIYLLGGY

SEQ ID NO: 974698 - protein, 304 aa, Homo sapiens
MIFVVREDYQWKYVCTRSLVFSVRSCACLQCIVYLGGWLFALGSCCLFVWRCYQLCGLFCDRYRRCVGVCAISYVDLFVRGGPPLLVLSRPPEGVTHTVVVVVGMPSFLCPRGERWGVRTDTPAVWGWPPPWVCPLCSVFLPADGVNLLVVVRAAPPVECCCGAVDLSSSPRGGPHISWGPLPKCFPEEYCVCIGAHMRMFVFPVRVGPKPVVPFVLLPRPQLVCVRPPPKWRNVLALGFFTLGFSRVDFYAPREPPCPRAPLIFSVPRAYLPPPRDFGGLPTPRACHTIWGTGHNVFASEGLG

SEQ ID NO: 974699 - protein, 331 aa, Homo sapiens
LLASSRPEPANERFALVAQLECNGTISAHRNLCLPGSSDSPASASRVAGITGMRHHARLILYFFVVVVGGGGPSSVGSGGSRTPEPRVDPPCLGLLKVRGLYRRVGHCGPVALPSSFINHFHYIGNVVVFPIKGKMWQTHFPPPVSAFTRGLWKPKPFRDVAWAHVGEPAVRGAGGHTQGLSYPGGLPRGRGPPGAYPGTGHLQGALPWRHLELIPGALDLEVYPGPPSGLGLTIFWTASAPELPAMGPMAPCVPVIVLITGLPGNWSPIAVTIRAGEPHDPDGLNSQRDYGALHYYPVLGHPRAWCGTQRTRGEKQGVTTEEPPQRCTTT

SEQ ID NO: 974700 - protein, 223 aa, Homo sapiens
RIDSGVVLMLRRPGGVVVSVRVVVFDYRLCVCGRVSVRLCVAVARGPCVLRLLFGCWAAPRASLVGRAVVVVGAACPPVGVRPLLVCPVFCVPLWWDPLRGVSLPRVCSLFVRVLLGAEVSGSGGSRVVPQVFGGMVVWGRQSWGCHHRRGVINGGSWPCGGGGGVSAVAGCGAYVQPCTPGRARGPLGGCLISSGNGSFPPLFGPERGDSVLPPRGLWTAGP

SEQ ID NO: 974701 - protein, 329 aa, Homo sapiens
RGLVGCGCWSSVAAGLVLCCAPSRCLARWCLVGADTCRACVIVGVRRSNFLYIPVSPRRCSGVLLTITTTHISRRFIYRGGSHPPVVCGNPLPWIWGSFPPPPGVVWGDPTKDAHWAVLCYINPAPWSPLVYPFFCHPGFSLFNKGFYSSEAAPLWVFVAREIFLGRLPVNERVLLLLPPRETVLKSVVLFVTGLPQGPPPDLATRTLFLPPGEPPFMRRPHTPSWEERPPPRLCPFVGSLSCPTCLSARVSAGRLFSSRRRCSVALSGGLWGAREEMILISPRGAPFFRRSAPHIRGGDFFPAAPLAWGPLTIEKGCFSSSRGPLSRR

SEQ ID NO: 974702 - protein, 205 aa, Homo sapiens
LRGAFFPRSRKRSRDRAAFCAVSLGRHNTERPGDVGRGEAQETASQQCVVHCGSLGLCLLWLWVSRGKGLCRGVWVATVKTPVGEHEAAKVQCVPEGQRPAAREAPHKIYVCVAPQARGGLSWGLGAHSAVGRDASVRAGLCPQIHEGGPLWRGVCLWGASWGASYVAHTVIGETQRTQVAQTVGAIGDHKYIPTRDLYPMGRSL

SEQ ID NO: 974703 - protein, 134 aa, Homo sapiens
MMMSLLSFLLLFMLVVLLSLLAVCSLVIVALINRGCGVWVLFTRPLWCPVRLSSPLCVAGLCLRVVAYCVGIVVPALFFLLFLLPVFSLLFVSVVVSLRGVFCSPTYYWCMLVVVCGLGVMWCVYRRYVRVRVV

SEQ ID NO: 974704 - protein, 136 aa, Homo sapiens
LSTQVVGVSCDHASPWWPAEGDTRWGVLRPTTAARDVVGDSPPCGCLSPVHACLPTGECVDVRCWGSARPCGAPVVVVVNVVFSLGGATHLCGGRSQSGLRESLCFFASQEGVVVLVAWGRNSAVCPFGGGSPRPH

SEQ ID NO: 974705 - protein, 76 aa, Homo sapiens
MARTFKFLVECLGTRTHNSTCTTTPKEPPTPPEYSGDGQSGVLRTHDHPKILSALSPPEARVPLGDPEAQLKVQEF

SEQ ID NO: 974706 - protein, 151 aa, Homo sapiens
MGACGVRPLTLYGGRPPSLFFVGPDFFLFTPAYYHGGGATEGGGSGPPRLWPAPHSCVCYQHPGGVDFVFFRVPAKCCLVAAFIWGGHDPAPWWLPLASSPRGGVVSPLLSAFFFLVVGEPNQSRLLCALLSALLGGCLWTETHIIVVCCL

SEQ ID NO: 974707 - protein, 198 aa, Homo sapiens
MCPRGGANDGDTSSHNGVFPAAVIPVLEYRLANPRAQVKPRKKGPPPFVRPESKKGNPWGEKAKDLAMHRTSPLGPPPLGNGPLYQGQRPSSFLYYRLEVPLRITTVTHGPGPPYSYLSCLNWPHQYQTRGPNAREVSRDCWPRAREEGFCAKGDRPHEETPLSFGPRSLPPVHPPGGDTKEASNLVVIATTDSGSPI

SEQ ID NO: 974708 - protein, 375 aa, Homo sapiens
VPPRFLRAQRGPRAPTKKGGEHLTAKKRRKKVVWCCEKQPAQSCGVLEKERKSNILVVKEEEKCGEKSGPPPAAEYNEAVGTKRMYRRRKIKMLGGKEREDARFSGCSTRPSAGDPPPQGRRTRRQHRDVGATILFGNMEVSYTQKRGGYFRFVLFLWKQRWEECFFLVLWKNLCAHRRIMVYVKKSCWPHHVFMGEENNCSPTTLWKSFNRLEEKKICVFTTRRFYINTFAPVETNITVFPTSGTAMGRILFISPPRGDTTQKMCGCLPHGVAHKIIWGTRTHNIGDFVYSVSHPCVKNASQGTLIARTWGIHIAFFWVSVFLCVCLVFISIKKYTRSPNISRDIREKSAFSNMGSQHPHTQGLAHTISGEEKR

SEQ ID NO: 974709 - protein, 331 aa, Homo sapiens
MGRAVGQLLCVGRYWSLVARLTQWSACLFLLAILLCLSSSRLVELASLLATLLDAPAGGGGLSPPSPPSRGRSPTLVAPVAVPLVGRTPTEVVPGVLILPPAVSMELFYVPAVENVVTERRLYLCGFCLSASLMCVILLLMGVVPDHRHCGGCTLFVDGNEGDASLVGGEHLVGGGYPPVGLDLPTWAATCSLSEILLSGAADSPPWLFCGVFVPVPNCSPRLPPTVCAQGGFATPGGPPAAVWYTCLSTGRGLPLRRIVLVPTRVLRRCPKSKPNFRQGHTPAPTPCGHRRQGVHTLACDYRRPGPPVGVRLFHENVFPFLGAAHTFTRC

SEQ ID NO: 974710 - protein, 226 aa, Homo sapiens
TPGGPAQVQEDLIRRKAPSPPEDTWVGGKQCFHVTPPATPLAYGKSKELNLGVFRLDPGRPLKAKRETLSPAVSVLGEGDIALTGAPRPSWHSDTPGHPSGAPFATKSWAGLRVWGRRTPPPERKREPPGTSGSLPSSDTSHPQLVALWPPRPTTTHPVHFIRPRAMSTLIFIGHFAPTCPALRLGVIPIWFLTTPVFIVCSSVPRCCALGTGHLHGLPALVELVV

SEQ ID NO: 974711 - protein, 228 aa, Homo sapiens
ALDLSNLERLLTVLWGLYLDPPGLHTYLRSQMSPVSPPPVSPNWGTREVHVSSHMLAASPTWPSIPASHQCRYLGAEKALFRALKTRGNHPQNMDSIFPLPTFIGRAAAQNQGRISRYLANQCKYCLTNRFFSEVPTSVFGEKLREPHVEERLSFYETGEIPRKNLDVMKEAMVQAEEAAAEITRKLEKPEKERFEEGKENGWLHLPSRFPGNRRSTPEECEETSANP

SEQ ID NO: 974712 - protein, 157 aa, Homo sapiens
VYLFMPAFGKGGPLKAPPQPPPPRGTLLEGSHLVNGLPKPPRPPWREITFLHPRPLLVWKDPRIVALTGVVPLPKHGPRGRSLLGFSPGLVHFASFLVTHIQRKAPTAVTRTESHIHIHPRPLKRLLCLKPVASATPCSLPQRSPLRLCIHIICVSQ

SEQ ID NO: 974713 - protein, 202 aa, Homo sapiens
YEDPPAGTPWGPICWRPRLFSCHLGSSPNVPWEIVTKRDPHGFYTLPRRAHNLWRRVSPGGHALVLPREVKGERCCLPCERTRAFGDESPLPGSRIFLRPLWRSHDNPEYLYSPSLYTRMLGTNEFPGRNFVPPSARPLGLRFWGRIFLPGEHAKGEGRHMGSAFSSSLKDHDDYSFKGHWHVTHSVEFDILFMPTPLAYHV

SEQ ID NO: 974714 - protein, 309 aa, Homo sapiens
MYTVWPFLERQSRTRCLRLFSGSMFAAWVISAGYRAGFCFGEVRFLGDLRGFQPFSRAHMTVGQTEPESPRIWIPELGRFRKSAGSPWHLQRFCQATWNVVSSGDFDEFKKINASTPNKQKGKRSESSVWFFCEGRILVSMHTRGTSSPRYWYCSSSPCWSFPGAPGIRPGFLARGIPTWGSPCPQAPARTCWAQSLGLAGPSPPGDDPPRKRYCSNPSNFCPQPSIPGLPPRFPPGPGGPPPPYWAEEHPPPGTDGPPSLVLRPSLLGPPTGDPPWKRDSHGHAPSGMRPPPPGMRGPPPPGMRPPRP

SEQ ID NO: 974715 - protein, 328 aa, Homo sapiens
MCWCVLASLLDRCYYYPRCLLWAGCKGFCRPFSRLRRRLGIRQRPWRALRIGARGLALGGPRVLRGFPTWASRPGFSPLTGARPWPRLSRRPCPWFRVMSRPPIGPLGQGTRRSKSLGRKFIVWSAPAHFRNPEILWVLSLGPFLKDGSFERIYAPGPGSSDPGARPQRNPGFQKPIVAYSGDYPMGPSPVLGWFKWLPQRRLRHPPIPVGPLNPWPKRFHIVPRCPREANFGGHKNPAKPQNWSPLHKVNKAPAALVLERLNALHTPGATGTRFRTLGLKKAAHIEMAGNRVSCYTPQTRGLHLPPLGNFAQGHPLNATFYKTYTAT

SEQ ID NO: 974716 - protein, 162 aa, Homo sapiens
MSPVVFYPHSFLRCIGCFVLVALSVSVSVLSPPYLWWWSSCAFFPAQECACGPPNHPACVLLLGAGPRSLVGTPWGALFRRLRVCSPNRVVAPLLSLGAPPCAVPLCGVFLSIHVWLSSFFWGSPRCSSLPWGDICCGCVPSSLGGVSRCVTALFPGRDVVE

SEQ ID NO: 974717 - protein, 104 aa, Homo sapiens
MSDSPPPDEFYGPHPPLEEELSRAARPRMGYISACMAPFKRRFVYPTGGVCLLFSWEWRQTVLSAWWRAHLSLRVVRPSLLCGTVNSGWKATPGNQTVLCRVSL

SEQ ID NO: 974718 - protein, 315 aa, Homo sapiens
LGTRCKSVGPPRVLIPCEHFHWELPSYGGLAPPPWGVVLSPGVSWYHGGLLGAHTLSPPPSCGGGDTSPRLDFPSRLGDLYNHPPERRDCPPPEGLSLCERHTPLYRALIKEPSFSTLSVPRALVWAPYKIGGPTRNMGSTSTPTNRCCVSLETLWAPRRCRPLLSEREPQGCAFWASARLHTLYTRAPSLDPSARRSPLYTRDFPRETLYTPPRYTPGPTAATPREPPRLKVKAHLSFEEPTGRGPLGRTWETLWPTAHPFEGKVSHLEPPSHSTARGNSRPPQGERPHPHIGKGANSPERPRRAFATLPSFCF

SEQ ID NO: 974719 - protein, 191 aa, Homo sapiens
MRRSVAESDLHQQRVVSPIRFLGFRTNTVWWVWGLSPRGRGEPRPLSPSSVSRLSQHATALRGAPLCVCYARIYIAVSSPRCAPSSQLALTWPTERESVLWYTLSYVSLVTGVWLPLYSESVTELSFAPTGSVSVTVLSSVRAHYSHSPQAPQATRFATAVYSSHLYHTPSFYHHSLATVSHTLLNTTPLS

SEQ ID NO: 974720 - protein, 148 aa, Homo sapiens
MRDRPLTSFVLGVSSPTATTNIVLSSTAPQISHSPLLVVRPFFLHTTGGANNTSQIFFYNISSSALSSTGSYFVSTDRLVSICYLLIFCALYGATHSLFTLLSGHTLTALTQECRDSLSYRHSLCSKERHFSHTFCDTLSTLSETVVV

SEQ ID NO: 974721 - protein, 421 aa, Homo sapiens
MRGTTLSCGEDVSWCARTEFRVADAACGTPRTPPGCLLAREGGSPPPLVVWKCAPAVRYCCGQFVAPWGEAPAPRGVSVDVVRPPRVVVCGWSAVAALGRFWRVRHWGVLQFCVDQERHVCVGPRGGGGVAPPLPDGGDAFSVVLGAALRYRRVGVCLVVESPLLVGLRWRLPPPAAVCVNKDGVSDKGSGSPLLGEVSSGAPGVDYGSHRTAAALVRGIVKRAIGALCLPARGAPPGGGDTHLFGGPATPRVVGATPRRVLRLLASPPAEDGCIYVCVDKTPLLGARLGVGASSGFRGDRALLAWYYHVARLFWRHLESVFERGRERAVRRGWAERERGGAARKLSLACSVLTPGTVSPRGVCRHSVVALLGGPSPLYSSEIVCGDIVEAPHTLCDWGSHTQAARRLSLDELFPTVCVCS

SEQ ID NO: 974722 - protein, 163 aa, Homo sapiens
CSGDYPGPFRPNLAPAMPLYWIAHTASNASQFAELKERLIPLLVKSWTDGPEILEVWVMLPLLIWFPASPMCVESFSRLSPLWVALLFRDMSTSTSSPVGVLSKASGTRRLLELARSPQSAPESSRRPKWILSPYTLPTPTSFNPVVEEPVSRTLFPIGPFKF

SEQ ID NO: 974723 - protein, 110 aa, Homo sapiens
MSKGFPPSVVVFIAVLAARGGAPPGPPRCPLAGRLSRGAWRHSVLSERSFFKGDSRPPAPPWDCLGAGGAPRSPPGSCGRFFWSALFSGGRVKYVVYCKMLPTFSQCHHV

SEQ ID NO: 974724 - protein, 273 aa, Homo sapiens
MCPSAGVSLDRLSRGHPAVRGIYFSQRGFLACAAAVWGSTSPALFVAPSVYLAGSFPRHSGGRLSPGGSPPNCPGEIVGNEPLLPLVAASSSLRPPRVAHRNRHIVGPTGAPPLGCPGPPWAFLPPAGCSPVVLATPVLWGLDLRPPRSPTVPCVEAPRPSTGGLGTPSHGHGAPLLAGVPFSWEDGYPWSDPPIAPWWPRTQRGAMAPLKRPLLVRLGKIWGPPCLPTPAPPLVAPTFAGGTFLCSGPLGLVPLGDLVGFTSGDLLGFALPR

SEQ ID NO: 974725 - protein, 114 aa, Homo sapiens
ASSLPPLIVLWVVPLCLLAEGVLLLRAVSCSPFAGVCSCETTVHSVCVRGAHCLSKHSGGGRAATTPGVCSTPPVVGTLSSHSGVLRGELMMVVLRRQFGPRAATTNIFSEMPA

SEQ ID NO: 974726 - protein, 172 aa, Homo sapiens
MDTQHHVKRKMENRDYRDATGDLLLMYGLCSHHCYKYHPPRSQMLWPMATESYQDVFEFPLCPDAQMDPLEPGPFTQSSYMPMPPGLAQICLPEILPVRKVASESSSEEEEEENEEDEEEKESEAQTPRKKGLIAYARTTGPSFGPYHDHWLLCPRVPLSQPQRKREYNNKK

SEQ ID NO: 974727 - protein, 401 aa, Homo sapiens
MSASQDNSPSVIDVDVPYTRIPTGCGKKDLFLPPPYAKDDVLSAPQNVTNPAGVYIGPPTTPTPRCAPPCGYFYMSSAAPYGKREGRPHTPLVMGEEILPNGVGKPRRRPPLVWGPHREKNTSVGEHWGPPPRRKKKASFVTTPAPRGETPCGGRAPQRWVLFAPPHRKLYTEFGSSGDRCQLSAGGGSPTTGAPHKGAYHHKKGGVATTPQLPLLGAHTPPNRKDLCPPPPHQGAPPPGEGRSGSTTAVVRPSVIFLAAPHMGNSPSAFACVSDPSLSLVWAHTRPSRGAHRKKGYATLSHPPLSERLPHHTEKSVYKKILWVTQGLYPSYLTQDPAHTSLILSRTPYASPPLSLYEPQCLGHTQRAYHTPLSLGGPVVSHTKWVYRVDTPEDTLFSSPV

SEQ ID NO: 974728 - protein, 359 aa, Homo sapiens
ALVLLFFSRRERQVAAGRVSTRRKYIGALFIYEMCGHRQLSRKIKCVRTHEPFFPGTVTKFLERFQGPFLEPGVPKPLARETTTVFWAESPRCALLVARPPVERLPYGILGSPLHQALYPCGLPHSPAYGGTLDAPEYTQLLGFAPKPLGPDVRLFPKQLEQEDSRIVVPRTNLPPEFQRISRYCGHHVCPSGATANCYGRLLGVTVTPFSRPSTLSSQAPGSPVLNSGHPGIHRHLRVTWTQTPSNQYVCSITPGIKMACDPPSGRAPEMMIRELAPGSPTCSRVSYRCLRETFVFRRRYRIPLGKAPSQTGGSVVSRLPPWPTGSLLNDVPPDPHARGTPRLPVRKKVLAPRVNLTF

SEQ ID NO: 974729 - protein, 320 aa, Homo sapiens
MLVSTHRTRGGSREEKERGRRNAALTILCNLLSSFASPLFFFVAAGCLTYSLSVGPYTVGSVSSLSKVTPGPFSGSQRTALCSHSRTPKGDPRRQMAFPGPSGHSQASIRSSQVALDWRVPTLKTGPYPVRPAPELLFSIHGDLWERGFFLHAAGKFGGDFLVYPGDPLRFHPPYIAPCWAPEDTTPPSQNLVASWAPLETTRYERALAPLVSATPDGKGGLHPPLPWASLQWNSRDLGDVAVSARALLDVPQLFSGRSRTSSYPSPRVVFDSRCFEQLTSFLMFFLVSKATYWLCFCRYLISPCELSREWGLGLIHLFF

SEQ ID NO: 974730 - protein, 228 aa, Homo sapiens
MGEPTPHGVTPTHHVLPVGFGSFLYDEHALSSSLEDRISTISTSLCVELPPVTVSIVEDICQEPPFGETHTLGGKSGGPRFSPFQDVEPESQPGDLLLRTLGVQITGAPEHRGQKRTQTAPGPKEYVGDLLSHLRSQAGGREICHTTPPRPAGEDGEDLYICWCCPWTSQHDVPMPNPSPKTHPPPDRWMAKWWFERPKTTQDFEAFSPPKPGTPWGTGGPIKNSEVP

SEQ ID NO: 974731 - protein, 374 aa, Homo sapiens
LFALLRLVWVLFLIAPLSSFLLCLCLSVLFVVLLRVFLLFVVVVAITSFSLVVSFALFFLLFFSWSVLLLVLLLCSSSLLFLRVFFAFVFLSLRYVFLFSLLYFLVLVVFVFSVVFLLYLFCLMCMSDYVDVCVVTGYNKSIRDRTFRCPHSLAVVSAPFFEYTQKRSRAIRKPRKKGTRLKTLRFGMQASPRRPPRLCECAGYQVQRQRASSERLEVLLRLPVTQAMDRPTATQLLKLAPQYRPETKPEKKQRLLARAEKKAAGQRGQSPPRDPLSFEHGVNTVNHPWWRTQKAQLVVIAPRRGSPSSWLSSLPAPVSVKWGSPYCHYQGKGQTGTVLVPQEDLHHVSAFTQVNSEDQGALAKLVEAIRTHYQ

SEQ ID NO: 974732 - protein, 360 aa, Homo sapiens
MCMYDYFISSSLASDMRGLVLYLFFDIASVVMNSPFVWGAQQCGATLNEDSAAFSFAGDCVFCERADTTLVGASPLSRGAPWGDIPPAGLGFPSLYSRGNWAFVCPPQGGLFFCEFSGTIWLRPHKGVHQLGVPTCVGAALAPHMVKSTLGRRAGTTGFGPLRETPLCSRSLGIPPAVNVPRGHHWNLCSDVQLDQDWRTQVGASEPPLLNMRQHVPLAPLAGQPNKVFDHGSIYHPEVLDIPEETLHSRFLEGVRQSCPVSVCQIGYPTVASSDPHSIIHGTKRVLALSVESGLHPSHLAEKGQGLSWLNPLCLCGCCPCGCCHPPQLLLLLLHAPRYKVETQEESEESDEDMGFGLFD

SEQ ID NO: 974733 - protein, 149 aa, Homo sapiens
MMDKRRYEGRAQGAEEWFVYNGGLSTIYVGPSSSISMVLLVRRDYRCPPARKCAVLRDSYPRGPFPVVTKVPAPGGPALFPNWCFQLPSARLLSCPRGWPVWNGLPRPPDRENPGFNGDLTRGFSPPLCPGLGHPWGHSTRPVHRRSPA

SEQ ID NO: 974734 - protein, 171 aa, Homo sapiens
MYQNCNSMARMPKKLATSRDPPGPPLAFAIQNPEVSMGVSPKSSERVFAKTFFRPSVQVFQWDTLVKTPHRRSDSPELRIVEPIYCHGGTPIWKSTVNGLNLTQRGYGPNPLRERDCFDNDYALIARSLGKYGIICKLEDLIHEIYTVGKRFQEANNFLVAPPIVFSTEVE

SEQ ID NO: 974735 - protein, 78 aa, Homo sapiens
MAPCSPPALLVPTNPRQAFPDTQPRNQKKGPPVHNLAENRLLCLPRPIPGFRVVSARLRQRRLSLLVFVTGEYNAPEG

SEQ ID NO: 974736 - protein, 123 aa, Homo sapiens
MIYGVTTPSGYWSPQPQSHSCCQHNHLHNLANHNQRNTYVPHPCEEEPRGTTKEFSSHSERETLESPESKRKGAGWPPLGLLAIPTLADRPPCMDYSLAKPGEIGPEGKFDELRPPLPHSPEW

SEQ ID NO: 974737 - protein, 211 aa, Homo sapiens
MFKEMPHPEAPGPFPPTGSLEKGKEPGPEPERSWFPHPRERGRRRKIAPALPGFDLALRGKEDKGEKFMKDAQQKGEMTPRGKVSVCEILPGARCLLNGLANEESARAQPGHEAYALQVGDPVTSVSALESQKPGDRNLLFDVRTPPTTSLVRPLHTSIRSCALLFGRIQEYRLGLPPPRRRRITFNLNPRYQRKEVNCPWPEENHGGQPL

SEQ ID NO: 974738 - protein, 196 aa, Homo sapiens
LCTCSFAEPNPALGGQPTGPPAVCFPPGAWCPPLVTPPPRGDSWGPSRRGSRLDAFLFLSHAALSLTHVGVCARRPPERGFSPNTPGTPENGASTPRTGLGTRLFQGAPGPHKTFRAAPHSTQRGHSHKVHAGGRQKPAGLKGHTLAFRTVGLAHPTRRTREMAAHTDRISWGDCRNREPCEVTPLRRTSQSPMSP

SEQ ID NO: 974739 - protein, 228 aa, Homo sapiens
MSVAVSRRWVDSLSLRPLFIAELSCVLVFLAAQGGVFPPAGVAARAPPSLFPRVYFVADPPEAVVDTFLSRSLSGRFTLSHKVVFPDPEGFFVAGPHLFLGCPASGWAPPRHGGSQSWGFHLSLQGWFVFLCALPLGLYILASAGLICPPWCWGGGAPPGRHLRCAQGHKCFALSTLVVWASMYFGVRPPCSLVVKKAVWDGMGAPLEICLVKGLLGGIALPNIAWHI

SEQ ID NO: 974740 - protein, 139 aa, Homo sapiens
SPRSQELEEPPIPEVGLFFCCSAFFVGPKHSLKLNPLYAISLSSPPVAAWGDHKELGGHQKKCNRGKNLRAFNTSAQRSSEETPHTPTHMGRTQHTRLYSWRDTPRETRFFSFHRDGSLPPSVGLFWEGTIGIGHGPLV

SEQ ID NO: 974741 - protein, 147 aa, Homo sapiens
MGVCPVVRPSLLFAPVRILVRHFAPFLRVFPPGGPLGLSRVVVNPYTGSLSFFGGTSEVGAHPSGPCVCPPLPWPQWPMPSGVRVGVRCRGSQARVSSCVPDVSFPTGVGLSGHSTYYCRNSTQWPNRRCARPGEPPVVSRPSGTVP

SEQ ID NO: 974742 - protein, 182 aa, Homo sapiens
MGCTHTVRAPRLFFLFGALCTHTHTTELFWTHNGAQTLLRHTPSEKWPLDIFTHREDNSSGTFSSGFPLESGGVRHNVLGHTVRVSVLATEWLYTHTLVWALHVNPHSSNHSTPGDHTHEVSWPSVLVERPRVNTLSHTLAEKRLQGLFLGEIPLLPLVDCCPSWLLPPTSLLLAAAARPTL

SEQ ID NO: 974743 - protein, 331 aa, Homo sapiens
LPWLAPYNRPAVFSFFVLAPPSFQGVWAAAALAWPHHRRALSWWGTPNEGGGASFCPPVVVGPPSARSPPPEGVWAPPAYMVPSRRPLFSPRWRRRYNTLFCCDHNSPFLFSSGGPIFFSGEGLLSILGAPPPPQGWGSPPVSPSFVGGAFCAGPQHDCHPHVSPILSSPGGVFLPRRLYHNTCCVPGVPHPAPRRPSERVSLWWSPPPPGGTPSCVMIRPPPPRPTKGGPPNNLGGPSSPDKIEGGDARARLGFRLVGSTTNHGGGFPNILIAQDASKGAAVDLPVGVPPGSCPDETPRRVCRTTVGAPWRAPTTLLALTRRLLAAFAGG

SEQ ID NO: 974744 - protein, 257 aa, Homo sapiens
MLVLYSSLAFLLRDALGPPRVAPRFVEKPPGVKTVFRLWEFVPRFSFPGPVPCSSCRVPRWCSLPPSYVDGPTGLSLKVLCRMCVPCGQILDILVSRGLIDEGPDLWSSSRRSYSCPLTPCAPKQGFHLSEGRTLCVSRYAQTDSRYPVAPDGKATLRGNGDPQREKKEAPGSRRTLRAQCLFPKRCSNPSSPWRSQERVPSWVHPGGSCTICPSVGDVAPHEVTQSRRASFSDAPVQGFVDHRTDTRPVRFSFAQK

SEQ ID NO: 974745 - protein, 205 aa, Homo sapiens
LSCVCFLLVSRVLFVCIVAMSQRAAQTASTALVGVAVVSFSGPFVRFFSSKNLGPGLLSLSVWYGWGLKMRPGPLCVISCPDVPLMGHTGVPAPLSEALFRESPRHCVRSPITFGVVHRNNAMALEVTYRGRLYRYKGQLRIRLDYHNIWARTCCVERDQDTMINWVEKHLGPSISTHQPGKEDHCPVPLRSLKLLAKKAPAPAR

SEQ ID NO: 974746 - protein, 106 aa, Homo sapiens
MALSLSPGNAPGPAFADSSASPPDTLNEDGFLAKKHEGFITSQEYFPTLSLSGNSQGPCGNGVDLGTQADETWKPRPRPSARLVHEPRLHPPVFSKWRKGEGDETN

SEQ ID NO: 974747 - protein, 159 aa, Homo sapiens
MRVRLLLGSRAALFALWLVYLLRLGCSLMPGRGVLCLRRCASEPDLFVVPLLLWPPPMSPLPYGGPSGQLVGSTRARSPLLASPVTPALILDMDGWCPLVLFFFRSTPYLCSHEGFHLLEWAQVADWRDKRGEKRGETPHVTRILAMMALAHASASVHT

SEQ ID NO: 974748 - protein, 261 aa, Homo sapiens
VCVFFLLFLERQSARVEREEREEDSRFLVRSVRFHNGPALAIRTFSCQLLPPPQQSSSLGAPPNFVWDLAFRATPVRLRFEPTRSRPVSGAIWKTIIPLISQGTPQWDFPPDPADSTHWADPGGRPRGGHRLNPSQALPPSPWRMPAPPLSSPLWMPWMERKVLWNVPSLSHRRTGCTYFVHTSCLLGKKGIEKNLGIGQVSSFEEKMISDAIPELKASHPEGGRFREDPEVSPCDGWPRFPLIYEGIMSLPNPCQINFVF

SEQ ID NO: 974749 - protein, 431 aa, Homo sapiens
MPGSPRGAPLPAWGVVWGSLPPGRAFPVQSRHLLCVRHPPPRGPLGCFSRQGPHHRKRCGENFASTPGAPSNMVVAPGDDKSLVVWLWALAIVAAPGPPPAPSWGWSHGPVALTALTGGAPTHLALTGDFCLPEGGAFSLGRVNIPGDMVSNAGGTTPKGTTRGHEGGAPARSVFSGGIPRRRVPLGARPKAPRRSPPFGPHDPHKRGDEREDPRVSSSSNSALRSCVRKGATCGPHKSYLTGGATHAQGPAAFSRAPAPGFLSALHRESLVVLRACRPGEISRRHQVGPHSEACRRESLGAPRCGREMAAPCTGPGAWGEVFWGLLTPRPPPTKVLGRRLSKCSPRTLWNTSTRSTASESLSESSDSTELSASRSPREPAGAHTPCREPGFTELHEGGIIDSRPLEEEKPKCSNRHVPTGESLVENTGLP

SEQ ID NO: 974750 - protein, 488 aa, Homo sapiens
ELFAPSPVGVLFFGLAHSVGVAIFACASLAGYSAFSFSVLRSVHPSRWLGRRQSFVVSRRVGVRPLSSCGVGQCCCLERPSCGSVFWVSPLSFPAVGIGFSGGCGGELSFFRCVGSFLYLAELVLFVLLCNDIFCWWLAPSRSLVLIFVCALFPLRVFVKVVFFYRWKMCVGSLPRPRDVVWGLPAAGLALFGVCLVFLAARVVLCGETTPLSSRCARLFRGVCLHAPPRGDKRGSGLLLPSPPPEEIERALPRSLPSVYALSLERETLREGSSSLPRNELVSSGVVGAHLSRTLARALSRARMRLLVGALSAAEVEIERETPPLSRLSVVCASARIQHRRARAVVCFCPPLEWRPRLSLSCGAPPRPLSPLLTDIVCVCRASVWLCSLPRALLAHMHTLRRARGAPRRAPLVVLCVCSSHTQAVLVGLFVSCGLLSLFTPPLSPPPPLLRSPPRCLPPTQDFPPWGCVCETPPDNRKTGTGEGVFSH

SEQ ID NO: 974751 - protein, 115 aa, Homo sapiens
MGPRVCHQGAPHRSVVAPRPSFSGRFVTPPVVGTGVIRILVASPPRQVAVPQGGSRRCLAATNRMVSTVGVHKEQTILSRGGPPHSVILEPEEAFVVFSPKRDDSSSRDGSAPNW

SEQ ID NO: 974752 - protein, 364 aa, Homo sapiens
MRAPPPPVGHDDPGGVSHTQGGGVHTPPCAFYHGPVFNVWSLRKLWVVGTHGVTVFPRLCHICCLAPRFCPPAGPTPGPAPPGCRAALCDVASGFHPPPEWLLEAPQGPIDGLALASPPPHWAPVTRGPVCPPAGSGGRQMSTERKVELKPKCFIMVPPTTYNHGTLYLLLEVGVPPPQCEKSAVSVNTTHTSRGLKNGLRHPFTLGNKHRPLPQRAVSQAHIFSRHRFTGHMFSGRTRPSHAHWYHPARRAHGAEEWKFNRRPERPTLNEPRWSRGIHSTYPQECPPQPKEGGRGFEGRKARRKEGGLRALTVTWGKAREASVDSLFTPRPVLWPVPLCALAVFPVHIPAVPDHPPLSLFIVE

SEQ ID NO: 974753 - protein, 131 aa, Homo sapiens
HLYRVFYGRPPFYGSLLRKRVPPPRVGSATNAPRLFVYNWSAPTVTYIYPGLFIRVIPGAPFVCAPNISGAPEERFVCLPLVVAVPLSPGRGPPRGLSLCPLQGFLKFRPPCVGPLRQQGIFAEEILLIGG

SEQ ID NO: 974754 - protein, 110 aa, Homo sapiens
MLWCDVVVFAAPFLDLYIYRGGLLLVLHTFGPHPLCVCTLTLRGHPTPLWDFYILLCAQFCIVTRVGPPFIYSVSIDLSLTHVCAHRETPTLCDDPPLFSWSPLPPDIGG

SEQ ID NO: 974755 - protein, 225 aa, Homo sapiens
MGKAKGLPHSAEFFEAPCTCSVHTRDPPVLDFGEDAWGIHLKIRTVDIGFATHPRFCETHQLDNRMESFFLPSCEYLYLLFDPTHFIHHHGSPFDPVITPFMGSASWGLGGTSSTPEAHPYRPCRPALLPEAEGRRQWEVEDLMREFLHLSNGARSKFQKNTVSSGPWEPPSKAQEHIFSPRKPMTQARERKPAQTRRSPLFQLPPVSPSPPRLALLGPVFLDSS

SEQ ID NO: 974756 - protein, 482 aa, Homo sapiens
GEQHHQDMGGSPQDQECLLQMFPPMLSPSLRGGKAFVVSPLCLGPPETTTRRVVNAAPQKTILPRRGPHLLGGRTPTPPPRVLSWVRRTLVLSPPFIINIYPAAERKLFGSPFLWWCFSQHQNGVGLPPLSSSFVEEFSYGGKPICVCSLCSTNIKKGCFTTLSVFSCVPPPLWTGGGRHHCGPPPTSWWREISHTCGGATRSPTGTPPCGVFFPGGVSPQLEYVAPFPSVCVPHAAFEWGNSHPRLYRVSPHGDTPTFEDSPSRGSEMWLTALEISHDSRRDHMVVESSTVEICPTRLVLGTHWAFTDSVCPRPVADPLGTLCVTPHAHRCVFQTHTVGTASFYHTRPAERVGSGESPQRGQISLRTCLRVSLWERGVCPHTLCRHSVCSVLRTEFGVYPTLVLHSTGTPLSITPHRVPKRGPRPLFSWKTGVTPFPTLAEKRFKASSWLESTSASCGCCPRGCCHPPSCSCCCCTPHAKG

SEQ ID NO: 974757 - protein, 107 aa, Homo sapiens
ANTTKSPNGRFVLLPPAPAPPACILLYISPGSFFTKGCIPRAGHPMGGCATIISLGAHPKKADRNICRVGRLSLPPSPCGGRTNRCWENISYRRVIRRMLSVLCPNK

SEQ ID NO: 974758 - protein, 122 aa, Homo sapiens
MKLSCCPLLLLPDPPSRDPVYPRAVPRFLPLGKNLSCFSLLLPPSPPSITLTPFCSLSSPLLPSRSPTPPLFEKTQALPNTRRHFFILTQDYCCLPMRFGGKKYKYKMAFPVPCIHGMPTIS

SEQ ID NO: 974759 - protein, 120 aa, Homo sapiens
PPLFHDINTRQILFTFTPLIGVPKTPNNTRIFLGRPRHIYKENLSLKGESPHTKQCCGLYHNKNTTHAPFVFISHLPWRPHTFNMIVTAVSPLKRCILRRRHFVWWAALFFPGPPRGGGA

SEQ ID NO: 974760 - protein, 154 aa, Homo sapiens
MALSHGLPPVFPTGPAWEAPHALSPLIAARPASMPTLHGMPYGNSGPHSVHSVHPLWRSGSRCSPHTLRGLRLKTHSWHGIFSGASPTTQEAALSKPGHRLVHPMSPPRPSGRAPPPSCRVNSKLSLPHASPGCRVCPSPKEPPPTLFFFLYFE

SEQ ID NO: 974761 - protein, 236 aa, Homo sapiens
MSRLATIDAVFLKLEALPVWPRIVLFSGHLNLMHTWSIICLRPRDHLSTRSHNWGTVKDELTDLDPSKVTEEHLKVEDSSPWPDTGNKENEVEEVKEEGPKEMTLDEWKAIPNKDRGQSQDLISGNPMKVLNGHTGRRDLFLHKSKSEEAHFLKIRLMDHSLSGSHANDINVSRWRSILESLGRPGAWRPGEDEVERGRGGRPKPWQHGAEPNSKCFCSLMWMTPRHSPLWLNWMP

SEQ ID NO: 974762 - protein, 126 aa, Homo sapiens
VKVSLSVGRLFPTKGLTSSCVSGPPPWVARRPVVLLGGGVHPYRDPPSPGCSSGGRFCFPGTSYKLPRVDLPAPFAPPPGAPGSLCCPPPCHCAGPLSGGFSTTSRPGLPGLSPPISQGPPPEAEG

SEQ ID NO: 974763 - protein, 150 aa, Homo sapiens
VCFRRLFCSCYVVCLVRFSVCVFSSLFVLLCCCVVLVRSVFAYLFFVLMFGLSDEVARRRRRARRLATTARVWSSSMLACRAVVFFFVDRWLVCLVDVMYITRGRRSCGPPLKWRGFPERGKGPWCSHFVVAPKCSLGPRCSRNGPCVLI

SEQ ID NO: 974764 - protein, 173 aa, Homo sapiens
MGKEGSKYLRVLNLPSGTHVVAPVDGVPEMAQKFSSLALELYHPRALVGFPPHCPLSWVVPRPRSVVVVLPQIALSMGSPHPSFRGHRASSGPGVFTHSSLGGRLTPLCLHTLSLCRWRLPPICPTVCAPVVKLGNSGPLGGAFIVFAPPLVAPLAPQEVACLPFTAPPVSGL

SEQ ID NO: 974765 - protein, 323 aa, Homo sapiens
SGLCVVVLSLVVVCVSGVMKRKEVTELTINQKATMNDHGGVCKLIICVCAVLKRSLGGLFCLGGQYSPRGGPRLFGASLLREVLRVWSKMPSNLVWGDLFSRGTHGCHCPHRNGVSLTRDVVCRGPTHLWSGGPRRIVGPPRWWIAAGAYTVSSRVICSLGPISRSHICSLGVIGPLWNWEFGPPPGAHHLWQWHRCWPGQLYKDRTVCVPPFSVKKSLERLAPPIFSEKFSREWLAHLVRIIGCPRHRRPIGVFEEALLTSYDHPFGSLLLVSEYEEHDTVSVGVNPKHSGPKNRLLESWHKVYQVCPRKAHEKAINGYLFP

SEQ ID NO: 974766 - protein, 132 aa, Homo sapiens
MRRECHWGLKDSTFSGRRFRIPAELPRIDLDRSGTLNSYAMRKALEEAGFQMPCPLPPVIVARFADDPLITLILISLFGVWFGWKRYSRYLSTLDPENTGTHRARPLCCSCFPTHPILQSQMHAWLPLSHEL

SEQ ID NO: 974767 - protein, 259 aa, Homo sapiens
MVTWLVDTGQWFRREPQFLANNFCLGNSGRCPQAGRCTRVTGVKTATARSLLGADRSLVRVNPRMVTPPWLSCGGSGRVGPPRDSLQASFLGSSRLPPPGPIMIRPYEFGQSFFQRLNPDRLLARLKGAQEAQDPVSPTGWGEAKEETQPSAFSSAPEGGGLFPFPPGDKLPGRAVPLGGPAHSSDTTFFLLLPVVGIHHLPHPPSSRPKSSQLPPSCFPCVCCSWACLPEHQTALTPGVVIPDPLLIPLSSQRWMQHS

SEQ ID NO: 974768 - protein, 218 aa, Homo sapiens
NRPQATACEAGHSRRLLERGYKHPVLLLHPLAAGPRMTKASETGRMNQHPAVLEEGVLDPQSTQWCPTFRLPTVYAGPHRGPMALQVPDDCGGPIRTIVGRDPARMPPPEPRRICMNPTHGGQVLSMAPGLTSVEIHFPFRMAAYQPSPKKPWTFYDPSQATMSLTFISRNSNEEAPPREGENPPRWLHGPPSLEGPDQIITGPFGEELRPLAPEFLF

SEQ ID NO: 974769 - protein, 156 aa, Homo sapiens
MVCASVLPPPRVRLFVDARATSRPHGCFALSLCCNGAIRRGAPPMGERADHSIYVGGEFAPPARVEQFGAPLLRAHTRHNPLFWGDMYVLLIFRGGRKKVSGAVCCCILRLCPPFLCGVSLCLPANKAGFCFMTRPPPLSWGNVGRYPYALGTIPL

SEQ ID NO: 974770 - protein, 101 aa, Homo sapiens
TLSIAGWGYFFLLRLFFSAQWHWFFLQQVVFTHTLGASLLTWAALLGVRTVIPTHNTLRGCAALVICRCSISSPPEGGHNYTQPRKCCTLSLLPLKIISGA

SEQ ID NO: 974771 - protein, 113 aa, Homo sapiens
ALGIKSQVYTRTPTLYLDFQLDPGARHSPPIPKRVDQLHFTRYLGDRVYMGRDDATHPKIRTFHPPPASAMEKSAPDVPSGEPGSPEEAHICLNMLGGHLRETQFIPTMVPYC

SEQ ID NO: 974772 - protein, 496 aa, Homo sapiens
SAERMCVVCVSASVITNFVRDEGVVRSVWALNTLRPARKIGRPMLFSPRGPVLRSVPLFCRSPSCLCLHCACPPTFLREGNVPRSLVKSPLFCTPTPLPELFGGRKSPRLGGDHLSFSFPGALLGGNFSSTGERARVVALWCARCPCDLSLACFCPPTTVLGCPLVCHEEFLLRNTQIFLGGEATQHNPSFFRGGRPASLPAGRMTLVPCVSAPTAPLCVVKQVHFFVAGGQTGGVPPLYDGVPSLARVGFPHPSKCSPRPVVLLSELSPSVPFPAVCFAPWLFVCPPLLKEEEASSVLCLLGGVAPPQQAELLVLLLPLWRLSGRHKPPTALLEAASALLLLCGADSLFKFGGGFLTRRGPNMSPSSFVDASVCAHTVLDTLSLPPPAATLPTCPHSPHLKGVGLYSLGGDTHPEVLTTEPAREGSPPSVIHILSHTLTPQPQRGEHFVHPLGLPTPCGLSRALSLSRHPSPNSRPRPDPRESFSPLHTPTFVRQ

SEQ ID NO: 974773 - protein, 100 aa, Homo sapiens
APLASLVLHGPIVVLPVGPLVGWWQGPPICRHFFRGRHTFFGETFSAEGSPTPGLWGPHHKAPRALWVETLASAPPVYLFFPGGCLNKGYSGGGPGGVAR

SEQ ID NO: 974774 - protein, 107 aa, Homo sapiens
MGPLRPHAGDIFSAKIFSPRPLLENQAATSPHLFGVCLCTSPHLLNEALYGIMLTQLGERPLCVLETPPQSHPIIIRLNDPPTKTIGEKWVRPFVKIDTQKRGGNPL

SEQ ID NO: 974775 - protein, 200 aa, Homo sapiens
MGGTKKDGGPHHLWGHPHNTRGITAPLGSGDLSALLTYRRGGEKNAPLPAPRREGPPLARGAAKRGVPRESPPTLRETPSGGSRKNWGDTWETPTLTPSLTGRKHTQWCVTTHKERESLIHTEKSDTLSHTEFNTLRGKFTHSHIGGETLFEIETTGREPSQQKGECITPSLIETTQRGCLAHRDTHKSSSERHNSLLWL

SEQ ID NO: 974776 - protein, 133 aa, Homo sapiens
MAVSSLGGWFFSRWVGCVLYVLLRGVVFSYQRGVVVVVASPLVVCRPTTRLLGRRPDRLRCGVASNSCGDSLVWLGLFAPFGSSVSVAWGEEYVVCLFDMCVLFVLSPLLPPSVFFIMGGAVFSLRRVVFAPL

SEQ ID NO: 974777 - protein, 224 aa, Homo sapiens
HSCGKILPPCHIRAPFVVLLCMSRSVVVPPPTGGAVLFHPNNVSLHDLLACSRPHQCSSFGGGCMYFISRGAPPLFPPWWETALVKLCCAVVPRGPHRGGGGRPSRVCFCPPPGAPTMSTPCGVFISEKISGEVITRGASHSDVEVDDYPPPPLGAQPQQCLCISRATAPQPLLVALIRRSRRGAHQLVIIYGGGPQVSSLRPLSSSRLSSGAPLLLGAHASFG

SEQ ID NO: 974778 - protein, 135 aa, Homo sapiens
VDILLVGVPPLIRPVILRVCSRTPRGGGFSPVFAKRGGPQLFPAGISPRGGLAATVGAFYRICSLKKCCVCYTHHYSTLVETAGGIISYISLGGANDPPVVNFGSAPRPTRAWENFASRRDQIGPLALSYIGKLL

SEQ ID NO: 974779 - protein, 136 aa, Homo sapiens
SPFSHWGTFAAPPRGVYFFLVGTLLLRRAHPHSRCVCAPRLLTFVEHISVDALSPPPIGAPREMWRRRADLYTQRARLWRSRDIFVVEDFGGVYKHRVLSARPTPPASGCDICPPPCSVFPQGVPPEGADLDIAAK

SEQ ID NO: 974780 - protein, 123 aa, Homo sapiens
MATRQLVIVLSPASSLPRMYPCRVKPPSPGAPPCGSRVASAPSESCPCVFICFALPSAPSCFVARASGTGWEDRLFPRSSGSIPSGPPLWPVVPGASPGLVAVVLDTVSPPLVGSLVSGGGVL

SEQ ID NO: 974781 - protein, 261 aa, Homo sapiens
MLFWSVAASHLTDVAGVWVGALPHTRVSWCRWLPCLLRRGLVVVFSVLGDSESPTPQRCLCGRAAPATPNLVTPHAWVWVGSSPLFVVVVFLVGPPPHTGGAPPLPFIQDEVGGCSPTPVVLCPLTIFAPRWLLIECTSPPPAPLFAGEMVFVSPSLPRGWYSIPLVFGSVVRSSPPLGANVAPTIFLRLCLVKGRVVNDQPVVPRSPCVDSLARVGVPPPPKVCRYPPYMLPSYRPGSGQLTLAFFGPEKHTPSSGGGFV

SEQ ID NO: 974782 - protein, 125 aa, Homo sapiens
MVGVVRSSSVAAAVVVGGASGVVMAPAPRCGRAAVLAPQLLPPPLGGCPTRARVVDPVVRGPRFARESVLMFFLFRPPRSRFVLCSPLAPPAVVFRPSPKTCRRVSCGNDPHTAGVVVRGPPVLA

SEQ ID NO: 974783 - protein, 125 aa, Homo sapiens
MSCAPHWGVIWHTRGPTHWCGSVVGCVAHTHTLSTRAHTLGAPHRRGERNERGDIFGEERCALRSVSRASSHFVHADIETPHTLRVTSVWAIYRIVWRRLALFTPHGATPTSRRRREILRHTRGH

SEQ ID NO: 974784 - protein, 148 aa, Homo sapiens
FLEIDFHSTHAGAHTHAGEGCSIRKGCFSPAWESSFVEIFHTAWEFREIFGVPQRDISQTVSPQRDNSTWGPTTLLRGGPQIHPPCVSFPRAPLVFTRPKSDALLWGPAFEKICQICYTSILRFVITAPLPADREIVDILFVPLYAHS

SEQ ID NO: 974785 - protein, 136 aa, Homo sapiens
GSIPLPALLRIRGRPLLYDAHYFCWPPGTTHTRRPLVDTPLCGANTGGATSGVSRTSQRHTLSQREILGGAPHFSRTHAALFLCINPLAGRTSRLGESTSPNICFHGPLFLGGQSPRREMKNTPLGDSLSVRKGYI

SEQ ID NO: 974786 - protein, 125 aa, Homo sapiens
ASSRPRARAREREQHHSPQRARESARARRRMKRERDSMCVCARARARSAAERPHSASARVRAHHPACSPSLSLPLFSLWPPLSLSLSLSLSPLCCCVRDDHLLSAVRACGRFVCGPPPTRTPLRR

SEQ ID NO: 974787 - protein, 250 aa, Homo sapiens
LAFSPPVPPVICPKPFFPESPHTTHLFPFLRPKVPLRCAAKRLFISLSTYLSRFLPHPSPLLAPPRDIQIPHAAHTVAPAFRHMVFKKPTPVWVSTEYEPPSGFEAARLALWVTLYRLLELGTCHHMCTHVHSPLANRYHHHMHIPLRASTTQHLATPHVELLYHFANPAHWLGKGCGNPTSGHNPLHRSAPLPRHYAVWPRPEKANLGTPQVSQLAPRPRSDPPKGRAPPLSPCFYPSFWVLYTSGYPA

SEQ ID NO: 974788 - protein, 73 aa, Homo sapiens
GCVSPPLVCVVTHREYASRRVCGFISPARAPPALTELCYAARSSVEVCSRDVRAGAVGATYFAAHARGEHPAW

SEQ ID NO: 974789 - protein, 164 aa, Homo sapiens
CALARPLLFWCPQSFFGRRVFVGVEIILNRGATLSSGPYVFTDRRQFSTVIFPRGTLIGAHRVFCVSPDAFSSRGDTVCLCATRAFLFGSFSPPPRFSVVDHTLPGWRVCFPGAHVFCFPSCHSTGACVCPPFFPPLRLCGRPRWWVSLGAAFGFTGVTPLGDV

SEQ ID NO: 974790 - protein, 434 aa, Homo sapiens
MPARVVPHRSWSTLLSGGGDLPTGMHPSFSSECVQPKLREKIFSAAVKGGSGGSYNVPFLPRVVEETRHDGGCARPDTAALSVVLSTRRRREFVLLLACVTARSVVCVAQRALVVRCLLVWWGSARPCCAATEYVKVVGADERRTLPYCWVPSCSILLCGARDPRLPPLDVCCSLSWAAHSRRLITFRPGGWFTSHVLSTSCPPPLPYCGVGFFLSAPSCAATCCSAATVLRESCASPAVLCDDPPPPSLISVDRATPASGVPQSDVRRPSSSAALLYPVVLVVAARLVRVRSPRRRMCGGTPCVEPAPLWCCAVSPQRSSPLSYGARSTPHAPTLYIPPLWATHPRLITHTPFRTHTPHAPAAYEYMFPYMSRLYTTLFLAISRPLYTTLYRRGAPLGALYYTISTSLTSLSHNIIPHSPPHNISHTTPHKHI

SEQ ID NO: 974791 - protein, 111 aa, Homo sapiens
MAPLLLPTEVYSAPNICVLTPPTEKGVSPVGGVFSTLVGPTPRRGQRVPTATMSVQQRSCALCFRVGVATEDSTIWCPRFCRVSQGDMPPRLARLVLWGRSRRLSSGGVEK

SEQ ID NO: 974792 - protein, 371 aa, Homo sapiens
RAPQNGALPDDPRVSFVGRHPSWATLFVGVSHMLFCVAEKPVVSPTRVWCGRNIKWGFWEHFFAHRGEYLSRCVAQQGSPICGAAHAVVLLAQLGPPRVGPPRCIVSPPEGTTFFGTPPKIAVGGYTMGNAAQRGSPMRPPPRCWRSPRVFWNIALPPLGVVAHIWEKKMGVSPNLSHSLSPPLGRTVVPCRPPFWGRGPPHTAHYTPTVGDTPGWLSTESIFVTPGGPHFGCVFSRGDTFLPGRCERENFPAHNCWGCHTMWGAERPPLEAPSFGARSPPHAAHSEFGRLFSLLLVCAHTTLLRGPPPRGGDSTLSVCVQHYGGSIPARLKKNIYCARRVLWGVSLSRICATMEHTRNTLLTLTRPAYPT

SEQ ID NO: 974793 - protein, 253 aa, Homo sapiens
MGAPRAQKRHQRAAAPAKIWHHSWRCAPRAILGGFSHNLRAHTISGAAPLRPPTRVSRVIPPPREKGGVARPALPRAFSTPGRGEPHRGPAHIHTHREECAPGDHICAHVSLLEIPRGEAGDTQSHPEVSLHRPNRASRLKRRYLPSPTLISCSPQEAPLAPPQRRERPQFLSEKNCEKLATPTAEPEPGHMPAPGNVLIKKGEKSSRVTSPERRRRKEISKAFASFPMAPAHASAFRHTGPKEPREPPGPDV

SEQ ID NO: 974794 - protein, 101 aa, Homo sapiens
MRHKFWVPPHTRVWWDPPLGPPPAPPRRYKHPSDAPTPPPKRAPERGKEEEPPPPGESPPTTPVPPPPWISPPPPAVPTVGHPCKKGRGPGDPPLSKEPPH

SEQ ID NO: 974795 - protein, 120 aa, Homo sapiens
MRARRASHACLCGRARQPTTNQPRTSLYLSYLLGDDPPPRVVEDLPVGSAPSPHQNYVRSAPLLLLGWCLLVLLERAAPHQRSCVAPQQPPLLLLIMSFLSTHGSIGPTHNTPFCDDTPP

SEQ ID NO: 974796 - protein, 108 aa, Homo sapiens
MCHVVYVPANPFVFNTLPVLGPPIWSRQGPHTTVLTTKPAPFFTPPPPVPYTRFLKVCPRPLGVAANLRPLRGDPRPPKMRPTSHISTQQEGGEKFCLRLLYGAILFQ

SEQ ID NO: 974797 - protein, 256 aa, Homo sapiens
MLLTVVWVPPAEGSIPEGPHTPRTKEELCTQPPHILHERCCVANTKYSRWRTPQGFLCALSAPTPRILTLVCPEDSFSPNGTVGYPGRFLRRSKMARPLLSSWAHPISRLVAPTPSRLTRLEPDAMGWPMYTLSHISAHPDERPTVALPPRARDTRWPPDTRPTCEPNGVHHRRTIENPWEPSQARLVSSASPRRAQPGRSPAGLICLSHEVFPGSMARRQGTRARGLLSRPLPMPAWPGREDGTGWRPPQTDQCT

SEQ ID NO: 974798 - protein, 238 aa, Homo sapiens
MCIIIFVCMFFFFLFFSFLFISYFYICSSRSSVHIILEDNTTIVNTRLAPYIPRGTPMFATTSRFVFPPPLVFLLRLCNCTDPLGGQSFRTRGTLSLWPPVRYNPPREGFSWGVGPPPARDCVKSPPVPACPLLAPWVFPRGERKGGYKPQAPPQSSASAAAHCPAVYSPVHSLRSVHHPGEEFHGSSPPPVVLVYPRVPGPPVGCSLDAPLPPPPVDSPGGAEGNISTKGFPQSFHS

SEQ ID NO: 974799 - protein, 171 aa, Homo sapiens
SHYAGACVAVLFRRVSSVGDYCLAVGLLTQGIVVPLPGVGGTPFSRSIPSPCVLGECNPLLRQQLLSPSPRGYFSTLEDFLFTDRWVVPSAYPPPCRFVNTRKWFKRLFWHSVCAVDAPQSGDLFAYEERCAPLLEADISSSEREEYFHGAFHGFTDSLGTRTWSPNRKVG

SEQ ID NO: 974800 - protein, 385 aa, Homo sapiens
PPKRKERHKAEGREQNDKELPYQPSVVLFFILTAFLVEQVFVSPLLLGRMFFLTQWVLLFYMSCVSAISLCSSICLWCSSSSPPVSHHGPLLLGAHPLVHIVGVPHFMSWNSFPPAGVLGIVSVVFRPSSRRGIPSVVPAAQLWGPGACSIGLIFPLLSPTVSWGPHLGTLCAPGPSTPLLKPKFWDPPSPGWPIGKWAPILPVRPGNIRWHLLGGPPKRTTQWVHKGVQKYTPGRFGVPGLIAVWEESPKYWVHNCAEDPWPLGALSTVSMMGSSSVACAPPEGPLVRIPSFSPNGSLRAIKRNILSGIWVLLPIAHGHSTLTHARDHEYFHSEKLSHKSKVAPGECLVLCTDPKGPIPQICPLPELLALPHTHCHGHLVLHEA

SEQ ID NO: 974801 - protein, 482 aa, Homo sapiens
MTDARQAGRRCWCCVCSTYRRCGCELALSPLVAPSFVIRCAAAVRRWVRRSWGGLHSGWGLAAVGACGRAHCCCVPRRVLVVWAPRYLAPRCVLQASRAPERELLRGEFLPGRPPGAVVDLAWGGVCPGVRTVAWACAAPPWVCALYYGAWSMGNRGGVAGTVGARRRAPRPGGILFCAPSVGVALAGGEESRGFSAVFGVLGGLLLATLVAAVFCTWGPEPFCVVANKARAPRCFAGPTHVVETAPGRWEGPLFVGGGLALTWGHAPCEENCGATGASPSPLSWDAGVSLGAYMGDEGLTPPPGVGFTPGGGGVTPRALCRAVALVQPRWMAYRGPRVPAGHLRSLFPTAKVWAQECLPVLPRWGPLKCPGGPRVSASEDLVKNCVASLGVRKFVTTWARYTTWAHGGCWALLLLPSRRARLSTGSLTPLEWAHSCAKGLHAPWRPQEASQATRHPTELAEFFLRSILLGFSQFHVPTPLS

SEQ ID NO: 974802 - protein, 231 aa, Homo sapiens
MCAPQGWFPVQKVWTLCESVVCPRLAAFQGLWGLVPLVVVPRRAGWPGVCPRFGGLRPGASLIASGLVHVPGGVPRPGLGTPRVCPGPPALVGGLMGFLEGTCTLAPGFVFVFPGPCESFVACLPGVSSPGPRSSALQLPPRGFRLEDFSDAFVDDALGPPGPFLRKRRPRPFPGAAPLPPFLPPPLLFTRLFPGACPRPPRSREPAGLSRGRVHRDPPPFFCFGSRRTRA

SEQ ID NO: 974803 - protein, 405 aa, Homo sapiens
CVFFARFDRQCRREERRCVTLGCVGCLLAAVVVVLIRFVCSFAVLVLIFVLITWFPGRLLSLVWPAFGVQYAPAFFSCDAALWCLRLLSVYHLAVIFRLSPFSPYLCLLWGLCLRVARLVGSGVPRASGRDPIGSRLASLAHFPGECGLASLSGPSDSLRRFATVKVSPPFWGPPWTGHKPGFTSYVGVLRLTFDLTPACAPDEYPSVPQSPVCPMGTQFGAGRLSRSLGKRPSPRCMARAQGGLGPPQRICALVIWSTQPSILGFSLLCLVTRPPPNPPELISPSFPLSNFLCFLRIKKPILCNHPTTLTSRKAHSPIIVGVNPDPDAVPDDLLTFSMWISIKNPYHHAIYNCWAIPVDFLMFRMGFPHHLTPSSYIARKLNLWIWYFVNDLFQSKGHPFFYNQ

SEQ ID NO: 974804 - protein, 120 aa, Homo sapiens
MIFVATTTSLVLLKAQSLVVPPTMFISGAFSPPHSSGNIVVSQGAQWSAGSLGRALFYSRGAQYVFCGASPPPLVWGPFPVLNSSYWSCHPHGDFFGWCPPLACAVGHHFHGAPAALGCV

SEQ ID NO: 974805 - protein, 143 aa, Homo sapiens
MVFYKTNGGNFGLGEFIIICAGRLNKKGGSHFVRVVACALIREGELFFVAFFNWFEGNSCFPPCVCAPHSAVCVTVCPPHGPWPLGPKHQVSVSPDTPLWPTWWRPDHTSVSTHTPHACVWPMEDGFSSHWVFPLLMGTKSPL

SEQ ID NO: 974806 - protein, 240 aa, Homo sapiens
MRGVPPLSVRGQSWSQLAPVWMTFYMEPIWPQGIPRVYTDEATAIAAESTGTISDATGRQNTTRFGQPPGYLPAISRKYFGDTPILSANFGSPGALDTGFDTNMIPAETRLSPRRPDRVSARTGALGEVTCVHTTADHEACYPRSTVVSRTLSRECKSRATTLYFSCRRGIPACTHTAVRMGPLFLCDPAGSPRMEATRTEAGPQKGWKLSEWEFPSHSLLDIRYIPHAWSPQKERLRFS

SEQ ID NO: 974807 - protein, 410 aa, Homo sapiens
ACIIRLVCLGARGRPACDPCSWFVGRVPDIVASFVVVLAAALGGDVCVRQRVPVFCARGVQPFVLALMCVPFCMVSVGERDVNLFCGWVYNTLFATYVGPHQGLLVGAPPSAGGVLFSSPLWLLWCSRYYEDGRLLLALPVVGLAPFDLLSPAHTRRCDPRVDGRLVFSQWHCWALQKSSLWGVRRSTYCPGVLVGGVSVSGGEPRPLLLLPPNLSADAPPFGGQKPDAEYSIEGPPVSANGCKLSVGDHLFFMASLTRGVCTLPRCTVLGNLQQGVGAQLLQNSSQNCYRPRSNPCPHQLAGCPLFCAPLHPKSVQIVERSPPLCPHSSVLYVISHPMYRIIKMSPPTFKPRLSPHPLVFRPRPPQGPPLLSEPPCPLTWNPLGPHKYVNLYPPHTLCHEDPHLETPPV

SEQ ID NO: 974808 - protein, 102 aa, Homo sapiens
LSCCVCCCCCSVLFSVFLLCCSARFCVCVVFCFVSVVVSSVCWCCLCGLGHVYVVTTRWPLWLRRSPMLAKSGFFYAPPRFLYRSLYVFWHSGVPNIAPRRC

SEQ ID NO: 974809 - protein, 104 aa, Homo sapiens
CGMLVCDSFRCALWSVLLFVRCTCSCSVASGLVVFVGCCRFSSRVENAGGSFSRRPGGEDAWLPRAVFFVILSGLLVVSPRVLLPALFCPADVCRWRGVIIVSL

SEQ ID NO: 974810 - protein, 122 aa, Homo sapiens
MTNRGVEIDAPPLVVSTGCSYDAPECGCPATPYVAEELPCGFVFPLGNNRLFQNRGAPPSGNPFGEQLAPPVGNRIGESVGVFPPCGPHKPGGKSSLYITDNYTRLWKTVEVEGTFLVAPSL

SEQ ID NO: 974811 - protein, 105 aa, Homo sapiens
ACFCCFFCFLWTRAEPDGTLVFFCSAACYVCFSVSRLVACTVLPLLFPPSFPCDSSSPLISAFVSTVPHLFRFWFPSVFASLGVFLSAVAPPALLSAPLQFPPGI

SEQ ID NO: 974812 - protein, 261 aa, Homo sapiens
FAASVLFVLGSMLVFSRSVRALRCFVGGHTIVGLSLSVFVSLSVCAPAISFVGAPLNRAYTPSPPVVLCAVLFLFVFQTLLFSRCALYVFVCLLYSVCSLTSPLSISSVGVAEVSLSLIRLSLLPSFQMFGVGAAALFFPTQYICSLRHPRWCPPRYVDLLYMREANASCSSIRSPHPPRPVPCCCSPPLLSVGSPPPPLRGSPLASFLFSTCPSPSLPRRAGCGGCGRGEAPPPPSWGSGRKKNFLFYYKKKFCFFYVCV

SEQ ID NO: 974813 - protein, 377 aa, Homo sapiens
MSVRFGLLPSSSLLDRVSPINPPPCVDKPPHRVLGAPPLLWDLSWRCHTWVDPTRKHEGLVFTPPAPSFLIPVPYKGNQSPFGVAANFRPQKGGVLCNPPGRDVDIKRGEIAPLFPWKENSTGANSPKKPSWGHKNGKAFFPLEETFSFATKDQGMCTHLFLRETPPGASKQDPLFKRHLWRGPLAPSRDILIGTPGHQPSGHPGTIGPPRFERPMVITKNWASPLGVDRRFFKGALCVYPHPRCHPSLLRRENSFPPKSEIHHSIICEKGFSGDAKEGAPKGWESIFQEREESLRRPHTMPPKYPRAQVHLWPTAEKEASSAAYRGSKEVVLKKPRRAFWKALTPAPSTELTRGRASQLPFPQCGPGCLALSSSPV

SEQ ID NO: 974814 - protein, 151 aa, Homo sapiens
MGFLGYVGVWASQSLRMLERGCECFAGPPGAPTSNELFLASKWVNLSPGLNVWDVKVKWGKDHAAGDAEDGPPGLLVNSWRTPLLRFHDFSWETPMSPWVTLLTCSEDNITADIGQWLEIFAHDEESRCPDIRIWRDPGFFNPKYRRNVFC

SEQ ID NO: 974815 - protein, 235 aa, Homo sapiens
MVLCRGVFALRDILCSPPTLEVFLSASLAHKCARLVDLLEGCSHRLSADTWLEHSPPCLDVVCHHFLWGEFFYYLQIFWGRRAHTCGHPHAPLCVIIRDSGALVLWRLRCPLTRRAVERVLSTRHTHSMWWPHGVCPTCPAEPHICVVSRLCEKYCRVATLFKYPRERFYRGSRATLYYIMSTRVPHCSHERAYTLECIFGLLYEKTRLSEENGNESVPRTRHAIAQMGVNPRGN

SEQ ID NO: 974816 - protein, 624 aa, Homo sapiens
VSYVGCVVWVLGVLALGWLGGSGLSYCWWCVAWIVFGVLVCCARLFVWAVGVCGWWWWWYVTTLCVVRCLLALVCCIFVLIFCVGWGVAPTLGVLGCFCHARAPLVDCWFAVVCFLFVAASAVFVVGGRLSVPRRLVVVVCGSVCGVYFSLCGVLVGGFLSLTVVGWGGRLVVSCDARRWCWWCRVVVVVVGSCCGVLGGREWWVGGGGVRGDVWVACWGVVFFVRCGCCVLASVCGVARGSWCVCVGFVCGLVLLSYVCGWCGCCLASGLVWGSCVVLLGVWVLVFVSGWSLVVVCVVWSLCWCVLVGFCASLCVACALRRLWCCFGWCCARFLLLVSGVCGVCVCGVRWVGVYAGSSLLYSCAVCACTARVSLRHVVVLVPRSESVACVVWCSLWCSCFARLGGSSRSARCCALLDSLCGLRVVWSSLRCVCRFSQPLLSRLRAVLCCGCVVMSGVLCVLWVLSTLAARCHYLPTSLLRHTSLCSLAPCPRPSVRAWGVIVRVSASVIVRDIALPALRRSARAHWCLYCCAERAAAPAPSPSRVCVCVCVCDIRTSIHFACVFLMCVCRGRDRFTTVAVCLCRVLCVGAPRHLSLVALSPGVLAHRTSSVSTCICVCVVWSR

SEQ ID NO: 974817 - protein, 377 aa, Homo sapiens
LLPFDTDTLVESQPREDKNSEQCVSACLLSELCRSSLLYTLFFEDTEGCVHSPPLLWGYLFLPPHMRLPPPFDWSSRSFVPYSFAPSLPLMISSWCLLLFSSSMGRRNPLVLCGGTSNGQPLFCGVPHFICCCGLLFCAPACWWCVIAYILVFWGHRCVPTGEDVAPCVATGRHSIVCPGGAFLQGPHVAALEVVSLQVPFGKPPTCGGPITVVSPMAPFVPFFFEPQGFWECLLSRGLGPQWNNMGPQYVRILLARENRMCPLFGRAPSKANITPVVIQRGWFTESIFPPGAFWVCSPGPICVKCGGRNLPKMLASNILPQKALVAPLVGSLSPQSNRDEASLSLLVARPTHCESPPSGGIYSLSFSALGGYPRAL

SEQ ID NO: 974818 - protein, 401 aa, Homo sapiens
LPLNFVLTLILLFSHDCGCPPASHQIVYPVEISLHFSENAFFGSPVWLTHPHGCNTRGMCAVFLLRSPPIVWGGPPTLLQRGCPISKSCRPLLDCGPTPRRGQYVREFPPRVPQGELLLEPLFYPWVGNLWGFHTCNKLRFLLKGLLVRGQLRFSQAEFVAPKLLKEGRGKGPLWRFSCNAGVPPPTICFLYPETTHFGAGEYTPRTDTRVPKDSHTGSHTREKHPLECPPGRGCSVISPLGVSLSDLDRIRLTPLQCKNLFSPNHRVHWIHGSHQTCIHTEKALFQAANKTTPAVFRNTRPTLEHAHLFHKALSDGRDTQDTSPGCVHFHLHHWKTQYGVCAPGIVNTHSTHLHQERTPHTLHATAPPEFYGTSATTFSIHGMPPPVGSPRPPSPDFGPS

SEQ ID NO: 974819 - protein, 115 aa, Homo sapiens
RAIWPALSYRVPSPSPLSPGQAPLDTRAHWPSLCGPSFPPVLPPRKGAHKTTTLNAQKGDCKKNVDPRKELHPLALKLPRIAEIARLMEDIGPGTRTREVNIPRSMSTLPGGPWL

SEQ ID NO: 974820 - protein, 230 aa, Homo sapiens
VWLVCWLVLVGVFGSTHGCWLRVSVFVWRCVLCSGGVSVGVLLVGVCGTLLVVVVAPCCVVSSCPRLVCSPRGRVMLGGCLLLVLVVVVNIRDGGCQRGSLPSRCVWLLVCCFLKGWGNCVVYAPLGWVSFSVDVSYCWAVSVVGMHRVAFGARPLVDKVFKGCFSPSPPGGAFVFVFGSSFPWEGVPAPEMVVCSSKSCAVISVCCQRGVVDCPAPGVCVIQYGEVVLH

SEQ ID NO: 974821 - protein, 375 aa, Homo sapiens
AFFFIVVARVDFASLLALGLCVGCGAAGCVLLSPVSAAGCLLSSVWLVGWARLVRTARLCAPAGCLGLLSCGVCFIRSGGLSLFWGVVVVVVGVRFALSSARVPPVFLLTSRVGRTIRDFSTLVALRVLAACNLRPIFRPFPALGPARPRFLGSSCRRTPTLGSQIRPEVVPRRGAHRHTPGPIGTCRPPTPYLSLASISTPMIGLLEGLSHFFPELAEEKPEGYERFLKMPNPRGGRAFLPRTIPESPRLKDMKLGVKTPQDTPIMKSFALWPLEKKLETQALFGFSMPWVLPAPEPPLLCELPGELTFLDEEVKAYQKMGDPPWATPSPRLGGPEAGLGEYSSFEKAHTSHKHRAKEPLLKPTANFLKGPLAK

SEQ ID NO: 974822 - protein, 202 aa, Homo sapiens
METNVSTLCLSSLSISPWGEFSLPGDKIRWGPPVISLLCVPPRAPDQNLGERLYETSPLKAVSTGGKSPYECPRGYMEARPMKGPGHFQQEGLMGPDFEGPKQGSPFIWGTLGNSPPHSSYYFAPPPKSPSPGTWEPPAGPPRWMPRGRNLSRALFACHHIWCASAARPWKEATPRVTHTRVYESPLATSDTCSHTHTTQGD

SEQ ID NO: 974823 - protein, 134 aa, Homo sapiens
SLLHRWDDTISGFFSRLSAALRVLARGDLPGPFFGHFLLFGTCPPPVFVGYSVSVPTHAWVPPGSPQRLCPGDLGRPPGLPPWVQVGDTAGPLYKPTSLWLLFCPPLMWLWKGLSPLVPPNWPRKSPEGYRASS

SEQ ID NO: 974824 - protein, 117 aa, Homo sapiens
MVSTPFVFVCLPPRPSFMWEHLLGDNGVFSTREQSCCGGVLFSLAVCLSAPSSGVLCAALPRGGSPPCRALFFLTRPGVLSSGARPLVREGQPRGSLTCCVYWEVGGFFLSQSSVGG

SEQ ID NO: 974825 - protein, 317 aa, Homo sapiens
LVDRPCPVRVVIPGPRKGPRSCFPRARVTPRKALLPLSPPGCFSCSGTVTSKGHLSRTSIPGPGSWAPLAQVVFPGSLSCFRTGLDWFIGPRRAFTRAPFGVLRPERPQLQPLAKVLPRGPPKPERSPIVCCPGERKTWRTLGQTLAPGHTREHYGPPCYLAPPTLWGPQKDPVVETLPSRLPQERCILLQPHQRLVVWLWLAWRLARIAPNPFLKAGPGALPTKYIKAQEELPGPEYRGVAHESLWSHPFWEVANPPSHNLAKPLPPIPPEMPPAGPPKWVFLAAPPTGRLRGTQTVPGERELVLRALPLRFVFMP

SEQ ID NO: 974826 - protein, 130 aa, Homo sapiens
MLYHRSRGNTSCRKLTFWLWGSSFANRHPPLFWGSTTSLYLPLSRGEAKRATRKISRKVCKLRLYHICWCVLPSVPPSVRFVHSLGLWRDTHCALTETLFVATPHSASVSLFTYCLSPTLVHTCEGISAA

SEQ ID NO: 974827 - protein, 324 aa, Homo sapiens
PGPLPWEGWALAPATGYPHISVAHIGRKRPHGGPPPVACPQMRRPISTHARGHNNLWVNTHVVRQGACAPQMGGGHKKKRRSWGVIKTETRGWAPVSRVRPYGRVATQQQVGATKDRFTLSLKKCGWGDGPTPERPSFEGRPGGHSHVLPCEFIESRYMFSGGRAPAPLGDTPLYRHSPHSNSTGLSLFGEGFHSVRKGLVLRPSVPWRLEHVVGKFRCCWKATHNTSHHARREVFDTGLLKNPHLGHGLKGSPHPGPQEPLKKAHMDTSCCFVNEGGTHSAGTEWHMETALGNCAGCLLKETLLDCFFWLSRQIRPNKHFSEL

SEQ ID NO: 974828 - protein, 291 aa, Homo sapiens
YSLCWCGILCCPPLVCGCPLARWVTCVAVCAVVFCALFWLTLLALLHSCFWHQTGGAPRALVFLEVRPSFFGGAASSLPRIGHPRFVGNTSADLVGFLLVFYGVFFAVVPYVFFWGSLGLFDFSAFWGTFSVSLSLLDPCLFVVSMHRVALLFVPTFIPRGVPQLRAQCAKGIPFGVSPVFVNGGFEEADLCPLIGMPLPKGLFLFRPMELPPVCLVGLGGPTCVSQALFFSSSPFEYPPLALGGPMRHNPVWAPRDFLRSTPLAHSLWRNAALGTPKVFPPENWEDMFFS

SEQ ID NO: 974829 - protein, 117 aa, Homo sapiens
MGRPPLVVQRFLRSPSCRKKGLNVASQFFNVCLTPYFWPAVYIRRSFGGVLDKGFQTGGRWVPLEMWATTNNLDILDFACGAEKRGKFVLMTVFCGGDLLSGPFLVSQPNDTDGGTV

SEQ ID NO: 974830 - protein, 124 aa, Homo sapiens
MPLCCPLREARICIKWCRHRYPLTPSVWRPLWVNTPTDLFSLSLCRLILWGHTSAHFLALATLTHTQGRVSHTPQCGCLDNVWCEISLVSAEIFFWRTMARETHHMCSPRETHTLTCERGTHAS

SEQ ID NO: 974831 - protein, 286 aa, Homo sapiens
MDCVSMPFFVGGVLLSCSGPCFGVPSRAHALLLSLSGVSVVPVVVSWPRVLPSYRLWFPPPVFLSGSGCGPTVRGLHLCFCVGYPISSGLFVGELVHMGGSAFGVPPPLRTPEVCFGPARCSPLIGGLLQTLLVAPRWSQCERDSAHLIIIVFGGMPPSILGGSPVCFCVSAHLGPPQARVLFFVPASPLFSCGRQCRHCRFSSRHGVSLYSPPISRPRGDTFFVTRTPSLCEREHTLEAHRTHRCYTLTHSVREISLCGDIRSLRPYSPERESHTVRHTRVSHTL

SEQ ID NO: 974832 - protein, 367 aa, Homo sapiens
LFLSSLIVCWCSAKMLIHYSPCCVGFVTQDTTIQESFYGGGPTPQCDRSPSLRSGGRPRHLQCGWWTTQQNIAPYGPLFVLITLASCGLAACISLIFILRGGPLLKKGVITSAAGPLILGVLGVHNIFSWVISPRGGFVLLLAGVAAPLGWVFFWLRGGLFVSNYFLLVPRAGGVKYYVRGDYTQGFFLTGRKLFIKYVCVFSSHPVGRPHHASRRAREEENFSSREREEKKGEEISRPPTRENYRRPPTGGITLGDQRDVGERHTPLYIADKKIGEKKSEKESPPPPFCGEERESVKGRPPQAPPSQRGYTATGGAQQRRLVLAHFAARAVDMCSREEGAHIIRPPQRERRESFYTVVDGEERVGV

SEQ ID NO: 974833 - protein, 175 aa, Homo sapiens
MRVNPHYYTLLNVKHWGIAFCTYHVLGAPRCAQVPRCVRKLHFHWEVISPLPKCLFLEKGETPIKLKEDIPRGYKAVYRKKVFCSFNTQTPLATPRNSCYIGEMNPWVQYVKKNCWEERLLSALFYSCPHSGKPLWKEPPPTKRKSVLWNMNAKGATPAVFSPRPPQRCCTPQHR

SEQ ID NO: 974834 - protein, 120 aa, Homo sapiens
VFVRLPPWFLSSCLGGSVLSSRVVYLCCSAVCVPFLAGRTIARRRCSHCWGRLPSCNQVALCYPSGVFPRWGVLSAEKVPPVGSPGFTLGGKTLVHRKVVVNDVTCRTGSNSYMGIFWGG

SEQ ID NO: 974835 - protein, 142 aa, Homo sapiens
MWRPQRELNPSYFTTGILAQHSLLISTQRPQLWRSLSLARLYMERSISLDTHRELLSHTLLSGCGSFGGPTLIRCEKWRPHRETFVYTCLEKGVCCVCVWRHHTESRVACHHLSPTHVLWLGGTERNARGFSEKRFEPLKFT

SEQ ID NO: 974836 - protein, 40 aa, Homo sapiens
MGYPEKVSPTVELGKKYSHLDKPYCVLHGKGPENHCPLSH

SEQ ID NO: 974837 - protein, 478 aa, Homo sapiens
FYIHPPLSRLVVYIVAVRFVVVRGGCYSWGSLFSRHARLVLTHYGVGFVVFLPRPLTVGWLVYTPAACLSAHMLCLLAAFFTYYLYGSLLVPNYLSLLSRLLAASRLWFCLLRGNHPHRGCVWSRPPSLSLSPLRWFLLPPQSCPTRFWCPPSVWMQPVSAALSVALVPPKCHSDRVSQVVTPPLDEWYVFSLLYTVVSSSVVHQTRPFPLSLSVVVHVLALITPLAICLFSPTTNNVRFVCSHLRRRAILIGPPAGGGTHLFTIPYRGSISPPHLEVLPSPLGGKTVVFVCLGEPPSFVVEHTLLHAVMSVTPCVGPPLLLLRLVGQHTLFIYVRDHRASSLSRRALYLAPPTYVPFFLRGTLRWLTPHDCFPQNAHLSGPARLHLFLHQKYFSHARARLLFTCHSPHCVSSLSPRPLFFCVVLSVSILESVLSAHSDLFFFSPCTLCASHTRREMRRSRERSRDYTSIQRESERST

SEQ ID NO: 974838 - protein, 194 aa, Homo sapiens
SPPPVEGLFLGPHRFREAQWPSPKGHTVAKSCPRSFLDRLRKTSGPSFGRHCQTARQWSSIKSEPGGPLEMIVPAATAHQSPRLLGRPILAFLGKGGDLSGVRTIPCPLVKGWWYNVGPQSLMLSAHSPLLPRPSVAYYHEKMWNEASQKGDHKTLLTPRMTGDPAGQLSPRRCEVPKVWRVLVPALATQKSYR

SEQ ID NO: 974839 - protein, 247 aa, Homo sapiens
MGHLPPNQAVASRRAFYNFGPPTKEGPGTPRSTLYALVERIPKKNMFWPPGARKNRKSVLGAKKRGTVPPNLRENPQRGAHFENQRRLTHTVRTTPLGGENTKRKTSHTLWWVDCHTPHIGRLPSETCGWSIFVPCPLCVLVKIVGVSLTCHYTRGKSQEHGDTFRVSTRKNTWPPTLFRPVQHTECNIRKNTKSAFLAEDWWKTIQDPITNRPDTDEIPPSTGVAKVLGPKICGVCICPSSEKAKG

SEQ ID NO: 974840 - protein, 183 aa, Homo sapiens
MCPPLFSAGTLIPRCFLFGGDHTSGLKQLCINGEYLLTTTSLLWGRSFLSPFGVIILSLGESPPPRCLSTLVHTSGTAGLLAKRGFFSASAHHPTGGCCPPHNLLAGPLLSSPRGGGPHDGFGCYHTAPRVDSSLHSSRSRTHTCPRFSRGSHRATGHTSRGVCPRETSGGNSHKKASHRVAR

SEQ ID NO: 974841 - protein, 177 aa, Homo sapiens
SILFWGGAKAVVYTPMWRRQTHNKQRCCVTHSNQRWEGLLINKQHRVFIKSSPFWWCAPKEGARVCATIASRSAAGWGCAHYNTPATVLAPTARQRGSPGGALVLFGGRRKWVKACWWVGRKKYLRPTSGVEIRFVKKACFGKGGSSPLLRLEKRGPNPRPPGVKRRKRGVFYPGEM

SEQ ID NO: 974842 - protein, 141 aa, Homo sapiens
MGKNFFGRGPKSPNTPLRPLGKVPGSTPLIEGEKPVTHRAGGSSPALLIGETPKGSDKWKIVHRLRTPGTFALNFVPPTLPSDRGKEHKDAPHGANRPLLGGRTISLCHKHPTMFLVEDLKGMVKGFRRGVSTSHIEKTTQ

SEQ ID NO: 974843 - protein, 119 aa, Homo sapiens
FPLYFLSVVCLQGVTQSLGVFDRVSLWRPGGAARWCLPSAGLGGHPLWHHSQHWFPRGCSIMSCSRVAPPVKVCARWEPFFLLGGTNISGPFLKFVTEKCWFLFTENIFFSLRQTVVVG

SEQ ID NO: 974844 - protein, 358 aa, Homo sapiens
RPSMLCVVSPHSVVFSSAGVTRPYFFVRRNWGVHLSGPPPACLYPLRRERVILNTEGWSLKAVCLLREEMTPLRGGRLPPALVFAARSPPKGWSAPAFSSLPQSEVGCSAELPALCGDWYFFIWVPYAFIMCHHIIPAVVPHGRKKMGLFGSLPLLCPKVRGHCAPVFAGNNTPGLFVKRSPRPTAPWGRLGPPGVVPALLCSPQSAPQCPEDAPPEHTLVILHAWPFRGKERGLGTHRRKKVFLKGEPHAHGGPRAQGDNTHMAVEREYGHPSVSPPPRAETFPALFEKKPPTRDNLTEMLSRASTPREGPHGGTTLEENRALTESGERATRKKFSVSLESASVGTQSSPRGTPRHA

SEQ ID NO: 974845 - protein, 277 aa, Homo sapiens
MSPPGLWRVLAPRTPRFLARREGDFCSLARAWERRVVSLPPECNRPGWPMCPPNTPQYDPPWCVSILGSPPDREGRPPPWDWEEFPRGCNPGRGQPCGPRRKSFGTWGPPPVRKAFVGPPKVNTRWEPTIGVWRTRNVRIVVGQVPHLGGCTPKGPKRRYPKKGVLTPGAGLGATRPAERELLAPPRAMSSSLRRGAVRAQHGGALCEFWGALGHCPRVSGVKGLWSVCVWRTPPVSGRTEKRAYTTVTLRTLGESVTRTQRRFCYKKEFVGHTRGL

SEQ ID NO: 974846 - protein, 115 aa, Homo sapiens
MAPPNGWWHARKRRGFVYDRPPVPLCLYGPGLLNIGVSPRAPLGGGGNILANAKGGAPPFLPVGGVPRGFCGLARECFSRGLLLVVVNELYVARRCGLGCVHAVEKCAATVYMGW

SEQ ID NO: 974847 - protein, 166 aa, Homo sapiens
LARRPMAFLGPVAQPFPTSSRLRPAPALALGAHLDSHLGDPLALPLDPRGPGPRVGWTHQPRPLTRHVVPNASGPPPPLRNPPELGTLAMPCNSVTPRAEPEFLDVMDPLSVSPRPHPFSFSLVALTPSASGSPLCLLSTRPHGTQTPWDNLAPWDLCCTFPVGGM

SEQ ID NO: 974848 - protein, 140 aa, Homo sapiens
MLQAVVTHVGVCGLPPHMCWRRRHTERCVSVWPQSKRDVIEISELCATWGDTPHSGIESSVPFKSSPCPVPTVRPLVEHPKILEFLPHTTPYFQAHTKRWETQNPLPIAPQTPSPPSITAVFPWPLYFGILVILLSYKTL

SEQ ID NO: 974849 - protein, 109 aa, Homo sapiens
DRALYQSEGRAIARPDPTGLSGAPPSTGLLTGSKGDLPLAPGPWEIESFPPPERKYSVWIRCSIHDLTGNRPTGYGIYHRSYDESGPSIVPRQMLFNGLSQMRSISCMG

SEQ ID NO: 974850 - protein, 76 aa, Homo sapiens
GPPEGCQKKQAFLLTSRPPFDDGGSLRISEAPLVADILRPPGAHLLKEVLKEKKDRQREGFPLPCAPTETPFCRNQ

SEQ ID NO: 974851 - protein, 170 aa, Homo sapiens
LLLDVLLVSRLYCFVSPTTNAVEGCCHYKGGHSTYRVLGVFTGGPWGQQNIISLVVYSSVSRFVSSWLVCSLPPPHLVSSLSVCDNPLVATTGAAPPRRCFSPPSPGGVYAKGPWRVLVSRSLAGVAPLPVGGVCLYRPLLFQGVVYQLAGAPMVVVGRAGAWLVSAPGV

SEQ ID NO: 974852 - protein, 385 aa, Homo sapiens
LVRAGSTLRGGHSCGGLPCWGGSRQSGPGLSVRRQCRWCWCEPLWLLCLGGRRSQLARRSWYLAVCVRAPVVVVRARTRVCWLAARERRGVGRLLGGVVEVGGPPLKNVFEHAVATEEVLPDETHNTLRGGPRLESPLWSIFPPIVCTPVCGGPPNKIMWAPRLGQISFCRWEGKNNPPFLRPWCDRKAVFFCGLTPTGRVCSSPRRHRAGLRAFWLEETAQARNTPQGNWGCKKNVVGGRPCGPPFRRYEKNTDGGVVGGGRLRVGVSPPLVGGEDPCGVVFPPRREIGGPRCGRGAATCGGDATRSRVEPPRALRALPRVFCGEFGVPPPTGGFIKESCGHVQQTMTHAPRPTLVWGAPCVWGEHLWPHTGTHRRRPVCGHMS

SEQ ID NO: 974853 - protein, 412 aa, Homo sapiens
ASMHNKCVDRVCLAINTRRVAKVVRRARTMCPSGAIVVLVERPGMFSPRTQCVFVCRGPPHRVDPVVEIGCRQWMLELAPEMETRRWCSHGRAAFGAPLRKAVPLVEQLLAAGVRKPCCCAATWRSSGVFAATQRGAPRKGAFCSLTKRGKGGGGDKFVGCSSVVEAGKAPAELGAATSLMGGLNRQGCFYPQISNDLNKSRFGCVVVSHFGWTPRCGRWWRPPPPPEGPRRVSACVADGPRPPWVGGPSSPRAPVVCALLNVLLNSPTLYWGASTTPQTAPFGCKGGDLLGTFFLGGARRVMNTAGGHTTSVFIELLGETTPPRGEKESGGLLTTRACHALVIDTLGPAAWGGVATPPVAPSLIGCGDDTAPCTQERHAGGRVAAHTKKSVRPRHTRRSPQRGVKIKRQSK

SEQ ID NO: 974854 - protein, 181 aa, Homo sapiens
MCRCGQQMGECLAHHGLWGGFFHTMWPRNRELRCVRRGRAFVFGRTSAPVGFCAGAHNSSHTQGWLCAPPLPRGREVDTCVCTARAFTQTVALSHTHAPRVFVRGGSHNPPVTPPRGGPLWGGLSLSPHTQCAVPAEEATSPLLTRDMRWGAHTLSRCGILKNPSLYMGVSPTHCGDISPV

SEQ ID NO: 974855 - protein, 142 aa, Homo sapiens
MPGGDSDVLWVSGQRVWDNVRPGGFCPCRGGSVRRPPGLGIIAGEPTAAASHGVCNRDPARGLFNGDLPWRCHLPEGGDTTAHRTGGPIGLWDCFHPRTVRDPCLDSGATQGEDYVPGGGPTGVPALETPFPPEPLETARPY

SEQ ID NO: 974856 - protein, 390 aa, Homo sapiens
MVPRARRSGACCSRAVLACEGCADSAGCEYARGRVLAALVLGWAQGALGRCFRVDPCGDDLGERAVDVGGGCVALTTKVLSEHDAIGLGVVLRGRGVLCRGFRCGGGGVSWWRRWVYGDVVGRAVLLPGASLCQRGVCGRWWSPHTVGGAVARGALLCVVSCGVTLGGEEARVVVSPPLGFGVEKYGCNTPAVGCVLHAHMRVSAPFECGIPRQRGCKKERYAGVRTLACVVVACGGRECAWSTRRRGALAGDRRGFDPQRRAEVRGGAGPLGQMTTGPTEEEGAPLQRGRRGAPTAGSPWSAKEERIGGSQRGPHRASAQWRPTAWWDNRHDTACDRSCARERARGTAHDARALWDAGGNTRGVHMGRCVTVFVGTRRSCVSQDSRVCL

SEQ ID NO: 974857 - protein, 151 aa, Homo sapiens
MRPQRAITLRPAPTWAFWFFRGFALAFYTSALTFLPPTRIEGYHLPGRNKIHGPHFKHPAWYMFEPFLALGLVCPRPWPQRSNTWETLTLPQCIGAGEPAPRTLCAAPNHVKVLPPSHCCCSTLKEERKVERQRKEESEESDDDLGFGLFD

SEQ ID NO: 974858 - protein, 320 aa, Homo sapiens
MAFVWSPALLSFGGRPLLVGGGGITAMLGVAPLYSEGGGGARFPPRGGLGRPPSSGENGAFGCGVEDMFGYSEGGTLSLLSRRRGCLRLHVDRFAARCVLPLRRGGALTWSTNKVRVVVVATTSAGCYYKAGHYRIRLDCRAHKDGVGGWGRGRAHRKRFRLCGCTKLCWGKGVLCPPAGASLKAWCLRSWVCEDSVLTTRWAAASLCSSPPPLHQLVWGPPHLVGGVSYSGATGVGAFSRGEPLPLVGREVWTPPPALSLRAPQRIVGAHRMVLGRAPHEVFFLPPLEWGPPFWKEVERCLCRDRLPNRGLPTICGDRL

SEQ ID NO: 974859 - protein, 186 aa, Homo sapiens
MYYLFPHRRTSLACGEKTLSIVVFLGFGKEKLRISPAVLNTYNGRVAHKTVAKGYFENRIIMGPHTTRVVWCPPLADCRSHKRSVVATTPRCGRPPLQGRHTLENNPNQEVDGEEKRGGDHHHSCCRGRQHLRRGEEVVFVDATPWVAPTPPPVAHLLCGGVAPHHLLWRPTQGAPCGHTHKGGRP

SEQ ID NO: 974860 - protein, 270 aa, Homo sapiens
HRPYNLRHQEGHRGDKGVLSTRMGIFVGGVVNSCVVVVRTGSSRHCFPHAWGITRAAIYAASQHHKHPVPPLGVSRVIFPPLLLQGGPAAPLRCVDNTRVTTVVLRLIFCPRLCSAPSECVGAPTLSCFVLVVRFTPAPARHMGLQHRRDLPPTLGKRPQERLDSPSQVPTAVFAEPTLGAHPQGVGSPPFFDDIDVIPNMLAWVWVVHNPGVSTHVRWGALEGQENPLWIPEGTRFPVGAEIHNPLPTSHPLGRIRRETSCLSTKLVEE

SEQ ID NO: 974861 - protein, 126 aa, Homo sapiens
MCVPSEEKAFGRLLSDKYHAHLGEVLCSKETSSVLCSRVVLWGPPLVCSIGESVKHSVWPPLWSECRHPGCSRGAARVCVSLRESCLSIREGFGPHRDTHLCVCVLSFLGGVSAHGVCGESVPHTR

SEQ ID NO: 974862 - protein, 176 aa, Homo sapiens
MILCMCGSGEKARCPPKRQKHLVRVCESEARDCDLFGPRAGVVCHSTHLRRPTEGVRTVCTATPCVCALVTLSPCPTRPTAPSGTLWSRRDTPRGPHREPPSSRLSFGGSPLGALSPRCGSDNPTGFSPPSPRRPLGVNLPRAPLAATPSPVPPPLHFCTLLGVLGFLFFVNVQFV

SEQ ID NO: 974863 - protein, 132 aa, Homo sapiens
VGWPESPSRVVDGRPPGGRFQTAGPTVVGAVPGGGPKWARFPPGYCSGRPSVPGVHAPTRRFSGGLVSRASPGPVRAPGCTCAPGRVLRQLVCSSALVGGRPAPLRTTDQETMLAFRGVPFYTVAHTGIEAQ

SEQ ID NO: 974864 - protein, 67 aa, Homo sapiens
YSMGKIFQSASFKGLNIATGGPHHCVGLRSWPPPPPHKHCLGRVSLVYSVGEETLSRRFTAPEKQFN

SEQ ID NO: 974865 - protein, 126 aa, Homo sapiens
MRYNPPVEPHFVKGGDAPPLRPPGAMCPPHWSPGEGFWSPFSASLVFGQVLKGLTLGVSLALCGGLSKVHVCHPGERPENGVNPSPLVEMWTKHWCFLAREAPPGDFSGASYRFGITMPEISDNGV

SEQ ID NO: 974866 - protein, 372 aa, Homo sapiens
LLSLRGMSIDSPRIYFFICSSCIAYLICYPALLLFLPPFFGVVGLARPPPPLISVRPDIPPCWVSHTNIISCAPQRGVGAAAAPPEGDVFCRHLPLPRGVSFFEGVGGRPPARHLLFRITLLRSPPSGMVVCSRPPLLGGGPPFFLFCFILAPLVLAFLVTPACVVLSHTHLVGAHNHDGGLLVVLGHLDSRRCLWEGPPVPADMCLMIAVGGASSFWKEEGSTSLLCAPAHAARCTTLLVVGSHPPAPRGASFLPTWSQRHAERGGGGHTHKLALSVRRILRRWKKWMNSPPRPTEGFLPTTRRGGLSPAPRKILLSSSLHAEIFLPAEIHLTQPSVLILKHLARESSRRRACRYAHTSGESVAAPHTHIV

SEQ ID NO: 974867 - protein, 187 aa, Homo sapiens
MGIFGSSGPGPLPAAQRFLCAGPGGNLVCQTLSLNWFPGPDPVLSHLPERPSAQPAPRGPEAPKGELSRSGVQNPGWTHCPPSNLPQRGISLHMPHTRGRLEEWDQRFASQPGPQNPAPCVFRPLGTRPRFIKGLDPGLLGMCEGEKRQLVIPLRAKGMENAGAPPKIPGGANLVFEVETAPNRATN

SEQ ID NO: 974868 - protein, 408 aa, Homo sapiens
FCGDLFTHAVLRVVITNGDGVVCFALAASFTWGLCVYLPTAVFYGGSPPFLGQKRGFFPRFFTGLPGLQTDFSGVEAQGLAVTPFLRFIVLPTEPPSGLPNKGGSPFVRLGGAPPPKEVIEKYVIKGAPSGEGEIIMSPLIISVAALKLGAPREKDMYHIENALCFVVVSDTGVFFSSGECALSFFCPNMFRKEVFPFSGIPRRGPPGCLVHLLSPRLLPDPPRWRKIGVFLCPAPFLGLIKLEALLPRRKLTWKLYITFYLSGPTAPLDRVSHALHSALRALGRPPQRLRTPQHTGPRFPFFTRTDLCPTHTSGFPTLWTGLPRSETLSVCHKSRNTQKVVSLVGTLSTTTFHRRGTALSWFSGDPQLGVTPLSGFPVYPTGTCDHRRNTEVTPGGHLSFPGHTEKW

SEQ ID NO: 974869 - protein, 213 aa, Homo sapiens
DRFPSLGLTRMKFNHGHFKLLFLGPMLKVGPNEFYSWSTPAIPPAGLFLRDIRASDTRGPLFITPPARRIHPGPPRKGRMTDVFSSTSFGHGPHLEESFERVLPPRVGSSFPHERLNDYSCLGRRWAHIAFWVAPPTREHGGILAGWPFYRMLPSYCKVPGDSSLPPGVGPNAHPHAFSTIAIAILKCLHSTSQGLHQPLAPIVAPRNVNFKD

SEQ ID NO: 974870 - protein, 131 aa, Homo sapiens
MPQRVRPPYVSHGPHRANCGTQAHCVPPRCGPFALTLGHFVGTRRVISAPPEAPRPTTLRGAPLLSWARPRPMSVWKSLCLGAALPLCGTGLFSLGYLSLGYTRDSEPLCALWHPVISQSPGALRTLTYNV

SEQ ID NO: 974871 - protein, 163 aa, Homo sapiens
VYFFQGETILGVPSSSTKPIHEGSEGSSLSSVFEHTWPMMQRDKLGGHLSRLFFLGPEPSAWYPDSPQFITRDWHGVPRANGRNHWLAGIYISGMAPRPSLATEIQGFGILQPRSMAYPVYQRWPPRRWPHTTYSRRPFPRHMWLSLFLHVTEDAHLGGPHTY

SEQ ID NO: 974872 - protein, 148 aa, Homo sapiens
MRLLGLLALCLGEKPHGGWRPGCVAWPSLGSPMVRSRPSPWGPGVAPLQGSWVGVRACFASAMQPQGVTGEESFSCAAGGQVSPPRVCSSGALLCARRDTVWAALGGPLVLPLPAVGLVVHALVPGFPFVVTALVDYASFGLDFGGRR

SEQ ID NO: 974873 - protein, 96 aa, Homo sapiens
ATPWVNLPPWIVALDPVSSSWHGLLSRRVSGACSRKGRLRLPEVQVRRTCASAQPKWQRRPGTRRVRSGCPQDRYVSPSCPLRGLLQPGFVPLADR

SEQ ID NO: 974874 - protein, 253 aa, Homo sapiens
CLCVLPPLLCAPPRPPRFFGGPPPCGISRGEVSPPWVPPPWAAPCGVSPPGAPLWFFPRVFLSGFAHAPLGGPTFWGPPIVGGTRPPLGCTFPPLRGGGSLARSSSCWGVSPSAENRCVFLPSGSRVFLSCVSSPVVSRASSRAPHLWGVYSPRSFFLARIAPPLSPRFSLGPHDSCGHVVRPLAPPYTRALIVPTLCVISSCPPPLLGGSPLCALSRETLFFALLPPRALPLFPTLSLLPREQTLGGRARRI

SEQ ID NO: 974875 - protein, 109 aa, Homo sapiens
PVMPSGILMSPHELVRFQSIQRSSPRDENGETSVIVNPLWKNCWIRGLATQTLLGMVPGCAPTMTCDLSFASSPWQLPQSSPCPESGHLTTRGGALLTEGAEEKWQQLT

SEQ ID NO: 974876 - protein, 134 aa, Homo sapiens
RTKREKILAQLQCEPVQTLTRRYVKTTGQSHGYLSGPHPRCLAQGTTSGQAATHGLPILRLPPAAPQGYSWTGTSRRLPWSTWSLSRAPAPGVLPRANPAALGPTHLLDNPVPPEPTLPPGPYGAPAGPPDCAL

SEQ ID NO: 974877 - protein, 108 aa, Homo sapiens
MTHNMLLRLPMVHKGSNFHGDITRTPPHTTLWLLLFFLMVAYKYKRPTASCTVMPLVGNLGTFILGSQILLKNGGLFHWCFVIVSKARFYLIDPMPCVARFFLGKSIF

SEQ ID NO: 974878 - protein, 144 aa, Homo sapiens
MSLSYVFASSRRREHDTLASRALVMEEQSAGVAQLTLAREREIVERTTRRLGRSLVRTHARRESETHTHTDVVVVCVCEKYVFGSVSLTSTPAEGTNDHICIYTIRNTHKTDYDSPHHTHAREREILSSSYVHTHKQIQTHLTA

SEQ ID NO: 974879 - protein, 306 aa, Homo sapiens
MGAHQEDRGCVNPSPPLYLIPRALKVYTEILCVGPQYSRTTQRCCHCPNVFPRERGENSVRLRGVNFFIKNRCGSVKKGKVVSLTFREKLWVSVKREGHNLSGELLREYVRKVYHTPAIPAVIHARFRCIITFSAPPREGPPHSESEVFSYCVKNKGLPAREFLSRGKPRERRPLVEGFPTQKRRVFWAFFSPTRGRTHCYRGAFYYALEKYRVGPPPKERVSRVVPTLWGPTAHEEVSLWARLAHNSPMRRGLLSCCAKGLVLYGDAPGFTPHRKKWGPTRLVARFWFFSGKNSRKDHTRVYKSH

SEQ ID NO: 974880 - protein, 337 aa, Homo sapiens
MRFVGRLLCPPAGRFLPCVPPGAPHEVVLTGSLFLSGPSVPRRVAPGVPLGEPTIGGPMALPLAQEPVLVIPGFWMFPPPGGHMGNWAPVCPYPTEDAGPSLGRPPPAEHGRGYTKGCYTKLFSPGRLFWGVVPPVTLCLYMGEDNRQQMVGGPHIVSRMPRLGPPCGPLSPRFTEWGFLSPWRGPPTLRAPLVVRIYCSFFRLWSSRALLQEKYFAAYCGFLLRMSHWTQHTSRTATYSRILFHSEKSDTTSPTSGPAESVLAGCARTQRVTIHPNLSLYLIAGTPTPHCHGHLGPKRLEPQSEALSVTSGELISFEKENVLTPTVEGGVPRPPFV

SEQ ID NO: 974881 - protein, 423 aa, Homo sapiens
MIYVYVLTCPISLCAVSCAGLWDLFFLYVMRPAGPGYPPVRVPLSAGVPRWWLSPIFLCGATKPIGGPTTPDAPPRCRDVSFSREAFVFIWHKDTLMCTGIFRGTLGTPLPLWKNLSVMYISRGNFGLLGLHPTEGLPWGLTGTIVACATYSGPRLCARGLGPLAPPWWKSPVGPAPRNTVVLRALAGRASPLCPERLLGLFTPRESVCPGHNPSGKSLSGIVAAYSQTRRHKVGSPAKIHPCLRHMLKQFRPFCPFGTGPHTPHRLFRPNGSSTFITPPEKCLEIFHPERKHFCTIFRFPRRGLSRHMCATLSRSAQNWLTHTLLHSTYPHFLITHTRVPQHESPGPLFCGETGVITLPTLLKKVRPFWLSPLCLCGCCPRGCCHPPQLRSCVRACTAPRYRLKPRKSREESDEDMGFGLFD

SEQ ID NO: 974882 - protein, 110 aa, Homo sapiens
MLVGPLEVLDHTERKMRSSTKSTKFFAEKTRSLAFSLLHVDISLPHKGNPRARLILCVQTGRSHTPPRVENQIALDSCQYLPLAKNCPALFIGLARPRSELFLRACFSFI

SEQ ID NO: 974883 - protein, 281 aa, Homo sapiens
MTTLLSPVVFFLSAGISLFSESVVLPKVFFSPASSTLTTVVWWCCTPHDSSLSFYPVMAPHRVFVSWVWARYLFSCSNTIASLLSQYLVVCGVEAVLLILCIRVSLFFSPFQSDATGAGRPHSLCVVGRTLTSLLPPTHTEEVLCVAAPMIVVPRLLSTPLLFFVVLVTAETNVFVSVLVVDPYIRRGAPSFLCFVFNCSSNTCSFLLFILRWLVGCFVLVLTPSSLVVRKLVRAERRCFFFLFVDDTLRFRRCVVDYKLVYEMVGGAPHQPVVVLSSRGC

SEQ ID NO: 974884 - protein, 154 aa, Homo sapiens
SALLLIVLFRPSSCFVVLLLVSIFCLVSLVFFVCLLFAHTWGAPFCHPKTRVVKAAPGLHREVTYSRPLGATDILTTDQRLCEEIRPLSPAKSSRHQDEPGYVTHLMNRIQRGPHKRYLPIQLPEEEKRKESTHYGPRGSQPWITEIIEVDPRP

SEQ ID NO: 974885 - protein, 208 aa, Homo sapiens
QGPSSKYPLWEIPREYACLQQVDGVLSPLAWCNNRISAVVEHPLSFVVSGVVSLLRLLMERKGCSPPHTTHNWCSRSVCGLLLMRVHCGRTTGSSLDPPGALSAHTDYDSHFVARLGARPQGVAHTTSRSHDLFPLVALPLFSHTTRPQSAERVSHIETPRERRPSSHSHCVSLSLSCGTLTQKPAMRGAGRSLCRERDITASHTLCV

SEQ ID NO: 974886 - protein, 112 aa, Homo sapiens
VLPVQSIFRSNLLIPGKIPLSHDFSKTLVFTSGVLTSPVGGSTHLAGIIGFVALGHSPCQACGPPQLQHFTRHAALGPAQHYTFGGCSPNTRPRARAGLLQNMATYRRLTLR

SEQ ID NO: 974887 - protein, 109 aa, Homo sapiens
MEKLPRSYPEDLDYRSLTEGDYTETIDLKADKSGLLWKMMPSRTFIDWPGEVSALASENMRDVLYVRRLDAAGDFQLKPMLIYHSKNPMALRTYAKSTLPVPYKWDNKV

SEQ ID NO: 974888 - protein, 265 aa, Homo sapiens
MRLYKDSEKRYSSSRTREMQLLSPDGASMLLGAEEQAEAPRMAVPKENGGTEQRYEGPHDLGPGSVTQPAKTLEENKTTSDSMLHFRNIICPKTGQQGKRRLMRKRKDPWFLARWVAHQQSPSITPADALAWLGWMGKIHHGTLVQEREIKARKLTQNGMQTKIPNPKNTFKIYTYNKEAGQYPHRRQGRKFNQRPQGNIWVGLQSGKLSKVHDLNDRHPKMALIRGPRNGPKTGGIGTGPGTKNGRAPRNSGSQLQRGNTHGGP

SEQ ID NO: 974889 - protein, 131 aa, Homo sapiens
MVCDVQHIATCHRGRPLRVTHKGCISLTGHRREELSVFCSWVCFRLLYWNPLLLEGLFPETVDLTLHGHWGPMDKYVTELCFATGDAVGQKAGQMAEAFGYSQLYPLLGYAILSYHECGASVKAVAMLWKL

SEQ ID NO: 974890 - protein, 111 aa, Homo sapiens
TEWGRPGTKRECTCVPANMKIIKTMGDVEKGKTRIDDEWCCPVTERKKMGGQHHTTWAKSPLVSFARRDRVMAALDTLDTMTPVKWMNEQGVIGEMTDTLEWSMTEKSQRM

SEQ ID NO: 974891 - protein, 81 aa, Homo sapiens
AWLVMPFCEDLYLWSERSFDLRPASLLSKLTVGWALTIVTRIRSWHMDMSPLRSQNYLFGCELKVRPKYYHLKVWTNDLIG

SEQ ID NO: 974892 - protein, 68 aa, Homo sapiens
GEAVTEALPLLHPAVSTVAHETSCCFVGVVSTCLTGVARDRTESNPWYQLKTRCQVWKSLSAPFQSGL

SEQ ID NO: 974893 - protein, 149 aa, Homo sapiens
LSRARASFLQNVYWCHEILCKLSLRRVIYSSTAPRSAYGSVKASYLTFCMLDAGMHLVEQSFETSSIEGPEKVSDGVSPFGHTMCRLEDTETIVHQKNQEYLHYLTLPRSKDQNTETCYQARVITVLIWVHLRRGMILGAIYGDSMDLV

SEQ ID NO: 974894 - protein, 212 aa, Homo sapiens
MMHLQAQHSGPQQRCTVGVRTGHQVCPVISSFIMGSRRVEPTGPETVQGWTADTNVITDKNRTRRTGDRRRSRHGRERRPRKGQERPSHGPTGTGRESQRENGAANGQGRHNRQRDHNMHEKDKAQQRARDEKNRRELRRPRTDPATETHSATTKDIELSTLYISKIQSTPILQSKTILERAKDTLERIHGQVRNTPNLKHVHINFSTYQRP

SEQ ID NO: 974895 - protein, 464 aa, Homo sapiens
TEKRDGGRVLSRDAGRQSNKVASNTRPDTQNKNNAQRQAKRDKRNEKKKDERPGQHIDETPLMQHTKQREEHNEPSTPPRKHPRGTPQHANTQPPHPPRRHRNSRAPHATPEREHPHATQETKTQTDQTKPRHEPLHTATPRQDTYTEEPTEAAKRTNTDTRQQTPPQGNDKSSPTLTPTDHHSPTAPDSDRDPHRDAPNNATGAHEKKRRKHHAPPSQLNPAKTPHPAPTQRGNTTTQATAPHHHHPTPAPTGTPNRQRPKHQHDCRTQDSRPRPGRRHQPSTAPPTTATPKATRRTSTKHQPDDHAPRQYTHKSYASHTEPQRNTTPTAHEEPPQQPTTHTPRTLTKTKRHTTPQIKKPESHQHTHQPRQHIPATAHKNRTQEQRPRDTNERQQTREQEETRQTGDGRRRKREERKTETQRAEQERETEESEEAAHAPGRHGSQQEEKGKEAERRRVGEQGK

SEQ ID NO: 974896 - protein, 80 aa, Homo sapiens
SPSGESELSGCVVASRENRIALWLQWLSLTDLKRQIAEFKEALFTSLSKDGDGTIDNREELGTCQLDGSSWARIPSMKQS

SEQ ID NO: 974897 - protein, 139 aa, Homo sapiens
GAQSGLVVRWAVLVFARRCGSSSGSGRRAGVGESGHKTSALGLQRKWPEPSRCSISPPVGKPPRKEWPGTAARKRRSFYRRGERSPHRISRPGRPVPARRDSVVNQRSTRAASSGKVGAPSQSVGSRATSPPGFSKTEP

SEQ ID NO: 974898 - protein, 169 aa, Homo sapiens
GLLSCKDAVSRRRCLSASAHEWDRVSHAVSREAVTGYPRDHESRLRQGIQAHSTSDFVTYGKPTIGTKLGCASPWQGIHGADSDVLLGYDGVVFAKTLVDYCRPHCLCKITVRSFCSVVCDVHTCHPNKKGTGVTLVTAIVGDPLTQHGVSRGRVARDTMGQGEEPTME

SEQ ID NO: 974899 - protein, 189 aa, Homo sapiens
LPAQSPGADYGCDSLYCLLRYARHAAARTQLVPFAFALSTSRTVRNDSCSQFSWKDTRGPASIQAGEGAGLALLHTQCVGLQRTHNGSHTLDVENPWVIEPLNILEQVQFLHVLPHQNNQGQRYAHMWANSNQVRHNLIATPHAHKIHNDGTDIWCDFPLHITPDLHPTAHFVTFGLPLAPRWPPSQKP

SEQ ID NO: 974900 - protein, 117 aa, Homo sapiens
MTIAPFSRRLFTKPYFTPNNWDQRDCIIEGTCERRHPKSICVDHLSWDTTPIFSVRAQPAYIPFEQILHVITYPHGALITVFPKQLWASPCTKSLCAHNKQIQSFRHTMTNAPVYKC

SEQ ID NO: 974901 - protein, 140 aa, Homo sapiens
MSGAEVLRWHDSTGHRVGRHALCDTIRALAHEKVNSCNTCYSDRAHSDINAHVVQPIPRSLLDGAPSRKLDYFSFTPSNYEHAGIRKITIVETKKGATPVFWVQRDAFGTFVHKGIVHHHMIVVGKRGGILLELMEILVA

SEQ ID NO: 974902 - protein, 260 aa, Homo sapiens
PENFAMGFSLQLDESAACFTDCCAACVCSYIGLISLLRNDLLLCESLRSTATGEEIFNCINSFMQKHDTLNGQHTCVACSVVHASRAVAWAQLPKLSPYYKYVAPDSTSSHCLLYRHALASEHNAYISNTMCYTRQYKSSNYIKARAHQSRLLTHINCEDTWVLQYHSTFFYIQTVKWLLEVKGPGSDYWNYHVNFGIPMDSGTRLSDYVTKFILGLLTTCRIWRNICTTITAVHWSNARTPVDRCPAFDYSVAHGNTLD

SEQ ID NO: 974903 - protein, 70 aa, Homo sapiens
IESLDADMPAVLKINHWTRGSRLCANNSSSTRTKIYMYINKFLMYWMNFVTVVCIESIRRTMITSVEDVG

SEQ ID NO: 974904 - protein, 76 aa, Homo sapiens
GVSAGDRLREEDGVPDLVLDMRYPWMISSIRDQTRSTYYPSVAGQSFNPCVRASSEALRRLTLHCFLSIVVHLELA

SEQ ID NO: 974905 - protein, 383 aa, Homo sapiens
RAPCGSCQQAGCERIPWCSLLGGWRLPVCCLLAVCPPVRACPVCAVYVMFVLAVDLLPPVPVCDACLAVWTVLTSAVVQQLTDWTRGTAAGCDAGDVHVHVDPEACATPQRAEAPAGCAAGTRQCPTGEDAERQGTCIDTDLHEENPYNTGWLKDLGICGPNSRANNSGKQLGAEPHLLYSRSLEHPSGQPRQENPFIIPKLDLVLPFNADGHLSYYYIWRTETSSTLNSLEKTTTGVHVTAPHFSLTYSHAERYHLGYEARSLRTYRDTLRQNDAAFVDTSKGIFGLVITILMGPHWCIHTTNFSIGHGQKSKITHTKPHLRLPGQQLLGTHFRVSLGTQLTRSDKAPRLNLLGLQQFGITGNTGLHHVTLDPHRFCLSENP

SEQ ID NO: 974906 - protein, 149 aa, Homo sapiens
MRWKKKARIRRLTSEPVRRAPCKAWNFDVCYSIQEMRRQIERSGTKLLKSDIQYADAQEPELTSQHLHDGDSFQMSSLRRCTVSSNWKHRLQFVIERNVKVHFMDALGKRQRWNYIKGEFLSKFFPELSSFADAENSYKNHSCKFTNAR

SEQ ID NO: 974907 - protein, 318 aa, Homo sapiens
MAAGTQYTYPEKLECAFKALIAAQYSWRLTVRVRLRTTPLPYLAKPTRTPEFLRKFPAGKVPAMLSGDDGFCAALTSNAIAYYVQQLRSCGEVLHEAAAQVVQWVSSELIPDLVPPASTKGVPTLGIMHHNKQATETVPQDGTWRRTSCRMTAMLYLDPHDGTFLGAADRVDTRVKSHDDPATPVGAPYKPGYKEAITTAGAIPKNTRTVHPTAINQDHRTRPRPGPRQTRCDHAASLDANTRWREPKLNKDDPGQQRLRRREPNAQRWAEAVKNERLPRVTTKQTEYLTQPVYSTQAKAQTNQPPQLARQQPNTQTN

SEQ ID NO: 974908 - protein, 98 aa, Homo sapiens
HSFLVPRDILAGADVCRSRLAPKGKDRLGVVAKTRTNIARWMIEIILLGSEASVIENSWEVPSMGYKRDLVTEVIQTRADSLGSMVTFFGLLEPDEPM

SEQ ID NO: 974909 - protein, 146 aa, Homo sapiens
GTRTFAASEMGYERQMPSQPLNATTLGSVALTVRARRDWRNRDISFQAYYLKFPGFRRTLFTSWTLGPVYSKKTQPGHTRVGNYPEPLETQHTGRTRLPLHSTTTWPSSLERGLLGRLENTRILREPGFGRNSIINITRDGFKKKH

SEQ ID NO: 974910 - protein, 327 aa, Homo sapiens
AVKGRRGTRRGPALVAADSAGLPAVEAAWRQDQLAAGASEAGAHGSGMALASPLSIQLLALAKFNGPTWVGWGGLFNSPRGWGQTAGRLIESLFMRKLARTPGAAGIRGSFRRALFGNGDGPTGTPYEPPGAGSTYPGAHAFVEAPWSAGRGVGTPGLAETDPWNGKARPTLPRRTAWSYPDCSMSTEQDGAKSRGCHQQSGLVWGTDSARGARGTRWRPSPEQARSDCMRTQTWVTLGQDTSSMGDNAPDRVEPNRSRTGEPLAAHWNGSTPLGPTQTRHRATADKRAAEHTPINRGASYHHNTRVVMRARAPGPQGRAPHVHPTD

SEQ ID NO: 974911 - protein, 482 aa, Homo sapiens
DDDVGTVRLRSGTCCCATRPTTHDDTYNYWVLYETHGNDTTFTYLNVVPMCHHLLKHGTATHNNLGQTLQCVSFGRNDMVKAPVTPRYTCRHTNDTNTCTTPPVGRRTTTCLRRTLDELPHDTYHSPWKQHTLTLWLGHLHDTDRTRHTRPDRLHYALTLHNTHAYLKDVTTLGATCTYFNYPTPPTTRVLHWTLHLYEMVTQSPFVHSHSFNNHPSHFTAFSGPLTWTRKLTEWYGRPDPVIFTNSLHEPGDFCWVFKHLEHYLFSSGSMSGQISHHFMVQTSHKLSRLTHGGNYTVGVQPTIIQQDLIGHEATYTNTGHMWFPPYINTTRNEMTVGHIPFNRTRIPGGRHMEPDNNPSEDHYTTLQPVGTTREHNYSIDPTIKRECRNLRPPTSEVQEPHRHKTSNRGALRAEHKPTQVAHLKQARAARQPNIKAEAIAQQEKRRIHIEPKTVITPRVYTLGVSPPHTTDSMGDIHTYQQ

SEQ ID NO: 974912 - protein, 350 aa, Homo sapiens
GNPAPVSIPCCGGSCCFALSTAYIFGSTLLYMSCNTHPEGLQLDSCSQQDHEPQGGTNNSRRAALRAVNITEKGLQLHSCSPAQATNPPAQDSTHSGTHPNISKEQTPRRATFTSCINTHTARGPRTSIFEVQGDQETNQFGATNTTSFMPGEASLKTYGAFTQQHIGSTISLQQLSQGAAVGRFPPILATCTSSDISRWLPGHARTTRRRNQEQHHGTTIPSPTSTTSTGIHTVMTGTQAASDGRNGMPRQGRPCAPSPWAQRPSTLTPWPHKGTPNMENDRCQLTRSARTHEARTAPGNGKLPTDRTKEKNTSRRDQPHGETTWRSEHAGTPYCGAAGAAQQNSRYSR

SEQ ID NO: 974913 - protein, 381 aa, Homo sapiens
KREEGEDGWWPGPGSWESSGCKGASRNVMPLGARTASHMTKAHVPGALILRTPASNGPPPPKQVINHACGQHHATLPGMMAMGYGRIPEAPMTDSQHEEIHGYSMGPAGPEVELGMNRCTGTKTLYNRNRVDIHPPDWYTWACHVYAKIIRDFLGCMISCAEVGKVYPGSISHVGPKAVSLQYFWYLERGGDHSKRTQRGWLTMSTDGGFVAALGSSTKGLPQITRNFNLSIELPYSHFSGGGNHTHNKTTPQHHSRQQKRTSESAKHTHTGRTRGHQKQSKRGNDAHQKEPRATDTGVGTTTQHGGEPQQANTTPTEQSQQRDKQRTRDYYTSSGVTPADRSRETTAARKDRVAVHEEASAHERHTQTKKERTDSAPTPT

SEQ ID NO: 974914 - protein, 374 aa, Homo sapiens
MAANQRISSDYKGILQLEHVGVTPGWAQDGVSNLRDPQGDRHTHMRTSQKVRGDLTGVETQVKPGGNSGTFTYTGTIRYRASRTEHLRALVRKDRGVATPNDPESPGAKGPRGAPITPPRYGTGTGRGTITVLERNIIPSWMQTWHNSDNSGDYGEPRNGLRSPGVHHGTTQKRSNWELWKHHGWRDWTTGGVTRLITRHRAHPNDRDQPMERRTSRVVPEANGPGENNSQSKHHPKGSTTGLTSTYEGATYRGRNEGATPVKDTDDSTGYLANHQVAQEGQERSKNTRGYQNGEDKPPQIGDCHGTTQRETTVTSTVSRKQQRRKHAVKQRVTHRTNSRPVTSSSASQGGTSHIRQQRRTRSHNAKKRGETPR

SEQ ID NO: 974915 - protein, 257 aa, Homo sapiens
MAVAIAAARVLAVNRGLSQAALLLLRQAWGSGTDRSSPPQGKQQASFHLWDDKPQFPGASAELNTITVGNSSSPNVISGIPIYRVMNREWPGSSNPKRGTPTCKAEGAEAPTMSLTLFNQTMDRILYESQPAGPESPSEMTNYGEEGTARGRFAAALTHHGTGVFDKYRAAKVVLMYPGTYPPWHLFQVAQCYGTPSCVFGARGRQIACPLRLRGKPPLSSLFLSIATQSPQGGGGLRRQAVHCQRSRHGTSDRGRH

SEQ ID NO: 974916 - protein, 119 aa, Homo sapiens
MVFRRYVEVSGWPMSPLDLMPKNRSRFVDVSRSEHGLRVDGTLLFNVSDDYGLLPFKVALQLSLFVILKFLHSVHQEVMSGEAWRDVLNNLMTKNGAAKYDRPTKRIEGQDEKGVPDGS

SEQ ID NO: 974917 - protein, 75 aa, Homo sapiens
GPDVHSSSSGCTSCQWRYEEVSVSGFEEFHRAVETAQWARPFSPTLRVLRTPGGKSCAPNACRAEPVVREGLTAH

SEQ ID NO: 974918 - protein, 83 aa, Homo sapiens
SSRSSVNSRSMMALVQRLPEAISIWDTLSQVYQVPPLNFSCRPASAVGDCSLSDPVCPTEVLFLKSCASDTFDFLSLECCFLW

SEQ ID NO: 974919 - protein, 85 aa, Homo sapiens
AKLRSQCGSLQKSRNRTQGSRAGMLVVLSAQEIGVLWERQDHLVQLLIIIILCKKMYKYYCITDVQGLSMDNFMTHGSAPTVYTI

SEQ ID NO: 974920 - protein, 173 aa, Homo sapiens
MAPKAKKEAPAPPKAEDKAKALKAKKASVEKVSTALSKRQKIQQRSPTFLGWTERLLRLLETAQISSGKPASQEKTKLDQYAIIKSPGPDEVLPMKEQNRTRTTQQNNYGCTQLGWESSQHAQPKAPRHLHTRLRDRKALDIATFDMLAKGTKKPRSLRALPSRQHEGLMYTT

SEQ ID NO: 974921 - protein, 121 aa, Homo sapiens
MARDLIGPALPAPVQDPRNSGGRKAGPEPVCRTKLCPPNYKQQQFRFIRPSGEGQVVLCTKKGHINESERTMTCVPNVQENRGNTQDAADSMMTGMGNMDPKPYPSLNSTTRRMILPPRPN

SEQ ID NO: 974922 - protein, 305 aa, Homo sapiens
LLWVRHCQPAVAHYRAVSSASPSEPRETADPAPGTRRGGVPGEFPGTTHSVPTVSQESGHMGSTDVAHRIRGTARPQNLPVEKYLTSASCMRTLNEAHFWTITLKEGEHGYAQRINTVVPQSPFGTGDHGNKHFITYARYNHEWASRQFTTTSDITILYALATIGIPQGSHNGQGYNHISHGTPLGGCIPNMSRDIERHEHSQYKKPEITNEDLKKKETDQAKYTTSYLVTIRQSAGQIHGERNLTFAGHGFIILPGFLATQHPNKVRITPQGASPKMDGGVTCGQHHVPPVGLTMIGMDPYVSH

SEQ ID NO: 974923 - protein, 115 aa, Homo sapiens
ETFFAESRRGFLLQQCLDGTRCSFPTPAAAHSQPSVTSLTAPWTGPKAPTAAPAGLAQPPAASSALLSRRHEDRVPPRRCARNYHQDSEARHSTRQINLEASTPPSVLPVHVLTT

SEQ ID NO: 974924 - protein, 74 aa, Homo sapiens
GKGNCEANVTVVPSISDLLVDLVHHHHVGARLVCLRVLPSRVCHPAFTNGLPCCEEFHHEESMAVEHLAGSMRT

SEQ ID NO: 974925 - protein, 164 aa, Homo sapiens
AVVGPAGLSLASPVWDGTDPGTLFQTSDSTSDRPSPYGNLREHLLGHSPAIWDLPSSELVVSILLGKTKQRAPRFVRDYFHADDGGGERSILVLGHIKVGVQDLPYQGERSSTGGLSYKKTRGLDDGRAGKQKMKHLCVLHAEYRVRRQERGEGHKRGLILERM

SEQ ID NO: 974926 - protein, 106 aa, Homo sapiens
MRMEWMAHGAGLVADVLVLLPCTCWSRSLYMLSPGSWTVFNSMLVSIVRDGTIHMDTLHAPIHIISRLLHYFEICTIDHTMATQESEDSIGRKTQTYEVGMRTYKM

SEQ ID NO: 974927 - protein, 98 aa, Homo sapiens
SRRLVTVTATIARGWVPETWRSRSPVGSCVRVGAETSPGQGSYQDGLRRPGFAEGPPAGRNPRRKKTQTDRRGGSAGSQPQACADGVRSLALYQAAVQ

SEQ ID NO: 974928 - protein, 34 aa, Homo sapiens
HKNKNKKDTAQLYYIYGHPLSPNDERSELRSEEA

SEQ ID NO: 974929 - protein, 249 aa, Homo sapiens
MAGKYRGADGMLLVGIPCTDAREHYDAERIADISGWHGVHELRSIQLASENPEVGRRHTMHACLRRAGTRVLLAVGRFERLTVAGNLTYRGGSERSVIRGGGRCCRARQEPVLADVVYQKNNSGVPRTSGITHPTEYAYLARQFRDKTKRHFLVTDAWGAPKDEGFDREYLGRQVFLQNVECTLDYTGTHLRKDHPVSSLTEGNLGKGGTKEMLQGPHPERVTLCCDDVVHHLDRGISPTRGIRDRPEV

SEQ ID NO: 974930 - protein, 512 aa, Homo sapiens
ALARARLCLALRSVYFTTADGCVSQNSSASASIASRMPKAWQMQLGHEFPIHLQHSGFPRFKTILLASALAEEYGTYHVLQTTHCKLGLRSLSSTAQNYTYASFNRHHTGTRKQLFNTPLVHPSKLEPVFKMSSELSVSSHQRIPETEQQANQTHWHISQLTTREQTNFDTSTPEVLTVTQPTGKSTNHTPAPTSEWQLLTWNWFALIHTKGLSHTFGSRKRTPPIGQGINMATKHFFKAKLYYPQGVSGQGASAKHGGLGTRSPPLGDTSFPWLPTSPNLYPLQQQRKQISARTQTQQGNLNVGHKQAGTYTPKNTWLSHQRQLTMRTVPPSTKQAHSHRSHPFDTTHCALALRTQDPTPKTLPAHYTERTHRPLNQGRPPTTSGPIWDRQTQIYGAPTTNIRYNIILAPDKSSIEQQWPGHRHTNPTLRHTYTLNPKHSYTKHKTDDSRTAHINPTTDHDAIPRTPTKRSTEELTRTHMKQQQPAPRQRARQNNKHDHSNSPKTSSSTHH

SEQ ID NO: 974931 - protein, 294 aa, Homo sapiens
MSDTSQNPCDWSSWSHNSPVFTAVLVICANRESCLWSRIYDLIIALCIVGYQAPDEWVSWHGVLMEILLDEMLSLGPACRYSVIAKEHKRQDCGLHMTWSVGILVLLHATEWGKAMERSHGFTESRMVIIFQESQSAEALDKFTATKSVEGVICGSGNPAQYQLSDCLPSQLHDIPKENFSCLTRLESQLSLKLKWFLKLGVTVMMYRMSSSGDSIPRVNIQMSAMQVHSQEGKGVRGSEKRRGPGDWRDGTECGGAKVNHHGHFGNPLASAVAQGGEGDWTQGASTRKNGAQR

SEQ ID NO: 974932 - protein, 225 aa, Homo sapiens
MPLEQRSQYCKAEEGLEDRGEVLEAWWVRRLLLLRSMRWLSPLLARRWIVRPGGGALLSSQQILPSSSSWVASSSRDLHELLLSRSQSYEDSSNQEEEGPGQLPVTGVRVPSKYSGGRWQSGPRFCPHSIERRLLVTTAEFGGDVSSSMWQDLVSCDRQRECRFVGGLGSACGVGPGLSFCTAGFLEAGVACQPGAGAGIRGVPGEGGCCGADLVTALGGRTCFA

SEQ ID NO: 974933 - protein, 178 aa, Homo sapiens
CLPAVWGDGGLPPYVAKCPASRLEGRTSFPEDTVITYTCEEKLVKLPGEKDSVICLKGSQWSDIDEFCNRTLRGANKAKFCIPQTALYHSELFPVGTVWTYECRPGYRRDTFSITKTNLPSDIEHVVHSSRICKKNIMPYSRDATTKWSTIDVPGGTIIGATISFSCNTGVQNYFGRF

SEQ ID NO: 974934 - protein, 119 aa, Homo sapiens
MSVMTGFLAKITTTIDITQLITGPVHYYPKSQTDSHIYITRHTHVTSLSNTTKTDTGNDQLRVNTDLHRAMGNCKFYQQGNDIDKLIPKSNHTQPRQDHSPSGNPILKGLRKCLTYERK

SEQ ID NO: 974935 - protein, 330 aa, Homo sapiens
TISRDPGRKGDDEGALGSFTGTVPDNHAWSAVEHGDTRWVSRNSDAIGGRGRRDSVFENLITVMQASENWACSDHGVNWARIARNRKHECHEVGRGTSRKNPLGQLPMRLYRCLHMGLSNKDRVPLCHLMGTSTGDWLTRHSSVDGYMGPLTGQKMTFLSVNRKALKTHCGTMMLSTTSGGKWIIGGRKGLATRCWENLIGGIAWGEQSLGGDGDLWELCSVLPVAGRPGSSNRKYDAVTMQSQPHAGPLRGVVTNSKTIMNKNSTTDPKAGRWAQGLSNMQRVVADSPLEGTMNGAPVGRGDRTLCGQKKAMVSATNTRINVPKKSGEN

SEQ ID NO: 974936 - protein, 202 aa, Homo sapiens
MQLVSAVLTRCEEISYRPVEKNVMKMKGSQDTSESLVHKYVLDAHEREIDGEIKSEAPSVNFIIEQMDRKIKSYRKFRYITEVKARHPSYPSPLLAKGTQLEGRSWYSSSQEACGQWEIAPLKISVTIFILMYRLRSALRIPWNRYNCLVFLHEVDLNCHVFTDICAGLHLLISEIGVRMRFRVNVMIASRNQTVRVPITVG

SEQ ID NO: 974937 - protein, 306 aa, Homo sapiens
ELVMMPLLGAVSHGGRRAFDLSVLSFLLTILEVLCSVAPDGIDFECDTGTSEPPWRSPRRKYSVWGCLTISAVQSYHHVDTVGVPECNTESPVILRTVSLEGWCKRMSCTLLKQRQLNLRRQSNESNTVQTLNNVCTANGFPLGALEITPPSGLNGLNCGSRASAYSGTSTLVPVPGTMPSQTHDRGGRCDILVYSWETRLLPPGRVDTARVRTAATVTLAACCTRLTMIIQQGDALQRTDHCCLSMTRKLLHTARAALSAYPAQAKQHMALINVYPDHVPTPTGNPSTQQPRRITTVLIRDLQAP

SEQ ID NO: 974938 - protein, 43 aa, Homo sapiens
MPAYSKYLYRLTHPEEKDQKETMTSPHYKRADKDMYNCENKHT

SEQ ID NO: 974939 - protein, 41 aa, Homo sapiens
MRSQHRLQPRKGQNTKDTKGTSNEITNRHRPQKTQKRKRTA

SEQ ID NO: 974940 - protein, 77 aa, Homo sapiens
MPYHPSWPESRHSRTRQTLPGTGTGKGGPRYITAQEYTRKEGARGQQYNKGGAEMEHRKQKQNKKEGGNIQGETTRS

SEQ ID NO: 974941 - protein, 128 aa, Homo sapiens
MGGLPSSSGKTTIKMPCLPYRVMNVVLLSLSWVFNSFWHAVPRGVGLEDGSIDQDLCCGRHYETVVMPSQFHAEAPKSVALTGVLMLVEGLCKWCELRNEMVGRVNDGLGDRRYLERVESEWWMMFNR

SEQ ID NO: 974942 - protein, 308 aa, Homo sapiens
MSGPWRWARIFLLLAGICPCAPPGAVLSPTVLRYNLIGAVLEMDLCSQGILLRYIWMVSPSCASDRQKMQGKAARDSRAEDVLGNKTWDRETRDLTGNGKDLGDDPGFISRIMKEGCAVPSQEIRVCEIHEEKQHRGASQQFLATMGSFFLSQKLETEELDSGPVLQSSELGHERQEFLEGGCLKTKTKLSGYELRLACRNYGRYARNPGVRPERSSVPQGEWYQAGRPGRIPVTGGSAQPRESYDGAGGNLGPTRMGECPGMNHARGHRSGRQDPEQEHNGAEGQESRGGGNTKEHEADTTLTVETR

SEQ ID NO: 974943 - protein, 139 aa, Homo sapiens
MNRAFHVCAVNVVIAGTYEKSVVSDSVFGILSTLKKGPGEDEQETFVNTVRESNAATEGPHCASMNRESIALSSAYSSVMVRPGLGIRPIEVRLIGVGGWAETTHETLLNVKQNAKIGTVVTRNRLTQYLHRNEEKPLE

SEQ ID NO: 974944 - protein, 150 aa, Homo sapiens
MTTSTSFKGVDPNSRNSSRVCGLQVVDPIHIRFDEPREQPVRKNKMASNIFGTPEENQASWAKSAGAKSSGGREDLESSGLQRRNSSEASSGDFLDLKGDGDIHDNVDTDLPGSLGPEEEKPVLLRLCQPGWPGPVPSRRIPLGSQLVWV

SEQ ID NO: 974945 - protein, 301 aa, Homo sapiens
ATTAGVAAALDGRKSPVSGTAWRQLVVTEITLPKESYCEAIFSSGDGHMCIVTEPEWLPYAPQDLLFSLKGLCKSRKSLSDCWDHRGSDESHVAAAPARYSALEQCGLMKLWDPWTSRSEVQRSWEHRLGLSALDGTCFTEEKPGFINILPDVLAEVFIKVKDDEFMMAQEYVNEFQGNDAPVEQEINSAESYLEKGQSRGGHTTCAEIGAKELNPWFRTLGNEWNSAVQENKGSLDGGGNIKRRERVEKQRRKRWVREMAEMHRGKGRNSVEQHANGRDENDGHGDIEERNSERGVLSRA

SEQ ID NO: 974946 - protein, 113 aa, Homo sapiens
MELDFEEDKSDREDWDDEIVRTQGNLVQEVMLDLQRVKEKCGKRGSRDLARPRRDIPKAECKRAESRKATGTGQQRTEEADRPTHKRGHLDGGNTRSEQQNGHGEDNAEKPRK

SEQ ID NO: 974947 - protein, 45 aa, Homo sapiens
MRPMRDRRRVSTEGYKEPTRRETGGKVENTNQAPKKHADRRDKQV

SEQ ID NO: 974948 - protein, 262 aa, Homo sapiens
MIFFGKVYLVVTNELLPSHPLELSEQNFQLNQDKMNGHTEKHSGSICSAKITDGTSTAVEQVSVFHFFSKLKSFPGLFDGVLLEHYGLEDIFNDHQPTAKSLVTATFDGRNNKHLVTVNQTVLVIGQPERLHLGLLVNNRSTANLMLTTTIPKLTEHSNNACPTQDIRERCQMDGGQGKRTCHINNKRKSRQTKKYTTKDAPQHRGQAVRKKTTPKRAAMATEADQQSTEQDNTLGRPKKTLQANRNITTPHRTATTKAETH

SEQ ID NO: 974949 - protein, 81 aa, Homo sapiens
LSNDLATTYLLALRAKPCKMNMDRSVAVGTVLRLIVLDLDSRNGVLANRTVFFATNPSKLVSRRAITGDRITYGVPDAITE

SEQ ID NO: 974950 - protein, 178 aa, Homo sapiens
ARNSAAPLVLSLASSSVWTVTDPGGLLFQPSDRPPDCLSDCKTLLGPSLLSASSPCVLGTVLSHRCVCWYSSLLAEHNHRAPRFVGNEEFQLTWRADVEQALVPFVAMEASIHHTVTRGPCSEERNDVGVWTGVRTTCFRRNQGRGRSAEGYERLLKMHKSRDGRRGFSVLGRSQNAR

SEQ ID NO: 974951 - protein, 69 aa, Homo sapiens
RNRSAQARGADRRTGVAERDPLESSSRTCQKPQENMGRVFLTGEKAKFHIKEATQELMGFFEEIRQGND

SEQ ID NO: 974952 - protein, 191 aa, Homo sapiens
MMSVWKAAVQTFNVKKKKKKKKKKNFGASRPRKVFKPLGGAGPRKEEQNVGRKWVPQGKPGTNHIWGVVSSPNKRNRRGGTRDACSRNNPHGAGSEGASTGVLHYTGRSKAQPAMFKFTPALGMKMSVQHNGCTLGALTNNNNQWVLRLKCGSGTSAYYWTALSSCWRKMQSREDEEEEDVKILSISGKRF

SEQ ID NO: 974953 - protein, 33 aa, Homo sapiens
VWPSRLTTPGESFPDDEWVDGLVGVLYKIQYEV

SEQ ID NO: 974954 - protein, 57 aa, Homo sapiens
MPQKAGANRRRHYYIRQTKREQAERLQKASRLPRPRSLRSSVSHTLSATKAQKPREK

SEQ ID NO: 974955 - protein, 390 aa, Homo sapiens
VRHSGAERNGASDALRGSAADAYVQLWLTPGLPLLEARTERSYYTANGHETEHQGGKETWLRQAKKKTNKVQPHRGIRRLNKNIKKVGTRHKNRRTVATTSHEAPHPKHQQAYRTLAMKRNQQQNTHTNSHPREGDESEQQTHEEESNKTKGARGHNSTESQRGQQNERTTTQSHPNITPHARTAAHHTQRNANNKQHTQLRGSPDDLARSTRTTTKTTALDHALPVDKHTTQDALNTRMGKQGTETTRQRANKTNTTTANRNTGSKTTNASTSSTHRESRTHHTTEQTQYGAHPLSEQERTLDKQTKSAKRYNVDDKPTAHYLLCRPVSLYNEATRQDRPTRTTTHTRTKYVEPNRKKQELTAKTKQRQEATPINQHKHTKNKRNTRET

SEQ ID NO: 974956 - protein, 145 aa, Homo sapiens
MHDDIQADKTTAKSEVITTMTSKKRARATKRARGRKTRRRGGRREHGRRTPETGRRTEEERGDEERRDKRERRTDRSPAGEPAKENGRQTAQHDAPRPEQSGSHRQGRRRQAATSRGRAQQHRKAKSQRQDTRNKRHNAQSEGHT

SEQ ID NO: 974957 - protein, 182 aa, Homo sapiens
MTVNLASIAKTESYPDNNISTTDMTSQKTDNWNQTKIDAQEENYSASVAVYIIFEAKIKRQLLEGEPLTVMPPDATKKAPVPNDNDMSSTVRKHGRTTRNIHSETGQQGNLSRARKRRRMRKDTMTRETWQSRVMKTEIPPTSDAAETRSGGHASTRAQRKTSGKGQQNKGENITGPLSEGR

SEQ ID NO: 974958 - protein, 309 aa, Homo sapiens
MWKTTLGDNNAISFGKQFETLFEKEYTSHGRDPTPGLKPKDKELKGEDNAKRGHEGCPITHPARNYLAQHGRNIHLPSDRSNTPGAHSATSNHTILSKEGIADNAESPRNGPAAPHLPTRNQTDTNSAAEYKARNNEKMCTKDGTPQDENPTGHQHDSNTRQDRNRNDTDILTSRLRLQAHTIPRQAVTKEATPTTPQHTDNSHHPYHQKKKIKHVATASSINLSYYHTTSQERHKKTDTYYISYDTHFNLFCLPIPTNKHTTPQQPINTHKTHYKKPHGQTPTTPHTHQQTTQTQPHNTTIQPTTNNH

SEQ ID NO: 974959 - protein, 665 aa, Homo sapiens
AVSCGGFCWFRKCWVRDIQRPVVLSPNLRSAVLSRSLKSDGLLEENAFDPSERSQGRTVFITYCSNNWQLVKCVYVLLPQVLKSKSTEMDYQDEKRTKLNHPSLTESPESTTKDNDEFMMLLSKVEKCQTHITGDHAHNLTVVYRLGRAARELDKSPRNLLCITFLQPDELAEDQRTYDHSDKPHTVRTEFRTSSQSITFISTANNSLRHFNDGYEDDHMGQSDCRAITDRHPNRGHIRRQRRRLTLTTTSAATDTSASTERSTRSSFSLLSYFYFSRARARQETIRRRRDGKTGEDGGERRRQREEGERERNRRGRRRERARARRDATKKSRRRKRDERQREETNRRTARKKIETARRTADAQRATPRRERATRVRTQGGPHCKGVTTERAARTRESPAESGAQNASDPAKPGRERKEATSEKGSEGQDERTRDQAGNEETERVRDEREAAGGRKRSGGGGRVHGTRQPTRRTEATGATENHTTQETHSARDPRDDKSDQQNTNQRGRHKRHHTRQTAQTTRSRDTQHAKHTPDHRHDNDPKLARPSRGEPDTGNNSRVTRRRGEKTRNEPTHEPRHGTTDTPTRRAQPRHDAASAREQTDRASRTSKPGRPRDDADDDRDTTTEEPERAEAEATERRNKNTRQRWAHRRRLHATRHRQNPARA

SEQ ID NO: 974960 - protein, 523 aa, Homo sapiens
MYQRDVFEGWPDAYKCDYPESYRGTLLKDFHMSELSCNITLLIVTIVATMLVEAVTVTSLCIYLDLPVVSQDGVPDGPRPGAGPGTYPEKNSKEISSFSAFISYSGHDNFLGEEGIIAKPRDQTVCRFAFMTRNFVSGKSIVEHIITCIEKSYKPSSFVSQALYRVDWCLTELYLAIHKSLRMQDAIGNLDCGNPSEAPIHHVYKPTASCQATFGMTRKSKVVGQSGLIIETPTTPMDNPEPSDRNIVINNARVNLHCFIYYLFCVVYPKSAADQAPHYKPLPTTCTTLTTTPTLRPATQAPQTSHNTLNSPNHYQIPQAVLTHSINEPSTAARREDRVTSVERSGSARRVEVLQEELKKRGGVCTRGDRSMPLLSSVSGGGSKATWIRVDREPLRQDQTRREESAQRKKQRAEAAVAHRRFQTVVADAVAEDRTAKGRTSAAASQGDTCVPALQLCRTPRQDETMTRRLTMRSRIDMPEAHSATHRAMRCMKIESQHETTQNEGHAAAHRPHTSLTNEGKTP

SEQ ID NO: 974961 - protein, 142 aa, Homo sapiens
MPGETVRKTQEVTRVQGIQRQQEADKTRPGLNEHQHTTDDRNPYNSAQHSRTATRLNHNKRTHNRHNNSSGKTKKRKAAAEPDDSDATHQHHTSLRKETRQKAKQNPDQNEEGRHNATPRQTHNLKRDQRTTTARKTDNRGK

SEQ ID NO: 974962 - protein, 59 aa, Homo sapiens
MTPNTRINGEQQHSNNHHNNESYDQKAAHIHKVTDTEPRPPSAALQDEEDSNEHEKQEN

SEQ ID NO: 974963 - protein, 754 aa, Homo sapiens
VENIGGSPGVQVVSSIDECGERPRVLVLALHVCVCLGPRCVNNTDRWPCASVPLETAVTQGPEKQQRETANKDAIISVLGKLNEYSVTTNLSGTRLLVCIPFETRKLALGIYSPGTTTRHTNHMNGKHGLRSQRTRRTSEQHTATTRTTGSTCLRNTTYTYTRHSDSCGTLAIQAPHTHGPANTKSPEHPPFTITHSDNNVISKTTAGSPTRADTATPRRASLGATTRHLHIPNSATQGNSTRHPPHPDAGTQHNNTRTRTTSRLMTNLIQHQASCPVNYTWHLHLATSLTPHLADNTHSVHSSPYTSLDPSVHASYDRPSSPTSSLPHTLTATASDPRPRHTPLNAYNYTTSHTLTRYTTLVILHATTHTHTAHTTQTNQHNILIYSVCYPHVHLLGPTTIASPPHSPHSNDTHDPYLAPATPTYNTHIDPYNHTTLTPHPSHPPTPTHLTPPSSLPHHLLPPRQPYNHLQSYDPFIPISTILTTRYYHSIYAARFQKHKDITFATSHPSTHHYTNTSSDNHNPITPIHNTYHHDHHYNYSLPPPIHPTHLTTLRAFTQHTRLTSLNKLRHISPHDTKAIAKKNQTRTSIDHSRITKYLAHTNDLAHSHTTMRVTNHTLKIMTISCHINTSVPSFPRYCILLNCSVQLDLTHQANQYTQTTTYPRAATRLITKHIYYYYSMNYPTDTLRYLIMHSSAAPPYTPPHTSSSPSSDNITIKTLTHYHTSSYVYYTQYSATISYSTHTPTPHQSHLH

SEQ ID NO: 974964 - protein, 59 aa, Homo sapiens
MTTDDSQAHIDTRIDIKPHKTIHGPHMRGHSCKLTDMWSGHLSIPLVSPFLCMSINDTE

SEQ ID NO: 974965 - protein, 368 aa, Homo sapiens
MRWGAGGAQYGKCGPGAKRVSLGKLVRRTTVRDFSPIKKPPAGQPDAFVNNPKGSQNATRGLYTPREAPKERLQDNKINRGQGVGCQNAKAPRSRQLRDIKTKESAEPGTQDDRATTHARDPRPQQIMTAHHTHTPPQDKRDQANNDYQGKRSREMNRQRHTHDAATRAHAEDAGHAAATTSRQRPQRWISRTSPRVVTTHSAEDGHDSATNARAEAREDRPGEGTTRGQRTEEKTRMKGDEKERRVKKQRAEDSNESRRGKQSKDEGEERQGESKGSDDERYEGEEEGEKRKEDDQERASRPRAHKQDQTNERAHTEQATENNAQAARQKQKGKRPKVRNDNAKTPSSNSHKQTTEAARGHKRPNRR

SEQ ID NO: 974966 - protein, 125 aa, Homo sapiens
ILGLGLAAVCLRADEAGWSCKMRLLLLLLWRRLRWSGRGLGQSGRVCPRLRALHDASSATGPLLKFQISVSGEVDRRDCGESTMRVIENRRYPEDRALKGENDAPSSKYIGHIAYCSVFSLQTTY

SEQ ID NO: 974967 - protein, 160 aa, Homo sapiens
MYWNTFVYQQVMRMSDRDHELDIYGPLVCSINYPEQPMGAIAPVPTDMCDRGPEYQNVPDAPSYTCFGWNALRDAGLATALLEQTDLPVPGPAEHRRVTKDQGSPNRQVFPCVVNHSPGCCGALGVQGSDRNTRYNKQCNKAMYPPPLGHTTPRGNVWLS

SEQ ID NO: 974968 - protein, 155 aa, Homo sapiens
MVFLNAQSGLRGISRHRPLLRDPGVLNTASTSGEVKSRCYMGGGQNRDSSLSEDAPKARYLNETMNMRTLWIKSNYTLLARNMDVKYPALIWEFSQGARWMLTRKVLADLAIYEAKDLQIFGCLCASRRRPRTGFAAGLGDWDRNLTGHPSRVVH

SEQ ID NO: 974969 - protein, 118 aa, Homo sapiens
MRGSQERNRGPGTRGGDFPPKKRPPGGDNRKGSGEQIPRERESREGDHKRGDSYITQRGEPPRRRPQNSLKNYSPPGPRGGGGPRRGKQKRTRTQETTARRLPNKRKHKNVNTKKQGS

SEQ ID NO: 974970 - protein, 123 aa, Homo sapiens
MWGARARGPERESLPRTQAGGGARGAPNGGKGEHWGRITAGPQERENSRAPERKEGGEILSPQYNKTRAGGRNRRAGSWRKNLQRGRASRERDHISGRSSINTGGAQRRTPEYSKINPRTGGS

SEQ ID NO: 974971 - protein, 160 aa, Homo sapiens
GRARWLTPVIPALREAKRREDSLSPGVRDLPGQYSETPFSKKKKKKKKKKCGGRDRAPEKILNTKRGGRAGAPRGQGTGAKTRVPKENPGQDTKGGGFSTQLKNAPGGHTRSGSGQNLQREPGGDKKRGDLLSHTREAQSGKAPRILQNLPPADRGGSTK

SEQ ID NO: 974972 - protein, 238 aa, Homo sapiens
MYQQQQKRREGGDEGNSEQHRNITQDPDQKYTATTRSVCVYPRAPTQIPPTRRHTGQKESNLVIQTPPTQTIIANKRCGLSSKSHHNHQLVNSGVGLHSIENNRNTKRREKTKERRNTEKKNTKQATNKQRKAKKQNKEDRENSKNVKKRKSKTTTTHNTRTRTRRITKQNKSKKQKTNNERNKKQKETNKKKTQQQKTERTIQENKKNTTIKTTGTKPKRKKKEFKKREKSNANTTT

SEQ ID NO: 974973 - protein, 124 aa, Homo sapiens
MRGGARGPQWVRGNPGAKAGLPERKPGPREQGGGDFPPFKKSARGDTAKGFGEQLPRGESREAANNGGAILTGEPQGERPENSKIKAPGAGGVTYRERRRQTINQNKIQGEQQKRNKNSRNTED

SEQ ID NO: 974974 - protein, 102 aa, Homo sapiens
MNMRLLLLLLMVGVCEWSASRGLGPSLGGVPSKRLNDAGTPTGPGASGKIPGNLVIALKGLSRAGMFRRKLHCGDYLAQSDNPVASRNCKCRRDLLSTSTTK

SEQ ID NO: 974975 - protein, 104 aa, Homo sapiens
GKEGSALSHVRKIVEKHFRDVEKANKKKKKKKKKKTCVPGAGSLGALSRKKAFHRTIPVGRARRAPKVGISVDTVGQKRGFPKGKLPGRKRESREPWGSSLNQH

SEQ ID NO: 974976 - protein, 126 aa, Homo sapiens
GARLVSRQSCGQPGWDWFPCVALDYGIHHAAASHGQGVASSVGEMAASGTAKGLETWGAQDQPVASPGALVKGTLPVTCAYLWAQEVGPSLVQAVPARLLLQFWGALLATILAFALGVSVLASYGG

SEQ ID NO: 974977 - protein, 97 aa, Homo sapiens
HECLRNVGAAVGGYQGVFPRIVQRFLGDRVLSTARSHPQYLTRHHISAATRSIPRPIMTHSQLVDQGWIDCCNRLNELLRHPFHNRNRIVQYIYYRG

SEQ ID NO: 974978 - protein, 204 aa, Homo sapiens
DGGSVDLSRLALINRLCSRGKLAALHPCASETGRPTCSVLALLAPCCLVLGVRAEMHKQCKVHHPCKARACVRPCMPMVGMCQDDAQGLQSAKGRQKSAACCAVRPGQLCISECNIEQPYINQGLWEDNERGANPAEPRSGAQHTQGSRTSRENEEEKRGTTNAYNQQRTTQTHQQAQTTNTPQQAHTNNRPNNKQEHKKKHTT

SEQ ID NO: 974979 - protein, 76 aa, Homo sapiens
ELRGRTRTGMDAISPVLDCCRQPWSVLKAWKGCSEQRDSYKKDSVGDTDQGIGGIWKRAGKLNQSLRNRYSICKEP

SEQ ID NO: 974980 - protein, 137 aa, Homo sapiens
GRARWLTPVIPALREAKRREDSLSPGVRDLPGQYSETPFSRKRKKKKKKKKKNLGGAAWAPGEKFFKNNRGGGARGAQGGRGQWGQKARVPKRENSGAQREKRAGSSLPIYKKRAGGKNAEGSRRTILQEGGFRGGP

SEQ ID NO: 974981 - protein, 80 aa, Homo sapiens
RRVKEAWRDCDSMTSKNGTALLFLEDLHHSPITDHQCGVTVLSELRPIESQAAARLLYLTNIQTMGASLLDNTIPMLHTY

SEQ ID NO: 974982 - protein, 125 aa, Homo sapiens
MATGGSDSSATAGGICTKAGASSCLGGRAAAEGGGIAATIAVSGRIAYAILPLAPTSRAIVRRIGGSDRPFFLLNPKAITRSSWTMLAYRLTNRFCSSCRSWAVCKGGASHKATQQTILNQKCEI

SEQ ID NO: 974983 - protein, 154 aa, Homo sapiens
LPRPSPPPPPPPASSASQPGEGGVGPARLRRAPGELLPGRGPGAAERRGGRRGPAKSGHTSKLASSILLSPGAPARGIRPPAAKMCGQEGRERSVDARRAARTRGLRRGCRQSQGSSGSRLPAGAPRGAGLYACCSLPGDRKLPQPEFPAAGGG

SEQ ID NO: 974984 - protein, 168 aa, Homo sapiens
ARHHATFYKPLPKDKKCIALDQNCTNELKKGVRTTNNHILVIPGHLRAGSLPYWPSELPFTVEGARADTCQASTGRVGPSRGTRRIELKVKARQPQGPSMGPAQRACALQSVPHFPPPAGPSAHAWTSPALQQRSRDAAPGSRRRVDKAIAAFHFRRPPARLCCPRPR

SEQ ID NO: 974985 - protein, 101 aa, Homo sapiens
PVPLPPGAARQLPAPSWQVAWVAVDAGREEDVGLLWQVGGARRKKKQRKTHTERQGESARERALVYRFIHIIYIYVAFFLSTLMNARSDPRADSLQAGSLF

SEQ ID NO: 974986 - protein, 129 aa, Homo sapiens
MRYIQSGGFRRAGGALPLQGAEGPPAQGRASLQAAVGATVCAYLPRQPDGRPSPDRGSQGQGQGTSDAGRARGASPRPSPHFGGQLPSLIPASTLDLNHCWRGTGRDPFMPGIGSRCSRGVCSCILAFF

SEQ ID NO: 974987 - protein, 249 aa, Homo sapiens
FGLRGKPRGASTHICCLLLVTQLHKLAADLCSPDMPNLWVLSHEGHTYAMPAVLWRLECAVTGDGVPQWCVTCLEQAGGCTEAGWEPTPTLEGVLTDWTGAYGGTCQTNNCGCLFADLLTPDFQAENDPQCITGYSKLHRMYAKTGPIPVKCSLCSSEGQSCDTISSSWNVKNPRKPNGADGFVPWWACGTHIWPEIGTYVVWQEYNHADLRWNPVGHSVRHVTRWLLVSRAVEGLQAPVMRTESAVGV

SEQ ID NO: 974988 - protein, 78 aa, Homo sapiens
MQHDEKAKHRQSISHKKAQKKRHKQTDETTDTTRKRNHKDKRHTTVNRADQTELTIKEETQNSTHEEKTTHQQRKALK

SEQ ID NO: 974989 - protein, 284 aa, Homo sapiens
FLSPLPPLTIPLGGASRGRGERVTEEQYRGMQNTIKESRGKRPNTQPGQNRQRKEDKQKEEANRRNKTRKAKTSDEEAARRQEKQEAEKIKQRRHKTNKRNIHKAEAKQQNDERRKETAMNKRGDTATSESNSTTSETNSHRQRKSKESRQRKRHKKHRAKQEQQKKQETQRATTDRKMRKSRKTTNKDRDIGRREHEEEDKKKKRDEPKQEERTKERDTTEKQQEEREAEESKKKISKRDKRDKYQDKREKDSDEPNRHNKKNKTKNGEKEEQSTKQRRHETK

SEQ ID NO: 974990 - protein, 138 aa, Homo sapiens
MAGWKGVHSHKKKERSARHRTFRSAEDLLRLRILTKYPRTSAPSEKHSSDQQYAIMQSLSADQRELVLDEERIERRTNIDLCSWWDVESANKQPDETRRVLKLYDIDVAQGQHPDCGTDGEIDRYMFDWCPDDECVWM

SEQ ID NO: 974991 - protein, 365 aa, Homo sapiens
TGVVKTTPKSQSGKGKRLTSETIVVYRYDVDSVASPPTNWHMLDLIICCVVSTNSNLFVTNFDEWHVLASSIGTRARIRQSHALVMLCDHTHVKAAADELLDSSTKISMMRPYAEKHSGVPMRKLRNWLESSAISSSSALWAASKHVTCVMHNKQLDINKWTPSHPVAKSVVGIGPVSGVIVDVGSIIVVGDFVDRLVVMLPMRQIGGSTPQQDSALTRDLTATEGFVKNKATLDRIDETNNLGISDVKTKRFKGQEKTNNEGTILSTKERFTANVTIERKKWGLTKPRTRSEKFSSQMIKRIREIRVDQNNRLGRPKWLNNAHGEPHGERKKLHPSTRDWGNGHVGNHDSNTERRSGLGFPSNQ

SEQ ID NO: 974992 - protein, 78 aa, Homo sapiens
GEARQWLFGPTERQSERPYGRRLAWRPEMYLGKKAAARGGWLLQRAATRDGVLALGQHGCAPEELGLECGPAAATAGA

SEQ ID NO: 974993 - protein, 223 aa, Homo sapiens
ASRAAELFLEAAGLVLPAGSLGLRWALIAAVSPLQSSPCAPTGPVMQLVPLCRAWTQPGAPASHMHLTWVSAWSLSPHKMADGGSPFLGRRDFVYPSSSRDLVPLTEGAASRRDRDEEKGSRSSFDFQAQSPKELIYETGDIVYIHKEVDKNLAGGRAHGLPGQSSLLIMWRLLPHDEIPKPHQAPDYTGAAVWRGVDQYTFEGDLEVELTSAREEHICLIEG

SEQ ID NO: 974994 - protein, 507 aa, Homo sapiens
REAVLLAGLCVKALVLIVARQVQKHKSTNRDKYSETATQALYKKLYSASDRRKRGTPARHGDNAESKQEQLARPHDDARLRLTATLETGPPNEHGTPGNGHQDVLHIQHNNAHYTPHNMATRARGAPPGISSIKETIAHKTQHGKRMAHRGSQHSTTMPLTQVAHDPGSARSTRRTYRATSTYLDTVTDTKSEEHHQRKREETKRHRRPKNQIRGHAAKQHTNTRPQQQGPPLAPLPPTRQRKTCLGPTNLSPSFSPRRDPSLTTKEQKLLKGAPQRQHASNSDGQPITTTSTNAHRRPLADPNPTDTKATSRIKISPTHNHPTSPRDNSDPPGHTPPGHHNHTPQLTHRTRPLQQTQHTTDNSPTPSHPLNTKHHTTPKQAEQALQPENTVSNDSYSNKRNRNKQKHNHHAAQTDKAQHNAHRPPTSSRRPIDTTHTPQIATSSIISLSLISSAEYPMRHNSSANSKSYINTNTNNNDIYGAHPQSQINFLYTKPASLTQYSVGLS

SEQ ID NO: 974995 - protein, 535 aa, Homo sapiens
ANNWEQENDSLSTLVVIGHARFGQVHHYWPSDAINAAGIDKQNHLTTHSDDRDGCLTHWRPRGSLSHGTAMGLSAINPCTTPCTPLHTDGYSTPLELTPLLCCETLSARIPRHTPTHCLHPTSTSATAPPAHQSSTHPLYIEDTPLALYTRLSNSLQRPCTMVSWLPVHSGVSCLPWRCLSRPHPLSHTPLRLPHPTRTLGGLRTPRTEPIAPSSCALSPPNPCAPRRTQPRHKAKASRAGSPTHTPPANFSPTLHTPNPPYQATNHRAPHSLRRDNHSRPHPRTHASNPHPSNHLPARRHPPAPAASTHQPPPQATPPTATRPNTHAPSPPPLPRTLLAHNPGPDNHDPRRPQRPTLTTASPSPPTPGPRRTRPTRDRTHTCGNPRPLTPPGPKRRQTWPPRRAPLAPAPTPHPATDTTPRTPPPSQPCPTTPHAPPPPPLHAPTTTACDPRPHPPTRPLAHPVTTRHTGAHPPTPRTAHTPTPPRRHPRTRPHTLHAAPQPAPLLQQPTHATRPTHTHDPPHRHTHTHPGHRP

SEQ ID NO: 974996 - protein, 183 aa, Homo sapiens
MSGTGAEAGRAGATGGRTEEAGGGISEEERHSYDRQIQPDGDIGGPANWLQGLIVVASMIGIEIGLWRLENLLNESSFLGQAVDNGLNPIASDLTTQGKTPRRIPREDSEYTFGFHGDLWGVLGIGPWQTLGEPEAKDPPNRGRRCLTRDSYPNSATLGLGNSLDKRCGRNLDAALITEAKCN

SEQ ID NO: 974997 - protein, 601 aa, Homo sapiens
LEPQVGTDVWLGAAASLSRGLLPDACWHEAPWVSGWLLLLLTHVTLPTPEPRGLAGACLLVQRRMHFTCVLSPPGHNNVVQMSVHIKGPDSDVAQRVSIFSKLCFRTIRPGHVTRPGGPNPAPTTLPPGHTSERLCRTHTYCASHTIDDSTEPLDETLPKAHLTLPALQRSDGTCLAPSPGTSQAITLHSERNKVPSTPPHTILTYHCNEDDAMEQPRPPHRPQRRTHGSCQATAPSNPQPRPPRAASHHQARTQTQHANQTHPTSEQPKEPASARPHRTPVHPPTPAPRTTHTHATALQDAHPTTTTRAAPPAEPSATQPARRPRTPTHPHPADARPTTHTKEHHTPPPPPPPHQHRTHTRTPPSAATQGDRHARTASPRRTSQRAARHTRPGTRQTGEQKINSMRGETKGRAGATGGRLREGDARDGTPRNCEGCTSARQKRRHYTSPSPLTTPPTDPPKATNPPSSLSTYLTPAPLAEHTSRKSTQPLRRITPNSHTRHLTPHSSATTHNHHLTAMHPGEARTRDDRRDPCRAPRQHRLESDGDEPRQKRRHAAAERPRGRRTALPRRLHGGVMRGAAAPTAAADPDDGRRPTRRREG

SEQ ID NO: 974998 - protein, 337 aa, Homo sapiens
MWEGTGKTCGTQGERAARAQRFIGIRASKVGVEGVLFRELQKGSDRGWFKIKHKFKLISELCPQFSNGVTLSGRGSWPILRGTQEAPPVAFQQILSVPSLSTFVAKHHMCCAHPNHFESWRSVHDVNKPCGTIWVLGSPSICAMWHKKCQEPDSAYRSEGSSSFQIFSPIECGLWPPVAHQVGGVKLTTADTINPGNNSGEQPGTLITKILEDITQEGVWGRHSYQESLHILTGGTPPGNIRALIWANGPEGHHGHQAEKHNGGPLWSPLGGHHEGERSDTNESTKARGGCHHQEGQPCCDVIQPDEYKQPGGGREATEKAATRDWTRVRGAKRGKN

SEQ ID NO: 974999 - protein, 348 aa, Homo sapiens
MYNLVPHDAIGSTDAPSNHCNDCADCTLHGLSTLTERAYDPRTATSSDRRPGNHTTGQPTTRTTRHGPSATLHATGTHSHTKRRESPMPPHLRTLRYASRATGPLTNHAASDVTPLIHLHHHLVPLSTHGTPPKPLTCALRPSGLRRFLTPASALRLLTTSAPYSPPDHGAHSALTTRGPTPASQDERNPPDATPHQPVTPKRLAPNLRQRKPPRRKQPPQLTDCATHATTHRPQEPSTHMKPRGPLSHAPTSATPTAAPTQATCIPKRPHPRQRPKRRTSPKRRHTTRHPPKHAPRRRYGTPHEANHKRTTLPRRPPRTPSGDTKPQANKATGPHNRAQAAHRTQQA

SEQ ID NO: 975000 - protein, 358 aa, Homo sapiens
AVGSLLLHGPGQTAWSWSRLSWAPQRRSCTDLDLTSQQGGAWWKRVNTLMTLQCPGMEPPSSCPRWGSPSSRTDRHAGPDWRSAMPSWTDVRTVVWHLVRTTDEVDELASPMTLVCVDKTNVTRTERAITDDLRCRGCSQLKAPTADSHMKDNISIHEALLAAMWPQLRAHLDKYKVHFFGTILGTEQLQTKHQNHTGMTAHPSHLLATHTDTKYYRLPVLGLEHTSQEHTPTSILLDSALYQDGRVRHGYAMVTVHNRTQGNITRGNAIVTSRQRVATHTLRARQNTVPETRKHWLTHARETLSQRYTTNEWMRATTYEQRHYRRHTELTAKQDPPDDDHRHDEGQRKYRARPEATT

SEQ ID NO: 975001 - protein, 183 aa, Homo sapiens
MQEMCQHSPSPWWVLNTHYTLEEAGFNPPKVAPPKRICKKAAPLITHLRGKDPLWGEDNSRNDRHWVRGKPHIITHIHTTPCRTKEMHTAQTRDMVSTPHSHSEDAHEVTNNNSRRSTATTKEGDTQQHVSCENEANSRSTTYVHRLLTTIRRKPEDRRSTRTVTHRCINYRKDEINPHPTQS

SEQ ID NO: 975002 - protein, 108 aa, Homo sapiens
SHSVSQAGMQWCNFSSLQQRPPGFKQFSHFSLLSSWDYKRVLPHLASFCIFSRDRFHHIGQANLELLTSGDLPPLASQSAGITGVGFKFLICPRVNQTESFGDKGFLE

SEQ ID NO: 975003 - protein, 400 aa, Homo sapiens
ESRSHRQSPAQAEPELQPELLCGALSPCPLVLLSLICRRLLGNDPGTPGQQGSEAVWEMQRDSIEERLDMAPSHFPECTVVHTCHQLAAEQCEGIGRTGLGHLDTPTCDHTSDRHSSEQHVRPDRTVPTLFGHWEPGPTAIPLVARAATPRMAPLQLLDTPHTLEPRFLAETPGQPCEAVPEDNLYTTRHSDPGRGRSTGQWLERPMRLPELAMTAQRLCLSGANTWQGQPAPDLAPLRYKLNLSTYINTTAEQTGLPANMPHRSARQESAALTGDTHHRSTRPQLRRLHCPQCPMASKNCDPTIGHTAQQDHTPEDAGPACHPSRTRKALGHNRRQPRRNTAPTRWPCEHTQSRAPTVGRHGNNRRHSGQANAQATKDNNNTRGQSESQVVEEQTRRVE

SEQ ID NO: 975004 - protein, 104 aa, Homo sapiens
MDQLSYDNIGIRLSWNKIKVSLITCDSYFGYCKPIYTFSGRQKTRDNSCASQGLEAVVPTGAEEKPSLPDAVARGGSCGTAGERGQRSVLHRFYYLCFSLEKDK

SEQ ID NO: 975005 - protein, 181 aa, Homo sapiens
PSTSARAPGIMDGRLLPAYWYFVCALGMWSLVFMVLQCSLPCYLLHGQHWLLLVVDLVNVGPVLPDAAGGPETAFELTGDNYTTRIMTPVCDDGTPYLQLTRPDIRDPDLTLGKPTQQPLYPTRDLDAEHIAMTIAPTGIASHKKYTHITQEWFPSQPSVLAMSVATRLPVMRIASPQASN

SEQ ID NO: 975006 - protein, 346 aa, Homo sapiens
LLTRSPARTICMPSRTAEAIADFGRWQMFMTPCDPGQTLRLVVPVLVPEQFRAMPYQTVQQRRSARKGCRLDRSHIPRSEVHKYVLLSVWWWQSNMLLSMRRMKVASSMVDTETHTEDGLPAESNEIMTTRTLRRDNKIRSEHDTQIQPAQSMPKSCNQTTRENAYALHHNKSKKPKKEVKARTWTSDTPSKPRRIKQTERTDVIRASEQRAKANNHKEEATRRENRKENRRHNDNMKRRRRHLPAPQHKDTNHLPHKEEANRQRDDHTKKHSKQTRNTPHMQKPGQHGARRDKKNPHTTTETRPTTTDTTSEPTRQKKSTPDTRESKQAEEATENTATPTTKQRT

SEQ ID NO: 975007 - protein, 114 aa, Homo sapiens
GYFVYSSMADCWLLGGYMSFDFKSEELENRLAIMYVTRHACIMHICMQACMHAHITPRPLVGQASYAGHRYIKKFLIYRLSKGIGLRPITPGFSIYWNRTYIFPRLALSHTTDT

SEQ ID NO: 975008 - protein, 257 aa, Homo sapiens
MEVEHYHSCVQLAPDAEAWSELVATVPPELVPGGPRGVAGVAGLLATWSTCAWSGNVTGAQLLEPRYVANAAPCEDLAAEDARALKIREDAQRYDDLTDYAVSEMKMGRYWSKEERKQHLIRAREQRKRREFMMQSRLECLREQQNGDSKPELNIICPEPPQNMKKRNKKILDNLDHHTGDAVPKGARSAMRSGSQPFSQHPPGQLPGGTRPGPGEAPLGAPGAFKSPYRHMAAIAAAVVRQARLACSSRTQHFSLE

SEQ ID NO: 975009 - protein, 214 aa, Homo sapiens
RGVNCCRRATIMPGHYTGMASVLRGHQPDSTSYLTTNRDPFAGAEVQQRTMKKWMPGVVAGVWGALWCQDAAAHVPAAQTNSNAGMCKHACCNGVPEMTCKNPAMPPSCWAVVDTTEEHAAGPVAAYRTDSAITDCVRKQDLIQQTFQRVDGATLHSCYADDPSKQGGHTPLLNPCTALPTNSPTLQPTKRLPRPVRTFHSLITTRTIGPALIG

SEQ ID NO: 975010 - protein, 296 aa, Homo sapiens
CQGAEAQVQHLSNCAHDADCRSPCHLPVNAAPACTVPLSVTWSDMDSQVLTQSAQLAACDLVLPCPPADQLCPLCKVVVHPGPVPPVTCGKAYPIQAAPPNRLHTCTPTACSEWDTQIIGLFLAHTYPKHEMGDSHPVTAVQELTVSLEQLAARDRDRKVTDVSMVCQILLDSLDTTVTTLDLVAPQTLPRTQKGPKRTYDLGNPDSNLVDKLNTTGGLAPSAHDASTKRHTKFSGLAMPNCTSEPTELDTLAVQAPLTTGPLATRNRRLHGILKAERQPRETRPHGRHELTSYDR

SEQ ID NO: 975011 - protein, 139 aa, Homo sapiens
MGVRRDLPAGVSGSLLIHAVTTRLSGSVLARRMDDQWYVEPVVVVVRSCADYAWWLILAYHSRDPGLINRASPTGDHSSSACVALRRGKCPHPDEGAKFIALPGGPWTRACTCVSVQRSFVNDGDVPDGLNLGCSSERC

SEQ ID NO: 975012 - protein, 84 aa, Homo sapiens
VEKQTGKKDKDNVSLTKTPKLELWLMAGKECEGAEPASWKLPFTCWAANGEQNGLGHMDLRGPCLSWGSTRGSPRQERHGPEAA

SEQ ID NO: 975013 - protein, 126 aa, Homo sapiens
ALTPLIPSTVEEVLLPGSVEGWERSACASSMKGRTDGESVFLGTSMKDLVRVRTIRAANSIARTVLPSVRCPCRLHGPGRERTVATLANQRANQPAEVRVVHHCLTRSHHIRSGCGSLVWEPCNCT

SEQ ID NO: 975014 - protein, 241 aa, Homo sapiens
RFTCCQRHLASTGSCFPEQAAPPGAGDPVGWGGCGLALAGADRVTVLLAANLTWQPQAEACWSLCACAGPGQPCADTTRTSSLASYRYSPDCLAQPAPLLRGLGSLRNFVPGVKRYLRLKLLQQKAVLLVATRLPKAQLQYALPGQLRDAPCGAGRSPSVPREELENTGMGRCAGVLFLVPKAAVRATYSRTVEQEAVVADFRQLCKRELLDWAVSCASGPVDFMPSSCSGLAYCLTLLGL

SEQ ID NO: 975015 - protein, 344 aa, Homo sapiens
MWTSHHNLQVHPCHSLLMLCQLQCDPVCCDTCCTCERKRCDPVRESQLLAGSKPPVYLASVRGTAVCTPGDSVRMPVASNVLLLSYNLVISSTCGRKASRRLMHGAQVTRLLALDNIYLTRMHWSNCRRAYCATCLLTFTSDTRCFQQMCTYTRTTPQHGTIPRSPHNTNFPGSIMNRNLGHWLVRAPTLAQEIRRMTTIDSLPRFPYTRDHDHWRNGTHCHWSNIPESVPPYTVGTVPARVTFYQLSNLAFPTLDKNLPHMYCTPITAGTRCTFARCLTLSQETLRSIDQEISGPPPAMEVCTIATLYVPASHLRPPTNNSSEQKTQSTHHPSSIPRHTSYSN

SEQ ID NO: 975016 - protein, 41 aa, Homo sapiens
MGTGMAAMRTTDGQGIPCKEAAPNVAREPNGPYADASQFSG

SEQ ID NO: 975017 - protein, 324 aa, Homo sapiens
PLLSFYALKNQFKPPPIVKGGRDKRQKRHKASWEHNPFGCPRSFFALMWVWWFSTLCPVCDWGRVGGWRLRGGLCHVSPLCDAQQGDLEKALARTCGLGGPGADPPQGSVQAGSGGLAANTGSSTPRLFQRRVSERSAPTESTVRTHPEHDPLNSPDPTQSETEGGSNERACCNTRNDECSHHHGHRGHREFETNQLPSKQTSDASNHHHHQPRGKNSMWTATTPNTKDVRTTKKSDQKSTSEMEPTTRRDTRGGIRTATSTPQPLQTSLEHTTTDAPQTRSSHGTDPGQEWDCTPADTPIGIGENTEQRPTREHHRHARRHRR

SEQ ID NO: 975018 - protein, 229 aa, Homo sapiens
MADLPGRVISTHLSRKPWLMETEKKFGDTLKLTGQKIEKALETVDATDVLSLLDKFLIQTCNCLQYESKVSYLNMTGDSYRYLASSVASARSKNNSVVEASDSCLTGKPSTITNEQMHNPRIPSAGPGPQLLPCSNYEIQNAPSARLPLKQNTHRMHAILSWNTLHQRIPINAYQLNHMLHEKHKYTLDKDKRMSKRRKRVEDLTGHATHSSNTTIVQELIAAPKNNRA

SEQ ID NO: 975019 - protein, 116 aa, Homo sapiens
MTDAGRVSVTSTLENRGCSELGRSTKSAQKSSRRLRSSIIPYISCRPQSSIEWWTKGSSRNVSSHRATILGLRDLRRSLYLINPCLRTELHKGKGEEVWGALPDRLGGRGGTDKLI

SEQ ID NO: 975020 - protein, 571 aa, Homo sapiens
MLRSDAAPQWIPSPLPASSPLWTGWNVKVNDGDVNVEMTCDQHITPTKQDAAGRTWAVYSSDRRTQGPQTHSRTIHEQTRQTKRTHARDSKTTDTGETSTSSKEHNEARSDMRVRQRLIQDRRRVEEHREHTTEYDKKIVQEDADDRQSSISMREVKQRQTTKKETKRSKEENETKKRRAEEGQEQRATRERSTTQRRTGDEDHSSEDRDENNRAGRQAERAERQERQTSRQTDGEIAQRGGGREGESARRGRDREQREAHKGETTTRRDSTDEQKKATQDERQKNMTTKSRETTEKHERQQGRNEDRHDRRASEGAKRNIRERREREKTEDMKSRKQELDEEKVEGRRAESAYSEEEQVRRRYETEKDEEHRDAQQSQRKATSKRKDRAARAPRREKKNEQMSEHQQDAHREITDIRGHTRTPTRRRERATSDSQRGSSRETKQKRRRDSATERTTNNQRDTDKTKDRTEDRRRRAIRYADDDRQGARDSERKDEDAQTRRRSEETAVSARQRDARLRMITNRVATLLKQGNRDRTVHKYKDHDGHYEQKHSSKAEQQAERRARRGVDAK

SEQ ID NO: 975021 - protein, 485 aa, Homo sapiens
AGVLAALRLRTAPVAGTFVAADAGCPALAMSVLALPCVLLCCANPGLECGPVPCVWPSSQACCLGLMVVLSAAPCLAASFGAIYTCAAQQILCCCLPAACLGQSSFRICPQWPLLDPASIALWDGLGVHLGTPQDKGSPLSGSRPSSIAWRDRVRHGLAMHVDGDIEAVVPKCPQEHLRKLLKWVRQEYWHRATPYRTGLPGRETKNPWTPQIPPWDCIPYFPLGKTHLNTQEGTFNTGTRPLTPTKIQKPYERHRQAIRQASGPSVDTSKGPHEFGPALDEPTIPKGDHMTLNGGDSILDTWGDILATTNIPDRTGAFRIGGNPGVFQKVTNVEYELSGGKRHPYEPQNGEPTVTTSHITHVRHGPRTEERGNQMRQDRPHHRRKKARPKDERCSSPRKGHVQVPLGRGHQTPRRTQKTSQAQRTRRNNKASHQHRGPKSGHRRAPDTHKEKKTAKHRKRAQRKEDGQTENRTHRKREKPRRAT

SEQ ID NO: 975022 - protein, 172 aa, Homo sapiens
PGFGALGAGAFLVSASPCRHGKWGQGTPHWIVEEREDGTNVNNWRWRGGGLLPGSGEWPVCLLGAGAAWGLCGAAGQGAAPLSCWTQCSAFASRLGRVLEYGDRLGGLQLPLFDTSGWGPRVTFRQDLSTPTVCGLRGLPLLRSRPSPLDVSAELRREPGFERRVVTRSGGI

SEQ ID NO: 975023 - protein, 433 aa, Homo sapiens
ELDGQHENPVDILIMDDEDVIAMSRAPTISLSLRSPELLPPAARPGRDSAIASTDRNKENQSYWTWSCDRMRQETASHYALITYANALSRRSNRIPIASSRNRDREREHEHIRGISSKHHLDIAAVTTDTALATEPRRRAHTEDREDDRAKNTDAKPSRGGRVDTGTARRHSKAPRGGNNTATTTHHPDTKPHQEKALDEATRTQQPHGTTPNRPPQRKKETHRDGQQTRQPHGTPNARVPPNPNHTRKKARNTKKRNTAQTQSDKKEKNKRTREGRGRPRNAESIQRHAHRPRITTACGDPRSTLCEHEMHTKRTHQTRRVAHHHAPTSPATSNPARNKTTPKREDARRRSTTTPKHESQSKNKPKKQVQRRPPEPPTKTRTTKPHKPHTTDTPKAQSDRQTQKKATTTRRRKDTRGHTTTRRKQRWPPRPQ

SEQ ID NO: 975024 - protein, 421 aa, Homo sapiens
PGSQRGAPGPCLAAGIAAAEHEPSCAWMCLVCPVALMPSAGSAVPLLLVLLVGVVALNICASSGVECDVPCPSCRLLLTLPVVPHMLPDPLPVPHSALDGRLCHECWDVMLVPGMIHGRTDGPRQPAGLHDMTVDAQHDQQTAWPRCQTKKPWTLPRMCPLRQLRFRPVTDRREHVSARLTLNDTVRAASTALLLQAYLHRADSLANSRPKGLAARKTQQNVSWLCRDQLDQGTTGQVAWPSVLPTQAQDPRQRVLLKTHPFVLFNGSQLTSPITCSQGCREGASVHRPSNWRIQVTRPRTQANRRGPRFHGQSGVLAHVVHQGSSLELGMAYMEGTPKTHSTHAKTNASGIAKKTIGATPNLRTTQDESGPSQQNRKTRRSHKREHNTPDTPRAQRSKHTTRHTTQQKNRDNRRETPQHR

SEQ ID NO: 975025 - protein, 147 aa, Homo sapiens
GCSGLRGLGETRALQRQTDAAESSAVYCVAGSRLAGPLSCQGQLVSGAKRSPFDATQARSLAERDGDRGGVIGRVELERSRLALRGTEPTELLRVPVDRCHRRGKDRDWLCVEVWPASCGVSRRAMIKGTSFDVIVYLADVNKGIRA

SEQ ID NO: 975026 - protein, 246 aa, Homo sapiens
GLDGDRLIVHRVSRRQTSDGLDKSLASCDPSCRPLTMVLDSIIGAYRRCIVPIEIRGTDSKHAIKDVLIETRLVIDHRHPGYLSELFKGTDGAEYPIFNHSLAHDNGCHSPCGTINATMSAHNVVPRKKPSARDLCQYDHKSLGIINAVGPLTMGVINEAQYVTKKAQGTHRIRHVGTWGIANTQRDTDGTCIAALWCRGKAPSGNQVGPRNVGRAPHPKPFDLAYARLDHRDCFANKHRFLRDPM

SEQ ID NO: 975027 - protein, 362 aa, Homo sapiens
ASGSVSELSRSFSGRAGGGGGRAIYRSRERGAAGLTSRESCQLDSRSESHVPARSPDQTQAAPMGATQTTSWTMRSLRAYSWRLSSAPGRLVLAAEVRETCQTCETRSCALREKIAAPRLATTSPERRRQAMDVQAGVPGHGPRHQAVENITEDVTPMSEMASISMGAQCRMERTRADTTDCRRATGQKNETPKQHDSDRRECATSRDLEQMHGCRLQVKQHSDRERKVDLGKPGQAELVRNPDSVSIGCMTSLRKQAKQQYKLAVTLQRITVTRNTQQEQQKDTNDAGPAQDHRRPTAEETKKGSHTERPTSKKNRDHNEHRADKNSPQNIRTATHDNRNKQEDKKTRQDNNKNKRKETVT

SEQ ID NO: 975028 - protein, 236 aa, Homo sapiens
MPVAGGPSAKSQLEDVPACVSQGPLVPLPHQRKVRSGAHLTMGASLCDLRRRLSSTPCTWHRRAHMAGGELKSSQPGPGWPSVLGVLWAQAPPDWCSPSSLSKCPRSEYEHSMPAHQSSCISVRKGGRGYGPATQVRWCEETSERQLWPPSAAKKLASAPRGQVWGHGMDGAWKRGPPWASPRVVLFLATLGVGCVAVDLCLPPGGFQAPKFLSQGPRAPLFWDPRSFLSQRPWVP

SEQ ID NO: 975029 - protein, 510 aa, Homo sapiens
ERERMGRRTNAKKSGKRESAPARSNNAQDSSSAAVIQAAGEANSAQHTWQQATNTPTGQFGTICKQPQNRRQQQCKQQQALWLISSRYTRNSDSTVRESISSIRAQAPRQQTGPRSEHPRVGRTERTRDKTEQATLLQAPKRNTPAQTNKTLNNAYVHITPNNAPQQKTRHRREQYNAKTTAPTRLSKQEHKRKQEKPQNRQGIQGDKDARRRIGEQQGQRHVTQRKEKQQKKTDMKKHNRKARKEQKTAKQTNKKRKETNETTTTMPNQDNRSNIETEGSRPHKGHNTPHNKRNNTHDEKKKKQENKKQKRTRKEEKQKNGDRSCKDTADNNKSRTEKHKTTETRDRGRQGEHAKREQQEGQNTKRSSEQTTDQEKARETPDRTAKKEKHGRPESTRAAPRRKNTQKAARKKSKQQKEEKRKRAKNGKKSRQRRKTKNREQKPTGAMNMRKRQESRTDTEEMTNSNAQRNRRQRETRRGEGKTREKRRHAEEQRTYKYTQLYNTKKANR

SEQ ID NO: 975030 - protein, 384 aa, Homo sapiens
AEREEAQLVMLAAAAAAAAAASIADTLVGLEWVVPIRTICQPETEVKKKTVQPLLPVRVLACCIRTSGHKENCASDMALISTPLNQHYSEDHQTLVLIHGTQQTGSDDHIPQAATHPSQHSSQHHQNSEESSNTDNHGQHPASEHENQKPTSTPYSTRTQGPTKVADLQGREAPEALTRMPYHACHIEDPPGTNAHRHTDKQLASRSKTQGINSLTAQQHQAAHSDQSSRRARQAHGLMTRNKSHSSRQSDTPALHEPRHATQYSPNTSPQRKNEQEKRPKPNAQQTKQHPRPPTSTTKARTTKEAGKRPNHNAPHTHTHHGTRTPQQNNTSHPARALTTRSSATETTHNLTREQIKQQKQKHDTTQHTTASNRANQRRNPQRT

SEQ ID NO: 975031 - protein, 154 aa, Homo sapiens
MVGQAVSGTPGPQVIHPPRAPKVLGDNRAVEATGAGPHLTNLGSRGGMSQRNTMSPLSSKIISKHKKSWTDWGGHRDRTSSNPEHTSSEARGPHEDGSGGVQEEVPAAQAPPIVIVPGGETTAPPRERRDLLHHQRWRTPKRYPHQNRDSIADM

SEQ ID NO: 975032 - protein, 281 aa, Homo sapiens
MSPKGALLRPPNDLRTSPVILTLHCHKAPHTRPTSQHTNHMPMMARCNTDKADTKGHHTHYTCPKNGSYRIAGVIPDVYVTFKNVIDYCRHGIGYLEAILLPHSHDLDPHIPAQLYARDSLERLISETIYPRRESPPENSRTLLEALSVISSSIIGVTQIDLRETQLNKIIDLENECVECMILSGDVFSVQCSLLGSLILPLLARPSEYFVVSLHQFPNGHLRLSHVWYAIMAFTGGFHVIIWSSFLMICFIRKVNISLYIPKDHCWFESRRLILGFVDGG

SEQ ID NO: 975033 - protein, 403 aa, Homo sapiens
VSSRIEVDSDHSLWLGTGDRVRLCWLSGKLRLHVVVVSEDVVARTSNSEQTNLLSDLVCDQVYSMCVVLTICQPGILLVLGGMHLAQSVSGTEPCVTKGDAMIMKKHGKIYKTRHRDMTHRSRITPKQHNGYTYTCVCSPSTPLTERPGLYTSRNGDLCETTLTLGRSNERLASNRLTVSSHYLSVDCNSGRTQVTKGRQRKQRNRPAEPTVRSSTLAPNSTGQTQQTPQQHNHGHEQPDNHTARPTHNTNMHTRTRHGIGGQHPAATQTRPTPGETQPQTYKNTPRSQDERMTHRTTQTKERPIHPRTRQTTAHKKTDSTRRQTETRITNAPNTTVRQPKKKRTKERHQNGRTENTDTTQTDQQARKNKKRRRARPSAPAEGTTDEAQRTNKKHEKQEKNKR

SEQ ID NO: 975034 - protein, 37 aa, Homo sapiens
MALQGEVGGHQMERLFAPGVCLPRQTIDILFCRNIGG

SEQ ID NO: 975035 - protein, 403 aa, Homo sapiens
PRAPMDAAVPPRPRAVWPRASACLMWGSCDGREAHHPVPHVLPGAPDLSLRAGGAWVIPPDQLYPENHNAVSHYPPVFRSMSDQRMHAWCMLSIYMHSSVTLAVGLEEMPLEACHYYYQNQVHQWQGLPQIAIAWHLRRSTCICFPVLKAASSPWNLGERSRPWTVTTHCDACENLSRMCDQDMTKPGPRPFPCKEGCITGPAVAESGAGPTGNHTAEPRGHDGQQTAPNDTRRQEQRQGRRDTPYLAPAADPDAPHDINRSSTRQKHTDTKKTSMRSVGPREREETAQDTNYVNTRQEERNNKRRTALRTHGRGPPPNPIMTPRKRTRRPRTANHGANEGEAKSHEAQQDEEPKQKQRSTKERKEKKAPNKKKKEEEKKTARTEEANKQKKEDKKTTNAQGN

SEQ ID NO: 975036 - protein, 475 aa, Homo sapiens
ASCWVPRSRMCDYLGSNLGAHSRLRLNAMRVHESEFTWGSDESSPRSEGSLTTHRLFMSMGHRNKTRRVMVHRFQNKAGDVQLNALHESRVWSLAQFSDETPVSTGGEVCRGDARACIHGCKFYTRILIISISDGAGWREISLSHGHSGVANSECETFGLARGKFRGGGGTTANKEGQLVYAKGTPPGQERNEPRQLRKGPLCGHLTCGRIGYAPTLNCPRNRIGGISIKAHVDERQQGDMIESSRARIPVWGAIDIAAGHRERSRDGRQLSSWKPRKLCAQDKGVQCPRYKTFFPNGKAPMGAQTDTGFVAHFGFPMSFPKQGDPLSMNIGAASVHNTNVLSTMAVTHFADRTHDRSYGAHELSLRGVSARRDSPPSILQELCRVSLPWETPYSTKATGTCPNETPDSIPPGGATKGEADGPTHKHSHNHSNIRVVRRNRTKRHHTSSDDHDHDEDRHSTPHSENNSASNNQHR

SEQ ID NO: 975037 - protein, 179 aa, Homo sapiens
STAPLAPAAERRLCERQCAAERARGSAVCLYRGLSRQPGAELPPAWARRVTTQYGGNTWTVHTECDPEGNWNACENIRFCRQYLVFHDGDSVVFAGPAGTVWRPWWELLSRESPSGTMKSCAAQCWRHGPWGREGSILEGLGEEPGRSRASTCQRWRNHGPCFIDGLTCFGCHVLVALG

SEQ ID NO: 975038 - protein, 135 aa, Homo sapiens
MYRGSRRCGRGGGIHIVTPGLGRVLSTIRTFSLSKQKASQIMKIINITAVEEMNEPTDDRMFRGCIASGIAEIQLGSITGIRPQTVSRRNTKLDSPPTELLPQRTGIRERTEGNNGVYTMQATTGNNHADSEAPT

SEQ ID NO: 975039 - protein, 79 aa, Homo sapiens
QVVRNAARREDRAVSLQPPRAVTCDLDPDSLGSARAPQARSGGRDGRMSGGRRKEVAASSAAGQRGPSKSPSGVRCCES

SEQ ID NO: 975040 - protein, 242 aa, Homo sapiens
NPSLSFMALLKKPNKTPPPCVKGGAGDTKRQRTDTEGTAREKTTQVVAPETLTRHSGVGDLRVYHTSLGRGEASEGREAREGVEKHSAGEAHLRTKKKTPSGEKMHREGAPCGTHKAPHMVQRETWGIHEGRTKGGHRDPNRETTSQRTREQKRERERVYREQAAGPSPTESSTNAEVSLLEERDTTRAAVESTTWRNGNREKALRQRKTRKQGRNTQKRDRKTKNGRQPKKKEQEKNRRDI

SEQ ID NO: 975041 - protein, 260 aa, Homo sapiens
MAEVLCPGAVMVDALSWADWRSSWLHRYCCAANVVALYAAEGIEYILGLHLLSTTDRVREVTLVPFLLPHTRDRNTLNSIAREGLDYAACTRHTSADYSIMGWILVRVYCSTLSKDASRWTHGSDTGPRLARSLGLRDRQRRPLTTIRRKCLEESGVTYASALRSVVGVIDTTVLDDIVCSTLVRVVLDSNEDWLVKITESIDDQITAEGGITRRQTDERPRSRFKRVKKQTTINGGSWVSRSVRSNVAASTLLHQIILV

SEQ ID NO: 975042 - protein, 344 aa, Homo sapiens
GQSTTTFISKREVRCSRGKKRGGSSFPSKGDHGPFHRGQASGEQRGPQGWQAGGESRQKGIRGPGNAIGPWRKTMWSAPSLSHPRGRPGTVGRGGRHATEDHNRRAGLWRLREDLRDNLRRAPVKTSVHREGGAQIYSHLGRGSSESSISGFGPRMVRPLKEEVSLGKIPHIKPVEGAFMFTDSYFLLSTKIAHTFSSKQGWPEAGEDKGRAQELRPKQGGSRGPRKCNTGGRIPINISPKGPSSDAKFLHQSIRRTGREELQSAKKKFWATPSGGDHTERTQGDIDNTPLEEHTQWPKRVHPAGTAAATQYVQLRANWAQGGRDTPQKSTQEPAQEPARKHRK

SEQ ID NO: 975043 - protein, 239 aa, Homo sapiens
APVPCGGREGAKSETRACTLVCRRNGFDRYVCPRAVLFVMECRVSAVSNEARGRPSVAGWVDLPSVGTGCAPGVACVDVRRSVDVSYAKAANVRGCAVIYTLENSEYRMLAERSARMFRTQQLLSGGRISFARRSFKRLPSCAVVGELGRPKGSLSLERYAREMRQPPRSSVQGPAAGLGWDSLQELFGALQQLWGSRCFEWAARSGHLLLGDTGNFYTRLTRITGPRVRPRSLDYRRT

SEQ ID NO: 975044 - protein, 255 aa, Homo sapiens
GLVHVRPFPGSPTAWRPAGYVSQGTRMSAPLSECQVPASVSRSARRLERTYQRIAMVTVCDNYVRVLEGSLMVVRAWMQDGLSPCFFFTLVPSTRMALGSSGTWCWLFPADVRERPLVLIRCLGGPALASLPTCCSCFWRTLQAALPWPGLAGPGWALPWGAPLPRLSTSGLRAGLSLAGACGLWLLVVERSQARQRLAMGHLDPSSGTSPGLLLPLELGLFAAENLAPGVLEPAHSGGGQGRLGQHGQETGVLR

SEQ ID NO: 975045 - protein, 99 aa, Homo sapiens
EVAQGPPPAMDERLLGPSPPGGGRGGLGLVSGEPGGPGEPPGGGDPGGGSGGVPGGHRGKLEDIGGRFVLGEIYDASTDLGAVVARPQAEETRPLKCAA

SEQ ID NO: 975046 - protein, 198 aa, Homo sapiens
MVAMRIIRGCLKWTERVHKLEAQSYSYAKVPKQFGGTPYGVTYERLQMTANKTCVSSKEVARKPADLPYTSRLSSTSSTETIVCIRHRLSLRIVEPTTATQYPMPLLGNVVRPRAIATFIATTQTSKGLKALLFTFEVPLHAVHGVRRQIHRAMQRSSALVKGSAGNVADEKKKAPKEERSSITEKVLKPHKGQFEDA

SEQ ID NO: 975047 - protein, 122 aa, Homo sapiens
GTVSSRRCIHRPSGGGHETGTTQGCPYVHSEVRLSRVGAGPRGVGLMGERRAAQPQSCRWSSCPMGGSVIAVCALACIAGKEGGQEAYSGYGVKRIDGPSVEGLEETRAGPSAKKECHMIRE

SEQ ID NO: 975048 - protein, 279 aa, Homo sapiens
ERGKSFKVEKKANGGGQGPKTQPFSGCPPGPVCRGQSLACPKPGGPEAPREGGGKKVGGWQLSPTEYREETNRGVVELSLVKNPSRECGIHEVLQNLRCFSPSCSGKPQGLLSRVDTVILCHQAGKSIRGRRSDIGKSSGINLRGVMDSSGSWDHQGESTTPSYGSPARGKVHHLGRLKGGQRVSHSDRHTSMEEVPTKRMSRGGPCEAPPGEVAASGMSTTQGPSPFQPEKFSTERGPVRPQSRKGSGPQRKLGQSWPATRGGQDLGITNAPNPRMGQ

SEQ ID NO: 975049 - protein, 376 aa, Homo sapiens
QHKSKFRVVVEEVQVVELKVTWITNEFLSRGHGRAVQTRHLSVHTPDGKPRTVVQASLDALTMLQLAALAERWSGIVFPAQGQSHARDCLVHMSSNIQLRHRGEGVYAPQNGDSALFEDSMVCRGLIVIGSPRRPSGYPGPVSMARAMTQKGESKKHAAKRESAQNLRRRPMALTVQWRCRDEGAEEPHEAGEEMRTKFRDKKKAEMTGCNGRDKTQMMSADDEHGRNSTVTYYWTKSQLAPSSGSDKSRQQEHPVDNQGLKSEEKEQKNQITENRKRRTEAIEVYPEQPGEHDGEAERDDPATREQTTETEDKQNTEKRDKNTKMQQKPRTKKKNEKGNNSRQQKHRQPREKKKEENKKTKAYTNRQQEAKPPTR

SEQ ID NO: 975050 - protein, 187 aa, Homo sapiens
GDTGAGCPVRSPPPPRPPRPGWAPPPPPDPSPPGRRRCARRLALKPGPSRAAVRPAASPPAHPGRRRAVTSACRPYPPASGCVLLLLLCPAHVGCDCGGLWAALGYGPYQHLAGRCTGCAWNRAGMSQSCCHGLSLRKCVAEATLRGARARGAMSASSKFRFLPLGNLSRHQQRLLDCILQHGQSGD

SEQ ID NO: 975051 - protein, 102 aa, Homo sapiens
MSWSWDIAPWEGKGPEGWRGKHQEAIRAAAQLGNFYLPEYLRNATTVDDGVRFFLVTSESGHSTWHIPRALEPQNELIPVRGYCLPRTFHGGLWCGNKVMFK

SEQ ID NO: 975052 - protein, 276 aa, Homo sapiens
MGERVNQQGALANAGGGDTDTHEWHTNKHRDTNNNNRAARGNAALRGTPGAATRREVPADNHMADCGHGSNKQHSRPYTERTTRKSRRKRHNSENTNKDNKIAHQHQQQINTVDDLIQSPPTAKKNSNLKKRTASRAPTAPFTHTTLSKQMYDEHQTTPSAKTSKPTNTPSLLAVRNTNSSHHHNSLITGDARRQRRLTRYNTHPPCVVPAGGPTRQTHARSTPPVVPTPVVTTHHLSLCSPTSQSRPPYSIYHSRVASPPEAIFQLVQIDKSRHT

SEQ ID NO: 975053 - protein, 143 aa, Homo sapiens
MCRKRKSDRLQALARDAVALAGSVQKADLAWKSAQGTRLGAWGEQDPSHRRASVITQVCHVPRGGEKKYEDMKQCGEGEEMEKVWLEYHADERVITWSCVWRKDQGLSIMDVRKSWMRVIESDGKDMLDRTGSAHRLNQWLGT

SEQ ID NO: 975054 - protein, 360 aa, Homo sapiens
RARAAAQRAGPPAGALEAADAPDGCLGPIAERRGRDAEPLLWLLAAWFSLFHGRKRLELDDDLDTELVAVRERELGSGPLVPDCSALACCPVSSHRSCFQIGANLLVAICTSQSLWPLCLSMEAPRRAGGPTKAQQLARTGYCRYTLLKVYRLSEEARGTCEERYVADAPRHKTCVLGPLEVLGWYPVSSTPFSLGTHGDMHRLVRSRHVSLNLRLPCSSDRWPALAHWSHARSGSCVDLKPGVALSSLNVRGRSWCWRTGGEPGCDLGARMNFPGGHTPRVAPGQTCEPGENHGPAGRHNSRTGEPKFGEPGREGPLTQEDGRHTRYRDMKTELDCEITRGASRLVRPRHHQDDSGTTR

SEQ ID NO: 975055 - protein, 124 aa, Homo sapiens
MIHRQTTTTYSMSKWPQGALNRRTRDRDHTKKHSEHQHGHNTLLSTPTKERNQRNCKQGATEQPMALADRKDHRGTSNTTHRNPPGQEDNNANRRTRLQQHTNENINTNNNRDTHKQPTHNTQH

SEQ ID NO: 975056 - protein, 104 aa, Homo sapiens
QQEAMEATGTGDDGARCLGSGRETAGTVGQRPWVAGYPERPTGSDPGPGGRARMREQVDERKTVRSLCASRYGHGTRCGCVVTTGRCEQPWSHYHEKDMGKAAR

SEQ ID NO: 975057 - protein, 128 aa, Homo sapiens
MISHVVIQNRLSRSASAVEPAMSNICIAPIVICRLESAQRSPRIREVEFIPTVNHCRVAVDQMSGPTEDVTPTPYRRLVWLCCWGATVSLVRWLGYFNFSQGRGRNWSTLVLTGGYSRYTCRDFMNNW

SEQ ID NO: 975058 - protein, 344 aa, Homo sapiens
MGRLGALDWNGRLSTSVASTKPGGNVLDEWRRDNMRQPRTYQGGRGSLKSERELGQGIRSSGPVRGTPCEGGRPWWPRVTWCPSRLGAKARFFGTWYVSEVGHVPMSSEEIMQAVEHKSPIQITTRNAWGTNLVMNLDNMREFADWKHKTHRNMRLRRCQKVRCQYQCMDVYGDGTAVVARKVEGKTQKAHMETLEAPKRLDRGMARTTQLVETPEREQPESVHVPETTNGGQDTARVKGTARKRKQKEDRKKQTNRERQPKEDTEMAPSGPRRRSNGYGRNRQPGDTRRNRTTTQREEAMETEQHTRGKDGDHAQYDRQNRHHSKQKRNRGIKTIDLQVRHRK

SEQ ID NO: 975059 - protein, 345 aa, Homo sapiens
HLLSRPGDRSAGLARRPGHRAWWLPSLPVLCDAVINCCVMHGTTPVQTLAGSCAHAAVDLLCCPAGVPWGSWLGSSAAAGLSWLWSRLDDVTWLSRKPHLACNLRKVLFDPISFQKPLLKPLEKNDVTVPIKKDSETYTICEESGPFSRFKIDILKFQNASQEPNLPEKQPITRNGQTFKLRDILSPDMISPPLGALSAKHSHWQEGQTRLRGYILSIHGSLELLPGKQRKGRPGGRSLGLKGSLRCHSAPRAWVTEKHTRGGAQQERLPTLQAMVGETHENEGARQGDTRDEKRADERRRRADTRLRAEHEADRTEKARERKPSSVEILTDRTRHGKTRDGRRD

SEQ ID NO: 975060 - protein, 222 aa, Homo sapiens
TTSFTYEAVPEALDTLQACKRIPLVKPLSSEPHETQAVTGPDIFCQNWYRMAAHEASINCTVREKARCCVPGDDVPTIEDKNEVLDQFMDSKQLDPETVDNLMPTVTSHPSVMEKCAALERSRPGHCQEPCTCPCQVACQVLFTDVVHGFPERTIRDLGRKGRAVTLDYYSLKAVTEARGPPRRVPSSIYLQTVIRHQVMPALSPLTARAMRKRPSPHSPPL

SEQ ID NO: 975061 - protein, 128 aa, Homo sapiens
MDRYNRGTKGTRPPPTLGVPRGTRDSRGRHRGARATHKGKITPIRGASSIPLGGRHGAAVPKEGRCSGAPKRGAYLFHHPRGPRGGTAAGPPSHAHGGPPGGSTNTNPSGVTQRAPPKRGSHTRGPPH

SEQ ID NO: 975062 - protein, 206 aa, Homo sapiens
HEKIWFDRVLDMTTQKGCILRRQMNGPVVRLRSRQENGASVILRGGIASSPYRNIAVELLWTGKHQSALWGLQSVHHAGEEHEMTLVQSGIARSGTLDERSSSVVAVCTCELHAGRSPMSGEPSAVNRSWRYDALPWPTRGHERPAEPSTVSPIDSPMWSPLAKNARPTPGRRNDDGLMTIDLLMAVTMRTEDHGGGTACVDRAAT

SEQ ID NO: 975063 - protein, 375 aa, Homo sapiens
MPRQRDPDTATTVSQRLLPFANPEPITLAMAQAARDHVSTAPALTPRNPLNDQCTAELPQPLDTTIADHSKPDPPQNRTTPHTKAPHSSATRLIPHNKTSRTATQGPPHTATSPMNNDGAATAGEPPQDTPSRTAHIPTIPPWTATPPRTLAAPSPTHTPHTQPTPATPTTPLPYSTRLHAPNLRTPPPAPPPLPPTTAPTCPPLPTLPPTHRQPRTKQPRTSGHLPPPATDTRTTHPHPGPAPRKQTSARTLTPPQQDPTQPTTLQDPPYQPPGSSPSGTPRTTGNHPPDRATHHRHPRHTRSHTTNLRHPTRPRHNDDHRARHAPLHGQPTNSPNSRLTPQPPNNTSKSRTETTAKHAQHHPPYHTPQTTPLA

SEQ ID NO: 975064 - protein, 206 aa, Homo sapiens
VFRAQRMTGRICFAGAGRKSSCPVLCRWLSSYGFFESTVDASKDCRKSPYPRMLTDVTWKAGTWPNFVALRIEVLGIFACDQMRFIRTWCYVGGSRQYEIPWDPWTLDYMLTPRGRPFTKVKQCVLVQSGHLHNWAMNTGRSCFNVCSSKGILYQYRSASEVIPLVSVNMGGEQVAGLRGHKEPNTVCALILDVNFLPDSALPGNE

SEQ ID NO: 975065 - protein, 97 aa, Homo sapiens
VPLQCPGALVLLVPCCCSAPEPVRTDARVSDCHVCPVPAAVPLCVDVHCPAAALPVLPMCECDAVCCLRSLSSLPVLLLHLIFDDPLATVCHAPPVT

SEQ ID NO: 975066 - protein, 298 aa, Homo sapiens
AEAAAAAAASLPPFACRRLRAAASDHWPADAGWPTVAGCTPDCECPSMCPAAAELLTSTAALLLAGCCAQLPLNLACGPVCCCTPMLQCLCACWWPCAACGPDDWLVLNGTCLLDVLVLICLLLCASVTLHVLCFPCVPPAVGVLCCCPNASVWCALLPLMVCWLVDGCLAPCWLCLPDAPLDRQPLYQVLTVLVSLLCCQACWPLAMSLCEAHSGPWPPTACGHCGALYAVLACLGGAPAGSATGAGRGGQGKEREDRTARGTRATRKIRGNPRSGIQSREKKIFENDQSSEKGCIR

SEQ ID NO: 975067 - protein, 239 aa, Homo sapiens
WTVSHRRHYPGSLMSVEPWLWLQLEITKKLFCPLKNRVVRDWGAVEYMAISISLTRLMGEPPNKMGYQVRVYYMSRDAARANEVAEDHHDKGASYILTFRLRGQHTNREGVPMRTGLSTWASSTWSTIVLIFEGPKDLNFQSEKQRQKNTGFGEALGSLYEVSFLIMAAKGSFPNRVTGLFKREAHEAIQVRACSACWESDQGEDLNDSGTTLFQRCSTRSGESPIMALKLFRSLCANQ

SEQ ID NO: 975068 - protein, 274 aa, Homo sapiens
MTQSQCGSERMGRKRLCVRHTVSDSEYFKHRSKLVYAICRYFEEVDTTESSESHTERQRECLCMPIREGTCTIGMRVQSVQPPYINATSYNRRARDVMHALFACATIKLVRTCRTNIRMRNATTCRAKKRFPPKGVVHIGGYLYRSALLGLPTTSGSPIVLCAVHYPQNDGARAPNFSTAEQRHRIRRVCEAKASLRTLWGRYGRHPIIEPPLLSFETITDLEGLSIRNDGSDEKAADGVDPPKHYAAGDDGSVLRVILNHKNKNLSPLIITYM

SEQ ID NO: 975069 - protein, 115 aa, Homo sapiens
MGIIRQDEDGLALGQGRLLVVRDGIGKSCYATTEILIPASTARNGCPHGVGYGNNAAGHADARRLTNPVSKACTGTHRPTTTRREASRRVPQRAARASPHGGRRPQGRTPAPPTP

SEQ ID NO: 975070 - protein, 270 aa, Homo sapiens
MTTFDTLALQVLAWRLGGLHERHSRASWAWLERLWTLRVKVRAGGSRPLSSGPGLPSPASSMPRGARLLMKSQALLGQGAGLGKLDGPGDARCSPAPWPPGEDAARTRPHAFAHSRPRPASRPPGLTGSGNPRNPETLAGPPARAAPAPADSPGTQEPPARHCRLRRQADPRSNPTAPRPQRPPPPLPAPPPQDRHPAPPHAPPPPPHPATAQPPPAQPPAPRTPPHPPRPPQTHPPPPPPTRPPHPTPPNPPPRPPTPPTTHPPPHPPH

SEQ ID NO: 975071 - protein, 259 aa, Homo sapiens
GERSEAWERTALGCEGARVRRQGGKRTPTGPMAPVAVWAVLGRSGLRAFLGVREHALPRPGNMQNVFCHQVARTTVCDFHVRTVHTLQLWNWVPECLNCGPAVASEHGGNVNALHSGREPHLHLQARTGTELLTQAVNGGVRCCDAPLRNVAAGLRGGHNMELRTSDVVWIALVPRVTFSNKTSFTVYWHGRRSDLYVVGMRWECKHGCSLHVHVPTRSMPGAVHLTSVFNDPKKQQSEPRCPDSSVHGPPHEEMDCSL

SEQ ID NO: 975072 - protein, 127 aa, Homo sapiens
MDRGEQSLCPEVVQCQSTLSWAVQECLLSWNEGMQGDLHGRERVVATGSAERVRKFVNTLFRVAQEQAIASEDCNKGAAELVGEERCRGSGRASLYLSPYPRILAEPRVVTYRVSLRKSRASKDTDV

SEQ ID NO: 975073 - protein, 241 aa, Homo sapiens
SLAVLEPGRTPPLPGLLGAGRTVVEGSRSATPDFLAPPDVPSSGRTSRTSQTRRASRRQQVAPSFQGGPCAPRRSGALSAAPPGGVGGGFGDGEELCRLAQSSRCESRSVGALGARSSGHCAELRVRPADAEAVFQRLDADRDGAITFQEFARGFLGSLRGGRRRDWGPLDPAPACLRRGRRHTTARRTKATRTRWGLALVGRESGGLEDSGAIGEEASSFQRRAVVPVSKINLWSRLISI

SEQ ID NO: 975074 - protein, 288 aa, Homo sapiens
NRFNSRTYSKFSKLSGGFLSSDYCEYYRPRFFLLENVRNVCLLTSDSDGPEAHTSADLVRMGYQCTFGVLAGRSVRRGQTRRRAIILLTGALERSSLCFPEPLQPCLLPGPAQLSVVVDDEEVCEPDKQVDALPSSPGPISAMQRQRLSDRDRESAEVGASATGTISYERGASVPGCQRTRLAGRTVTSPSIREHICKDMMCIGGGRHAAHPLGPQAQTGRDLPRYEVRLSDGTMAEKLRNTHHDRKNGETALGPSVGSAPAVEAGKAATRSQQSDPHPWCWPTRDGN

SEQ ID NO: 975075 - protein, 60 aa, Homo sapiens
MLPEIGWDKALGGIDGCHSVTGIIALCHRGCAYKSLDEMLVCEERQHEEGVDRRVEAVRV

SEQ ID NO: 975076 - protein, 109 aa, Homo sapiens
MGSWEPSLWHQEAVSRLMTCVFGSRSDVAEGLTLGARVDGPPSNIHKGSQPAFDFAPHLTRKATQARTPVREKTPLVLTLFCGAGQGKARNRTHAFNLYGGTVRLDPRG

SEQ ID NO: 975077 - protein, 113 aa, Homo sapiens
MRPRVTPPTYTYRLACETPSYRNTPTKGTYKVTKKGRCVAKGEQTWDRERRLHTAGEIGELREDTGGMAVPGWTEGRYHEPRMDVDGASLRDDDEETHGVSWCSARMDVEIDQ

SEQ ID NO: 975078 - protein, 131 aa, Homo sapiens
PCCCGTRVVIIDEGHERSVYTGILIGLLVPQLVYSSGLSRNAGHVKSCHHVGPRCWGGMDLHPRKPHGLFGKPSPVDAKVESRQFPVTVHFNKRTPLENYMWLSASWKVCKIHLDACPEGGISEWFTVVGR

SEQ ID NO: 975079 - protein, 111 aa, Homo sapiens
GGEDLGGCWQKLAELDVARQVSELLRENLALTGMLCLVLGEEWGPRGGPAGAGGSVSRAAPGALSCPRAGPRDLVRIVKLQHWHGCGHVLDQLPLACSPDDLTRQLVPSNA

SEQ ID NO: 975080 - protein, 141 aa, Homo sapiens
ANDIRCVGAACRLWPWGSEGCVAPLDGVPRSLPCSPRTPAETEWLWQCLRWTHWPPSWSVEPGTWLTSLYPRSLSPRSLELDSTCAFVLDWPCMPTSAPDSQGEHHPWMQEILRTMKKGGLQWGVCAQSPRQPALRQLRYP

SEQ ID NO: 975081 - protein, 136 aa, Homo sapiens
MRLLEDLNLTYDRCGEKERVTQEKVQCRSGRMRFETLWHRLVSRSLALRVEVLRGQSRHCEYRYKWRRNRNCIAITQPTRIVHYLPAVQRIVARGESDTERPGFACNETRQKANPQFTIPWGPIVRSTKGLNMRMI

SEQ ID NO: 975082 - protein, 247 aa, Homo sapiens
MSQRNGPHNKEEEHHPHNSIEGQGQHPTAPRPPNYLTSSGGRKQDNNTDTAATTHHKPATHHVDTPPPGRAHTNNKSTRPPPPTSAEATNKQHHQAGTTSSGDQAEQKEAHTTRARTNNNTLMLPTQAGHGGARPTQNQTEAHDRHTTRKSCLAKKHQRGRAAKQPSPTRLYNTHSQTRPPKTRHKTRKVHDYTAHWNDEQNTSVASTTEHTPRCLNTKRTQLHAQTPHPPSPAETTATDTHNPPPQ

SEQ ID NO: 975083 - protein, 123 aa, Homo sapiens
MVVLEFSLKVEGGLGNCGARVQRGYSVASDMFASGGNLLVVVGFGAPVGWCPRRQWALLPGCLAGRLGTVACCFPASLDLPSFAGRWGPNGPPSLAVDSTRFGTGSFLGHTRPPGLRCPFLFV

SEQ ID NO: 975084 - protein, 73 aa, Homo sapiens
MAWAFQTEVWYVTQREKTPPWGAVDDGTPVFPRLPVGQDTRDSTWGDQPTLDVPATAELPRTLMCLGDGLPLS

SEQ ID NO: 975085 - protein, 204 aa, Homo sapiens
MDGDTVVPGCTGSCRLRLLIPETIDAVSASAIQVDQGECRKLARPAGQLIACHGTLQCYPDPEWTRNAHCDETVGGVTMTRSTPSISETGAGQGDGGPGLWSVDVGHPQVMDEVRNWRRYRAVSLPPWKRAQITGKDDAADKYARGHYSHWQGDQLTLCGTDIRKLADQCTGRSVASWFSTAYGWGNWFWVQPPCSWKRLSVDH

SEQ ID NO: 975086 - protein, 163 aa, Homo sapiens
MFNCIHSTTIIQNLWALEAELAGWGCVKVAVDVVVGRKPGGNRKGIGEGDKAREVVSKQLETDHVMGRSQTTHDWRRDARWCRESPRIGGSSTGLHNTGNARLQTRIGERKEDEWRRVVVPGAVQAGPPLSALIPAHPRVGTLGPGGHRTGGESLRVDDGKAK

SEQ ID NO: 975087 - protein, 469 aa, Homo sapiens
LPFPPFSPFPLREGGFPGAGGKSRVITPGSPGTRDAAQVGRQGKHPQHTQQRSINKRKRGPSRAQGEINNGTRPYSGNAHPKTDAKRQARRDAPEPEKATKSKHTGGTQTAHQRDTADITTQNTIHYTTTRQEPQKPEHKNQETGDLHRHHRHTVAKLKARMGKHASAPRRRQATPRGYNTPSRKKRTDEKNTVAHSEQQQEKATKNEHKYADNHDRRGEPYMDQQESGEGARRNKHHENGNNYQQTTRDTQRATRWNKRHPTPDERDTQTTTGQKQGQNNNQAKIHRHKTRNNAMKEQKHNTATTTRTKETPRKQTPPNHNTHTKTTHEEQSTTTTPPTPISTRKRTTNQTQTQNTQQQHTNDTKKRHSKQRDEEQQNNTHTNQEEQDRKKKEQRQDTTSSEDKPIDQDNDVRADNTIDNRRRQQIAAQLTHLISPTTDERTHQTRYNDCRDEENIIHMHYHINVFHL

SEQ ID NO: 975088 - protein, 116 aa, Homo sapiens
MKANLSIELTTHTIVSETRCIINTGRYVDVTVMRRSETRQNQGGLTSYHTQGRQKEKRHVSTYKKAHPQRNGTKQKGREGKPRPTHPKNQRHSKRHKQRPNPQHREDIQTVADDRK

SEQ ID NO: 975089 - protein, 68 aa, Homo sapiens
SRCQWRQPHAVLVGAMHITREAGASACRYLVEVEELADVACWRYEAVHVLVGSGTSYRGIIIIGSEGL

SEQ ID NO: 975090 - protein, 105 aa, Homo sapiens
MIRKVRDYVMVRKHKHAVLLSSRQESKQGKGIRRVRVVRALSRPNRYVSGVKFEHLIDIELLAGVPGFVHHHMTRADDRTTWIYGFQGAEKIGQVMDNGAIGPRN

SEQ ID NO: 975091 - protein, 117 aa, Homo sapiens
MGGRALLTGPPSEPYSLGPKSKPAAAERRAPERQEAWRRPRRSSNDAIRGNAWNTPSASSVTAGKILIRGLPGDVTNQEDEVARVTSQQLKICFVDKYKGTAFVTLLNGEQAEAAIN

SEQ ID NO: 975092 - protein, 210 aa, Homo sapiens
MRGQPERASTGYAVLEPSRGWSRQGNVHGRREAVQFRPVRIPHPGGTARSNSSSRRSRFQALLQGSLEKRTRYRRTRPPRGWSHGPKTGGHSDAAESCPGNQEVHHNQTLGRELPGGSPGAGKVHHSRRRTNSGGLPQGAQGTVRVTMKIASVKKLVGCQARGVTGPTKKPRVPRKGSLDPGRKRSRDRVGRMGGPIGRTIPQPRAIPGT

SEQ ID NO: 975093 - protein, 294 aa, Homo sapiens
GNAEPGSRRYLVELRVVLEAADAEVPQRIQRGAPTRGEEVAPGRRQEEEREQERGAERPDPPCVLSGGKGRGNRPLREAPGGEGVSQVPAAAPLPRFHGRGECFFSTRLPPARAVRGRSIPAALRSGRRAVPAQLRGNASRDAWGVLPGPRRRGRASAVARLALVLLGWVSSSSPTSSVSSFSSSGRSGFCRCPPSPPLPDQCPGCGVLRGRRTASASPHSDARCQDCRLGGHLFLRHQVACSWRGFAAAAWGVAAQLRGSAEKCAGASRLPAGSDCNRWARLVSGSRLAPLVC

SEQ ID NO: 975094 - protein, 147 aa, Homo sapiens
LLSSPSPVCLPPAAASMISSIRQFSSSMLLCNGLLRPGGAGSSRTSCRLSWRAGCRLLQAGDLAGGLEHGASGVAATPGCYSFGSGGGYGSSFWGCRWASWLEGDERAFMQESYYMTGLVVAYRVDKGAVLAWTEAQAASRGGEVLL

SEQ ID NO: 975095 - protein, 328 aa, Homo sapiens
MRHHVRSSKSFHLHYGSRSSFVECGCSGLAKAYSRGLDEGQGLLLITRVLKDVIAWSIIQWTYDQWMAEGVRPKGKLQIELNDEDIPADDWMRRAERSSVGATAGKVYTVTDAGIDQVVTDLRLWMRQTCSTSLVGILWELIRTMVDRAEAETVMYSFPGYTHLERAQPIRMEPLDSEDMPGHLTRDSERMLEVRKRINVLPLGSGAMQGYHRVWGEELHDRTQLGAINLNRWGPTRERPSGANYRAGGAREVPNSTEGAEKHTSGPATLPRTTKGQNRRDCAPKTRTRGRPQGTVVPSATSHKRQPTTYHERLDEEQAEGEKDKPHN

SEQ ID NO: 975096 - protein, 197 aa, Homo sapiens
MKFLLDILLLLPLRDRLLPKSFAKLFIPKRRKSAPGEIRAGLQELGHSTLGDTGLAYEFRLHLKASWVSGRYKYRFGLGGTTLAKLQGTGVATRPSPLVARLAATDNDILPALPTEGEGRTLADPLSRIFNVIIKAACTTHHTSRHRYPTRSIRTPTTLSPNVSPYNANLLPHTTGPTTSNSRTNSNRPYRHMTSHL

SEQ ID NO: 975097 - protein, 83 aa, Homo sapiens
ATDANSVGDAGGSAPSILDTRDALQLVNEIIDKAGYASFISLLWYGMLLPHMSYRDGKIMTLRLQCLATCSFPHDITGAADGG

SEQ ID NO: 975098 - protein, 148 aa, Homo sapiens
EAVSVLGLGPARSYPATITTIWDGMKVVSHSVVCHTESAGVIAGAFVGILLFLIPGGGKIPKRIGSTRPAGPMRRGTKWRPFSFVRKMRESRPLMVQTEAQYVFLHQCILRFLQQSAQAPAEKEVPYEDVENLIYENVAAIQAHKLEV

SEQ ID NO: 975099 - protein, 290 aa, Homo sapiens
FFGLGFSFPPDGVRLCVGLLGRAGSRRGVLVTLISHRKRGPGAGCCGPRGFRGREEKGRGKKTLAIPEYQDGPGGWLAGSQASETRSCERAPGGEMRWVRGCLVGEVGEAAGRWTSMGKMQSGGRGVAIGEESRCAGRRWPGGAGRRGRRRAQLLGETAVDRGDCGHSRLIHTGEQDASYRVLRKGGGNTGGETRATVSNPGTGLGVQGVPPIGHQSGAGWAPTEEAAARSSRDGGGPSGSKGRDPKKPGVSTGAECSTDVDEASIRTTRGGAQQGATGTPSRKRVEEAK

SEQ ID NO: 975100 - protein, 104 aa, Homo sapiens
MTYPYQAEGNFGVPLEGYGSRYFADVLTLKNHTPDRASCVHTPVLGSGRLRTLLSPSRFPALAMEELLNGTQPARLIGSFQLGCACNLGTNFCCKGSARNSCLQ

SEQ ID NO: 975101 - protein, 217 aa, Homo sapiens
NPSLFYALKNQFKPPPPCKGGAGKNKKRKTRWETTISCPRPFMRPDGDLGVSHLVPVAGVEMWKVETPPGGALCLWSPLGDLSRGDVDRRHICAGSGSRGDMGLVPKNFLRAKRAGVWGDRRSSLQVCQREGSLQGGRQEEEGGASLWAGPLESLAPEQGRLVGVTVCCLYHERVSPLPRLGEQGVAPAFRELSLMDPFSPLPPGDFLASPLKEPLS

SEQ ID NO: 975102 - protein, 68 aa, Homo sapiens
KPQMEESADHALLCSSSQHLFLDLPKLEEATGESGGRRTLPGSDVEHPYAQFYHPCLAFGMASMLNAD

SEQ ID NO: 975103 - protein, 256 aa, Homo sapiens
SREKGLSILYSGPNKCVKGQGVRGARGLLGWRDRWLSWKGEQFSQVASKMAHRWAQGGSPLCEGWRRGHQRRGGRRGHREGCGRTVEGGGGEGGVWWQQESKPPCRPGDGVGGPPATGGSSSGTLNNIGALAEHSHKGGGRQGTAPVWQVGRRVSGEAQIVCVEQVSTEMGRGTQREAGLVPQDGTEAPSWCRGSLWGERPGAQSNNEQHMREINSNSWRATRMLSSQAKETVPGRQGGHPQNSVCPRMGAVPRTL

SEQ ID NO: 975104 - protein, 96 aa, Homo sapiens
DRSTSLAEKTDGPQTDMRVSVTSPLSLRKSVDHCEELSGLQTMDPSWHKAVYVVASHTRGRRIPPWTYAWRAAWIITSSDHPDGRVALVGAPSPSS

SEQ ID NO: 975105 - protein, 424 aa, Homo sapiens
SPWWLGPVYTYPEEREGASRLSSRGQYSGAQVRVSSSGRNSDFSIVGSKSIATACNVSGTISCRLRAPAICSGAMDGIVCCFAAANADCPSFMLQPDCQAACCGAQLHPSHGRAEHTRDGLRDRAVEASIAWHYPGVTQLPPHKANVTRRELSLTHDASVGLVNLHPTESHTTEEAQRMNDSSSPHNAHAPMPRTTPGNTFTLDRAQETLGTLEAVLNPSRHTAHRDRDTVLLIHWRLVAARNNLGKALATDIYWRTLGPIDPNPKAYLASPGPTPHSCIMDWQTILITLHAPTAAFTIQRTSPHIPCLLPRHPQATPFYPHARIFTHDKHGTIEEFTTSKPPLGRHFIKHTTSTPGTRTPPGDHVRTLCEPARHTEMDTHQFGRAANEQRTWWPRTAQADSWPYTNHKQHGPRTEQPETAITT

SEQ ID NO: 975106 - protein, 344 aa, Homo sapiens
GSCEKRRDAEYGRQPGAGGRASGDDATQKEAWVENHGGTAPWNSGGRREAVLAGSPVKSGYEELGVFLGRTVTEQAPADEGIRVAKAVTSESCELSSQDSWDHTPVQESLATGNWTEVRVSRDLRPCAIQDERGPSGSKLLVPGHLTKCDKHGLYNQRQIQCKMSLERAAVRECWCVNPNHREADPGKRPSIQGGTPSVISVYKEEEEARGGDTQADAVDRRQAVPGDPWTRRHIYKEQCRKTGVDDRGGSDEKEGDDQYRQRRISNGELEQERIDTNAAPTTYHEGKSPGMNHVALTRQEERETEKDTQEQHGKERRPQEGTTPGTIGRDRDDENIDHKERQQ

SEQ ID NO: 975107 - protein, 177 aa, Homo sapiens
MKSCGAVSRGGGNPPREGNNLFPWGPTKQQGFHRRTTDQGSSEGRSMSGTQRSTRGGEALRRKPARCGAHTNKESAAAPVGRQGRGGAHTERRAHPFLGGPTEVCDQLVEQTECVTHQRKRGGRPTREKPPAREHPQESPTQHVQLEEVSAGKHEHSETEETPTASERRDHSGTRHI

SEQ ID NO: 975108 - protein, 107 aa, Homo sapiens
MVGTAHECKTGLVMYFIIQNWGYQYGTYLPMVKRPQEIATIPVDHSGHKRAHTLPASLNNSIPHDPHDCPHATAPIHPTTAPHHPRPPPAGNRPPPPVMSPHPPERS

SEQ ID NO: 975109 - protein, 322 aa, Homo sapiens
MLRRPSRTNHKLVRKTERTPISQTYMACGRPRRQTTDPYNYTRGAGNQTSHPTTLKTPPATNPGTTAGLAHYPTAYRHTQAPAAHSPTVRTRRADTRHRKIVTHTHSPTGPTDHTTQYRTREHPAPTHTTALTGNRKGHINSESPNRRRLSTPPKGQTNNKQDTTDTQREVKTLQRGYRHTITRRKNTAAKLRRQHKRTPANTHYHQGEQKDIQRQGQRRGQRNTETKQKTRPPRTRALASIAHTRPHARHKNSTIKAPPRPDTPGSAQHDHERAERRHPRSKQHDRPSTAHTLAQTHADKQETDNKTPTRRTGPPTESRTT

SEQ ID NO: 975110 - protein, 601 aa, Homo sapiens
MSRVIARMDGLAGVIMIRSGLGALRRHRRGRQLYGSMRARRVASAATFSWWRMDAGGNVGGVRWGLRATVDAASRHLLYTLGVSECRQQSTEHMRMPPSRYPLAATPTCSDVHRVLVFGVRALRRPVWIHGNSAHDISKGVSGACFGAPGHAQRATRGMFTMSEAGRLALITAVPSDAENGTDAGLLIGVPVDTGPEALIRWALSQTPTGEARGVLGKRPDMWGSKAPRYIIGDRGGRGTTWGFPRGIRREWATAAQVRCSTRDNHCAENGRTSDTTIRLGPICWHMLQRSRTGPGHRIRDTLRAPRNGIGVADDGKNFNHQKGVTYRTDSAISHVGTLTVGRDPHEQGHKHRRKRLKPNIPRDHRSAYRDCVSTRGTLSGAPNEGAISGTQTRSRPEQEIAPVQLEALPPREALSNSALTTAYRGAAPIGDSAPERRNAKRTGHTTGAPALGKHQGETGTSRHENQRRWATTGELTTSLQTQTQSREIKTRGNDTPGDVRHEKPERAPGGPHRDRHTHPKSDKQQEGPKQRTDKPTEQGARPELIGKPTGLEKYTDRQGENNTVTSWHNSSKQEAITAQTTTRQNRQQTEYSKAKTRANN

SEQ ID NO: 975111 - protein, 167 aa, Homo sapiens
TFFSIKGEIGRSRGVGARVGGGRGGVGLSNAVIYFSVGHTTLGTIRCDWTGGGRVKLRYYVTATQAYETGDDDYGQPLSRPCVVTLRTRGLHNATRRRGDVWNTGAYTVAPGVSQIRWAPHVGGAHAHTLGTVGPIQDLTTRQTTREYGVVRGTKNTWAQVIRTDPQ

SEQ ID NO: 975112 - protein, 249 aa, Homo sapiens
MHQLFYQCSEELGYTEGDCRYFCTSVPSGKCESEWSSLERSILEPEREIRGDPGGFEHVDQGPKDDIVDQGDPQTGLASRDRIQRTVSAAYVSKRPEISVECRCASVHRDLKPENILVTRGGTVKLGDFGWQNLQVPDGHLHPWLLHSGTELPKFFCSQHMQHLWTCGVWVYLREVRRQALFGDLSTVDNFAYGGSKLVGESSGRGLSQRPRGSRERPGERFPRVSLALGTARRHISGACGPPLLASSP

SEQ ID NO: 975113 - protein, 114 aa, Homo sapiens
LPQVSPTAQRTEPAEDSGESEALECSSQHPSQLLPPDPAPRFATSRVPISQDAQVPQKMSVSLPEGPASPVVPTPDSVEQEKFLRHHFETLTESPCRELFPAALGDSVSALREA

SEQ ID NO: 975114 - protein, 52 aa, Homo sapiens
MQGITLKLAKLNGVEMHHTIWDKLAWPTLMVATEYKVRPKSTRTHNNNEQEK

SEQ ID NO: 975115 - protein, 287 aa, Homo sapiens
IRVVSDRWSSLCEQPDCLSPCRHLILPGEVPPSKRTLGPGSPGPCLLRVNSAFESLYQDKSFLSVTIRIQTQVYNELYTSEGRLTVFVGAPHGQREDYSCKRLGILRMHVAELGGALCVRHPHGGPGRAGIHGLGTRSVHGQARQEGGTPDRRDTASRPVSCWAIGTQLSSAPLRSGTYFPGDGSSARTCRNINLFVVDEVHLIGGENGLLRSDLSRMRYISSQIERPFDCGNQSSVSNARMWPTGGLSAPSTLNSFQCGSVLGVESRLNRHKNPGSRNGSSVQMQN

SEQ ID NO: 975116 - protein, 98 aa, Homo sapiens
MPPFTHVGISTRSIYSTTKKPPLSGGLGGSPVGSGSEPGNVSQASGGLGQAGGGASLKAARVLAAAHSGPRSSFSSGQREPLVVRRAAAGMGRDARGQ

SEQ ID NO: 975117 - protein, 138 aa, Homo sapiens
MDTENAEKPTDHTQPPQAHNTPSATRHAHTPRSNTHTRFKNGTGGRTTTTHQNPNPGSSLNHRHKPTANNAHEGTNTSKITHQQTNTLTTEHRSRTPAPRYNPTQTPTQRPDPTTADTDRHTQVQHKQHTTTHPRTHN

SEQ ID NO: 975118 - protein, 145 aa, Homo sapiens
MGEMRSGRIGPTDGRFAVGSVTVTERGARSGVEGRALQGQVELSRVSRRVKPSGSTVSSPCDSNVLISSPRRRVGRIQDLSRRRPCVQQRLSSSFTCEKDPECKVDTRRGSGEVKNQMPGGPPSWSGARIEWVQNPQNWTLGVEG

SEQ ID NO: 975119 - protein, 213 aa, Homo sapiens
MTIHRRELKATRLHQLRDEDGKIVRESRRNAVLRRPGLQARRMAADALLLFYWEATSLMQDCRGVGRYSSVYCEYGRMERFRCPGRSSVPSTILPGYGIWRNPRKPTSSPSRCVTMASMPRRDRCTVEQQCAVGRNHSCSPGIADRMQKEITGLAPRTMKGSHDHRYPQSAKYSGVDRWLHPEPHCPTSSRCGLAEQEYESRVHSIVHSVNAF

SEQ ID NO: 975120 - protein, 208 aa, Homo sapiens
ASSCECGWDGVLAVPEPGNLAWLSVHIILCPLSEMCVCAVAVKMHHLHCELCPGTAAMQCKKLLIKQFCVLTVLPVGELDYLCVWTLPPWVTSDEHMATIEDLLSLPAPLWRPLDGHHCTQCECPVGVDCDGADALTLHCSEVTVACRAECEKTTKRSNFDSRTLHSNETQPPTTHTVIVHERRANESQQSTNTVEMATITLILTSTV

SEQ ID NO: 975121 - protein, 86 aa, Homo sapiens
LSGFTTVSCAPELSACRGAPRGESGAVRSLIAARGAGEQEQPTLSRTIRGPRRNPEGRECPDATGQRVGGEGQHAQVAARIAPSRG

SEQ ID NO: 975122 - protein, 290 aa, Homo sapiens
PGASIGRSRNRGPIAASSLPQCHDQTAFSSAAQDWRAARHAAAGAGVAVTGVHSWHVRDVEAGSPCNMSPEPREHVSSSGDLDVVAPDEASTSHKPCVNVSHLTVQTRTSRTGTKVTTVLWAQLHFVAGRHQGVLPLCDVHRGDILYQVGDTHQNDLDRRRARMRLLEVTGWLARGGRLSAPVVSPRGQLLSTKPSVGRLNAWQMTQASVSSVWLRWFAELFARGPRSYALREMAVSESSACVAMGAAFVSERVSISAPPYHAMHAVQTICVHSPYAGMGGGRCKSIEIR

SEQ ID NO: 975123 - protein, 225 aa, Homo sapiens
MPELLGENCMARARMCGARACVGHEPDLCARTWTCRVCGTSEATDLRSIYISGAAAFTARAGVQRLRECNTETEESLVKRLVCCPGRHGRAEGARLCDVVIINDSWTRLRRAEGGALRGNQDKVKGPGLSLLSVLGPGPIHEQGGALSSPWSERSLCLGRFDGGDIFRVVEPGGPTESGGPGNLGTRRSPTNVVHSKRNRFGENTARYHFQKAYLPKTKSSRKDT

SEQ ID NO: 975124 - protein, 205 aa, Homo sapiens
MSTSNKRTLINAKEDSEAEFLGAGWMRQLSRGRRDVCLGEQRDRRDHPRMKCDRIALGPCSVGLYSMVAMKPFLSRQGLNPNKASDWVPPPGKQAPVPGVLERSETVENVVHADAKSWETHLRKAPPCETAPRQNRDSQGSREGERAGTPRWDGDVHPRLSSKAGLAPGANWGGRPRPESSQRREHPNGEADPRKQEAIPSTQNK

SEQ ID NO: 975125 - protein, 235 aa, Homo sapiens
MVGVRVSYNNVVYRYEERAKGPAGIDVKPEIVRIPFGKVEGGTAGLGNGGDHHHIRAKGHEGRSNQRGLGVRQGGTGQTTHLIKTRSDPVQSTDTEHSQYETAGHTAPKGPRKPSEREDDTERPPRPTSERHDTRVRHQRAAPQHTTTAHSYPAHPGASNNRTGSHTTTQQPTHPTPATDNKGSHTNTTLTPLAQPDAEPTNAITRAPHDIATKSRAPPIQTHTLSASDTTHPTN

SEQ ID NO: 975126 - protein, 275 aa, Homo sapiens
MLERQLMSRVDNLSDTHTFPRECELLKKSRTVESIELINQRARYRIRNSTGCVRWHPGSTMNEREPVNASNECHQSRRTVSRQQRSEGARDTAVELSTETSHNHKRPRVRSDAMTPFDRLKPMTANEAHPIHDGTRDSEPDDDEEKRKREAMHMHGPAECESIAKNMGEPFKPLVAEGQEEQTSSNRAETKGVYRTKNEYQKRTKRKNASRNKAGGKAAETDPNTSEANSHSGRPENKTEKERNAKQYTLDSARPKINRGKSDSRQQGYLKTTES

SEQ ID NO: 975127 - protein, 186 aa, Homo sapiens
WVGVVWEPPYSLKDFIKDLIGVMAVIRRHWIGALQVFPGDLGAQGHSGGKTSSPGLVGRRWEKTGKRMVCRCPRIVGEVAWVPPKEASRCGCTRGSQETGLSGVEPRRGVRRGVSGYKASGGPVGSEHFLWKTRVSRAPSLFFWVCFHREPQGATVCVGGIARTLCGERVALCGMPDSSPQRGDFW

SEQ ID NO: 975128 - protein, 489 aa, Homo sapiens
IGSLSVSTRPRCSLSGPSLVPLRRVGGPVKVTRGQWYDGMIRGRGMLGRESRRFCASGLRVDGLAGVTTRASLSSHAHDWTTRLGVLEEDRVLLMYCSYGRILSSAQGKRMRPAGNQLVLEGAFLTCKALRNAGAVRISRKEEFRRAEMERLKVPGDEGKAWEDMGPWGLYRSRGAKFGGEGTIFKGIPSKGGKRTGTKRVALLVEQHRVGVCFAIPHFISRLAPLENRPSRTGGQVGPGPLGCKAAKRATKATRPDWAHPGHTAPTSNSLVAPSQTGPGLGWAGGRWGVGSRGPKTPERYTHSRSARLKPPILHQPGRATIWPPQTRAPRRPVKPHPGDTRRRAQETPPRHVTPPHDTATPRSLNQPPRQPRTWTHTTSQTDPATPQQNTRGNAGDNNQARTDTTQLRRRRTTQPGATPKTGKGTPTRAARDPHPATSQAQQRATSNRDADPTPTQTGDTQPGETGAEKAASSIDATAERRSCETRLE

SEQ ID NO: 975129 - protein, 285 aa, Homo sapiens
AAGVVLCRGLADANKVSSVLPPQWTLHPPPGGLLQPALVYCHHDRQLAQPECWCRSSSGLINCGNNVPDVPECFGFKVNCVRQQPEEEADLDAVSSPLTECCGMLLGLCALLQPPGPLPWRWTRTGNVTCERCCVPCVPTACFLIVAHGRLVAGLLQSWGAHWLLLLDVTEDRLSLLRAGGVPAEKLELQHIAMHLRYSDLTVSPCKSLKLQPEVRVTDEEDLPWAAECAPVGLFDFAHKPSTFQGPVITGWKPATPIPLPHNAHFFGEPDLALETLRFSPEVDS

SEQ ID NO: 975130 - protein, 321 aa, Homo sapiens
RDLTVILQGAVSGRRRVDFPRGIEVQEHKVRILGNIAVLSSGEFYGDEEKDQGLQTSQDAGCLCSVRPVSRPFSNEGQTLVVQFTGEHMMHETRTVRGGYVKLFPNSLEPEQIMHGDSEYNIMFGPEICGPGTKKVHVIFNYKGQNVLINKDIRSKEDEFTHLYTLIVRQTDTYEVNDWNSQVESGSLEDRIGTSCNQGRSRSRRVKNGHWDVLGQIEYSKTFQVGDWAKPEKYSDLMYKSPGWGKHMAGTVVGPRGCKTRVNRGVGHRSYEKPDQEEGRTQEDETRIPTQQVITNNQAEHTVNLSTQKCTPQKQLRDGSG

SEQ ID NO: 975131 - protein, 59 aa, Homo sapiens
MEWPEFAYIVHSSRGLKERGGNRMSPSHNLTGGDSLQDHGAKGTWMTKAFKVNTSGAKQ

SEQ ID NO: 975132 - protein, 230 aa, Homo sapiens
MAKTNRPNNYITTTDMTFQEQKQNKHPRESEILLLLYSVVPWWNTFTYPVGGLTRNLGKTPSGGNWRAKQPAPGGQRHHTSTHMRPTGTHTMTQTGHHKSGNRNRPRHRRTPRAHPTKPPPPTHVGPPSEPQHRTAPRQKPANPPKHTQHLRAPNPGHPLKPAWQPAETERNKAPNGQSRPARNTRGTHPKTPRNHRNAPTRKSPKHTPPQHNQHTTLPVNTKWMRTRNK

SEQ ID NO: 975133 - protein, 87 aa, Homo sapiens
MVSPWQGYQSDPPLLKKIRPRVPKKRGGAKQRSGKKRYPQVTQAIPSPGSGERHRPARRTRRHAAHAETARTHTPQNSPRTPHHTWA

SEQ ID NO: 975134 - protein, 285 aa, Homo sapiens
PTNCSCGCARCRSAAPIAICYRRLEIGAGPAAISASGLRFYSLTSSETSTSRPRFPSSPWRALHPKSVGAVSTTSDDHWAVPSWRRVRRVGPHYSVSGITPRCYAPTRCQDARSIRSIILSTFMGSCTCYSYPRYMPIEMSASTPILVSPWQHSNRVESRTLSGVAGDRISDSEPGGKAAPRTETVELSTRAITHLCIADLMCRSSAEASGQSSLADQPKSLDLADTGNAPAAPSHYVEHHTTLPPSRSAHQPTAPLQSLTHRPHRHYPPCPRPPPLCPAHFTAA

SEQ ID NO: 975135 - protein, 332 aa, Homo sapiens
DNGGGGDGRALLKQQLWRLPLRDRGRSGSLTRTGFRVTASYCSCCCSTLPVEVLPPRPAPVPRASTVCPWSDVRRCQKAILRRFVVRDQGVARCVGHRCGQAQEGTSVDLRVIHQMLEGSSIVQTNGDYHFCLDKLVCQLALATWYTSPIYSIVPPALCAGLGASVEMNGRGELVESLKRFCAFHRGFPPLHLMLFPEEGGTMGGRGSALQFWQFYPRCGASSYPASSETPGLCGRVSDAPWVSNCCGHFSAFQRGPRKGVRRVMRALGTDVGVGPRDTPWRRIGPPGRASPWKGRCWKKPIGAGHDFHPETRGGRHQSATAAQTPEATRRD

SEQ ID NO: 975136 - protein, 85 aa, Homo sapiens
MVERALREGPKGIISPGRPAIIRGHGAWWGGGITLAASAGTAPLGTQHDTCSTRRIITIYVRRKEQLITHSPPNRETESSTADQT

SEQ ID NO: 975137 - protein, 286 aa, Homo sapiens
DALRSSKLQAVIKSSVCNRWVDAAGSCGICVGSELGRWHMVAKTAQQTVAIRGQADKNHHQLKSTEGVFHGRPGVRDVVTKYSNFVRLPLYLNGRRMNTLTGHLDDGPHRMSVSGKHEEFYRYVAQAHRQCPLHPATIRRTHRINIRQIFYVPDMKTVHVRCETGAGLQLLTVQPHKVLNPGPKATDIHAPSGWRFIEVWWTVRTFPELSESCADRHTFRETPGRFNTMQGDIKILNCPAVNNDADTYTNTTGRLPPVHKQANDSRNTCTQEQHSTPTSLVQHQEH

SEQ ID NO: 975138 - protein, 212 aa, Homo sapiens
MLKIRPYTLPPPKFISNKIREQEQRGAPLTVQAEALKVSSQGEVHSARSRAAPGGCGGLIAEGNNATYVQIRVGKIPAVNSGLIGGAGSREASEAVCGPLGLGGAGQEEAWLKAGPWVSKASRLGRHGAVRGRGSARKATPEGGELAQATPPAKRRLKTTGGEEKSALKTPEYESSRCRRYKKRGRHTKRVPTTRRQQSRNQKIAAAAHAQT

SEQ ID NO: 975139 - protein, 322 aa, Homo sapiens
YFLLLPRRRRRIMRDIVYLQAGRERKPIVRVQGFGRGSAMEHGIDPKGIVPRGQGSVAGMHQTCTIKESRRAVSIVPRAVFGDLETRKHGLRGATGPYTRHDLAVAEQTSCFASEWCCGDKHGVAQEGSYTGRLRSLDEYLGAWMCVTKRKVGNAVTAWIVSQRRHQIHCRGADVASGTSCPNLLDCPGDERIALTWIVSIAQAEVVLSWKLVGVKCVGPADRTAHTRHAGCSGLGTVTQLGTAAWIGERAPDTAFAVQSPLLVVHRATWWVTCTGLGGGPKGWGPAGGAETPSEAGWGVGGSWPRTGALCPFALAPGARPA

SEQ ID NO: 975140 - protein, 115 aa, Homo sapiens
MDNSSLNSLREIVPRDLATDYVSSAVTQYVDIVIRIELRATYMHDTYVGPLTAISMEGIISYASSADRILAMQLELGLEIVGSLDLSTCFRVGLCRTKCLLEGELATGVYHPYAH

SEQ ID NO: 975141 - protein, 227 aa, Homo sapiens
SLNPAWQSLYAPAADAHGQRQGRPGSPTTSLRSSNYLDDSSETVSLLREQHNAAAPSQTAARIRMLPSPGNGCWLLTAATNYHACAMASPDGAPGHHPPHALRRTPRLPLISGGTAAASRCFSHPRWTPHVTTQGPPVARPTLPRCQSACPAALPAPFSPPLLTLSPRCPGSPVSTWALRCAPDRKELSPLLPTCLLRVFHPGYRILSLCVFPISTNSLAADLPAMS

SEQ ID NO: 975142 - protein, 102 aa, Homo sapiens
MRRASTQALHLGGHREGGLPPSAHTEQATDRKQAGKGTSRSGNRQPGWYVQKMPIIGWTPRRGGAPTELRRLDPPARYPSERGRQPKVTKTPRGGSTRLGPK

SEQ ID NO: 975143 - protein, 139 aa, Homo sapiens
MLGRTDRADVDREARVVTRVASAAVYADFVSRQPGGIRRACCIDRDIVVLRMAGGQQAPLARRGGYWGRTEEQGYAHRANPSALVNDPKLRLACVTLEARDPSRYNEDLDYATHRYVALTEEESPIMKLDLRYDRTRMT

SEQ ID NO: 975144 - protein, 332 aa, Homo sapiens
HSFSEWGAVTTAGRGIRLGLSPTFWCGRPGGQALAILPILVPQQMALASDDSCYMPFAEEQGWGGSHRFGKRPGHTIGKEMWTGCLLLQGPPIGHVFSNTCTYVYDHSITHNHHPQKPAGPSRARGGGTRRHRDSGTRAPNSSEPRTTTHNPRATNGSTIRTSAPPNSAHPHHHLPQKPTAHTPRSLHGPPPPTPARTHHHTQPAPPPKPTNPPHKRSTHNAPPHTNTSPKRTREGSGATRGRTRQRKRDAKERNKEGRRHTPRRAAKRQTRAQHGATDDAGTGERSGGEGVDETTGARRRNPDGGGEEEGNEAKRQEERRGERKRARERRE

SEQ ID NO: 975145 - protein, 134 aa, Homo sapiens
MYYYTLSFRVHVHNVQVVTYVYMCHVGVLHPLNISHLGVRYIGPNAIPPPLPVRCTFVKPSLPDASVSKKKRQEKSIQDQVIKTLGRAQGLTPCNSKNLGRLRQGGTLESGLYLQGSSDPHPSWVSQEHGDYRV

SEQ ID NO: 975146 - protein, 491 aa, Homo sapiens
RGAESERAASLAEAQARQPWRLEGGTETAAERSCLYPPPPAAPLLRHAAAADVTCQLRAARARHTPCSLHAHRTHYTPRGVLTSSWFSSASAQLAHLYSPRCALLLPPPSPWPAPLFAARSPYAVARSCNCAAHLTLLVPPLPLERRLWPQYPFSVHTFVVLHLSFGSWPALRPRPQLRHLPWRPYCLASYRSRHLHTPAAHACIPTACSFSYTLTSPELPIDIPGGILSTPTLLDSDNTLNILATNNTSYYPSILLCVYAHLPPSDPAAAVAERGSHEASRTAPRPLHCTRSHKALKAEHPAMAPSRPNGDRHVPADLHRTCTSGTTRSTPGEGTPAPGSRSRREPRSQPMKKQPSTPHRTPRRHNRRGRPANTSAAQPAHNSGNAQQSAHGAYQRHTHRAAPRQAHGSYVVARQNTATTQREETDGKNELTPKWKQQTTQQRHTGNWNTGGDSCGTQNAPLTDRSTTSTRSMHEDQKSRSCTDEGAVAE

SEQ ID NO: 975147 - protein, 321 aa, Homo sapiens
QKYLTHTLRKVAPNVYEDIMNGQITNLLMYFKSMIRSRRESGTPCGSYLPVSPPITAGMCYVWRLSGPSRSCSWEGYDAEKLFLEPVFHTLVTTTMKGLIHILRFSSKGSSWLSRFNCRNLLIASYQQTPLVNNATSQFAVEYVALPLGLRVLMTWLSDAAWISVAKTGSVLPVRGLSMKAKAIKPCVQNFMFCPGFKLKVRLDDLLVYLHSDDSSLARSVSPRQVLRFLDLCTDRQECGDRVQDMLADSSPASHCIKSTSWNCMRAVSKEVLIRCAGLRDDLDCCQLPHSFMAHSSILETLPIEQPREYNFNRDYVCNEE

SEQ ID NO: 975148 - protein, 323 aa, Homo sapiens
RELVSSFGVVVSTVYKESEWAHPTDKSRGKPSFQACRDLGVNQGHQDWGSRSSQLTVLNLQMIQTIAPMWVGKGGPVWRRSPGYGPVTHNDSGCPWDSRNFWEKNGLPLCWWSHFILVLFNSHFLKGGENNREATVRSQGPHFICTFKNGLQRKPGGYDSDPRGQQQGRGATEGITAGEENLREPLRTLEHDPKRPRNNSASPGKGSQARYGQRLRWALGKQPRNPNLGSEILERNLGLEVTERDMSRHETWRRHDIDGGTTRAFRTTPRERPPRVVKHTHAGVSTQAGGGNPGRPRGGQPYKGEPGYDTPKEEAARLPGQVH

SEQ ID NO: 975149 - protein, 263 aa, Homo sapiens
MGKVKVGVNGLGVVSGAMDHQVLLLTLDKDGIIVAINDPISLTVNYTGEQCSTYDSSPLANSMCTRQGMTNGERYVINWQITIHHTSQETRIRSKNQSWEQMLAAADSVAGSPTGCTSHTNRQHSAGASISPGVGTPTPGVHTSSDPTSCIDAPQCFSSMRVAATPVQHSSCTNQNIKRSIQNTCNSIATKTTHALDNTHEPQGFQYPLTNKTGHTAAKPNRHNETPKRNAQMPKIHMDHAPRKRPMNRAKGHTPYTEANNNE

SEQ ID NO: 975150 - protein, 328 aa, Homo sapiens
GRLAVPPRGTARRLTSRGTLRSRHSGSDDRDAGRLMAASSRGTPCAREAGRSTPATRARGPRLLYVPFVAGDRGTRDGSLTDLGPLTARTGATQPNSRRRGLPDGPGRTPEHPVPRIPLGPPTLTTGRCWLGTIKTPCGRPTLVVRTSSPSSPPFNIAFYMPVVLGIDDRAKRLTFFHQRPRADLLDKILHQALNAFSTRVVAQLIRAHPLAFFTPSQPPDPHQTPPSTQAFFHPLTHFPQKHILYLMNFTLTIPLSLVKEHPSTGSLLFWKRPQESIKHTGNEHIWQNLGTTGKGPPLFPGAILDWVPTFTLVRGTIDGCTGHSTIQ

SEQ ID NO: 975151 - protein, 421 aa, Homo sapiens
MAEPRQEFDTLTGQTHAGTYGLGDQDTDSRGANPCTKTHEGDTGRWPDTAERQQALGSPPPSLDTRKLAEVHVDPKLSHGPATQQRQGLGQRMTQHQPQGARMDNNRKTRQNTRRTQHTSTDTAGDDAHTTTKAFADQNTTGPAIQKTRHTQTHGWNRRQKVKEGINRRQYKRGTPDYERTKYPGQARHPRKQRNTMTDGHNTQSRRSHRKKEERQMRTRDRPESTRLRTEQYAATRAPVRARSEHHTLGEVERHRDENGQRRTESRETPEAHPTKHTQERQQSQDPTTDPSDTTNRRLTRCVKRQQYHTNNMTERRQHSRTTRGKARNKKQVHRQNTHTLRPQHHGDSQRGAQPATAGRTQGEEAETQTRGQATSAGHARGGDGGHSRQGRVAKRTGDHGSENTGRGEEREPAARARTGE

SEQ ID NO: 975152 - protein, 132 aa, Homo sapiens
MREISASLGSERPQTFPKLKLQGIDGTCQMVFPQRICGGYRRMGLLPSNMGKSVHGGTVLILGPLLNEKVQTGNRLPPKVEEEQTCPVPLGRRGGGAGTCALPPCMPTTPWRTMDEFVSQVLGGDLGRSIPI

SEQ ID NO: 975153 - protein, 150 aa, Homo sapiens
LDSAPVCIMVRALCRLPRSGVWLLLAHQLLHDHVSCTGGKASGALLRELWLTQFQVDMEAVWGDAVVCLGTETIRSYRARWPDCTWSTWREKLGWSLVPMQESGQVLPVQCTGLLLTRELRPCSGRAVTETQPWIDSTYYALHRVVPHHR

SEQ ID NO: 975154 - protein, 277 aa, Homo sapiens
MNTTEPLQNCRMHMAWVMLAVMCACHHSSVVMMVLHHDDPNAYVVSSSQPCVPHSCRVEVKWALEHQEARQQALVTVCEWPSHLWAPSCEQSRTPDRWACLSLTPVSSVATLVPRSCREPERRPGHAGQRLATQAVVRLCPDCLRDLQGGRAPRQAQTEVHSQGTALDGLLPHPGAVTSCQGQLRPRHEAGTRPALHAAAPDPLEAMTVRYLRDATTSAPGTAHGASPRAGTQHMKSPTRRPKATAHGTVRRTSHSRDNPKGNQTHERQSWMDVERR

SEQ ID NO: 975155 - protein, 239 aa, Homo sapiens
MLNGDLPRWYRLTELWACTESLNKREHPPAQPTKIVRLFVPPVKLLKMAPPLTPGILENCTRRGELNVNYKPEQVFAAVTNVTAFTKSKTLLFQEAYSARCHSKLPQKLKISRGYTSGGRIPKNPLSDPAEFTSPCVWGLSHGNSHNHLAGGTRLHGLNWYPVPQLGKNPRWSHYVRPGPHTRRTALNTTFPSLDPPRDVGPPQKLPRNPARHSSPTAYPPTRNRAHPRSSPPARVQTT

SEQ ID NO: 975156 - protein, 55 aa, Homo sapiens
MLPARCSADTPVTLGRLVRLQPVPMPERPAAAPCLPQASGPNQMLSNPLFSPLTK

SEQ ID NO: 975157 - protein, 294 aa, Homo sapiens
SCLRNPRLAGPWLERGGGGRWSLEAPGGGSGSGDPGSPSPLSSLAAAAAAAAAAQQPTPPNVWPRPPRRPPSTSGCAGCLLLVLVYLHLHGRVRVASVLLMPPGAPGGQCRTPAPVQMNLYCHLGGGPELVQLRAYVLFSLILKETRHAKRNGHKILTQWSSCEAARVQKEFFASNEIVLPASGLVDTAAPINLSPFSTLISLTRDANEAEIIADQGETRYEESGPSWVEDLAPWDSSTLAEVMRDLMSDCDGYKNGGCLGWDNKIYCTTNMTRRTTERAAKETGMQPSQGEKK

SEQ ID NO: 975158 - protein, 173 aa, Homo sapiens
LPSPPLHSPAEGFPGAGAERVSPRGVSRSPGRRYGEREPLANTGLERQEALRTGGATWNINPHDRHKMAEAVRSQIESAQMSPETQEHPHESRILPTCILPLPLQRQGPDDSYRAACVPADNLRRTATDERLSKGWNTGAPTGEFTPRGYNQDVEKGLNQELTTRGARHGIPV

SEQ ID NO: 975159 - protein, 487 aa, Homo sapiens
MYIKGRLCDDSYIIEEHYSKGIKRQRKWQFYVKKRVWTKRVGGSIVSLTSCATVGNCEHMGIDVCESVKKSRRGVTGIVNCFSISRESQTNISGRIHSGITQKRECVVQVDKGNGVQEHVEVSEPEIIIRVVYYKVGWVQSEEQKWSPWGNNDEVPNEGVRREGDMGSARLKGEEKLMFAEKVYMRSLESRGRKKNGRGEYKQRFKDEKERTEKKTQGWKSISGKRDECMDSQKANMDSERMVKLEKEKTQAYRGTPKQVALPGQGTTIVGSTRQRGSQVNTEWGTTGQPTRARKATKQSEEHGEKGEMQRAKRHRRRSIAAPRKIWNQKGRTSQNMCRAVGTKMEQELSIENREEHEKYTRNHKGHSGEYTGETGGKEMKAKRENRCQGRRDRPNEMQTLRRKRGAGQERKRKGEERTQGAKRRHSGKQEERGHTEAGIKETSDREVKEQRRRDERKRERPREKQAKDKKRKEEMKEVVRTKIERN

SEQ ID NO: 975160 - protein, 484 aa, Homo sapiens
ARTPMMPTSCQIIIPQKQVNRKSDIYVCMHLLMRHQGSSHKGKSHQLIVQSHTVANPRSLSTGNIQTELCELSGTNWNSNIMFSIQCPPWYQKDYGNSKASIFIYPRRYDATTSFSSKHVVHAPSKKPSHHSRHAPGIQQIRTEAGNMHSRQASNAHTMERTTHTSQEHWPIHWKLTGTSISTNKAGDNLRAHNHRTTTNHTRAQGTMAHEGVQNRNNNRGTKDRIENKKPDTQAARIDTLTDAHIDHTRETQQRHTHNKPTTTAGASWDNNTPQTSGSTGTTQRIETGRRKRDKRHTNVEAKTHKRVRATQRGSKDLNDQKKIRGKRNRGNKRPTQYRARHSDEETQQGTYRTSTESDERQQNAQGRHADDEQTKNNRMATSPKESQAEVQEMPTKRDPQARQKRSKREKKFHKHSGTQPTKTRRNREAKTEPQDSISQAVNRKQRKRTTKQKQKNIDRTPTTEIRTEKLQQKVARQTKKKRE

SEQ ID NO: 975161 - protein, 205 aa, Homo sapiens
MVVEMKVHDFPKGPFCERGRTCDNENLSLKDTKYCRQFISGPLDAAAWNSPLPRVDEEITHKRVVVLRCSNIPGRKGLIAGVSQHEPLFAPQDKGSQNDPQGGHGGYEGAGNQWKVAEHVGLYTQCAGTAVNWVISRKAGKKFENSALFHKIWKRALYEMPDLFPGPHNINIAQVDHEITNKHIEIISNAVLYHHKVDLDVHSTI

SEQ ID NO: 975162 - protein, 147 aa, Homo sapiens
MDRAKVTARKSTGGKAPRKQLVTKAARNSAPLYRAGVKECLIAYMGPVHRGRILMRIRRVITKSNERASSGRRDLPKVGEGESPQGIQNSYLRFQSEAIVCRLQRGLAKRTWMGLYEDTNLCAIHAKRVTIMPKDIQLGRRIRGERA

SEQ ID NO: 975163 - protein, 113 aa, Homo sapiens
MNDTPSRTNRTAATEGQLTPTSPPGESFSPKLRSSTSRKITHTRPYATHQHSTPATGAQSTSTHNLPRGALRTSTKPRRVTKARPRELTRPEGRPRTTHSTGPATLTRLPQDP

SEQ ID NO: 975164 - protein, 234 aa, Homo sapiens
EGSEARHCWGEEGSEERGAGRGSSGGREEGARRREEGLAPRRNVNQSPEPRESPPICSDLTWLLAAALAAAVAAAEQDQLGERGRTDADAGGCAAQCAGPCPPMTRRSPPGEAVAGACRGVWAPFSVPCPRGAPVFVPPVWDTNYMLPLLAVQRRPGAAGRRAAACRRVGPGASVGAGASELNASGVLSNVLSVRVRGDLQPGRAAAATRYGPFCPTPGVGYLPQWGADELKAR

SEQ ID NO: 975165 - protein, 171 aa, Homo sapiens
MKQGWVPVGRPTRGGTSVGAVGVQHLLMKSSATPVYRTKNQGSFPFTTESSATAAPRGATHGGATPHVVLDTRRYPLWKPTQRGRRAAVETPTTIAPPQEGSTTLVCGSNNSPRGAHFRGERGGEATSPHKRSSPYGRRQHYYQARGCSSPEKRRRMTPRADKQSPAGGRG

SEQ ID NO: 975166 - protein, 170 aa, Homo sapiens
MRKPSENVVRREMQPSCRRLGRIRATTLQCHQAPVWGPVCLPPGWFWCGPAGMSLIRSSWSPKLSLVPVESAWGAQCWPNSAETYKCQPRLATYTQRLPKRRKSPTRVRGDETTAKVNPRSPRAHSKHNIVHNSNNSSYMNTHNKEVNNRKTERAELRTIDYTKIMRSTH

SEQ ID NO: 975167 - protein, 203 aa, Homo sapiens
TTCLAERTPCPPPRRNASVTHSLSPDETAAHATGLLTLTRALRHPLSHPAAHARPSRSTAPPPTRRLARTTPPPPPAPAPPAPPPPPPPPPPPPPPPLPPPSPPPPPPPPPPPPPPPPPPPPPPPPPPSLPPPPPPPPPPPPPPPPLPPPPPPPPPPPPRPPPLPPPLSPPPPPPPPPLRPPPPPPPPAPPAAPPPPPPPRPP

SEQ ID NO: 975168 - protein, 329 aa, Homo sapiens
MVIEVIGKAHKKELEPDSRGKTPGGGRLRNRGEPEFLTMLRENGLGSSVSENPCAEDDKAMFKSMVDVRKAKGSTAVNSLPGQYACRWTRLERQRAITDSSIGVQCMRTLPHFIRRMMYGLEQRRSVCGGTPKLCGVTTRAELLYPRRRMWGRSVKGAHGRRCEPRTGGEWMTSQGVGVDQDLHGSGVDEVKYDDDCVDTSNHREDGGQVVADGRRTSAGPGGRGIWCRGIWVDVEPVHGRLSKKNGPGFRVVTSEEGPGGHPGRGAGEGGAGKTGTPQTRERAIEPLRENHEGPGTGPGEHATGAQAGEEGRRPLNSAAHSPRGPDQG

SEQ ID NO: 975169 - protein, 104 aa, Homo sapiens
MNSDRDEAFYPTSDTRSMEIRVQHASCPEHRNTRALGEGEKIRWTFMVERRRKWEQRFSGLTHTMRSSSKDIDVCNKCPAKHNRNGRVSGHGNKDSELGTLKHT

SEQ ID NO: 975170 - protein, 188 aa, Homo sapiens
MDGPTMGMAWHGCPAPLNDLLRSVLGAMAACSASCSPQCVVKLTSRCPAWWGLHGLTYHYETQEPEPTPGRLVRTPPAGLGCTSSASVRTFLLCRSLCRPCNFDPIRCLRLAAFYSQVLLQVLIIITGNYSFFTPDDLLVLTTALLDEQQLACEPGHGTARKTGTFWPRALLGNPVGCCWNLPVNRAT

SEQ ID NO: 975171 - protein, 185 aa, Homo sapiens
MGRVRTKIVKKAVRCRQEKSTNGARVGPNELPTRRLATLMLKEGSLIYTARRIYTSAVRQAEAVFTVSCDLECRGVTCERVPCNEVVCPITETCHGKEGEMTVTRRKERNILLYTWRDRLDTFGIPGTSVVASCEYLSNYWEIDVNALWASRHSIIVQQRSGVIVMSVPVWGDDSSQKLHHREVT

SEQ ID NO: 975172 - protein, 80 aa, Homo sapiens
ASHPAAVFGLANRSYPTVGLCYSPTDILQEKLDNNFHLAARDGPGMHHVRETRLALEISVLGFLTRPLVEEVAERPRRRM

SEQ ID NO: 975173 - protein, 376 aa, Homo sapiens
LASALRGTRAPPSAVARRCLHASGSRPLADRGKKTEEPPRDFDPALLEFLVCPLSKKPLRYEASTNELIELNSWAIAYPIIDGIPNMIPQAARHDTSHSKKHEEVEQRYVHHFNTHNYPKRNSQLFLIPYPFKTQWQVISAHTERRSLLSSYRCTVLIPLVLFSSELFYYTPLWTDHFPQGLHSAQPAFGFYSLTLAYFTIPSVCISFHPLEPETARTFNRFQRHYIAQPTKKSTHCSPNLHRQRPEHIDISKTHTAMATTTSARATTAIATATNRATQRGARTTHLNPYQSTQPGHPRVMQHNCYYQAETTPYIPTDSTHEQATLRTTTITTTHQLTLSPIRPRSTIDHVLPPSTIACTNNTHISRSVLLTHITC

SEQ ID NO: 975174 - protein, 266 aa, Homo sapiens
WSNDPLLKCFPWCLTGWASQSPTVDVIDDVMRMAAINITAHCRGSPQDLFNGFQRVLGLKDRCRICRAMLTISSKVISPRCQMVSLVSFCLWGVPLRAWIDQGRGRRHHLNLGACLSEGSVSLVILRPFQSPVAWEMSSPTFLGDRPRGPIWAGQAEVAPISPRVHLRYTTWISWGSNSGGHGGGGGGRIEPGFGTTERKLPLGLPPSQGELRQVATPQGSVSSLRGSLLTGGQHPSSGAPTNPISAPGTPNPVRLTAARKQNTKK

SEQ ID NO: 975175 - protein, 281 aa, Homo sapiens
MSRCRTEDVMRPLVRNAGIPWVSRVGDCISKWLLMNNRKHNEEHCYMIILWKGIKGTGEEYMSNVLLGVVMMNGWSGRSHGKANASELRMNGTYKLDVVIRTEEKVNIRMKELWRCFVNGMKMSVMESVCEQIKKGDDEQVLGSMTRDQYGKGSVEDDVGPGICFTRWMGAVATEFSGSIVEMSSKKVMTRFKNVFCNATYKNWYICLITLFGNLILSTGCFLNWSKRVCLYRNSGFHSSKFFSHESSGMIVSVISQNDNVAVSWFRHINALHLLNGARDM

SEQ ID NO: 975176 - protein, 126 aa, Homo sapiens
MNPGPSNWGGWRARAQEAQVAEIRRYMPLALQPVATRSKRLPSCITNHYKKKIHKENLQEAGWGERKGEQKNGDKMGATGGHGTHVLSGLPRGTIGGEPPKDNTQYRIQKTPVNRLTSSKLAQQQN

SEQ ID NO: 975177 - protein, 147 aa, Homo sapiens
MAQRPAACMAPRLRSDTHQQTCRRLNTHRPEQRRPKGGIVVKSPPKTPQWTLAQEPSVSDAMGRATPPRTIHNKYQERPYYRHSIVHPRTSADPHCFPRNRDSQHLSNSILYKPQCGKIQTQGGINPGAQNGARATGPKENTLRSNG

SEQ ID NO: 975178 - protein, 214 aa, Homo sapiens
WQQHPELSCAVPAAGLLMALPAWLCGDDYCSCELAMHVPCCVMLCVHCLLCFDVLMCCVPAAAVLCCQQCTLLCIDVLPMVAVPVCPAELPDNCWPVFSVCPAFCDVASPPVWSHCGCRLVNSLRLAGCGCVTGAFLCAGVPVVLWWPLVVNIQGVFCGAWNPEMMNVVSPLAFGAPARPSGGPHSRVSFPEPGGTLHRLTIFRTHFRYIPPGE

SEQ ID NO: 975179 - protein, 323 aa, Homo sapiens
EYTQASLPSRGCVEPGRPQLLPDGRLLANSKPDPGRPVPPSTGAQSTATHQSQDITSATEQNSSSSSSSSSSSRQQQQQAAAAAASRKLWAPSSWSISPTTWRAVAPTTHTLTPCLPPWGPEALTTRGRTAATTSQQVYYSTKRGPNGPPVSSSSNSSSSTSQGSYPCSHPSPSPGPSWGALPLPPVTTVTLFGYLSRVMAPWLPRQQVQNGSPAEPHVRKESPVPGGYKKAHHAKKSRVGPLRREPSGYEELAPAARLSGATELACNWSLAHVHTWAAAAEYTHEADTQRRSKTTPVKDSTRHSTNPTPPTTKTKDDNAQAH

SEQ ID NO: 975180 - protein, 71 aa, Homo sapiens
GVKMAALCTAAPVPAQFKSIQHHLRTGQEHDERDPVVAYYFVYTQWRLEMKIDSKDSWKCGKFLSEVNGYS

SEQ ID NO: 975181 - protein, 52 aa, Homo sapiens
MSRYYGCARSPIGPDINAAAVGLWAYTWQGRHNGKSEAVARVQTRKYKRYTH

SEQ ID NO: 975182 - protein, 104 aa, Homo sapiens
MPKPSWDATKWVPTPRNRSLYSSHIMTHCDLNELNRLQVRSLHETRNLHKLCLKRDEIGRHHYNTGLFYNIPLMYQSNLLSPFFPSEIKGGNGETIKLIAINDS

SEQ ID NO: 975183 - protein, 115 aa, Homo sapiens
MADDAFTEMEGILDLIDDAWLIIYKLPSCRDASHFPLQVSFLIPEIRIWVGTTESVKEPRNGSGQTLGSFYQYLRMKNVPPIDKADCVRILSCGMDFPPKRHTKIQCDGLCEDAS

SEQ ID NO: 975184 - protein, 411 aa, Homo sapiens
RDAEGPEETVRLWPAARAAMDAAEVNSIAEKELVTIIPNFSLDKIYLIGGDLGAFVTLVYPWEVPLWLAINLKQSTESVAVLPPVAGVDCTKQLDERSGISETMTEDIPFIRQVPSHLTTMEAYESSLLTHASDNIPQGTTKVRTLVKDTCGDTSYSQDSECLLTAFETAVRHSAKLDNLSLEWRSTSSGTFLTQALNTCQTPYEPPASGEYSVSGLLRERAWCQRLAGDVSAPRRELKVPGVLEPLDTLDALKHCVVHRTGSAVVGNNIDIPQQFSGKIYNWLSESERFPRVDKSTLRNLDENMSACNKLRVRVMHTKVRKRLSEIHKREEDGSRLHCFFLVLLCLRFSLLQTGGEQEKRKEKRRKRRARDDVPNSKTTTKINENKAGKKRGQAERNEEKKNQSKESKER

SEQ ID NO: 975185 - protein, 115 aa, Homo sapiens
MASCDRIQPEEKAAHWAQFVFARDCYRLGNWLVCLMIRKIMLRDAKIGNIPIGTHYFRVGDNELAEEGEKPECLANMDLRNPYPNVQACIHLSVNGGLQHVRCVRGIRGAAMLET

SEQ ID NO: 975186 - protein, 37 aa, Homo sapiens
DTTPGGLGAGESGTSTIVKHMRILRVTGFNGEGGEEE

SEQ ID NO: 975187 - protein, 121 aa, Homo sapiens
MLASHKGDEISFVDILRVSPVTDRLASLESFVEAFEFPEEGEIQVTGRKSWLDNTGRWGLGHGDDWTGAMNSAKPYKRNAGSLWADINNSLGLGRKQAGHNGTGTWGAKGSHTLWRVDWQQ

SEQ ID NO: 975188 - protein, 150 aa, Homo sapiens
MKSQAHLDRTKYAPPRGPPDPHHAHTHDSTQHEARTPHDGPPEPTGGARQTTRAAPPAARRATGSGPRRPTPDTRAQRNARAPPTEQPTKEAERRRQADPGAQKDATGTSEESEPRTDKEPGQGRDDGTGQGPEAPAGRDSTHDHAQAQA

SEQ ID NO: 975189 - protein, 261 aa, Homo sapiens
CKTMRRVDPVYIHLAEDYGDPKAKVNILMRKELDEQVERMLGWNFLSSHCTHQREPVPALHGLATMTPQGRTVRVSKGWLISAGIITWLRTNTIPAHPLVATVDRSCRPVVPGCGGNLDRKNHINPPTANPVMHATELCPRLSKTYWSTSSPRGVDRDRWRERDTTLGERVLNAMEGLSQTERSSRRVRLVLGKEKARLSTGMGPGLGRYAIYCDPIMEGKERLDISAVYPRRDFIVSPRHVYTFPLGLVDIVSHGPRKVE

SEQ ID NO: 975190 - protein, 248 aa, Homo sapiens
MTLGDAYEYGWTWETSDLKSIFVTTSNNHIEVRAEKLAVDGSCGDEHASLTSAMLPEDVEPDVGDPRSLRGGLAGSHILRGTWSTRIQNTSQLDSSGRRSKSRVPLAFPLPVSPRHQALPAKASLIALQQLQDDLSPGSSPHASARALGGPILPKLGASYSYPGRPGLPGLTHDAQIITIMGSGSLMPEYRGWGQGRKHLENHCGAGKWEQRGRMRQATEDRQTRQTPLIYESLSSAIGTRDWNRLGQ

SEQ ID NO: 975191 - protein, 282 aa, Homo sapiens
MIALFPHHRNDLRTVSAVLWDIEEPFKGVNINGRLKADKLNCNWRAFCRCDQDEVIGKYEWWITWTGECDPVTLNVISGPTNLSAMTVSVDPLIILTHRPGLRCENLGSRGLPSRRNWTFDRNLGDQLGNPTKENVGSDRWVVEPFVYASKGSDASCLRPDVSFNPIPDTSRGAYRGRVSHTVIVVIEATPGTRDSTRLEFFGQIDKKGQPKLSLENKIQVKEALSVWGLAQKGGVRNHAFVLSHPESQDMGGVWNNQFWAPGAGREFCAPWPQSNLGCGCH

SEQ ID NO: 975192 - protein, 162 aa, Homo sapiens
MECMNPDPVSRNVKTCLEQCRGRWYTGSSRCIVGCDTTEGHGVLIPGINFLDLWVHQEALGRSSSGESQWILISGQHLLMNIEVNPSSQVITHETLRRIEARLYSRQMLVRSLGRGNKISQLTGIQQDSGMYSGHKKLGIRGPAVKCASFSGNRCRNATQLR

SEQ ID NO: 975193 - protein, 118 aa, Homo sapiens
MAGLLLAVVVAHGLTTLCRPDSGTAWNSLIDCNVISGMIRSNLRIFPMRVVYVDIQWTQSDYPISLCVRARSDPLRGGIAAMLREYSSSLEGRKKNANTRRGTVLSSVHCIGVVQRRT

SEQ ID NO: 975194 - protein, 547 aa, Homo sapiens
PPAIECPNPDDYVQAQAPIGYLGTYHIGGCADLRCIPRLMRPDMRTTATDCTLTILMAQALAQEGNDFSGRPWNERAPEGVGAKKDVSVEDVSRECVEGSYILVPPCLSRYADSSCYCTDTAYTPSWSPFISSTEGPEIGADKTKWVKSSQTGYGGAKYVSHGGHKEKLGNRLRVLVMRLKLLLTGPPRIKVIAPWEEPEFYNRFKGRNDLMEYAKATWDSIPVTPKNPGDDETSAISTVLNLRTQTSAPGLTQNQDQQSPNPEFEIVKKAVSDTYVAPKSGLVKIENMGDMEHESGYTPNIARRTSFAFCSIFCYEREKQNENKKAKKKQKKTQKKNNKKKRKTKTNKKAKNKKEKERRQRREKREEEGKSEEKAERKKTGRGRRKETGKRQGRGRTGEEKEEETENERKEEAQREDHRRQGKKKKTDKRGTETTRRRRNEEGREGGQQEKEQERKTRTEKAERQREKKSDREEEREEESERMRIKETRKEQENEREKQKAEREKAERRSRGTQKQTTRTERKSRETRSRGDKEDRTKKQRRKRRR

SEQ ID NO: 975195 - protein, 138 aa, Homo sapiens
NLEIGGDAGGRIGCKELVLHVRSRTPESQPWNRLRVEQAPPVIYYVPDFISKRTRRSICFDRFLNAPKPRVDPVSLRQTHVTDTGRAASLIPDEDWFLQRLPPWFQRYVDKCQTSPSLDASQSVHVLVNQYLPGEGIM

SEQ ID NO: 975196 - protein, 243 aa, Homo sapiens
GGGGRKRKSRLSLLEGRRKAEKRGGEGEKRRCPLSEPSFNKPKKVRSDPKKRSVQKSEEGREDIITTGSTLVGFTTSQLRKTITPEVLTLRGRKTIKKTRGGPACEEGPSRNEGTVANQWVWRGKKACAGETVVGTWRLPHRQWWAGGKEQKVSKAQLTQRDAVTFSPKMSLGRGETLKVNSGGSLWEKPGSQFAPGPHYKGARPVSWLEQRTSTSLCVLIRKTRWPMGGLTNLIRRSGGFSQ

SEQ ID NO: 975197 - protein, 270 aa, Homo sapiens
MSKTQATEEAATTTTAEKRETAEAPQREHEKRRAEQEERGRARESGEERAEEKEKGATQDKKKKTEDEEETGTEEDGRQKEKKGGEERTSRRREKRETEAGGGRGSGSGEGSGRGTSERAESRDRKQRGQRERRERQEGRSRRRSGEGEREKQRRRTSEKRGRHRRRKGGETTRGGRSGGGEEATRGAKRSAEEGRRAGGHNIGRKAERKEAGAEEAGGSEGREGTEGKRRRRGRTRGGRKEKPGRKQEGAQKEERRERAEGAGTRQGRR

SEQ ID NO: 975198 - protein, 84 aa, Homo sapiens
VHRCRLLLLPLLVLLCARAVRTWYLFVKRAEEKSGALPMARAEKPKVEESKTENNIILIVKVAGQDGSVVQFKIERRTPVSKHK

SEQ ID NO: 975199 - protein, 120 aa, Homo sapiens
MHMCSVWDYYWSDGESLRIGMQRLTLGNSGRQGTALPEPCGMRGTGLRADKWGVYEGAEIGETQSYLSGLDKWLRANGGMTLTRRGLRPTGNQYTSAATRLGPQAQAHKDRTHNQRQVKG

SEQ ID NO: 975200 - protein, 325 aa, Homo sapiens
ISEHLIALREVPHEGPTVCTCWGQIQMTEEVGDISPSKGPGVTAFGLRYLLRDVDHARWPSRGVSRSSSQLVLEGYDWVAMSRECDHPDVLSARNYFGVIVVVTKTVYFYVEHSERYSFYNSDFLDFGSVDPQALLRRTAEATTVHLRYGYTRHDLNVSLQVNTCRNNSVRKYLPVRTIIIRAYAGNGGGRRHTSKLTSRVHDTDAGHNLISTQNPGSYSTWDPKHGMRPTIANQRQALRDSQTARGPTLKTRNPASSGPGRKPTTLRAKRHLARRQQANSGEGTPAHLGQQTGRRTETGTTPAQNYDKPHHEHRPAARRRHAPT

SEQ ID NO: 975201 - protein, 311 aa, Homo sapiens
MRPGTRTNDAQIVPRRTDTERHAKRTNYVTNQRCGTPTRSQKGGHHQKTVDRETELDDKHETGEKQKEESENKKSQPEGGATLQQQQTTKQKRGYLGHRRIEGCTNKEDNNEDHTTHRHKHTDDTNGASSLQHKRETIYYHKRGNRWRNNTEESQTTPRSTGAEDQSHKTTNETKKKTKQKTIYQQKLPPRAETQTGKHKESKTERSKAKHYRRKETPRTQEDRNQMRRYPKVMDDQPHTETRATTRTEHNNTRWNDINNRQHRHSSESRIMTRTRRGKRSTISRDEQPHNKEHTRGNNEQSTQKHDKKNP

SEQ ID NO: 975202 - protein, 473 aa, Homo sapiens
GHVSERVPTRFCLIAFNKCIETGTESEWTSSSQPPTSPSDIPYIRIETLSRTHTYSSHSSMHYWRTLHKTPYYKDRVRLPFLCQNPSTVTTTTEFQSRKINNAAETLTSEDTIQARPRIHTSWSPLARDTTLNKPYPFLLHGELHDNKSGSIDCEDIVGKMDDCTPNLILTTAETCVTRKGQTGSATGPYRASGSIHWNRIAKQTHGCGQDTERHSSIIQVKQHKNEKAQTSDTMNLERYKTPPENGTKDNSTAKMGPMRKQQTAMTPQGHLKRATLQQQAPKEDQRPRTNGEHHTKHRGATMTDESNYQYPFSNEENAEKAYIKEKKAGDKTRNREPPEREENAPTDTATGKHTNRTGTSYKLTENRRHDGRQNPYLKATMQRYRGRGAKNYLKQSTHVHTLNDGTKGQTSDRPTETRNHTSLYRRSINLCERERKDRQPQRRERQEREGNQELTPTPLYVERAERQQIVPY

SEQ ID NO: 975203 - protein, 220 aa, Homo sapiens
MHARAQQANPPLQYTTMAATTQYKRDTGTTGVRTPPHARPCDTRGHQRRPPTTTPTLTRGPKERNHGRAHPQTHQKRSEATTANWITRGPTNINNGQRHQLEPRNEAHHRPPPTSHRRATSRNNLTIPPRRDRTKTQEGPGETPVKGGRTTDGTQQPWGSKTRARYTRSHTARMRAKEPEQRHGTSRRTSQGTPPPVRERAPRGTRDDGPSQDAVHNHRS

SEQ ID NO: 975204 - protein, 283 aa, Homo sapiens
AADAESVCSRGHFTDSLAPDTAALSIHVAEAGRYSGPQDAECDEYCDGERHWNVAEYLTPVLKASQFKEHRCNYPRRVSGSWRSPSPPLSNMATWAYRGKNCHVQAIPYQQGKHIIRITTNMCRAYKRVPNSMDIIRALHSEAHPSTHACMVMAAGSDTYHNTAYYTDITGNSPVTTQITHWKTLTGHIIRLHKTWLKHHNVNDATRTLQADRQNDCTPIETDHTERSVDMTGQHRMQAYPKDIQGHNADRHHDHSPHNGNTERLQDTTSRPSHTPLVPSTIK

SEQ ID NO: 975205 - protein, 99 aa, Homo sapiens
LAYSLGDEAGTFSLTAGGWCSVKLVHLRDLLTAMTNPEITTEGLKSSEDMSPETAFREAEQRSNKPGGDFAGSSRGLIRSQVLTSRSLQRFACASGCSW

SEQ ID NO: 975206 - protein, 299 aa, Homo sapiens
GSIRKVPDGVCLLHSTVVWTEQDPGDSYFQPPNCPPHYPLRLHSLRDHLTRTSPCYLETCQNRNKWLSSLLAKPTMSSQIRQNYSTDRGWQTVKQALANRYLQAYLPTTSTLGLQYTTDDDVDSGRRDANHYTEKLGRGRKREGQRAVSCKMQHPAIQGRDHSNQRPSSKATEDCVRVTPPSTPIDNACQCTHVTTHTFESRPHLASLHALRIMAQNGPHNFYLKYMHDVIFTTLTARATIFTEPTGMHHLTQASTRRSRTRKNELGQKNLCTGHQINTDKKTMDTPKHMTALGQAPGI

SEQ ID NO: 975207 - protein, 89 aa, Homo sapiens
ESSVSSGRQSSRGRSDIIRLSAEHLKTCATRCTQCQHLIVHAILGCGTYVSIHLLPENPLQEPFKNAWNYMLNTLYKVPDCNMGIPYSS

SEQ ID NO: 975208 - protein, 138 aa, Homo sapiens
MGRTNGKSVMSVGVVLFALRHGMQRGIVYNPCASSLPHRLRVPINWYVVTRAVRLSRFGFVDYHSYARTVWTTVTRRLQDMSVVSLLRSDTASLAHVFRAHGEENSWGSRMDEYDIAVMPDPEDLGPYNDADDQHLEW

SEQ ID NO: 975209 - protein, 158 aa, Homo sapiens
ISEHFIAYKKFPMRFQVCDLLVVRSKDESRMSWGYISLEQLCYTVWRKIFLRHLIIANGLTSVSRAHQLGDGGTITGSHERNVDKDYQCSKVHGYQLWKIIVLFMVLDEYYYQRTTVLGRKDQHARRERVQNVNYVVPQTTSCTEIVRLEEYAMNHDI

SEQ ID NO: 975210 - protein, 136 aa, Homo sapiens
MDGRLWGPGWGMQWVLLDDGQLASRSTSSVPTAGPLRLAGSMGARSRGGQRVVLGGPGERSDSAEGVRVHGQSVRLIEPVTVDSVAYEWLQIQAVHISIRGNPEGTWSSPLGSHESRGRSKSTNAFEGFTLVGGKL

SEQ ID NO: 975211 - protein, 205 aa, Homo sapiens
ARSTLEYKRFSCLSLLSSWDYRRATKLPYHAHNYLTSDCININISTLVLPTHGLHTIEQQLHTRFSTPQTVNPQQRIHNRTRHLNVSQSLCRQIRSPTTTCSNTNRCEYYRRTQMQHFAHSNHNAHWPHDYTCVTHSNDNPPNGTPLAQDSHTRTDYSLMKSAEHNTTYWSAHITHQIPPDTQKVRQHTNPIHSQRARPMKTPTN

SEQ ID NO: 975212 - protein, 562 aa, Homo sapiens
MLRVQVSMTDRPPGYKKQKLSGMDELNAGQRYYHQGTPRCTQSRHKDADERTSGHYNVPRADPTRGATSPAEHTHTTSRPIDGTSSSTHTKAASRHGRATLTATDRPKRRAPPHPNRAQRNHNHCARHDKLERHHDSGLPDQLDEQKARRIERHRPGHGATPGAKYARGQLGTDLNIRNTTHATGFTLGTEPTAPREPARDPLTQPTYNLAAGKHDSHTHTPPPPSTPNTPHQHTAPGHHHNSAPNANARTTGLPIAWAHTPTKHPESAPDARTTDRTDNTHDRAPEQPNIGAHTIAPTTPHPHHSTTHGHTRYATRHLSHAAPSYTPTTTPSATTPQTRQPHHEDRPTATNTTQQTTQPRTNQTQNKHNTAAPAQTPAPRQHQHNHAATRGTTHRTVTAQPRRHHHAEHTPATQPNNSTHQRRHYVTRHATPATTPPTDETTQAKRNRDAQDRRSRAQATHNTTVNLRVSYPRHARVPRSAAGRRSAGTSSRPGETERMNLRRNIPYCATPHRRRTTPARPTNTSPPVATPRAAAHTTPATQQNTTIHTRATPTPRRTTPP

SEQ ID NO: 975213 - protein, 449 aa, Homo sapiens
FAAWLRLLGGATHAAVSSLVVSSRPLSAGPGAWRAVTPGTVAPSPAELKDKTLCLPRSAHGCSHPSILPPALPQTLTSPTITRHLALMVTQAGYITTPFAPTPTRTRPYPQPHPQERHPARTNAPPRIGLLTNHIQPSRKSAAPPPKHTPRPLPPPQTPTAPKPPTHPTPAPAPAPPPLTPASPPPNTRPPTPPEPNDPPAPPAPPSAPNPAPRPSHRPLLHSARTPCPSPPPPHLSVRHHPPIQRPTSARPPHTTAPNNRPTPNRTSHRAPPPRHNTLPTTITAPLAHPPSHHTHTRPPNKPTQRHTNTDTNNPPQQHPNRQDHWPTTQKTDQLALTKDTHTVGANTDPTQTRPTHNNRTHHNHSAPPRHRAHHRPHHRGAHHNTETQAHRDNTDGKQHAARQITHRQTPTRIHATHRAHQQTRALTTHTRPEQHPTISSHHTEGYTR

SEQ ID NO: 975214 - protein, 494 aa, Homo sapiens
AVTNDNGGDGETSESSQGGGRRPRALEMENLSVVYACLIGWPSIDARQSEFRAVRLANMLSDIGGVVDWTALVGGGELPPRILMAFHDSISGVSGAPLISRTVWHGRREQPRRDWAPAPSDLLLDSDAYRGLTESLLGEVLDMSVSGVSEPERREFRCWLGFTGEVLKRERDEVSEGDGSLSRYEREAHLRRWEGGESLGGWRTLSSQAKRMSLRTTYGAYPDGVHNGAHAALHWAQTHNAKVPGSHRNARWRMSSACIRRLTYYAKDIQTEPALWQTINNGGRDAGELRRITHFAEHPRGHQSGDWAGGGTRHHGKIAPTGNGLIEHPGRRGMRRPNIPRGQHRSGNRRAKPYGTHGDTAEKPVRSHRPRSRKRKATHQQRRRTPTTDKNAARTQPSTEHVPAPPTMKRNPDKAPPTPTSTAHTPTREETRSPARQQARREEKKQPKRRRTERIPTAAERTHTSGNHNSKQTAHDERNPKAAHTSPARPHSAP

SEQ ID NO: 975215 - protein, 542 aa, Homo sapiens
MHEAHSVFHKHELTQRNEHERNGKSSDRPRIHTTDTSVIKHTCARHTPQTTWQEIDNQHAIEGKAAPKAHEAANTATNSQARARQDHQTGGEGPKRTNQATNHNNKNQPKSNVANDQKTITYPQRNAYSKHPDNAVQYTPAKSKGHTNEKGQRGDTQPLTWATTDTQRRRTQIAHSIQHSRRAHSTRRTEKRPQKKDRKKNSKQNRGGQSQTLRGQKAGHNNYREKNTQKYRLKPHTHKVKQKRTTTSSHPLMHKHNHNESEWNNTNTQHQQRQAPNIKIQQPMQETKNKQLEETNYHNNEYHNIHTQNSAIATSNIDNTDIQVNTSKAQSHNKHKNRPALYTEQQARHSPAHVQDEPSSHRISTHNEDTYDPETDKERTAHKYPNPTEHAPKDCLKTIVKPTHTYNYTNQIKTYTDNTEETPLEDQRRLNINQQREHTKGVDAHETVDMRTDQTQRNSKTAATNERRIHGYIDATRERQTRWLSREVQTKADNHSMRAEETHRELQQDKTTTGEDEKKPTTLGHGKTTYPATQHIRTKAEK

SEQ ID NO: 975216 - protein, 375 aa, Homo sapiens
MVSHTHQLGAQHSHQRQQRAPTHPHRQHMRCISLALLPKASAHPLHVTTPHNNKFQSHQPRHTRNRLTTVTPDLGNSMHQTMRIKNTRTRQGTHTGHSIKANTTIKAHNPHTQLCNTKRPGQGKQEQQSIKAQPPQPPTLQGHNYEQSTKDHTQPRRSKETHNGPVYQQAHSTNTTDPEAVTPVKHTHTITQRNNPTLYLDPWAHTSPIPNNSPTHTGNPKARNSNHPNSRQRKHLTQATQLHYKGYQPVPQHPNLPPPITDNKRNTEPLQASFTHTNRRTNLEPDHSNPSRPKVNNKPSSKTTQQSIKLTETGEYQMGQEPHSKHQGPQCPVHNKGTHGRHNQQTARPTATPIPTTHLHYTPHTLVTTPTTHTP

SEQ ID NO: 975217 - protein, 126 aa, Homo sapiens
MNNGPRTNLVNQLQDERRHQVCNPGDTRLSTKVIMTWAEFGVQELLVRVQGGWSEHLRSPSSRIGVGIVVGARRAEVGQNITKGHTLFEESYVGCMALDDRNLYGNIRNESSTPSGECEAPSSWDV

SEQ ID NO: 975218 - protein, 248 aa, Homo sapiens
MSQIHGECKRTTNASRTTHTRRQANQNSRHTHTTIALTKSPINVTTPVCNRRNRNATATTKRLATHTEKTHEDIHTLWTDAESDDKNGSRASETDRERKGNNKNAKSIHDHVVRGDHCTDNHGHKVNETTDDRDTTEHMQTEVRSNGTREKVKTTAEPRSSEGTRNKKEEQERNMDEERKENQKERLRPLSGEEYHEASDKQGDKGEINRGRKELSGIDDTRNSKGSERAEHAYAIIGRRRSISTGRE

SEQ ID NO: 975219 - protein, 153 aa, Homo sapiens
GRLGPGYTYRGKTWRACAEALIAWSVYSGGSRSGVRLRRPMRHSAQFGARGKPAPREIVSRKLSCPGKFRRMYVEDDVDGTVLLMVWSTANGPNMPYVIVAAICMERSSGNSYFSRGHDKTRESCGSNQCAGGFCLGFPVVIDRPRKAQVTVV

SEQ ID NO: 975220 - protein, 144 aa, Homo sapiens
MAPMTPAHTATHSQRPRTQALTQPTPGKSPHRSAYTTTDPQAHNTSPRTDQHNNRQQPRTYHTHNKPPTRHTHPGNKRTRRPHNKGEGKHTRPTREQRETTKQAQEYNNGNHRKTERSANKQQHKHEDREQNKNAEQQLRLPPW

SEQ ID NO: 975221 - protein, 522 aa, Homo sapiens
TLRPRVPDQPHLQCNSSVFNTSTQHGQQSVSKICPSHMDRLVPWSSHFVMQQPKHNTAQQNAHSITVPTNPRSHSATQTMQTQLSGQDFCPLCTEFRQQDNTQPLPQTYPTHITHTFAICTTHHAILLHSNVQTKQRTTVTAWAPPGTTGIPHPYIALEGHNTNRPPPYTLAMDTGHTATLTRTHMPNHQTTEEPPAHAHGTTRETNTQTYKTQPKTPKDIDQGLTTRHIMADTKRPTQKAPPPHYPRKQQRRTKKHKGTPETLGTNRGPNRQSKTTNNKRAHHQAMSATPQHTHHQHTQQDDRATSQQHEHHITRDNTHTPDTNPTVGSNDPDQETTGPHNNRPTNRDNTETQLMAHKRRHTKHKQTTTDTAQTDTEAQNKRDNKEEQTKAGRQRNENTRQNQPNITRRKQRRAIETTQTRAHSRTPEKPSSRQQTTRDPDKHEHRNDTRHKREGQNEQHSNQRNQDKTEAKKATTAECGRRHVADRTEKCTEKETPNKNTARQSRTTTHERFLDTGNSRT

SEQ ID NO: 975222 - protein, 47 aa, Homo sapiens
MDTDTRGREQQGYLRSQRQRRGRTERRTRESSPAANAARNCPNAAPK

SEQ ID NO: 975223 - protein, 318 aa, Homo sapiens
TLLLVEEKAHLNRICPQFRALQDSVYNQIVCGIALACPIETECDIVRQLLFTDDKRREAKHIRQYYVDVPSLAEPFQVKYIDSGISLSEWRTQARTSMRGRINMQTTSITGPLRRSYSLGKTLGPIITRTRAAVRIQGFKALDTFKGNSSQMFLGILLTDTSVKRTRIYPPTIVLILTTNIPDRIDTACASRTRHWGHVFSATGYIDKTLSPNETEFKRHSKTALVVYFPFQQPTFNKIGGADYTPKKIKPFIAGIQSCMGIDEGDSLSGCNGILGVHASHILLHALGPSMTHTTTVMVTCTCTTAISANDGQHTFGQ

SEQ ID NO: 975224 - protein, 272 aa, Homo sapiens
VCFASTHQRWTVPANLQGTQSPAEFQVQEHSLLETSKTRPKDKKKNGELQSLKTMGVARIENYYYQKHFPATKRKMKTERDFNHHQMETVIIKEITGFASCNLHLVSDEGDRVELESFLRTGAPLTPNLFPVRDDDFRNAVSVLTSAFHCRGSWHCEPRCSIWCHHRAASLVCKTPVSCILTKYTNKGSDGRYPYKIIVKASLRKQKSRDRCSPGGQLPPLSKLLAGLTSNTPGILTCTRVCHPGTGAESRRALNQADSEHCSDMTTNTYPN

SEQ ID NO: 975225 - protein, 129 aa, Homo sapiens
MNNLTQNGSQDLTAKETTTYTTLSKTLVAKHTPITPWQPRAHHSQPKQNNTVPPRRTSPTPTRLTKRDTIHNAHKKRWQPWTLQQDPAAAPGTFHTLALEQPTPSLLKVTRNHLLDTAQYRFNPTFPKY

SEQ ID NO: 975226 - protein, 234 aa, Homo sapiens
AKGEWAAGWVRPCAVGPDELTATEEPTCMGIPRLPTSSGVVIDGTRCLELRSASVLAPLDSGATCGHATSRSPVRNQCMRAARVRDIACTTVMSECRGRACTRGGRVEQSAADALGGPGCSSCVGPVLGEPVVRSAGGMCADSSYRSWVGGSTEGRAGDCPGYRVGRPWSLMRSPGFDEDVPEKGSVVRGFGEHLRNHSSERRGSVSADPTKVAPARKPSAGDRTVGMEKHYKL

SEQ ID NO: 975227 - protein, 135 aa, Homo sapiens
GRAVERMEARSSDEGTGVKWMPKKKTWMIQQTDFLVGIHVMNPFWKHVYKLVYGNNASGKVTRRHHTGDVKNQVPPRNSHKTQHKVPIYYHKIYLPIKLKRYIILPAVDAQGTNQTMGTRIDVSLIGNPISYPGT

SEQ ID NO: 975228 - protein, 382 aa, Homo sapiens
MSKDAPEAQLAPDFGPMRLTRCHGCPGWRTYTLKLLGPHSMSRGCSTMPRNYPGPVGPDRASDCLDPVSPSWCGSSRHRTTAGALSWIDSFLQARPSTSHVVVAADTLPYAEPWPCPESHNSAHGSMIQKPTCDRHSRRLEARKTYVDTEISGPQYLTGGAGTERNLGTELKQTLRRRAAPEPTQTDKINEWHAPGMDTGTNPCKRSPGPQDKGPAPAPAVRTQTRLLGSKDHRHEHQRSRDDTRQADTVRAGPWHTHSEPQQTHQQDAHPKGTGEEENTTNYNMKENANRGWHERRTERIESNDRRRSTNTPRPGRTHPPTDTNRRNHTRHNSKDRKQETHKRDKGPQQKKQRHQREPTNAQLATQPPPSQHTQRRSNLPK

SEQ ID NO: 975229 - protein, 166 aa, Homo sapiens
MEGYQGHKNPRARGTNNPRREGTRVISGKATGFPGTTGGGGHDVKRRTQENNLAFPKRTWATTPRDERLRGAQYGAGNHWEGHTRRPWHLPGGTNKGDKEERQQGSNNKGAQGITAPAKQYNYRMGPLGTTAQQQYTQTHTQPPITSGTHASSTQRKGHHNNQSGQ

SEQ ID NO: 975230 - protein, 141 aa, Homo sapiens
LIVPMLSRKGIPNVTERENSRAIYKLRKGPQRCRPRTGLLTNPSLEADDKLCHRRGAPKRPATSTRSPVLRSPRPTLSSRPSLFVLWNPLSAIPNPLVNLNLGLRIYSSLPLAYASILNPLIRGEHQHVETTPCSRLHCER

SEQ ID NO: 975231 - protein, 200 aa, Homo sapiens
MGSRTAQWRSRAIVTTTFSEKRLISKRIWTIYHSGTPTDSGTGIGPIPTTNTPPPKWAARPEDILSDKFGHPPQTGQTNSSGRKPNLCGSTVSTTRRNPATTAVAGQSDSSALTQPSAKPLSGHNGELFNDAGKEAPSSHDFIPDRVTNQHVHSATHRRATHHRRRQLTNLLHLGQRGTHVSAAELCKAACTYHKSREPH

SEQ ID NO: 975232 - protein, 617 aa, Homo sapiens
PGPRVHTCSGLQDGFSHTADIRTLAGSSPSQLALCGLWCLFMLPGSAGVTLGLTLEDEPLTGLRFLQLHNCAGATVMPRCVPGAHALHARPVGLHAADHAAASSSLVAGRALACPQCPAPLLLRLPQRGPLAASAHLGVPAAVLTCTSPWPRTVLGTGKGAGACCGSEPGTRWLLVALDGGTALVQPRPNGCRCPQWTRYVRGSASRSLAIGPGGAAELRSPVLEARFSCFGKAARVASCSMTLGRHCRLQVWGYVSLVREPAEDKKYGASSAPLVTEDSERIQGHGKANSEVRYKNHTRNEKTQTQNNKKTNTNEKKHKERNKEQQKQKKRDKNKRKKTSRDEEREGTDTEGGHERQREKEAGRRGAAAGRGKDDGSTSGRRDEREEAAREEKKTLKEGDETERGENGGEQGRAEGGEVAERNTRNGEGRGEAEKQAEKAGSKVASPGVGEQRDGESGQRREQKEEADGRGKGRRVEAGVEATRHTGGETKRRGEQDAEAERSGEDREREEQRRCPEERGELHGKKGEEDERQREEQTHRATHKRGKRRDRSKKKELKDEARGERQAGKTNRRTEEDVRGGGSAATQSSDRPQSAAEHGAESRATRHHPIRKDREA

SEQ ID NO: 975233 - protein, 151 aa, Homo sapiens
MVVDLCRLRSCATDRSALVHANDARGCRESGSCYRAGSFVCLHAVARRLMACSQDYSAVGDTYHDDCLVSQVVVWSIRSRIMKTVKDCNCGLGSDIVSESYYVRTDTVRPLWVEYAWREGTTDDMSRGGKRSHDSDSGVAFEIGGYSEPVR

SEQ ID NO: 975234 - protein, 124 aa, Homo sapiens
MCPQVDLFYYTHLTTAPLAGRRCCMPASWLNQEGKFVAAWASPDMLAGKWPRSVPSATAWLASATVYHVMYQRPQPGMCKPTPFPGSSHLDLRFYAVKPLAGAACWHRPPQPALNRLWHPRHNF

SEQ ID NO: 975235 - protein, 72 aa, Homo sapiens
LAVGSQIAVLAISETPVGVGPSEPGAGYNLVAAPFIKPVRKAQYSGGSDPICPGVGFHPLLGLNQNIPVGTQ

SEQ ID NO: 975236 - protein, 134 aa, Homo sapiens
LNHSPKTARPRLLPRQPLAKPIYPNQQSEAHQNMETWQQIDIVTAKGQACKTFISQSDHIIATGLTPYHLLPYMHIQLSKSTLAKAAAKSLRPRETQTRLPQEQLKEHSPSYVRHNSGTRLYTVEAHKPTEPGG

SEQ ID NO: 975237 - protein, 113 aa, Homo sapiens
MRFKQNSPPTPFQTLNDYTPCAAVKGTGELAAWNERRHFIRCFASTCRLASREYSLEVEQRLALSLWGSIKTTGELGHNSSKPIVESRKRGSITESDAPKRIPSTGGPKRLGY

SEQ ID NO: 975238 - protein, 240 aa, Homo sapiens
MGIANRATRSVKESPMQHRNPGPHSTVARVACTAKPFSTKLLDVPRAMAGFGPMLGGGSSPLSLPSGSGLVGSSGSSSTFWLACSHAASVMGYQVPWSHAGDTGGRPICILPSPPAPEATYRRAVSRPTPAVVKRGPKKPYRGYPEGTHQLGRSPRIDPPGKKTASDENPPEMLHRQQTYSVQTVVTPGGAPPKDSCRDTQQLALTQRSPRVYYHQLHNGSVHNTLSYTTTSTSVGANYR

SEQ ID NO: 975239 - protein, 461 aa, Homo sapiens
LGKPHNLLYLYLRRNTCTLTYLWKPKFGHTATLRTDVTYGYDNLRPYHSTTRLTDASTTCRLDDTWNLQPYQSLLSHDYPYNTLPSTLQHGHLLYSLYVLDTLQHITTTYLLASRLSHYPFTNATGGHHTVRGYPTASGTRSTRAPGPRTTLASLVATGVAELVTHGTGNSPNGVRAVCKDSHPYTRTTILPYIPTLNVTHTPNVKLIIRGHFHQDGPPGCTSLRVPSLTHTGLGPLQDTSPWRPPCVTPNILSKAHTPQGTLSAPPQQALTRLTYPNRLLKITPRGYRTNQPQRTGSNHSNPWPPTHSPGELRTVAKYQRQGRTPDSRCESHDHTWLGARPHVQNRYATAVQNLGAVTTRPRCSRTGEENHKTRPGPTGPPNNETPETPHGTTAGPTRTDHPSKGNPVQDNNLPNQRDNTLDTAQPDNYDTSHKSTAHQEDPHTATDQNLDRHTADPRKR

SEQ ID NO: 975240 - protein, 251 aa, Homo sapiens
MPFSNSHNALKLRFLAEDEFPDLSCPQQPHGQGADPRAVLRMLRCQGALPELASLLDRQSSRTVRVTTLVPPCTSMTRGLAWPVLTEAVLTQVFNGSLRPRSYEGPGTGCATMPKRLQHNDLTSTPGQPARAWLTDLGTHRLPCMTLRERCSDRSLPRIPVGFHALPHTAHIATPAGETAAQRRTIRRKPQAGWDSPLIQGLATWREPLRECPRTYLTTGLKGRQWTREAPGEPRQARLNPTRAQLSLPSD

SEQ ID NO: 975241 - protein, 174 aa, Homo sapiens
MAPNCTQRTTQKPGDTTNRDNHTEETSPKQERTHDKETLGQRKHSKSPKHMGDPPRRKSAGRKQHDHNKSLLGTNPDRGQKSRGRNKHRRNHGTNEKQIQRELNDNNEILSPPKRGHTQSCTKRPHTSKQHPKEMTTTRNTTTCEDTTHRSNKPSQEYPINTEKGKNRTTEKHI

SEQ ID NO: 975242 - protein, 403 aa, Homo sapiens
GAGRNLPLAAEQTRQSCPMNSAAHERPCKRRLDSETPRTPTRTHRKQPDQPHYLTDAPGYPAAFRPDAFHRRHRRRFRTRTTRSQHRFSVTYWLTRISFSLLYLGTRTLVTTFHAPDSLNLPSSASDANALGTGLPTPLNTGPNRHTETTANEPANRPLGTAPWHPTQRSRHRPFVHASMDPPQLGTPDRNRGPNATRTLAWHQNPPGRVRPSRTPTNPSRGAPPTPHNWLWSALAPATCTRYTAHGTPHTLLPSTNQPLVFGTTETPRHRRHTNVLACPAPPLRDAHPPPTPRDTHTAPDYAQPPGPCAFLPYLKTTLIYRANWREHFSLQAPSSDLWPLSYSCRRTLAAPLPRRASFLPTLATVVTEPPRFQAGHCRRAPTLLAGLTCSLLHLLPNTIGGL

SEQ ID NO: 975243 - protein, 51 aa, Homo sapiens
GLCWGGSRATGGGCMPPTSDQPSCLSTNAAARLLRRRRSLRLNRSSRRRHG

SEQ ID NO: 975244 - protein, 157 aa, Homo sapiens
MARTPGPSRQLAGLTWWFADDHELSPEQENTLKRRSQSPVTVACAGVSVRKFTLTMSYVEGESLSAWARSTSLNESLSFMTGGHDRCTHSPRRCHDMEITRQRGAHNRGEIIVEPLKAGMIPRDTDPRRGRSTPGTRKIIHGKRDRHVRGEHKTLQH

SEQ ID NO: 975245 - protein, 67 aa, Homo sapiens
VDGAAISHVVIQYLKASLICRDAHMSPLMRDSLCGIGRMMKRYSILKTKARTTLPYILEGDSNGCCE

SEQ ID NO: 975246 - protein, 102 aa, Homo sapiens
MAAVVVFGRKSDEETPELIPLGLLPIQGYLLATLLGCLIEKVPCVKRSWGEYATLIALRSTGINYFNSPWGHHSTIYRGRADFWSHEGVKFLAPEPFGPVLH

SEQ ID NO: 975247 - protein, 94 aa, Homo sapiens
TDEATGCRRGDENVLGVLCKSTNANINRFVEVIRVHYIIIFKNSKEVSVAVYLSKSISIFLLIYGEILRNIDLDFDTIYCSGITRLCGGVGILR

SEQ ID NO: 975248 - protein, 130 aa, Homo sapiens
GAWGLRPHALEAEEAALVANAVAHDVYALVVVSILPHTPGGTYILSMIIVRTSKCRLAMTGLNMAHSERQYAFLGPYRQVQIATNTINGNGLCQFQFSLFTNGEGYARLHYLLGTDVETCRQIYSPEEFS

SEQ ID NO: 975249 - protein, 420 aa, Homo sapiens
MAEVEQKKKRTFRKLHLPVRQLDRRCEHAWNKCSLTDGRHDLSSVLSKCSGHVGSGVLNLGPAVRQAAVPAEAPAQGQEGGAAPWKKPEDGEDARVRDSESSPTPMKVGSLVGVYESCKTFNSGGDQAPEMICYYLGDVLHQLLDPYSMAGPGIGAIHSSRFIPLKIVASTNQGLHDSNEEHHHIKTDMKFPGCRLWDGTHQGLQEARHPRQVESDVAPRELAGPDSQDPTDMGVEGDCGQPYRWTMGLVSPKRRGSGPVRGHHGRPEGRGNKWGWNMGSGAHKTGVHMVGDGTTHKRESKHTRPARKIARDALKSPTGSRKKPATGEDHRKRGENQGQREQDGRRAEENPQSRRHKDNNRGENPRGLSTQEETNTRDKTGNSKEGEEKLGEKGRSNIEARPGADARRSRTNAKERREER

SEQ ID NO: 975250 - protein, 103 aa, Homo sapiens
RWKKVGEADLLSLPAFIFLPCCMLPAHEHQTPSSSALGLLDFTPGVCQGLSGLQPQTESCTGRLPCFRGLGLRLGFLVPYLVDGIFGEFTLWIVVLVRNGWSP

SEQ ID NO: 975251 - protein, 440 aa, Homo sapiens
AGVEPPSWTPAVCRPIKLARVTQRSCVQDTVSSGNSSTAGAAWNSCDRQQSRSIIRQCKKGPMSRLGRPVVSPIGKITSDRIARTVVAEAWTEFAGVSGMIVDSTHFGSRTAETAIMVNKIMRHYCNVGLSTQQRLAIDTGSPLRNHKTVGEDSTNTATTINRTIKDTALERPIHTLRTNRFDNSDTPLEIRHQRNRHHYTAQPQACLIKNRVIQISEPMGRSMALSINTRLIKQMKHTGYTDTTRHVKHPRHLKHRPTTTHTNGTLQPPTNLLSSGPTLHLSRSYQTNRKQHTAPPPTREQGRPKDTTHRTHDKDKTDQHGGYRPHMNAPEHRTHKGNNPDSHKTPTKKTHGKKHNTIATPHKVYNNAETKRTRNTSRSPRCLSYHPPEPPTPRTKHRPAPPTPHLPIHNNTNEPYSQCRTRPTTTSTTHPTSTQANII

SEQ ID NO: 975252 - protein, 129 aa, Homo sapiens
MNPGVVHASPAHTRSRVPRVKRPVEVGRIAGRHCDDDKHRTRGQSCHKWLGTQQLGLEIPKSGFRRAPQNDLHHSSGQPPTQCYILSRRSGCSRGHCADSPLLSPGLQLSPGPLTQSVAPGCLVMTSVP

SEQ ID NO: 975253 - protein, 326 aa, Homo sapiens
MVRQRHKVRASMASRLSTAGARRTPSPSKNAWRCTTPLDSGSPQATKNRYVKALHTRRAQHTLLATTTDTPPSSTHPNTRAHNEYKKPMAYKEITDTRHRGNNHGSVNIGTQPAVTAHRYHTPLMGDRTTGKRYTHHTYQNKHSSIMPTGTPLTTTRPKGPNAQRSEQGHEAGPPHRRSNRQNTKAKAPERQDTSTTKNDVSTAWNSSAQNTPRQKEEHKRRYCNAQETGQRTPYNGHKDNTQEYNQPDTTHTGVTRTRRTNNEPRERTQQLTPAARPPRTQTTHPRDPQTTSQPKVKRQKSNAPSEHATPVQHGRQTPKHNTTLA

SEQ ID NO: 975254 - protein, 289 aa, Homo sapiens
VTARLQPPELLQGQKPGVDCVFGNWLLFHFSGVTESSAPRLNSVPFWHDWELMHLWTCLPKSWSISCFSTTKLGGKNIWHSEIQKLGSAWHERMTGQRLNSKSRLQALRKAQQQKQEWLSKGQWGTPEKSLVHSDFAQEVTGRVTMWLAIFYRDFHIQVYTYQTDILAILVQEQLETKFCTLNVEQSTFCFCEQTAFSKFMPETSTGNNAWGQHKSHVWVTELGHTDDSTRNLHWRTRISDILITGDFTGATISDPQVLGTTFKAGTHLRGTHYPTCGDSPTTVDGVSP

SEQ ID NO: 975255 - protein, 236 aa, Homo sapiens
MRSRGFHVVNRDMSRIGKSVTFSCSLEAFTLRGSLRNLRLVDVHLGGGNPLNRLSDRIAVELARVGAKGKRYKQTASGFIGFYPETNNSGECQRYRFFLRRHPILVGSRTEGWMRHQRGVTTVRFSLPLEKDTLFIELVSPTQFGSLVFWPPVRKTRVERRVWWGLMSLMGCLKKGSHKEMLTFDSMADFWVMSTLDSMELSRNSELCQTGLAKWLILLTWGITTKGVPKTSDIGF

SEQ ID NO: 975256 - protein, 337 aa, Homo sapiens
MRECISDPRCARAGRPDRKSACWELYCLATRDPAASALHGQVTKDNGGRTTEVRLKQLTLHMEDRERWQCNVPRGECVSTYLVTHSRPGSRFLHMVCLADQCRSQPEAMVHQHVHMERCLAQNRSNGRWVKYTPIGRLEDTYETGCSGFWTFDGSIGLNHDDTRIVSGTILWPEPTGVVWRVEPGSGLQRPCSLGASCSIEYGGRKSKLQVAPFTPGNPCFNDGVRAPTSPAVTTEKQPWETLVMGEHGKARRPLDICRKKPRDERQLRTSGILARRSPHGSHDGEPDATEKSTTGQPEQTRQGGTRRNTRQNATHGLAPSRPLNPRAAAKQHNWVR

SEQ ID NO: 975257 - protein, 87 aa, Homo sapiens
PIAAAGSTAAKKPEWTCLLKVLLFHFSGVRESSGPRLISVPLGTVTADASVPCFPEFLEHQLLQITKTGGGTLGFLNFKQLDQMAEA

SEQ ID NO: 975258 - protein, 436 aa, Homo sapiens
AASTDGSGPDPWPVGGVTDTWCPVLEIPSAGRQTGDVTGALGLDCLVELLRGHVLRPVGGLDEGGSWMGRRRAPALRLRASVRFALALSPGRERPPLAAGLTGGTSDYGRSHRLDRPPVAYVDVSGYYLTGCKRTIESVHAGRVDGPNGGLGLDSAVYLAELRTLDKACLLLSLSPCASCFLNRCGTLIPELVRLALYPYTLRAVPGGHMKPYLENEPGDLGFGAQGPSLTSILEPLTHVDTKPKKLGPKNTLARTRPIGARRPLGLTPIWLSTRREAPTLHIWDHRNTVSYALLGITMSGDKPYLALDTHLLVHMGCDKQYHMHNHRDMNINKTRAANHHEHTTTQQNECTLLLFISDHITLTQVTHIHIIKTISHNSRTPTTHTISTPLHTLHSHTNTPYTHIQQQDLTHKPHIDTTTPKHNTYAQIHRTNTHP

SEQ ID NO: 975259 - protein, 129 aa, Homo sapiens
MSDTRDEQNEGEPRTRTAIETQHRKQRGETNEEQESERTDDDAREREKDRRGSRRRGGRNEGRAQHEQRLRPERTNTDRDGRKKQCSDETMQPDAPSEMRERRRGRERGIDTRRENESDAQRRSERIAE

SEQ ID NO: 975260 - protein, 94 aa, Homo sapiens
MGPNHLGDVLAYTSSHSGPNIVAPPPPSYRLLDRTIGGELHETGPPGHRGGLPNQIRMTVNGHYSEHSRDNPTFNTVPPNYCGTLGTPTCLNTQ

SEQ ID NO: 975261 - protein, 112 aa, Homo sapiens
DASIAKGCPWYRRTRAAGLVPGEFLSPRCGLEAPGEPCRRSCASGSTRGVDRVSRTVSPKSFAKAFSQWLIYLEKSTPSLNFRHDFPAISLDSRGFNVPNLITFSRWGSQTF

SEQ ID NO: 975262 - protein, 303 aa, Homo sapiens
AQDWRTLSASRRTASFLQACLVFTNILCKLSLESDDSYSPKCIWVCRKPILIVMLSVDAVNIESRHQDQRCGLSVTMCQHMTTRSNALGDRILPSCTREGPTTVELCNQQLKSALSGHLKTVIWGLLKTPAQYDASELKAAMIGAGKPEGGLSHGIICSMEPGRSCRKLTESTREHVKTALEKGHYADTSGGFQKLMVACQGLDERTNGRALRRELNDQEVGNSMTPALDTDGLVSKRIVQDEMLPTTEALKVNSHAFKGGTLAKGTDLNARRVGLNPRCGRVNRAGKAHNQRIISPATTKEK

SEQ ID NO: 975263 - protein, 288 aa, Homo sapiens
GGKPGTAPESPPVWGPVTQSKPPRRRRRRERRLFPCPLPEASVGPPLLDPPGTGPSVELASPRGGGVPRTVGGPGAPVRDPGCRRRTPPLGSPIGLMEIPPGVDGLLFPLETQSCLRGFSNRPYVASGLGGVCCGDFVTMVILPPPVDIQAGGRWGLTPPGYLGTRPPVVWHVGNLPVYHGQSNSFESTFFGTGCSPSKGRFQKYSGGTTASLYMITRKTKARPRPLGAIVGTQRSGGNKQRDFNPEFILTARLNKQQVLHIEGMFVQSGTNGGERSLDISLAGEMTR

SEQ ID NO: 975264 - protein, 35 aa, Homo sapiens
NKAPHNLKKNERALYTYMGHGLANDERQELLSEEA

SEQ ID NO: 975265 - protein, 254 aa, Homo sapiens
GPAEVPRRRQRVVPEIQGLALLPRLECIWRDHSSLQPRPPELKRTSCLSLLSFLSSCDYSYLSQPQSENIKGILRQKEERGEKPDSPYRCPYDMNFSMELMEPVSSVAIIGRNGLLLAFDLRVNRKVLQATVMPRIRLVVLLLSILDGGSRGTNFRLSRIFARKQARSTISQNSHCHTWIGPILDKDKRLLGGLVNFGLLLGNMDSLGDVKLTSITNLGPDLTLLIDYKRLIARRVPGCKTGVTNRFLVPLAYF

SEQ ID NO: 975266 - protein, 111 aa, Homo sapiens
TSRQAVLVTVTSSLNPAWYSLTHRREMPREGQADLKIPSYFLKIIQSYWMIIRRCCIGGSRTNVGSKQGCSKIRMSLRGTGLCVVDWARNEHDARRAFRGSTCDITQRTAL

SEQ ID NO: 975267 - protein, 220 aa, Homo sapiens
DRPSAGLWLTMFSRAGVAGLSGLDLAAAMGFTVRNMAHFEQISPQGRLKMVQFKKTIPGKINPKVYDNLGKRCQPKIIAPEVGSSSTPGKTKATEITSGDIARDLPIKALLWYIATQTRLWNNYKRGGALGKGHPKGTKGRKPRPVSPLLGDGFGSSVGHFRGTGNLWIDIAERHNSFDQGVSRIATMFVGIEKHAKGIVRTKHYRAMQPGPALSAHIKT

SEQ ID NO: 975268 - protein, 124 aa, Homo sapiens
MAPKAKKEAPAPPKAEAKAKCLKAKKAVLNRGVHSHKKKKIRMEPPSWARKTLRIRRKAKYPREERSQEKQSLNNNAIIKVSADPLSLPMKNDKKDKKHTCVSIVWGLFNEAQRKHPGFNTQGW

SEQ ID NO: 975269 - protein, 170 aa, Homo sapiens
QFVGPAALSLCFNSAWTETDPGTLYPVSDAPPMSSHGWQTSGDLSSLAISLHSMGTCQHGFVVVSSFLPNNHEVPDCVRFIQTTVEAAVNSLVNFVPEACYSYLSLGFYFDRDDVALARREPLLSGKWADVRKRRGLTRRTTARMQENQGGGLDALLSREHQMKPLWEPN

SEQ ID NO: 975270 - protein, 117 aa, Homo sapiens
KAGGSACVLGASFQPGVGLVEHINKNVFQKSSVSLTGEEEQSDQVETVIPVDVMSELGLKVTVCMGLVWEKDPDNRCSPVMWTIVLDAKPLKDATKTRDHMIVVVHNQEGKSWAQQE

SEQ ID NO: 975271 - protein, 232 aa, Homo sapiens
NSQLPQFHFTNRDCDSLKGLCRIMGNGFAGCMLFPPTSPPVRCSVLMPPVLVQEEDLHWASSPKIQSGFVKLPSRRVITNPKARQWDLVGVNFMAPGPDRQQNKVFLGQWTWWSWELGMEAPRPLSPKQVRVQRQVAMPFPSVLTVEHPRGDGSLEEPKARWAQWETPSVTFARIPVPRERKGLLGHKPISCPDCHRELRGLVCPRFPTFSNGDLVRTPGRRPCCRDPMEQT

SEQ ID NO: 975272 - protein, 221 aa, Homo sapiens
SAARVSRSHVCECYDGRKGKKQFTGESNKDRQDKKTDFIKHSDPGSSKTFPHTGTLLTDGALKSHLGHLGERVSQKLWDPHGCKSSSRITQHGDKFTQENNIPAGKSHFTKTEKYSSQMVEAMNSAANEAQTGLTFTKRRQKRSGSKADNSVDKPNYDIVGPGHSSMWDDFNARTHRTGSQDTQRKIVTHKHLLLGAPCGPWETGLSVTPNLGCVRASSPC

SEQ ID NO: 975273 - protein, 183 aa, Homo sapiens
VCRPVLQPPDGTAGGKKPEWDRVFGKLLLFHFSGVTESSGPKVNSCYHCGRNGELMAFWWTMFPPNVLGASACFRITQMCVGRHIVRFLEIQKSCNQMDEGCTWKALLKRKENPGHLRERFNEEKHTATGFPKRDLWGEIPEKYPLKLQREDFFPTATSTGAVAHTWLVVPFSHGRTSHIPGC

SEQ ID NO: 975274 - protein, 299 aa, Homo sapiens
DGPFSASSPSLMASLTVKAYLLARSDAARGDSAGFSFRVASPRSLEAEGEGLAGASPGPLGGAGLVGPRVLARPWFPRGLRPGGGFPGRDNYNRGRNWRATGGNLWGFVPFFPQVWTPEGQFVDHIVATMCSHNGVEETLHTIFLSRRRISLTYFISGPSRQHLIVHHHIVEQANNELFCVAAGATPAGTLMRGTPPVSDKTKQAVFLHPKKTHTPDRRAVDDGSTNAGDGCDAPHRSDNRGGMHDWGANTSVCGDDNKRAGGVVDSPPKREGNTTPPGGHASERANETGRGPRGDTFP

SEQ ID NO: 975275 - protein, 142 aa, Homo sapiens
VTDANMAAPVRHLLVRKGSHRIFSSPLNHIYFTQGSQGMSNQRKKFLFSETKRTIFPTTGNRFAAGLGQVSFKTTFAGSLKAPIKRKPDLIVNRTTGHLCNPKNGGGQPRAIYATFHRTLERDSTNSPKGGFTITGLWVQRL

SEQ ID NO: 975276 - protein, 211 aa, Homo sapiens
GSRMQEPGPKQQLPESEGAEEEELTEGACEFSASRTGPSSKQDGRRSATGPVKPESAQALKSLLIRNGNPADQVPSLQAALVAQNYYQLPAGDPAQAVEVQQGQNKPAWKDIQEEAHKYHLTFAVDSKLSTTPELTVELCNSLKYFTLQQGQEIAPEVNFTFDRRNWDKNPDDRSKHILSETKSMRARKKHTISTTFGTVLQNGAVHISRL

SEQ ID NO: 975277 - protein, 186 aa, Homo sapiens
DPTLQRATIHQTDHRDPISQTPVRMDANHQTQAQVDKFTIERERGEKNDSRSNCVTIGENQPNAIYGVKTSQMADNLYAEILYHHVCKNTSLYTGDLWLVKIGARNSWGVRLGGPTAGFGRPLHGWAPLVSPQKGWLSAQKGVNACSARNITHRQFRHRVEQTQQGREDRSAIFTPLLLRGPYTNA

SEQ ID NO: 975278 - protein, 47 aa, Homo sapiens
MVEAEAMNYEGSPIQTYTLATFATCLYSQGFPCGGFDINTTRWSSRS

SEQ ID NO: 975279 - protein, 308 aa, Homo sapiens
SRTCDTAHPLDARVAFGRSLPLQAQSSAMACPPGSGHVPPRAIFHKYSGWGRVDKHTLSTKELKGADPEGGFTIGSKLQDVANCKRDGRLGPGTRTQELTFPRTYVTPFLGDLGFDSTNEMPQGAWTNTITGTNWSTTPLGESSSESKLHVVCATCRNHIFVWYHIPTRLQQTHTNYTRSTYFGATASWAPSEKVFETHYVCAPARATPVGELRHTEHTGVAQRRAPGPDTRERRVTPTANKTGRADNARCVTNNYKCSVEDQRGLHTAGTQRPWIIHIAPRWVDTTCSRNIHTVEQMHASCNATSMQ

SEQ ID NO: 975280 - protein, 113 aa, Homo sapiens
RPFFDRESSGLPATTVLGRNRALVPHPGPMDHSQPSVHLFSAPSVFGPKGPCGWIQVLGKTITTEAGGLLFHEVAAHEGRVCNTRKGAAEKYTRPQGNHSRGGYLNAATESNA

SEQ ID NO: 975281 - protein, 125 aa, Homo sapiens
AALESKAGSGPSSLSEQSASSLQMTDARLCPSPRGLSLDKVYVTRSQSPNDADSRHQKGRLKASMLHGGIDSRRDAKTRRREYTKTQRRFHYARRYIKEIPRRCTASCCDLVMGERIPVPHFVHQ

SEQ ID NO: 975282 - protein, 184 aa, Homo sapiens
MEAPQFVIILYITEDVWFMKLVPQQLRGLNTHDCTSRDGYKPKTHISGYHGTGGYYYGVKWLLTTLVGAKHQVLIGHCPSHEVPLKLLDIGAGNYTYVTRFNALQSHKQQHTHRSKFGAPTALKRGDKNMDEGRRPQERTTAPRDLKNRHWTMMSPKNTRERHGINTEKDSVTRTGKKPATGAA

SEQ ID NO: 975283 - protein, 136 aa, Homo sapiens
SRTNTGNRCLPGEGDTQVTRTRKNYGAISSEEIIKMHIGSGASNAVCARTATWVPGTPETLSNDLEMRSGLTGSDERILPLSGVNGHFTRRCYLQRGKIGRCPCSKVSMATSNDSVDDLCYPQIDSSDFCWNLPGT

SEQ ID NO: 975284 - protein, 121 aa, Homo sapiens
RRKPALCLEETRRMSGLWVCQGPTEKTDDPVSEILMGDNLVPPGDPFSHLETHGRAMPSEKALHSSLRVGIIRKNSHTVVVTTLPSDAPPDSDGLKSNILTLEKDGEPTIFSRPVMTRSLE

SEQ ID NO: 975285 - protein, 103 aa, Homo sapiens
MIKLAELNERIMYAQPVTNTKEVKWQKVLYERQPFPDNYVDRDSWKSSGKTSICSEIPILGCGIGVQCGDPAAVQCWCLVVSGCIWMRVFWPPMCFRDCRVLH

SEQ ID NO: 975286 - protein, 85 aa, Homo sapiens
VQNEVRTCCRPECNRVWPLWMRTRIRAGRRMVLEWVPDVEYGRKRRGESSDKCHGLVGSRFPLHNKSTGVFEGAGKIRPISEVYF

SEQ ID NO: 975287 - protein, 170 aa, Homo sapiens
MGNRVESGGNANRTHAGPIHRATTGASIAGHRHFLRPQNKEPLLMRKSRLDKKRKISRPVIQRARHRARPKGTPPRGQSTRQERRYTSTRHNQQSGTEPTTLHKHERLSWGRTTVHIHKRQQQGHIRQTGQRTHSQRKEYYNGTAPHSSGHTSNKRGDDIPPRPHGQGTP

SEQ ID NO: 975288 - protein, 73 aa, Homo sapiens
VCCQSLLAKWLPNQYALAAYIVLCCGVKCSSIVELMSLLSALVFTDIYHTSLVALIEIDSLFGEDQLCPYIIE

SEQ ID NO: 975289 - protein, 121 aa, Homo sapiens
MGIGEDSYQPFVCLLGTNVRFRGKVSNLTTCAHLDLIKHCAWHSGIREPSLHIHLSETESALHCTHLGNRRLTYQLSATWSLGVKTERGWMRETVALVSAFDYLSSSHTCVDDHAKGTRSR

SEQ ID NO: 975290 - protein, 68 aa, Homo sapiens
VPSDTSFLQQRRGVPEAVKESIAGICSYLRVWFQQDQKLEKEEEETDPISARSHCIQRRISKKRTQKE

SEQ ID NO: 975291 - protein, 68 aa, Homo sapiens
ILEPESARCYCGFCPRCLRWSMALVAQIEVQGDTISVQRKRLCLTWVQAILHAVSISSSLGSLGMHTR

SEQ ID NO: 975292 - protein, 118 aa, Homo sapiens
MLNNILQQGLFVESILHKITIEHRGPRRDTGGEASPIKHLGNQEGQNNFLNGRGDFNPPFFRARKRARLRGGHYHTGKNNRLILCARAHSKAVHLKRGQYFLSPPFWGPLCAPKSPPS

SEQ ID NO: 975293 - protein, 205 aa, Homo sapiens
MKVHACGHPNARLTCSGTRALRSPEAYFSWNGCNSGEARLLTYTKRPLTQLHAILLPPGVLSPTVTRRTFSSSDPSRKEPFHDRTIALHALCITHTLSLHPTRVLPLSPPQSSIPFHFTVHTPSLRHKLYYPTFAHHIRGHHGVSARTPSTGRHRHVAPQHILTADIGANEALHYSPTRIIAAPPFPGYLSKCGYPQHPSHPFSR

SEQ ID NO: 975294 - protein, 229 aa, Homo sapiens
MDENDTKHEESGEQEDVVTLKETPWRRDYGIELYSVFYIQQGKISFWYTGKDQMLDNPFQGGLTANYVCVVIHYRPIQAGVLEENVRALWKLMGQTARTQTERADRGRRIGTTPCGTRRFLHRTGQNHLINPPEFHLTKVSSLDGYLGVEHWTLGLTYCWWGLRNSRCTFWTSEIPIVRIQRLWVIVFQGEELSRNFREKRQPGVEIRDTAGLKIFGQELLFRCGNLIL

SEQ ID NO: 975295 - protein, 285 aa, Homo sapiens
SSSKYAPSYYHVMPKKIPLCVGDKRSDPEQNERAKDTEYSLWLAATPCSVEERKFATRVNTGHLGTIKKRQDRFHRHRLISQNAIDHKIAAVIQRNTQDTTVHRLTNWTDPDNHPRQTLSRPERTTVNQHHVTHMPPENAHTGTLDAKLPLTTTSVTYYRPTLSPLNRNSYATGPYQAVVTPDTLTQEPTDVLCQKSDGCLLKPSRRINYYYLLTDTTAGGHRTRGGGFVRTLNSKPKKFPSGKKQASQLNSLLEPRAFGHSLISSLTTLHLVGGPLHRGLHHTP

SEQ ID NO: 975296 - protein, 190 aa, Homo sapiens
GRHQTVCRCSRVVVVFLGLSRSSRSRPLALRLLKPKPVVDVILLTRSACSGVVRTRSTMFEARLFPGLHPQEGVGGHSRTSFNEACGDIRLQRVTLAELGSLSPPYSCVAASPVRGCEASTTYRGATETWPVWCEPSPVCPKILRSARESGQISLHSKGRRLTAEYPVALGIGGHQNPSEKSPRHIEMNV

SEQ ID NO: 975297 - protein, 96 aa, Homo sapiens
DSTDVVAALGEEVVFRWALVLKTRSGSPLAVSYSPKAPTRLFSHLLCRMRRAGLVEGVPPRNLWERMAMLIVRIVPVKERTMRGSLKVLRSKSKVL

SEQ ID NO: 975298 - protein, 116 aa, Homo sapiens
KKHSAETRGQLPCVQHGLETESEAAAANDVGLGISKTLPKRSGSDRSVICHKSGTWEVCCRSRLTGSRHAGESKSTLRSSEYKDRALDLAGLRPRKLTTRELHRAAIKTRARIPTV

SEQ ID NO: 975299 - protein, 143 aa, Homo sapiens
LLLGLLPLPRRTVDCASSWPTGCRGLPQAIVEPMYDEGTTVIYKLFSKPSSQRTSCRTQELFTKNNSQRWFHQIHYLLVCITTVLRTRTMRVLKQWLLFNRWLELGLPSLPQGSGLGTSSFNVTNLIYQYTNSSSTPNADGTA

SEQ ID NO: 975300 - protein, 106 aa, Homo sapiens
MSQEGRSRMLSAGLFLPGRKCARLANELRCLDRKPGKFRMGNAAGPRPNGLFRIDTGLSGRTSLKEYDTPEPLPIDDPGYFGNPGFGGVKASGHVAKGIQYGTSTG

SEQ ID NO: 975301 - protein, 138 aa, Homo sapiens
MGVFLAGLDVQALRGFLAESPGAVRSSCPVCGAPICRRMPRPPPPIISSVQHAGSVMRLEQILSRCGKQLCAGHRNYRVWTTVIETDTNNDWGHTLLTGMFYTQQEVGELLVAAVICEFRTNRWDKKGSSGFIRADSA

SEQ ID NO: 975302 - protein, 66 aa, Homo sapiens
TENVTLKKPEIFQNLKRRVFELRDLKGMLEVLEELTDVQTLTGGSLALCSPRPDVQVARSRFSATS

SEQ ID NO: 975303 - protein, 79 aa, Homo sapiens
MVPGEEPAGEAYGGSVDSEVPGVVSAVMSLRAQAEWVEVPGIVEMGSAGKGGQDVFVARLKATQNMGWYYSLLFRPKWN

SEQ ID NO: 975304 - protein, 141 aa, Homo sapiens
MGDVSPKNEANKSEVSVASKFPSLSMTQGDAKHPSCATRRDGGAPGGEPKAAGKGRLTHSSLKSWCRRVLHTPFRHKANPDRYRVWAKNWDTHFQVPQTGHQTVGEPFQTYLWARLTGVTSRDIQLCGPCDLNSSQANGPK

SEQ ID NO: 975305 - protein, 519 aa, Homo sapiens
PGCDSVLRWLYLWSSVLYIYRPPSLLPKCVPPPDGTIRWTMDIEPPEAPELSFRECDLTGPTQRLSLERVAYLHEQLSTTYTLLNERLTFKRAGCQQRMTLATLLLSNATQRTLAISRMGTSQISHCKPSGAQPLGHTLSPVHMPQPGLPPLMAAAPLWKPSHHPTQVALLQHRGSCNRWIGHISSGPNVGQLTSQLRNQGHLKRSGPVWATRTTHWHTTSFHANPTRTRQAEGAAAICLADTLSLYKHNLLLGAQTAPGLPRPAPLAHRAWRITPTRAFSPPQRHHHHMRLHNTPSATWPRHSHTALLNQHARVAIDLHTPAHLHLDIRNQQLDRDSGNWTATSLGPAHASTTAANTQHTRRPHRGTGRTRNTAQATTCPQRPHTTCAPTPASEHTHGPVPRRPHDPPATPFTPRQPLHTVRAPQHPAHATTPRSTHRSSHSSCQACTNLRVEQHHHKPKLCTTPIYQHNTGGPLPRSGRPKPTHVKHAARNAHARNTLDDDGTVPNAHRTRHLTSLH

SEQ ID NO: 975306 - protein, 130 aa, Homo sapiens
MSLDFQFQRTSDWIAAVTHGCLGQLQHVVHLAYQTDFMVNKIIANKAIDKPFTIPEKTTPRISTCCLTWQAIVGALHRLGYIAVVGKVHKQVPNSVNGGLTQQHTEAAVQTIVGPLDPSSKTRTLNLDNF

SEQ ID NO: 975307 - protein, 172 aa, Homo sapiens
MSPANQRPGMHPVAHVSVGKTPLDRTWSHSEVGRPSTSAMKGGCWHRRLLDATPPLATVGATIRDPFMPGEHFKSPSISHEGDTHSVTVERDTVQKPLQISWPSLVPARYKRNVHSEAQTICGLNHNPTAGKRRKNLWGIFAQFLPLERGDEGSAHGADFWKRAGLDADVGP

SEQ ID NO: 975308 - protein, 253 aa, Homo sapiens
MVVGRRLVLPSCGGWPKALSTLGFGPLRLEPELLCARHLSGSLGPLRALGGPKVLWAAPCRTFIFTANPRGKSTAWVFGPCVIAGKPACGEKQNTMRMGCGTTSFNEVPCNRAAYTPRGNSYTISPPHRFYWGSKIYIFRRPSCLNLLWTGKHHPLPTLGRAVWRTQIARGLPADCTYQHTRTAGHKTSLYNPQHNRVDGFVSQGTQGQYHPCVGVRAPRGILPFGRDNVVRWLPKSFEYPCEVLGRSPPCVA

SEQ ID NO: 975309 - protein, 297 aa, Homo sapiens
LPVSGLALVSGFFAVDQDEPDSSGKRKPRLQAVQAWVFCMGHGGQVERESHCQGSIPRWGAVAEWMCGGSDRVMMQRGSCNGLWLEQKALLMSQKSIQRRFDAASGNESVPKELISSRGNMRHLYTIQVFERTSKDHRFDAIDHWDYKGDERTAYMASEDRQIGIYKTSYEGSDGIMAMLHGSGACVCVPELVKSVESKWHAYWVSSWSRNSLIAYGHLPGFRVSPVKHDVAWGGTGEEPATVCSRSLQSTFGENYLSIVNKDPSRRESHFAHSEATHSHSTQLRPFTTSIGASLLW

SEQ ID NO: 975310 - protein, 280 aa, Homo sapiens
ACRPCGVTVAFPQMYLSAQPALEGRTSFPEDTVITYKCEESFVKISGARRTQVICLKGGQWSDMEEFCNRSCEVPTRLNSCIPQTALYHSELSFQSVTVVEYECRPGSRREPSLSTKTQLAFSTFYHSVHSSRHLLSKRNHALIRRRTYEMLRFDVQVGILSCEPISFSMYTTGYNSLARLLVSSKFQAGPVQCGVDRWAQSAEEHFLSMQPPTNGSSGIIHGDRGHHGIDALSQHAVNTGFPLLEHLSSAREHCAGMWVDPVWEEIYSSHKVKLYKSTQ

SEQ ID NO: 975311 - protein, 69 aa, Homo sapiens
PPGAVTGAVYGWTSLMSALVPGAAAAHSAPFAFALSTSRQFGINSETIMKAASISEDEMVDSINKLNNC

SEQ ID NO: 975312 - protein, 232 aa, Homo sapiens
MPRKAWCWRCNGRNTALQEVLKMPSSTMAKHGGIREVAKALDKRRPNLGCAVLPNVMSLCMSSGVEALGAEHQINLLTVDDTQETRRLREALVQLDREGNPVKGLARSCVVVQAYGKGRPGPRPVIADVFKCENVTNSNLGSPEEEHTHNNNVSAAKKALKTIVGAGQREERGQRAKNRARMAVAHKKTAGNGGGHTRSARATDSTARLKTPPRDPPRTALPPLRPRETHRR

SEQ ID NO: 975313 - protein, 231 aa, Homo sapiens
MMGKIFNACISFTEGKVQHVDGEDDQDGENFGADVEEYEVAGTCGGFDHQKKLWSFYKLLMHELSVDIGSSDFSGTTVEARDVTATGENWNANSSATRRVARMRCLYGPLGEISPEELLDIIRSAEVKGYFSRRSMAEPRRMKRTQGTASITGGKLVQEAARDKLRTSGAKTAVGRSIQDIRGGLGGTKHAKLRAVASTDTGALPIRPRGPKAPGPSDTAAARAPQATAAG

SEQ ID NO: 975314 - protein, 242 aa, Homo sapiens
MTEADVNPKAIPLRCPLTRSYDLVQQSCNYKQLRKGAMSNKNLNRGISEFIVMVQRRATEIILHLRCCVQDTELCPYVLVRSKQALGESLWGLQACHRLVLSPSKKARSGNSRIQSIQQSIERLFSLNLCALPRCSLQVFPPEVVIIYLVLSHGSIQGYSSNGDYNWSVVNTRRRHARRHTHFWARPARKKRSLATPVVGSGTKGQEARPHSGPTETGASTSGAVPPTTPAPARLKPRRRPR

SEQ ID NO: 975315 - protein, 164 aa, Homo sapiens
MGSPVGGLKNLQNLITREGKQNGFRKRGIGRSTTPRASGNKICPLTWHICQLPPPKVDSAPTLDKCYTNDSQGWWSNRGALAQAEGVTLYFSCTTSTAHDFKTEGIPNQTPRSSGATSAGKSKQVWKAKDLNGISWKTQGKFGKNPALCKNGKKPYSLREKYEK

SEQ ID NO: 975316 - protein, 301 aa, Homo sapiens
GVDCEETWRPDVDFENVYFPGVRRTSTFALTIIVGVSVFERASIKAADAYLRTTFNEGKLWNTHSGTGMRTSEFLWRGPPSEAREDPGSNPKQVVVPKSCGALQLGRIEVVTGVPLSGGPTNVGVLGQGKGVFNFTKKKESFNPFLGGVGIGNGMVKGSGSVLQGNINIVELCPCRNKTHKRRNKRIAKHILCCGRALGPMRKNGLFLETPHFLLLAPRCPPSKRSMCVPRCGHNRAGGPQREHRGGATTTCGLVCIPHTKLQRRPGGTHGRCCWDTIPEVGFRRELLGGDFTRSGQEVYY

SEQ ID NO: 975317 - protein, 111 aa, Homo sapiens
MDKGLEWVWEKGTKFPWGGIPLRNYFNCGSQEGIFWLKVVGLPAPPEDRKRNFIGRGCAKALWIWDRAHHNLLWTGATHKRKFFESIVDNGLRWFETIINELVQYIKARKC

SEQ ID NO: 975318 - protein, 112 aa, Homo sapiens
QRMENVNTNALKGAMVRRVRDKKQSITHSWTTLTSDDDLVSATVPLTKKSRTAPKELKQDKPKPNLNKSPDRKSQYKRKPLNTRLALDDKLYQRDLEVALALSVKELPNSHH

SEQ ID NO: 975319 - protein, 295 aa, Homo sapiens
AQPELKARAWSAAQSPRGPLPVIPVPDLHRPQGPTETFLPPFFLPPLLSLSLSLQLALGALQQAHSPGVAPKTPFWLLPHSQACPLYRPWAPLHLSPSLLSPRLNCGQRQATMAAFCGLAFGPLCDCLAWPEQPAQSRCVHNRGRVQAARIKSNQTQFSHNPTVGALNVGRHPPRSATLIHTHTIRGFPPANGPTRCGLGPTALSNIEGPPPGDSHFPFRKKYPKASSTLREGEELANRIRWHRAISRHASRNERWPATALLGRHGLRRSWHVPVTFFANQTRYFAKMRWGISGL

SEQ ID NO: 975320 - protein, 73 aa, Homo sapiens
MNAAREKPYSKDRGWRKHDGGADRARNHPGKNSPGSHSAGLWTTAANTGGREQGSTQREARTGERTHPKGYTR

SEQ ID NO: 975321 - protein, 215 aa, Homo sapiens
MHGRLKGEDRQKSRRRPKGLEREGKLKAIPMSAHPRPLSRGARLWSCMTSRALEWTSQILGSQPLILATLLNRADEEGAPRQLEDLKEVSWKSVGCSADRHDTGAFLDELTVRGEPPSLNVTVGHLDAGLVGRCLSKIDREWKVWGPGFPAGGLRGTFHVGGALSGGCGHKGSGALEKSKLHEGYYRIFKLFPGLLLAWPVAPGDARGLDWCHTA

SEQ ID NO: 975322 - protein, 244 aa, Homo sapiens
SPKPTGCLLSQWGPLIIVAHAREICPRGSCGSHSFEVTQYAPSGRKVRFPTAISWSRTHGGILCSSHSSGTFYPEVCNLQNALGKSLAKVGHQEICPRRQCQFGWPFQISPAVGGTQSLPLGGRDSHVALQTVWNDAHRKNVHPFFPHFIPMTTEIRGRFAHPCGGIFGVSQGKQDGIEQGHCFVTARGGGLGIGVLIKKAGRLSNLLPRVPSATHLRMQILQGSHPPLQAWTGSTTQWFAPPV

SEQ ID NO: 975323 - protein, 246 aa, Homo sapiens
GSVFWTIRCRRHQVSLGDDVPELCPRRSQVASVLEAEDASRNSIEYARVVTRMQSRARSEMAAIDASIPGRLPKGEFQREAEIDNTTHPAFCRDCPKTNDTPLSRPRPLLCWSPLLLAYPLLLRCNPGFTRPCLLPSIARHPSPTLRSLDPVLADRHTPPTQRPAPLTLPPPVPTLPRSPLLTTLSPPHAVLPLSHTTSRPLALRPSLPPSRLGARPPAAPRPPLPPVLAFPAEPSRLAPSRPIGP

SEQ ID NO: 975324 - protein, 126 aa, Homo sapiens
MGWKKPDFWLPRKVADHIGGEHYEVLFNSEEGIQALDDVIFSLETYDDYEQFVLQLGMYLISKYIRKNKIGGDLLLEKDPDELTQGYIYFHKGLLLKKRGRRVRGSEGNSIVDVLRQIDYAAMVLN

SEQ ID NO: 975325 - protein, 310 aa, Homo sapiens
DSAYGDALSSRRMAQLPIKMSSVHEILCKLSWQGDHSTSPSAYGSVKALYYLRMLSRHASDHGTQPSRPNVGNDGHPLVNHFLTPILQSHGTRAHATTCAFRSLSVSACAPSPRVTCGFQGLLGSSMPFSSCVPPLPAIGAALLWLSLFRPYLLLAFHVLCSPVSLVALLHRLFPCLSHVRAFGPTSPVVVDVAIIFLSFLISVVLFLTLPLGFFTMLTSPLHTPRASALRLPVASRRHIALFTALPLAHGSSLYTRSLAAVSPPPVWSYTRTMRGALRLRPALPLGCGSLHLLVRMLFSSLSLVAPPAS

SEQ ID NO: 975326 - protein, 102 aa, Homo sapiens
DSPWEAEGRGVGWGVPGTPGPRHGAQEGSARAAAEGGRPRTSRALPEAFARGGRRRAEGFRWSQGGLTRECLARARGGCPCTGWALWEVGPICEPPGVCPGA

SEQ ID NO: 975327 - protein, 176 aa, Homo sapiens
MRIEKCNYCLGAHLSPGHGMMSSVAISKVCRYWQCLNVNRYNLRLEAQILVESTGGTKGILGNACWVEELYSGYFHVRDLKNGGSEAIKYRWESIAGITMYWDCDEDDGVKSFNRKASQSIENLSRCNEDLDRRRLNEGYKKSPRDIKTESHSTVRSIYIRAPPLQCMRENRSRRR

SEQ ID NO: 975328 - protein, 105 aa, Homo sapiens
MKEVVLSAGGLLRAGICYWKCARYKHTLCACDRNVAVTVLIANQCLSLNSQNHYIWLRGRSEIGNDLKVGRPWTQPQIQAGATRSGQGWHGVVEDLRSPLRFPGG

SEQ ID NO: 975329 - protein, 112 aa, Homo sapiens
ARVMCAAASRGLAYVCHIQVFRVYGVSSCLLICTCANIRSLAPRPPGTEITMALVGLYPGKCRHEIVNRKSPYVAVCCHKLMAFQNSSSYSTLGNTCQNCSCHSELMCEPRT

SEQ ID NO: 975330 - protein, 326 aa, Homo sapiens
AAPGAECHLIHCTGTDDVGSFQKSNPSWRMKICQSEDLVDKEKEPQALKAIPMLEPELMWQCGHPVAPGNNDLSEVTRLTGEAILRCDSSSPRSLRVGANSRTHWLQRDSLRTSQLGEPKFFLAYSPFWSKAWDLQGFLTGWCRVQKKTVRARKANLWAKGLLTSRFSTFGRVCRAHLFLETPWYRYGLLSWERNFFQVILVVLAIIRTQFQKFHEAGGGNSSGAKKGEVTRTPKGAVLLGTSGPERRPGEGKETAKHCAAARLGQPRDHWAPHQNGLGGQPRGNKGRQVGSHTLVRNGNRARWAQDNIEAWTEGWNHCAGSQKHN

SEQ ID NO: 975331 - protein, 74 aa, Homo sapiens
GSAQEAGLEDGVSGEISDTELEQTDSCAEPLSEGRKKAKNINTDMTEGAFSSRKHLEEQPCTLFEVPDTMVTKT

SEQ ID NO: 975332 - protein, 182 aa, Homo sapiens
GPLGSDATGGGDERPPAFESSGSSRARRRSPLTGTPGTNGLFIHHQQRRPHSGNIINSQFLKDRAVLWAATKSPTLVEHKIIIRSADHAELKPPGSFYQGQSGDSSVSCPCEERFRWAIKDKQEGMEEGPEGALLRLCETPFPTLCLTPPFKLPHRGRAAVHSHAPLGATLHRDNGGVLYLD

SEQ ID NO: 975333 - protein, 121 aa, Homo sapiens
RGAWLTLVIPALGEAEGGGSRGHEIETIYTGEPGLYNTYKKIEPGVMAGRFVSPQILRRLEGSEIGCDPRGAEGLPVDARRLRPPNLATSQLWGHQGGGEFRVLKKHYQMATAGTTQTCGY

SEQ ID NO: 975334 - protein, 114 aa, Homo sapiens
MTSAEIKQLEVTTTSETKCKSIYKDFMRDLEKWETRHEAQNRIWKLRRQSGVPEENLPPIRNGEFLGKTKNRRTVKESSKKTREENKKTVIKSYDMRLGKIDVDRILDELDKRR

SEQ ID NO: 975335 - protein, 235 aa, Homo sapiens
MLWENTVGTKDYIPLLDVDEKTGNSESTKTPCSETSQIEDTPSSKPILLANGGHGTYEGSDTTGSPAEFLEERMGYQEYPNSQNCQKIPRVGDQTEQVVDPIQTVPLEMYHLMMTGGLVFPSSATGDTFNICRDKMIPGRDEGRMSPLKHRWWELSAWLGRPEESQGSEFQFPQRSWSTFLGKGLPLETSHENKGSEEAEPSLDNGCGHGGRQKDGSPGSENGWRRLTKRQEGTD

SEQ ID NO: 975336 - protein, 275 aa, Homo sapiens
VRRTLRTSLWRFRGSGKRCGPGHLSSWRNRRKWEVLEPEGGFQEQFLAPVINEMREEHSASAGTPQEHKGRGAVYLCGDTGSQAWWGTMATKICGFNTQWHFKTPGNVVEEGPFGRRSKDACPSKQHIFPKKTPGEPRTCRLGRSKNPGTTSWETLASVTIETHFFTTRVSDFWRGHPFVTHQPVGEEHHNYGLAISRCAGALETQFWWTKATGMPFTCAAPGENFNPWGQKTRPEDLYTMDYGVPPRCRHLNNTRQTRSAGTNRTGRHITIISL

SEQ ID NO: 975337 - protein, 295 aa, Homo sapiens
RYHRASLLLYDAMSDNECAFKSVYYSYCAPDTDECWRHRPSCRATSLEQCNGGESREPKLERASRGYFDHVVLRGIFRNGGIMEKVSLLLMDMVGYRDTRDGSGRPSYKYAELKYRGALFVKTVLLQSEGRIRQVNIEGVYIFGENQSVIECDRKLMHLYNTDRSMKAEKMSKTSYDTGHLIQNKMIFVGLKQDQHCNYLFEDLGGQNCRTNCRALVKTSHAGPVASTWTIEEKRAGKGAYEGDRYLLNEEANCGYLSTSFCPKQWRDGDLRYPIYSSSVRLASRCALHHCAHSS

SEQ ID NO: 975338 - protein, 122 aa, Homo sapiens
TPRGRLRCANFVPFPPARPQARCARADASRTSQRRCPTLPSVRGRVSHVVAALDDCPSQGRDMKGDAQPGLGKPRIGRSHRLPVVHKVGRHFLARANMSVMPPSKIEDRQIIGSYKGGLVAH

SEQ ID NO: 975339 - protein, 117 aa, Homo sapiens
LDNLRRAGRAPSSNTCRPVPGVPSWHWVCKVCVIQEKLQLYQISSYLRPATGGDHNSSTYVLRHFPQFWAVESLTLLQEQGASRSRGLMAIACAVGIVLAKWSLKLMCLVNLVMAPL

SEQ ID NO: 975340 - protein, 74 aa, Homo sapiens
DSRRRQLTRDMDAHSYTDCFGAGVVKPEEELGRLRTFGALSIIRKDSPEEETCIARRPGVQSQGCKQPVGLEDF

SEQ ID NO: 975341 - protein, 110 aa, Homo sapiens
AFPRPSGGWGGGGRPALKPLGAHGAQEGGAGVPAGVSGGRGVGIGRGAVCTNLAVGPGALWEALQGGQFPCGGRAGRFGALEGVPGLCRVVLRALKLWDTGCGGPRPDFG

SEQ ID NO: 975342 - protein, 71 aa, Homo sapiens
VVDTNMETWYRVPYLVLECPNLKLKKPPCLRMPVGHECVVLLVVVSYFPHHRERYKLYDVSVFDTLQVSVL

SEQ ID NO: 975343 - protein, 159 aa, Homo sapiens
MEWGEKGYMTGEAWPSPEEVLFPTQEPKVNPQITVKAGARSSCLNEPGCWPIVLRGKDLEHPKGPEDDTEKSGGMVESNVSEAGVKSTRSFMEGCDWRTWMSCTRLGVGRSFVGGFPQSRIRAYIEQRAIFSYLCERINETRCSWIMRDGSGPKFLDTE

SEQ ID NO: 975344 - protein, 311 aa, Homo sapiens
DLNLTELRARTRVPGADEAGSPGQEGECPGCQPEHVFNLQLIKEMFTLSVGKVTVLSLSGGYDFCLTPKATEETWLVKLVLITGCWRLDSEGSSALAGVPGCRLLFLSSGNINKEEAMRKTCNDGSGKLVAHQGVQRLLPGELHAKKEGVVYGVNPDQVYQNDTFGEWFPLLIKHAGNRNSGQHVPLTGQDEAYGNTSFDGDISTRHFKGFLKLSTCYDGYGPMPLVACKVRCVPGDNGGGSRARIGPWGPASVVATTVPTTRRNPLGPPFKSVCSAQALCSPCIKDHELMGRIYNATFTAHLPYFHEFLL

SEQ ID NO: 975345 - protein, 75 aa, Homo sapiens
RDDVVRRGWPVGAEHGEDSLSRKRIRAGRMDHHQPRLGATRCFLLKRILRIIGYEQHLFKPSTEMVQGCVFKHKH

SEQ ID NO: 975346 - protein, 225 aa, Homo sapiens
MATENPQQFNHVKHDFPTCQGPPHVGSAITRPILDNWDLTDCSHNGLKMQDTLPWIPLFGPGARPKKSDTQQQVSTSLRTTLGVHTPASTTQTAGHLALPGRPNWHLWATSANSPQPRCGNTRHGYFAYQAESWVPTRTIEVENVVQKLLRSKLSHQPVTYLIAYHDPTTKTHTEEVQTTHGCPQPGPSATAATTQGDKASINPVRQNISTDKQGEDHYIQKSTT

SEQ ID NO: 975347 - protein, 107 aa, Homo sapiens
MTTRCTVPEPGLNMRCETYCTTHEGLRRASTSMSCSPVVRDNPAFVSPGFASPLGYLARRTLTQHEPSQPYTSLHKAPQVGPVEDSPFCQNGIGGHYNACPCNAIST

SEQ ID NO: 975348 - protein, 74 aa, Homo sapiens
GRVRRYAGADVLESGHVQARLQLTVVCPRTSNPWGSVGERRNLGGLKTVGSDEAQGVLQEWEVYARGLLQRLRK

SEQ ID NO: 975349 - protein, 70 aa, Homo sapiens
QDIIMRYGARNLLIGEHGRSWFIYICANNYEFANNQIISREKNFAVVGVNHKMYVLEVLMGRYTRGQSDV

SEQ ID NO: 975350 - protein, 82 aa, Homo sapiens
GGIVDACVRSDSATLNPNEGLRASAVRNIYNIVYSQRGRKWKLPSRLIIAVKAVQQWTVLVSRSRETLGSVTEDIPESVRSS

SEQ ID NO: 975351 - protein, 111 aa, Homo sapiens
DDVCQAIMTSDRVPVCAISQKEVYPEHTSAPSKLKIDRALQETDPNFIRYDEQVISTESVRMHGISGKEKIESELTRQNIVESIVTESIEAHPVCPSGSPGLVLIGRLPRN

SEQ ID NO: 975352 - protein, 339 aa, Homo sapiens
GILNLAAGLHAVKVSTHLSTGHLELLPPRFGGGPGCKEQAVATLEAEKRLPCTRSGEARLREPGRRRLTHRNIAAARWVGPTGELFCGENPFDKAQGGDPLAESTVEGAQGPLVLASLRRLHHSGGQDQGSLVSHLTSEGEEMPGGPQGLERASLAAHVEGSINQIWPTSRGGSQNHLCREAVKGQTNRVSGSWVTASREGTALELGDTFKAPRDVLPLLGLLETGSTRQVLRNPRRTALRVKNTGSTNSPVKQLNKVNRGAGLNQWRMHRGRSINYGSNTEDDPDFGVPSAPQWTPEGATRGGHTGGGGAPGDRPKFPQGAHETRHSEGGPGEPNTEE

SEQ ID NO: 975353 - protein, 284 aa, Homo sapiens
MIRGDAMCVGWCRFLLMNTAGDSRLCVSPRRRELEKRWIVSRETVRRNQGRFVHAGPEREQDTCDSSAGEAERGRMVRMDPWSRKQRWVASPMLGGRNSLQSSVGDLVTTMAVQDMPLTVTNVSERPEEWNSVVPWCYAGGGVPGGGSRMRPFERKGLVSRSEHMSPAASWGKACCHCGWLVPGGGLHRGFVVKEGRLGGLRTVGGLLLSWRMFLARTASEGCLCRLDRYAGTRLYKLPSYVVPVRFALRWRWRLAITTAGAPWVSGTLHRVVGLSGVLRGSRR

SEQ ID NO: 975354 - protein, 92 aa, Homo sapiens
ECVTLLRSRTVRAPMTWTTVGIPSEMNPVPQMEMRNHPSSASSCWELYGSGAVPIRPSCGSSPVGQFKGKDLHNREPVDGHLLKTNQREDYL

SEQ ID NO: 975355 - protein, 193 aa, Homo sapiens
MASSLVLTVLPSVVYLQEGLSKIAFLNSRNLSGGILRDWNDTLFPFTRGIFVHARCGTSQPSSPFFCLQSWLCTNGKDGPAEKKKLRGAQIAQWIMSYMQRTLVIGPWQVSRELSSPRRCGTLQRYPTYRGSLYCHRKALCGGKQLCSLPQGAPLVELSHFFGKRQHYLFRCPLKKIGVTTRTIACTSSCHRY

SEQ ID NO: 975356 - protein, 261 aa, Homo sapiens
TLLRLMSASHGYPDPERMSPDGMEPEGVIEEYAWHEHLLTRLDGHEPLRSTFSVAILAAYDWDESLCRSSNDGILPLSQGDDVIAQAQSETGKTATFAISILQQNELDLKATQALCPSNPLENWAQQIQKVVMALRRLHGRLLYACIGGTKRAFAGGLRKLKMEGSPKSSWVPLPVCRYAYLKILVRQNTFKMFGTRHEADEMLSPGFPGQIYDIFRGHRNSREFGGRPHALSVEVTKVRRPNRSCRTKVPGGTQSHQDTH

SEQ ID NO: 975357 - protein, 105 aa, Homo sapiens
MSAERRLFSTKPQRALEQYTYNSWHERESWAQTLSLLIRAELGQPGNLLGNDDIYNVIVTAHAFVIIFCIVIPIIIGGFEYTEEFALIIGAPEYGVVPAINNISF

SEQ ID NO: 975358 - protein, 138 aa, Homo sapiens
KRDEEKAKLRKADSDHKDELETGKKDQQKHKGISKDNWQEETVKSKVTVDTGVIPASDEKADDSQSCRTDDNEVRQKARNDKKQKARRKRDRQREPEQQTTKGDPKPNATLLNAYARKLLARLNRGRHDHATTETTEV

SEQ ID NO: 975359 - protein, 68 aa, Homo sapiens
PEGNVRGRKVTGTEHADLLGENLVHHHHVGARLVCLRNLPSRVSTQRFHHRPPLWVKNSHQESTQWLV

SEQ ID NO: 975360 - protein, 250 aa, Homo sapiens
FALGCTNGLGRDESRRRKKERCPGGRRILMTGMGGQFRPGENYRVFGQCPSSSVYFRRRRNHFRAGGYPFRLGVPSLMLLWEPPSIQLRCTLPLLPMKRSSLISTRWQSGIGWPRQSGVTRSPEICRKNPDLSGEESLCPDTIVVTVLIGLRIPPLSAGMSNTPKLRFMHHGAKGVIISRSSDVTYHDVTRAISSQPDARGPYYQGQNSLTPWVCNTLAHFRHNFLSMAPVRTTGGPVTQNVHRFQFIAK

SEQ ID NO: 975361 - protein, 44 aa, Homo sapiens
MRLAHDHRMWYNSAQPFIGYQRVCLSPEVIVTDFDVHLGYLRGV

SEQ ID NO: 975362 - protein, 303 aa, Homo sapiens
GARGRNAGIMEADKDDTQQILRSIARRIINDDQNRDLIDEDYNRKNIQLRKEIQKLETEVQGGYQEIQIQRIILKKEDELLNQWKPPVRMTASWVKIILLSGSKVKLEKFLYEITQKGPALYPLLEKRRKVGSTTGGQGIAVTFHGTGLKIVNSGGTGPSQFPLTIQESSIQVTLYKVLKLEQSNCYWKCLNTWGGDSNERTTKSEALKVPESGGGEVNRVDYMTDSGGEAISWWHGVLHNILDRTIPSLLNHTGHEVLVHTGFLTVSDFGTQRRAREGARVSMWVNTLRQWGAVRSALTDVI

SEQ ID NO: 975363 - protein, 101 aa, Homo sapiens
VVSIYVQCGPYHGEKTQKSVKIALEQLYVYESEIRGDVHYRTSEQLIHPKARIMAERGQLVMGEGNLLEEPGPYHKCLPQIISLLTLKDPERKNYDHWAPN

SEQ ID NO: 975364 - protein, 106 aa, Homo sapiens
MDASCSKTQKKLGLDKTAINDLQCDKELTCLSSTSCLQHGEDAILDRDSPVIGDDGGNMWLVRVLRPHCSMLWDPVRGKKVPKRCDECGRRRANRSKISLSNREYI

SEQ ID NO: 975365 - protein, 168 aa, Homo sapiens
GQPAPVSFHAVEALCFALSTAYSSGPHCFYELVTLTLKVCNLTPEASKTTSPRRNEQLQTRCLRAVTLTEKVCSFTPEPARPEPTRRKKSETHPNIRRNKSRRATLRAVNTHREGPRFHFEAPGETKNQPIRDTIPTLSCQEKPPLKNFGDNKQPHGQNLLKVEPGEL

SEQ ID NO: 975366 - protein, 240 aa, Homo sapiens
VRSKMGTRRTGKGLGYNSDEIRPRTELIEHLMERWQDRDHHTMTGVMGDHQEIIVAEFHKKFKRGILKSLTMSRHNTSGCETVSLYCPGQEPQWAVISASVKAYNLLGSTRILMPTASQVPGHTEIPEDGLQKSITVIRMLSNEKGELHDLMAEIQTNFQKMSSSTLWREDQLNCGFLTKDRAGSSICMDEEGVRSDRPGLTLQWRDTGSVKPPPPGSRDSPGLASETAGIHALNHPGMG

SEQ ID NO: 975367 - protein, 72 aa, Homo sapiens
KTCRHLILPQEQCPFQFSKGISMQHSVAYNCGCSADVRRLECKPFLKVLMSNSKSSLQLRTERLTIQQRFPV

SEQ ID NO: 975368 - protein, 108 aa, Homo sapiens
AFLRARAVPVLLPSHGSRRGFCYMVGLCHAALIFFAIVATLYSIDELKTDYKNLIDQCNTPEIPYMSRPVMSGQDSSDPKTIMNAGYLGMLSDGPAGANSLNLLAIFY

SEQ ID NO: 975369 - protein, 276 aa, Homo sapiens
GRTLYEGCWRPRVVLADIRWTVRNVIVWRLGFIDGSCFSLYLIPALRPADCRHVPKTCEQGMFSPTLAGESLTLAGPLIERHVLVLNLTTAILNGRTLVVVNNMINHALDFHVITNHVVPRATKRVGSKGHCHVSTGGHNLTFTWDSTWANSYLNTFHLGALFKAPGIPLHLVHSKTLSTLNIYDRKTSTPGSLSGAGYLQRTMALQMFLQRSLVPADTRDFGDYNNFFHNLGLHTPYNLAGNFYNVDIGRKRGTRSPRATYGVNPKVGKTTLARR

SEQ ID NO: 975370 - protein, 118 aa, Homo sapiens
MVPLTAVGAFHCYSSSTAFDFHFNVRLYRFSATWTAQSFCLVSPSLLGTTGFYPGFRIRWRTVASLSLKAGLAVLSHFFGLYGLSAGLFRPLPPPLRALRHPPASGSPPIAGPPFLAG

SEQ ID NO: 975371 - protein, 255 aa, Homo sapiens
MYSWPCVCLPTRYLWWVHVISLLTTKTDFRGTFVDLGMVCLGPPLCSSCLVLTLSPYVGFVPLLRCLAILHVMFLFWPSNLATHAVSEGMPWLPGGMIGRLRVECMLCQTCHGMSRGHNAIVPARSGRVTSASPVRWWTSTKICLYVPVFGAPHCTSRTPSCYCHIFPCQVFVIAGRTDATCGCEQHGWGCLHFALIENFFYDLLLTCVPGLLGGGVKSNWAFKNQGGVSLSTFVGPKKGVFKAKGFHFNIKNAW

SEQ ID NO: 975372 - protein, 136 aa, Homo sapiens
MSVASLLPRFVSEDAHSCVPSTIMVVSRVCWHSFRVPYTHGAYRYAADRNSADGMFCRMHILGVRSQDTVTLRRRDSGLLEMYLLEWSGAFWVGADGGGRVRLYLGGTEAHEMGYPPSPWTITQMVIGLSIATVGL

SEQ ID NO: 975373 - protein, 158 aa, Homo sapiens
MRRAPLIGHRSLLCSVSAACYGPVCAGPRRESWKRECHYLYVCMHVLKCTSSDPIHATEFGKGCGPPFLRPLRESVCRQTRGHLWASGAEHFCALMPVQMLVNQVASARLNLECCVDHGIFAVAFLEDIRLEREENWVNRLIGLHQVCLNIVLSVRSG

SEQ ID NO: 975374 - protein, 85 aa, Homo sapiens
MIQCLRDGTPPGAGNTIMENNGPPDSTGLNGRMSGTLPSRNKGGLRPTGDVTNVQYGVEEGANEGAPGLRKCENRTLSSDEPGDM

SEQ ID NO: 975375 - protein, 110 aa, Homo sapiens
YAKCYPGTMDDMVVDSDEEVDYQQNGTRVDKEGALMAVGTFDTQEEYSDVYEQQEKLCRRFALQYGINNVCRADNQAFKANNDKAELDRQWTEDQCNHEKEDRTMEADGR

SEQ ID NO: 975376 - protein, 267 aa, Homo sapiens
PVQYRARKMASATRLIQRMEYLGVRYNLRELTPPGDLKELNAILAKSPCVRSIATSSPNNLLCALAIGRRESVPPSIIMSSQKALVSGKPAESSACSCHLRKKGVTPAPPIKRWQLSSDQPLPVTLHPHGHPITLPPVDSSRETVTLLYDKYVEPQVSTSSLLLQTTTDTTRQEFSPMVQTQQQQNRTQQTTVSGPTSAPERNGAPKKTSSNHHLPLAPAAPRRTTRDPGQHAVPLREPRATRRRLGSPQIKAAGGTQALSTTPGGR

SEQ ID NO: 975377 - protein, 82 aa, Homo sapiens
IFRETAVEGRGGTSKSAIVAGEEITEDYPVEFHECLSAYENSIEAVDEMLKTMMSVSRNELLHKLWIQLEHANSGFGFCNTH

SEQ ID NO: 975378 - protein, 181 aa, Homo sapiens
MRAPIIKGGHRGASVVASLLVIVKQHPVTKSPLSLHNVAMLLDALRIYTNASKEVVEETYHFPGTFTKVTPGLPCTSLWIRQRINIEWIPITLKQPRGISFHKGGQVARGFILVSRYVVLTNGTLRTGGSRDIGWDKFICLDLLNNAANGSGLSLHHPCPFGRRTTCYIGPNKCYNHFSIG

SEQ ID NO: 975379 - protein, 99 aa, Homo sapiens
GSAILALWASRRLENPEREVVWWAAFCVLECSLAYTCLGPLMADSYTSNTGDGRYSRVVCPTIRWDLRLLLYEGNRVRTQNIGILRANFDVCKSSAVVI

SEQ ID NO: 975380 - protein, 47 aa, Homo sapiens
MIQESTKSKAVEFQKGAPTQVCHPTDVAGDLLVNDRPPLGAKNGGGN

SEQ ID NO: 975381 - protein, 77 aa, Homo sapiens
MCLSSRAPRTVNDLLASHEPSRQYWQLVFPDVTVSLDTELQLDRISGGGHKGCDSRFVSKDPYMKTNTFVSGPRSIR

SEQ ID NO: 975382 - protein, 128 aa, Homo sapiens
MRNGGVSVSRWSLSSQWDKELAVEERARALVLPQGPSSKDFSGMQHRELLDSGGVCDPEYATNLLTGGRRCNKHRGDRLRAWRENPRSHAVWRKKCCQGGDFLESGVFANRRRYLKRDLDEGAKSQWG

SEQ ID NO: 975383 - protein, 107 aa, Homo sapiens
MAIRTYIESKRRGILHLGEALYITGHNTDVMNLATDGWLLGNVASFVCSYTQGKPGRPLAIDEFALSLIICSLRKEGQVTRNVHEPQKAGWISAGPLGSHLLDNCKV

SEQ ID NO: 975384 - protein, 220 aa, Homo sapiens
AFFGKMAESDLTTRIAHTFGSASESYRFLNCSLYREIYNEQELLHGKTLDLLSDTNMVDLCYGCITKTFYSDDILMLVEREKNHSCLATNLKPAFSARKHEPNCERLFEDPKKPTNGNCGSTQGWFRNALCDYLVDKPLFHAPGLIQHPLYRYAKFQYECGDFTQETRRISLSLKSACFPSHRLEHAYSSPLGKAGLCILHCSMVAAIEDLTWLKTTIDK

SEQ ID NO: 975385 - protein, 99 aa, Homo sapiens
WRGPKATAIYGHFSGCGTDKGLLTPIIKDAAAKGIQEIADSVKGSIKESKRWKMCCLKNTKEDVLVFPTVGMLDIEEFTAVINPLSGLHFAGWEVPDLC

SEQ ID NO: 975386 - protein, 72 aa, Homo sapiens
DTDWKTHSMNTHGLYAGHKYFGQFCISWNMSTESSRGSPSKNRNKSHKEYPAKHVPTYQPLNHIYMMLLPIF

SEQ ID NO: 975387 - protein, 160 aa, Homo sapiens
MVTLVVFEVKTCKYGLGQVLPYSGELDSSALVGSSYMSALEVRGPLYGQHRSWLRVKNGAMDKGGDCPIDGKPSTGAVGGCMMAGMTGVQVPLPCSSDQGIPQGRIGYGNGFRVPRMAIGRWGLAKKGLQMVGSTRGLGKGGRRGHTWHTRAPGEKRTSS

SEQ ID NO: 975388 - protein, 317 aa, Homo sapiens
ELEEIRKCGMHNTSVTSRLHDSYFIDLAKGFIVPDNPPYDNGSLQNRTSTFQQSTHSTPPKITFLTTQDLSPKHRTTPGHRSALPANLAAENLEASNPKPTKKSTSLIALADMTPSLTHPPSALHRSLARTLPHQGPAHNTLSVPQLLARTLYTATFIAATPSAHPAAPPTLGPTTRAVQHHAVHARDPPCPRHSKTPPAHQFPLLGHFASLPPALPFASSPHHTPTPPSTPPALLPSPPPPPPPSLPPPHPHHPPPPNTPPPPLPPLLSTHTHHNHHRPAPAPVDPPPRTPPPPRRPAPRPPHRPSPLSPPLPLPP

SEQ ID NO: 975389 - protein, 84 aa, Homo sapiens
YCVREQNDVTKLTRNGRSNEVIVCKMKSCVCKRCVCDPKILCLLRVKSCVTTCKERKESRLAKRISHFDMISDKEAYPKGKNYH

SEQ ID NO: 975390 - protein, 273 aa, Homo sapiens
MAVEIQAVATRLDSISPAISAKHWTSFNDRKKVIRHVNDWAHQYATPHYCQDMVTPIPCEVLPKIPMRFSPQPTKFKCLRNNNLPRAYYLAGLRTTLPLLIAVRMAWPLDTRGTPLEPSYRTGFTGHPGDTVGEFSVFIVAMCSSGHIRLHLGLPLHWSPWVQSTPFRLTRETSGSPTIFNNSKPFTCTIGTIHNIKSATVGSTRHNVCHRSCHKDSVYLGSAPKGERQLPMGISSIARGERIWSNSQVIDLGGARQENAPRFFPSCPNFPFG

SEQ ID NO: 975391 - protein, 148 aa, Homo sapiens
SCAKDLTTVLRRILLKRLCGECAVGACCGCCPRQLKARDIMVRVSPEANERLRYSPEEQGKFTLSGWDAAKNSVDQKFTIFITSHSKQSIFQLFQGLCQLLFPIVEDPFFTSEVGRNNPGNLTIFGLGYNITWIPLKAYIETDSPLKT

SEQ ID NO: 975392 - protein, 219 aa, Homo sapiens
ARENRRTAKKRTEQKQNSKKKEHTNKKKKKKQTKKERKTTKRHETKQQRRQTKKKQHDNTKKKENDNTKKKQYTTTTDKNEQHTKNRNDEKKTNKEKEDTAQQNEEAKEEKAETKEKERSTKEKEETAEETDERDKKKRKRERRKREEGSGMNGQEEKGTGEEGGREVTGRGEKERRERSSRDRRERGGEEREREEERRGRARGEGEQKERESAKSGRE

SEQ ID NO: 975393 - protein, 81 aa, Homo sapiens
SDPYKSFLILNWVRCRCCCSCESRTVANMGLEDEQKMLTESGDPEEEEEEEEELVDPLTTVREQCEQLAEMCKGPGAVELL

SEQ ID NO: 975394 - protein, 300 aa, Homo sapiens
LAPCRAPNPAMERPSLRGLSSGRGLLLLLLPPLLFLLFGHLRPCERPPAPPLPPVGCLLGRDPGLRCGCCPYVRPVGRATRCRGVAAPGGAVTCGAGAIGSCVKNPQECEVRYHAVGSNAGGPGETRRTLLPLCKEPVYPVVVAASKGPNLPERVYHSWRAASNEGAEKPGGRRRNHPGSDRGTPGEQVCLPIEHVCEEGTPVDATLSHLEHRGSILLVTSAAPSKLVTPPKGNLLRIVLSAPGGILTCGGTCGNTEDLSAIVEQVNGGSMGQQDKTLLERGTVPFNRCGKTIYGGAHPR

SEQ ID NO: 975395 - protein, 361 aa, Homo sapiens
DAGRPVDGNAVSALGSGPARGARTLCSDKSSETQSCAPPRPLAPTIAGKPATDPTNQKCPPSAPRTLRPLSLPAPFSFTGFANYPFWPARAQLHAPSSIAHCTTLTPRGDASVLPPFPKHVLSPALGEYFVPLTPKGRNQLVYRLTPGAILTCTFGADHYETPPTLRASDGGAHPHYRSPPSSQQPALSPDKTSASLSCCAHITAGSLLHTLVRAPSTAVATHPRPAAWCPHADNRSNRTSTHSLPVPSFIHRCAPPHPTNSRMLAPNTSPAAIPLATPQLTMRTPTRSSINRHAAAMILPPLFISTPALGNRYSHSAPPSCCAPPHFSQTCRATTQARVRPAFIHSHVRYIQTHVSARPR

SEQ ID NO: 975396 - protein, 67 aa, Homo sapiens
GTHRLFRFCGLIFLRVNRPAEADFAGVCGIRAQRSSEFGYTHGWPTWRQGWDLSYNPDTPKIWCKKQ

SEQ ID NO: 975397 - protein, 108 aa, Homo sapiens
MLITKSVLTGPARYQRSPKPSVEMYISAGEHVKVHRDLLVTMCWVDHVQIDIARKLDKAESRAPAAVRYLLSRSWEQAAELNACLRSYHEEVTHPCQCRETSVDEAAC

SEQ ID NO: 975398 - protein, 101 aa, Homo sapiens
HPGAPKRRGSSGSVVVDLLYWREHKKTGVVLVPAYSCVLSLTVSSIVSVNSLTLPLALLSVTISLGYTRRVIQAIRNQMKAPIQGISWNLKLLISEEWFQK

SEQ ID NO: 975399 - protein, 236 aa, Homo sapiens
GTKTAMAAAEEEDGGPEGAKSRSGAGQGATFECNYMLGECFGKHVVSVCGAPRYTCMDHGHFIQIGWEDHGPRPGATKCPQYCTTLENQHEDERWSQTYYAAKGEGPGRPQRESTAIKKRPNTRTQQGTKEEHTTGAAKRENYHGTLRTNTGGAIHSVPTLEKIAKHIHHLMHIIHNQPGIIKGDTIESHIDPDRGYQIVMRILEQQGVNTKSIPWLGHGNAHSLHMYTVAKEILA

SEQ ID NO: 975400 - protein, 218 aa, Homo sapiens
MAFPMKDKHENDCTSDDSVNILIVRNTLGGTTLLNCRLGHQGRQMTSHLNKYCNRIWTTPTPMWPNILPFTKGPYICHFMGTPPSDFAKIPMQKIRARTCFGESVDPIGVVRDNRGSKDFFPSVGRKFIQMVQGSLGNLGLFMGSTRGNPIGHINGLIHAELIPESPQEVHGIWPAGNTVSPRGYLGSLLSSAASFSAPLGNRTPLLQGIHTGCARRL

SEQ ID NO: 975401 - protein, 409 aa, Homo sapiens
GKTEWSVLPALGTWGPRVATGWLHAFLMISCLNSKFEALARWQNLNNSCDPARYDTTTFHITPYQQPGTTLTRHSYILERTVTYHTNLPSDRNPNDLTRLWASLSGTRTLASTYEACPKPPTLTALRIATTFAPLDDNPTGGPQTSSSPIPGYPLIATRLGGKGTLGSHTPRSPGQQLQRSLGHPTLATYQPFPTRQRRSVLQPNLGYRPAKQPGYAWWISSTANETSWWTQAHTAPDCPRSFGPGTSCDRTRQVTKGTAQNVGTKRPTTLPTRILHVTRLKSELRPYPFHPWQHTSTPVKPTQDTYLDAQQGAPFVNTFDSHRATPHSRDHLPLTPPTVYRRPGNPLDTTQITQAPHNGPRPLSQISDRRHPLANTRAITAPTGHSAHTGPSIERRDEAPIGSRGQDS

SEQ ID NO: 975402 - protein, 102 aa, Homo sapiens
AKWIVIIMVPLGTTVLLWSLLSMWLRVWKRVCVRARIQALCSVPRPWLRTLGSLLFAAMRCCLAEQVQCSDGPGESGMPRDHKNTYNQWMMRMSKLAYSTDN

SEQ ID NO: 975403 - protein, 74 aa, Homo sapiens
SCRTIHHESSDDPPEYQPHLDSRSETIGAVYMLWRWEEFAIVYIKVRITRRLSSITCEICSLDHERDTGHYLTR

SEQ ID NO: 975404 - protein, 186 aa, Homo sapiens
TDHRRQRYGTWSPGREQTNREDIREISINILSPREQHYNKEEKEKQQERIDTKTKQKDQMTPTNTREKTKREEKKNDETTEQTNTQNTYNNRNIDKKHTEDKTDNKKHDETQQNHTTKRTSPKRHEKKRGTRMRDGNPKQEGNTQNRRTHRRQHRKQSTAKENKQDQDRTTGPKTKTNSRNNHNKE

SEQ ID NO: 975405 - protein, 271 aa, Homo sapiens
MRRDMIFSTECFMPKIPACLSSVYTCLICGHFVALLGPNIQGSMTKLVSSDALLYTSGATLMAPTGASLLAPCSTLTSLGTPEQRNPLRKTKDAKLPPKAPYFHVLKINPGLRYPYPPETKHYLCAQGGTQHLFPCLLPPLGSTWQHGHTASALPCGHASPQVRLMVSAPGHHRVATLPPWELCFRESAGSPLCRTVPPALGSPFRATHPSARHTCVRPHEPLLFPISPHPEQVSSLPRVYALSRAPAPDSPCERPTPRVGYSAAGDGPAC

SEQ ID NO: 975406 - protein, 122 aa, Homo sapiens
MSSPRTSLERTLEQRATKWDEAMLKLNDHLEKRYNEGPIEKFVKQEVYEYHDDITVTNGQNAHRIYVERNGNKDTLSPDGDPAIVHPTMQFLTHHHVSMRMWQVRAKNSTAHMTTLTHESSY

SEQ ID NO: 975407 - protein, 195 aa, Homo sapiens
MLADLGRSSSLTQVSGGRRRVRPLALRLLKPKPARLSSFPPACSGCCCQVRSPCSRRAWSRLHPQEGVGRHSRTSSTRPAWDISSSGVNLARAWTRPTVSYGAAQPCGLRASIGYRDDRNWAWAVNLTSMSKNTYQCAGNEDIMTLRADGERGYLGLVLKHPNQEKVSDYESEVEDLRLWNNVGIQKGSKLCRTD

SEQ ID NO: 975408 - protein, 163 aa, Homo sapiens
DSPWGGRGARTWGGESPEPQVRPWAAGGQARAGGGMVAPRHLPTRSLEAFAEEVGAALQASVEPGRLTGGGPGRLALALQAVHVGVGPLRSPRGCTGRKRGRSGAVAAALSRGQRFGGLVLSPVVKAEQRPRETDRLGGAVGGRRHRLFLGMAGRDSVWNRWR

SEQ ID NO: 975409 - protein, 103 aa, Homo sapiens
MGTVTPEPWTGALRWEHASAALKSGTAPMNGRSLEKAVQPVHWLLQSADFGSVPLFHPRARPGLAGPLASCATSVARLARLVSSPLFPWPCSLPLGTRMITRP

SEQ ID NO: 975410 - protein, 260 aa, Homo sapiens
LYACFSSSKGATTCAVASAIDVRKSPVLGQLEHQLVVTEITLPKEKLFGTIFSSGDGQMCFGKQSQTGFPISQDICIFSLNRVVNPKAIYDMQWIIMVRMSSHARLLTPSTIYAHATVWPDDNYADPLDLTGSERSSFSWEPLALDLSPSNGDLASPDRKHACVHQNFCRDCPSRNLLFNVCYDLDDLVNRPPSIVDLPFQRVHGLHPCMYTRHLTSDQTLHLDTLPTVTCSNTTLSRNRLSHPFTITCSPNCTPNGQPH

SEQ ID NO: 975411 - protein, 163 aa, Homo sapiens
MPTTFQSNFSLSVPSAIRHNRDALVLHGFALNARWVFIEAVLWYFLTQVCTGDVRLPQRDRVLSRGEPMPRLVPCWEILFGAVWKVTLSCYKQSKVICISLYTIFDVPCGYTKSVLRAGGCKVALSPPGCFSWSRRLSHLWLADTFLGCVQGFSHKEMCARRV

SEQ ID NO: 975412 - protein, 230 aa, Homo sapiens
MSLEPLAFIFIKYPLHSDSPGGDPKTLSGAQACKKHKAPGNISPQPKGEPFTQWSRHATGNRSHGDQQWSGHIVGHHENRAPSCIKPVDNLPKLQRHTFWGRHPQETRLAPTIATVYPHENAPSWPNRNGVAAQRTPTADAQRASQLERRRNWHRKRKKKPHWQTLEPNCKRKRLGSLHTLNSARKTAVTHTLAHETHMTRHVDRHALNHPKANCRNETLTERYCQNNTA

SEQ ID NO: 975413 - protein, 51 aa, Homo sapiens
MRFGVARLGPMSGNVNDGQIGLVGLSEILVNDVDDRSPHQVNTHARSADRV

SEQ ID NO: 975414 - protein, 66 aa, Homo sapiens
KAAGLTIRVHEVRATIVDGCCLKHFTREQGGLERSEGGTDGLQFERAELSNMIAKLAQNLTLRIKP

SEQ ID NO: 975415 - protein, 232 aa, Homo sapiens
MVCILWLGRSELVPDYDIGACSAGRSILRGSTVDASKGQHKNLPSGLSGPRIILIDTGRNGNFQKYIMPVFKSKWLINVVDLNNKSNVQVEVVRLMSSWGTQRSFWEALRRYAVNTVIYLMRHYLIARYEKCALRKSIGQYGRRIMGDTWRAEQLVLHLQEDGRCDLRLEGSHSEEFYYYPLDTLDDHMALTLRTHGRMLSLLEECIPRGREAPGILTTLYDSSDPFHLESI

SEQ ID NO: 975416 - protein, 87 aa, Homo sapiens
RGRVHSGGGNVSRRETSWFPGVGSPGSSWKGNNGAEGTAVAAAAARRPSRICSAPGIASSVRCPQASSRDRTEDMYSSEKPWTADLG

SEQ ID NO: 975417 - protein, 148 aa, Homo sapiens
MLIKIKIHLKLPNGKDVCPGALPVAHRRFYTVAHKCERSEQIPEKKTGGSHFQGLLSRKAHVGVLAGREPSVPSSRSQVVWMQREGAAATHLHIPPGPLGPVSSPCHTGQRVPWAPFVALLAHVPRVAPPGHEEQRHRGGPLGSPSSV

SEQ ID NO: 975418 - protein, 285 aa, Homo sapiens
MTDNSQHITNTYESYPRGTGELHVGEEYKTYNNETPCIWACDTIMGLRFRVFHVSVLRGKPSACVGHWLAYARLALKTSGKKYYPPRKYARVGVTFHRCIPLTPKNTQFETGTHLVLDKSLPSWNLAATNSTLTFLNPNTFWHQAARKPGQTVRHKLSRNGLRGDDLQLRIRLSDPITLKIIGPIKSIGWKLAFTSKKLLQPVHWGQTLGPGIPLTYRTQTWDITLGKVPKATGSHGPFEPETNLKCNHRVAKQGKYEENTVHAIPTAPPGGPRYMKAAPRPRNA

SEQ ID NO: 975419 - protein, 81 aa, Homo sapiens
KQAWAMAGCPSANLACRACSFDLRLAVLAISEIPVGVGPSETRCWDIVSWLHQFFNACVLSTAQYYAVCGVDPEYFPGSNL

SEQ ID NO: 975420 - protein, 195 aa, Homo sapiens
SGAVALAARCGEAGLWAVMYYKLSGFTAESWAGAWGFGGPIGPAVHKSRGGYPKECNHLIHIGPPTRLKIGPPGSPPGVLNIMRGDKNQCSQKLNKKVFSRTRSMVVARFIPETGGLPDPNWIKTGTNNGELNGGKEPILMALDRHLLNGLSEAQQTTLKYGCRSAPWIWRHCGQSPTLLESFPYRKHWSKLQSL

SEQ ID NO: 975421 - protein, 226 aa, Homo sapiens
MRRDAVRMRVRAAGPGPDMSVLVKSKASMGAFLPNQDANNSGIRNETLKTGSHLQRPQCCGFTVMRPSDCLGGTPVNAMETPFQPAKDSLVDPITLDILHQIGITSHLWRAPQRFGTRFSGGLLYQEKEHPSPKTTAGILYYYQVHWGSHRETTRNYSGERTILKRWVHGRYGKSHNSNGWRVKTPKNQSLFLVHKDCSFRRQWGHHSHNYTFIAGNFVEVLKRST

SEQ ID NO: 975422 - protein, 125 aa, Homo sapiens
MIIRSDVKLASQALITTWATALDRTIAERLQVAAFAALMRQICERVIGEAVAIEHVYCCDAQIVYPGEVRQEGSSILMEFIRTGNRTRHFVDNIDAFPDGSYGAIGVDHYTVIGRQFHFNRERGS

SEQ ID NO: 975423 - protein, 72 aa, Homo sapiens
GSDRAREDCCSPFAALILPSHIGHHCSHVPVLWDYTLWDNAVVGRHCTHGHQKLSDTTQNRGPHHTTVTRTY

SEQ ID NO: 975424 - protein, 68 aa, Homo sapiens
MCDNNTHKEQTPKEYTQREKTSVEKEHRNKTGVTEVTTRATKRPHVAQTQNRSTTKKHTLSKKKITAK

SEQ ID NO: 975425 - protein, 128 aa, Homo sapiens
MSGPCQGDREGREGRPAASCPSPFPPGLLVLHLVPRLASPPCCVPCAFHSASSFHPVAVTRQRPQRMETSASGYGATLCESSMYLSLPRCPFSTGTEQCRDSGLDQFPISYFMSHKFFSTSGANIHSR

SEQ ID NO: 975426 - protein, 109 aa, Homo sapiens
DRFPGNWSRMADEVIVSKSAIMAGEDYYMNDYPVEIHEYLSDVLRIPLVLWMRVLKNLMSVSRNELLLEVGSEIVTKEKWIWSSAVQHYIQCVGFYLATQGVNPKDTVQ

SEQ ID NO: 975427 - protein, 167 aa, Homo sapiens
MALSLLPSQVPPFQLPPMLRKRLPKKEPAKKRYVESRGAEVVRLTEAVKARWLSFSDNDYSSDVSAGLPRVEGICRTRANFNFFPIRALPYSSPPFTLGSCPRNFDGTTEMCPPASSGTTFQVIYGVLHDFNVTRTPSPRVWNPWVYQNHGLRKDSCQKLGPMAMTI

SEQ ID NO: 975428 - protein, 105 aa, Homo sapiens
MSENTVEGGLENTERTSSNSGGDGGWKGNGFTVEHDIVYDLWYVDIGECIFKLTRPNFPPLEIYGKKRTIKIQGQKGFINRSGGGKYRLNIMWRKHSDFVDLFIK

SEQ ID NO: 975429 - protein, 200 aa, Homo sapiens
MPKRGKVSIVGGANPKGSFSDVHTNGSGKTTSGLRYLQGLLPGMNMLAFIPPATPDRIWVLEVQPIRKSKLSTSLESETGTWDHAKKVTKHPNHPKNIQHIIREQWKQANMVMGAGRRGCQPAGPGRACVRAKLWRVPAEDTGASPPGGREGQRTSPPRGWGAIICPGVMAEEKHTGPGGHRPRSDWGPEENTKGYPEAG

SEQ ID NO: 975430 - protein, 280 aa, Homo sapiens
ESRLLHFSGNLPTKEADSFRLEQVRTRPSGVYQSRRPARIVQGRTASGETVPSKGCGVISRFTFGRNLYRLGSSSCVWPPTTCFKAPMQFTSISNSCDLHCCIWGSHLQLQGLPPQFSPTEYLPQSPGGFTVNQNQVLSKRVVKPCVTLYFNVKCSSTLRVMNIWSSGGSNTMRWTLELAASHAESTFPSPRPTSRSKCCGNQYPWMETGDHDSVFYLGKLTNCDNGFSNSLGPALGFIPVPRPRTTTSGGLIGTVTRDQRGFFFGALHAVSVGSPQFGS

SEQ ID NO: 975431 - protein, 285 aa, Homo sapiens
ELCDGPERGGAMLYPTPGRGGAVGVPCTRPRRCCNPHQPTPFYIEDICGRGPAGAAVPTLTRSLNSSFTSLVSPYRTPVYESHAMIPLRPYSHHPKPFGTCHTHPAELRGALLGPPFLRDRDESDLKRASPLHSGQYPHVLKPPIPGKPHIFDTKCLTVPLAPLHRRLLLEKISPNRYMTTSSTPLTQTKQCREEPPEKLIIQPPAAAGGKPGLGPNACSGVSITSDAVSSTWVMRQSKPIVEMALSNKLRFTFHPTSICQTGITATSLLTLIQWSTHSRCSLGE

SEQ ID NO: 975432 - protein, 169 aa, Homo sapiens
MLPEGDEAISILNTGTQHNCTYGCLRAGIPTSTGKTEELHNSSEAARIDAIRTIADHEKPPDDLLGLHRQRIIVTSRLATTMTFSVHYTTDLIRTVPPLLVLQGGALTHPSWSAQQQFVGERHLCSCPNSHGGPTLDSRLIAHAALFFLSQVFHIYIPALLSPLLTNHS

SEQ ID NO: 975433 - protein, 248 aa, Homo sapiens
EQLRVGPEGSGLIASTAVLRRHTRSGGTTTIQTIRIRPITTFSYSRFGNLTRHRSFVRDTLHHIGVLLSDPLAHDNTGFSDMVRLAPHISYAPHRTAPTARASHQGRIQTPGKSCNYAQARTRWAGARPLAANAAHVRLSKSYWATPLGPRGPQFRVNGPPTKPLFHVYLPWGRPLSIRFLREPPGRKLATCAGGLLTLEHTAAGPGVVKTPKPLFRIPPHGLGTHLADLQDRCTGTTALSRNSRSLF

SEQ ID NO: 975434 - protein, 84 aa, Homo sapiens
ERRGRVLKPRARRGPRAPDAEIREMKRWGRHYGTVFKAKNRETHEIVALNAGEAWMTMMRVVRVPPSGDLPYSGAEHKNIVRAS

SEQ ID NO: 975435 - protein, 30 aa, Homo sapiens
MCPKPYAFVFGFLKSVTSHVDASSSRKAHW

SEQ ID NO: 975436 - protein, 116 aa, Homo sapiens
DRQPGELPGVPRERCGSSPGASGGDYPVRSKRYLCKLKNMPPKFKRHLNDDDVTGSVNKWKEKSFEDDSDEAKRTFFLRGPSGPRLCARIDKHYSMFRIIVDEVMMSCTEHYYKGN

SEQ ID NO: 975437 - protein, 193 aa, Homo sapiens
MGGSVVEFSPATREAWNFPWVLPTHQPMTQPLRECTPGTTHTHLLPVLDIPSEPPDFREGLDRLASPSQMAPTHGPPGRRRASPNCAWGHQELRILPKLGGPLQGPQLQPFKDPPRQSPGKYHRAKASLGPRGELAFQLRATGVMGPPSNVAWSRGGPRSSCVETCIPEREQRRDEAYVYLLGANPISLMNNK

SEQ ID NO: 975438 - protein, 123 aa, Homo sapiens
MHTSRDVLNQTNFHTVHDRGYYTGQWLCNSGEQTKFHAIASEISLKLWNRAVLPIAHSNPLKKHTKNVGRGHQAETPGGGQENRPCPERRRGPNTGGRTGGPHSEPRGTASPPTSTEKRRDAT

SEQ ID NO: 975439 - protein, 234 aa, Homo sapiens
LYLVPEVGREKGCDGGIAASEVLVNSARRGPSLRGGGGPIRKREQRLRKIRGSLHLDGKFEARKLNHQEVGGRKIKDLRITLQFGEKPKKSSLGRWGKLKGRREKKRGCGARRDERYEKRGTWVKDQCKKIAEKMGEGKQREEKPCDRGFTRFMLLAKYGQVSIGLTKRIKLGCGKHLRDLGENSGERCFPKQSNRFLSWEQVVPYNRGIGQGGSLDLKNSLEKGENYGGERFL

SEQ ID NO: 975440 - protein, 84 aa, Homo sapiens
TVTATVAKGWVPETWRSGSPVCSCVRVGAETSPGQVVTGTVSGGRDSRRVHQQEETPGGRNLRQIAGEAARDPSLRRARTVCGV

SEQ ID NO: 975441 - protein, 71 aa, Homo sapiens
MLLSTYVWAGSQIGLLEYEMHSSVSLEIPVNAMTWLLCDSLASKLIDKRSGEITGPGSRYAIPAIADRGGR

SEQ ID NO: 975442 - protein, 188 aa, Homo sapiens
MGIFHGGAGFLDQGNLCGIFREVLTHLQGHTSAVQELRDKKLPGITGRYQNGGYQIKYGADVWVTRVIIALREAEAGGKLEPEEWRQAGTLEEPSLKERWKMTGQGGGIVIPRLEGHNIARETRRSEIGEHGPRGDTWNPSTRKNNLSHCRERTKTLRLAKITPWRPKKDSPKAYGATTGSGHEADKP

SEQ ID NO: 975443 - protein, 122 aa, Homo sapiens
GVGGVILIRSGIEMAVLWRHECRNAVPLRRTRLVFASKSQWSDPCSYCSVELYSQRSRPVSSEVGVDVAGQVYTLSTGATDVWWLPRAVTLSALDIAESVSSVVPVLESCCRLLYVLKSLLV

SEQ ID NO: 975444 - protein, 142 aa, Homo sapiens
LGFTRLVRTVFWVALNVLCSKVLRGKTQGGRLACHYEEEVEKYEFDGVSTQRGVKQQLLGEMSARSSEWSTRYETQIDLNDELEKANGVSQGRRVEKIHGKLFRVDYHSYCVSYERMPVNSMRLQSRGGAVVYNAFRNPGFP

SEQ ID NO: 975445 - protein, 323 aa, Homo sapiens
AAMAASSLTVHLRSRVASACSHRHPDYLRGPGYRPPFGLLLESSHSAMQPHSYIYQDMLPKTSLSSPSFVPSKKYCPDPVEETQDTIAKKVVKKVNVDDRHRGSMGQVSFVRWVQLSRDRLVDRLTSCKTCSYHLEMNVDLACGERIRLENGPADRVHDNFMLPWKDTPREDGSCRVEATVIEEDRIMARIIMRSTDKDPCRRKESSEPADCPRITTIEMAPGRGLPSYDLHRVRITSASQDGQRDTQKTWAGLGQGTLQTTVWAAGPVKATLALVPTSCQIVGAPKKLGTVLTPTVGWSQDALAPAEGRSWEHAYPSHRVRF

SEQ ID NO: 975446 - protein, 316 aa, Homo sapiens
PSTSAAPRAGAASWDTEEAVERAKVVCQPVSPDAQSRASVMMVRRARMARPCIHPCSDVRAVSESMHTDEYSGIMGDRRPERLVGHWRGHLAVFKVGAQTWGVFRVIQRECKTMCMSRSRHWDEVHCPNLYVVHGAVDNVRSGWFWWLVLQQTLSTTYHGVYAREPIRWKHQWCLICYPVDLLCMKLWGPLWWDARCPRFVGHVTKISWLTFGFNNQLRSVVLVSYWDPKTEYVVHADVGIATHIMHGGHPAEGMARGLFGEPARKVTTSWGGPGRQVMVQSRPKVAPKNAGARCNQRGVETGRVSTGGPTAGTRQ

SEQ ID NO: 975447 - protein, 113 aa, Homo sapiens
YTKKRNKVRLYKNHLLRAECHCDREELQKSVVVYGLSVSSLNRVSELCESQHLGAKRMQEESSMHWSVQSVQREVRPEAFPTVQISRVCFEVISFLLDYFLYFYMYGVIAFVN

SEQ ID NO: 975448 - protein, 190 aa, Homo sapiens
YYSQVATAVVIHSDKRMGEEVLGLQPLETELDDVVLYIATVHQLCCRSSLRQGGRCVSALQILCASADVLPISPWTFRLLLGCILGYVTSCHNQSIALARSSEFGIETQVGLASVGPKEMVARNIHGRPVIEFYGCSPYRNLACIHQRTMNPGVNEQCVWHVSSSVCIRVQLESHAKVCVNVPDDSYHDP

SEQ ID NO: 975449 - protein, 218 aa, Homo sapiens
DSRNKKARKDGGPMPRGAPSKGAGRESMETGSAPFILILVLQLLLRIRRNRQQRVPPCPQPPSLFPGCDLVVERLSFKTTPMDADRLMFAWDHSITTCTVVVYNKECHFNTLTGHDAWEGANVTSYPVIVGTRMSEAKKPSELRLHIVLRNTYGLTHTSEERPLNRCQTLSPVVLQKLRSRYISQMDGMYRLAVCNHAIGNRCAAIHKARIDLVAVRS

SEQ ID NO: 975450 - protein, 64 aa, Homo sapiens
MRGGGGRPNVEVRESTWVANTGGSPEGENPGASENNRGAGGIPHHMRKHPPGGGNPQGGVQEER

SEQ ID NO: 975451 - protein, 75 aa, Homo sapiens
VAIGMVSFAGPVVIPVRLIRSQDVACQKEVVQVRKRINEEEKQEELDSMCSSCLCAARHTLTYFDEELRSFYISP

SEQ ID NO: 975452 - protein, 97 aa, Homo sapiens
GAASALPVRWASGEMAPSGVLQFPCSPGAVALWVLPGRTGLGEQSVGVNQGTENVERTCLEGDLMIEFYALVCCCVLFKIFNGKWESLAEWGEDLGG

SEQ ID NO: 975453 - protein, 297 aa, Homo sapiens
MSLPWSPVEDLAARRVLSRMFLLPQMEFGLSYTASLGHLYVDKRVAKIICQVSLANRAPFTASRHWTYGTKLVGGTTPGKEARHIWAPVFNTVKEAKEQTGATDSVTLSSAFCCVRAINEAIDGRNTLGVCVSLKEFPSRTWYESSTKCAPGTRHGYIGPNALESSILESVNLGSCLAYSQQSGRTWHCVRSGNPTNEVGVSINARGHRGQLCDENSGAILIDARIHDAAKPRPAGHEAQWRERCPKATSWEHTDHPRQKIQRPDKSSARDHRAEHQNSNTSHKQKHRAKTGHNMRR

SEQ ID NO: 975454 - protein, 213 aa, Homo sapiens
AGSTRRWRVDPASDEHGHCCVLLPILSLISCLLQSPITEGVAATRACLNKYQREGAEAHLVDLSDMCVPSELQDQNLHDCAGSMFTIDKVVRQCLRIAQGIKVRSSRYIKISHRLVLGKSDVHSVSREPACYPKQYYSRNHRHTIRCKRTPKVTHWIQYHNGRTTAVAITQNTHSASTLDKRTLRSPVRDPGYFQRPNMGLPWPYYHTLVCVS

SEQ ID NO: 975455 - protein, 115 aa, Homo sapiens
MVCSFTQEASETTSPRRTNNSRHTALRAVTLTGKVCSFTPEPARPRTNQKEETPNTSEHQKEQTPDTLPLSNCNTHREGPGFILEVSETKNPQIPDTILVHEIDRLIMDFDYGSF

SEQ ID NO: 975456 - protein, 71 aa, Homo sapiens
VGSGTPRILPGWDFKVSDDAFPSQVQTLPSSPACAWEPNWGGWANEEVHFEPFREITMTSPFMTCLAQFYC

SEQ ID NO: 975457 - protein, 109 aa, Homo sapiens
MIDVATQSGDELQNMTPSNGIPDESQWLRVGHPVQVQGHSRDRNTCCMDLRSGAFGCMWRSRRSMDSQMEKLGDDLNFAVGMLHVEMSGTHVVGDSKITVMKGVEEENA

SEQ ID NO: 975458 - protein, 319 aa, Homo sapiens
MTRSAQHAVFMLDTHSLTTADTPLLFLSCLLFFFLSTFYFITLSTPIQDTQNEQTYTTTNTQHAHTRTHTPAITRQRPTLHPQTPKTEKQSRRERKRKKQRQDTNRAREEAEQRGTQKHGEKTKEKERKRRTEGEKEERTKEKEKEETKEDTTNEKTKAEHTRNNTKERRRQRNNRQERKEQAKAREKEREISTKKQEKTRKQKRDKQRKKEKTKTAQQRKTQKEKENEKRAGQRKDEKQRTERAKDRKRQKEEDNRKQKQTKRRESREDTQTDRKKGKRKTAKTRRHKAERRENNGTKKEKAEEREGQRGRKPAEEEE

SEQ ID NO: 975459 - protein, 505 aa, Homo sapiens
MSITREHDALGDDPTWCVGPPTENSISKRKRARGNFFSIVRAPYMGVASNIQGFVRQTCTWDLVETIGTGLNATHRDPGLQPFWHGNSKTVGGISWPNVASLSHIYRAFVLALEHSRCGPICYTQKNTTQSANPIYIKTRKHNKLAQTKEKTTCVRALINHNTCCGGRNRHSVNALIGVSKAARIYDDLSSYARRDDDQPDECPANCVTTTHDNEDEDSIRIMTDEQRARHITHNTRRENDRRHTDDINLIVLTMTDTETATDRLINVTLSASQQQTVKLERSRGEGRGEQETQEKKEREMRNRGSETYTGEQHGEPEETARASERARAGRQTPGARQPARREERRAERARETKSREWKGGEAGREEQWEKEEGPSRQVEQGATGQRRENRHKTADIKALTQQDKTENRQTEKNETTDETRKTRRQRGKKAAENHEQEEAEGTRSEGTAEMKQTLGRGKHMRPRTHQPSAARAAHRTTPIEITNHEVKQNKTIEKHTKEHTQTTR

SEQ ID NO: 975460 - protein, 689 aa, Homo sapiens
GAHTVACSSRLYQLDARITFVCRQPGIGEAPPAELSSILPVPTFSHARDLPSTLRTSDQLREHSGLCRMDYEDPTPVTDIFLGRQPSFKSTDQCPGRPALGICQAHNQDLQCGRPIDGSQWLVLYPCLYSFHPDIAIVTNHGQYPGIHPVFVSVWLVSSETSNCYHVGPNVEANVYGIRKHVLDPVIIRKRRPRAHNRNSTYQLAGRRHNHGKRARGLRTLLRAIKRTPRLAQGDARTKALGPFQGETLWARQPRQQRVHNKTPHHTPLRLRAVVATSMMTSQTGESKTSTQTTRRNDTRRTTSHSEASHPYIATNEDTSAHDTQQDNQQASQHNNQRQPTTQPARKEQQNSQRREQEETPQDRETAAEMHTTRRVAHTQPRQDMPSENKSRGEREEERKTQSEPATGEQSDNEERTTQHEPDRTEPGEREAEASDSEYKQSRERREAQGAQPSADATQRGSNKGTRETASKATGQSETATQRGNERYAKSRDESKEAASQRGRRETAEQRDNSEEEQEEPNVEQQRAESRARSSSTPRETQRGGEEDGQKVAQAGSEGTSDRKRRKSETRQGAQNRGQKKRTEREEEQTGSEAKGETARADKRDRTGAAKERSDEPSSKEVGEENREESAARGPAQKTKRRLQREKAGASEQEDKTTPAEKAKTAGGETRERREQRDERREGRQEGEM

SEQ ID NO: 975461 - protein, 495 aa, Homo sapiens
VLYHHKVVQQKLLLLILLKLLKVTTLYPMDTDSGEFSSVGEEEIGIILSHRFLRPYGLDADEWIWIPNGVQISSVNPAGEVSAPSYPGYLRIVRYRDNSLDTGSKPSIPGFLQSLSTGIYPLVPDRSPVLKCTAGRLHVFLIQVLQAAGCHSEGSTCPLSYHTLMTEEAPKHRQRQPVDLYGIRQLDTAPQNRQDANPGHTKTPPSTLKKAMGTDGNRWHQANTADDHRTRRKGTAPTEQPPSQRHGTPTTPKLLLEGPSEPNASAHPNLVPNRLTSYHRTVPRELHNQSYVPNQPSTTMWSFSSHYLFIYLPLLTDPSIESHQMQSKTQQSQRNTYTEKQRDKTETTGRAANHKTQQSNGKKKEKQNEKNSEEAANDETATRNAYMDEQQQTNQTESQQGDQKQHGNNGQTNNQTRQHDLDTVRHDKSTHMKATKYRSQTALMIEPSKPTNSNYSHQHTISNTHMTHLQTNSNPYNSITSIVPRIYTTAYIIIY

SEQ ID NO: 975462 - protein, 529 aa, Homo sapiens
LIPKQTSHPQTPLSTQTHRQTKQQQHDKAEKSRTRRQNTENTPTRTKHHHTNDSDTQAQEREQTTSRTSKRTRSRRQNTPTQDNKKQQTEKPPKPNTQHSKRRHKNKENNAKHRSHKNTYPHHHEKHTPTNNKTEKQQKAKRAKTHTRTERNTAHKKNSNRQTTQKNNTQREQKKTTKDEHKNQETKQNTKNRQHKKQEIATARKKTAVETYRSDESTSTQNIVNVNKYSNLYKEEPKHTTRHTAKSPEYTHAQDKSHHISQTKHTLKQRKQQQKTQEAEKAKQHYTQPKKTKETRQHTDKHKTKRNRKTNPETIRHKHPNRQSKKRKSKHQKKIVQKQPTKRITHRRRETNKKKSRTQQQRHTNKSTNDDRQTTNINNQNSTTRTHKNRAQKRRKAREHRHTARANRQKTQTRIREHTKDTNADKTDNLPYNTKRNRVHRDRATQAQIARRREPPSSRTRPRSEEHNRTQERDEANRKEREHMSNRHPHNHRYREQQHPRTARTKEKEPDTLRQPHKHRTTTPHMKKQ

SEQ ID NO: 975463 - protein, 172 aa, Homo sapiens
MRDAATVRSRDPGRSLKTAVIYGSLLSAGMIAQEARHCPGEANLHVFCSHNGKMKGCVRPMNMDTIHLEIMADASNLPLCTDRDPGNGIRGVRLPGLGAFTNKCAPDQSISREIQTAGAPLLLPGECWAKATPCDPQGATKWSVNQWYTKSLKVKPVPTARGNIPLAKFPWI

SEQ ID NO: 975464 - protein, 245 aa, Homo sapiens
RWEMLARAARALGPFAEGLSTGSGRLGRPPLDVPRNTGVLFGAAARKRWCWWQRLGRFHRDPWSVVWNILILVEDRIRYVQSLTELGHQGALSSRGVTLDKCNLWQIGWRSLYRAHSWTPLQGARLGVVRGTLSYAGHHRLSFKTTHGGSELGKTLSGPKVSPGTRGVLEVPGFVCGLPFKPGLLTWGGISRRASRYLEIRGYHMVPPRVEEVFARCLVEGAGGEKGHSSQTLREPEISPFHGAE

SEQ ID NO: 975465 - protein, 125 aa, Homo sapiens
SPAMAFTFAAFCYMLVRCCSLPRSSSSPFGTLIALDELKTGLQRIPIDQCNTLNPLVLPEYLIHAFFVCHCSPCVASHEVGLITTWGDPPKLCAPLSCGPFIHYICATAIIATTPCSCTLGPKTS

SEQ ID NO: 975466 - protein, 158 aa, Homo sapiens
PGVSCVVGKRLSEHGPLGVRVSSLVMTSCLVAGPRQEHSRGGERICRDLPIMDGQYLAGSAPSEAHMEGVRMLQWGWLLIIAELTAHRVQEDFIQGGGRIDNFAPLGRAYCLFVDQVPIEEFCPYQKGLQQPFGENRGPLVDYCQIGPSGKTTRLDNG

SEQ ID NO: 975467 - protein, 111 aa, Homo sapiens
MVIVWLGVGRNWDFSRLFFRPSEGWTTRSVGEGIKDRATAQGAGTCEKQARDHLESPGPKKLQPHLRRVSKDGDAHENASERKNKVGAQVNMGNGDQQSKGVTQEGQVKQK

SEQ ID NO: 975468 - protein, 128 aa, Homo sapiens
MRQVHNWIAFAAQLYVMGQGKAGSSEISLGIHMRGERNIDEIGYWTMEKVNRLIYTKKLDKYEKKNTTRTPKTTRTTYSTQSPQDGREEAKSSHHTLGLGPTEEGKDPTEQTGPPQGTPMEATAATQE

SEQ ID NO: 975469 - protein, 141 aa, Homo sapiens
STAVCRPGGEGLRNVALAAARPATQRAVRQTDRAAPRSVWGQPPGGPLRCACPRFSLTGAVPHSQRRPPRPSSRPTELRGGDLSEPSAMTAPCSPAGAASWTPPARAGARSRRAAGTPLCGCDVMMAAWAGRGGRAETWSC

SEQ ID NO: 975470 - protein, 99 aa, Homo sapiens
RPSLQGSGSPPPVFSALCLVMAALRQAIPHNCYEIGTLGTLPAGSPSCKITGGALEGVPEDLCSSVLDSHAILRKRKIRAIIYTNYSLRSYNPASFLTC

SEQ ID NO: 975471 - protein, 168 aa, Homo sapiens
MSKLRSAEISTKSINCDLWYAVGMPVNVPMETLRRDGLNMEDCVGYVTDVHYLLHLGAQVVGIRKLRLCHLGVAEPEQQEGPLGTSPFSDFRRASDCKWFRKKALITFGLDRPCSGLKRKFLVLGTHVLRLELVRPGLSLDRFLWPFRNVLTCCEDAPPICPYVGNST

SEQ ID NO: 975472 - protein, 159 aa, Homo sapiens
MCWFSRGALGRWFGDRSDAMSGRGKQGGKARAKAKSRSSRAGLQFPVGRVHRLLRKGNYCSSVVGAGAPVYLADEMLEYLTVEILELAGNCGREDKKTRIIPRHLVAVLRNDEELNKRVSVRVTICLRAASFLTSRPLLLSKSDRMSSPIHGFMVSVGV

SEQ ID NO: 975473 - protein, 115 aa, Homo sapiens
MPAVDAVNRVTGPVLPACSPSPYFSSLPPFPSLVDVLAVVSRTHMTHLRTSSAMRLVLGGPAEIAPWTFFSGLSASPTSYVSGEGEHMRSKSADLRCSMYTRENEHRYEALHSRP

SEQ ID NO: 975474 - protein, 181 aa, Homo sapiens
ELICQAVSAKHRCRRLLPFDGSEESGSRDSWRQMSGRLKIPLYQRKAILRTIFSSGDGQCALYPEPDWLSYLPGFGSSVNKGSQSQMPLQIAGSSGTGLSLSVSSLAPTRYIAHRTVWPCMKLWNPLDLNDQRFQTSLGNIGTRSVTINGTASQKEKTGSYNFALMSLGRPFIHVDTHLDL

SEQ ID NO: 975475 - protein, 41 aa, Homo sapiens
MTFTYFLSLYTLLIALPTSFLLLDLFASHANIPSVNLHIRY

SEQ ID NO: 975476 - protein, 167 aa, Homo sapiens
HVRRRHRRGKPCAISTWSHPTVFFDIVVDGEPLGRVSFELCGRQGPRDSQTDFRALSRLETQRIRVSGLPASPELFQGICVRVVTSDAIMVLVGKVSLYGEKSEDENFYPSKQYRVPGICDPMAELLDPPPKWFLTFDPVVQLTPYLRWFEIGKPCGWLVDTVKRKA

SEQ ID NO: 975477 - protein, 86 aa, Homo sapiens
GLLGLASVGDSRTQVVMWGRVSEALGYSYTFATSRPSMPQYRDLGGSAASAAEKALPRRAIMKAGVVRRNIGYSDGKLCVQSNQMI

SEQ ID NO: 975478 - protein, 85 aa, Homo sapiens
MRTEDEKNNRPTTASTNADAANCHEQQSVNIQHSQPTLCMSPGNPVYPQTLHLPQAPPYTRCSTLPTQELYLSELCAPMGLAQVP

SEQ ID NO: 975479 - protein, 110 aa, Homo sapiens
MARKRRLIPVIQGYPGKRYFLIDDSSRVSHISFFQLGPGSNNRVLAITMVRWRRLAGQCDRSFQTIPGTRRPLDFPRWGSSIDSHLETSFCVHTNARFLGIGSSPSFLPC

SEQ ID NO: 975480 - protein, 244 aa, Homo sapiens
NAGAGSVRRLGLRGEADWRNIGPRRSMKEKICSGVSIAQSPAHTPACSPEQSHHASGAEESAHECAEEGLECLRCMRPWGLVGAQVLLLRSRRLASILFYSEVEVTLGEVLLRISQIRPQEVLMVDASKTSPNTMNYASLGAQSYEDSSNQEERRGKAAFSDLHVQSSKAEFSSSDAWPELGSLYLLHHCIAPRKHGQNGRHWLSDCRGKLAGCPPRFLAQYQLLQWFGNGDMTGPIAMTFGSA

SEQ ID NO: 975481 - protein, 88 aa, Homo sapiens
ESAKTWSKTLERTAAVGVTYREDYSESTSFSKVAGYELLYIKNIFLKKHQVRVPTLRDGFLLCYPGWSAVSNCWHYHGRLRSQTPGLK

SEQ ID NO: 975482 - protein, 147 aa, Homo sapiens
MLRTFSGGVGHPVHPRLIFGLTFPMVKKSMPPKTSRGVRVVLILAIRRRWPVDAAASILSSWGWETVMTAVMMCGMTNCGKLMCQMLSFMYRLRLIGIAGSRLVCHGGSPWLARRDHYVLIPSGSGTRPLHEERVQVRFWITLHDWY

SEQ ID NO: 975483 - protein, 317 aa, Homo sapiens
ADTELQRLGSNAVAPSRKFFVGGNGKMNGRKYSVGELIGHSGDAGHRCRAHSEGGWGYTTMTALFIGLSAGEETKIPKDCNVWCKQLTATKDATRWGFDLGGDRALVHDRGFHCGARGGVVLGLLGRENAIVVLVADVTIEPVLGQKKWRQCVCAEGSSGVIACIGEKRDEREAGVTEKVVDETVAIVSIADKREGLEPGRSLGMSPVWAIGDWKDWRTPYRASKCRENAPKMGRKCNVSDAGVTDRILVARCDWGTGRVGSQRKGRLLGGVPRERESQATRPLPPPRTRMQQGSHKRGPRAQTGSEGAPKEAGREP

SEQ ID NO: 975484 - protein, 74 aa, Homo sapiens
GTRNNKARKTESSLGGSSNGPGRESMETGERAVSSSSLVLQLLLRIEATGAGCRRSSATVPLPTDVISGGSANF

SEQ ID NO: 975485 - protein, 82 aa, Homo sapiens
SARSYGRKMAAAAELSLLEKSLGLSKGNKYSAQGELTRFQILLDESNGPSLTRIDVTIAAQSSHSIAIQRNICWGVLQEEKA

SEQ ID NO: 975486 - protein, 379 aa, Homo sapiens
GEPHPVSFHAVEALYVSTLSTVVTLRVHTAFMSCNITLKVCNLTPEASNEHEPQGGTNNSRRAALRAVTLTEKVCSFTPEPAEATNPTDRKKLCNTSEHPHGNKLQTCHLKSCSTLTARVRGFIFDVSSDQEPTTLRDTIATLSCQEKLLPTLSAINQQPMGPQSPDTVAATGSCHTEFLLFSHMQIYMISARRPWPTEGTTSRATPTHSPQGTSDAHTAAVRQPGHETAHPLTPWSASRPHRGDGKCGTNKSVWPLPPARRGPIEKGQSGDTRTGLPPEGNQKAQKHQGRTTGQRANQEDIGRGHSRDHATDEVNRVANKHTGETNQNLRSLSLKSMDGSQINEEEADTEHAGRHAIIVSPVAVCSFRAPTARQPREH

SEQ ID NO: 975487 - protein, 74 aa, Homo sapiens
GGSRSFWCSLHCSVSSAPRGPASVASLPAGMGDPQAKTPGPTGSLEMLAPKSAAPSSPWRSSASVPFSHRMAAG

SEQ ID NO: 975488 - protein, 379 aa, Homo sapiens
MSSDFQLPAYELNWICSKITIASWDSCNLVIKLTTRFDCIKHHRNITAYASTPSTIQHKHNPKQSHMHYMTWQASGQHKACVTCQYVWAVSQNTVPHSLSHCGHHNKDINGKQTWRHTCGAHLNLSKANTSKPSHWHHLSHASQDPACRRSSPALGSQFSNALTTSGLIHPFAAILHWCAYLHNLQAYHIDWHSGLCLHTIPWCAQLGVHKHPHNRTGTTKHSSHTVPIKPGHLPEGTQTNAEQHDGTNRRRGSHNIRHTAAPTRHAPSTLTRYTKTVPLLGNWAWLNATKREHPQRHESETAPATAHAPRRAAQAVQAHAPQDSRQVRNSTTSTAGQPRRDTRDAQRQAQQRARDDKHGSDTRSSEERNNADTDAHQQ

SEQ ID NO: 975489 - protein, 116 aa, Homo sapiens
SSSGARPAFRSCGSVLFVASDSTHSSTLNHCGCIVAATCASTAFFIHCKLFHSCRDQLQNGQCNATNDLCAQHLPLVFFCELCKTGVMAHCASLLYHMPCLIQHTTRPSLFGSQQA

SEQ ID NO: 975490 - protein, 618 aa, Homo sapiens
MILVDFFQHSDTAHPTYPTPALQPSGVPVIHRTIIHAFVRKPCTSNTIYYDGFSIHIIVTKPQHNEDITRISDQENYFHEPGTDRKETMPRYKQRTMGSKISWSPLARGHITIHPLTHLTFLVRIYINLSDHCKKLNLTELFIADNGSWYAVHPTSLQFPHSWNTVGDPVTTARTSAGKNIDALTRYVQVHFTVEASKWPHTKATNMADLVTMMAPRKITSDHSPQVDNEHRNGKNAPNAAVQRHWHGTGAATNNTASPTKQNDGPTMASRRALATRWRPRHECRHGTNTHTGRCAHRTDGDTPINQLAQCIPSSQLGTPRCERLQPMNPTATTGTNNRRHKTDPMRRVPAEFAHEDTGPHNTSPPQQMTSSTREQTTTMTLQQRQQQMGATDTQPHVKHPKDDDNTAALVDTAAPERLLLRWAQETAEHTDNADITTHKRATINATPSKRPDRDHTDAPHMICANDRSHAHNTPVEQRALTTTCTAAAQHTTSDNTDAPRAHHAQTPTNNAPGADTMHSTSFSTHNPSVTTHCTQRTHPDSHNEQNKITDTDTQGSTRTTRPRTRHHDSNSSRRASPHSRTLKLTTNENNTTNVDDTHTARRHDPPHTQHPRSTTPD

SEQ ID NO: 975491 - protein, 306 aa, Homo sapiens
GLESDVEVAELTGLAEETASELQPKAKESLKIGEGGQGVIMGGFFSSIFSSLFGTREMRISNFGIRWSRKNHNFVQIHKCARSCYYYTTIGSHVETVTYKNLKFQVWDSGGHDKYQAILEMSLFKTQMHVIYVGETVVTETESAFPQSEYTGHVWRNEELTNSHLVASANITQDMEPALTSSADGHIHLGHLLAGPDTVGAISNTFADQRDRDLHEANGTWVAAPITTADATQPMLFPAHADQYRPLGNARTNNTVTPDRLGAPPATETNADAQHEQRAHRTGDTTPHRRQTHHHATPREQTRNAK

SEQ ID NO: 975492 - protein, 103 aa, Homo sapiens
MHIGMDESDPVPPSGDLNTEGCNLYLEDKGSNYSAQGSDFCDVLHECRSHGSASEREESAIGAEMNCEIFRVDCAVELVGFMLEHPVRESAIVHSRLCLAYHN

SEQ ID NO: 975493 - protein, 111 aa, Homo sapiens
MCAASLVVWLNMSMQQNILSSGRTMTDVIILISSDCLAEEMFGASCTNNNSCYDLVRIHLPWPDAHTSTVLKRNADNSVTSRSGQGVDGVDVQIDRQPGARDGGGLPLLLS

SEQ ID NO: 975494 - protein, 247 aa, Homo sapiens
MTSANNSQSQITTTSETKNARKKLQAPLCRAFRHKLGTQQHITTTPGYGTTYRRQQWVSLQREISPPYSAQWGISQRHTQDSKGKAKRVFLKKPEQEKHKKGGIKSYALMRHGQNLMWTVSLMSFATSTIATHAVVCLKDSRVRKTMPLHVDSQKALYLTKKTGNKILQNKDRIIDEAKLGVCYHNQGMDARSNINPGVGQRNSSVRPNLRTANNLAGRPQSAWPLNQLPCSTSYTTLVPTRGGHGL

SEQ ID NO: 975495 - protein, 86 aa, Homo sapiens
VAETREGRSGVRLCKLGRPGDVIPPPLPPRRVRVLMDPRGCSILIEVDTREAALPAAGAPDDVNLLGDVHGRSLGQSCDSRAEACW

SEQ ID NO: 975496 - protein, 111 aa, Homo sapiens
MRTIQKEQDSKTVSTPFTVSVLKHLITGYVLSRCAFQFFLQRSVEYQGNHYPELRVTHKHHTSFSLATREMPFPLNTTFRVALHMTAATGLHNSRMNTLSQQRALVARNLL

SEQ ID NO: 975497 - protein, 37 aa, Homo sapiens
KREKERSKENRGRKEEERKRDEDEKKRKRHNEREEKI

SEQ ID NO: 975498 - protein, 106 aa, Homo sapiens
MRIEKCYFCSGAHHIAGTPVRCSGQATRWHMVSRFLQVRNWSIKNLSRRESAIALLKYSVGPELFLVKQRVLRELYSGDKCILEFEENVEIEPIKYHARSILVIKS

SEQ ID NO: 975499 - protein, 147 aa, Homo sapiens
NKSETPSQKKKKKKKKKNVVGGRGQSKKAFKNQFGWGSRGAPEEETGGHVGPTNCVTPREKESRGPSRQQEASAMGIYLNNTQNIEKNEPRGGNHHQEPASRENNLTENSEDFQRRDSNNGGHSIYNRRSTNKSGVRKYKINAPTAE

SEQ ID NO: 975500 - protein, 219 aa, Homo sapiens
MEHLKVDQMQYKHGGHPPKDENCREQKASGGSTQNIHKQTQGSNIMSWQVVSGAATNSQYALGDLSLGGYHHKEHNLTGNGTDIERNYKTIPMRIYLELLQGQYRDWNHSMTVLERLEERTQYGAGPSDGNLHGNYNRGHELTVQNRLLAKHRTSTRGTDKGRRPPRTREKRQGMNTNTLYTTQRTRKHPPQTRKPQSDRVPQPTERWRPATAHRMTEQ

SEQ ID NO: 975501 - protein, 200 aa, Homo sapiens
FSPNAANMVFRRFVEVGRVAYVSFVTSIAGKIGSADLVECLLDPGHEGALVAWHLCNSKTEDRPCPFSKCMASSLGISCLKFSPGQQRWRPNPRKSLIGSPDHKAPWARQKGPGPSSKVSEKKVGGPTAPKLTREIGGVPPKKGKTQANIFGRKINPKGRQKKAEEEAPKRRIGKPKGNLFLLWGKIFPGGFFSFFTQTN

SEQ ID NO: 975502 - protein, 269 aa, Homo sapiens
MQYPAPRAGGGRRGGAVYAPTPCCTGHPTPFYIEDILGRGPAAPTARPTLPSPYSSFTSLVSPLPEPRVYEPSRSIQSSRTTPAPAWPWLTDPACFDGGPSVYPFPAGTVNDLNSNGPLATGQQSAEWGNLLTLSSRPLLAGWPSCPLKRGATRQAHCDEFLPTEPILNYGSKKRTGPFRTDASHTLVFVSVGEEEKRRSGQRMLDSIRKEHTGDTHLGIPRKSDVGYNWEDDYHNCEDSLTTQCPTLTGRGNRFGTVSWSISGTELGH

SEQ ID NO: 975503 - protein, 166 aa, Homo sapiens
KVTRPGRRLRPTLSAVAVARYTIGVGKIAAGTAVERLRDPRGARRRASLLTGTSPPQTPRRLKRRRRQAKKQVKKANRENPDVKGPFPRVERSMPGHGLGVQTGSLKKTPKGWVVEHKLNGRESLKATSYEFKAEEQSLGGKLRWTFRDHILYQAFLLKHHWCDGS

SEQ ID NO: 975504 - protein, 105 aa, Homo sapiens
MAQWLNTGDNEQMAALEAKICHHIAYTLGDFTILPRDKFLKEQIKLDEGWVPLADTDTHSNPVDTVYQSDFNVIVEALEQIQGRTHWKSVNDNNKNQKVSKTNPT

SEQ ID NO: 975505 - protein, 154 aa, Homo sapiens
MLTRTQHVDKVKDDRPDQSPRLRIYIIFHSIFTTGSQTAHLLKGQCQARADPVLDSNLSSLDKAPEQILNPSRDTKRQAATHKVQHQKPQAHRKGPTSGANIQTHQVTLHQESRPGGHHTIHKRNTYPRGNGDTEMRTGENGTEDEDTSNKHAD

SEQ ID NO: 975506 - protein, 177 aa, Homo sapiens
LVFAESPMAAGTLVHVVLKTGGSFEGVSSRACSSSGAQVRVLSERTPRSSLAKTNRTPEFLREFPAGEGPRRFEGDDGFCVFESNANCRYYVSNEELQGKYSQRQKPEVVQWVSSVDSDIVPPASTWVCPNLGSHAADKETGHVRMQQDGSEAKFWGCVDAYLTDEDFIWMGERVTL

SEQ ID NO: 975507 - protein, 102 aa, Homo sapiens
MDVPGSYVIHGPEECWMLTTENNARGGTRRRSGNKDPRWRLPEESSVGGSINEGVRIERRYHLRHRRRWQYNRSPRPSNILQIEANESEEVRKPEIFAQWWR

SEQ ID NO: 975508 - protein, 261 aa, Homo sapiens
GAYLGPREHGHMIMSTDMISPGARQYGTIKVSTGTGRSVNVRLLDVDERKAAAAGSRDLRGHGRIGQDSHGVKGSTLRGRDIKACSSKLLNEGELYGRDNNSGRHNIRERGRPPRGEEQEHSLQKKRQPRGGGRRGGAQEKGKNGHPWGGKYNRWDTPNRKRTPRAGNSEDTNEPATGNLRHTTNYQKNHAPRGGERPTGRPGVAVANTQNTSQRLGASNERGRCKQGGEPYYQNNGGSPHSEAERARLYQNNFTGPAVAG

SEQ ID NO: 975509 - protein, 135 aa, Homo sapiens
MWACGAGPTRGDLLHKRVSTGEEPKIQTFPPRLGEQTIDQPTPNPTAQHAPGPNAEQSEEGTTKTQENKRPHRTHRGEHQQRSDGRRQQRRNQQGGNTNNNQTNKLTETTSDPHTDKEGGHNKPTPKATNQQTTD

SEQ ID NO: 975510 - protein, 153 aa, Homo sapiens
MRVGAARGPREEVSVEHVGPKSGFPKRRNSGSEDQRRRGILLTNKKERRGGNKAESGWLETNIPREGEFREGPNYEGGLLPKGGGPPKRGERPAELYLHIFNAPPGLPGVDKETIIHGERSQHKLNENAQTAEQKTQQTHYINKTNSTTNQTK

SEQ ID NO: 975511 - protein, 520 aa, Homo sapiens
PLPVSLRGPRARDCKPALPARHYSTAPSFASSPGSQSAPPLPPQAIATLRSMSTRSVSSSSYRRMFGGPEHREPDETPAGATVTYVHPQPTAWASALRTRTSRRLYASSPGGVYATRSSAVRHEEQQRPGGARSCRTRRTTSQADAINNRVQATPGPTKGPLQERNDGSPINPPGAQLEAAEKDLRAEAQTRQRPRQRAGGPATSRNGKRHAGPAHAIRTGTQPDRIRARKPENRNRHTNPITPAPQDDNAQDQNIRCCLFAPRRALASPRHEKTTTKRATDTRKKETREQQDNTSDADNNTKERTKDKRTRASQRTTKEEPDKTSEERRRERPHPARHEGEPRTRRGPNEPETPRPTARGGRRRRRSKQNTHTGETTKATQATTRSKTRDDRGQGEEAETGSRTEHRAQRSEDRKNEEERRTEAKGSTRKAAPRGDGQGEEETQKKDRGAKQEEKKRKSAKRAATQESGTATEHTRTQSKSGKETTAQKPQQEREKHTAKQRRKRENKRAWKRQNRRSR

SEQ ID NO: 975512 - protein, 69 aa, Homo sapiens
SPCGFLIARFRTEGIGYSPLAWRSLVLGGVRITAGRPLGFSGGERGGSEYYVDVEQAASNSSEVPVVAD

SEQ ID NO: 975513 - protein, 63 aa, Homo sapiens
MKECGGPKRGHQSATLKAVQESKTWEALERKHGTLRARPVSEATVLIVDKIGKIYSCMGKNSD

SEQ ID NO: 975514 - protein, 172 aa, Homo sapiens
MGCEVLVMSPCVSHPWRREGGRPGGGVWLHPSTGRGHARHQRRGQPHPCQAAGNPVVLHFTGDTVFFIIGSHIFLKEWRSECDLYLVSDVRCVKATNNVPTTPLSGAHSIETGPGYLLQRRTCGRGDSWGPPSSMGVPITQKKQHTNKTQHAAAPPGPEKSQTQAGGHRPSK

SEQ ID NO: 975515 - protein, 168 aa, Homo sapiens
MSRYKTRLYAPSTEIGKNRLGLEVGPAGSNTVCKALRCYVYAYLKAQHLILYILYDEDFVHVFVCDLSPQCLVTLENPPLRETATMMIILGKQKLEDLIWDGGPGTLSYQRRGLLPSQSPKTQVWGPQKKPTGGAHSAPGRGTRRTRQRAQPTRRTTEQWRPASTHCR

SEQ ID NO: 975516 - protein, 119 aa, Homo sapiens
MAVTKGIYTNYSPAFIYYAYIIKPINTTNPTIAKFGAYWAMTRSCASLRKQAVGPRPELVLQSCQHDMGLRHDVAISLKRYVHYANNYIVPSEVILTTTVTLTFQENHITLNRHKQPEL

SEQ ID NO: 975517 - protein, 242 aa, Homo sapiens
MVRAPCGPKKRGLSQNPHCGGGPGGPQEDESNKRVRTTAVVPREKNRAHTNNRGRGCSLPTKKKSAAREATRAGGACVENNNPPEERNLLSKALPIRWGLSSIKEGDPSPSEQRRDIYYKISNPPARARGCTIISSTSSDRRSYIIPTTSRLHITLNLIPSSASHHNHALTKNPNLPQLTDNHATNTSTTPAHDPDHHPHRRPHQLTHIHRTPSNTHNNPPSTHNSNTRSQPRSIPNDTPQP

SEQ ID NO: 975518 - protein, 196 aa, Homo sapiens
SGGLVIGDWQGPLSRHLLFSHPHGERPSAHVFSDGVHGSASGWHCPAARPTASQAGIGNRAAGAQADGQKPDTAGHPPSPTLHRPPRTPFSHPQATDSHPCNPALAPAGPPGHQTDPGSGADNQVPSTTTIILPPQLHHFPSAQMPTPNYGRKTGPIVTFLPQHNNSIIDDSLDDPVITAPHHLVKRQHHYNTTHT

SEQ ID NO: 975519 - protein, 103 aa, Homo sapiens
MVEDSSVGKMIGQAAAARPGMKEDLKVMASVEVQCLSTSGELRMGQASPVRFESGTCSDRTRLHLLPITLALIGTCPSSSPLSCSISIYPFIILLLSLRVLGC

SEQ ID NO: 975520 - protein, 111 aa, Homo sapiens
MHIACICISLRFLVLPMCPIDPLQLTKEHNLNYLNNLQNSIRDNMKPGMNIALAPPIMPSRVNRSARHPLRILDITERGPSIAIPLIPSSRIGLQVVTDTLAIASEVRVGS

SEQ ID NO: 975521 - protein, 155 aa, Homo sapiens
SSGINADCPLRPGGDKKKKKKKKKMGGAPRAPRKKLLYKHTLRVCGRARGPTRGYKGEHVGHKGAGSTRKTARGQRNKGAGEFPHHNIKTRARAGAQPRGRLLETNIPKGEFSEGELSYIERGISIYQERGRLSKSAESLAEYISNIIAPRGPGV

SEQ ID NO: 975522 - protein, 77 aa, Homo sapiens
MRGGDFPNQNKEKRRGGEQTRGVLVKQKSQEREVSRGRRQYRRGELISQRRVSKTERRARDISQIFTRPGPGGRKNQ

SEQ ID NO: 975523 - protein, 123 aa, Homo sapiens
MGHKARVPIRRRLRGQETKGVGDFFPNIKKRAGGGTRGRSWENNLRERGNTRERAHRRGDSYLHEEESTRGGSRKKSKNIRPRERGENNRKKQQTTQTNTEQQKTEKAEDNKNKQATPNNQTR

SEQ ID NO: 975524 - protein, 58 aa, Homo sapiens
HWSDMSNKDRSIDSAICTKKTIRTQTLSKHEKRQQMHQKVTSLQRELVENRPTIFYGP

SEQ ID NO: 975525 - protein, 104 aa, Homo sapiens
MWKRGNLVAKEIQTKKGTKQVLVRKVDLSDTNVYIELLHKGFLAEEKKAPPRFVINNCRSDDVVRTSKTADGLTMHIGSKQLGHYLITIWLIRETLKGIKPDQG

SEQ ID NO: 975526 - protein, 186 aa, Homo sapiens
MLTICEEPQKTLPFPIIDDRNRELAILVGHAAFQAGGRMKRACLVTASCGGVFGPDKKLKLSILYQFTTGKELDEILRVVISLQLTAEKRVCHPQLMWKMRDSVMVFKHPGRRSQKIFPKGVSQRVPFGKNTPVKTNLKSWEVCCAPVVCAMVSAGILNLWVSRQFAAPRLKTARLEFLAETHNPS

SEQ ID NO: 975527 - protein, 140 aa, Homo sapiens
PCRRGGGGGRTRNSGGAVRVVSRAPAWLVAPPRGPSSAERIGVDSRSSKPRLGKEGPRSAQSGRPRGALQDGGRGTSRQGASLTAYVTQPFLGSGSDTGVPRDGGQVSNNGQSPDSKQKTTRERHESTGRPKSLVGDLLS

SEQ ID NO: 975528 - protein, 120 aa, Homo sapiens
VPNSQLRHIRLENNENKPVTNSRRMCRSWYWNRRKPVTNSRDTQEVPLEKAKQVLKIIASYKHTTSIFDDFSHYEKAKRKTDKCYTRNVKVVGNNKAVLHRLQQRLHLHILRGKNDLQEN

SEQ ID NO: 975529 - protein, 236 aa, Homo sapiens
MDDDIAALVVWNGSGIVARPASRATMPPAGFPLHRGGAPGHPGCDGGHGSERIPIVGRRRSQSHERASFTLKFTPSSHGFVSPKPATDLCEKTYSGPPQPFLTIELRVGSPEDATPVACLTRRAPPLKATKGQTRWRTIDPDSMVGRHLSKHLHKPIVTVWFIPGVCGIFPLYGLLGVVPTGPSVELSSRVDRGITHTFVPNLPRDYALPPFACLALGPGWAGTCLLTVHEDPTER

SEQ ID NO: 975530 - protein, 185 aa, Homo sapiens
MDNIYLTVKVGISREHLGENARIRPGELSTLNTKRRRRSPGYCNGLSQLPSKYGRQDIRSVLQNDKGEDPVDVRWNTIIDGRQPLAKMTIRIVNVYKGPTEHACRNAQPSVRPRDPGQLGRGSRLYDTQSSRPHQTSTSLLISITAAVYEGVHHNRPHTHVAETGAVRVTTLEKIPEGPLRAEST

SEQ ID NO: 975531 - protein, 133 aa, Homo sapiens
MVQRILTKRLADVPLLTSLAARLALPYFTHLHTTRANGGTISSTIRAAHLRLPRLTHHTPRISAGTRRTGTPAPKRRRAPNTAKRHTAAPHRPPHQHPTHTSDPTTQRTGPLHTHHPHHHTRQHNRTTPQQHN

SEQ ID NO: 975532 - protein, 127 aa, Homo sapiens
GQTVPEAQDCKEAPSSYDHQPSLSYLDSFDGEMLDAVDPQHKGDTPLQKVPWVAECQNILRNSRGGPTWKIDRRPATVVGQGAKKSRTHQEHQPWAKEDRLFLQFLVTLLAVRASSVSRYLCVSFPM

SEQ ID NO: 975533 - protein, 110 aa, Homo sapiens
RATAGYGAPALAPNITMGVVCKLPRAEQSSSPHQRFQRTQRPWVVVLMAVLLLLALLDRKPHPLPEAARSNRGAGLLRVPRKRQEVSSPNEATEKNILVSDHGTLIEQQE

SEQ ID NO: 975534 - protein, 222 aa, Homo sapiens
KPGARHGWRGCGEAWSPVPDHAECEHAEGSPQRLREMALRRTDTGIRPVKVALQRQSRGIDGPFAADRGPQEDLERRRPGEITNQGKVAGQLPWWVALDHPKKTRIKNYAGDFKPTSGTLGIYTWNRTVCAETFGFNFPKINICGMGRTPPIKICGLYRIQGPMASREHLDHLGLNTWVTEQAGHTQLDLVWRRHTSAQLDYNYNAFRTHTHLLVHRQQRRY

SEQ ID NO: 975535 - protein, 74 aa, Homo sapiens
RDKGHRPQSDTADEHRTTADKKTKHKQEYNKRTGRQKTTKGDKENIQELVANATKQLIKNEADKNDKTNTRDTA

SEQ ID NO: 975536 - protein, 303 aa, Homo sapiens
DRRNSCGGEAPVALPCCAGGMGFLAENADLSRNAWGSGLALSTRSQYRDPGRAAGTPGKCYRRCTGGTPSEQGGGGPGPKQIIGWQSAREGKGPNAQEERGRERRPGHRMGAERYGRPTQGEGPPGEKRELCHPVWTDGNLLALWADRNFQEAKAVSSCGGPRERSRGTEEYQCHRTLLRRTRDCMPVGGEHRFSTKPLNVTWLKVRKGDRAGNDERQVADLKAPMTAMSLREQYKRHHKNVGRPRTKSSQNSGARPNSRRASARNRVNRRATKNAERATPAVAPHKRGKPGERHAAATDSPR

SEQ ID NO: 975537 - protein, 193 aa, Homo sapiens
PVAAKGRRQDAQLRAKLSRGREPSPIWWWAPSVPRVQDASGGLGSPARCGEVRAGDMREEERQGLGGEMRTRMGGAGPVVAAHHLWRCTQGLNKSRYKNCQGAKSSPTVKDHGGATVALPEWAKGVGDRAGIDRRPGEYCEVVTKAREWFVPNREQLNGPRDTGGARPVTVGSDFGTARISGLNQRTGRTKKG

SEQ ID NO: 975538 - protein, 283 aa, Homo sapiens
IPTPLRFPHVPLCAPGLGIPLFPSASGPALFGGTVWSFHPARQRGEGARGPVKRLMPPSTDASVGVEVLPAALSLCEGGGPSPVPTDVGRQERGSERVGAPGVSELPSALCPNTQVAGRMTSSRKRPQFVPKVVPDVALRVLKVAVQSHPLRARGLPVGIFQKRKKLHVRGPRCSLHRELNSVYSRDNAALGVQATSLDKDCCGRTRGGGGMRIKKHRKWKNSRFEITQGSPLVWHSTSDSLWGPMVTKGPGLTLEDTAGECRVDNNPTGFFKSGATEKARSQ

SEQ ID NO: 975539 - protein, 272 aa, Homo sapiens
GPDPAFGARSQDGSRTRDRLGPWCLALGPSASCTPAGGGVHARSPCTVSEGGHPGQVLWAKEGFRGKKIVGLFPVVAFRFFVGPRFKEGTPGRRKTGGVAPELIPRDSGWVEQMEAPSFGPGVGAFLPPRGLLVGHPSGNFPKGALLGCGSQRETKTQGPLVGCLDTALVVAPRWVKGPQVVTHRGVGCAKGICPGALDRLVQEGPKRTQGGPFGSYPLSRHLTGARPMWGTGHFVRPNSLGGAKEKGAKVGPPEGQYGGPKKGPPEGYIKG

SEQ ID NO: 975540 - protein, 317 aa, Homo sapiens
MAGQDAGAAVGDDTQEDEGDSSVSRAGVEVSGKLKDLKCPFLEGLYIHRGQKTIQELGWLQPPQSTVVRILEVMLYPGVLALTAGHQVSAHLRGGPPTKEGEDPKKMRKVWATAECLGFAPSIDPGSLLQGVVPAPKKGRYTLFMAQWPRYQFGRPDPLCVGSELARPCWSNFRRQPPGADGNEPLPGGALHIDPQLEDAPESKVGTLVPCGFASPSSNKQSGDWQWASASPGPTRGTADLPGSCRTMLPIGPYKGDCTRSRAAWPRLSPNKTLVSAPHLGLHTGEVPHAPRAIAPMFNTRVRHCGRTECGPTRISR

SEQ ID NO: 975541 - protein, 77 aa, Homo sapiens
GGTGAQTKPRPCQGDARGPLAKGFGPEGPVGPRLQKLSLPTPVGATCWPCGQGRHEQEAGRGGPFVVWWSTSLTGSR

SEQ ID NO: 975542 - protein, 154 aa, Homo sapiens
VRAQRCSKLSYNTLHSVARKLQQYTPRRTIVTRRIHTTILNPQRINNTPCSAHPPITTCAITQQNSHLLLDNPHQANAQTTSHSRLTRNNNHLMRQNCHLTANSRTPPPHTTSSQTVNKKHYYIHHGDINNQTPQSDPSMTHTNTNNAHFVEPH

SEQ ID NO: 975543 - protein, 82 aa, Homo sapiens
FRKGKPLALVKELRNRKDVKVFNVTKENRNHLLPDIVTCVQTSEQEVKTTCIPAFRDGTCPVSRGALIGAPCLFEAVMPNGG

SEQ ID NO: 975544 - protein, 176 aa, Homo sapiens
MQRKTTNILVALAIGRSQINISLPNRGRRQETSMKNWSLNISKVWTDKSSGTDIGDIVDLASVRLDGPGLGRRCCGLENDCMTDQMMIQPDPEKSSNILKAIQSQSNDALCCKNSQPAETPDDKRRHPKNDKQDAKSNDTKTDDNSRGSYVPKGQAIVNYHEALMDTKCQRNDLAI

SEQ ID NO: 975545 - protein, 111 aa, Homo sapiens
MRQLYAYFVSRHSHTPFPLYGQTNCAYIAYVVLCLHDTEEDGVLSPLLSLRSQTRIVGPYERKDNTNTAVSANSDEAKRESSPLPKQIEYYTEHQLEHRTVPQPNTPHVHL

SEQ ID NO: 975546 - protein, 379 aa, Homo sapiens
MKNTQRHKETRNKHTKERQQRGPVGNRTTEDNDETHQQPPRPQRQTAAMEQQPHEHNNTRTREATHGHDTSAHKNRKKAHKQEKTKQKRKKTTTPGGNPKGERPRQKHKKNSPTAGEHRNKAQKREQNRENKKTQKQTTKQQNRRQSRRRRTEKKRRDNKAEATTTKGTQQTQAQEEKARKEAERTNKRPKRRENRRTKTQEGKTDTPGRQRKRSSGRRRRDTERSSGRGRQHEERGGTRERGEEEATARQEREEERGHKRRRKEAAPEGRRRSGGGQPEQEEREDKRRKRKKETEDHASRTQTTRRADKQNKQREKRRGDARSETRQQAGKRENGESRHTRAAKNEKREKTGERKKERRQSDRQRPRDEEHHDGSRAR

SEQ ID NO: 975547 - protein, 289 aa, Homo sapiens
VAEMEWSREKGPWQRGLEEFSAPPGLRVGCLPYLCGHILRASRRKCSCVRWSGGSGLRERDEEEEAARVGGGAKGEKSQKVPGTRSALRKIEQVNEGSCTGSIRGQRIPRRLQPGTEGPHESAGLHNGMTTGQPSSTMVAWKDEGSQAPGLAPTQEMGKWAPRERELARPRRTLTHKKRGAQGPGGGGPVAEEARSATGWDAREEMAGLQEVARSRSRVADTGLKKEPDPGAPGQTMGLPTGKRPDEMQKWPFIKKKKKVGRRPEIQHVGAPGESNARAERVQTGGQRG

SEQ ID NO: 975548 - protein, 105 aa, Homo sapiens
MFEGAPGSRASILKKVWRHSRDLINEACWDISSSGVNLQSMALAPQRIIMVADHPWGSEGFDTYRATANLDIGLNLTQYVQNTNMRLANEDIITLRAEDTRIPWR

SEQ ID NO: 975549 - protein, 241 aa, Homo sapiens
MVTPTPYPRSRSRTIQLWQQCALPRAHPNAQNATDLGGLLRQVLNTEASYSQSTMVFQVISVVANGQKILNKMAQFIYVEANGLSSCVICSPKQTQDFQACLGQFGTVFCEQDSMKIVLIVLRILGAKNVSWKTGPMTDRSGCTKNSLVPSIIFFGLDFVTLFWGRELSFFYTTLTCGTNYRPFVEKSLTAFLSSCGVLLTTGDFQHVFIPVSRTDIVPGEPCVNLGVAPDSVHDWVLKRT

SEQ ID NO: 975550 - protein, 376 aa, Homo sapiens
HKIISYHERNSNEYKECGKAYNQSSHLTSTEDNSSLERNPTNVKNVAKALEPDTTHHYQTIRYIQYWQRSPYTTDEECGKAYRQSSQHILKNKHKVSYLESNTIQDVQHVENRLETKMLNNLRRPQEHAIPGRHTRPKPRRLQQKKVSNRMNKRRNTINKHKRGTHSPKHMQLPGQQNHPEPKHLMTTPWSGTKPREKHRRLKHHNQNTNTRKEQYVGKDKPDTKETAANGSQTARKTARTARNTQQPIKTDPTNTGNEQQNRTTKGRQHKGGPRPKHERKASPSTTDNQPTTHNREENTPTHHGQPHAPHTPDNNTTPTQDTEHRITHTRKQQHHNQGDETAGTRQIPLQLTPTVRTVQRSTRWKENTRQQKDRR

SEQ ID NO: 975551 - protein, 221 aa, Homo sapiens
YRSGPQRTVVHRLVEMYSSGCFLTEENEWETEAPVVGETPEESSCEKWSSDECADQVNNPAGYIAVKERYAKYLAHSAGRNAGKASRKLRSPMVERLTNSVMMHGAATKGKEAHRYVAPSVGACLSRSYTCSQARTLLKGPGERPSSNSGSPGGLPHACGRAGTVRRQGCGCVPLGVVNKASGLLCTGARGGCLPEHSDHVLKWLADELINAWQGPRILMA

SEQ ID NO: 975552 - protein, 33 aa, Homo sapiens
ADTRQDARKREETVTYWPSVSNDERSEARSEEA

SEQ ID NO: 975553 - protein, 250 aa, Homo sapiens
MAYLSPPGVWGLKAEAKARGGQKSMVSMEHGLYILDRMLDIVGSSSDTEMMCAWFLAVFVDVMMTRSSGVILIMGTVDCLLAVGTRQGRCWMKGTRLSQVAGSCCELSLGGRACCRSYPLRGDGLLCPDLVRRVSGRETSKIVMVTPTERVQWVQNQGGSPGLLKRGGSAVILVSVLPHLGGPQDGFARRQPEGEAKIGKPVKNPGNKDRDPGKVNMWAWNGVPVIRQWTVGDSSLEATLTLVRYTKFIA

SEQ ID NO: 975554 - protein, 122 aa, Homo sapiens
MKLQQSRSNISDVNSKGVKFAESRTLHYGNQLSYPRYCIAAYSPTSRVEFLPTSTSLHGSTHSMGNQTAHGGQRPSRRATERAQGSPHGKRGAGLTAHTQNNTIWRRTNRAHKSPHRGNGRT

SEQ ID NO: 975555 - protein, 335 aa, Homo sapiens
QRTGRTDGRLHLATLPGCRLPFVFLGGDERRAGAEAAAHRSARRCLSHSSRPSARFVPGQRPRAPARQPAAGPPKLWPSGESRGGNRRPLTRNHRAIGPIVGPKSHGRPENHLPRTGSEPNFPVISPSRPVAPGSGYRFAPPGPSRAQVGATHRPQATRGRAPRRGPARAPCRRRTTRTLSADPSEACPAACPPRGAPLKRTCPQSGPPLTGARNFPAKTLSRRTSSSPPRRRTASPASADAQSFPDTFRQTTRTTRTHRPSRRTYIIAPDQCPSRRNVTTAANACALQHLTPGGGVLIINAQPAAEQPSQPSHDGASLAQTTGTAPLRAHAIPE

SEQ ID NO: 975556 - protein, 278 aa, Homo sapiens
MPLHALPGHIRHSIPCNRSNKLAVHSKVHHSRKPIPYILERTGHDSGRLLSETLATLLNFNPSGSTRWHTYATFQPSAKMHAPFARQTINTHSNCPKQLTLPVAQTYQQPTAAQGIPLDRKAPKALHCHNDMTHRQRSTRHNSAHTATPRLLGGITGCQQDQRPPRQTYIRPIHELAISGRHKHTSNHPASDRPGGTLALHDHSGYSQQACAHNREDTCTPEGANRMPIRTGRKWPGGGSSPTKTQELQTTQQPGTGAKDTLPRNRDARPGTTARDAK

SEQ ID NO: 975557 - protein, 109 aa, Homo sapiens
MRFTCRLLNMSISGLYEVRVYEKWVRITLLSNIVREYMLCRFWRITWWDSDDSYGIIDNMRHIVTIVIHLKLCSGMYFQFLPQGGEVIFIVICTFFYFKNRIHTTLQHP

SEQ ID NO: 975558 - protein, 383 aa, Homo sapiens
NCRGGGLHYSQVLKFGDIARGGTQVREDVKSHRTAQHIVLENCVQAKRNPFTTVSHIHDATKRHAWDNAPHRCYTLYSPSPVETIVGNLKSCSRPPLRAYWLIQCRIGHKTPPSDSHTAGSHSSNKRARKLWRQTHKPPATNFTMRVYQDAAAQQGTALRLDIHSSPPFNRTPKKPPRNDDTRCTPQSHNTLGQPNEGQLQLPSTWEHAHTASTLVASHLPVGPSDDSRKRHGTRQTAREQKRDIPTYTRTPVRIPPGNFPRHATPIPTFGTRHLADPTNARGKRNPNHTHGTAQGGHGNTAKELTHKARRHNPGLSHTQRLGPPHTNATQRANPGAATPREADNDKASSAAHQRHQEDIIQGPVTRTATDHEVPTPPEHTDT

SEQ ID NO: 975559 - protein, 359 aa, Homo sapiens
DQGLDELEFELNLTFVFLEPWVSYMSGLSLVLGFAHPSTKRKLYSLHNKTNNTNKHTQKKNNNTNNQQTNKNKHHTKTTHNTKNNTKHIQNHNTPLLAQPLLPTRHTTSFTTQSSPHPQTDDHYKIKHHIYKSQSTIKANTNQQTKYIPRLIKLTSSPAKKKTQSLLSTHPCIITNKTLPYTPHTIQNKLYKEITTINPLTTYLTDKTLFFSIIALHITPTSTHPPLLQTITLRALSLMKTPYLFTTTPPPTLKVSIHHHPPPPLTRYHKHPTTHKNHIRTNPRYTQKPTLRSPLTKLDQQITYHNVTTITIDTSSHLYTVPYTITRIKHTRFTNPRKQLPQQLLSHLLTPIPYNTHAQ

SEQ ID NO: 975560 - protein, 108 aa, Homo sapiens
MVREDGVPDANAGVHEWVMCTINYEITVFHVPLHHGRVYCTTLKSYNDQDATRIRGSLGKTHLRSWNETIRCDKGNSSRCQHNQAYKGLKIHERTGKIILTHVVCLYF

SEQ ID NO: 975561 - protein, 339 aa, Homo sapiens
AYEPQGASGYDYSYAGGRGSYGDSWWTYHLLHKLTIPKALRLDSTYRQRWLSGLKQTPLTELAEPSDHKLDEPFYHTDSDTIGIHLPTSTAHTPAHPRITRNATSYPCLQQTSRCTPTYLPPLLRHGLLTLPQHYSPSPPPLLRLLATPRYSPGSTRSPPPPHPQPRPHTLTPRRSPGPSLSPPPLPTPRPLPAPSPQGPPPYSPFLASPSTPPLPSPLLDALVPSAPSSSALFPPHHLPPWPSTLPPFYTPPLALCPPAPPSPPRSPSPPPTPLLPPPPPPHTPPPPPRRRSALSPPSPAPPSRPASPTPFLPPLLTPPAPPPSPSRGPPAPPPAPPP

SEQ ID NO: 975562 - protein, 105 aa, Homo sapiens
MVHKSYAPSHTYSSNPEDSYNGGSPSLMKRQKILTKLGPTVGKQHNVWGGASRMEDHDNFGEDRNGRHAQAAKSPAELGGHPKTRGRFQTKGACDTGRNPRKQKD

SEQ ID NO: 975563 - protein, 197 aa, Homo sapiens
ELQRLRRDPEAAPASAARPGPAPPVSVPPAAPPAPPRKPKASPRVAQRGPWVAGKHACLVWPLGDPFGGRRAVVLQPSLMRGVRGRLPVCRLVWRWAPPGVGGPLFSTRAFSRDLARSAGTQRGRTTRLEPPQVGLSTKGHAHVSCDHISVQCPAWHNNSNTPPSSNSPRIARVYVGFTNPCNPRAVPFRALQTPTH

SEQ ID NO: 975564 - protein, 205 aa, Homo sapiens
EVSSATEQTGVKNMSFFSIYNTDKPLLNQLSVNNTNFLYLVLSKIKFCGIKTISVEGLHDCHDGKILKQELIKTVCRCLILRNQKYQQDDETTHRTTIHEAHDAGPDRTLFIQVSLSARSSTRSSQAQQDDATAHQRFPVPHGQPEDTGTSVTQDYPEVSCHENPQEHHDLVRMPPPFHEQPYLDVTPGLAGEVLVDDALLARMT

SEQ ID NO: 975565 - protein, 187 aa, Homo sapiens
TNVFVYARGTSNAENLAVMPQAKFVSENNNLPIDNTHRYLKHTWLAVCRVMLDNTGTTEADLQLKRQCHSACTVLVGVIILYDHVTYQWEHMLNKLPTIAYARLVSHVLKDQPPNSVEGLLQCSQVHNHTHLHCMTTTYQDNIKVHAAHNQSWHYSTCLSDRQTSYSLPVTGEWQLFNADLPLTYSH

SEQ ID NO: 975566 - protein, 100 aa, Homo sapiens
LYRVTKISGLHADRVRDAVQYTRPLISYNTRYNKRDCTREHALFFIVHTDDQTRLYPKQMDTTGNTEEEDTEPPPSTPRTDTHNFDTNQDRHNQTNRNET

SEQ ID NO: 975567 - protein, 347 aa, Homo sapiens
MAPALSPYRFMFRFPPYFTDVVLCPRHPAIRLEIEVASTSLRIDNQLKAVLRISQRPEMGYSTSEDFRNTWFAPRNAQEDIAFLPPVEGWTVRNPSYVICTICLVESYSILCPSKKIYIGFELRVIGTDGGPRDYAAVYYAQPYESSLVHRVWPRYDNVLGRLVPCELKVYSHSMWEDLAKKGLEIIPSSGKTCFAYRALKNCTVIDCPANRNWTSSEGAVSCNYLEEKFDEYLKPAESSLRHEPDNLQGDFVLGPSELSDINGVRLHKPDTGVEESVRLHPGWNDGGSTRNAMKLIQAQVITAAAPRTSKGGGRGPPDARHNPRVDFNGRCPFRTLGDGNIAALYI

SEQ ID NO: 975568 - protein, 117 aa, Homo sapiens
MPGGVRSANPARCPGLERPACGAPRAEETGGPRVSNRSSRKCNRVLRAGHWGHSRGWRHKQVVLTPCVGGAHLHRDGNEGSQDPLGDRPHGLFELTLKPRGASDILSQSDQPRLKAR

SEQ ID NO: 975569 - protein, 309 aa, Homo sapiens
VLARRYLCRVTSCFLSLSRAVWVAAVRSQPRKCTNRRRRFRGPVRAAEMLRWAIASSVPGTRPSIPDEGWPRVEQGVTMAGFDVAKSLHTPNAYFVGSAQLTATRSGGWKPQNCIVPNFPVPGISASRRAPVNVANSVLSNESNAFLRHWAPERHSSTKGICWDTLKLRAPITRFQTIYSLDTKPQRRHKAQEDRDRGQDYHMNREPRWHDRRHTHPWRHQVCADGETYVVTKPHKYGSRMKRRPPVTPQKGTSRQSEHKAMIPIQRAKAITLDKRQPTSRQRNILTRRRRAETTPTNEKLNTNTRHLV

SEQ ID NO: 975570 - protein, 215 aa, Homo sapiens
DSTLRGGPRVTRFVNEKCPVGVAKRTLVVQCRVLAVVTMCKQPGKRGTVLKNHPDDGYMRVVTGSLIHPWSPQAEAWDNHTWGPLKMAGLPQKGSPREKRHRAEPRRDPQRGESRKGSPYAHKGTHARNTQKCRTQEGGCPKERPRRAVWHPKDGARRSLTKSWRDRHKTRKKLPETKRGQQIRRTEPQEGQHTGKFNPRLYTGATDHTQDSQQY

SEQ ID NO: 975571 - protein, 101 aa, Homo sapiens
SPCHVVDAKLCLVCYMLVCVLHAAGPVYLVIVLVLAYARAVHGLRTNLIVHMMYVPVHAPCELPRELTLRCNRLSLMCSLYRWWHADLAYTRGFGYCPSVS

SEQ ID NO: 975572 - protein, 520 aa, Homo sapiens
SLSACGGGGVQERATPGRNLSGVVSLVPAHLVARLPPHSRVQERKTAIRGWAHRESSKGTGAGERNGRPGDHRPDSGTHLPEGTTERRRRPDKNTAQETDRHSSPTAETWRGDTPYVDDRIIKTRGASTQEGLNRATANPQWAKARPRTHQRRQTPPERDRHPDRITRKDRSTHRRPRSGNKPTRGNLRKEVPPAAEAKRRGAPPKEPAGKNTTRKQTPGNNMYGNPRAHRVGDKRTHRTLERTAPKTAQQARIQQGHTAKKKEGIKRSNHGSTRGRKRLQKRQTDAATTQHLDKANTKSTRTTKGKTKGHTRGGTQGHNRDHPEKDGDLNTKSTTQKHPGEKNPPRREHHEVGVNSPNERRKYEKAEDDQPRDNTDRAKMQLASRDTPPHPRDAQTKAPKKEQAKTQHIEHKTHNITTHTSETRFHKTKVTNSARHNTPRARGKTNQTAGGVTHKSETTAKRDAKQRRRPKHNVWSHAERTTIGPATTKRTSTTGQSCNKPRTEIVCNQHRTAQGEQQN

SEQ ID NO: 975573 - protein, 72 aa, Homo sapiens
GLFRERRVLASAVWAWRLFLARWQICRLIRKKDVAVPNGGGASVREADINQGKKTSNNLHSWSKSNVAPTLT

SEQ ID NO: 975574 - protein, 185 aa, Homo sapiens
MAKSLRELRLAGTKDCVLTMRYEDCPPKECRAGLEKYSQKLDGDVYSERMFQEIANLWWYPKTSKRFVQGAKHACVRFTLYENKYELLTVVRGVVVTMKQENDVFYEPKHVYEWLDEWMNPKGWRKRADGAKVEMEKEWGEIGIGKKSVENVGKRGTAAGIESFRNPLGKIAIHWDTMTRLGLVS

SEQ ID NO: 975575 - protein, 257 aa, Homo sapiens
MTNNRLDKHATKRRMGRNGGGSRDREAENSRQETERANRRREADSRRRETTSEREERAREREGEERRRRQRAKRKEKERERKAERERRRRGQSKKGHEPQHAQRKHGEREQANREASDDRRREEERREESIERGEQGRTRRGEKTGERIGRGARRKEKQQNQEASTQQDARREEETHKEPSKERRKTAGSKTKEKRTERSRDEGKEGEEKERRNGGEEEEREEVKHETGHAKGRRREGESGRRERQKTAGEEERKDN

SEQ ID NO: 975576 - protein, 33 aa, Homo sapiens
EKTTNHPNKELDITNRALGLERTTERRSFERGS

SEQ ID NO: 975577 - protein, 398 aa, Homo sapiens
MQTEELLPSQIARGQTRALLLKMTPCAQEDLKWLRATTCPPLCPRCVSQAENDSMPCGSITAIIKGPSGEGAQNRGARTWGPTKGIENPADDEHSMEGPLVLLPPGGVSVRYRILSCYNTSPHPATRTRPRPTVSQQVQSTQYLTRRQRPPLQTRRATTRPASGPTTEGGTRRGAGGRERGGRAGGSGSEQEEGAAEDTGAAPEGRRGERRGASGEKRSTAQRRSKTEGPRGRQGERDGEEQGAGGGGGGGPGQRRSREKKTALKNAGRGGASRGARKAGRESETQRGWRHGRTEERERGRDRESGQREDGEGDERKREPARETPTEKRMPQERREERAREGRRVREAAGRKRAQTTQQTEETKEETGTAAEGNKARGQRPQGAKHEERTGTKHTEAQ

SEQ ID NO: 975578 - protein, 70 aa, Homo sapiens
CGARIVCSNSLRPVLPHSAAMSFLKSFPPAVPAEGLRAGQPQDIEAVVETEKVLAHVATLYTSLRAACLC

SEQ ID NO: 975579 - protein, 327 aa, Homo sapiens
GASLERVRTGCGRSCRTEVQRPRGHGVTQRGIDPCGSHVRRTPLSSPTRVSACALRDETSVLLPVWRGPEARRVGLGWKAPIGGGGWVPPLKGGKRRWGCGGWNPRVGPGSGRFPTLWGTRRVPPAGDGPPGGLRPDALGARDIGLRAPVVGPPKGQANLVGTFAWVGLATSSLGGRRLPCLRKRQCLGCVHRPGSPDNGGARELGCALVGRDPGGGQARALPPVCGSSSDRGVACGFVHDAPWGAHMVWNGGAMEIVIPLGEATGPGGGGGRSLGDSQGLWRLKRGDRVAPVGWLARSQGRDILGRCGNCWTSLCGHRAFGRPPRS

SEQ ID NO: 975580 - protein, 78 aa, Homo sapiens
EAKGRYASVPDGPRRLCLHLSFASPFRERTVSLFLSTLGGCCLAAPSYCSGPSLFAPLGGRWEALGSKTPSLEIVFGL

SEQ ID NO: 975581 - protein, 315 aa, Homo sapiens
PVAAEGRGQDRAIRPELAVVVSRPAWWGAPSRPRGRRIGWAPGLQPGREEGTRDLRERGNFGGPSAVRATTKVVVGPGRLRGHLLAAVLTQRAPRKRVTAHRNMAQEGRIQGKEPPVWLGTGVHTAGQQEYWWTHPGECHGPPGVNGGDPTRREKFNGTIRGCYGEPRAEGRLKPAPGGKSKGRGNCRHPQNRAYQKRRQRGYVVRRQQARQRCVTLRSDRPSVDIISGTVAYGLKRGLTNRHSRGNSRGSSSGPHRALKAESTVKTRDMVSRRHEDFGPNDKTFGLTQIAELRSERTRGKAQWKTRLWQSPTER

SEQ ID NO: 975582 - protein, 120 aa, Homo sapiens
MRLLLLLLVAALCGWSGARPRPNLGGVPGKRLKMQYATGPLLKSQICVPEVIARVFRRSTWRGYEARRYPDIRIEGENYLPQQYKDHIASFRVSLQKLVSPRLNYCVGKDPFAFLCIASS

SEQ ID NO: 975583 - protein, 109 aa, Homo sapiens
YDWNIFTVSLGVLGKNFLSFMVLFKPARMKLSTDTSSSIWKKKATSHLTFYQSDVQADLRTLEQLSFIPEDDSVGDCITLQVRNPNVMCMSQSVTHQSIVHLHLFHHCL

SEQ ID NO: 975584 - protein, 341 aa, Homo sapiens
AANWRAAVMCMEEQPDHIIKGIVFQDGYQTSLALPVNIRGAQRQIAAATQVCNGHLKPQGANRPTTPDDETKRMHARHTLSGNSPSYGQAKPLRTGMSHSKTAAYSRVQTFCTAGRNKLGHVYVKDNFLQLLRLLIVPNSQKELRSPWIVTLRSALMAPVTIFNCGSHCHPVATLPLSIHLFGLPEIHSRSHDIPRITCLRQGPHNFVATYLWLVHLVSQSLDLHSGQRRRADRRKPSRKPRHASRHTSTINGQQVHNRGADNRLSTHPKASWTCHWVGKLESDAHIEHGQYRSDAKHRSDGAQLPHEHARKEGTGTEQSRDPPEHTAAVHHATTTGVTPE

SEQ ID NO: 975585 - protein, 72 aa, Homo sapiens
TVPGAPVLAVGGFGHGDLFWPWWHILVSLNPQKDVAVPKRRLRRVRQSGFKPVKNTPGANFSLGDRPKVTPI

SEQ ID NO: 975586 - protein, 387 aa, Homo sapiens
GLLARATGCRCCRGSLCPAACGPPAPGPWGLPLAAVEEPASAGSKRRAAWTPETLERRPERASTAGGTTTGHQCAQNSPMHNLGVEGVPFTHGRNSYLHQALGTNLANEEALVKAAKGVTQTQFACRPLGNLCGKQCGHKGPNTAGPWRQRVTITTNSRGGTLAGHHTRHCAPHTVTILGSVATCGQCAHFPSNGETLRPNGTSQDTRENSQGNSQRRHCTQCFRKHKMGPTGLLPVLDPNISLRGKSHKQHTSVNGESFLLKERRTRKQANKQKGSVTGDAHITNKGYPRIIPSPPPGQFKKAETKSHVATKQEWCGTQILTSNKQPRDRHETPSTAQNSGQQPNSDMQRDINGKTPWQRTSGLTKWHRANGPRDETLRQSGNTEV

SEQ ID NO: 975587 - protein, 90 aa, Homo sapiens
ALPGAGITLRGSAEIVREFFSFGINEHFNISVAYTPSEPFTSSAEYTDSPVLCNYVICELIKYLNNVVEPSERWGYTSVQSRNWCSYLKY

SEQ ID NO: 975588 - protein, 322 aa, Homo sapiens
EGCEQRGGEAAWTDEEETYRSGKSRRTIMQLCNDAVVILLAQGLCLDQTLGDVQSPFWWTHACIEGAAGAHGPSTRCLFAHKMMTPRDQIVCGLFPGWSPMGGLSRTFQGWSLPAPCRERRTSFTRGSSFGGWPARDLTPFRQEASPRGSDIGPPDGNSVEARFLGGEGGGHSTFSWGTALSSLEHCRSCPKAGTVDQSLGGPDIKPAGGRTQACPGSQGGATLVGALLGSQGWGPLLHSSGPCERVAGYITNGWCGVPAEALEGEPVAPSWVKAWLADSGPKFQVWLWLQGWCPRPLWGFVPASVLGVTKEPGWCGFTRLV

SEQ ID NO: 975589 - protein, 178 aa, Homo sapiens
MHTDDALRRNLRLHMCDTHTVRLPQELQGTSQGYHRHFALHVTAMSGYNSSHNKAHELLATLGGKHKLVFSWELVRILAGFTRASGIRDTGMAGQLGFVHYNYMVKPLTVEALLERVGNTLKRRIFAAKINASVNSQGGKVTGNDIGQSGAGGNTTTPNHKLRHYNRYELKYKCYVGY

SEQ ID NO: 975590 - protein, 235 aa, Homo sapiens
MRRDSRERTTGHERARVQEEKRGNEDGDSRKDRETKHNPEHEETKQAKKKRSKRTSNEGNKTRAHRQHAQTNQTADETKELKKSKKTKRTRESETEEAKEQEPEKKEGETQRTPARTRKREQREREPSAPAASRTTESRTAKTEHRGQGQHEHRQNRTRTGAERRQDGRPSTRREREKDDEKQHAQTESRERADRARSKPSQNKERQAEKNKQRAEANSRESRKGQQARAQPAGA

SEQ ID NO: 975591 - protein, 31 aa, Homo sapiens
MAQQWHARGHANLAHFHIRTDSLDTSMRLST

SEQ ID NO: 975592 - protein, 102 aa, Homo sapiens
TIGDDSGCGEVSVQSAHGLRTVNPSMGEVQKGKKMLLCVKCDPAGPYRMTRPATRSKIGSTILHVSSVGPDSTFQAPMVYSFNSSSAIKNKGTSIVGESTTT

SEQ ID NO: 975593 - protein, 130 aa, Homo sapiens
GWGVRGRSLKGDSSSNQYVNDDTGVSLPSYEEDQGSKLMRKAKRGTIRTAWNSGFASPIVAYGLYKTEEQGKYYNVRIHLIHMRVAGQGFVVGARTVGMGYSSVSGMAGQKPKPLRRRDAVYGLVGGACL

SEQ ID NO: 975594 - protein, 249 aa, Homo sapiens
RWLTPVIPAVGRPRRVHHLRSRVRDKSGQDGETPVSTKNTKISRAWWLMPVISATREAETGECLNPGGGGCSEPRSRHRTPAWATERDSTSKKKKKQGESGALFWWFAKTGWGVPLVHNFLFIFTLKGYLEKVWPGGHSIKSFKPLQGIGGTERWGVQAWTMGAGNLVGKAVVVTLERGPPKVLQVNGQHSKGVPKGSQPHGEVHHGGATCGENWNQWLSLVRERLEARHREKASGRYRGGRGPPTVGH

SEQ ID NO: 975595 - protein, 246 aa, Homo sapiens
GVTGKLVSGLHLNDLLGKLCEIIEKSEGIKQYLFFMQQVAQKSYGNDKKVFLPTSLCISYGQWMEEHTKEQMERDGVSLNKSLNRCAFTGIGNSDQEMQQLNLDENELLAQPKHGIYLTQYKRKPLHVVWYPMSYGNSDDQSVCSSAQRHKQSSPNLPIQEAVIEKVLTLCHCLRETKGGLCSNLTTIPRQLGYPITGLSERRSLPTGQLTRQWGSLFNHTPLAGSPTPKGEQLPEPGLGSSPFGP

SEQ ID NO: 975596 - protein, 313 aa, Homo sapiens
MALSSPSSSLSHLGNSASEVTRSPRYAQNEDRTSTATTHTLRTTLQTTSFARQPCKLPTLHSQMHSTSQDSISLGHSCLLLRHSLTHMHIGHARTMQSSTTEATAQHRTPSPAKPGLPIRNPLTTRTTHHTPAHHTRHTCPNAHPAALRTTTQARSPQRLTHILPPPLAPPPRTPLATPGRQPPPPPPSPPPPDPPPTASPLPAHPPSLPAHPSVGPQAPQPTHGHAAHIALPWASSAPRLLIPQRPPTPPPRGNPHPHGTPPRKAKPRQRTANRAAHNGPTPTLGTTPQRHTPCPEPTATEATPHTHSATRH

SEQ ID NO: 975597 - protein, 41 aa, Homo sapiens
MDEAHYLPPGEAIPHDSRTPAYIDQMVGSPDKVALLSSLAR

SEQ ID NO: 975598 - protein, 70 aa, Homo sapiens
MGRLGPSSPRGCCWGATLGGVALLALKRLLSLPLRCSCYAATSVSCVRFVRHPSVLGGFGATPGVALRVL

SEQ ID NO: 975599 - protein, 119 aa, Homo sapiens
GLVRCVGVGARCRTGSALITDVAASANSSPTMLGRVASFLPLSVPLFNYVGPFKQIPRSRNESGAFSDPGFPGTNKLLKRKAMRRAYRSGLFHTFHLSIPHFLKPQQPKQFTKEPKTLQ

SEQ ID NO: 975600 - protein, 103 aa, Homo sapiens
MESRGHRWRKNTGVPKREETGGTTVTNSGARRSLHNKNNKNPARGGTTSRRGGYAGDKNSTTKEERASLRGDQKHQGGRTYYPTREGALTKQGRPPRNLLQNI

SEQ ID NO: 975601 - protein, 142 aa, Homo sapiens
MAPYIFFNKRGNNNTRNGGSQVLNSISPGAAVNHPGGRGRPSCGGPWYGRYGGTTRGSDRVATKRGAGSPHYTFAPPLCGCPILISQQDLRGVGGNKQARISGQTTMLNRFYTYRIISQDSEHISTHGGTQPKAGRAPIECG

SEQ ID NO: 975602 - protein, 126 aa, Homo sapiens
MLLVTGPSRPPRKSSFRNRLACWPAAGPPIAVTAHTSWHQPVSPGGEHAGETGSHGRVGIPSAMKTSTRAGNTRGVCGPSPQRLAPRQATARGDLLSAGGPEKERVCLKYYPPGPSGCVPLKRLKT

SEQ ID NO: 975603 - protein, 116 aa, Homo sapiens
MASRSRLLLHAGAALLTAALIFFAIGNYTHSDELKTDYKNPIDQLKYPESPVYSQSTLIHRFLRVSCLLCASRVAYTWVLNYCPFLGIIHTCGGTMSDQLTELGPGPSYDPYKPFH

SEQ ID NO: 975604 - protein, 187 aa, Homo sapiens
GGSTVRPEHESLAFADPPPVQPAAVTMDDDIAALVVDKGSGMCKAGFGAQHECPPGRLSPSIVGADTRQHRELMASGTGVTHRSLCGADGGQETREDILHPTESTPTSTPTVTIRYKPKTGGTHHCAATTPWDKQPTLTVTKERWQMMDIPKEDTTVAWNEPGGTTPMKAPKGSNTEKTELTTNNTK

SEQ ID NO: 975605 - protein, 241 aa, Homo sapiens
MRILVTGGSGLVGKAIQKVCSRWSWTSWRGLGVVSSKDADLTDTAQTRPCCEKVQPTQRHPSCCKWWGGLFRNIKYNLDFWRNKMCTLNDKVLHFRAFEVGSPQRGGVLPVSTCIFRGQRTNYPIDETMIHKWGSPQQQFGYSYAKEDDRGAEHGPTFQASTGCTLSPAVIHHQTFFVTPGTTSTIQEHGSGLTVCGVTGENTADGRFIYFAGPWPSSLSRVLPSHKKWRPYTSRGRAMRF

SEQ ID NO: 975606 - protein, 85 aa, Homo sapiens
ATSYTRVHRLVPPVWDSIRYLNGSIQNAVVTFKMMLFIEQIQKFTVVLVLCNNHYGKISRKPACGHANGVTDTGDICFEHALCGW

SEQ ID NO: 975607 - protein, 292 aa, Homo sapiens
LCLIPFPPNPDSVKCSSSPPRTAAERGISLPQPSSQPFPSNNKQLQVDSGLWEVRLSQPRKELLYTAPNEMAHKSTIRQSHTSSVCQAPSFLPFSTNLSAGVKGCVAPIYRHQGLKLLGQTNPRGKTAARRNYLLNHQLRAWSAILFPIVCGGLQTLMFPASVFPRNYSCILGFQTLTRRTSVPPGRRGLFISRCAPGIPSVVDFHGPVPGQGPLPHLHGRREAFNSYCKAAIFTLMDNGLPQCGKSLSYSKFYTTAWFKKLINLKALALYASGRQGRALTYGSNFYTDLSG

SEQ ID NO: 975608 - protein, 85 aa, Homo sapiens
MGGDKNCCCSQEENRSWSQQHTCAGGDSSHTKLKKGGRGETRGTVVETQRPQKEDCREGNKRRELHEGGCPKDRAEGKIKPARGG

SEQ ID NO: 975609 - protein, 116 aa, Homo sapiens
MHTLGPNGGPKEKKPGAQKQWGVWVSPPNKKRRRGGHPRRCLGNKLPKSGGVSRGGQIGGSYSPREAPKRRRILKLYRPRAWRRMMSRKTRGQNVVSYGSRRTNRRNDHEETLRHT

SEQ ID NO: 975610 - protein, 131 aa, Homo sapiens
AQLIDSMANSFVGKGPTCRQKDSRDSLLCAVRHLEHGTVSGRDGGWRGIPSLLQMPMELELMFGCQVEGDAVESPPRPGTPGGGPLSSYGMDSRPPMAILGVCGITIGQSEPRSKKLASGVVSPWEFQELW

SEQ ID NO: 975611 - protein, 200 aa, Homo sapiens
MNVIGTTWRNVVGRETTGRGAEINAGGQDLLLQGKTINETHSGEMQLFEGLVDPIYWLKGTWAMSRLAQKKAVEPFIRVPGKLNGGTFSAKWGAKLAPRGGKRDRGSLQKVSTETRNDPGEERFRVETPLGKTDGGLDHRGLEGTPRGKAMIQVWEVIPEGVGPAANCRGIAGHDSFEPHHFLGKREARGEHFETCRPGM

SEQ ID NO: 975612 - protein, 223 aa, Homo sapiens
GETGPPGAQSLAFADPPPVHTRRSSPVDDDIAALVVDKGSGMCKAGLRGRRCPPGRLSPSIVGAPQAPGVMVGMGQQGILCGQDEAQSTRGILHPEVPPIETRDRPPNVRRHLEKHLGTKHRPTNGRLRVAPEAATPGRFAMKPEGPPLENPPQGPHPAERTEWTPSDSTAADKPIQTPPPQRHVDYRLPPTHKRLGRLYHPACITRHFMAHREPTGTLDDWA

SEQ ID NO: 975613 - protein, 106 aa, Homo sapiens
LLRQNQPVACLSQRRPLIHRLPCREVCFSGDVGPNFVRPHTTVGRIRFHRFLGDSWGILFSHPRDFTPVCTKSWGELAKVGTRIVPRGMSRGWALSIEQCGGPSVP

SEQ ID NO: 975614 - protein, 172 aa, Homo sapiens
RCNSTATSCTDSKHSSLYSIQDSFNGAEGLTPRSGTTPKPVINSTPGRTPLRDKLNINPEDGMADYSDPSYVKQMERESREHLRLGLVAFLPLRTDFGNWFYQKMAEKDAGKNVNLDDYLHFGNDGWLDGGMLEKQAIEMQSVYQAQWKRNAIKLVQKRSAKDPSEVNGNLF

SEQ ID NO: 975615 - protein, 76 aa, Homo sapiens
AAAGLRGACCLLSPQWRVLALVISVSSEQGGVTLVHRCHFVPVGIPKGFLFGPSIVVETVVHIRNLCRRKDIQTDR

SEQ ID NO: 975616 - protein, 268 aa, Homo sapiens
MGGTGSPGVLDGLKGPELWADAVLWWALGENPLTWLWSVVSSPTNKPGFSKTHKISNQNKNHFAAGQDFGPIEENSVFRHTTLPVGERGPPRKGETRHQWAPNGESPRKKHPGGTRHTSGLSIPHTPDKKRRRGGNTAQTSSGKHIHKWLRGDTTLGTIPTGRPKRGSRKSKILGRDGGVKNIRNQQHTSNEHDSDRHSPTRASTQTTQQTTKNAHLRIPQQTLPDHTKTTTDSSASHDTTRTTKDHPDSDYSYPTAYTTRYSQQASS

SEQ ID NO: 975617 - protein, 300 aa, Homo sapiens
PPSDFTPVCTTELESCKGGTRIGKRNVRDGPFNRQCVRTIFALEQGIINAYNCEEPTEKLPFPIIAGLGIEELCQSLVWAMPGIPSQSKADKGACLVAQAPRGWYVSRVPELHARLGSWFLSLLTQFTHLARGNLWTGRTPLKGGYAQSFFLPQGVVPQPGTKHKGFLPTPPGVDCGPRTGGIRWLDRAPLSNTNSPWTSKRNGPHKKPFFPRKRRTLFNPNKEASPILLRNGHTTFRLTRPPEAYKSLLGDTLGRFVEAQARDWSRCHNCRPSIARHFPLYHHSLGGHPQPSGFIKGWS

SEQ ID NO: 975618 - protein, 117 aa, Homo sapiens
MVAPFVLPVLYLGHLKWGLNTSYLGIPRMLPFPPIPPSLFIPVLVKGLFLSVSDTLCYGELKTEFYKELIVGPSFGSHSYPAKERVEQIGFNSRVSAQAKDLLWRSPYIRGGADDSP

SEQ ID NO: 975619 - protein, 95 aa, Homo sapiens
MQGPQGTKRPNQPRATPTVSDTPPTGHTNNTETHYRTNTNPKSTLHNTNEGDTKGTNTPITKNNTQGEQRDRQTTGDTRPKHNRTTDKRLEQQTR

SEQ ID NO: 975620 - protein, 303 aa, Homo sapiens
GSRRSRGSVSLLQQCWDGTRSGDSLPASDRLRFPLGYELSGTIFSASPASGTGQHRLVVSSFCAKPTMSSQIRQNYPTDVKRSLNSRGQIGYLQASYSHNPFLSLGLTNFRPATMTVGLLERPSSPTFLPRRNWGPEGRKGHGGCYTDAVLLGRIATHTNARLWAPARGPIFQGTIQRQAPAVKRTEGGDNTPKKGPMEHGCQRALGTQKRTVTNPGHVVGNPARAREFLGQERRPHIMVAELRGGTTFPYDGRQVAPSSQERLGSPRWDQLATGQERARKTGHGRTTSNRKAVTLQASMNKL

SEQ ID NO: 975621 - protein, 418 aa, Homo sapiens
AFSCHLAVPVCVRQSSGGPAETRFEHRTLVPRRWPIIQLRHRYNNRLWHGGSGQAGTGQRGAGKFPARSRAQGRAKGSRQEQEGRCDRTTAHPLKALTSREGRRSSQGPGLALADRRPTPCLQTLQPRGRDTRRTPDASDAQHHPTPVTPREQHSPKTWHAPPQCRHSARRHTAQWASASTHRTDKAESHHRYQAQPRPNGHEHNTPSQTPPLHPRTATRARTTTTLLPHWAHLRTQGLAHTSFRTKHPQRDNHVLTSHFSPNPFKSVPRRIHLAASRKPTCHPIYPAPNSARDTPRATACQHRTTRAHPQGNLLKPPGPAGGRNKAAHTSSNTPTAVAPTPRSATQPPHPRSPCQQQRPHRAPPGPHATPHAHNTSHNLGARHQRPTRPHNSSRTPPPAPHTANTPPHDHAPRHISA

SEQ ID NO: 975622 - protein, 183 aa, Homo sapiens
PLSGWSVSFQPLDPGQRHSDPFSERCSPWPSYYFKPMMKEYRFEPSSQTGSSDAGKARVLKITIHGVFENRLTGMLMDYMLSILYTERLRFKGFARDELVRAKIVSCRAISRAHDTVGQTEHEGPKFRGIEVRIWLPGIVVYPYRCKSQGVNGTPDPQYAAGRISHSTNKRLIRSVRGIHCIL

SEQ ID NO: 975623 - protein, 69 aa, Homo sapiens
NSVVATGNQIRSYSCASLPLFLRNHVDKPDYGEIEKLDKSKLKKTERQEKNPGAFQRKDWTRRSKQGNR

SEQ ID NO: 975624 - protein, 68 aa, Homo sapiens
KHGGVGYEAGTKPRDAGVVPVGTEEAPKLFVLNSHLRCGCPEDGMTVSGLPGALAYTTCSLNYERMWT

SEQ ID NO: 975625 - protein, 124 aa, Homo sapiens
VVAVRGVKARGLFVSLAMGCSLLGAVNHPGGRRNIGGEFSLQSGINEHVYIGGWNTSNFETFTFRSAGNRDSTCVCKLRWFCEASLKIPKISVGGTTHVGKHVVYYQGVAVQENVVCRLSSKLL

SEQ ID NO: 975626 - protein, 323 aa, Homo sapiens
KGAKSMAKGRGEEQQEREEKSKRKAAAKNFRRLQALWDGGDGKRGAITRLKSGCRFLRGFERFREIAHRNGAAEQVNVHRWWKQAAGGREKVGLVNEKNLKIEKERLWGMKGRTKSLYRMIDGATSGCIDRAHEESLMDGQRALIDDTLPSLKFASYFKGKREFSREDSHLAIIEIRPQGENEYEPCEPAPPQVNTKLTVLIHRNEDVCLERKLVHTVHSHEIFTDLMGLTGDRNTHRWLHLRHLQMVKWSLKMSRVARTDVEEGAPQNNAGNSGIFTDRGINGVWAPFPTTYRRGALPQGASISYRKGWRTTHVSGFKNRGN

SEQ ID NO: 975627 - protein, 103 aa, Homo sapiens
MRRKHARRQEDTERGRTMPGRTTAEQTENAQPAADRTATPRADMEQASERGELNQKSTNRSQIRITQYSSSQSITEGRTRPKESRRTHTPTLTGRTVTAARTT

SEQ ID NO: 975628 - protein, 95 aa, Homo sapiens
NSVLPTGRTDFARTRAPRCGMLWNIVEKPIWMRIDEIQIEVEELKKSDEGKDNGPLLSNRKRLDSRSKASREKVEMEACAVEILELVYSIKHLPS

SEQ ID NO: 975629 - protein, 218 aa, Homo sapiens
MASWHHTHTAAEDRNTLVEQAWLIQHFETGRTEKYVDTPFGKPSDALLRGRSQNVDSILLARHARQTHHHAFKGQLPGEHLGLRRKRAVHNVIVTTAEWILEGGDYSPENIVIHRFSTFTRDTTMKNSRPYTYACDSQFICSQTKMCHSSTCAYTRYSLKHETRIPRKQNEHTDTPRHTRDATHKERTHRTHNPKGPTVIRNRETHTIHEPQTQKTTK

SEQ ID NO: 975630 - protein, 267 aa, Homo sapiens
MAWNFHRNSANNVDTNYWKPDNRNWTDQIGSRLRHTGPISTTTRSTPKSPGHQCTHAGYTLPTFLSFTKHAHTRGNTNPLAHGQRIALEAKYGWDTCKSNGVHAGPKASLQGMGHVGWGVTPQYWTPFVAPVGPNSNSSGRVINTFGKQGVTRANCGAFTQPKQHSTVAPTLATRPFGQRLHFIIQNNVWVHAIFDPPPEIPPVHSGNTGYPTLYSTVVADLDGQPTPTVDPRGHSHFCRNSHNLPSNSSRHNNTTLEPDVVAYTCA

SEQ ID NO: 975631 - protein, 84 aa, Homo sapiens
DGNGAERLSQSGEDDCQQDVDLEVKDSIPVTELQQVDLLKVMHLSSERVQLVVKNELLPQIIPLTFQQMKISRFSQDKMNWEPH

SEQ ID NO: 975632 - protein, 157 aa, Homo sapiens
MCVGRARPRRPGEKEVLKTHSRVGARRGPQRSVWEHTGAHKRGVPRGRNSRGRTDTRAGGCSPPPNIKKAAGGGTTGCVVEAKHSTRGGSSAGERHTAGYYNTRRGATKEQARIYKIYPQRPEGEEHQIIILLVKPTTTSHRNQHPPITIRNTNSAE

SEQ ID NO: 975633 - protein, 107 aa, Homo sapiens
MRISRDDEQLKDAAEDIYGGHEGMGGEDGLTVGQRTYTGLPGPGSSGHLQKYGRTPQVHGPPLVVGQLHRVPVARRENTIDSTLADSYTHKRLQDACRGAPACEHNR

SEQ ID NO: 975634 - protein, 451 aa, Homo sapiens
RFLKILLFALCVVLSVLPEQDLCCKATKLLLNLCTWHLYRNLVAARQHGYLTPFGLNGIQRNIYSFNSEVYTCFLPSGGYPCNSAMLMERKTGNLKPRPKPSLTFSLNANRYQQFSTPHHQLRISLTTFCDHIQSTTEWASTVYNWHLLTSPSPPYTTNHIPSLPPSHRPPPTTPPPQPSLLPHHLIPNPLVSHPHTSSHPPPTHHLHTIFSSTLHSLSPYTQHLPSTLPPPNTYTHSPPDPLPTPLTLFTFLSTTTHYSTTDHLHTMCPLLHLSCALLELKHLLNLPPNSNLTHYQLTHNITYSSRISLFVLITHLLNYCLSTPSHNIKTHWVGSTRDKLVGRNTDQMTPRLVRVYGDRALEPVLRRLGRSTESLVLSDVSCERIDELKLTDLQTPKANSTTCAAQLHASVNSDSDDISVARSTCAERRAEEADKHTEVTLSSSIVTDTK

SEQ ID NO: 975635 - protein, 433 aa, Homo sapiens
LSPGVLVEVTSSLNPAWQSLTHRRDAQVRQGDLAVQLLPYDHPTMGLIYPKCLIAGTQTHVGSQADAARLRIVPSPPTRLWLLMGNEHHDCAQAIRRAPGHPNPALAENLLPPYPRARNRCASRSSHHRSAPSTEHPADPLLRRAQYTLLPNPALPVSCAAPLAPPLAATLPLVPQPHEPTLASFARPRSKPPPSFPRPSPRYSPPITTLPSARHPIRHHVPRPLTACTAWAHRHCRAPTRGVPPAALPSPLPVIPAPTMLPRLRPLRPGIFNAPAASGTPRPQRTFFEPSLPTLPCDQLPPTGRPSGPCPRASPTCQTMTNARLPTDHSPPYPNLGITPHLSFPSQSTANIIKQHVASLTHTHFTSNPPHQHAFILTQTSHTSTSLSATVTHHTMFAPSPLLLLPPHHPLMFESHISHTTTTACHINPTLIK

SEQ ID NO: 975636 - protein, 250 aa, Homo sapiens
MDDDIAALVVDNGSGMCKAGFAGDDAPRAVFPSIVGAPGTRPGLVGMGQKDSYVGDEAQEQREAILTLESTPIEHGFRHQSGTTWRKICGTTPFYNEAACGSEEHPVLDDLRAPWNPRANGEKDDQIMFETLKNPKQMYVAIQGCVILVRLVAGTTGIVKGSGEGSPKLVPSTRGYPSPRHSGWTWWRTGEHSGNLTEAGKSHRRGRTGGNRKRGGPRISKKAAVNPRETNSEIPGRGRPQHHPRSAPHK

SEQ ID NO: 975637 - protein, 63 aa, Homo sapiens
MGRNSWKRKGAWQQISRGGRGICDHTIFGHIPIVDVSPLVHHQRYTSVEYRWDPLGQGTNLNS

SEQ ID NO: 975638 - protein, 177 aa, Homo sapiens
MSSHGRARLVVQIGNVLLGALFALETMGNPSLDGQDAMVDMTYCGMADDVLSRTFLQGDGRWRGDVAPALWYVDVVIPQVIDDTSHWDLPRRSFHAEQLIAGKEKDAGKYTMPEEGQVQAIGKEIIDSCVRTRHAARAWMTQCRRVFKGYLGLPIESGDGNMVLGSTSRASVGTVLR

SEQ ID NO: 975639 - protein, 451 aa, Homo sapiens
AVPLGSEPGVVGGLGWRQTLEQHLEDTTEESLHCLELLCTASHKALNSWVAEETLAQHAAMLGSDIVSLDPANASLSLDHLNPPPCILSMLQRSLSRNSGLPGRTPSIESQDKPRSGSQRAGQAATNTLRPRLNGVHYSCFYQAKPLDHQGTAGLHTHNATTITFHRTPYLKQLYQANSYSGPRLNLHHCLPFQPRLFSSLAPPSSTGQPPYSDTLPQQCPPRGAPLLLTPPAIPFTGFKRNTRHSIWLPRPRPPQSIPRGPTSGVTSFRSTSRPSHFPLHTPLVPDQRATTHQPHYHIILPPPTNHHQLSFLSRRTHILPFLMNNNTFLYRTQPTILCTRNPPSTVLYSLRYNYRYLTVLFATYGGATDLVTTHPTERSAVPHSRHLTTNPRGARHRDSCLLWQNDSTDVAALRRPLMRGALTRRVLRRARSQSTRLATWEARRSSGSRP

SEQ ID NO: 975640 - protein, 247 aa, Homo sapiens
MDYMRVMPSRTEYIGHHVGGIACNLNSSNSGAATQSPGGVPPLVETNPDRNNGNLALHTPSHWLAYARAAPSRLEQDGGSKRSAISFMNNSLPQCSCEHYHEEWWRQYTSESSNNILISFKDVVRPGHPDSKLLYGTPLGDTVDLCRFLTGKIMGIEPWTDLTRHSYETLLKFVDHPVVSQGNLLIPGFRCTQHPKSKYYDPPITTIEANRQGQLSVDTELNVANMRYNTAKVTIPNCLFLCQKLPT

SEQ ID NO: 975641 - protein, 144 aa, Homo sapiens
EDTVDAVSGMHYNTDGSMLSQQSTDKTVAVWDSETGERVQQAKRDISSFVNVLFIAGQEEALMTCLQLCGERWQQLELRDYPEGRAGIQTFQNYRTRCELVTFNDASDQIILVEETMISRSGTVRQNKVSYTMRGHADSVTGCV

SEQ ID NO: 975642 - protein, 302 aa, Homo sapiens
FRRERALAPEQGSVSGANFRRIRSSTVNGASVGGQQRSRAERAGAGAGDAAWDRQPGSGITASQVNPCRPRVPPGLCAGRRKEGPKSAGAGRNTEAGRDSGGTKMAGPPGKLGRAEGANQGALCPAKESRQSVPGAHIKLPSNKNAGRKITGMARLTTLNRSAPGRRITTLVNCEGVPRQEEAGLDAHFVVGATDCGAKRKAKEGGIKSWRSLGQLYGIGGNSYSTTQWGVKPRAGVKTTGRRKSDSDQSADSEKTADAETLREPKLTFGVQLEVRPPGDAKVVAGGTLRRRTHSEKTWDRN

SEQ ID NO: 975643 - protein, 113 aa, Homo sapiens
APGSNDETLLSAVAVLCTQALRPITGQVSAAVAKEPCCCGLTHLNPSAKAYMVTDDDIRNQDERVQPSTAQTHWHTKPLTGRPSVSRCCLTTEARMRLLAHTATRARLKPKNY

SEQ ID NO: 975644 - protein, 569 aa, Homo sapiens
GTRRLPNNRPADSFGSWPPTFKKAHTMAIKFSATKDMSPKPAASLKQPPSRSIRAQLCDLFRIGMGTLAPISMVHKNTAQGGHMQAPLALLQPLSTRTAHMSEQPILAIQRWQTSGHHRPSAHPVHTHIGNSIRWHLLHQSWVALHPPCPHMRHRQAPGIHFTRAHAHNILRGHNRRRFSQHQGRSPSLGTRGHCDLATPPVGRVTRPLLPSVSTTPHFTLVNPPERIGPPQVPGSSPELDSDTLVGHLGQLARGHGLRATCGKHIRTCGTLGTQPSANYRHSHLRASTRRHQRCVQGSQRPHTTACTLLAGTLAHFGPHKHGTPHAPFRTCYNVNYHALVSSSLMSETLTAGAYWTTTTWAIHRYSNISEALGPLAPSVGSVDANNSLRCGVPAVSVTDTCIATTPAMCYTHTNRDHDYASYVMNSQRSYQATSCNPLGMDPISYFTARDYWGHTTAPISEPTVARVLATWCDTTVYSWRHSTTLKLLRKQAETLIVAINLHSDINKPWRRIQRYVKRPVEQSVRMNTHSNLYDADYTQYTHAQCQGCESRACKRSRSHRREYIRGSD

SEQ ID NO: 975645 - protein, 72 aa, Homo sapiens
APLLLLAVPQSRMPELSAEPEPRGLWVVKSTVNDEVIKRFEDYELYGNLATQEEIKTRKKVVLLAVFKTMYK

SEQ ID NO: 975646 - protein, 38 aa, Homo sapiens
MGDQHTGHTTTRMNRPTKAPRYQVERHNGPNKTSLHKA

SEQ ID NO: 975647 - protein, 178 aa, Homo sapiens
ERRPGGVLRSVVALLGARGECKLLVLRLERAARGSAFFCRDPRRSDECWHKSLTRHGGERVHGLPRVLTNLVIYEFGEAARLGYMKQRKQRVLETYGCGKNEHTGRLVIGRSQIKSHSEPGKKTTTHYMKNWRSQISGKVWNSKFIRKIRRHCGLGFSEVEDHDGEGDVGWTLTDDDR

SEQ ID NO: 975648 - protein, 97 aa, Homo sapiens
ACVNEIPRPVAPVSQWRYLATQRDWLHLTRNPQDYVDSYMRKYSCPLTTSFVFRLCEKLLSSQHTMASNVTNKTDPRSMNSRVFIWESQGLCVVHEI

SEQ ID NO: 975649 - protein, 230 aa, Homo sapiens
GGRSGSVQGSPVSRRAVVRCRWALQAPGHAPFPARQPGNAAFPRRAKECSKEGTGQLPDTKRAPPKRKEAPRKRQTSGGEVWFRLNLFLCNGVWAQCGKAPEKKKGPTPAEAGISPTSLTRGNPTRCVCQKPHYGAPQSAVDAQTGGPHMRGPRSVDLHPTPTHHYSEKGIYTVVRETTAGGKKQEQTLLECRDCSPRPPLCIETSHGAINQRAKCPQRLQWLYNLQPDI

SEQ ID NO: 975650 - protein, 396 aa, Homo sapiens
AFHPRSPTSARGQPCCPSPCLACALRPSCQRGPFPGRTLDSMAPGKAAEAIHYKTRGRWAPDLHAGTMKAATDTHLVPSGPTAAGGEYPREAGNPTGRPIYTTHRYLGHAEIPEGHRAKGECEHQCPPCRCPGHQQRPGEQESPKPWLYEAHHGNTARTATTPVYSTQAPRRSTGKWTKQPECRCHAGKRVRKAQHFSTTGTQPRNTSTQRRPSCDTATSTTTPPTGEKSTTQQIKNEPAVEETKANTLQSPVGTQTRGSAPHSEQHEIRHPGQSHYRTTVASATHLSPERTTNTIPVRRLRNPDPPHHTRRKQHKLDNALDSATLPTLSPRMHSPQIVAKPTLRLTVAELTTDSSTGDNNSERAPAPHQHYEPHHTAVKNRHHTSFIRHNTPPTR

SEQ ID NO: 975651 - protein, 236 aa, Homo sapiens
DTELSSYLDSPNKSGLLFWLLLFETGALALSPKLELKLARPLASLQQSTPRFERLLLPQATWEADGRQNHWNLGGGGCSGAEDHAIARPALGQPKGADNFRSSKDNNGAAICGSACCDSASPSSAPLYSPESPVGSPAGVSDRLNSAHTQCRTILRKHVYNDSGPSGRIFLQSRTTRLQRRELPRATAYDRKRLCCETVCLTNARTTFHPRNGSLQTVFVDTIGRNTRWSTSFLIP

SEQ ID NO: 975652 - protein, 114 aa, Homo sapiens
MSLSTEWKKTIIKFIETKRVRIPKAILRKKSKPGGITLANFKPYHKATLTKTAQCQYKNRHIDQGNRIKNPETKLHTYSHLTFDRVKQKEAKGKELTIHYIEWCWNSQLAHAKG

SEQ ID NO: 975653 - protein, 408 aa, Homo sapiens
GAGGGTLGKIGCVFEWELIETAGNFKKPKVVQAGEENQVLESSIHRDGAIPRTNDLRHLTQGQPFIMDNCNVPHDTHRHVAAQRRPVITPRRLPTHTLQGNARTHTWANSLVLPNRERDEKLQRSHSDNTATHTQGCLSPFLDSTTTFKVLHIRDPVPRSNAGMVAPTWDLGFQGEPPGKTCEPKSDFRTMRKAGLTVGQDAHNSFPNYNWRVTGPFYPSEDWHFGSQRKTWPRMFPCAPPGTPVGQVHNGPGRTRTMLTHAKFISKMRLPVATPPWALIKGHMDSTVLAQDPMRNREPPYRQRERDGPNWAKRVSQADFPRTGNRATTRALNTGSRQKCPQGCQNKPRLTRAVRKSGPSRHRVRRQAEPSELAHSQQARPEPDRHCPPAAITPPRAPIVLTGAPPSR

SEQ ID NO: 975654 - protein, 373 aa, Homo sapiens
GNRWCEAVVTIERCKSQIILLTVRWCLSSKKVFGQYLTKNYCEDELHSTVTGCSGSCYQAAGDAYRNYVDFQNYSQGRQEEAAKTEAFKFAINRGHTVWSGASLSLNDFGETRYCYLIATLPPVHLALFVSCLPSAVSCGDAFCSVALPASAGWVRAPLLGVTWIFAAWRSSSGALFGPLSGSLPRGRAGHTAWFLCATLSLAVVGWPKAPLWAVLILLVVHPIGEVLGVLEMRSRSLVRALLLCGGLVVFAPRGSLSRGGKKPLASFVGFYPGAAVWWVCFRRLLGGFPPSLSPPSFPCCLLGGVPPGLTRVFDGMDSCFTTLGEHTSGSPLRQHTRLCWLCPVLIRVCLGRCGPPHVSVLHHFTLGPLSGC

SEQ ID NO: 975655 - protein, 123 aa, Homo sapiens
SLVLTDLEWRLSILTRMAAAAGSRGVGAKLALREIRIHLCQRSPGSHRSSMYFIENRYVELRKANPELAILMRECSDVRAQALCRLRIGPRDECPFEQLRVADQVTRALENGSKVVNTPEASN

SEQ ID NO: 975656 - protein, 150 aa, Homo sapiens
YQLLTALQTSVPCVLVAGKEELVDPQIAPSSPPFLLFGGPRICVTDIWGKKLEQETTPTELSRKQQQIMQKTLQKKTNRKAKVPACKRGRKNARMDELNASKQKGNLKTEAASVSRRISTRNIDYEAFNDEEMTREGDEDAKVLDEIQGV

SEQ ID NO: 975657 - protein, 312 aa, Homo sapiens
VLVSFLDVRNIILGKSHYVMYGLVAAMQPRMLVTLDEELRHCQCLSVWARQVDVVGQACKPKIYHRVPDAYNPSVVAHGERAEWAPEEFFLYTPILKGFVILRKNPNYDLYVTTKGLCNVQADCNQARPLPSLWPRVGTTGLQTFWGECVGSMLLCQLSEITVVQIEDFLFPKKKNKTQETHFWGASDPQKNFINHFVERRGPPDGPETRATRSLGKPDKESGWVPPNENAGGNEVWEQIQGTAATRIYREHGRFKPAHGKATLNNQHTTQSEESDTRTTTRSTHERQTKRAMHTTTTAADTLRHSVHTVRS

SEQ ID NO: 975658 - protein, 141 aa, Homo sapiens
TQCDQRRVGITAGRMYDLHDLSKARTGDSANMLECATGNNGCVIYLVGEERRMAELMPVGITTFQIVKKEKDLKKSVIYKVNLMDWKTWKLRSLELSVVEPQPVFEASGAPDITGSNKDLPPETPGAEDKGKELEDQTLSL

SEQ ID NO: 975659 - protein, 71 aa, Homo sapiens
GHLGGGHWADQIRSYSCASVAFLRILSDKCDMAEMEKVRVSRELREDRYAGEKSSVFQRNDVKRRSKLGES

SEQ ID NO: 975660 - protein, 146 aa, Homo sapiens
MGILACVVRKGNLPVVPCAWLSNITLFAAEGRPTGHLPRGRPLTPPPPGALSFLGMRPVEDRSLRGLKGRIAWARRAGRAPGNTSQGRVLGLPKNPHRDGLNPRLRPVRESPNSVGTKKKAGQREYTLRRGAQRLKTRPTERGHRD

SEQ ID NO: 975661 - protein, 147 aa, Homo sapiens
MALQRVREAAEKAKCELLLICADLTSIGPILQWILLDPSNLRYEVEPCQFERDVSPDLSQKDYRSMFKKAMLKMLEVSKSDIGEVIYVGGLTRMAQGFSHDMSRVIFLGRASEVSSVCNPDEACGPLELQFREGVSAGECPRTVLLG

SEQ ID NO: 975662 - protein, 253 aa, Homo sapiens
MSGTSTKQGGTTKSEIIKIYTPRARGKHTGQQWVGNNNNQHRRPERQWKAPNKPTSGPRCEYHEVAPQETITTHIGRDSGDTTNSEAQEEKTKADTANRVAVNVEPAQISTQKEGSHLTNKRWKAKQQKLDRHETLETNRQGPRSKHQPDEQSFVKTRQQNREICTPKGETVEKYRRTVKGALIQITTQLTAKQPPKAQAESNKGKTLNSSGHGETDARMQEKSKAQRIRDYNATREHRKRHRMRIPKAHIVY

SEQ ID NO: 975663 - protein, 388 aa, Homo sapiens
MGCNPKFPGGDTSCGYAREPLPRYINHATNWVETSLCKLGATLALLDKIRRRKPTKQFLQHNSGELRAGKGPIMLGVNGRIPRHGGPTPFGDHHRDFNTISTIQAFQRGGCINLGSPRPKYHPRGGVKIMLSPKDPSPYCWVLGALQGPTFSRVAGPPQMVTPFDQETIHDCGVGNKHMWCARKASICETPPVEIIQKWARHTVDCWAHKDNGRLFVQTTRHALPPIVDSNFPLGTRAPLFGKPEPKFTPTSAIGDIATVDALLFGRHACYQHTVGDTLQPPHGVTGIRPRVCPETVVSFPRGTTTHSVCNTTSGSSVFCRSQARRQVGDKLSTQLEAEYNYTDSGGYYETKFKGWTSNSIASTNTLVQNKRRQVTHYLLVQRRSATH

SEQ ID NO: 975664 - protein, 575 aa, Homo sapiens
SSGNQRRAITAGAGRLMTVRGPQHHPRPTMARNTQPTYHKTTHTLQARRKQPGQHTPRTHQRTHPQTTPRGQTRTKQHTQRTQQHPQRTPLRTIPRLTGRTQENTQMRKRRTRHQQRKAQQKSRQERDRHDSQHQPEKTQYSVTELSTAATQDNTSASRDVTTVAQQETPARHRGYTRSGQQQQTPQRENTAKKKGESEKTHNAEKKRTDSAQETTTTKRERERTSAAQRSSKQNKEYSERPTTRTTKRHEHTAHSDSRERSEAGRRKEDAGERERAGDRERIGRERRRTGAREPGGRERGGDRGKGTRRGEQGGQGAARRRDEGESKGNSAEEGTREEGRGHTKEEREETRGEDGERRKEGEKTETEETEEKRERRRRAEREKAHNERHEDTEERTPARQKETHRDQRGDKKSRKHERGGANGTAQRGEATNSERGQQTTREQRPQDRERRGKRRKARRRERERGGRNGRRGDSSRTAERPRGHTDARKRQGRPRRQTSITQRRPADPRTARTHTDEHGSTRHDDCETDRRRPQREPGPEREERSREATQATHNETQRTIETGKNDQDDDTRQG

SEQ ID NO: 975665 - protein, 137 aa, Homo sapiens
EEYTSPEEIERSAAETQTVKKKKKKKKNWGGAGRKKGFLNPTFRWSARAPQRSVSGTWGQDGCPQKERIRGAQHIKRLRVFPTPNRKKPPRGDTPAAVLDTNLQEWGCPASTKHGVSNHTRGATSERRKIKISPAGG

SEQ ID NO: 975666 - protein, 551 aa, Homo sapiens
PLQYLTRAAFQLSCRDPCESSQEQPLTLADLTTGRHYHYWTAWHALTFVTPPSDYTIRPSSTDLHFPKLLLATNTLDYVTFTVPNPSLAALNLHSQPQGTTAALHSKHTHLTGTTAPHTTRTHTHWAKLHLVTHAHKHTLQRPTTTCYLRPLRPNPKHLRSLPLKRLTAKTVGTNLLEALHGATHHPHGKTAKSVDTTALGQHVPQLLATAPFNKDPRRSPLLLSERRDHSYRRPTGVVQFLRGKTTIGRLHNEETYYTAPLSVPCNCEKDRYAISNVVSEHSGVTLALNAPHVYEGQYKPCSVHPPQDFVYKSVSISHNERNPWPHTRATYALVSTYTNFLVNPTGDDWNSGPNSNSRGHSRAPNSLPCLKTALTHVGAPTHNLQPAGTIRRTLSNLHPTPWGTATHIHIHHTNPTTDEPRAQTDDKHDRTRDHIQHTRTTNHNTTRVRTHKPVIRTHPPNRTPPSNTHTHGEWRHPEPPNTETDTAGPKHRAPTTRSTASTTPPDERGMTQQEYRPPPRHRDASRPTPPATTPATRATNRDPAQQYTTA

SEQ ID NO: 975667 - protein, 167 aa, Homo sapiens
RWLTPVIPALREAKRREDSCEPRSSRPAVGNIAETPVLQKSGKKKHKGQKKKKGEKKKICVGRDWGFWKGFTRAHCGEERAGATEEGQRRHTGAKTRGPKGEPGGPGAKGAGDPSTTILKKGARGGRHTGKGVSGNKLPKREENTGEGPKPGETLTQPRGAPKERAE

SEQ ID NO: 975668 - protein, 287 aa, Homo sapiens
MRLTGSPAWLLNPGDRLSYTRVLRGPHWGHAHTVHKTAGGERGLLEISIPGIAKVHARYINWSLIKSGCLNPEWRISKIHNLALRLTRLHGGRTWAQPESGVTPFSDLTEEEFGQLYGYREGQLEGSPAWAEQIRSEEPEESVPFPAVNWRNGGRAISPIKDQKNCNCLLGHEASGSANIETLWRNQFVGYGDKSSVQGNCWTVRRMGRWPGNGAPTGTAVITCPHNRRPGHVKRTTGPRQGRAKVPPKSTKGAGSGLHIVKNNRQNGKLAIRPTALKNLRTEVSPT

SEQ ID NO: 975669 - protein, 140 aa, Homo sapiens
MIATMKLCQLRAHTFKPAISYSPFSKYYIFGPPMRPNQPARPLDTDTIWHTHNLGSTTGFIHTYTTTPLVVCNNASHPPDVQQIVATLARHRNYTEPSSIRFTTSHAQRTICVDATNLSVLPKTSSTSPHTGIYTPTAPR

SEQ ID NO: 975670 - protein, 269 aa, Homo sapiens
ESRFAPTDGRRSRPQPRRARAPGRVPAPHPAPAPAVPHDPAPCGPRGGQATTCALGPPETRSLSAQRAERPESGSSAGEPPGLKLAQAPGPGRWAWFSTRKEDADNMYYMCRKNKRSKGHTTIGHGKIFYTFLSRGIHNKQCRIQGGGLWVAQNLMLEKQIRDLARVEGQLLQDLGPIHIMVIGLGRHRLVLKVVWQHHDSVQERENDVPMIQDLDFGKRPEEEPRVPPVAKPGIVVHTQIRCMSTGTDTGMHRQQVLNIAAKCGVRQA

SEQ ID NO: 975671 - protein, 178 aa, Homo sapiens
MRTLTARGPELVILILIITWLPKRGLVILARGAEAMVTVIHVRMSLVGAEWVLRSLDDEGLGWINGPVTCVADECGSIRYLMTNTWKDVTNPEGTILSVVCATSEVICAAQEAIVAVCLMCIGKYTEGTHGNNCDSDIDKPATLVHGPYMNSFALYDIERSGDQYLVYHNDSIWMQIS

SEQ ID NO: 975672 - protein, 131 aa, Homo sapiens
ELHFSNNGNGGSVPASVSIYNGDMEKILLDAQHESGRSSSKSSHCDSPPRSQTPKIPTELLKQIPISMGEKNSSQSEEDDIERRKEVESILKKNQMGYGMGQVGRKIFPPRSSSLNTRSARHPQHEEHERH

SEQ ID NO: 975673 - protein, 98 aa, Homo sapiens
DLSRVESAEQLVACPEKILLELNHGCWSGRQERVDLKPGEVPFRVRGEVWLLRLKELRCWNLGQLVPGKRDPVPWNCFIPLCLQTAPRGERQKANLCC

SEQ ID NO: 975674 - protein, 158 aa, Homo sapiens
MCPVCITDWTTPGDVREDTCIFASKCSVRALVSWLFIQTDVQSSESDHCQDYSPESGVGTNKWAMPEESTRAARVDKFVNKPCKRLQKDSCGQSNTSQPLLIRFSFQKWNNTEVWESSCKKSPNQLTPFLDNLEMDAASPTSSEVRAGSAKIGPPIMR

SEQ ID NO: 975675 - protein, 117 aa, Homo sapiens
MEGRVVEIFRLQEIFTEKVLQQEAEIDSIHELVVGATWNITEGTEDVEKALKRKWVRVGIPVLLEDGVFSSIFLELVDRRQAGLEKVLDIVGGAEGSRMVKCTRKLVMEVVSKNGKG

SEQ ID NO: 975676 - protein, 93 aa, Homo sapiens
QDSLSVRYAGYPDRSEMAEVEETLKDESQKGVQGIIVVNTERHSHQEHMDNPHTTQYASLMHSFILKGTEHRAVTFGPKKDLHLPSNSGSKKN

SEQ ID NO: 975677 - protein, 174 aa, Homo sapiens
MQHHLYYRSASNDEDNDVTKMTDRREEENAVDKQRREQEKTYKKEDRADTEKRDEHEQDSTAERRENKTGTTTQTKQKTAKQIDKRLKRHYRQPASHHNDSTNRRHRTHERHKTNSGTQTQPAEEERGERQTTHTATEHDARKQSETTSHTHTKNQRIQTRHDTQTTDQKTRET

SEQ ID NO: 975678 - protein, 66 aa, Homo sapiens
YSLFSNTEPRYAGIDGGLAIWMMPRFDLVAITVMNKKARYDVWYCIGMRVLLRGARMVNTALLYNV

SEQ ID NO: 975679 - protein, 89 aa, Homo sapiens
GTLWDTVSPRRCSCLEATRSTPWPSHFLRPQRAELQRAFPGPIPVLCIHIGILVGGEEKQACLSSSPRFQNVLPVPPKPALSRGRDGCL

SEQ ID NO: 975680 - protein, 200 aa, Homo sapiens
AVVSTQRGHYGRGRGAVVTPVIPALREAKRREDSWSPGVRDLPGKYSETPASSQTQDQHTNNKKHQGAQKKNKNNKNTNTVVWARPGPEKKVLKTHTGWGGRGGPQSEGRLETECGSTGGVGPNRKKKPWEPGNKRRGGDFPPPTRKKNGAGGKHTRVVSWNNNTPEEESGRDNNAGRSLHEGGITGRSPKKKITPREGG

SEQ ID NO: 975681 - protein, 67 aa, Homo sapiens
VGRQTVCFQNGGSDGCGYPERTNSGAGKKRLEVKKWNAVALVGLGYGGDNCAICRNHIMDLVHRMSS

SEQ ID NO: 975682 - protein, 123 aa, Homo sapiens
GVLRRAARTTDWRSPHGRYTFLVTFPLVGHELERPDQNTDASATGLQVYAGGLEPLTDTTTDHLPTVGPRPLTHCGASQRAAKLTDNTTDTTSEALETGTTLAGPLEVPADNASFALRLYALW

SEQ ID NO: 975683 - protein, 494 aa, Homo sapiens
PCSYSSLLVSLSNHMFRVAIMHLNSCMQHTLHLCQQASMHVAGPHTFSTHIHSNLGISATKTTEHAFPYLLSHWAHTGHSSAIFPKAPLSGHTPLTFSSYPSPSQAIFHRIATPRDRGSNNTRFITRSLEAIIHSKGPRHEWQPHGSSKWPYLGQAKVHPNCAHRGLPEGHPILPRGNRLALLSLCATHLVPSRPLLVNSGPELRAIRHWPHTQWRHHSSTVIFRHRLNYLGEPTTFHPPIQQGAIGAQAFPSSPFPILWRLTNPRRRKDEPSNLNLVHTERGPFNFNAVFTPIYNLAFWTTNTPQLGDTASTKPYPPPGWPTHTMIAGLTTQAFPHTVHIGPSGTLTPCCAAALPHQTVYASTPHSGDLPKTGCGPTYTLGGLRAHYPNKQLLVPVVSDHTLLPNQDYAPEPTKPTVYPPYIHRALGQPVYATPINNRSALIAIAATLHFYTTSAGAAQSATTVPSVPPTSPERPLHLAAVDTHQYSRRYRKH

SEQ ID NO: 975684 - protein, 204 aa, Homo sapiens
GPSGGAVSQAGGKMAAPGGSRAVRVSEMAGFKHLGVLGRGNPRWGGCHNKLDIELEQTCERAWKKSPGAFDRYGRPGRSREAGRARGTGVGGNPTGGVIRGEEGHRIPQKEERIAIMGGGRSPPQKVLPGNPNEALSGNGGKRGPNPKGSFRGAQLGGETKATRAGHTAFPRNKAKVVPRLKLLCGGARSGAGQDLGGPINQKQ

SEQ ID NO: 975685 - protein, 263 aa, Homo sapiens
ACSQEVEEEAARESDSELVDRRARVRAADAGQRASKISDLPLYRGSREATGPGGAPGQGPGPKDRVSYEGLRRPAEGVRQEQTNHDSKEAADRHTSLSRSRHEGRRRSEPGEPKTLSSYPRNQVCRHVMTRGKLLSWGTRGTIIYHTDTVVKASTAITPDGASHLTSYTRHKQQPYTITTSKEQSRLNKKPDEQQGGRKKLIQQTPASNYGCITPSKTETKERDTTRSTQHTTGTTRDCTHNSRRTVRTRPIVTRRQRTRVHD

SEQ ID NO: 975686 - protein, 176 aa, Homo sapiens
MREILSQEIKGATQDAEFQEEGSLDIMMLDYARVIVRLREWEKECTKMKTLSNNTQARRLMESKELMRLLIHTHEVSIKISLPRMAAKLRILELRQELTDNTWIEAPEKVQAIFDRSVRATKSSSPDMPSPHSCMAKCDTTRVLQQHPYCVTRKAGLDVGNCAYQLEYHGSLKRIC

SEQ ID NO: 975687 - protein, 212 aa, Homo sapiens
VTGCSEKPSLHCSSSASLLAAAPPPAPPPPPRTPAALSPESLNSRFLFNPLHRITGVPHHVRRSRRHQLRNHHQGLKRRRRKLWKRQKHWNETPLLHGNANEDTPGEQDVLNQDGRPKNDGKTVGAGHRRRTDHDTTGRLVRTKDWQMQDEELSQLRAKRAAEDDEDDDVDTKKQKTERHDLAANKRNKFNLPNTKGRRNYSPPFPSQKSKR

SEQ ID NO: 975688 - protein, 106 aa, Homo sapiens
MPGQGFGRHKLSAGQALMWRGATTKDSWPKTKYQTGSPEAEREESRRNGKLQEECSSAKQRVASDRGNPATQRCTETEEKRETQKGDKQTETPTKHIQHKEGNEEH

SEQ ID NO: 975689 - protein, 161 aa, Homo sapiens
MALGFPSQIKKTARGAPGRLSGNKFQRWCVGEGHISGFLLTQGRPKERGLGFSNSPPGGGMDKVRKDRRTEVSKKSAPPREGEEPNTDKQRTKIGLGYNRTNSDKRGQRSERTKPKNCTGHTRDNEGRSKNKTDTTQAQKTEKHKPTGTNRNRRRQTQNQS

SEQ ID NO: 975690 - protein, 107 aa, Homo sapiens
MNNRGRRGNRLHSQYITDTRQGGGNPRKRSHSDTKISKMRGILRGSHARGGSSKHNRGGVLPREETLAEYLKMLAAPKQGGSPITKKKQKAQKKAEETQTARPGRGA

SEQ ID NO: 975691 - protein, 133 aa, Homo sapiens
MRVPKGENPGPYGTKARGVILHTNITKNAPGGGKTGEGVFWKPNSRERGEIHGRGAYNAGYLYSNSGRVPKRERTALRDYLKIFNAPEPPGGGGNLGQTITRRRVHGEKQHKTQSDNNTRTTRIGSTEEARTD

SEQ ID NO: 975692 - protein, 74 aa, Homo sapiens
TGVREKMAVPALSGLSRPACDAAVTSEVRPCAKLVRPPVRYAVIGRSVECHSILYIVRAVNETMNIESLAARSR

SEQ ID NO: 975693 - protein, 136 aa, Homo sapiens
MGGEIPTRQSGAKGTTDANADGADKATHKTGKKQSGPHCHANQTTDPQPHPQWTRPRARLHNTKGADEEASKGEQVTDNTRKRNTGQAETTRNNNENTSQRQENSDQQKEQEAKNKVSKRRDSEKPPRQPRGTRVQ

SEQ ID NO: 975694 - protein, 114 aa, Homo sapiens
MRAKERVRVNPKSWPKEQWGQPQRKRVRDRGRKLINPKRREKTPEREESTTDIVSDFLGTINAPGGKKKRNSDEKPNINCEETIYNKQEKTTQNEKTDPRKTKKLTRPRHTRGE

SEQ ID NO: 975695 - protein, 235 aa, Homo sapiens
MEVFEEEHTNAGLSPSRRVPKGDVPESTNLLPPRWENNKQRKQTSSTQTTSSKQRHEQSDNQPAPATDSTTTRRDKHTQQRDSSTASDNRHSNNNRPTTRHAKLASRQKSQQTRPVTETGRTYTTSTAGRPEEPMPTHRPAESQLQDGDALGTHHMRRIEAPSRHRTDTDAAHTQQPRDREPPDVGAMPALTEPRIHEQQQTEADRSSTPQDDGDWMPQTESDPTTRQAYLNNVC

SEQ ID NO: 975696 - protein, 99 aa, Homo sapiens
SSRINAKGPFTGGVRTSDTDLKWGGESRDEHSNAMYFIEFLMERGGIMLQKFTLCGIKHEPCGCTCLHYEWWRKIVMIDACKGVLVYEQVLEDSGHLGD

SEQ ID NO: 975697 - protein, 410 aa, Homo sapiens
GCGDGASLGPAGACKAFPLYGALKAVALPETFPVLRRPGQSLSLSGALASSRVGGGREDWTTCARLGSPDALRVYHEVHREGDKVGRPTTWTVGPHKEFGPPGATGLQRTRVGDGTDHGPKGQHGEELGKGALQGTHQVGTHWNPSQRNPGTGPQNGTGGVAPFLGPFLAPCGITIPKRPPLEMGKPQPQEEHPGNEETPQELDTPSFTTQPRGGTLLPRFIGELARTWGSNTHMFGPSEHEAMCLGPPAEIPLIGAEGEANLSLGGVKNPTHLNDASTSPLGRETVAPRVTTSGDMHKGLGSASGPNPFHCDLSYPNRPISKPGGLPCVRQWPQGPRLLRPLHRGAKHNFSQIEGGLPLGDPRCHRPITTCIMSSRPPMFRARALLTSRRKLAGPPIVLLERASGCPPD

SEQ ID NO: 975698 - protein, 114 aa, Homo sapiens
QFGGPAGLSLASNECCETGTRSRGLSSSLRTALSGFVPRAVRPPVTSLLWPISCLLGDPAQQPVLLSRLDSVPFGGGGPRPQKKKKAKIRQIWKPPRIRHEVIRTRTVGKCSPV

SEQ ID NO: 975699 - protein, 73 aa, Homo sapiens
TEVAVERVDSVAVATVASKCVRGGKLKGWNLGGQDEIMGSAARLLAVVNRGLVDVRGEKRSRELCRATPYMCI

SEQ ID NO: 975700 - protein, 218 aa, Homo sapiens
MCLLVAYEICLKALRWKLLKYRRDYWGITIRVDTRTSSNLSAHIDIIRNVDRVDSSREWLQLVECSQEQWCGSQRESCEPVVSCNSHHSGGIGLLGARLALTELTIASVLTCLLCKGGRMDYNNLHASNAHNQGFRPSVLRGGWMARGLSASFGGEAHVAPLDGTNRVERTRPSRPCVMDCAKVGSLACLGSLWARPVGSALGWPDRCPCGAPRVTEN

SEQ ID NO: 975701 - protein, 78 aa, Homo sapiens
ISVVAIAQTRLRSYSCASLRIASASDVRQNTGMAEIERMQIQSNLKRHRDARREIHVPSKAMDGTGASEQANRNEGVR

SEQ ID NO: 975702 - protein, 294 aa, Homo sapiens
AGSLRSLQCLLLRRPPKLGDARSRRGPGKDAPIRTLVQRIHQLQAELRQGFPPTEEGHPPVTCARGPEYGFGGANREATVQRGLTPGPFAGPPRRKGGGRVGKKKLGGGALRKGQAGGSPGQRCAALQELEANGGGARVALPAGLIGERQKRGRGPGRHAVTDAQQLNNVRGTLNTLGGRSAEVPPGTMRLDGEICRVMGGPRDCAEEDGTRGGLAAKPKPYNCKLVGVGAPLGLLTFRGVKDTSKIKEVLLGTQTSKHTETHDHSEQQDKVWAAESYNTGRGQKRRSGEHRQR

SEQ ID NO: 975703 - protein, 189 aa, Homo sapiens
CPSWAQLNVDDKIQIINNMLHKGTEMIIAEWNGLTPFLKVLKDMEIGDFSVLMTRGEPLIVKELMSKAEKNGVKMYLPVDLVIADRVDENAKMDKSRCLILVIPGWVDGLGCGPDLSKKYAEAVTRRYVRCVWTWSLWGVFEWEAYVRGTKALMDEVVKATSRGCITIIGGEDTATCCANGTLEDNVSM

SEQ ID NO: 975704 - protein, 170 aa, Homo sapiens
LCTYRPIGVAVIADIVELGCMFTMNGPGLIRFRRYRSERPSTGIEDVHTLELTVEMWQESIQGMLTVTGAMTSILDTRCSISYHDITVGELQVSVLVPQGEKYLPENSILYGDVLLTLSESISAIILKKRSRMDDMCVERQRTCIGHCSDISGCIRDTSRSSDIIWVAFR

SEQ ID NO: 975705 - protein, 146 aa, Homo sapiens
RRIHSLGSTDTGDPMALCITGYLITPAREVTLVQYLRRTRRIQEEDGEEDILEIKLEIIAILVCLCSGDRIVIEASKQDDDAVRNQEGWKKEEKENSKRKSRKKTEIEDVGSDEASNEKKVVTSKKKRKIKEKYIDQEELNKTKPI

SEQ ID NO: 975706 - protein, 95 aa, Homo sapiens
PWCDSVLRGCTLESAQLLSPADCLSYSKCVPHPMEDSMGMDMRPLRALELSCYGGELKWPINRLVICEGGYSDDQVMHRDVSLRTATEQGLVVKG

SEQ ID NO: 975707 - protein, 133 aa, Homo sapiens
ASLTGILPVVAGSHGKRENFYEKETYVLQGCGPLLFYAMAITGVSGNRREHTALLKIEGVQARDETEFYYGQEMRVDVYRAKNRTVTPGGNQGKPESIWGTVTRAHGDSGMVRAKIPKQIFRAKGHVDTRNPE

SEQ ID NO: 975708 - protein, 282 aa, Homo sapiens
PGAWLTPVIPALREAKRREDSLSPGVRDLPGQYSETPFSRKGKQKKNTKDQKKKKKKTKKKIWGARSGPKKVFKNQLLGGRAPQEWLDEHVRQKALCPTKRNLGGAKTQRRWGGFLPNIKKRAAGGHRKAFLRTKITKNGDPEEDTKPGRTINTQGGGGHKGEKPAQSEYNKIIKHPPRARGREYPNNQHNRQAKQTSADERHGARRQRSKQIAEYGGEKQRAQATADRTGRRQREQGKTERAARDDKRRKPPRDEEAERQRRDAQSTEAERQGSSEEKRRR

SEQ ID NO: 975709 - protein, 215 aa, Homo sapiens
MVPVYLHCIYVALDMVFFPGVEHLCEKLSSIIDPYRSSLLTERRENSRHQGCPGMINSPISKCWLEGVRELQRAAGYVPMRRPSSIELLAAPSPQTLNEPGMSVNMKIAKTKKMLGGGLGPRKSVITKHDRIGGGGVDPSMDDVEQPCTLAAWHEEEGIEGKRHIGGFVLCPRIKKHRPGAHQYLGDDTMSEDRVLKEETGAYTEKIKALILIRG

SEQ ID NO: 975710 - protein, 94 aa, Homo sapiens
MSVLGRGGPTGRCYGETWGQKRVVPKGETPGAIDAKGAGGSFPILKESARGGTTGSAFLDTISEDVGFREAHQGLSFTGGSRAAPNFSILPAVG

SEQ ID NO: 975711 - protein, 203 aa, Homo sapiens
VIEQHGVGGVALRTRSSRDILAKPQFRVQLSAGQIRIQDSRVVAPKTSVEESSGSAKAIKKMEGHLCVMLGTSCATQRHFLVVTQVPMWGVGKNKCLYALEKRGIVRYTKEVYVPHPEKHGGCGSGSPGCQGVLVLLQDFGPRGSCQCPEGALQTGSYVFDVLSRPSHRDWSPSVNRTMADYHEVTGRGWRHGPPEEKGLLDG

SEQ ID NO: 975712 - protein, 191 aa, Homo sapiens
MAFSYYASKTLDSDAIPEGTPVNYYLLQREKNNPYLKATEWNWQIDPLGFRSIITRYANDWRMPGLPDRKRHGVIESWDGVNPIEDTYRIDYHRAHINAMKEAMFEDRGRGNRLPRLGVNRHSQLPGDMRKRYGWSMSTRENHDLKDLKRVPKKSYAWLKQVIHTKRNARCKRYRCGRVLWTDVMANYPYV

SEQ ID NO: 975713 - protein, 325 aa, Homo sapiens
MAKYNNQPARCLAHACHSQHTQEADSKRRIACNLGGSTVYTRAKHRTTGTPALGNQRRETPLKHTTHTTPHHTHHTHTIPPGHQAPRAAQTPHYTTQTRTGPHRPPHTPTAAPAAPTPAPPRRHPRPTTQHTLTSQLSPPHNIKTPHSIAHHNLITHYFHHTLLPQLPLSNHLQYQAEHHIHTQSTPNRHAHNNPNTKTPPRPGHTHRPPSHRDHPPPTRNTHTSHTPHPTHHPNTRIYPHHVPFPHSQPITILYHPKTHPPPHSNNRGRKRQGQRKSPAPPHRALTRPPSAHTPPLPPPTTADTPQPPTPHAPTAPPGRPPSPH

SEQ ID NO: 975714 - protein, 212 aa, Homo sapiens
MLDASAEEKPCTISHWFNPTVSADIAARRRALGTVSFELFADTGPNRHAEPLFVLVSTVQRTWIAGYYTGSCFHRISFQGLMCHGMVTFTGHNGTGGKSIYGEKFEDEKLSVAKAYGSWHLVHVLMLECQLANGSQFSICTAQTECVWMAACGVGTVNAMACNIVDDHVALVVQEWQEQQRTDQSFAELLDYLEIKFDCCISLNQAELMPFR

SEQ ID NO: 975715 - protein, 318 aa, Homo sapiens
ERGLKASAPGSCGRVVLRLAAVPAPEGRWLRASRSTGLGQPWRARGPQGAEERRGRSRHARGAADHAGDNMASWIQGSPPGFAFTFRAAGAAASAPGSQKRIWPREGPDEHAGFPEKKLSKGERASVDPRFRAAEGLSKHFRPRAKAPPHLHAGCRANTGRPVTTLLGGLSYGRGRASKPGAAVTWLQRGGHVIPVATTTGDWRATATGGWTRPGGLKLAGPARPRAGGHARGTVPPRQQIEQALTPRRENRGAGISEITGQEPRGRGRGLKPDGTLGKKTTEETAAQESGPNNRKEGQQQGDRSQSPVDTKCATPPL

SEQ ID NO: 975716 - protein, 191 aa, Homo sapiens
MAQEGSGNLSWANIRRRARFPQKQQRKTKTKRTNNRVTDTALPPRKHTITDSTKERQGSGMRTTNRRAKVTKRGGKKRGSTQKGNTTRVTQDKRREREKPPHAREEKTRAPAGGEDNSAGEARRQRKQTKIHKGEGADKHRRGAHKLHNRREATNSTTPTRRNNQTARRADRKQTENKKKNSPPRPREGGG

SEQ ID NO: 975717 - protein, 264 aa, Homo sapiens
MGFSVGPRHSYEESPRSMLLGRDRGHSDKEWTTEPTTCVATGECHWATLSVPGIAMRGRVSVLVDRGNAPPTSLRLCNDFLEAYSPGGIVSRGRVKYGIEYSDIVETQSLRGRKLKQETHSKRHITLECEQHGTTPAKNVNQGTKGRVEWRGRPTYEDKDSKCVHMNVILTQEKPRTGHQKIRREGTHDKLNKNAPRETQVGFRTTPKSGNYQRNYEGPYSTQITGSDRIIHPREYKKATDTDKSRQVTKQGPRNKQQKNKEHS

SEQ ID NO: 975718 - protein, 274 aa, Homo sapiens
GTRAKKVKMATKSCPECDQQVPVACKLMSFVDYEYLVSRKLLTCEIHVSENVTTFYRETRKRKLTSMLTCLMKRLSCCQSPGQKINRENYQSKTYSLILVCKIWLKLLVRITSANSQDMLWTLRSISDCINKGHRSFLSRLSVDACATLREQSCVGLDWSVGFPCLPKEYGQCLVVGIYVSVFCQQQKKNQQKNADGCSRITHVIAGMGYSMTTKGTNDACMLPGWHQKMHFVTSCRNSVLSTLSFRMQAPDAYSALPINGTIYAGPPSRIAPH

SEQ ID NO: 975719 - protein, 104 aa, Homo sapiens
MSAAWPVRKPYYWSVLVRLGSVILRQPCADKTRYGVSIREISISRETAEDRDAREKSHCLPTETIDQEKQAGESVGEACAVTYALYIPQALPSYVYFFKLCYLL

SEQ ID NO: 975720 - protein, 218 aa, Homo sapiens
STGINAELPLRPGWESEGCLLPRPLLHVPGIPGRQAQAGPPGPQGYCGGNTLELQAKETATFDRTVPKSPGTKRKKKTIKERAEKHIQATGHNGHQEHTRRRETKHNNRNTENRDKEKDRHRTGPDDRNQREETHHSREKKREVMTQKKQQMERKGAAEDAGTTHTDQRQSTGSTHDRKATTSAGDRTKKTKTTRRRPKDNRKGRRRENETPTHKNTT

SEQ ID NO: 975721 - protein, 157 aa, Homo sapiens
MLNNRSGKLGVPEWVDTVKLVKHKELAPYDENCSTGELFHSADLYLRVRWSWLHDQRSMGDVRETGHCQAISAEAPKSVGLPVLQGPEGAGHMGGKRTKMGPKIETSGPRDLDQNRRTGGSCQQEALEQTMVGFNKFASFGQKRNQKQKNFVGGLRH

SEQ ID NO: 975722 - protein, 202 aa, Homo sapiens
MCWGRGAGFLKFVNLRLISHQPWGLPKRGRGTKCVLSPTWFRDLALTVFCEDKTYAVSKPGFQTALSRRESTGPHTPVKSQSRGGGREAIFAGPKIGNTTNDPQKHIGGRLGGREQKHAETCVRRVFSDPKRVPGHSERATRGILLSKKTRVCSHCYSREGGRDRVGANPTAFGETPPRGVGGPNSGGQTEEEAGRAHSRQT

SEQ ID NO: 975723 - protein, 206 aa, Homo sapiens
MVRGTPPVELLIGDKPKYPVGYTTATVTTAQATVHQNLGDAHTIFLLGRTPISGTQHYGGAAITSERHSPKVTNTGFVLCNYEVYCDTAVLIFIGGIYSSGTLTTKSKRRTHSSFRPHVFSKLNETLETFTKRDPNTTTPIPLTRHLYPGGMQDHRSNKNYSPRRKQFFYQMYEHINHVVTPPEYPPGNNSALHSNTRGLHHRCAP

SEQ ID NO: 975724 - protein, 175 aa, Homo sapiens
MLKPTIKHPQHNGHEKKHELGTTTDPQQHCKYKHPTAKCEREEHTQCYTDTPSTNRSKYTAKQLPDRSTQDDSQHSPTHKKTQRRQTTDNSAKKHTKNGEHCNKQIKDTNTRRDQGTHEMKITPQPGDNNTDRHYTDHNNAGRHTQRPRCHNDQHTPTTTQTHKRRHEGNTTYRA

SEQ ID NO: 975725 - protein, 328 aa, Homo sapiens
MLVSLNFILLITFVETRSLYVAWLRLKPPELRLIIYTYSLPKCCALHRHEPMQPGLRHYITSGQISCEHGVSLLSLSAWMSQLVPIFGYTGDLPALPQVSIAISTLPQPSRSTLGTYRCFPNQPLPWPKLYIWVTLSTYERRGYPPAVKAKEWALRIYIEPALNPIPAPPVFPRSRPGEFTTLFETTNGPRPCKFNFSTTVLAMDNAFNMENSQPYGPSNLRQRCTNLPWSGAPGQRSHSHVSTKNQERTTHTTDHHNQLFTAAPHAPPTKTLSERSTFVGRRHTHYTRHHTDSALLRKDLRVQSKSSGASPHQHSAGSHTLFITTHC

SEQ ID NO: 975726 - protein, 48 aa, Homo sapiens
MARDKHALLYYAPQAEKQTQCTGPAKGNLGNKRKGPRRHAKSTALVIS

SEQ ID NO: 975727 - protein, 99 aa, Homo sapiens
MQRRDPNHNKDTYAAPNTIFTTLTCTTYRYTNTYSIAQRRHVQLDTTHKYNRRIEPDHPYTTTTGPHMRTPPQQSSYHKSANIATIETSTKRDITQPGY

SEQ ID NO: 975728 - protein, 411 aa, Homo sapiens
MDPNCSRAIGGLLARETGSCKLQRVQMHLSCKKSCCTCCPVALCQVVPRHASAKGCIRENVQADVACMCGTRLSLPRLYHYEPIRATNLGILFTTYYTHLTTNLWLAIILSDTPINIYAALDPIKTNQLFRRKKYTHTPTTTHNNTLTIHSHRHTYRCPSERTRYIYTRTPNFSNSDAQHVKHPPVSAHHSEDTSNGATKGVFPQYSERPLAVAHNCKRERENIFHDRNNKKARPEGEPTRTGSRHQQPTKNEEENEDQQTRRNHNTKERTEGEGGAIESSARTMQRTYEKQKQRTKTDGAKTDRKGLAAVVAKVGADGGEGGSEGERSGAIEQTSETKQEQVRREGWEKDTRPAWSSTVVRDGTAGDASGVWRIDTENQNEESDLTRKGPGLSGTARTDRGGTSKTEQIG

SEQ ID NO: 975729 - protein, 212 aa, Homo sapiens
MRRHKYDGCRRRYRTWLHVDDRSKIALGEHAFHEFEIVSIGSIDGERSGSSREIPIHQLEAKESGAAYEEAQSLRSEVIIVSVKPGSEVVSSLIIYQIEEELAHHVKVMDYWPSLVKFWHLVALFSQPVHLFARWAIILQSTLSLYRYKRSPDGIALFEISDLRTERMNLNHVRVAWIRGACQGRLLDRVMISMTQSGGNSWLTDWCLYWDV

SEQ ID NO: 975730 - protein, 167 aa, Homo sapiens
MHFDTTKGLEGGTHGFYDGISQLAQNRTEMNEAPINQDHAPDPGSRPQRILMALRPRRSKDLDTNAEPGKISQDRKQGHSQKETKAHIGAGTNQTDISYSICEHVCKAALKEQEDVKLEGQFIMLHYSLGPFPQSSHKNNPSYGINGQRDDSPCNENTDRLTDTHNR

SEQ ID NO: 975731 - protein, 471 aa, Homo sapiens
RWLTPVIPALREAKRREDSLSPGVRDLPVANIARTRTPETRNQKKTKMTKKKKKKKQTHHTISRRTILRPTSEQTAPAQQPLYQSDRHTTEGPHENRASTCTPHTCAHSTRCTPQRANPGDTQHHRVAGDTTTHGTSYNNTRAPWVGTHTKTATYTENNQHTKRRRHTTERHQPTEGAHLTQNQRNTTQPQTPHRTHNTIESDPRHTRREYTQHKQKQKKTQKTIATNQHEHDNKRQKDKSTQRTKDAKTTPAKTRKRKHKSIKNKKKKQRRQSERSKRSGASEKKKDKADTARKIRTTDQPENKNETRRELKRLKYATRGSREISADAETENIAAGNTDVEDRCTTEKEARERGMIGGRRAAERRVRRVEQQKERSRATQAGTRGRDGKEAIGRERRSTKERVTRKSERQEESSNLDNKNEEHDQAEQKKCERTGGVVPMSSHTDEADRARDSEKARPSERAKEERRYEQ

SEQ ID NO: 975732 - protein, 251 aa, Homo sapiens
MSRHALDITGDIISIAEDECPQGYTFEDISSKLEDLLRKGPRKGDQEASTQQVQTLKPPPEGYRDESPVGAVFITLGPRKGLLNASFQYRALIGANKHDPVKIQRTRDPFKYQGPGGLPSAERCTNEGSQDLMLEIAQIDTLDAQEATQERAKNGLIDPKGEIAPLGFQRRGVSAGGKSNYLEASLVRVPMKDQLQYWRANPDYSVCSSTACNDLCRICAASTDENSSICGVVTEKSEHNIGAPVTRVDPV

SEQ ID NO: 975733 - protein, 259 aa, Homo sapiens
EPRHGAPCAEDPSLERHFKGHEMQLPVWTSVINTKQLASGSMDSCLMVWHMKPQSRATGSLATKDARHLCGTFLSFGNTCFGSGSRDKTCPHLGYPNVKQVSPLCFVPHTCHSEDVSHYLQVDGQFLSLTASDDKTAKRCGQLNRKKFLFLPEPSIFNLLSACANVLPTTGGASSSVWPVDLNNEVVSSLGGDKLSMRGHCVHSVFGELAGFGPPNGGISNPSGDVALAVPAWTTTSGRLGLRGITGVCHYPLPVTVKG

SEQ ID NO: 975734 - protein, 72 aa, Homo sapiens
VRAQREDDRETLCPANAGHTLFTQELVSADTKEERDLGMQKLNQVLVDIRLWKSCCLYKPMESLKLEIPSAI

SEQ ID NO: 975735 - protein, 85 aa, Homo sapiens
VLFRPFPRLLLVVLVRARAQRASSPMPRQTLRQHQGLPAHSPTKGCQICQESRKNRDNVKYKQSDASRYLYTLGHHLTKREGTRN

SEQ ID NO: 975736 - protein, 188 aa, Homo sapiens
MRPDVNRTSANSPVEQIQEAQVIEMVLSHCRIACEQSSDLPVLDAGEEHLGPAGKGKAPWGMLGERQGVVTKCRQDVLAQEKGPPVGIRMGTEIGRAFDLAARGKYWPSQGQREFTPGLAHHFLSIGKWISGEMAGPKTKFLAFTFPTPEGLPHGVLNPLLGKHPASSANTRRGRTTFWPRISSIIQE

SEQ ID NO: 975737 - protein, 265 aa, Homo sapiens
MVHERLEKLAGSYASHERRTLFGYLKGVNGNWHSSYNPPFCYIITLGNGIPPPVNTLKTFVGLARIVNQTTRNNQISVYNKHTIFPTPDVADPPKTPYFMTNTKRTRSPPQSPTTTHTRAHAGSKESGATKKNTTGHNRPYTGRRLPPRKKKTPPDKTASEHEQKSDEERTARTPRAQYNTGRPGDALIQIPPPRGGPRGTPQPNTRTQRQHPTVATSEERGREGRGGRGRQGGGQGRGRADGSASTRRGRGEGEQQAESGVKDR

SEQ ID NO: 975738 - protein, 184 aa, Homo sapiens
MAENPVFSQKHGKQQQKPKRHHNIQNTDNHTHHHTTHNSLFLAARPLADPPSGQKKRCLSIKRTHHPSSGDNVTAATASAPHNGGINRRLEHTIAAAPPPDHPPPVSPHTKEEHTNPRGAHTGAPPPPPRTPPGSKPHTPPKTPRNQKLTKKQTAPPPRAARKTPAQRRASPPPSAHPPHTHPP

SEQ ID NO: 975739 - protein, 140 aa, Homo sapiens
MYEWRTHLEEDGRREGKKSAQKNSCVKRDKALCKVAGTREDVTHKEDTPEDGAATQKVRENSHATTTTARRSNVSPTVEYNHTKARESRGSTEREDSNKKIVGPREDTVLHQRRTSGSTNNSGGERRPRGGKESTENTGA

SEQ ID NO: 975740 - protein, 35 aa, Homo sapiens
MFEKGAVGQGPRVVFSGPDVGTSTWCYPVACWWPF

SEQ ID NO: 975741 - protein, 236 aa, Homo sapiens
NFTSFSCVTWYDAKRLDQVEMTVLPLSHQRTTDNEGLRMPCPSVYLSGWQGRKELACVNGTNVGCEEVAVGTTVDNLEVKTSLAQGVLQAVMQFNQSAIFFFVPKIDLIYWGNAPTFFSIMPHFTKQKQTQQQTFVGGGTRRPRKKLFLETPLPVGPPAHPVRVEWTMGPKERVPETNSRRRGTEVAGVSSRKEKRRAGGTPQGVLGTKSPKGDAKPKRALYPRAPASRLITARAD

SEQ ID NO: 975742 - protein, 121 aa, Homo sapiens
MSEGAPCPLCVGTSGDIDGVHSGGENCGCSQLVRAEKGDGLKDQELEPSGSPGAWPPRATMGAYGETSGKLNILGRNKFPWDGTPGSSGGYTKKKYLGLHSRLLCYLVWIYPLLPCTYHGL

SEQ ID NO: 975743 - protein, 269 aa, Homo sapiens
NSVLATVQTRLRSYSCASVRLDLRNLSDKTRYGVRIGEIRSKVNTDEDTRRATRIVVLAAFPTMTHRCEQGTKRNAGATSVIDVLRRQSMALLTFPQSHLAPVLSLSPLPVLTAWFKTIYCYRALATEPEVVCTPSKFCHTNCTFVRLCPLICPNKFNRQHLPGNKREQVAQGGTVGPFVPPNLGFPSVRNRGRFGATRQHRDHSETFWPIMFRVVDATPPRGRFLGKPNRWGVGRTDAGLKLSSRKLGIRQALGPNGLSLARAWSTAG

SEQ ID NO: 975744 - protein, 151 aa, Homo sapiens
MPPHESCGLLSIPSPHITVWASHVDVAQHKPCTRDDGSRLCKDLFAFLFHEKIRTQMTGGDLKLWFQNPIQANKSSESLQWSTRLLEFQHTDILPLRGHEGNEAQVLRKNLKFPNSNWCLMVYYRRKVLAFEFQKKGCPKISVATEETECV

SEQ ID NO: 975745 - protein, 159 aa, Homo sapiens
MLSKRRGYNGNLAEKPRSQSGKLGYKPPVCCFPATSLFGAGTFFVHDRAATQIFTTPHNEFPEKLSRVTRVLTLPLNTRCARGFGEGPSRGPQRVYYMLQAPHLSLYGLAQDKNYHFSCRTFLAHIELAPLKRQLVNIIALGATSSSRAVTPGGVQVIR

SEQ ID NO: 975746 - protein, 291 aa, Homo sapiens
MEAGAAGGPRRVLALLCVAVRAARRGRSNTNATASDSFPRDGADAARVGLPDTRWTKYSGEHLGRRAWGYPGDHACGVARVCCADGRRACLGQPQGEALAPRTESRRAARQDNPEDVRLLGGPCCGRGAHCLKGAGKGGLGKRCRGTSPRGPRPTEGGRVGDIRKAARGEDHKKVALGPGSGVHCRGDVVLPPKGQFRAVVTTLFIMEAPVLVGQTGAQRDLWDIINKEAAPGSRENNLIRAGTTILRRRRPDQRGTPGTGESITHHRRGATPHATMRTARRGQAAHPSTV

SEQ ID NO: 975747 - protein, 344 aa, Homo sapiens
EPWPVSSRVLLVGRGVFEVAVTNTSGGIIRYHCEIDTRFAAVEVVSEVLTRDDSTGARMRRGLSVVVSLIVYLLYGRLLRSLGEGLIGNVHDTSAGVGLLGPRAVPSVALWWALLLEPPVSVGEYAKFRGYLEDTQESAYGGAHQEIGAGWCTNSQKARGGPGFRHAGRRRRTTARPRTSLAADGPPVVTKEHGYIYGVGRQMRGGAPTSQTRGRAAPWEAARRMTDDETRGRVRFTNRRGRATGQRRQKNAPSRRRPAPKRRRKGHDGSRVGLGPGNWWNPRLGSSSAHGKVPLWAHSTDRRLERGHPLGPGGSPEPQSPGGGDPQGRFLERDPLTAGGYSNK

SEQ ID NO: 975748 - protein, 43 aa, Homo sapiens
METCLSRVLSGSKNGEGYTCGGSAFISRGEDGRWEETCCVSLV

SEQ ID NO: 975749 - protein, 117 aa, Homo sapiens
MTTRVELLREKLPRPLIRLPLGYHQDPPSSDRRTTDGLGVAPHSVAAAESVSPFRFIFTFHVGLGPKTPMFGEAKTYPRLGPPGRNLRPGGPGGAQDPVPRGVANTHMTVGHTPTTE

SEQ ID NO: 975750 - protein, 297 aa, Homo sapiens
LGTSILSHFHLASHAWSPCTSGGHRVLCIPCLVPCAAPSGARTLSLRAHEGAQSRSPGPLVPFHRGLPRRLHLEVSRPLSRCSAISPSHSLPLFRETGSLPASSPPRGLGGLHAGSGLCGIQCKPFGLPWVHKRRSLRCPTGPSGDQPWGIWQGHPGQTPSGLAQFPPVISKGQKHGAIHTPRSAHAPSLLSNSLEPQGGGIPNLCHQAKWLANYHGASAAHNAQGPKIDRSKTGTAFLAGIVKLPRPASRAGPNVTHTRALDTIPPRANISFVAPRDTPIGTRWLHHSGDERGLSH

SEQ ID NO: 975751 - protein, 66 aa, Homo sapiens
QPARSLSARVQSPVAKRPRRLARVSRDHTKNAISNEQAMETMMFTISQIVGDKGYLTKREDLRVLY

SEQ ID NO: 975752 - protein, 129 aa, Homo sapiens
TVCQNLEIIRNGYSESMLNYWKMVKEGTRVVSSLDGVVTHGVWTFNQSLRWEISSFNTMFGKTFDAPPALPKATRKAWELSTELQKSRVKDQGTPQTRISQAFLAKKMTEKTVTAKGLCSVPQMMPIQK

SEQ ID NO: 975753 - protein, 69 aa, Homo sapiens
NGKWRLTARVVLRPWCPGVPPVPRSGREKGSGATRDMHPMSRERAKFCQKWPFMVKRDTRANVCMPVAA

SEQ ID NO: 975754 - protein, 236 aa, Homo sapiens
MNLCSREMLMAMVKDEYYGYPHGEKEYWHAAGDDLYRPCGDCPGKELWFGGSIAYVDSEVRWIVCAGMGLRRHCNGRSILLRGLDQDMAKQNGVTTMEEHASSSIHDSSYHLNRDPTWKQGHPGRLRVVSSVPADSDGNSSDRQTNNTTHTTTNTHPAVRRPPPPSPDHPPPQPPLRPAAARGPQHRSRSTGAPIDAPRNTLRPKQTRARHPPHIKKPPGRNRGSAPPPKAHEPHG

SEQ ID NO: 975755 - protein, 294 aa, Homo sapiens
MDPQCSLLACGSCALCLVLQNLKECKLHTSVQGRVVVLGGHFVGMVANGVAQGVHLAKRGRVRNKGEGCCDWSGQGPRWCNQNVKLGRKVLIQPVDSWRTECHIQVVQPPYEPRMRQNSDCAPQLQHSVADTGAKHLPADNTSKHTTNTTTPRATADLHIVRRHTRAHPQTNSRPSHTHTSSVGAPSKPATQKDKKTKAAAHPAAYAYTGNRNVETTSSEREGPSVNGEKTAGARGNDQRARQEQKRSEVRSMKKKLCSRAKMRNRARRQQQRRRRGENNKDETRRQASPHHRR

SEQ ID NO: 975756 - protein, 68 aa, Homo sapiens
GHISSGYSVSGGGFKFFRGVKGSVDISGLGSSSGKYTNSSENMSRRMTPREPNLLIFPPGTGPLITKG

SEQ ID NO: 975757 - protein, 212 aa, Homo sapiens
LLRFSLGSPVSPRLQWTPMLLRRGVSCTCAGSCNCKECKCTFLQEELCSCCPVVGNASVPQGCVLQKGAQQKVQLLELMPKDKTFSPRLYTRETYVQNPGFFLYTNLVTPFGYISFSLVNYCDVTLFNSTFRTFKKQTTSMKLTQKNNIVCGGIHRALLENKTFFHNAPNYFVFSSRRRGPPASKGIAVAKTVGRPMTRLVPQKRNDLVWSR

SEQ ID NO: 975758 - protein, 110 aa, Homo sapiens
MWRNKGLVPQKEEHPLWGNKKKQDVWQREIHPPQNIKRRRREGENNQRWFVSETQPPTELESALEGEDKKGTEGNITIQKRRGEAHQRRKAPIIIDQEDMHAPRWRRVEQ

SEQ ID NO: 975759 - protein, 135 aa, Homo sapiens
MTMCVQNPISFVHREVGGSRAGSEYKISLTEYGHLPCLLELQELRQGSGGNAVVNSQTRSRSGESVREWIGRRGRQRSVSELRICVLLSRHWVSEANTSVLKSLNEITAKEKVSLRPSTSEFVSQSVAALLEKVV

SEQ ID NO: 975760 - protein, 232 aa, Homo sapiens
MAFETMPKTRIRGDSCGGPGGAKGVPKLRTWGESSKDGFLRHGPGSPFPRFPRIDGQGILRRGPRWHFGFPRGSPGWVPSRGNRFVHGHQGAARGRIVGIRYKGALARLGFASGTLVGAQAYIGRGVFGPRVASGGLALVGRQGASQLRAGRLAGDSPERLVDVCPWTRTFTVHCVASGCQTLPAQLRAAAAQYGALVGALRSTGWFAGRHQRLFGGRSLPDREAEHCEGAA

SEQ ID NO: 975761 - protein, 289 aa, Homo sapiens
AQNWGRSQLSGTAQFLQNVYVTKSCASSAVRVITLTPKCIWVCQSLYKLVIAERDCFDPWKQPSRPKCVHEVTMCQPFGPTAALHQRRGIWALRLPREAAKKENCASDMKSALSATLTDGDLGLCDRHLLRYDASELKASMKGAGPERDSLIEIICSRTNRSCRTYTESTRDLYTRLDRATDIHSGTPFLVDFPEAAWWARQRVEQHASDRAVTYEVTKQPGDFMTAGEETGTVATGQHRPPRASTLKSLWQTIPPINGAVEGDATTAPTGVTPDGARHERRALLRKAP

SEQ ID NO: 975762 - protein, 123 aa, Homo sapiens
ERASAGDVPAAMCENLPQGYCVHVPVAWGLPEGRAAGRPKVVSRVFPGYSMPGEERCLTGRFGRHRVPGSTRERPGVLPLGRDTEHPSGFRYRASSWKEWYMVAMTHLSDSKRVPIIKGQWVS

SEQ ID NO: 975763 - protein, 125 aa, Homo sapiens
MVYTRSVDTMKLKLTKRRWQYMDSGSQSWGSQHYGASTALARAQHSARTNQACKSGPQHHQLSCKHSGPVPTTLSNRTGPVPKFGNVTHISQHQHKARLRSGAPFHLRHWAYPLGLFGTYWSKTS

SEQ ID NO: 975764 - protein, 190 aa, Homo sapiens
EQERHVGGDKILQSKYHYKEEVKSSVIKFKLNSAGKCFHPYNTCITDYKDFTGEEALQETKGGAANRKWVKNVISFEFYTFTAYDIAEDVKAMLLNSKGGRLPSINEWGQTDPEAEDGGWCLVSPILDAVVVGGEQREEKTSTVHINNLCNLLGVQLGDCVMVGCHIRHRHPGGLNARMDTQQSDHLNLH

SEQ ID NO: 975765 - protein, 96 aa, Homo sapiens
SPSKMAEEPQSVWQLPTSMAAGGEGLTDVSPEKPPGAPSSAAVSPGTEEPVRHQEKNSIYVNQSLGSSPDQEVELSMSVGSDGKAVLHYCKSQAWG

SEQ ID NO: 975766 - protein, 79 aa, Homo sapiens
LEALKDSTEVEMVDENTEKKDRTRKMANSRPSSTQVATNRFLNDGCVQSVSPGQALCSPYSQGDDLLKALGWSWDRNMQ

SEQ ID NO: 975767 - protein, 70 aa, Homo sapiens
VRARVLYRRVAPPQESRATMVEYHRHGEVGQMLRKPTIFVKECVDGVSGGEDYNQNNINQWMCMLQWNNP

SEQ ID NO: 975768 - protein, 131 aa, Homo sapiens
AAGRGVESGVKEGGRSRKSGTGVAAGNPCAVRRGRGPDSDPRGGWPMAGDQRPGRQIEQAGSLRSSIKEKRSQGPWAAKGQKKICARRRATVQEGCTRQSNRCWGSTIPLGHFYDLKRACQSFGIRDRIHN

SEQ ID NO: 975769 - protein, 130 aa, Homo sapiens
MAYIKVLQRFGIVMTKPWVRKGYVSELEVDETCSGKQILVGMVKKTMKEVCEMMTATRENLWRMCRLLWTKLFDWPLLWWTGTVERLSLARRKVACLQLEIICQVFRYLANVLNWFERMIRYIAVGYGEV

SEQ ID NO: 975770 - protein, 170 aa, Homo sapiens
MATDPSLKGSFKGDATDRVRNLLKNKISDAFKLFDFRQIPNRQIHYEGLTNWLRSGADSGLDEEQLAFFPLTLEGPRFHNARVHFPATYTVNPKNGPIYNGRHSLQRISVSAECTTRLHICTAEGWSNDVGTQDIVGTQFTPNVNRENLDQRIFGNAVAPWLYNAPNDTG

SEQ ID NO: 975771 - protein, 80 aa, Homo sapiens
SWQGFYNIGIVEQTCWSWWVGSPFKKNHRAPTQEQYNSLDFVSPICILKHTMAYQTYTILYYIISPLNSRTWLPYLLHNN

SEQ ID NO: 975772 - protein, 30 aa, Homo sapiens
MVVRSYRRTTIYPSKETSRCKAHPTRTCAP
